United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 43

SEQ ID NO: 1536020 - RNA, 13 nt, Pseudomonas aeruginosa PA01
ucaggcucgagcc

SEQ ID NO: 1536021 - RNA, 14 nt, Pseudomonas aeruginosa PA01
ucaggcucggccug

SEQ ID NO: 1536022 - RNA, 18 nt, Pseudomonas aeruginosa PA01
ucagggcgagcagggcac

SEQ ID NO: 1536023 - RNA, 16 nt, Pseudomonas aeruginosa PA01
ucagggccucgccacg

SEQ ID NO: 1536024 - RNA, 12 nt, Pseudomonas aeruginosa PA01
ucagggccgcgc

SEQ ID NO: 1536025 - RNA, 23 nt, Pseudomonas aeruginosa PA01
ucagggccgcgccgagccggcug

SEQ ID NO: 1536026 - RNA, 13 nt, Pseudomonas aeruginosa PA01
ucagggcaccgcc

SEQ ID NO: 1536027 - RNA, 23 nt, Pseudomonas aeruginosa PA01
ucaggugcguacuuggcccggcg

SEQ ID NO: 1536028 - RNA, 20 nt, Pseudomonas aeruginosa PA01
ucaggucgcgcgccuucagc

SEQ ID NO: 1536029 - RNA, 18 nt, Pseudomonas aeruginosa PA01
ucaggucggcgcgcaccu

SEQ ID NO: 1536030 - RNA, 16 nt, Pseudomonas aeruginosa PA01
ucagguccuuguuccu

SEQ ID NO: 1536031 - RNA, 23 nt, Pseudomonas aeruginosa PA01
ucagguccaccagccaguagucu

SEQ ID NO: 1536032 - RNA, 15 nt, Pseudomonas aeruginosa PA01
ucaggucgaggccgc

SEQ ID NO: 1536033 - RNA, 17 nt, Pseudomonas aeruginosa PA01
ucaggucgaggccgcgg

SEQ ID NO: 1536034 - RNA, 19 nt, Pseudomonas aeruginosa PA01
ucaggguggcgaucacguc

SEQ ID NO: 1536035 - RNA, 22 nt, Pseudomonas aeruginosa PA01
ucagggguugcaauagaaaaga

SEQ ID NO: 1536036 - RNA, 17 nt, Pseudomonas aeruginosa PA01
ucagguauucgccggcc

SEQ ID NO: 1536037 - RNA, 19 nt, Pseudomonas aeruginosa PA01
ucagguagguggaggccgu

SEQ ID NO: 1536038 - RNA, 22 nt, Pseudomonas aeruginosa PA01
ucagguaggcgcgggcguagcc

SEQ ID NO: 1536039 - RNA, 19 nt, Pseudomonas aeruginosa PA01
ucaggcagcgcgcggccag

SEQ ID NO: 1536040 - RNA, 19 nt, Pseudomonas aeruginosa PA01
ucaggaucggcgcccagca

SEQ ID NO: 1536041 - RNA, 14 nt, Pseudomonas aeruginosa PA01
ucaggaucagguug

SEQ ID NO: 1536042 - RNA, 22 nt, Pseudomonas aeruginosa PA01
ucaggagggaacgucuggccag

SEQ ID NO: 1536043 - RNA, 19 nt, Pseudomonas aeruginosa PA01
ucaggcgcugcgcggccug

SEQ ID NO: 1536044 - RNA, 15 nt, Pseudomonas aeruginosa PA01
ucaggcgcuugucca

SEQ ID NO: 1536045 - RNA, 16 nt, Pseudomonas aeruginosa PA01
ucaggcgucccgcucc

SEQ ID NO: 1536046 - RNA, 20 nt, Pseudomonas aeruginosa PA01
ucaggcgucccgcuccagcc

SEQ ID NO: 1536047 - RNA, 17 nt, Pseudomonas aeruginosa PA01
ucaggcgggcuccgccg

SEQ ID NO: 1536048 - RNA, 17 nt, Pseudomonas aeruginosa PA01
ucaggcgcaugcccagg

SEQ ID NO: 1536049 - RNA, 21 nt, Pseudomonas aeruginosa PA01
ucaggcgccaggacucgccau

SEQ ID NO: 1536050 - RNA, 15 nt, Pseudomonas aeruginosa PA01
ucaggcgcuccgggc

SEQ ID NO: 1536051 - RNA, 14 nt, Pseudomonas aeruginosa PA01
ucaggcgcggauac

SEQ ID NO: 1536052 - RNA, 17 nt, Pseudomonas aeruginosa PA01
ucaggccuugcgcggcg

SEQ ID NO: 1536053 - RNA, 17 nt, Pseudomonas aeruginosa PA01
ucaggcgaaccuggaga

SEQ ID NO: 1536054 - RNA, 22 nt, Pseudomonas aeruginosa PA01
ucaggccuggcccuggcgcagg

SEQ ID NO: 1536055 - RNA, 17 nt, Pseudomonas aeruginosa PA01
ucaggccuggcgcaaca

SEQ ID NO: 1536056 - RNA, 17 nt, Pseudomonas aeruginosa PA01
ucaggccgggcaccccg

SEQ ID NO: 1536057 - RNA, 17 nt, Pseudomonas aeruginosa PA01
ucaggccgagcagcgcc

SEQ ID NO: 1536058 - RNA, 16 nt, Pseudomonas aeruginosa PA01
ucaggccgaagcuguc

SEQ ID NO: 1536059 - RNA, 12 nt, Pseudomonas aeruginosa PA01
ucaggccgaggg

SEQ ID NO: 1536060 - RNA, 15 nt, Pseudomonas aeruginosa PA01
ucaggccgagggcug

SEQ ID NO: 1536061 - RNA, 12 nt, Pseudomonas aeruginosa PA01
ucaggccgaggu

SEQ ID NO: 1536062 - RNA, 18 nt, Pseudomonas aeruginosa PA01
ucaggccgaucaccacca

SEQ ID NO: 1536063 - RNA, 20 nt, Pseudomonas aeruginosa PA01
ucaggccgaucaccaccagc

SEQ ID NO: 1536064 - RNA, 17 nt, Pseudomonas aeruginosa PA01
ucaggccgaggaugcuc

SEQ ID NO: 1536065 - RNA, 16 nt, Pseudomonas aeruginosa PA01
ucaggccaagcaugaa

SEQ ID NO: 1536066 - RNA, 23 nt, Pseudomonas aeruginosa PA01
ucagcgcgaaggccacgccgacg

SEQ ID NO: 1536067 - RNA, 18 nt, Pseudomonas aeruginosa PA01
ucagcggccgagcaggcg

SEQ ID NO: 1536068 - RNA, 16 nt, Pseudomonas aeruginosa PA01
ucagcggcccagcgcc

SEQ ID NO: 1536069 - RNA, 21 nt, Pseudomonas aeruginosa PA01
ucagcggcccgagcaggcugc

SEQ ID NO: 1536070 - RNA, 22 nt, Pseudomonas aeruginosa PA01
ucagcggcguaugcgccuccag

SEQ ID NO: 1536071 - RNA, 18 nt, Pseudomonas aeruginosa PA01
ucagcggcggucccauca

SEQ ID NO: 1536072 - RNA, 18 nt, Pseudomonas aeruginosa PA01
ucagcgggucgagccagg

SEQ ID NO: 1536073 - RNA, 19 nt, Pseudomonas aeruginosa PA01
ucagcgggucgagccaggc

SEQ ID NO: 1536074 - RNA, 23 nt, Pseudomonas aeruginosa PA01
ucagcggguuggcuuccagccag

SEQ ID NO: 1536075 - RNA, 16 nt, Pseudomonas aeruginosa PA01
ucagcgccagcaggcg

SEQ ID NO: 1536076 - RNA, 19 nt, Pseudomonas aeruginosa PA01
ucagcgccagcaacccgcc

SEQ ID NO: 1536077 - RNA, 16 nt, Pseudomonas aeruginosa PA01
ucagcgccgcucggcg

SEQ ID NO: 1536078 - RNA, 21 nt, Pseudomonas aeruginosa PA01
ucagcgccgcuucuucccgcc

SEQ ID NO: 1536079 - RNA, 15 nt, Pseudomonas aeruginosa PA01
ucagcgccggccagg

SEQ ID NO: 1536080 - RNA, 13 nt, Pseudomonas aeruginosa PA01
ucagcgcccggca

SEQ ID NO: 1536081 - RNA, 12 nt, Pseudomonas aeruginosa PA01
ucagcgcggcca

SEQ ID NO: 1536082 - RNA, 19 nt, Pseudomonas aeruginosa PA01
ucagcgcgcguagcgugcc

SEQ ID NO: 1536083 - RNA, 23 nt, Pseudomonas aeruginosa PA01
ucaggaccuuccgccagcaggcg

SEQ ID NO: 1536084 - RNA, 18 nt, Pseudomonas aeruginosa PA01
ucaggaagguccaggccc

SEQ ID NO: 1536085 - RNA, 17 nt, Pseudomonas aeruginosa PA01
ucaggaacgaagaaccc

SEQ ID NO: 1536086 - RNA, 17 nt, Pseudomonas aeruginosa PA01
ucaggaacgcgccacgg

SEQ ID NO: 1536087 - RNA, 22 nt, Pseudomonas aeruginosa PA01
ucaggaagaagccucgcgacug

SEQ ID NO: 1536088 - RNA, 16 nt, Pseudomonas aeruginosa PA01
ucagcuucgccgcccu

SEQ ID NO: 1536089 - RNA, 13 nt, Pseudomonas aeruginosa PA01
ucagcuucuacuu

SEQ ID NO: 1536090 - RNA, 14 nt, Pseudomonas aeruginosa PA01
ucagcuuggccuug

SEQ ID NO: 1536091 - RNA, 20 nt, Pseudomonas aeruginosa PA01
ucagcucggcaucgucgaag

SEQ ID NO: 1536092 - RNA, 15 nt, Pseudomonas aeruginosa PA01
ucagcuccgagccac

SEQ ID NO: 1536093 - RNA, 13 nt, Pseudomonas aeruginosa PA01
ucagcuccaggcc

SEQ ID NO: 1536094 - RNA, 15 nt, Pseudomonas aeruginosa PA01
ucagcucccaggcgu

SEQ ID NO: 1536095 - RNA, 19 nt, Pseudomonas aeruginosa PA01
ucagcugagucgcuucacu

SEQ ID NO: 1536096 - RNA, 14 nt, Pseudomonas aeruginosa PA01
ucagcucuuccagg

SEQ ID NO: 1536097 - RNA, 13 nt, Pseudomonas aeruginosa PA01
ucagcucugucuc

SEQ ID NO: 1536098 - RNA, 17 nt, Pseudomonas aeruginosa PA01
ucagguucggcagcgcc

SEQ ID NO: 1536099 - RNA, 12 nt, Pseudomonas aeruginosa PA01
ucaguacucugg

SEQ ID NO: 1536100 - RNA, 21 nt, Pseudomonas aeruginosa PA01
ucagucccuugaucagcgcgc

SEQ ID NO: 1536101 - RNA, 17 nt, Pseudomonas aeruginosa PA01
ucagucgguagagcaaa

SEQ ID NO: 1536102 - RNA, 23 nt, Pseudomonas aeruginosa PA01
ucagucgguuagaauaccggccu

SEQ ID NO: 1536103 - RNA, 17 nt, Pseudomonas aeruginosa PA01
ucagucggccaggcgcc

SEQ ID NO: 1536104 - RNA, 18 nt, Pseudomonas aeruginosa PA01
ucagugcacguuccagcu

SEQ ID NO: 1536105 - RNA, 21 nt, Pseudomonas aeruginosa PA01
ucaguuccgcaucggccaccu

SEQ ID NO: 1536106 - RNA, 17 nt, Pseudomonas aeruginosa PA01
ucaguuccucgcggaag

SEQ ID NO: 1536107 - RNA, 18 nt, Pseudomonas aeruginosa PA01
ucagugagccccggcguc

SEQ ID NO: 1536108 - RNA, 18 nt, Pseudomonas aeruginosa PA01
ucaguucguugggccgga

SEQ ID NO: 1536109 - RNA, 20 nt, Pseudomonas aeruginosa PA01
ucaguucguugggccggaac

SEQ ID NO: 1536110 - RNA, 20 nt, Pseudomonas aeruginosa PA01
ucaguucugggcggccaggu

SEQ ID NO: 1536111 - RNA, 20 nt, Pseudomonas aeruginosa PA01
ucauagcucagcuggauaga

SEQ ID NO: 1536112 - RNA, 17 nt, Pseudomonas aeruginosa PA01
ucauccgucccagcaau

SEQ ID NO: 1536113 - RNA, 23 nt, Pseudomonas aeruginosa PA01
ucauccgcugguagcccaggccg

SEQ ID NO: 1536114 - RNA, 13 nt, Pseudomonas aeruginosa PA01
ucauccagccccc

SEQ ID NO: 1536115 - RNA, 16 nt, Pseudomonas aeruginosa PA01
ucauccugcgcgccuc

SEQ ID NO: 1536116 - RNA, 21 nt, Pseudomonas aeruginosa PA01
ucaucgaaaugccgcacccca

SEQ ID NO: 1536117 - RNA, 13 nt, Pseudomonas aeruginosa PA01
ucaucacgcuuuc

SEQ ID NO: 1536118 - RNA, 19 nt, Pseudomonas aeruginosa PA01
ucaucaccuucgccagcag

SEQ ID NO: 1536119 - RNA, 13 nt, Pseudomonas aeruginosa PA01
ucaucaggcgcuu

SEQ ID NO: 1536120 - RNA, 12 nt, Pseudomonas aeruginosa PA01
ucaucggcccga

SEQ ID NO: 1536121 - RNA, 16 nt, Pseudomonas aeruginosa PA01
ucaucggcggcaggcc

SEQ ID NO: 1536122 - RNA, 18 nt, Pseudomonas aeruginosa PA01
ucaucggcuggccgaggg

SEQ ID NO: 1536123 - RNA, 11 nt, Pseudomonas aeruginosa PA01
ucaucugcacc

SEQ ID NO: 1536124 - RNA, 19 nt, Pseudomonas aeruginosa PA01
ucaugcacuucgaccagua

SEQ ID NO: 1536125 - RNA, 18 nt, Pseudomonas aeruginosa PA01
ucaugccgagcaucagcg

SEQ ID NO: 1536126 - RNA, 21 nt, Pseudomonas aeruginosa PA01
ucaugccgccaucgaccagga

SEQ ID NO: 1536127 - RNA, 22 nt, Pseudomonas aeruginosa PA01
ucauggaaaccccggccuggcg

SEQ ID NO: 1536128 - RNA, 19 nt, Pseudomonas aeruginosa PA01
ucauggaacagcagccagg

SEQ ID NO: 1536129 - RNA, 20 nt, Pseudomonas aeruginosa PA01
ucauggaacagcagccaggc

SEQ ID NO: 1536130 - RNA, 19 nt, Pseudomonas aeruginosa PA01
ucauggaacugcagggcau

SEQ ID NO: 1536131 - RNA, 16 nt, Pseudomonas aeruginosa PA01
ucaugcugcgcgggac

SEQ ID NO: 1536132 - RNA, 14 nt, Pseudomonas aeruginosa PA01
ucaugccuucgauc

SEQ ID NO: 1536133 - RNA, 15 nt, Pseudomonas aeruginosa PA01
ucaugaucugguaga

SEQ ID NO: 1536134 - RNA, 17 nt, Pseudomonas aeruginosa PA01
ucaugaagucagccagg

SEQ ID NO: 1536135 - RNA, 15 nt, Pseudomonas aeruginosa PA01
ucaugaaagccagca

SEQ ID NO: 1536136 - RNA, 15 nt, Pseudomonas aeruginosa PA01
ucauucauggcgcca

SEQ ID NO: 1536137 - RNA, 18 nt, Pseudomonas aeruginosa PA01
ucauguagagcaggcugc

SEQ ID NO: 1536138 - RNA, 15 nt, Pseudomonas aeruginosa PA01
ucauggugaagccca

SEQ ID NO: 1536139 - RNA, 21 nt, Pseudomonas aeruginosa PA01
ucauggugaagcccaccacca

SEQ ID NO: 1536140 - RNA, 19 nt, Pseudomonas aeruginosa PA01
ucauggugcccagcaggcu

SEQ ID NO: 1536141 - RNA, 21 nt, Pseudomonas aeruginosa PA01
ucaugggugaagaccagucgg

SEQ ID NO: 1536142 - RNA, 19 nt, Pseudomonas aeruginosa PA01
ucauggccagcucgaccuu

SEQ ID NO: 1536143 - RNA, 21 nt, Pseudomonas aeruginosa PA01
ucauggccaggucagccaccu

SEQ ID NO: 1536144 - RNA, 13 nt, Pseudomonas aeruginosa PA01
ucauggccaguca

SEQ ID NO: 1536145 - RNA, 21 nt, Pseudomonas aeruginosa PA01
uccaaccgauauccguagccg

SEQ ID NO: 1536146 - RNA, 22 nt, Pseudomonas aeruginosa PA01
uccaaccgggcaucgccgacca

SEQ ID NO: 1536147 - RNA, 14 nt, Pseudomonas aeruginosa PA01
ucauugggcagcca

SEQ ID NO: 1536148 - RNA, 14 nt, Pseudomonas aeruginosa PA01
ucauuuccggcgua

SEQ ID NO: 1536149 - RNA, 23 nt, Pseudomonas aeruginosa PA01
uccauaguagagaugcaccggcc

SEQ ID NO: 1536150 - RNA, 12 nt, Pseudomonas aeruginosa PA01
uccaucccugcu

SEQ ID NO: 1536151 - RNA, 13 nt, Pseudomonas aeruginosa PA01
uccaucagcucca

SEQ ID NO: 1536152 - RNA, 16 nt, Pseudomonas aeruginosa PA01
uccaucagcgccucca

SEQ ID NO: 1536153 - RNA, 16 nt, Pseudomonas aeruginosa PA01
uccagucggggcaggc

SEQ ID NO: 1536154 - RNA, 22 nt, Pseudomonas aeruginosa PA01
uccaguugcagggugcuguguu

SEQ ID NO: 1536155 - RNA, 11 nt, Pseudomonas aeruginosa PA01
uccaguuccug

SEQ ID NO: 1536156 - RNA, 15 nt, Pseudomonas aeruginosa PA01
uccaguuccugcacc

SEQ ID NO: 1536157 - RNA, 15 nt, Pseudomonas aeruginosa PA01
uccaguuccugcucc

SEQ ID NO: 1536158 - RNA, 19 nt, Pseudomonas aeruginosa PA01
uccaguuccugcuccuccg

SEQ ID NO: 1536159 - RNA, 18 nt, Pseudomonas aeruginosa PA01
uccaguucagggccacgc

SEQ ID NO: 1536160 - RNA, 11 nt, Pseudomonas aeruginosa PA01
uccagggcuuc

SEQ ID NO: 1536161 - RNA, 17 nt, Pseudomonas aeruginosa PA01
uccagggcgaagucggc

SEQ ID NO: 1536162 - RNA, 19 nt, Pseudomonas aeruginosa PA01
uccagggcgguuaccaggu

SEQ ID NO: 1536163 - RNA, 21 nt, Pseudomonas aeruginosa PA01
uccaggggcauguccaccgcc

SEQ ID NO: 1536164 - RNA, 16 nt, Pseudomonas aeruginosa PA01
uccaggguuggaagaa

SEQ ID NO: 1536165 - RNA, 16 nt, Pseudomonas aeruginosa PA01
uccaggguuuccagca

SEQ ID NO: 1536166 - RNA, 19 nt, Pseudomonas aeruginosa PA01
uccaggguagcgccgcggg

SEQ ID NO: 1536167 - RNA, 19 nt, Pseudomonas aeruginosa PA01
uccaggucggcggcacgcu

SEQ ID NO: 1536168 - RNA, 11 nt, Pseudomonas aeruginosa PA01
uccaggugcac

SEQ ID NO: 1536169 - RNA, 15 nt, Pseudomonas aeruginosa PA01
uccaggugcacggcc

SEQ ID NO: 1536170 - RNA, 18 nt, Pseudomonas aeruginosa PA01
uccaggugcacggccagg

SEQ ID NO: 1536171 - RNA, 19 nt, Pseudomonas aeruginosa PA01
uccaggugcacggccaggc

SEQ ID NO: 1536172 - RNA, 14 nt, Pseudomonas aeruginosa PA01
uccaggugcggcug

SEQ ID NO: 1536173 - RNA, 20 nt, Pseudomonas aeruginosa PA01
uccaggucgaacagcggcug

SEQ ID NO: 1536174 - RNA, 20 nt, Pseudomonas aeruginosa PA01
uccaggucgaucagcagcag

SEQ ID NO: 1536175 - RNA, 20 nt, Pseudomonas aeruginosa PA01
uccagguacaccaggguggc

SEQ ID NO: 1536176 - RNA, 14 nt, Pseudomonas aeruginosa PA01
uccagucaccaggu

SEQ ID NO: 1536177 - RNA, 13 nt, Pseudomonas aeruginosa PA01
uccaguagcgccu

SEQ ID NO: 1536178 - RNA, 15 nt, Pseudomonas aeruginosa PA01
uccaguagcgccugg

SEQ ID NO: 1536179 - RNA, 16 nt, Pseudomonas aeruginosa PA01
uccaguauccauguca

SEQ ID NO: 1536180 - RNA, 16 nt, Pseudomonas aeruginosa PA01
uccaguacacccaggg

SEQ ID NO: 1536181 - RNA, 17 nt, Pseudomonas aeruginosa PA01
uccagcgguaccagcag

SEQ ID NO: 1536182 - RNA, 15 nt, Pseudomonas aeruginosa PA01
uccagcguguggcga

SEQ ID NO: 1536183 - RNA, 16 nt, Pseudomonas aeruginosa PA01
uccagcuccaccaggc

SEQ ID NO: 1536184 - RNA, 17 nt, Pseudomonas aeruginosa PA01
uccagcuccaccaggcc

SEQ ID NO: 1536185 - RNA, 17 nt, Pseudomonas aeruginosa PA01
uccagcucgacccgccc

SEQ ID NO: 1536186 - RNA, 21 nt, Pseudomonas aeruginosa PA01
uccaggcgcgccgugcggcgu

SEQ ID NO: 1536187 - RNA, 17 nt, Pseudomonas aeruginosa PA01
uccaggcgcgccuggau

SEQ ID NO: 1536188 - RNA, 23 nt, Pseudomonas aeruginosa PA01
uccaggcgcgaacgcucccagcc

SEQ ID NO: 1536189 - RNA, 13 nt, Pseudomonas aeruginosa PA01
uccaggcgcugcu

SEQ ID NO: 1536190 - RNA, 21 nt, Pseudomonas aeruginosa PA01
uccaggcggcgguagccgagg

SEQ ID NO: 1536191 - RNA, 18 nt, Pseudomonas aeruginosa PA01
uccaggcguccgcuggcc

SEQ ID NO: 1536192 - RNA, 19 nt, Pseudomonas aeruginosa PA01
uccaggcguccgcuggccu

SEQ ID NO: 1536193 - RNA, 20 nt, Pseudomonas aeruginosa PA01
uccaggcgugcugcacggag

SEQ ID NO: 1536194 - RNA, 14 nt, Pseudomonas aeruginosa PA01
uccaggcccggcag

SEQ ID NO: 1536195 - RNA, 21 nt, Pseudomonas aeruginosa PA01
uccaggccgacgaagaccuug

SEQ ID NO: 1536196 - RNA, 19 nt, Pseudomonas aeruginosa PA01
uccaggccgcaggugaagc

SEQ ID NO: 1536197 - RNA, 13 nt, Pseudomonas aeruginosa PA01
uccagggccagga

SEQ ID NO: 1536198 - RNA, 23 nt, Pseudomonas aeruginosa PA01
uccaggcugugggcgacuuccuu

SEQ ID NO: 1536199 - RNA, 18 nt, Pseudomonas aeruginosa PA01
uccaggcuguagccggcg

SEQ ID NO: 1536200 - RNA, 22 nt, Pseudomonas aeruginosa PA01
uccagggagcgcucgcgcagcc

SEQ ID NO: 1536201 - RNA, 14 nt, Pseudomonas aeruginosa PA01
uccaggcuggccuu

SEQ ID NO: 1536202 - RNA, 15 nt, Pseudomonas aeruginosa PA01
uccaggcuggccuug

SEQ ID NO: 1536203 - RNA, 17 nt, Pseudomonas aeruginosa PA01
uccaggagggaaugacu

SEQ ID NO: 1536204 - RNA, 19 nt, Pseudomonas aeruginosa PA01
uccaggagggcugcugucc

SEQ ID NO: 1536205 - RNA, 19 nt, Pseudomonas aeruginosa PA01
uccaggaugcaaccgcccu

SEQ ID NO: 1536206 - RNA, 22 nt, Pseudomonas aeruginosa PA01
uccaggaauccuccgccagcgu

SEQ ID NO: 1536207 - RNA, 23 nt, Pseudomonas aeruginosa PA01
uccagcuuggcacggccggcggu

SEQ ID NO: 1536208 - RNA, 14 nt, Pseudomonas aeruginosa PA01
uccagcgccuggau

SEQ ID NO: 1536209 - RNA, 16 nt, Pseudomonas aeruginosa PA01
uccagcgccuggauga

SEQ ID NO: 1536210 - RNA, 20 nt, Pseudomonas aeruginosa PA01
uccagcgccgccaggcgcgu

SEQ ID NO: 1536211 - RNA, 24 nt, Pseudomonas aeruginosa PA01
uccagcgccgccucgaaggccggc

SEQ ID NO: 1536212 - RNA, 15 nt, Pseudomonas aeruginosa PA01
uccagcgcuggcagg

SEQ ID NO: 1536213 - RNA, 11 nt, Pseudomonas aeruginosa PA01
uccagcggcuu

SEQ ID NO: 1536214 - RNA, 22 nt, Pseudomonas aeruginosa PA01
uccagcgggaaggucggcagca

SEQ ID NO: 1536215 - RNA, 19 nt, Pseudomonas aeruginosa PA01
uccagccggccauccagcc

SEQ ID NO: 1536216 - RNA, 20 nt, Pseudomonas aeruginosa PA01
uccagcaggucgagggcguc

SEQ ID NO: 1536217 - RNA, 21 nt, Pseudomonas aeruginosa PA01
uccagcagguggcgcacugcc

SEQ ID NO: 1536218 - RNA, 14 nt, Pseudomonas aeruginosa PA01
uccagcagggccag

SEQ ID NO: 1536219 - RNA, 19 nt, Pseudomonas aeruginosa PA01
uccagcagggccagcgccu

SEQ ID NO: 1536220 - RNA, 20 nt, Pseudomonas aeruginosa PA01
uccagcagggccagcgccug

SEQ ID NO: 1536221 - RNA, 12 nt, Pseudomonas aeruginosa PA01
uccagcaggccc

SEQ ID NO: 1536222 - RNA, 18 nt, Pseudomonas aeruginosa PA01
uccagcagcgcacgcuuc

SEQ ID NO: 1536223 - RNA, 18 nt, Pseudomonas aeruginosa PA01
uccagcagucgcacagcc

SEQ ID NO: 1536224 - RNA, 15 nt, Pseudomonas aeruginosa PA01
uccagcagucgcggc

SEQ ID NO: 1536225 - RNA, 17 nt, Pseudomonas aeruginosa PA01
uccagcagucgcggccc

SEQ ID NO: 1536226 - RNA, 12 nt, Pseudomonas aeruginosa PA01
uccagccaggcg

SEQ ID NO: 1536227 - RNA, 14 nt, Pseudomonas aeruginosa PA01
uccagcaacggcuu

SEQ ID NO: 1536228 - RNA, 19 nt, Pseudomonas aeruginosa PA01
uccagaugcuggagcuugc

SEQ ID NO: 1536229 - RNA, 19 nt, Pseudomonas aeruginosa PA01
uccagaugcuugcacaccu

SEQ ID NO: 1536230 - RNA, 21 nt, Pseudomonas aeruginosa PA01
uccagcacggugaaccaggcg

SEQ ID NO: 1536231 - RNA, 22 nt, Pseudomonas aeruginosa PA01
uccagcacucgcuccuccgggc

SEQ ID NO: 1536232 - RNA, 12 nt, Pseudomonas aeruginosa PA01
uccagcaccgcc

SEQ ID NO: 1536233 - RNA, 20 nt, Pseudomonas aeruginosa PA01
uccagcaccggcggcgccag

SEQ ID NO: 1536234 - RNA, 20 nt, Pseudomonas aeruginosa PA01
uccagcaccgggauggucga

SEQ ID NO: 1536235 - RNA, 23 nt, Pseudomonas aeruginosa PA01
uccagcaccgggauggucgaggg

SEQ ID NO: 1536236 - RNA, 17 nt, Pseudomonas aeruginosa PA01
uccagaccuccagguag

SEQ ID NO: 1536237 - RNA, 20 nt, Pseudomonas aeruginosa PA01
uccagaaggcuucuuccugg

SEQ ID NO: 1536238 - RNA, 14 nt, Pseudomonas aeruginosa PA01
uccagagugcgcag

SEQ ID NO: 1536239 - RNA, 20 nt, Pseudomonas aeruginosa PA01
uccagauagugcggccaggc

SEQ ID NO: 1536240 - RNA, 21 nt, Pseudomonas aeruginosa PA01
uccagauagugcggccaggcg

SEQ ID NO: 1536241 - RNA, 17 nt, Pseudomonas aeruginosa PA01
uccacucccaugccagg

SEQ ID NO: 1536242 - RNA, 18 nt, Pseudomonas aeruginosa PA01
uccacucccaugccagga

SEQ ID NO: 1536243 - RNA, 16 nt, Pseudomonas aeruginosa PA01
uccacugcuuggccag

SEQ ID NO: 1536244 - RNA, 17 nt, Pseudomonas aeruginosa PA01
uccacugcuuggccagg

SEQ ID NO: 1536245 - RNA, 16 nt, Pseudomonas aeruginosa PA01
uccacgagagaaauga

SEQ ID NO: 1536246 - RNA, 13 nt, Pseudomonas aeruginosa PA01
uccaccucgcccu

SEQ ID NO: 1536247 - RNA, 16 nt, Pseudomonas aeruginosa PA01
uccacgaagagcaccu

SEQ ID NO: 1536248 - RNA, 22 nt, Pseudomonas aeruginosa PA01
uccaccuugccgcgcccggccu

SEQ ID NO: 1536249 - RNA, 16 nt, Pseudomonas aeruginosa PA01
uccacgccuggcccug

SEQ ID NO: 1536250 - RNA, 21 nt, Pseudomonas aeruginosa PA01
uccacgcugugcggcagcagg

SEQ ID NO: 1536251 - RNA, 20 nt, Pseudomonas aeruginosa PA01
uccacgcuguugguguugau

SEQ ID NO: 1536252 - RNA, 19 nt, Pseudomonas aeruginosa PA01
uccacgucgccgaccaggc

SEQ ID NO: 1536253 - RNA, 16 nt, Pseudomonas aeruginosa PA01
uccacgggucgcagcc

SEQ ID NO: 1536254 - RNA, 22 nt, Pseudomonas aeruginosa PA01
uccaccgaguggcgcagcgccc

SEQ ID NO: 1536255 - RNA, 16 nt, Pseudomonas aeruginosa PA01
uccaccgccagcaccc

SEQ ID NO: 1536256 - RNA, 21 nt, Pseudomonas aeruginosa PA01
uccaccguuccgacccggccg

SEQ ID NO: 1536257 - RNA, 18 nt, Pseudomonas aeruginosa PA01
uccaccgcuccggcgccg

SEQ ID NO: 1536258 - RNA, 20 nt, Pseudomonas aeruginosa PA01
uccaccagggccucggggcc

SEQ ID NO: 1536259 - RNA, 18 nt, Pseudomonas aeruginosa PA01
uccacccgaaagccgaag

SEQ ID NO: 1536260 - RNA, 23 nt, Pseudomonas aeruginosa PA01
uccacccccaucgcccgcagcca

SEQ ID NO: 1536261 - RNA, 16 nt, Pseudomonas aeruginosa PA01
uccacagcgugcagac

SEQ ID NO: 1536262 - RNA, 16 nt, Pseudomonas aeruginosa PA01
uccacagcugccagcc

SEQ ID NO: 1536263 - RNA, 17 nt, Pseudomonas aeruginosa PA01
uccaccaccagcaggcc

SEQ ID NO: 1536264 - RNA, 21 nt, Pseudomonas aeruginosa PA01
uccaccagaaggcgggcagcc

SEQ ID NO: 1536265 - RNA, 21 nt, Pseudomonas aeruginosa PA01
uccaacuggcggcugggcugc

SEQ ID NO: 1536266 - RNA, 14 nt, Pseudomonas aeruginosa PA01
uccccccacccguc

SEQ ID NO: 1536267 - RNA, 15 nt, Pseudomonas aeruginosa PA01
uccccccacccgucc

SEQ ID NO: 1536268 - RNA, 16 nt, Pseudomonas aeruginosa PA01
uccccggaccagggcg

SEQ ID NO: 1536269 - RNA, 15 nt, Pseudomonas aeruginosa PA01
uccccgccacuucca

SEQ ID NO: 1536270 - RNA, 14 nt, Pseudomonas aeruginosa PA01
uccccagcaggcag

SEQ ID NO: 1536271 - RNA, 17 nt, Pseudomonas aeruginosa PA01
uccccagcaggcaggca

SEQ ID NO: 1536272 - RNA, 14 nt, Pseudomonas aeruginosa PA01
ucccaugccaggag

SEQ ID NO: 1536273 - RNA, 21 nt, Pseudomonas aeruginosa PA01
ucccaugaaaaauggccgcuu

SEQ ID NO: 1536274 - RNA, 19 nt, Pseudomonas aeruginosa PA01
uccccaacccggccagccc

SEQ ID NO: 1536275 - RNA, 21 nt, Pseudomonas aeruginosa PA01
uccccaaggcacgccccaucc

SEQ ID NO: 1536276 - RNA, 12 nt, Pseudomonas aeruginosa PA01
ucccaggccagc

SEQ ID NO: 1536277 - RNA, 18 nt, Pseudomonas aeruginosa PA01
ucccaggccagcgggcug

SEQ ID NO: 1536278 - RNA, 20 nt, Pseudomonas aeruginosa PA01
ucccaggugguacggcugag

SEQ ID NO: 1536279 - RNA, 16 nt, Pseudomonas aeruginosa PA01
ucccagcgaguagucg

SEQ ID NO: 1536280 - RNA, 13 nt, Pseudomonas aeruginosa PA01
ucccagccgaggc

SEQ ID NO: 1536281 - RNA, 12 nt, Pseudomonas aeruginosa PA01
uccaugaacucu

SEQ ID NO: 1536282 - RNA, 16 nt, Pseudomonas aeruginosa PA01
uccaugaacucuuccc

SEQ ID NO: 1536283 - RNA, 22 nt, Pseudomonas aeruginosa PA01
uccaugucgcuggccugcaggu

SEQ ID NO: 1536284 - RNA, 23 nt, Pseudomonas aeruginosa PA01
uccauguugcggcccagcggcag

SEQ ID NO: 1536285 - RNA, 15 nt, Pseudomonas aeruginosa PA01
ucccacuccagcgcg

SEQ ID NO: 1536286 - RNA, 18 nt, Pseudomonas aeruginosa PA01
ucccagaaggccagggca

SEQ ID NO: 1536287 - RNA, 19 nt, Pseudomonas aeruginosa PA01
ucccagaaggccagggcau

SEQ ID NO: 1536288 - RNA, 14 nt, Pseudomonas aeruginosa PA01
ucccacuuguggug

SEQ ID NO: 1536289 - RNA, 15 nt, Pseudomonas aeruginosa PA01
ucccagaccacccgg

SEQ ID NO: 1536290 - RNA, 14 nt, Pseudomonas aeruginosa PA01
ucccagaccagcag

SEQ ID NO: 1536291 - RNA, 16 nt, Pseudomonas aeruginosa PA01
ucccagaccagcagcg

SEQ ID NO: 1536292 - RNA, 13 nt, Pseudomonas aeruginosa PA01
ucccgccgcgccg

SEQ ID NO: 1536293 - RNA, 16 nt, Pseudomonas aeruginosa PA01
ucccgccgcucugcug

SEQ ID NO: 1536294 - RNA, 21 nt, Pseudomonas aeruginosa PA01
uccccggcggguucagcccgc

SEQ ID NO: 1536295 - RNA, 19 nt, Pseudomonas aeruginosa PA01
uccccggccagcagcgccu

SEQ ID NO: 1536296 - RNA, 18 nt, Pseudomonas aeruginosa PA01
uccccugcaugccggccg

SEQ ID NO: 1536297 - RNA, 19 nt, Pseudomonas aeruginosa PA01
uccccugccgaaccgccuc

SEQ ID NO: 1536298 - RNA, 13 nt, Pseudomonas aeruginosa PA01
uccccuuuuuuca

SEQ ID NO: 1536299 - RNA, 23 nt, Pseudomonas aeruginosa PA01
uccccuuuuucaugcgcgggccg

SEQ ID NO: 1536300 - RNA, 14 nt, Pseudomonas aeruginosa PA01
ucccgcgcgggccg

SEQ ID NO: 1536301 - RNA, 12 nt, Pseudomonas aeruginosa PA01
ucccgcggcgcg

SEQ ID NO: 1536302 - RNA, 13 nt, Pseudomonas aeruginosa PA01
ucccgcuccagcc

SEQ ID NO: 1536303 - RNA, 14 nt, Pseudomonas aeruginosa PA01
ucccgcgccagcgc

SEQ ID NO: 1536304 - RNA, 23 nt, Pseudomonas aeruginosa PA01
ucccgggcuccggguugucgucg

SEQ ID NO: 1536305 - RNA, 17 nt, Pseudomonas aeruginosa PA01
ucccggcuugccggcag

SEQ ID NO: 1536306 - RNA, 12 nt, Pseudomonas aeruginosa PA01
ucccgggaaacc

SEQ ID NO: 1536307 - RNA, 16 nt, Pseudomonas aeruginosa PA01
ucccggcugagcgcca

SEQ ID NO: 1536308 - RNA, 19 nt, Pseudomonas aeruginosa PA01
ucccggcugagcgccaggc

SEQ ID NO: 1536309 - RNA, 20 nt, Pseudomonas aeruginosa PA01
ucccggcugagcgccaggcg

SEQ ID NO: 1536310 - RNA, 14 nt, Pseudomonas aeruginosa PA01
ucccggcgcggccg

SEQ ID NO: 1536311 - RNA, 22 nt, Pseudomonas aeruginosa PA01
ucccggcgcggcuacccucucc

SEQ ID NO: 1536312 - RNA, 14 nt, Pseudomonas aeruginosa PA01
ucccggcgccgccc

SEQ ID NO: 1536313 - RNA, 23 nt, Pseudomonas aeruginosa PA01
ucccggccauugaacggaccuug

SEQ ID NO: 1536314 - RNA, 15 nt, Pseudomonas aeruginosa PA01
ucccguccgggcacg

SEQ ID NO: 1536315 - RNA, 18 nt, Pseudomonas aeruginosa PA01
ucccggucgagguugcgc

SEQ ID NO: 1536316 - RNA, 18 nt, Pseudomonas aeruginosa PA01
ucccguaaggccaggcuc

SEQ ID NO: 1536317 - RNA, 21 nt, Pseudomonas aeruginosa PA01
ucccuagggguucuccggguc

SEQ ID NO: 1536318 - RNA, 14 nt, Pseudomonas aeruginosa PA01
ucccugaccagcag

SEQ ID NO: 1536319 - RNA, 15 nt, Pseudomonas aeruginosa PA01
ucccugaccagcagg

SEQ ID NO: 1536320 - RNA, 17 nt, Pseudomonas aeruginosa PA01
ucccugaagggagaggg

SEQ ID NO: 1536321 - RNA, 13 nt, Pseudomonas aeruginosa PA01
ucccugccggcgg

SEQ ID NO: 1536322 - RNA, 20 nt, Pseudomonas aeruginosa PA01
ucccugcaauggggcggccg

SEQ ID NO: 1536323 - RNA, 15 nt, Pseudomonas aeruginosa PA01
ucccuggccggcgau

SEQ ID NO: 1536324 - RNA, 21 nt, Pseudomonas aeruginosa PA01
ucccugcgggacccagacagg

SEQ ID NO: 1536325 - RNA, 15 nt, Pseudomonas aeruginosa PA01
ucccuggagcagggc

SEQ ID NO: 1536326 - RNA, 16 nt, Pseudomonas aeruginosa PA01
ucccuggagcagggcg

SEQ ID NO: 1536327 - RNA, 21 nt, Pseudomonas aeruginosa PA01
ucccuuguuuuccuggcccug

SEQ ID NO: 1536328 - RNA, 22 nt, Pseudomonas aeruginosa PA01
uccgaagggaacccgcggcgcg

SEQ ID NO: 1536329 - RNA, 21 nt, Pseudomonas aeruginosa PA01
uccgaacgcgaggucucgaug

SEQ ID NO: 1536330 - RNA, 19 nt, Pseudomonas aeruginosa PA01
uccgaccuuugagggucag

SEQ ID NO: 1536331 - RNA, 19 nt, Pseudomonas aeruginosa PA01
uccgacgccggcuuccacc

SEQ ID NO: 1536332 - RNA, 21 nt, Pseudomonas aeruginosa PA01
uccgaccagguagagcagccc

SEQ ID NO: 1536333 - RNA, 16 nt, Pseudomonas aeruginosa PA01
uccgaugaagcaggcg

SEQ ID NO: 1536334 - RNA, 14 nt, Pseudomonas aeruginosa PA01
uccgaggccaccac

SEQ ID NO: 1536335 - RNA, 13 nt, Pseudomonas aeruginosa PA01
uccgaggaugggc

SEQ ID NO: 1536336 - RNA, 21 nt, Pseudomonas aeruginosa PA01
uccgagcaggccuugcagggc

SEQ ID NO: 1536337 - RNA, 23 nt, Pseudomonas aeruginosa PA01
uccgagcaggccuugcagggccg

SEQ ID NO: 1536338 - RNA, 19 nt, Pseudomonas aeruginosa PA01
uccgagcaggucgcggaac

SEQ ID NO: 1536339 - RNA, 17 nt, Pseudomonas aeruginosa PA01
ucgcguacagcgggccg

SEQ ID NO: 1536340 - RNA, 19 nt, Pseudomonas aeruginosa PA01
ucgcguagguggcgccgcc

SEQ ID NO: 1536341 - RNA, 22 nt, Pseudomonas aeruginosa PA01
ucgcgugaaaacaagaagcccc

SEQ ID NO: 1536342 - RNA, 15 nt, Pseudomonas aeruginosa PA01
ucgcgugggccaggg

SEQ ID NO: 1536343 - RNA, 17 nt, Pseudomonas aeruginosa PA01
ucgcguccggccagccu

SEQ ID NO: 1536344 - RNA, 13 nt, Pseudomonas aeruginosa PA01
ucgcgguucugcu

SEQ ID NO: 1536345 - RNA, 18 nt, Pseudomonas aeruginosa PA01
ucgcgggugaccuggccg

SEQ ID NO: 1536346 - RNA, 15 nt, Pseudomonas aeruginosa PA01
ucgcggguucgaguc

SEQ ID NO: 1536347 - RNA, 22 nt, Pseudomonas aeruginosa PA01
ucgcguucaucgucggcagcca

SEQ ID NO: 1536348 - RNA, 17 nt, Pseudomonas aeruginosa PA01
ucgcucaacggcgugcc

SEQ ID NO: 1536349 - RNA, 15 nt, Pseudomonas aeruginosa PA01
ucgcucauccgcgag

SEQ ID NO: 1536350 - RNA, 13 nt, Pseudomonas aeruginosa PA01
ucgcucccaggcu

SEQ ID NO: 1536351 - RNA, 15 nt, Pseudomonas aeruginosa PA01
ucgcucccaggcuca

SEQ ID NO: 1536352 - RNA, 11 nt, Pseudomonas aeruginosa PA01
ucgcucugcug

SEQ ID NO: 1536353 - RNA, 17 nt, Pseudomonas aeruginosa PA01
ucgcugaccagcccggc

SEQ ID NO: 1536354 - RNA, 13 nt, Pseudomonas aeruginosa PA01
ucgcugaccggcc

SEQ ID NO: 1536355 - RNA, 20 nt, Pseudomonas aeruginosa PA01
ucgcugagaccgauccagca

SEQ ID NO: 1536356 - RNA, 18 nt, Pseudomonas aeruginosa PA01
ucgcugagcaccgggacg

SEQ ID NO: 1536357 - RNA, 13 nt, Pseudomonas aeruginosa PA01
ucgcugaucucgg

SEQ ID NO: 1536358 - RNA, 21 nt, Pseudomonas aeruginosa PA01
ucgcugaguuugcccagcgcc

SEQ ID NO: 1536359 - RNA, 22 nt, Pseudomonas aeruginosa PA01
ucgcuugacggauaaaauccac

SEQ ID NO: 1536360 - RNA, 22 nt, Pseudomonas aeruginosa PA01
ucgcugccgaacagacgggaca

SEQ ID NO: 1536361 - RNA, 20 nt, Pseudomonas aeruginosa PA01
ucggaacgaccacgccugcc

SEQ ID NO: 1536362 - RNA, 20 nt, Pseudomonas aeruginosa PA01
ucggcacucagccagcggcg

SEQ ID NO: 1536363 - RNA, 19 nt, Pseudomonas aeruginosa PA01
ucggcacuccguugaccug

SEQ ID NO: 1536364 - RNA, 14 nt, Pseudomonas aeruginosa PA01
ucggcacgccgaag

SEQ ID NO: 1536365 - RNA, 14 nt, Pseudomonas aeruginosa PA01
ucggacaggcauuc

SEQ ID NO: 1536366 - RNA, 15 nt, Pseudomonas aeruginosa PA01
ucggaccagaggcug

SEQ ID NO: 1536367 - RNA, 18 nt, Pseudomonas aeruginosa PA01
ucggaccagaggcugacc

SEQ ID NO: 1536368 - RNA, 19 nt, Pseudomonas aeruginosa PA01
ucggacgccguagcggccu

SEQ ID NO: 1536369 - RNA, 21 nt, Pseudomonas aeruginosa PA01
ucggcaaggcgcagcuguuca

SEQ ID NO: 1536370 - RNA, 18 nt, Pseudomonas aeruginosa PA01
ucggcaacuggcuggccu

SEQ ID NO: 1536371 - RNA, 23 nt, Pseudomonas aeruginosa PA01
ucggagaacagcgagaccucgcc

SEQ ID NO: 1536372 - RNA, 16 nt, Pseudomonas aeruginosa PA01
ucggcaagcaggccgc

SEQ ID NO: 1536373 - RNA, 13 nt, Pseudomonas aeruginosa PA01
ucgccggccgcug

SEQ ID NO: 1536374 - RNA, 19 nt, Pseudomonas aeruginosa PA01
ucgccggcaucguggccau

SEQ ID NO: 1536375 - RNA, 20 nt, Pseudomonas aeruginosa PA01
ucgccggcaucguggccaug

SEQ ID NO: 1536376 - RNA, 21 nt, Pseudomonas aeruginosa PA01
ucgccggggccuacugcugga

SEQ ID NO: 1536377 - RNA, 20 nt, Pseudomonas aeruginosa PA01
ucgccggcgcgggcggccuc

SEQ ID NO: 1536378 - RNA, 21 nt, Pseudomonas aeruginosa PA01
ucgccagggucuugccgaccu

SEQ ID NO: 1536379 - RNA, 21 nt, Pseudomonas aeruginosa PA01
ucgccagguggaagcgcgcgu

SEQ ID NO: 1536380 - RNA, 19 nt, Pseudomonas aeruginosa PA01
ucgccgcccgcgccuccag

SEQ ID NO: 1536381 - RNA, 15 nt, Pseudomonas aeruginosa PA01
ucgccgccggccagc

SEQ ID NO: 1536382 - RNA, 21 nt, Pseudomonas aeruginosa PA01
ucgccgccgacacccgcgccg

SEQ ID NO: 1536383 - RNA, 12 nt, Pseudomonas aeruginosa PA01
ucgccgccgacc

SEQ ID NO: 1536384 - RNA, 17 nt, Pseudomonas aeruginosa PA01
ucgccgccgaccgggcg

SEQ ID NO: 1536385 - RNA, 13 nt, Pseudomonas aeruginosa PA01
ucgccgcccugga

SEQ ID NO: 1536386 - RNA, 14 nt, Pseudomonas aeruginosa PA01
ucgcgacggcauuc

SEQ ID NO: 1536387 - RNA, 15 nt, Pseudomonas aeruginosa PA01
ucgcgacccuggccg

SEQ ID NO: 1536388 - RNA, 16 nt, Pseudomonas aeruginosa PA01
ucgcgaccgagaugcu

SEQ ID NO: 1536389 - RNA, 19 nt, Pseudomonas aeruginosa PA01
ucgcgaaccacauccuugc

SEQ ID NO: 1536390 - RNA, 17 nt, Pseudomonas aeruginosa PA01
ucgcgaaaacucccggc

SEQ ID NO: 1536391 - RNA, 19 nt, Pseudomonas aeruginosa PA01
ucgcgaaaacucccggccu

SEQ ID NO: 1536392 - RNA, 17 nt, Pseudomonas aeruginosa PA01
ucgccucgcgccagaga

SEQ ID NO: 1536393 - RNA, 17 nt, Pseudomonas aeruginosa PA01
ucgccuugcccuggccg

SEQ ID NO: 1536394 - RNA, 20 nt, Pseudomonas aeruginosa PA01
ucgccuugcggggcggcgca

SEQ ID NO: 1536395 - RNA, 17 nt, Pseudomonas aeruginosa PA01
ucgccuccaccagcgcc

SEQ ID NO: 1536396 - RNA, 16 nt, Pseudomonas aeruginosa PA01
ucgccuaccggcgccg

SEQ ID NO: 1536397 - RNA, 15 nt, Pseudomonas aeruginosa PA01
ucgccuaccagaccg

SEQ ID NO: 1536398 - RNA, 23 nt, Pseudomonas aeruginosa PA01
ucgcgcaguucgucuuccagcgg

SEQ ID NO: 1536399 - RNA, 16 nt, Pseudomonas aeruginosa PA01
ucgcgcaacgccgacg

SEQ ID NO: 1536400 - RNA, 18 nt, Pseudomonas aeruginosa PA01
ucgcgcaacggcagcgcu

SEQ ID NO: 1536401 - RNA, 20 nt, Pseudomonas aeruginosa PA01
ucgcgcaacugcggggcgcu

SEQ ID NO: 1536402 - RNA, 15 nt, Pseudomonas aeruginosa PA01
ucgcgcaacugcucg

SEQ ID NO: 1536403 - RNA, 19 nt, Pseudomonas aeruginosa PA01
ucgcgauccaccgccaggg

SEQ ID NO: 1536404 - RNA, 23 nt, Pseudomonas aeruginosa PA01
ucgcgccagccccaggcgcggcg

SEQ ID NO: 1536405 - RNA, 19 nt, Pseudomonas aeruginosa PA01
ucgcgccauggccgcugaa

SEQ ID NO: 1536406 - RNA, 13 nt, Pseudomonas aeruginosa PA01
ucgcgccagagau

SEQ ID NO: 1536407 - RNA, 15 nt, Pseudomonas aeruginosa PA01
ucgcgcaucgcggac

SEQ ID NO: 1536408 - RNA, 15 nt, Pseudomonas aeruginosa PA01
ucgcgcucuggccca

SEQ ID NO: 1536409 - RNA, 17 nt, Pseudomonas aeruginosa PA01
ucgcgcgccggagccac

SEQ ID NO: 1536410 - RNA, 18 nt, Pseudomonas aeruginosa PA01
ucgcgcccccaucugcac

SEQ ID NO: 1536411 - RNA, 15 nt, Pseudomonas aeruginosa PA01
ucgcggcugaagaag

SEQ ID NO: 1536412 - RNA, 17 nt, Pseudomonas aeruginosa PA01
ucgcggcugaagaagcu

SEQ ID NO: 1536413 - RNA, 15 nt, Pseudomonas aeruginosa PA01
ucgcgggccaggccg

SEQ ID NO: 1536414 - RNA, 20 nt, Pseudomonas aeruginosa PA01
ucgcggcggaugccggcgcu

SEQ ID NO: 1536415 - RNA, 14 nt, Pseudomonas aeruginosa PA01
ucgcggcaggcggc

SEQ ID NO: 1536416 - RNA, 17 nt, Pseudomonas aeruginosa PA01
ucgcggccuucucgucg

SEQ ID NO: 1536417 - RNA, 14 nt, Pseudomonas aeruginosa PA01
ucgcggcgacagca

SEQ ID NO: 1536418 - RNA, 15 nt, Pseudomonas aeruginosa PA01
ucgcgcuuccggcuu

SEQ ID NO: 1536419 - RNA, 16 nt, Pseudomonas aeruginosa PA01
ucgcgcuguugccgcg

SEQ ID NO: 1536420 - RNA, 17 nt, Pseudomonas aeruginosa PA01
ucgcggaccucgggcag

SEQ ID NO: 1536421 - RNA, 16 nt, Pseudomonas aeruginosa PA01
ucgcggaccucugcgu

SEQ ID NO: 1536422 - RNA, 17 nt, Pseudomonas aeruginosa PA01
ucgcggagccaacuucc

SEQ ID NO: 1536423 - RNA, 12 nt, Pseudomonas aeruginosa PA01
ucgagcccuggu

SEQ ID NO: 1536424 - RNA, 13 nt, Pseudomonas aeruginosa PA01
ucgagcccugguc

SEQ ID NO: 1536425 - RNA, 16 nt, Pseudomonas aeruginosa PA01
ucgagcaugccgagga

SEQ ID NO: 1536426 - RNA, 15 nt, Pseudomonas aeruginosa PA01
ucgagcaugucgcug

SEQ ID NO: 1536427 - RNA, 17 nt, Pseudomonas aeruginosa PA01
ucgagcaguuccggcac

SEQ ID NO: 1536428 - RNA, 13 nt, Pseudomonas aeruginosa PA01
ucgagcaguucca

SEQ ID NO: 1536429 - RNA, 16 nt, Pseudomonas aeruginosa PA01
ucgagcaguuccaggc

SEQ ID NO: 1536430 - RNA, 15 nt, Pseudomonas aeruginosa PA01
ucgagccggcugaug

SEQ ID NO: 1536431 - RNA, 13 nt, Pseudomonas aeruginosa PA01
ucgagccguucca

SEQ ID NO: 1536432 - RNA, 12 nt, Pseudomonas aeruginosa PA01
ucgagcaggccg

SEQ ID NO: 1536433 - RNA, 14 nt, Pseudomonas aeruginosa PA01
ucgagacgccagcc

SEQ ID NO: 1536434 - RNA, 14 nt, Pseudomonas aeruginosa PA01
ucgagaaggcugcc

SEQ ID NO: 1536435 - RNA, 20 nt, Pseudomonas aeruginosa PA01
ucgaccugcggggcggauga

SEQ ID NO: 1536436 - RNA, 21 nt, Pseudomonas aeruginosa PA01
ucgacgaacaggaagcgcggg

SEQ ID NO: 1536437 - RNA, 22 nt, Pseudomonas aeruginosa PA01
ucgacgacgaaaggccgcgccg

SEQ ID NO: 1536438 - RNA, 19 nt, Pseudomonas aeruginosa PA01
ucgacgaucaggugcagga

SEQ ID NO: 1536439 - RNA, 13 nt, Pseudomonas aeruginosa PA01
ucgacggcuucca

SEQ ID NO: 1536440 - RNA, 17 nt, Pseudomonas aeruginosa PA01
ucgacguaccgccugcc

SEQ ID NO: 1536441 - RNA, 17 nt, Pseudomonas aeruginosa PA01
ucgacuucgcaccagcc

SEQ ID NO: 1536442 - RNA, 19 nt, Pseudomonas aeruginosa PA01
ucgacuuccgccuuguccu

SEQ ID NO: 1536443 - RNA, 23 nt, Pseudomonas aeruginosa PA01
ucgacuucuucgcuggaccaggc

SEQ ID NO: 1536444 - RNA, 13 nt, Pseudomonas aeruginosa PA01
ucgaccagccagu

SEQ ID NO: 1536445 - RNA, 15 nt, Pseudomonas aeruginosa PA01
ucgaccagcggcggu

SEQ ID NO: 1536446 - RNA, 18 nt, Pseudomonas aeruginosa PA01
ucgaccaucggcggcggc

SEQ ID NO: 1536447 - RNA, 16 nt, Pseudomonas aeruginosa PA01
ucgaccagcagcggcu

SEQ ID NO: 1536448 - RNA, 12 nt, Pseudomonas aeruginosa PA01
ucgaccacacau

SEQ ID NO: 1536449 - RNA, 19 nt, Pseudomonas aeruginosa PA01
ucgacagcgcggaucaguc

SEQ ID NO: 1536450 - RNA, 18 nt, Pseudomonas aeruginosa PA01
ucgacauaggacugccaa

SEQ ID NO: 1536451 - RNA, 18 nt, Pseudomonas aeruginosa PA01
ucgaagaagcgcaccacc

SEQ ID NO: 1536452 - RNA, 20 nt, Pseudomonas aeruginosa PA01
ucgaagaagcgcaccaccug

SEQ ID NO: 1536453 - RNA, 16 nt, Pseudomonas aeruginosa PA01
ucgaagaccagggugg

SEQ ID NO: 1536454 - RNA, 17 nt, Pseudomonas aeruginosa PA01
ucgaagaccaggguggg

SEQ ID NO: 1536455 - RNA, 14 nt, Pseudomonas aeruginosa PA01
ucgaaggcggcgcg

SEQ ID NO: 1536456 - RNA, 11 nt, Pseudomonas aeruginosa PA01
ucgaagcgauc

SEQ ID NO: 1536457 - RNA, 13 nt, Pseudomonas aeruginosa PA01
ucgaagcgcagca

SEQ ID NO: 1536458 - RNA, 18 nt, Pseudomonas aeruginosa PA01
ucgaagcagcccagcgcu

SEQ ID NO: 1536459 - RNA, 13 nt, Pseudomonas aeruginosa PA01
ucgcaggccaggc

SEQ ID NO: 1536460 - RNA, 22 nt, Pseudomonas aeruginosa PA01
ucgcaggccaggccccagggcc

SEQ ID NO: 1536461 - RNA, 21 nt, Pseudomonas aeruginosa PA01
ucgcaggccaggcgcagugcc

SEQ ID NO: 1536462 - RNA, 21 nt, Pseudomonas aeruginosa PA01
ucgcaggcgaaaaaaagcccc

SEQ ID NO: 1536463 - RNA, 18 nt, Pseudomonas aeruginosa PA01
ucgcagagacgcagcgcu

SEQ ID NO: 1536464 - RNA, 13 nt, Pseudomonas aeruginosa PA01
ucgcagcaggcgu

SEQ ID NO: 1536465 - RNA, 12 nt, Pseudomonas aeruginosa PA01
ucgcagcgcucc

SEQ ID NO: 1536466 - RNA, 18 nt, Pseudomonas aeruginosa PA01
ucgcagcguuccagcgcu

SEQ ID NO: 1536467 - RNA, 21 nt, Pseudomonas aeruginosa PA01
ucgcagcguuccagcgcuggc

SEQ ID NO: 1536468 - RNA, 11 nt, Pseudomonas aeruginosa PA01
ucgcagcucca

SEQ ID NO: 1536469 - RNA, 15 nt, Pseudomonas aeruginosa PA01
ucgccaccccgcucc

SEQ ID NO: 1536470 - RNA, 15 nt, Pseudomonas aeruginosa PA01
ucgccaccgcggauc

SEQ ID NO: 1536471 - RNA, 20 nt, Pseudomonas aeruginosa PA01
ucgccaccuguagcagggug

SEQ ID NO: 1536472 - RNA, 22 nt, Pseudomonas aeruginosa PA01
ucgccacgcaguucgcgggccg

SEQ ID NO: 1536473 - RNA, 18 nt, Pseudomonas aeruginosa PA01
ucgccacgccggcgcucc

SEQ ID NO: 1536474 - RNA, 14 nt, Pseudomonas aeruginosa PA01
ucgccacgcucucc

SEQ ID NO: 1536475 - RNA, 14 nt, Pseudomonas aeruginosa PA01
ucgccacgcugcug

SEQ ID NO: 1536476 - RNA, 22 nt, Pseudomonas aeruginosa PA01
ucgccacgcuucugcgccuccu

SEQ ID NO: 1536477 - RNA, 21 nt, Pseudomonas aeruginosa PA01
ucgccagcaauugccgcugca

SEQ ID NO: 1536478 - RNA, 15 nt, Pseudomonas aeruginosa PA01
ucgccagcaggcugu

SEQ ID NO: 1536479 - RNA, 11 nt, Pseudomonas aeruginosa PA01
ucgccagcaau

SEQ ID NO: 1536480 - RNA, 18 nt, Pseudomonas aeruginosa PA01
ucgccagcccgguucagc

SEQ ID NO: 1536481 - RNA, 12 nt, Pseudomonas aeruginosa PA01
ucgccagcgccu

SEQ ID NO: 1536482 - RNA, 21 nt, Pseudomonas aeruginosa PA01
ucgccagcgccuucgugacca

SEQ ID NO: 1536483 - RNA, 13 nt, Pseudomonas aeruginosa PA01
ucgccagcgccag

SEQ ID NO: 1536484 - RNA, 20 nt, Pseudomonas aeruginosa PA01
ucgccagcgccagcagguac

SEQ ID NO: 1536485 - RNA, 23 nt, Pseudomonas aeruginosa PA01
ucgccagcgccagcagguacagc

SEQ ID NO: 1536486 - RNA, 23 nt, Pseudomonas aeruginosa PA01
ucgccaggccguagaccaccagc

SEQ ID NO: 1536487 - RNA, 20 nt, Pseudomonas aeruginosa PA01
ucgagcgggcggucgucgcc

SEQ ID NO: 1536488 - RNA, 13 nt, Pseudomonas aeruginosa PA01
ucgagccuggcca

SEQ ID NO: 1536489 - RNA, 17 nt, Pseudomonas aeruginosa PA01
ucgaucagcagcgccac

SEQ ID NO: 1536490 - RNA, 19 nt, Pseudomonas aeruginosa PA01
ucgaucaggaacacccggu

SEQ ID NO: 1536491 - RNA, 17 nt, Pseudomonas aeruginosa PA01
ucgaucaggcgcaugcc

SEQ ID NO: 1536492 - RNA, 22 nt, Pseudomonas aeruginosa PA01
ucgaucaggcgcaugcccaggg

SEQ ID NO: 1536493 - RNA, 19 nt, Pseudomonas aeruginosa PA01
ucgaucagguaggcgccgu

SEQ ID NO: 1536494 - RNA, 23 nt, Pseudomonas aeruginosa PA01
ucgauccagccggcauccagcau

SEQ ID NO: 1536495 - RNA, 12 nt, Pseudomonas aeruginosa PA01
ucgaucccguca

SEQ ID NO: 1536496 - RNA, 22 nt, Pseudomonas aeruginosa PA01
ucgaugccgcgcgccuggcugg

SEQ ID NO: 1536497 - RNA, 21 nt, Pseudomonas aeruginosa PA01
ucgaugccaucgaggccaggc

SEQ ID NO: 1536498 - RNA, 15 nt, Pseudomonas aeruginosa PA01
ucgauccgaccuggg

SEQ ID NO: 1536499 - RNA, 16 nt, Pseudomonas aeruginosa PA01
ucgauccgcuccagca

SEQ ID NO: 1536500 - RNA, 15 nt, Pseudomonas aeruginosa PA01
ucgauccgcugggcc

SEQ ID NO: 1536501 - RNA, 20 nt, Pseudomonas aeruginosa PA01
ucgaugcgccucagcggccu

SEQ ID NO: 1536502 - RNA, 21 nt, Pseudomonas aeruginosa PA01
ucgaugguggaauccagggcc

SEQ ID NO: 1536503 - RNA, 19 nt, Pseudomonas aeruginosa PA01
ucgauguccugggccaccu

SEQ ID NO: 1536504 - RNA, 18 nt, Pseudomonas aeruginosa PA01
ucgaugucgaacaacccg

SEQ ID NO: 1536505 - RNA, 23 nt, Pseudomonas aeruginosa PA01
ucgaugucgcggcugaaggccga

SEQ ID NO: 1536506 - RNA, 13 nt, Pseudomonas aeruginosa PA01
ucgauggcguggg

SEQ ID NO: 1536507 - RNA, 20 nt, Pseudomonas aeruginosa PA01
ucgauggucuugaucccagg

SEQ ID NO: 1536508 - RNA, 18 nt, Pseudomonas aeruginosa PA01
ucgauggcggccugguag

SEQ ID NO: 1536509 - RNA, 21 nt, Pseudomonas aeruginosa PA01
uccugcaacgccuggugcagg

SEQ ID NO: 1536510 - RNA, 22 nt, Pseudomonas aeruginosa PA01
uccugcaacagggcauuggcca

SEQ ID NO: 1536511 - RNA, 23 nt, Pseudomonas aeruginosa PA01
uccugcaacagggcauuggccau

SEQ ID NO: 1536512 - RNA, 23 nt, Pseudomonas aeruginosa PA01
uccugccgccgauagggaaacac

SEQ ID NO: 1536513 - RNA, 12 nt, Pseudomonas aeruginosa PA01
uccugaggcucc

SEQ ID NO: 1536514 - RNA, 22 nt, Pseudomonas aeruginosa PA01
uccuggugcggcaccagccagg

SEQ ID NO: 1536515 - RNA, 15 nt, Pseudomonas aeruginosa PA01
uccugggugucguug

SEQ ID NO: 1536516 - RNA, 23 nt, Pseudomonas aeruginosa PA01
uccuggucgagcuuguuggccag

SEQ ID NO: 1536517 - RNA, 19 nt, Pseudomonas aeruginosa PA01
uccugggccaccuggcucu

SEQ ID NO: 1536518 - RNA, 20 nt, Pseudomonas aeruginosa PA01
uccuggguauagaccagcac

SEQ ID NO: 1536519 - RNA, 21 nt, Pseudomonas aeruginosa PA01
uccuggguauagaccagcacc

SEQ ID NO: 1536520 - RNA, 17 nt, Pseudomonas aeruginosa PA01
uccugggucgacugcug

SEQ ID NO: 1536521 - RNA, 22 nt, Pseudomonas aeruginosa PA01
uccugggucgacugcuggguac

SEQ ID NO: 1536522 - RNA, 20 nt, Pseudomonas aeruginosa PA01
uccugggucgcguacagcgg

SEQ ID NO: 1536523 - RNA, 15 nt, Pseudomonas aeruginosa PA01
uccugggccgguugc

SEQ ID NO: 1536524 - RNA, 17 nt, Pseudomonas aeruginosa PA01
uccugggccccggccag

SEQ ID NO: 1536525 - RNA, 19 nt, Pseudomonas aeruginosa PA01
uccugggccccggccaggu

SEQ ID NO: 1536526 - RNA, 22 nt, Pseudomonas aeruginosa PA01
uccugggcgugcuuggcgaggc

SEQ ID NO: 1536527 - RNA, 22 nt, Pseudomonas aeruginosa PA01
uccugggcuucguccgccuggg

SEQ ID NO: 1536528 - RNA, 20 nt, Pseudomonas aeruginosa PA01
uccuggggaaucugcgccag

SEQ ID NO: 1536529 - RNA, 14 nt, Pseudomonas aeruginosa PA01
uccuggcgcauguc

SEQ ID NO: 1536530 - RNA, 22 nt, Pseudomonas aeruginosa PA01
uccuggccggugacgaaaccgg

SEQ ID NO: 1536531 - RNA, 18 nt, Pseudomonas aeruginosa PA01
uccugcgcgccucuuccu

SEQ ID NO: 1536532 - RNA, 16 nt, Pseudomonas aeruginosa PA01
uccugcccguaccacg

SEQ ID NO: 1536533 - RNA, 13 nt, Pseudomonas aeruginosa PA01
uccugccgcggcg

SEQ ID NO: 1536534 - RNA, 15 nt, Pseudomonas aeruginosa PA01
uccugaccccggccu

SEQ ID NO: 1536535 - RNA, 21 nt, Pseudomonas aeruginosa PA01
uccucgccguacagcaggcag

SEQ ID NO: 1536536 - RNA, 21 nt, Pseudomonas aeruginosa PA01
uccucgaugaaacgcagggcc

SEQ ID NO: 1536537 - RNA, 18 nt, Pseudomonas aeruginosa PA01
uccucgauggugacguug

SEQ ID NO: 1536538 - RNA, 19 nt, Pseudomonas aeruginosa PA01
uccucgauggugacguugc

SEQ ID NO: 1536539 - RNA, 16 nt, Pseudomonas aeruginosa PA01
uccucgccucgcgcca

SEQ ID NO: 1536540 - RNA, 20 nt, Pseudomonas aeruginosa PA01
uccucgccguuggcgaggac

SEQ ID NO: 1536541 - RNA, 17 nt, Pseudomonas aeruginosa PA01
uccucggagagcagcca

SEQ ID NO: 1536542 - RNA, 14 nt, Pseudomonas aeruginosa PA01
uccucguccagcag

SEQ ID NO: 1536543 - RNA, 22 nt, Pseudomonas aeruginosa PA01
uccucuaccaggcgguuggccc

SEQ ID NO: 1536544 - RNA, 17 nt, Pseudomonas aeruginosa PA01
uccucggucuuuuucgc

SEQ ID NO: 1536545 - RNA, 22 nt, Pseudomonas aeruginosa PA01
uccucggcguagccggccaggg

SEQ ID NO: 1536546 - RNA, 18 nt, Pseudomonas aeruginosa PA01
uccucggggaagcgcggc

SEQ ID NO: 1536547 - RNA, 20 nt, Pseudomonas aeruginosa PA01
uccucggccaacggccgcuu

SEQ ID NO: 1536548 - RNA, 19 nt, Pseudomonas aeruginosa PA01
uccucaucuccuguggaua

SEQ ID NO: 1536549 - RNA, 19 nt, Pseudomonas aeruginosa PA01
uccucagccucacccugcu

SEQ ID NO: 1536550 - RNA, 18 nt, Pseudomonas aeruginosa PA01
uccucagugcgggcaguc

SEQ ID NO: 1536551 - RNA, 20 nt, Pseudomonas aeruginosa PA01
uccucagugcgggcaguccu

SEQ ID NO: 1536552 - RNA, 22 nt, Pseudomonas aeruginosa PA01
uccuccagagugcgcagcagcg

SEQ ID NO: 1536553 - RNA, 16 nt, Pseudomonas aeruginosa PA01
uccuccagcgccgcca

SEQ ID NO: 1536554 - RNA, 20 nt, Pseudomonas aeruginosa PA01
uccuccagcgccgccaggcg

SEQ ID NO: 1536555 - RNA, 14 nt, Pseudomonas aeruginosa PA01
uccuccaggcucag

SEQ ID NO: 1536556 - RNA, 18 nt, Pseudomonas aeruginosa PA01
uccuccagggugccgacc

SEQ ID NO: 1536557 - RNA, 17 nt, Pseudomonas aeruginosa PA01
uccuccagcaggaccug

SEQ ID NO: 1536558 - RNA, 21 nt, Pseudomonas aeruginosa PA01
uccuccagcaggaccuggccg

SEQ ID NO: 1536559 - RNA, 15 nt, Pseudomonas aeruginosa PA01
uccuccacccccgca

SEQ ID NO: 1536560 - RNA, 14 nt, Pseudomonas aeruginosa PA01
uccuccaaagccug

SEQ ID NO: 1536561 - RNA, 17 nt, Pseudomonas aeruginosa PA01
uccuccggacgccgaac

SEQ ID NO: 1536562 - RNA, 18 nt, Pseudomonas aeruginosa PA01
uccuccgcgacggaccgc

SEQ ID NO: 1536563 - RNA, 20 nt, Pseudomonas aeruginosa PA01
uccucccaugaaaaauggcc

SEQ ID NO: 1536564 - RNA, 19 nt, Pseudomonas aeruginosa PA01
uccuccucggcggcuuccu

SEQ ID NO: 1536565 - RNA, 11 nt, Pseudomonas aeruginosa PA01
uccuccuggau

SEQ ID NO: 1536566 - RNA, 15 nt, Pseudomonas aeruginosa PA01
uccuccuccaucucg

SEQ ID NO: 1536567 - RNA, 15 nt, Pseudomonas aeruginosa PA01
uccuccucgccgccg

SEQ ID NO: 1536568 - RNA, 21 nt, Pseudomonas aeruginosa PA01
uccuccucgcuccagaggaac

SEQ ID NO: 1536569 - RNA, 16 nt, Pseudomonas aeruginosa PA01
uccuacacgacccacc

SEQ ID NO: 1536570 - RNA, 20 nt, Pseudomonas aeruginosa PA01
uccuacgcgaccggucaggc

SEQ ID NO: 1536571 - RNA, 23 nt, Pseudomonas aeruginosa PA01
uccuacgcgaccggucaggcaau

SEQ ID NO: 1536572 - RNA, 17 nt, Pseudomonas aeruginosa PA01
uccguuguggcggcgcu

SEQ ID NO: 1536573 - RNA, 11 nt, Pseudomonas aeruginosa PA01
uccgucucagg

SEQ ID NO: 1536574 - RNA, 19 nt, Pseudomonas aeruginosa PA01
uccgugcuggccggcagca

SEQ ID NO: 1536575 - RNA, 20 nt, Pseudomonas aeruginosa PA01
uccgugcuggccggcagcag

SEQ ID NO: 1536576 - RNA, 21 nt, Pseudomonas aeruginosa PA01
uccggcagccagccgccgaag

SEQ ID NO: 1536577 - RNA, 17 nt, Pseudomonas aeruginosa PA01
uccggcagggccucggg

SEQ ID NO: 1536578 - RNA, 18 nt, Pseudomonas aeruginosa PA01
uccggcagguucagcagg

SEQ ID NO: 1536579 - RNA, 19 nt, Pseudomonas aeruginosa PA01
uccggcagguucagcaggu

SEQ ID NO: 1536580 - RNA, 15 nt, Pseudomonas aeruginosa PA01
uccggcagcaggguc

SEQ ID NO: 1536581 - RNA, 22 nt, Pseudomonas aeruginosa PA01
uccggcagcagggucagcagcg

SEQ ID NO: 1536582 - RNA, 15 nt, Pseudomonas aeruginosa PA01
uccggcacgcugccg

SEQ ID NO: 1536583 - RNA, 21 nt, Pseudomonas aeruginosa PA01
uccggcacgcugccgccgaug

SEQ ID NO: 1536584 - RNA, 15 nt, Pseudomonas aeruginosa PA01
uccggcaccaccacc

SEQ ID NO: 1536585 - RNA, 22 nt, Pseudomonas aeruginosa PA01
uccggauugguggucaccagcg

SEQ ID NO: 1536586 - RNA, 23 nt, Pseudomonas aeruginosa PA01
uccggcaacaguucugccgcaga

SEQ ID NO: 1536587 - RNA, 23 nt, Pseudomonas aeruginosa PA01
uccggaugcagauccagcggcag

SEQ ID NO: 1536588 - RNA, 19 nt, Pseudomonas aeruginosa PA01
uccggauacaugcugcuca

SEQ ID NO: 1536589 - RNA, 15 nt, Pseudomonas aeruginosa PA01
uccggcgcugagcga

SEQ ID NO: 1536590 - RNA, 14 nt, Pseudomonas aeruginosa PA01
uccggcgcggccug

SEQ ID NO: 1536591 - RNA, 21 nt, Pseudomonas aeruginosa PA01
uccggcgugguggcggggaac

SEQ ID NO: 1536592 - RNA, 23 nt, Pseudomonas aeruginosa PA01
uccggcguacgaaccccgggccg

SEQ ID NO: 1536593 - RNA, 18 nt, Pseudomonas aeruginosa PA01
uccggccggcggccugag

SEQ ID NO: 1536594 - RNA, 16 nt, Pseudomonas aeruginosa PA01
uccggcgagcacggcg

SEQ ID NO: 1536595 - RNA, 19 nt, Pseudomonas aeruginosa PA01
uccggcgcagcggaggauu

SEQ ID NO: 1536596 - RNA, 22 nt, Pseudomonas aeruginosa PA01
uccggcgcagcggaggauucag

SEQ ID NO: 1536597 - RNA, 21 nt, Pseudomonas aeruginosa PA01
uccggcgccaacugcuugccg

SEQ ID NO: 1536598 - RNA, 22 nt, Pseudomonas aeruginosa PA01
uccgggaaugcucagcacggcg

SEQ ID NO: 1536599 - RNA, 20 nt, Pseudomonas aeruginosa PA01
uccggcugucgacgcagccg

SEQ ID NO: 1536600 - RNA, 15 nt, Pseudomonas aeruginosa PA01
uccggcuugaccgcc

SEQ ID NO: 1536601 - RNA, 19 nt, Pseudomonas aeruginosa PA01
uccggcuugaccgccgccg

SEQ ID NO: 1536602 - RNA, 13 nt, Pseudomonas aeruginosa PA01
uccgggccgaggg

SEQ ID NO: 1536603 - RNA, 22 nt, Pseudomonas aeruginosa PA01
uccgggcacgcauagcgcgcug

SEQ ID NO: 1536604 - RNA, 19 nt, Pseudomonas aeruginosa PA01
uccgggagcaucuggcccg

SEQ ID NO: 1536605 - RNA, 16 nt, Pseudomonas aeruginosa PA01
uccggguugagcaccc

SEQ ID NO: 1536606 - RNA, 23 nt, Pseudomonas aeruginosa PA01
uccggguccaucugcaacgcggc

SEQ ID NO: 1536607 - RNA, 17 nt, Pseudomonas aeruginosa PA01
uccgggcguaacggcuc

SEQ ID NO: 1536608 - RNA, 17 nt, Pseudomonas aeruginosa PA01
uccgggcgugccaggag

SEQ ID NO: 1536609 - RNA, 22 nt, Pseudomonas aeruginosa PA01
uccgggcuggucguagcagcgg

SEQ ID NO: 1536610 - RNA, 19 nt, Pseudomonas aeruginosa PA01
uccggggcccggcaggcag

SEQ ID NO: 1536611 - RNA, 22 nt, Pseudomonas aeruginosa PA01
uccggggagauguccaucagcc

SEQ ID NO: 1536612 - RNA, 22 nt, Pseudomonas aeruginosa PA01
uccggggcgcuguuggccuggg

SEQ ID NO: 1536613 - RNA, 23 nt, Pseudomonas aeruginosa PA01
uccggggcgcuguuggccugggc

SEQ ID NO: 1536614 - RNA, 18 nt, Pseudomonas aeruginosa PA01
uccguacuggcgccaggc

SEQ ID NO: 1536615 - RNA, 13 nt, Pseudomonas aeruginosa PA01
uccgucacgcccu

SEQ ID NO: 1536616 - RNA, 16 nt, Pseudomonas aeruginosa PA01
uccggucacgcaggcg

SEQ ID NO: 1536617 - RNA, 14 nt, Pseudomonas aeruginosa PA01
uccggucagcagca

SEQ ID NO: 1536618 - RNA, 15 nt, Pseudomonas aeruginosa PA01
uccggucagcagcag

SEQ ID NO: 1536619 - RNA, 17 nt, Pseudomonas aeruginosa PA01
uccggucagcagcaggg

SEQ ID NO: 1536620 - RNA, 18 nt, Pseudomonas aeruginosa PA01
uccgguacugcugggccu

SEQ ID NO: 1536621 - RNA, 16 nt, Pseudomonas aeruginosa PA01
uccgguaggagcgaga

SEQ ID NO: 1536622 - RNA, 20 nt, Pseudomonas aeruginosa PA01
uccggucgcaccgccagcag

SEQ ID NO: 1536623 - RNA, 14 nt, Pseudomonas aeruginosa PA01
uccgcagcacagcc

SEQ ID NO: 1536624 - RNA, 21 nt, Pseudomonas aeruginosa PA01
uccgcagcgccacuuccagcu

SEQ ID NO: 1536625 - RNA, 22 nt, Pseudomonas aeruginosa PA01
uccgcagcgcuuuucaggaugu

SEQ ID NO: 1536626 - RNA, 20 nt, Pseudomonas aeruginosa PA01
uccgcaaggagcccuuuuca

SEQ ID NO: 1536627 - RNA, 23 nt, Pseudomonas aeruginosa PA01
uccgccguuccuccucgccgccg

SEQ ID NO: 1536628 - RNA, 16 nt, Pseudomonas aeruginosa PA01
uccgccgucgggcuuc

SEQ ID NO: 1536629 - RNA, 12 nt, Pseudomonas aeruginosa PA01
uccgccgggccg

SEQ ID NO: 1536630 - RNA, 16 nt, Pseudomonas aeruginosa PA01
uccgccggaaccugca

SEQ ID NO: 1536631 - RNA, 22 nt, Pseudomonas aeruginosa PA01
uccgccggacccugccguucgu

SEQ ID NO: 1536632 - RNA, 21 nt, Pseudomonas aeruginosa PA01
uccgccggcgaugcccaggcc

SEQ ID NO: 1536633 - RNA, 22 nt, Pseudomonas aeruginosa PA01
uccgccgaacgccaccagggcc

SEQ ID NO: 1536634 - RNA, 14 nt, Pseudomonas aeruginosa PA01
uccgccgcagacca

SEQ ID NO: 1536635 - RNA, 11 nt, Pseudomonas aeruginosa PA01
uccgccgaggu

SEQ ID NO: 1536636 - RNA, 16 nt, Pseudomonas aeruginosa PA01
uccgccgccgggcuuc

SEQ ID NO: 1536637 - RNA, 19 nt, Pseudomonas aeruginosa PA01
uccgccgcucacccugucc

SEQ ID NO: 1536638 - RNA, 21 nt, Pseudomonas aeruginosa PA01
uccgccgcucccggcuugcug

SEQ ID NO: 1536639 - RNA, 14 nt, Pseudomonas aeruginosa PA01
uccgccgcugggga

SEQ ID NO: 1536640 - RNA, 17 nt, Pseudomonas aeruginosa PA01
uccgccgcggcaaugcg

SEQ ID NO: 1536641 - RNA, 14 nt, Pseudomonas aeruginosa PA01
uccgccaggcggag

SEQ ID NO: 1536642 - RNA, 13 nt, Pseudomonas aeruginosa PA01
uccgccaguuccg

SEQ ID NO: 1536643 - RNA, 13 nt, Pseudomonas aeruginosa PA01
uccgccccacccc

SEQ ID NO: 1536644 - RNA, 16 nt, Pseudomonas aeruginosa PA01
uccgccccaccccagg

SEQ ID NO: 1536645 - RNA, 17 nt, Pseudomonas aeruginosa PA01
uccgccaggaccuccug

SEQ ID NO: 1536646 - RNA, 16 nt, Pseudomonas aeruginosa PA01
uccgccagcaggcguu

SEQ ID NO: 1536647 - RNA, 21 nt, Pseudomonas aeruginosa PA01
uccgccagcaccacccggccg

SEQ ID NO: 1536648 - RNA, 23 nt, Pseudomonas aeruginosa PA01
uccgcgauguccccggccagcag

SEQ ID NO: 1536649 - RNA, 14 nt, Pseudomonas aeruginosa PA01
uccgcggccggcuu

SEQ ID NO: 1536650 - RNA, 21 nt, Pseudomonas aeruginosa PA01
uccgcggcgacggcucuuccc

SEQ ID NO: 1536651 - RNA, 16 nt, Pseudomonas aeruginosa PA01
uccgcgcccaggcugc

SEQ ID NO: 1536652 - RNA, 15 nt, Pseudomonas aeruginosa PA01
uccgcggaucguccg

SEQ ID NO: 1536653 - RNA, 16 nt, Pseudomonas aeruginosa PA01
uccgcgggacgcggcg

SEQ ID NO: 1536654 - RNA, 19 nt, Pseudomonas aeruginosa PA01
uccgcgccgguggccagga

SEQ ID NO: 1536655 - RNA, 21 nt, Pseudomonas aeruginosa PA01
uccgcuuccacgcugaggcuc

SEQ ID NO: 1536656 - RNA, 21 nt, Pseudomonas aeruginosa PA01
uccgcguuaccguccgcgccg

SEQ ID NO: 1536657 - RNA, 12 nt, Pseudomonas aeruginosa PA01
uccgcgucccuu

SEQ ID NO: 1536658 - RNA, 18 nt, Pseudomonas aeruginosa PA01
uccgcugccguacagccc

SEQ ID NO: 1536659 - RNA, 17 nt, Pseudomonas aeruginosa PA01
uccgcucugcuggccac

SEQ ID NO: 1536660 - RNA, 18 nt, Pseudomonas aeruginosa PA01
uccgcucugcuggccacc

SEQ ID NO: 1536661 - RNA, 12 nt, Pseudomonas aeruginosa PA01
ucucaucccugu

SEQ ID NO: 1536662 - RNA, 22 nt, Pseudomonas aeruginosa PA01
ucucagcgccguugcggcagca

SEQ ID NO: 1536663 - RNA, 23 nt, Pseudomonas aeruginosa PA01
ucucaggaccuuccgccagcagg

SEQ ID NO: 1536664 - RNA, 17 nt, Pseudomonas aeruginosa PA01
ucuccggggcccggcag

SEQ ID NO: 1536665 - RNA, 20 nt, Pseudomonas aeruginosa PA01
ucuccggggcccggcaggca

SEQ ID NO: 1536666 - RNA, 20 nt, Pseudomonas aeruginosa PA01
ucuccccaaccuucucccuu

SEQ ID NO: 1536667 - RNA, 22 nt, Pseudomonas aeruginosa PA01
ucuccuggcgcgucaugccgcc

SEQ ID NO: 1536668 - RNA, 16 nt, Pseudomonas aeruginosa PA01
ucucaaagggcagcgg

SEQ ID NO: 1536669 - RNA, 23 nt, Pseudomonas aeruginosa PA01
ucuaucugcguaacguuacgcua

SEQ ID NO: 1536670 - RNA, 14 nt, Pseudomonas aeruginosa PA01
ucuaucgacaggau

SEQ ID NO: 1536671 - RNA, 13 nt, Pseudomonas aeruginosa PA01
ucuauaaugcgcc

SEQ ID NO: 1536672 - RNA, 14 nt, Pseudomonas aeruginosa PA01
ucuacuuaggcuca

SEQ ID NO: 1536673 - RNA, 13 nt, Pseudomonas aeruginosa PA01
ucuagcgcaggcg

SEQ ID NO: 1536674 - RNA, 18 nt, Pseudomonas aeruginosa PA01
ucguugcggaacgcggcu

SEQ ID NO: 1536675 - RNA, 16 nt, Pseudomonas aeruginosa PA01
ucguugaccacgcuca

SEQ ID NO: 1536676 - RNA, 19 nt, Pseudomonas aeruginosa PA01
ucguugcccggcuugccgu

SEQ ID NO: 1536677 - RNA, 14 nt, Pseudomonas aeruginosa PA01
ucgguuuccaggau

SEQ ID NO: 1536678 - RNA, 17 nt, Pseudomonas aeruginosa PA01
ucgguuuccggccaggc

SEQ ID NO: 1536679 - RNA, 12 nt, Pseudomonas aeruginosa PA01
ucgguuccagcu

SEQ ID NO: 1536680 - RNA, 12 nt, Pseudomonas aeruginosa PA01
ucgguugccgcg

SEQ ID NO: 1536681 - RNA, 17 nt, Pseudomonas aeruginosa PA01
ucgguugcggccugauc

SEQ ID NO: 1536682 - RNA, 23 nt, Pseudomonas aeruginosa PA01
ucggcagcucgcuaugcagcagg

SEQ ID NO: 1536683 - RNA, 18 nt, Pseudomonas aeruginosa PA01
ucggcagggcgcccgccc

SEQ ID NO: 1536684 - RNA, 18 nt, Pseudomonas aeruginosa PA01
ucggcaucgaccagggcc

SEQ ID NO: 1536685 - RNA, 17 nt, Pseudomonas aeruginosa PA01
ucggcauuggugcugcc

SEQ ID NO: 1536686 - RNA, 14 nt, Pseudomonas aeruginosa PA01
ucggcauggccacg

SEQ ID NO: 1536687 - RNA, 19 nt, Pseudomonas aeruginosa PA01
ucguagggcgucaguucca

SEQ ID NO: 1536688 - RNA, 15 nt, Pseudomonas aeruginosa PA01
ucguagccgcgcgcc

SEQ ID NO: 1536689 - RNA, 19 nt, Pseudomonas aeruginosa PA01
ucguagcggucgugcagca

SEQ ID NO: 1536690 - RNA, 22 nt, Pseudomonas aeruginosa PA01
ucguagcggucgugcagcagcg

SEQ ID NO: 1536691 - RNA, 21 nt, Pseudomonas aeruginosa PA01
ucguagaggcuguagcgcucc

SEQ ID NO: 1536692 - RNA, 15 nt, Pseudomonas aeruginosa PA01
ucgucacgcaggcuu

SEQ ID NO: 1536693 - RNA, 13 nt, Pseudomonas aeruginosa PA01
ucgucaaccagca

SEQ ID NO: 1536694 - RNA, 12 nt, Pseudomonas aeruginosa PA01
ucgugcagguag

SEQ ID NO: 1536695 - RNA, 18 nt, Pseudomonas aeruginosa PA01
ucgugcagcaagccgcag

SEQ ID NO: 1536696 - RNA, 13 nt, Pseudomonas aeruginosa PA01
ucgugccacaggc

SEQ ID NO: 1536697 - RNA, 16 nt, Pseudomonas aeruginosa PA01
ucgugcgaaaaccggu

SEQ ID NO: 1536698 - RNA, 21 nt, Pseudomonas aeruginosa PA01
ucgugcuugcagucgcggaag

SEQ ID NO: 1536699 - RNA, 14 nt, Pseudomonas aeruginosa PA01
ucguggaaggcuuc

SEQ ID NO: 1536700 - RNA, 12 nt, Pseudomonas aeruginosa PA01
ucguggccgcga

SEQ ID NO: 1536701 - RNA, 12 nt, Pseudomonas aeruginosa PA01
ucguggccgcgg

SEQ ID NO: 1536702 - RNA, 15 nt, Pseudomonas aeruginosa PA01
ucguggcggaagguc

SEQ ID NO: 1536703 - RNA, 13 nt, Pseudomonas aeruginosa PA01
ucgucuuucaggu

SEQ ID NO: 1536704 - RNA, 14 nt, Pseudomonas aeruginosa PA01
ucgucuggcgccug

SEQ ID NO: 1536705 - RNA, 16 nt, Pseudomonas aeruginosa PA01
ucgucuggcgccuggc

SEQ ID NO: 1536706 - RNA, 18 nt, Pseudomonas aeruginosa PA01
ucgucuggcgccuggccu

SEQ ID NO: 1536707 - RNA, 16 nt, Pseudomonas aeruginosa PA01
ucgucuuccagcggcc

SEQ ID NO: 1536708 - RNA, 13 nt, Pseudomonas aeruginosa PA01
ucgucuuccggag

SEQ ID NO: 1536709 - RNA, 17 nt, Pseudomonas aeruginosa PA01
ucgucaucguccagcuc

SEQ ID NO: 1536710 - RNA, 22 nt, Pseudomonas aeruginosa PA01
ucgucaucguccagcucggcca

SEQ ID NO: 1536711 - RNA, 22 nt, Pseudomonas aeruginosa PA01
ucgucgagcaugccgaggaacg

SEQ ID NO: 1536712 - RNA, 13 nt, Pseudomonas aeruginosa PA01
ucgucgaggcugu

SEQ ID NO: 1536713 - RNA, 19 nt, Pseudomonas aeruginosa PA01
ucuucccguaaggccaggc

SEQ ID NO: 1536714 - RNA, 21 nt, Pseudomonas aeruginosa PA01
ucuucccguaaggccaggcuc

SEQ ID NO: 1536715 - RNA, 22 nt, Pseudomonas aeruginosa PA01
ucuuccguugugauuggguucc

SEQ ID NO: 1536716 - RNA, 15 nt, Pseudomonas aeruginosa PA01
ucuuccuggccggga

SEQ ID NO: 1536717 - RNA, 15 nt, Pseudomonas aeruginosa PA01
ucuuccucgcugccu

SEQ ID NO: 1536718 - RNA, 17 nt, Pseudomonas aeruginosa PA01
ucuuccucgcugccuac

SEQ ID NO: 1536719 - RNA, 17 nt, Pseudomonas aeruginosa PA01
ucuuccgcgcugaccug

SEQ ID NO: 1536720 - RNA, 20 nt, Pseudomonas aeruginosa PA01
ucuucagucccucgucauca

SEQ ID NO: 1536721 - RNA, 14 nt, Pseudomonas aeruginosa PA01
ucuucagccugggg

SEQ ID NO: 1536722 - RNA, 21 nt, Pseudomonas aeruginosa PA01
ucuucaggcgugggccagccc

SEQ ID NO: 1536723 - RNA, 11 nt, Pseudomonas aeruginosa PA01
ucuuccuuguc

SEQ ID NO: 1536724 - RNA, 18 nt, Pseudomonas aeruginosa PA01
ucuucgcgugggccaggg

SEQ ID NO: 1536725 - RNA, 15 nt, Pseudomonas aeruginosa PA01
ucuucgccuugcccu

SEQ ID NO: 1536726 - RNA, 14 nt, Pseudomonas aeruginosa PA01
ucuucgccaguucc

SEQ ID NO: 1536727 - RNA, 18 nt, Pseudomonas aeruginosa PA01
ucuucgccauccuugagu

SEQ ID NO: 1536728 - RNA, 15 nt, Pseudomonas aeruginosa PA01
ucuucggccaguucg

SEQ ID NO: 1536729 - RNA, 22 nt, Pseudomonas aeruginosa PA01
ucuucggcggccagcggaugcu

SEQ ID NO: 1536730 - RNA, 23 nt, Pseudomonas aeruginosa PA01
ucuucggcggccagcggaugcug

SEQ ID NO: 1536731 - RNA, 16 nt, Pseudomonas aeruginosa PA01
ucuucggguagccaug

SEQ ID NO: 1536732 - RNA, 23 nt, Pseudomonas aeruginosa PA01
ucuucgggugucaacuggaucgu

SEQ ID NO: 1536733 - RNA, 22 nt, Pseudomonas aeruginosa PA01
ucuucguaaugcacgcucaugc

SEQ ID NO: 1536734 - RNA, 17 nt, Pseudomonas aeruginosa PA01
ucuuuaacaagucgaau

SEQ ID NO: 1536735 - RNA, 17 nt, Pseudomonas aeruginosa PA01
ucuugcccugccagcgg

SEQ ID NO: 1536736 - RNA, 17 nt, Pseudomonas aeruginosa PA01
ucuuguaguucaucuug

SEQ ID NO: 1536737 - RNA, 14 nt, Pseudomonas aeruginosa PA01
ucuugcgcauuuug

SEQ ID NO: 1536738 - RNA, 13 nt, Pseudomonas aeruginosa PA01
ucuugcgcaggcg

SEQ ID NO: 1536739 - RNA, 14 nt, Pseudomonas aeruginosa PA01
ucuugaucacuucc

SEQ ID NO: 1536740 - RNA, 16 nt, Pseudomonas aeruginosa PA01
ucuugaccuucugcac

SEQ ID NO: 1536741 - RNA, 17 nt, Pseudomonas aeruginosa PA01
ucuugaccuucugcacc

SEQ ID NO: 1536742 - RNA, 16 nt, Pseudomonas aeruginosa PA01
ucuucugguaggccag

SEQ ID NO: 1536743 - RNA, 18 nt, Pseudomonas aeruginosa PA01
ucucgaacagcagcaagc

SEQ ID NO: 1536744 - RNA, 13 nt, Pseudomonas aeruginosa PA01
ucucgaagaccag

SEQ ID NO: 1536745 - RNA, 16 nt, Pseudomonas aeruginosa PA01
ucucgaagaccagcgg

SEQ ID NO: 1536746 - RNA, 17 nt, Pseudomonas aeruginosa PA01
ucucgccagcccggcag

SEQ ID NO: 1536747 - RNA, 21 nt, Pseudomonas aeruginosa PA01
ucucgccgaugcccgggcguu

SEQ ID NO: 1536748 - RNA, 15 nt, Pseudomonas aeruginosa PA01
ucucgccucccggcu

SEQ ID NO: 1536749 - RNA, 16 nt, Pseudomonas aeruginosa PA01
ucucgcgacccuggcc

SEQ ID NO: 1536750 - RNA, 12 nt, Pseudomonas aeruginosa PA01
ucugccgcagac

SEQ ID NO: 1536751 - RNA, 16 nt, Pseudomonas aeruginosa PA01
ucugccgcagcgccuc

SEQ ID NO: 1536752 - RNA, 23 nt, Pseudomonas aeruginosa PA01
ucugccgcagcgccucccgggcc

SEQ ID NO: 1536753 - RNA, 14 nt, Pseudomonas aeruginosa PA01
ucugccucgccgag

SEQ ID NO: 1536754 - RNA, 21 nt, Pseudomonas aeruginosa PA01
ucugcgacgagccggacggcg

SEQ ID NO: 1536755 - RNA, 19 nt, Pseudomonas aeruginosa PA01
ucugcgacaucuccaggcc

SEQ ID NO: 1536756 - RNA, 15 nt, Pseudomonas aeruginosa PA01
ucugcgacaugccgg

SEQ ID NO: 1536757 - RNA, 20 nt, Pseudomonas aeruginosa PA01
ucugccgguaauuggccagg

SEQ ID NO: 1536758 - RNA, 16 nt, Pseudomonas aeruginosa PA01
ucugccagaaggccug

SEQ ID NO: 1536759 - RNA, 19 nt, Pseudomonas aeruginosa PA01
ucugcaugccguccgggug

SEQ ID NO: 1536760 - RNA, 23 nt, Pseudomonas aeruginosa PA01
ucugcauggcaccgucaagggcc

SEQ ID NO: 1536761 - RNA, 18 nt, Pseudomonas aeruginosa PA01
ucugcaggccgugccaga

SEQ ID NO: 1536762 - RNA, 19 nt, Pseudomonas aeruginosa PA01
ucugcaggacgaagucgcc

SEQ ID NO: 1536763 - RNA, 18 nt, Pseudomonas aeruginosa PA01
ucuguucgaccaguugcc

SEQ ID NO: 1536764 - RNA, 13 nt, Pseudomonas aeruginosa PA01
ucugugccgaggc

SEQ ID NO: 1536765 - RNA, 14 nt, Pseudomonas aeruginosa PA01
ucugguaggccagc

SEQ ID NO: 1536766 - RNA, 16 nt, Pseudomonas aeruginosa PA01
ucugguaggccagcag

SEQ ID NO: 1536767 - RNA, 21 nt, Pseudomonas aeruginosa PA01
ucugguagcgaaucugcaggg

SEQ ID NO: 1536768 - RNA, 16 nt, Pseudomonas aeruginosa PA01
ucugggcauggcuggc

SEQ ID NO: 1536769 - RNA, 19 nt, Pseudomonas aeruginosa PA01
ucugggcauggcuggcgcu

SEQ ID NO: 1536770 - RNA, 14 nt, Pseudomonas aeruginosa PA01
ucuggcgcagggag

SEQ ID NO: 1536771 - RNA, 23 nt, Pseudomonas aeruginosa PA01
ucuggggucaguucguugagggc

SEQ ID NO: 1536772 - RNA, 19 nt, Pseudomonas aeruginosa PA01
ucugggucgcgcagggcag

SEQ ID NO: 1536773 - RNA, 12 nt, Pseudomonas aeruginosa PA01
ucuggcccagcu

SEQ ID NO: 1536774 - RNA, 15 nt, Pseudomonas aeruginosa PA01
ucuggcccagcuuga

SEQ ID NO: 1536775 - RNA, 15 nt, Pseudomonas aeruginosa PA01
ucuggcccuuuuccu

SEQ ID NO: 1536776 - RNA, 17 nt, Pseudomonas aeruginosa PA01
ucuggaugcagccgggg

SEQ ID NO: 1536777 - RNA, 13 nt, Pseudomonas aeruginosa PA01
ucugcgccgcaag

SEQ ID NO: 1536778 - RNA, 15 nt, Pseudomonas aeruginosa PA01
ucugcgaucagggcc

SEQ ID NO: 1536779 - RNA, 20 nt, Pseudomonas aeruginosa PA01
ucugcugugcgucgagggcc

SEQ ID NO: 1536780 - RNA, 13 nt, Pseudomonas aeruginosa PA01
ucugcugguugag

SEQ ID NO: 1536781 - RNA, 18 nt, Pseudomonas aeruginosa PA01
ugggauagcuuuccaggg

SEQ ID NO: 1536782 - RNA, 14 nt, Pseudomonas aeruginosa PA01
uggcggaucugcuc

SEQ ID NO: 1536783 - RNA, 16 nt, Pseudomonas aeruginosa PA01
uggcggauaaccgcaa

SEQ ID NO: 1536784 - RNA, 14 nt, Pseudomonas aeruginosa PA01
ugggcagccacgaa

SEQ ID NO: 1536785 - RNA, 19 nt, Pseudomonas aeruginosa PA01
ugggcagcgugcaccagca

SEQ ID NO: 1536786 - RNA, 13 nt, Pseudomonas aeruginosa PA01
ugggcagcgccgc

SEQ ID NO: 1536787 - RNA, 19 nt, Pseudomonas aeruginosa PA01
ugggcaugcucggccaggu

SEQ ID NO: 1536788 - RNA, 13 nt, Pseudomonas aeruginosa PA01
ugggcauggcugg

SEQ ID NO: 1536789 - RNA, 17 nt, Pseudomonas aeruginosa PA01
ugggcagggugucgacg

SEQ ID NO: 1536790 - RNA, 21 nt, Pseudomonas aeruginosa PA01
ugggcaggauaucgcccaggg

SEQ ID NO: 1536791 - RNA, 21 nt, Pseudomonas aeruginosa PA01
ugggcaggcgcauguccagcc

SEQ ID NO: 1536792 - RNA, 18 nt, Pseudomonas aeruginosa PA01
ugggaugccgggccgagg

SEQ ID NO: 1536793 - RNA, 18 nt, Pseudomonas aeruginosa PA01
ugggauggccagccagga

SEQ ID NO: 1536794 - RNA, 15 nt, Pseudomonas aeruginosa PA01
ugggcaacaggccga

SEQ ID NO: 1536795 - RNA, 17 nt, Pseudomonas aeruginosa PA01
uggggcugcccaccacc

SEQ ID NO: 1536796 - RNA, 22 nt, Pseudomonas aeruginosa PA01
uggggcuauagcucagcuggga

SEQ ID NO: 1536797 - RNA, 15 nt, Pseudomonas aeruginosa PA01
uggguagccauggcg

SEQ ID NO: 1536798 - RNA, 14 nt, Pseudomonas aeruginosa PA01
uggguaggccaggc

SEQ ID NO: 1536799 - RNA, 19 nt, Pseudomonas aeruginosa PA01
ugggucagcgccagcaacc

SEQ ID NO: 1536800 - RNA, 21 nt, Pseudomonas aeruginosa PA01
ugggucagcggguuggcuucc

SEQ ID NO: 1536801 - RNA, 18 nt, Pseudomonas aeruginosa PA01
ugggucuggcgauucucc

SEQ ID NO: 1536802 - RNA, 16 nt, Pseudomonas aeruginosa PA01
ugggugaacagcggcc

SEQ ID NO: 1536803 - RNA, 17 nt, Pseudomonas aeruginosa PA01
ugggucuccuccuccau

SEQ ID NO: 1536804 - RNA, 13 nt, Pseudomonas aeruginosa PA01
ugggcgaccugcu

SEQ ID NO: 1536805 - RNA, 22 nt, Pseudomonas aeruginosa PA01
ugggcgaccuucagcgggucga

SEQ ID NO: 1536806 - RNA, 15 nt, Pseudomonas aeruginosa PA01
ugggcgaagucgacg

SEQ ID NO: 1536807 - RNA, 18 nt, Pseudomonas aeruginosa PA01
ugggcgaacagcacccag

SEQ ID NO: 1536808 - RNA, 15 nt, Pseudomonas aeruginosa PA01
ugggcguugcccaug

SEQ ID NO: 1536809 - RNA, 12 nt, Pseudomonas aeruginosa PA01
ugggcgaggcgc

SEQ ID NO: 1536810 - RNA, 11 nt, Pseudomonas aeruginosa PA01
ugggcucagau

SEQ ID NO: 1536811 - RNA, 22 nt, Pseudomonas aeruginosa PA01
uggucguucucgcgcaucgcgg

SEQ ID NO: 1536812 - RNA, 14 nt, Pseudomonas aeruginosa PA01
uggucuaauggcac

SEQ ID NO: 1536813 - RNA, 17 nt, Pseudomonas aeruginosa PA01
uggucguagcagguccg

SEQ ID NO: 1536814 - RNA, 14 nt, Pseudomonas aeruginosa PA01
uggucgcagcucca

SEQ ID NO: 1536815 - RNA, 15 nt, Pseudomonas aeruginosa PA01
ugguccugcggcggc

SEQ ID NO: 1536816 - RNA, 16 nt, Pseudomonas aeruginosa PA01
uggucgaaccagcuca

SEQ ID NO: 1536817 - RNA, 19 nt, Pseudomonas aeruginosa PA01
uggucaguucggcccagca

SEQ ID NO: 1536818 - RNA, 13 nt, Pseudomonas aeruginosa PA01
uggucggugaccc

SEQ ID NO: 1536819 - RNA, 18 nt, Pseudomonas aeruginosa PA01
uggucgagaaggcugccg

SEQ ID NO: 1536820 - RNA, 15 nt, Pseudomonas aeruginosa PA01
uggucgaccaggcgu

SEQ ID NO: 1536821 - RNA, 13 nt, Pseudomonas aeruginosa PA01
ugguggacggucu

SEQ ID NO: 1536822 - RNA, 22 nt, Pseudomonas aeruginosa PA01
ugguggacggucucgccgccga

SEQ ID NO: 1536823 - RNA, 23 nt, Pseudomonas aeruginosa PA01
uggucacgccguucagggucagg

SEQ ID NO: 1536824 - RNA, 18 nt, Pseudomonas aeruginosa PA01
uggucacuggcgaggcug

SEQ ID NO: 1536825 - RNA, 19 nt, Pseudomonas aeruginosa PA01
uggucacuggcgaggcugc

SEQ ID NO: 1536826 - RNA, 20 nt, Pseudomonas aeruginosa PA01
uggucaggucgacgccgccg

SEQ ID NO: 1536827 - RNA, 12 nt, Pseudomonas aeruginosa PA01
uggucagccagc

SEQ ID NO: 1536828 - RNA, 18 nt, Pseudomonas aeruginosa PA01
uggucagcaccagggcca

SEQ ID NO: 1536829 - RNA, 20 nt, Pseudomonas aeruginosa PA01
ugggugcuuuccugcuccag

SEQ ID NO: 1536830 - RNA, 14 nt, Pseudomonas aeruginosa PA01
uggguggaggccca

SEQ ID NO: 1536831 - RNA, 13 nt, Pseudomonas aeruginosa PA01
uggguucccagca

SEQ ID NO: 1536832 - RNA, 16 nt, Pseudomonas aeruginosa PA01
uggguucccagcagca

SEQ ID NO: 1536833 - RNA, 18 nt, Pseudomonas aeruginosa PA01
uggguucccagcagcaac

SEQ ID NO: 1536834 - RNA, 15 nt, Pseudomonas aeruginosa PA01
uggguucaggcucca

SEQ ID NO: 1536835 - RNA, 15 nt, Pseudomonas aeruginosa PA01
uguagaccaccagcg

SEQ ID NO: 1536836 - RNA, 23 nt, Pseudomonas aeruginosa PA01
uguagagcaggcugcuagguucu

SEQ ID NO: 1536837 - RNA, 17 nt, Pseudomonas aeruginosa PA01
uguagcgcuccuucucc

SEQ ID NO: 1536838 - RNA, 12 nt, Pseudomonas aeruginosa PA01
uguagcccaggg

SEQ ID NO: 1536839 - RNA, 21 nt, Pseudomonas aeruginosa PA01
uguagcugguguagaggcuca

SEQ ID NO: 1536840 - RNA, 21 nt, Pseudomonas aeruginosa PA01
uguaguacaugacgaagcgca

SEQ ID NO: 1536841 - RNA, 20 nt, Pseudomonas aeruginosa PA01
uguaguaggcgguggccacg

SEQ ID NO: 1536842 - RNA, 18 nt, Pseudomonas aeruginosa PA01
uguagucauggccaguca

SEQ ID NO: 1536843 - RNA, 18 nt, Pseudomonas aeruginosa PA01
uguaggcgagcagcggca

SEQ ID NO: 1536844 - RNA, 18 nt, Pseudomonas aeruginosa PA01
uguagggucgcagcaggc

SEQ ID NO: 1536845 - RNA, 17 nt, Pseudomonas aeruginosa PA01
uguaggccucggccugg

SEQ ID NO: 1536846 - RNA, 14 nt, Pseudomonas aeruginosa PA01
uguaggccaugauc

SEQ ID NO: 1536847 - RNA, 19 nt, Pseudomonas aeruginosa PA01
uguaccaccagcuugcguc

SEQ ID NO: 1536848 - RNA, 20 nt, Pseudomonas aeruginosa PA01
uguacugcucgguauggcug

SEQ ID NO: 1536849 - RNA, 14 nt, Pseudomonas aeruginosa PA01
uguaccgcucugca

SEQ ID NO: 1536850 - RNA, 16 nt, Pseudomonas aeruginosa PA01
uguacggcaccaccac

SEQ ID NO: 1536851 - RNA, 21 nt, Pseudomonas aeruginosa PA01
uggccgacccgcagcggcgcu

SEQ ID NO: 1536852 - RNA, 18 nt, Pseudomonas aeruginosa PA01
uggccgaccgccaggccg

SEQ ID NO: 1536853 - RNA, 14 nt, Pseudomonas aeruginosa PA01
uggccgacgcugag

SEQ ID NO: 1536854 - RNA, 24 nt, Pseudomonas aeruginosa PA01
uggccgaaauugaccagguacgga

SEQ ID NO: 1536855 - RNA, 19 nt, Pseudomonas aeruginosa PA01
uggccgagcgggaagcguu

SEQ ID NO: 1536856 - RNA, 22 nt, Pseudomonas aeruginosa PA01
uggccgagcgacuccgggaaca

SEQ ID NO: 1536857 - RNA, 20 nt, Pseudomonas aeruginosa PA01
uggccgagcgcgagugcagc

SEQ ID NO: 1536858 - RNA, 20 nt, Pseudomonas aeruginosa PA01
uggccgaacucaugcccagc

SEQ ID NO: 1536859 - RNA, 17 nt, Pseudomonas aeruginosa PA01
uggccgaaagcacugcg

SEQ ID NO: 1536860 - RNA, 22 nt, Pseudomonas aeruginosa PA01
uggcccugcaucgcgacagggc

SEQ ID NO: 1536861 - RNA, 16 nt, Pseudomonas aeruginosa PA01
uggcccucucucgccu

SEQ ID NO: 1536862 - RNA, 19 nt, Pseudomonas aeruginosa PA01
uggcccuggauaucugggc

SEQ ID NO: 1536863 - RNA, 16 nt, Pseudomonas aeruginosa PA01
uggcccuggccuuggc

SEQ ID NO: 1536864 - RNA, 17 nt, Pseudomonas aeruginosa PA01
uggcccuggcgcaggcg

SEQ ID NO: 1536865 - RNA, 20 nt, Pseudomonas aeruginosa PA01
uggcccuggcgcaggcggcg

SEQ ID NO: 1536866 - RNA, 19 nt, Pseudomonas aeruginosa PA01
uggcccugguacagcgccu

SEQ ID NO: 1536867 - RNA, 23 nt, Pseudomonas aeruginosa PA01
uggccgccucgcgccgcgccagc

SEQ ID NO: 1536868 - RNA, 18 nt, Pseudomonas aeruginosa PA01
uggccgcgaaccgggucg

SEQ ID NO: 1536869 - RNA, 22 nt, Pseudomonas aeruginosa PA01
uggccgccgccgccgucgacuu

SEQ ID NO: 1536870 - RNA, 13 nt, Pseudomonas aeruginosa PA01
uggccgcccuugc

SEQ ID NO: 1536871 - RNA, 14 nt, Pseudomonas aeruginosa PA01
uggccgcagcagcg

SEQ ID NO: 1536872 - RNA, 19 nt, Pseudomonas aeruginosa PA01
uggccgaucagcuuggccu

SEQ ID NO: 1536873 - RNA, 20 nt, Pseudomonas aeruginosa PA01
uggccgaucaccuggccauu

SEQ ID NO: 1536874 - RNA, 16 nt, Pseudomonas aeruginosa PA01
uggccgaucuccuggu

SEQ ID NO: 1536875 - RNA, 21 nt, Pseudomonas aeruginosa PA01
uggccaucagcgccgccucgc

SEQ ID NO: 1536876 - RNA, 16 nt, Pseudomonas aeruginosa PA01
uggccauccgcccugc

SEQ ID NO: 1536877 - RNA, 17 nt, Pseudomonas aeruginosa PA01
uggcccacggcgccuuc

SEQ ID NO: 1536878 - RNA, 15 nt, Pseudomonas aeruginosa PA01
uggcccagcuugaug

SEQ ID NO: 1536879 - RNA, 19 nt, Pseudomonas aeruginosa PA01
uggcccagaccuuggagcc

SEQ ID NO: 1536880 - RNA, 23 nt, Pseudomonas aeruginosa PA01
uggcccagaccuuggagccaugc

SEQ ID NO: 1536881 - RNA, 20 nt, Pseudomonas aeruginosa PA01
uggcccagauauccagggcc

SEQ ID NO: 1536882 - RNA, 21 nt, Pseudomonas aeruginosa PA01
uggcccagauauccagggcca

SEQ ID NO: 1536883 - RNA, 23 nt, Pseudomonas aeruginosa PA01
uggcccagauauccagggccagg

SEQ ID NO: 1536884 - RNA, 22 nt, Pseudomonas aeruginosa PA01
uggcccagaugaucaggccgag

SEQ ID NO: 1536885 - RNA, 14 nt, Pseudomonas aeruginosa PA01
uggccccagcgcga

SEQ ID NO: 1536886 - RNA, 17 nt, Pseudomonas aeruginosa PA01
uggcccaguugcccggc

SEQ ID NO: 1536887 - RNA, 19 nt, Pseudomonas aeruginosa PA01
uggcccccacggaggccuu

SEQ ID NO: 1536888 - RNA, 15 nt, Pseudomonas aeruginosa PA01
uggccccggcgaucc

SEQ ID NO: 1536889 - RNA, 15 nt, Pseudomonas aeruginosa PA01
uggccccgccgagga

SEQ ID NO: 1536890 - RNA, 19 nt, Pseudomonas aeruginosa PA01
uggcauccccuuuuuucag

SEQ ID NO: 1536891 - RNA, 14 nt, Pseudomonas aeruginosa PA01
uggcaugggccagu

SEQ ID NO: 1536892 - RNA, 17 nt, Pseudomonas aeruginosa PA01
uggccagcccggagccg

SEQ ID NO: 1536893 - RNA, 23 nt, Pseudomonas aeruginosa PA01
uggccagcccuuucagcggcugc

SEQ ID NO: 1536894 - RNA, 12 nt, Pseudomonas aeruginosa PA01
uggccagcgcgu

SEQ ID NO: 1536895 - RNA, 21 nt, Pseudomonas aeruginosa PA01
uggccagcaccagucccuggc

SEQ ID NO: 1536896 - RNA, 23 nt, Pseudomonas aeruginosa PA01
uggccagcaccagucccuggccg

SEQ ID NO: 1536897 - RNA, 15 nt, Pseudomonas aeruginosa PA01
uggccagcagcaucg

SEQ ID NO: 1536898 - RNA, 19 nt, Pseudomonas aeruginosa PA01
uggccagcaggcuggcggc

SEQ ID NO: 1536899 - RNA, 15 nt, Pseudomonas aeruginosa PA01
uggccauagagccgc

SEQ ID NO: 1536900 - RNA, 18 nt, Pseudomonas aeruginosa PA01
uggccaggcgcuccucca

SEQ ID NO: 1536901 - RNA, 15 nt, Pseudomonas aeruginosa PA01
uggccagcucgaccu

SEQ ID NO: 1536902 - RNA, 21 nt, Pseudomonas aeruginosa PA01
uggccagcucgaccuugcccu

SEQ ID NO: 1536903 - RNA, 17 nt, Pseudomonas aeruginosa PA01
uggccacgucgccccag

SEQ ID NO: 1536904 - RNA, 22 nt, Pseudomonas aeruginosa PA01
uggccaccgcggcguccgcguc

SEQ ID NO: 1536905 - RNA, 17 nt, Pseudomonas aeruginosa PA01
uggccacgacccugcug

SEQ ID NO: 1536906 - RNA, 15 nt, Pseudomonas aeruginosa PA01
uggccaccagcaccu

SEQ ID NO: 1536907 - RNA, 14 nt, Pseudomonas aeruginosa PA01
uggccacccuugcg

SEQ ID NO: 1536908 - RNA, 15 nt, Pseudomonas aeruginosa PA01
uggccgcugagcagc

SEQ ID NO: 1536909 - RNA, 13 nt, Pseudomonas aeruginosa PA01
uggccggaaaaag

SEQ ID NO: 1536910 - RNA, 18 nt, Pseudomonas aeruginosa PA01
uggccgcuucaagcggcc

SEQ ID NO: 1536911 - RNA, 14 nt, Pseudomonas aeruginosa PA01
uggccggcaccagc

SEQ ID NO: 1536912 - RNA, 23 nt, Pseudomonas aeruginosa PA01
uggccggcaccagcaguagugcg

SEQ ID NO: 1536913 - RNA, 15 nt, Pseudomonas aeruginosa PA01
uggccggcagcagcg

SEQ ID NO: 1536914 - RNA, 18 nt, Pseudomonas aeruginosa PA01
uggccggcagcagcgcca

SEQ ID NO: 1536915 - RNA, 13 nt, Pseudomonas aeruginosa PA01
uggccgcguacca

SEQ ID NO: 1536916 - RNA, 13 nt, Pseudomonas aeruginosa PA01
uggccgcgcccca

SEQ ID NO: 1536917 - RNA, 18 nt, Pseudomonas aeruginosa PA01
uggccgcgcaggaagaag

SEQ ID NO: 1536918 - RNA, 22 nt, Pseudomonas aeruginosa PA01
uggccgcggugggcuccagcgg

SEQ ID NO: 1536919 - RNA, 17 nt, Pseudomonas aeruginosa PA01
uggccgcgggaggccgc

SEQ ID NO: 1536920 - RNA, 22 nt, Pseudomonas aeruginosa PA01
uggccgcgggaggccgccucga

SEQ ID NO: 1536921 - RNA, 18 nt, Pseudomonas aeruginosa PA01
uggccgcgcggcuugccg

SEQ ID NO: 1536922 - RNA, 13 nt, Pseudomonas aeruginosa PA01
uggccgucgaccc

SEQ ID NO: 1536923 - RNA, 19 nt, Pseudomonas aeruginosa PA01
uggccgucgacccgccuca

SEQ ID NO: 1536924 - RNA, 14 nt, Pseudomonas aeruginosa PA01
uggccgucgcgccg

SEQ ID NO: 1536925 - RNA, 17 nt, Pseudomonas aeruginosa PA01
uggccgucuuccagggc

SEQ ID NO: 1536926 - RNA, 16 nt, Pseudomonas aeruginosa PA01
uggccgugcagcccuc

SEQ ID NO: 1536927 - RNA, 21 nt, Pseudomonas aeruginosa PA01
uggccgucuccaggcgcgccg

SEQ ID NO: 1536928 - RNA, 22 nt, Pseudomonas aeruginosa PA01
uggccguggcgccccaggcggg

SEQ ID NO: 1536929 - RNA, 19 nt, Pseudomonas aeruginosa PA01
uggccggugccgcccuggg

SEQ ID NO: 1536930 - RNA, 14 nt, Pseudomonas aeruginosa PA01
uggccgucccugac

SEQ ID NO: 1536931 - RNA, 16 nt, Pseudomonas aeruginosa PA01
uggccgucccugacca

SEQ ID NO: 1536932 - RNA, 18 nt, Pseudomonas aeruginosa PA01
uggccgucccugaccagc

SEQ ID NO: 1536933 - RNA, 19 nt, Pseudomonas aeruginosa PA01
uggccggcugcuccgggcg

SEQ ID NO: 1536934 - RNA, 22 nt, Pseudomonas aeruginosa PA01
uggccggcgaccuuguccaggc

SEQ ID NO: 1536935 - RNA, 15 nt, Pseudomonas aeruginosa PA01
uggccgggaaccagc

SEQ ID NO: 1536936 - RNA, 16 nt, Pseudomonas aeruginosa PA01
uggccgggaaccagca

SEQ ID NO: 1536937 - RNA, 22 nt, Pseudomonas aeruginosa PA01
uggccgggaaccagcauguccu

SEQ ID NO: 1536938 - RNA, 14 nt, Pseudomonas aeruginosa PA01
uggcgaacagcacc

SEQ ID NO: 1536939 - RNA, 15 nt, Pseudomonas aeruginosa PA01
uggcgaacagcaccu

SEQ ID NO: 1536940 - RNA, 16 nt, Pseudomonas aeruginosa PA01
uggcgaaacuccagca

SEQ ID NO: 1536941 - RNA, 17 nt, Pseudomonas aeruginosa PA01
uggccuggcgcucagcg

SEQ ID NO: 1536942 - RNA, 14 nt, Pseudomonas aeruginosa PA01
uggccguucuccag

SEQ ID NO: 1536943 - RNA, 19 nt, Pseudomonas aeruginosa PA01
uggccguugaccagcgcgu

SEQ ID NO: 1536944 - RNA, 18 nt, Pseudomonas aeruginosa PA01
uggccuccggacgcugca

SEQ ID NO: 1536945 - RNA, 21 nt, Pseudomonas aeruginosa PA01
uggcgagggcgucccgcugcg

SEQ ID NO: 1536946 - RNA, 11 nt, Pseudomonas aeruginosa PA01
uggcgaggacg

SEQ ID NO: 1536947 - RNA, 19 nt, Pseudomonas aeruginosa PA01
uggcgaucaggcagcgcgc

SEQ ID NO: 1536948 - RNA, 14 nt, Pseudomonas aeruginosa PA01
uggcgaucaugccu

SEQ ID NO: 1536949 - RNA, 15 nt, Pseudomonas aeruginosa PA01
uggcgaucuccggga

SEQ ID NO: 1536950 - RNA, 19 nt, Pseudomonas aeruginosa PA01
uggcgaugaucuggccacc

SEQ ID NO: 1536951 - RNA, 15 nt, Pseudomonas aeruginosa PA01
uggcgaugcccuggc

SEQ ID NO: 1536952 - RNA, 15 nt, Pseudomonas aeruginosa PA01
uggcgaacgcccggc

SEQ ID NO: 1536953 - RNA, 15 nt, Pseudomonas aeruginosa PA01
uggcgaagcuggggc

SEQ ID NO: 1536954 - RNA, 17 nt, Pseudomonas aeruginosa PA01
uggcgaagcuggggcug

SEQ ID NO: 1536955 - RNA, 17 nt, Pseudomonas aeruginosa PA01
uggcgacgaagacgcug

SEQ ID NO: 1536956 - RNA, 22 nt, Pseudomonas aeruginosa PA01
uggcgacgccggucgggcacuu

SEQ ID NO: 1536957 - RNA, 21 nt, Pseudomonas aeruginosa PA01
uggcgaccaggacagcacgcu

SEQ ID NO: 1536958 - RNA, 19 nt, Pseudomonas aeruginosa PA01
uggcgacgucccuuccccg

SEQ ID NO: 1536959 - RNA, 16 nt, Pseudomonas aeruginosa PA01
uggcgacgcgcaggcc

SEQ ID NO: 1536960 - RNA, 22 nt, Pseudomonas aeruginosa PA01
uggcgauguagcugccggcguc

SEQ ID NO: 1536961 - RNA, 21 nt, Pseudomonas aeruginosa PA01
uggcgauguucaccgcggccu

SEQ ID NO: 1536962 - RNA, 16 nt, Pseudomonas aeruginosa PA01
uggcgccacucggcgu

SEQ ID NO: 1536963 - RNA, 15 nt, Pseudomonas aeruginosa PA01
uggcgccagccagcc

SEQ ID NO: 1536964 - RNA, 13 nt, Pseudomonas aeruginosa PA01
uggcgccaggccg

SEQ ID NO: 1536965 - RNA, 16 nt, Pseudomonas aeruginosa PA01
uggcgcaggccgggcg

SEQ ID NO: 1536966 - RNA, 13 nt, Pseudomonas aeruginosa PA01
uggcgcagcggca

SEQ ID NO: 1536967 - RNA, 20 nt, Pseudomonas aeruginosa PA01
uggcgcagcggcagcgccag

SEQ ID NO: 1536968 - RNA, 13 nt, Pseudomonas aeruginosa PA01
uggcgcagggcgu

SEQ ID NO: 1536969 - RNA, 14 nt, Pseudomonas aeruginosa PA01
uggcgcagguagaa

SEQ ID NO: 1536970 - RNA, 15 nt, Pseudomonas aeruginosa PA01
uggcgcagccaggcg

SEQ ID NO: 1536971 - RNA, 15 nt, Pseudomonas aeruginosa PA01
uggcgcagccgcugg

SEQ ID NO: 1536972 - RNA, 21 nt, Pseudomonas aeruginosa PA01
uggcgcagccgcugggccacg

SEQ ID NO: 1536973 - RNA, 16 nt, Pseudomonas aeruginosa PA01
uggcgcagcagcaggu

SEQ ID NO: 1536974 - RNA, 15 nt, Pseudomonas aeruginosa PA01
uggcgcagacaggcc

SEQ ID NO: 1536975 - RNA, 19 nt, Pseudomonas aeruginosa PA01
uggcgcagacaggccucca

SEQ ID NO: 1536976 - RNA, 20 nt, Pseudomonas aeruginosa PA01
uggcgcagacaggccuccag

SEQ ID NO: 1536977 - RNA, 14 nt, Pseudomonas aeruginosa PA01
uggcgccgagcagc

SEQ ID NO: 1536978 - RNA, 12 nt, Pseudomonas aeruginosa PA01
uggcgccgaugc

SEQ ID NO: 1536979 - RNA, 16 nt, Pseudomonas aeruginosa PA01
uggcgccgaugcugua

SEQ ID NO: 1536980 - RNA, 19 nt, Pseudomonas aeruginosa PA01
uggcgcaugaggccugguc

SEQ ID NO: 1536981 - RNA, 20 nt, Pseudomonas aeruginosa PA01
uggcgcccaugccgcccggc

SEQ ID NO: 1536982 - RNA, 12 nt, Pseudomonas aeruginosa PA01
uggcgcccagcc

SEQ ID NO: 1536983 - RNA, 17 nt, Pseudomonas aeruginosa PA01
uggcgccggcugacgcu

SEQ ID NO: 1536984 - RNA, 15 nt, Pseudomonas aeruginosa PA01
uggcgccggcgcgcu

SEQ ID NO: 1536985 - RNA, 13 nt, Pseudomonas aeruginosa PA01
uggcgccuggccu

SEQ ID NO: 1536986 - RNA, 21 nt, Pseudomonas aeruginosa PA01
uggagcagaacuugcgcaccg

SEQ ID NO: 1536987 - RNA, 23 nt, Pseudomonas aeruginosa PA01
uggagccgcccucggggccgagg

SEQ ID NO: 1536988 - RNA, 17 nt, Pseudomonas aeruginosa PA01
uggaggcgggcucacau

SEQ ID NO: 1536989 - RNA, 21 nt, Pseudomonas aeruginosa PA01
uggaggaucuccaacuggcgg

SEQ ID NO: 1536990 - RNA, 18 nt, Pseudomonas aeruginosa PA01
uggagaaugaaaaaggga

SEQ ID NO: 1536991 - RNA, 18 nt, Pseudomonas aeruginosa PA01
uggacggucucgccgccg

SEQ ID NO: 1536992 - RNA, 12 nt, Pseudomonas aeruginosa PA01
uggacgguuccc

SEQ ID NO: 1536993 - RNA, 13 nt, Pseudomonas aeruginosa PA01
uggacgcggccug

SEQ ID NO: 1536994 - RNA, 15 nt, Pseudomonas aeruginosa PA01
uggacgcggccuggg

SEQ ID NO: 1536995 - RNA, 18 nt, Pseudomonas aeruginosa PA01
uggacgcggccugggccg

SEQ ID NO: 1536996 - RNA, 17 nt, Pseudomonas aeruginosa PA01
uggacgugggaaaucac

SEQ ID NO: 1536997 - RNA, 16 nt, Pseudomonas aeruginosa PA01
uggauacgcucggcca

SEQ ID NO: 1536998 - RNA, 19 nt, Pseudomonas aeruginosa PA01
uggauagaguacucggcua

SEQ ID NO: 1536999 - RNA, 13 nt, Pseudomonas aeruginosa PA01
uggaguugugcca

SEQ ID NO: 1537000 - RNA, 14 nt, Pseudomonas aeruginosa PA01
uggauaaaaaggcc

SEQ ID NO: 1537001 - RNA, 21 nt, Pseudomonas aeruginosa PA01
uggaucgcccggcugcacagg

SEQ ID NO: 1537002 - RNA, 18 nt, Pseudomonas aeruginosa PA01
uggaucggcaacuggcug

SEQ ID NO: 1537003 - RNA, 19 nt, Pseudomonas aeruginosa PA01
uggaucugguggaacagca

SEQ ID NO: 1537004 - RNA, 12 nt, Pseudomonas aeruginosa PA01
uggaucucugcg

SEQ ID NO: 1537005 - RNA, 16 nt, Pseudomonas aeruginosa PA01
uggaucagcgccucga

SEQ ID NO: 1537006 - RNA, 15 nt, Pseudomonas aeruginosa PA01
uggaucacguaggac

SEQ ID NO: 1537007 - RNA, 17 nt, Pseudomonas aeruginosa PA01
uggaugaacagcggaau

SEQ ID NO: 1537008 - RNA, 18 nt, Pseudomonas aeruginosa PA01
uggaugucgcuggccagc

SEQ ID NO: 1537009 - RNA, 16 nt, Pseudomonas aeruginosa PA01
uggcaguccagggcgg

SEQ ID NO: 1537010 - RNA, 13 nt, Pseudomonas aeruginosa PA01
uggcaggcgcugc

SEQ ID NO: 1537011 - RNA, 17 nt, Pseudomonas aeruginosa PA01
uggcaggcucaccgcgu

SEQ ID NO: 1537012 - RNA, 21 nt, Pseudomonas aeruginosa PA01
uggcagggcgcguccagcucc

SEQ ID NO: 1537013 - RNA, 22 nt, Pseudomonas aeruginosa PA01
uggcagggcgcguccagcucca

SEQ ID NO: 1537014 - RNA, 13 nt, Pseudomonas aeruginosa PA01
uggcagcaggcac

SEQ ID NO: 1537015 - RNA, 20 nt, Pseudomonas aeruginosa PA01
uggcacguacguccagggca

SEQ ID NO: 1537016 - RNA, 21 nt, Pseudomonas aeruginosa PA01
uggcacgaacccaggcgcugc

SEQ ID NO: 1537017 - RNA, 22 nt, Pseudomonas aeruginosa PA01
uggcacgacgcucggacagcuu

SEQ ID NO: 1537018 - RNA, 12 nt, Pseudomonas aeruginosa PA01
uggcaagccucg

SEQ ID NO: 1537019 - RNA, 17 nt, Pseudomonas aeruginosa PA01
uggauuucagcaggccg

SEQ ID NO: 1537020 - RNA, 18 nt, Pseudomonas aeruginosa PA01
uggauuucagcaggccga

SEQ ID NO: 1537021 - RNA, 13 nt, Pseudomonas aeruginosa PA01
uguuucagcgggu

SEQ ID NO: 1537022 - RNA, 22 nt, Pseudomonas aeruginosa PA01
uguuucagcggguagcugcugg

SEQ ID NO: 1537023 - RNA, 15 nt, Pseudomonas aeruginosa PA01
uguucaccgcggccu

SEQ ID NO: 1537024 - RNA, 18 nt, Pseudomonas aeruginosa PA01
uguucgaaggccaguccg

SEQ ID NO: 1537025 - RNA, 14 nt, Pseudomonas aeruginosa PA01
uguuccuccgccag

SEQ ID NO: 1537026 - RNA, 22 nt, Pseudomonas aeruginosa PA01
uguuccggcuggacgugcagga

SEQ ID NO: 1537027 - RNA, 11 nt, Pseudomonas aeruginosa PA01
uguuccagcaa

SEQ ID NO: 1537028 - RNA, 15 nt, Pseudomonas aeruginosa PA01
uguugcaggcuggga

SEQ ID NO: 1537029 - RNA, 12 nt, Pseudomonas aeruginosa PA01
uguugccaggga

SEQ ID NO: 1537030 - RNA, 17 nt, Pseudomonas aeruginosa PA01
uguuggccaaccaggaa

SEQ ID NO: 1537031 - RNA, 22 nt, Pseudomonas aeruginosa PA01
uguucucuacgccguaggccac

SEQ ID NO: 1537032 - RNA, 19 nt, Pseudomonas aeruginosa PA01
uguuguugccggucuugcc

SEQ ID NO: 1537033 - RNA, 13 nt, Pseudomonas aeruginosa PA01
uguuggccagcag

SEQ ID NO: 1537034 - RNA, 18 nt, Pseudomonas aeruginosa PA01
uguuggccagcagccagg

SEQ ID NO: 1537035 - RNA, 13 nt, Pseudomonas aeruginosa PA01
ugugcaccagcaa

SEQ ID NO: 1537036 - RNA, 14 nt, Pseudomonas aeruginosa PA01
ugugcgccaggccg

SEQ ID NO: 1537037 - RNA, 17 nt, Pseudomonas aeruginosa PA01
ugugcgcugcaucggcg

SEQ ID NO: 1537038 - RNA, 17 nt, Pseudomonas aeruginosa PA01
ugugccgucaggcaccu

SEQ ID NO: 1537039 - RNA, 17 nt, Pseudomonas aeruginosa PA01
ugugcgagacccccggg

SEQ ID NO: 1537040 - RNA, 18 nt, Pseudomonas aeruginosa PA01
ugugaccgagauucugca

SEQ ID NO: 1537041 - RNA, 22 nt, Pseudomonas aeruginosa PA01
ugugcuccuugacccucugguu

SEQ ID NO: 1537042 - RNA, 20 nt, Pseudomonas aeruginosa PA01
uguggguauccagcggccgc

SEQ ID NO: 1537043 - RNA, 19 nt, Pseudomonas aeruginosa PA01
uguggcgcagcaucaucuc

SEQ ID NO: 1537044 - RNA, 13 nt, Pseudomonas aeruginosa PA01
uguggcugcaggu

SEQ ID NO: 1537045 - RNA, 18 nt, Pseudomonas aeruginosa PA01
uguggcuggugaugccgc

SEQ ID NO: 1537046 - RNA, 21 nt, Pseudomonas aeruginosa PA01
uguguccgccgaggugcugca

SEQ ID NO: 1537047 - RNA, 23 nt, Pseudomonas aeruginosa PA01
uuacgaaacggcgcgucuccaug

SEQ ID NO: 1537048 - RNA, 16 nt, Pseudomonas aeruginosa PA01
uuacuuggcuucagcu

SEQ ID NO: 1537049 - RNA, 22 nt, Pseudomonas aeruginosa PA01
uuaguuaucacaaccuuucgga

SEQ ID NO: 1537050 - RNA, 19 nt, Pseudomonas aeruginosa PA01
ugcugggucacguggccgc

SEQ ID NO: 1537051 - RNA, 15 nt, Pseudomonas aeruginosa PA01
ugcugguagggcuuc

SEQ ID NO: 1537052 - RNA, 22 nt, Pseudomonas aeruginosa PA01
ugcugguggcccugggcggcga

SEQ ID NO: 1537053 - RNA, 12 nt, Pseudomonas aeruginosa PA01
ugcuggccaccc

SEQ ID NO: 1537054 - RNA, 14 nt, Pseudomonas aeruginosa PA01
ugcuggccacccuu

SEQ ID NO: 1537055 - RNA, 12 nt, Pseudomonas aeruginosa PA01
ugcuggccgcgc

SEQ ID NO: 1537056 - RNA, 20 nt, Pseudomonas aeruginosa PA01
ugcuggccgcgcaggaagaa

SEQ ID NO: 1537057 - RNA, 14 nt, Pseudomonas aeruginosa PA01
ugcuggccggugcc

SEQ ID NO: 1537058 - RNA, 13 nt, Pseudomonas aeruginosa PA01
ugcuggccuggga

SEQ ID NO: 1537059 - RNA, 14 nt, Pseudomonas aeruginosa PA01
ugcuggcgaucauc

SEQ ID NO: 1537060 - RNA, 17 nt, Pseudomonas aeruginosa PA01
ugcuggguacgguuggc

SEQ ID NO: 1537061 - RNA, 23 nt, Pseudomonas aeruginosa PA01
ugcuggguacgguuggccagcga

SEQ ID NO: 1537062 - RNA, 12 nt, Pseudomonas aeruginosa PA01
ugcugugcucuu

SEQ ID NO: 1537063 - RNA, 22 nt, Pseudomonas aeruginosa PA01
ugcugugcagggaggcauugca

SEQ ID NO: 1537064 - RNA, 13 nt, Pseudomonas aeruginosa PA01
ugcugucccaacc

SEQ ID NO: 1537065 - RNA, 14 nt, Pseudomonas aeruginosa PA01
ugcugcgcgccgca

SEQ ID NO: 1537066 - RNA, 19 nt, Pseudomonas aeruginosa PA01
ugcugcgccggcacggcau

SEQ ID NO: 1537067 - RNA, 14 nt, Pseudomonas aeruginosa PA01
ugcugcgccuggcc

SEQ ID NO: 1537068 - RNA, 15 nt, Pseudomonas aeruginosa PA01
ugcugcgccuggccg

SEQ ID NO: 1537069 - RNA, 15 nt, Pseudomonas aeruginosa PA01
ugcugcggcagguag

SEQ ID NO: 1537070 - RNA, 17 nt, Pseudomonas aeruginosa PA01
ugcugcgggcgccgccg

SEQ ID NO: 1537071 - RNA, 17 nt, Pseudomonas aeruginosa PA01
ugcugcggggccugcug

SEQ ID NO: 1537072 - RNA, 15 nt, Pseudomonas aeruginosa PA01
ugcuggaugucggcg

SEQ ID NO: 1537073 - RNA, 18 nt, Pseudomonas aeruginosa PA01
ugcuggacuucccggcgu

SEQ ID NO: 1537074 - RNA, 17 nt, Pseudomonas aeruginosa PA01
ugcuggauccucgccuc

SEQ ID NO: 1537075 - RNA, 15 nt, Pseudomonas aeruginosa PA01
ugcuucggcagccuu

SEQ ID NO: 1537076 - RNA, 13 nt, Pseudomonas aeruginosa PA01
ugcuuccaggcac

SEQ ID NO: 1537077 - RNA, 16 nt, Pseudomonas aeruginosa PA01
ugcuuccguaggugga

SEQ ID NO: 1537078 - RNA, 18 nt, Pseudomonas aeruginosa PA01
ugcuucaucggcccggcu

SEQ ID NO: 1537079 - RNA, 20 nt, Pseudomonas aeruginosa PA01
ugcuuacaagagcagacaca

SEQ ID NO: 1537080 - RNA, 21 nt, Pseudomonas aeruginosa PA01
ugcuucaugaagucagccagg

SEQ ID NO: 1537081 - RNA, 14 nt, Pseudomonas aeruginosa PA01
ugcuuuugaacacc

SEQ ID NO: 1537082 - RNA, 19 nt, Pseudomonas aeruginosa PA01
ugcuuuccggcccacgcuc

SEQ ID NO: 1537083 - RNA, 16 nt, Pseudomonas aeruginosa PA01
ugcuugcgcgccgccg

SEQ ID NO: 1537084 - RNA, 19 nt, Pseudomonas aeruginosa PA01
ugcuugucacgcucggcau

SEQ ID NO: 1537085 - RNA, 13 nt, Pseudomonas aeruginosa PA01
uggaaacgcccau

SEQ ID NO: 1537086 - RNA, 18 nt, Pseudomonas aeruginosa PA01
uggaacagcagccaggcg

SEQ ID NO: 1537087 - RNA, 20 nt, Pseudomonas aeruginosa PA01
uggaaccgauggccaggggg

SEQ ID NO: 1537088 - RNA, 17 nt, Pseudomonas aeruginosa PA01
uggaaccgcggcgcccu

SEQ ID NO: 1537089 - RNA, 19 nt, Pseudomonas aeruginosa PA01
uggaacuagcccucgaccu

SEQ ID NO: 1537090 - RNA, 13 nt, Pseudomonas aeruginosa PA01
uggaaggccacua

SEQ ID NO: 1537091 - RNA, 21 nt, Pseudomonas aeruginosa PA01
uggaaggaucgagccagcgcu

SEQ ID NO: 1537092 - RNA, 19 nt, Pseudomonas aeruginosa PA01
uggaagucgcccugcccgg

SEQ ID NO: 1537093 - RNA, 19 nt, Pseudomonas aeruginosa PA01
uggaagaggaucuccuggc

SEQ ID NO: 1537094 - RNA, 21 nt, Pseudomonas aeruginosa PA01
uggaaugccggccggggccgg

SEQ ID NO: 1537095 - RNA, 15 nt, Pseudomonas aeruginosa PA01
uggaccagcgccgcc

SEQ ID NO: 1537096 - RNA, 20 nt, Pseudomonas aeruginosa PA01
uggaccauggccggcgugcc

SEQ ID NO: 1537097 - RNA, 13 nt, Pseudomonas aeruginosa PA01
uggacccgggccu

SEQ ID NO: 1537098 - RNA, 17 nt, Pseudomonas aeruginosa PA01
uggacgacgcuggccug

SEQ ID NO: 1537099 - RNA, 13 nt, Pseudomonas aeruginosa PA01
uggacccgugcgc

SEQ ID NO: 1537100 - RNA, 13 nt, Pseudomonas aeruginosa PA01
uggaccuggccgg

SEQ ID NO: 1537101 - RNA, 16 nt, Pseudomonas aeruginosa PA01
uggacgccggugaccc

SEQ ID NO: 1537102 - RNA, 17 nt, Pseudomonas aeruginosa PA01
uggacaggcgcaggggc

SEQ ID NO: 1537103 - RNA, 16 nt, Pseudomonas aeruginosa PA01
uggacagcuuggccag

SEQ ID NO: 1537104 - RNA, 21 nt, Pseudomonas aeruginosa PA01
uggacagguccuggaacagga

SEQ ID NO: 1537105 - RNA, 22 nt, Pseudomonas aeruginosa PA01
uggacaggucgacggcccugac

SEQ ID NO: 1537106 - RNA, 20 nt, Pseudomonas aeruginosa PA01
uggacaagguuugcgccgcc

SEQ ID NO: 1537107 - RNA, 12 nt, Pseudomonas aeruginosa PA01
uggacacccugc

SEQ ID NO: 1537108 - RNA, 17 nt, Pseudomonas aeruginosa PA01
uggacacccugcugcug

SEQ ID NO: 1537109 - RNA, 17 nt, Pseudomonas aeruginosa PA01
ugcucgcggcuggccgc

SEQ ID NO: 1537110 - RNA, 14 nt, Pseudomonas aeruginosa PA01
ugcucgcgcagcca

SEQ ID NO: 1537111 - RNA, 17 nt, Pseudomonas aeruginosa PA01
ugcucgcgcagccaggc

SEQ ID NO: 1537112 - RNA, 18 nt, Pseudomonas aeruginosa PA01
ugcucgcgcagccaggcg

SEQ ID NO: 1537113 - RNA, 22 nt, Pseudomonas aeruginosa PA01
ugcucgcgcagccaggcgagga

SEQ ID NO: 1537114 - RNA, 19 nt, Pseudomonas aeruginosa PA01
ugcucgccucgggccauga

SEQ ID NO: 1537115 - RNA, 19 nt, Pseudomonas aeruginosa PA01
ugcucgcuccgagcaggcc

SEQ ID NO: 1537116 - RNA, 14 nt, Pseudomonas aeruginosa PA01
ugcucagggcucca

SEQ ID NO: 1537117 - RNA, 16 nt, Pseudomonas aeruginosa PA01
ugcuccagcaaugcca

SEQ ID NO: 1537118 - RNA, 21 nt, Pseudomonas aeruginosa PA01
ugcuccagcaaugccagcgcc

SEQ ID NO: 1537119 - RNA, 22 nt, Pseudomonas aeruginosa PA01
ugcuccagcaccguggcgccau

SEQ ID NO: 1537120 - RNA, 19 nt, Pseudomonas aeruginosa PA01
ugcucagccgcgccggggc

SEQ ID NO: 1537121 - RNA, 23 nt, Pseudomonas aeruginosa PA01
ugcucagccgcgccggggcagca

SEQ ID NO: 1537122 - RNA, 15 nt, Pseudomonas aeruginosa PA01
ugcucggccagcucg

SEQ ID NO: 1537123 - RNA, 19 nt, Pseudomonas aeruginosa PA01
ugcucggcgcccugggugg

SEQ ID NO: 1537124 - RNA, 20 nt, Pseudomonas aeruginosa PA01
ugcucggcgcccuggguggu

SEQ ID NO: 1537125 - RNA, 21 nt, Pseudomonas aeruginosa PA01
ugcucggggaacacgcgcugg

SEQ ID NO: 1537126 - RNA, 16 nt, Pseudomonas aeruginosa PA01
ugcucucgcgcacgcu

SEQ ID NO: 1537127 - RNA, 15 nt, Pseudomonas aeruginosa PA01
ugcugaagcccaggc

SEQ ID NO: 1537128 - RNA, 19 nt, Pseudomonas aeruginosa PA01
ugcucuucuggcugaucag

SEQ ID NO: 1537129 - RNA, 23 nt, Pseudomonas aeruginosa PA01
ugcuagcggguggcaacugccgc

SEQ ID NO: 1537130 - RNA, 14 nt, Pseudomonas aeruginosa PA01
ugcggcacgcugcu

SEQ ID NO: 1537131 - RNA, 13 nt, Pseudomonas aeruginosa PA01
ugcggcagcaggc

SEQ ID NO: 1537132 - RNA, 13 nt, Pseudomonas aeruginosa PA01
ugcggcagcaucc

SEQ ID NO: 1537133 - RNA, 20 nt, Pseudomonas aeruginosa PA01
ugcgcuuccggcagccagcc

SEQ ID NO: 1537134 - RNA, 18 nt, Pseudomonas aeruginosa PA01
ugcggcugugcucgagga

SEQ ID NO: 1537135 - RNA, 19 nt, Pseudomonas aeruginosa PA01
ugcggcucgccgauugcaa

SEQ ID NO: 1537136 - RNA, 12 nt, Pseudomonas aeruginosa PA01
ugcggcugcuca

SEQ ID NO: 1537137 - RNA, 17 nt, Pseudomonas aeruginosa PA01
ugcggcuggcgcgcgcg

SEQ ID NO: 1537138 - RNA, 20 nt, Pseudomonas aeruginosa PA01
ugcggcggucccagaccagc

SEQ ID NO: 1537139 - RNA, 21 nt, Pseudomonas aeruginosa PA01
ugcggcguggaaggccacuau

SEQ ID NO: 1537140 - RNA, 12 nt, Pseudomonas aeruginosa PA01
ugcggcgggcgc

SEQ ID NO: 1537141 - RNA, 23 nt, Pseudomonas aeruginosa PA01
ugcggcggcaggucggacaggca

SEQ ID NO: 1537142 - RNA, 14 nt, Pseudomonas aeruginosa PA01
ugcgcuccuguugc

SEQ ID NO: 1537143 - RNA, 21 nt, Pseudomonas aeruginosa PA01
ugcgcuccuuggcuggccagc

SEQ ID NO: 1537144 - RNA, 15 nt, Pseudomonas aeruginosa PA01
ugcgcucgagccggc

SEQ ID NO: 1537145 - RNA, 20 nt, Pseudomonas aeruginosa PA01
ugcgcucgcggaccucugcg

SEQ ID NO: 1537146 - RNA, 15 nt, Pseudomonas aeruginosa PA01
ugcgcucguagaacu

SEQ ID NO: 1537147 - RNA, 21 nt, Pseudomonas aeruginosa PA01
ugcgcucguagaacucgcccu

SEQ ID NO: 1537148 - RNA, 18 nt, Pseudomonas aeruginosa PA01
ugcgcuccacccaggcgc

SEQ ID NO: 1537149 - RNA, 13 nt, Pseudomonas aeruginosa PA01
ugcgcuccaggcg

SEQ ID NO: 1537150 - RNA, 14 nt, Pseudomonas aeruginosa PA01
ugcgcuccauccag

SEQ ID NO: 1537151 - RNA, 18 nt, Pseudomonas aeruginosa PA01
ugcgcuccgacuccugca

SEQ ID NO: 1537152 - RNA, 13 nt, Pseudomonas aeruginosa PA01
ugcgcuccgccag

SEQ ID NO: 1537153 - RNA, 16 nt, Pseudomonas aeruginosa PA01
ugcgcuccgccaggcc

SEQ ID NO: 1537154 - RNA, 16 nt, Pseudomonas aeruginosa PA01
ugcgcaugucguccag

SEQ ID NO: 1537155 - RNA, 10 nt, Pseudomonas aeruginosa PA01
ugcgcugcca

SEQ ID NO: 1537156 - RNA, 14 nt, Pseudomonas aeruginosa PA01
ugcgcugagcagga

SEQ ID NO: 1537157 - RNA, 17 nt, Pseudomonas aeruginosa PA01
ugcgcugcuugaacacc

SEQ ID NO: 1537158 - RNA, 19 nt, Pseudomonas aeruginosa PA01
ugcgcuggaacggccaggu

SEQ ID NO: 1537159 - RNA, 22 nt, Pseudomonas aeruginosa PA01
ugcgcugcgcguacaucccgcc

SEQ ID NO: 1537160 - RNA, 20 nt, Pseudomonas aeruginosa PA01
ugcgggacccagacaggccu

SEQ ID NO: 1537161 - RNA, 21 nt, Pseudomonas aeruginosa PA01
ugcggcuugcguucgcuccag

SEQ ID NO: 1537162 - RNA, 23 nt, Pseudomonas aeruginosa PA01
ugcgggaacgaugccgcaggcau

SEQ ID NO: 1537163 - RNA, 18 nt, Pseudomonas aeruginosa PA01
ugcgggugcgcaggcugc

SEQ ID NO: 1537164 - RNA, 18 nt, Pseudomonas aeruginosa PA01
ugcguaccagcgcgcagc

SEQ ID NO: 1537165 - RNA, 16 nt, Pseudomonas aeruginosa PA01
ugcggguuggucggca

SEQ ID NO: 1537166 - RNA, 22 nt, Pseudomonas aeruginosa PA01
ugcgguaccagcgcaccagggu

SEQ ID NO: 1537167 - RNA, 13 nt, Pseudomonas aeruginosa PA01
ugcgucucagcgg

SEQ ID NO: 1537168 - RNA, 20 nt, Pseudomonas aeruginosa PA01
ugcguuugucgaccugcccc

SEQ ID NO: 1537169 - RNA, 13 nt, Pseudomonas aeruginosa PA01
ugcguuccuccuc

SEQ ID NO: 1537170 - RNA, 20 nt, Pseudomonas aeruginosa PA01
ugcguuccuguccauuucca

SEQ ID NO: 1537171 - RNA, 21 nt, Pseudomonas aeruginosa PA01
ugcguccauccaggcuuucca

SEQ ID NO: 1537172 - RNA, 13 nt, Pseudomonas aeruginosa PA01
ugcguccugccuc

SEQ ID NO: 1537173 - RNA, 19 nt, Pseudomonas aeruginosa PA01
ugcguacuuggcccggcgu

SEQ ID NO: 1537174 - RNA, 18 nt, Pseudomonas aeruginosa PA01
ugccaauccgggcguggg

SEQ ID NO: 1537175 - RNA, 19 nt, Pseudomonas aeruginosa PA01
ugccacaguuucauggugc

SEQ ID NO: 1537176 - RNA, 15 nt, Pseudomonas aeruginosa PA01
ugccacugcgcgcca

SEQ ID NO: 1537177 - RNA, 19 nt, Pseudomonas aeruginosa PA01
ugccacugcgcgccagucc

SEQ ID NO: 1537178 - RNA, 21 nt, Pseudomonas aeruginosa PA01
ugccacugacgcgcagcgccg

SEQ ID NO: 1537179 - RNA, 12 nt, Pseudomonas aeruginosa PA01
ugcagguccggg

SEQ ID NO: 1537180 - RNA, 20 nt, Pseudomonas aeruginosa PA01
ugcagguaguccagccagug

SEQ ID NO: 1537181 - RNA, 17 nt, Pseudomonas aeruginosa PA01
ugcagguaguucuccag

SEQ ID NO: 1537182 - RNA, 22 nt, Pseudomonas aeruginosa PA01
ugcagguagccgcgccggccgu

SEQ ID NO: 1537183 - RNA, 20 nt, Pseudomonas aeruginosa PA01
ugcagguguucggcggcgug

SEQ ID NO: 1537184 - RNA, 19 nt, Pseudomonas aeruginosa PA01
ugcagguggcguugcaggg

SEQ ID NO: 1537185 - RNA, 15 nt, Pseudomonas aeruginosa PA01
ugcagguuguccagg

SEQ ID NO: 1537186 - RNA, 19 nt, Pseudomonas aeruginosa PA01
ugcagguuguccagggcau

SEQ ID NO: 1537187 - RNA, 17 nt, Pseudomonas aeruginosa PA01
ugcagucggcaccgauc

SEQ ID NO: 1537188 - RNA, 19 nt, Pseudomonas aeruginosa PA01
ugcagucgaaaaccggcgg

SEQ ID NO: 1537189 - RNA, 20 nt, Pseudomonas aeruginosa PA01
ugcaguacuuggccagcagc

SEQ ID NO: 1537190 - RNA, 21 nt, Pseudomonas aeruginosa PA01
ugcccaacuccagcucgaccc

SEQ ID NO: 1537191 - RNA, 18 nt, Pseudomonas aeruginosa PA01
ugcccaccagcgucgcca

SEQ ID NO: 1537192 - RNA, 20 nt, Pseudomonas aeruginosa PA01
ugcccaccugaacgcgcccg

SEQ ID NO: 1537193 - RNA, 23 nt, Pseudomonas aeruginosa PA01
ugcccaccugaacgcgcccggcc

SEQ ID NO: 1537194 - RNA, 13 nt, Pseudomonas aeruginosa PA01
ugccagcucuugc

SEQ ID NO: 1537195 - RNA, 16 nt, Pseudomonas aeruginosa PA01
ugccaggaccagcccg

SEQ ID NO: 1537196 - RNA, 13 nt, Pseudomonas aeruginosa PA01
ugccaggagcuug

SEQ ID NO: 1537197 - RNA, 21 nt, Pseudomonas aeruginosa PA01
ugccaggaggauucgccagcc

SEQ ID NO: 1537198 - RNA, 15 nt, Pseudomonas aeruginosa PA01
ugcccaucgccucca

SEQ ID NO: 1537199 - RNA, 23 nt, Pseudomonas aeruginosa PA01
ugcccaggcugaggucgcgggcg

SEQ ID NO: 1537200 - RNA, 12 nt, Pseudomonas aeruginosa PA01
ugcccagggcca

SEQ ID NO: 1537201 - RNA, 22 nt, Pseudomonas aeruginosa PA01
ugcccagggcccagagcagcac

SEQ ID NO: 1537202 - RNA, 16 nt, Pseudomonas aeruginosa PA01
ugcccaggcgcuggcg

SEQ ID NO: 1537203 - RNA, 10 nt, Pseudomonas aeruginosa PA01
ugcccaggcu

SEQ ID NO: 1537204 - RNA, 18 nt, Pseudomonas aeruginosa PA01
ugcccaggccgccgaucc

SEQ ID NO: 1537205 - RNA, 17 nt, Pseudomonas aeruginosa PA01
ugcccaguacccgcugg

SEQ ID NO: 1537206 - RNA, 17 nt, Pseudomonas aeruginosa PA01
ugcccaguugcgcggcg

SEQ ID NO: 1537207 - RNA, 15 nt, Pseudomonas aeruginosa PA01
ugcccacggccaggc

SEQ ID NO: 1537208 - RNA, 16 nt, Pseudomonas aeruginosa PA01
ugcccacggccaggcc

SEQ ID NO: 1537209 - RNA, 18 nt, Pseudomonas aeruginosa PA01
ugcccagcccgccuucca

SEQ ID NO: 1537210 - RNA, 18 nt, Pseudomonas aeruginosa PA01
ugcccagccccaccgcca

SEQ ID NO: 1537211 - RNA, 15 nt, Pseudomonas aeruginosa PA01
ugcccagcggcgcca

SEQ ID NO: 1537212 - RNA, 18 nt, Pseudomonas aeruginosa PA01
ugcccagcggcgccagcu

SEQ ID NO: 1537213 - RNA, 15 nt, Pseudomonas aeruginosa PA01
ugcccagcgccgccu

SEQ ID NO: 1537214 - RNA, 15 nt, Pseudomonas aeruginosa PA01
ugcccagcgccgcca

SEQ ID NO: 1537215 - RNA, 21 nt, Pseudomonas aeruginosa PA01
ugcccagcuuggccacguccu

SEQ ID NO: 1537216 - RNA, 21 nt, Pseudomonas aeruginosa PA01
ugccccguagccaugcccggc

SEQ ID NO: 1537217 - RNA, 16 nt, Pseudomonas aeruginosa PA01
ugccccuucggcugca

SEQ ID NO: 1537218 - RNA, 22 nt, Pseudomonas aeruginosa PA01
ugccgaagggaaacaccaggcc

SEQ ID NO: 1537219 - RNA, 15 nt, Pseudomonas aeruginosa PA01
ugccgaacugcaggg

SEQ ID NO: 1537220 - RNA, 19 nt, Pseudomonas aeruginosa PA01
ugccgagaaucugcccggc

SEQ ID NO: 1537221 - RNA, 13 nt, Pseudomonas aeruginosa PA01
ugccgacaggcgu

SEQ ID NO: 1537222 - RNA, 17 nt, Pseudomonas aeruginosa PA01
ugccgaccgagcagcgg

SEQ ID NO: 1537223 - RNA, 17 nt, Pseudomonas aeruginosa PA01
ugccgaugucgccggca

SEQ ID NO: 1537224 - RNA, 16 nt, Pseudomonas aeruginosa PA01
ugccgaugugcacgcu

SEQ ID NO: 1537225 - RNA, 13 nt, Pseudomonas aeruginosa PA01
ugccgaugacaug

SEQ ID NO: 1537226 - RNA, 18 nt, Pseudomonas aeruginosa PA01
ugccgauggacaggcugg

SEQ ID NO: 1537227 - RNA, 18 nt, Pseudomonas aeruginosa PA01
ugccgaugccggaaagcc

SEQ ID NO: 1537228 - RNA, 23 nt, Pseudomonas aeruginosa PA01
ugccgaugccggaaagccuggcc

SEQ ID NO: 1537229 - RNA, 18 nt, Pseudomonas aeruginosa PA01
ugccgauggcgcaccacu

SEQ ID NO: 1537230 - RNA, 16 nt, Pseudomonas aeruginosa PA01
ugcccuuuuccuccag

SEQ ID NO: 1537231 - RNA, 22 nt, Pseudomonas aeruginosa PA01
ugccgaacagcagggaggcgca

SEQ ID NO: 1537232 - RNA, 20 nt, Pseudomonas aeruginosa PA01
ugcccuuggccagcgcggcg

SEQ ID NO: 1537233 - RNA, 21 nt, Pseudomonas aeruginosa PA01
ugcccuugucgcccuucuucc

SEQ ID NO: 1537234 - RNA, 16 nt, Pseudomonas aeruginosa PA01
ugcccuuguacagcuu

SEQ ID NO: 1537235 - RNA, 17 nt, Pseudomonas aeruginosa PA01
ugcccggucaccaccca

SEQ ID NO: 1537236 - RNA, 19 nt, Pseudomonas aeruginosa PA01
ugcccgguggccuccugca

SEQ ID NO: 1537237 - RNA, 15 nt, Pseudomonas aeruginosa PA01
ugcccggcugguugc

SEQ ID NO: 1537238 - RNA, 22 nt, Pseudomonas aeruginosa PA01
ugcccggcugguugccagcagc

SEQ ID NO: 1537239 - RNA, 22 nt, Pseudomonas aeruginosa PA01
ugcccggcgcgacgcuccaggu

SEQ ID NO: 1537240 - RNA, 13 nt, Pseudomonas aeruginosa PA01
ugcgcaggcugcc

SEQ ID NO: 1537241 - RNA, 21 nt, Pseudomonas aeruginosa PA01
ugcgcaggcgcucgcgggccg

SEQ ID NO: 1537242 - RNA, 13 nt, Pseudomonas aeruginosa PA01
ugcgcaggccggg

SEQ ID NO: 1537243 - RNA, 17 nt, Pseudomonas aeruginosa PA01
ugcgcaggggcgcggcg

SEQ ID NO: 1537244 - RNA, 20 nt, Pseudomonas aeruginosa PA01
ugcgcaggucgcgacagguu

SEQ ID NO: 1537245 - RNA, 22 nt, Pseudomonas aeruginosa PA01
ugcgcagugucgcgaacucggc

SEQ ID NO: 1537246 - RNA, 12 nt, Pseudomonas aeruginosa PA01
ugcgcagcgcgu

SEQ ID NO: 1537247 - RNA, 15 nt, Pseudomonas aeruginosa PA01
ugcgcagcuucugca

SEQ ID NO: 1537248 - RNA, 21 nt, Pseudomonas aeruginosa PA01
ugcgcacgcaauggcgcagcc

SEQ ID NO: 1537249 - RNA, 17 nt, Pseudomonas aeruginosa PA01
ugcgcaccacucccggc

SEQ ID NO: 1537250 - RNA, 14 nt, Pseudomonas aeruginosa PA01
ugcgcaccagggcc

SEQ ID NO: 1537251 - RNA, 18 nt, Pseudomonas aeruginosa PA01
ugcgcagcaacuggucgc

SEQ ID NO: 1537252 - RNA, 14 nt, Pseudomonas aeruginosa PA01
ugcgauagaccagg

SEQ ID NO: 1537253 - RNA, 21 nt, Pseudomonas aeruginosa PA01
ugcgcaacgggacgccaggcg

SEQ ID NO: 1537254 - RNA, 14 nt, Pseudomonas aeruginosa PA01
ugcgcaacugccgg

SEQ ID NO: 1537255 - RNA, 16 nt, Pseudomonas aeruginosa PA01
ugcgaaaaagaacgcc

SEQ ID NO: 1537256 - RNA, 17 nt, Pseudomonas aeruginosa PA01
ugcgacaucuccaggcc

SEQ ID NO: 1537257 - RNA, 17 nt, Pseudomonas aeruginosa PA01
ugcgaccgugaggcgca

SEQ ID NO: 1537258 - RNA, 18 nt, Pseudomonas aeruginosa PA01
ugcgaccuggcgccgaaa

SEQ ID NO: 1537259 - RNA, 16 nt, Pseudomonas aeruginosa PA01
ugcgaggcggugcagc

SEQ ID NO: 1537260 - RNA, 16 nt, Pseudomonas aeruginosa PA01
ugccgucccggaguuc

SEQ ID NO: 1537261 - RNA, 18 nt, Pseudomonas aeruginosa PA01
ugccgucccggaguucca

SEQ ID NO: 1537262 - RNA, 17 nt, Pseudomonas aeruginosa PA01
ugccgucgagcaccagc

SEQ ID NO: 1537263 - RNA, 18 nt, Pseudomonas aeruginosa PA01
ugccguccagccggcgcu

SEQ ID NO: 1537264 - RNA, 19 nt, Pseudomonas aeruginosa PA01
ugccguacucauggccgca

SEQ ID NO: 1537265 - RNA, 15 nt, Pseudomonas aeruginosa PA01
ugccguagaggucgc

SEQ ID NO: 1537266 - RNA, 23 nt, Pseudomonas aeruginosa PA01
ugccguagaucaggacgaugaag

SEQ ID NO: 1537267 - RNA, 17 nt, Pseudomonas aeruginosa PA01
ugccguauccgcggcag

SEQ ID NO: 1537268 - RNA, 22 nt, Pseudomonas aeruginosa PA01
ugccggcgccaucgaucagcag

SEQ ID NO: 1537269 - RNA, 20 nt, Pseudomonas aeruginosa PA01
ugccggcgcgucgcugcgca

SEQ ID NO: 1537270 - RNA, 22 nt, Pseudomonas aeruginosa PA01
ugccggcgucggcgagcaggcg

SEQ ID NO: 1537271 - RNA, 19 nt, Pseudomonas aeruginosa PA01
ugccggcgugaacgcggcg

SEQ ID NO: 1537272 - RNA, 14 nt, Pseudomonas aeruginosa PA01
ugccgggaagcgca

SEQ ID NO: 1537273 - RNA, 20 nt, Pseudomonas aeruginosa PA01
ugccggcuugcugcaggugg

SEQ ID NO: 1537274 - RNA, 22 nt, Pseudomonas aeruginosa PA01
ugccggcggcggacgcaggccg

SEQ ID NO: 1537275 - RNA, 16 nt, Pseudomonas aeruginosa PA01
ugccggcguccuugcc

SEQ ID NO: 1537276 - RNA, 13 nt, Pseudomonas aeruginosa PA01
ugccggcggcgcu

SEQ ID NO: 1537277 - RNA, 18 nt, Pseudomonas aeruginosa PA01
ugccggcggcgcugagga

SEQ ID NO: 1537278 - RNA, 15 nt, Pseudomonas aeruginosa PA01
ugccgccgccgagga

SEQ ID NO: 1537279 - RNA, 15 nt, Pseudomonas aeruginosa PA01
ugccgcccagcaccg

SEQ ID NO: 1537280 - RNA, 18 nt, Pseudomonas aeruginosa PA01
ugccgccgccggagggaa

SEQ ID NO: 1537281 - RNA, 16 nt, Pseudomonas aeruginosa PA01
ugccgccgcgcccggc

SEQ ID NO: 1537282 - RNA, 20 nt, Pseudomonas aeruginosa PA01
ugccgccgcgcccggcgcca

SEQ ID NO: 1537283 - RNA, 15 nt, Pseudomonas aeruginosa PA01
ugccgccgcgcugca

SEQ ID NO: 1537284 - RNA, 20 nt, Pseudomonas aeruginosa PA01
ugccgccagucggccuggcu

SEQ ID NO: 1537285 - RNA, 22 nt, Pseudomonas aeruginosa PA01
ugccgccauagagugcccaggc

SEQ ID NO: 1537286 - RNA, 12 nt, Pseudomonas aeruginosa PA01
ugccgccaggcc

SEQ ID NO: 1537287 - RNA, 19 nt, Pseudomonas aeruginosa PA01
ugccgccaggccuuccaga

SEQ ID NO: 1537288 - RNA, 14 nt, Pseudomonas aeruginosa PA01
ugccgccggcgccg

SEQ ID NO: 1537289 - RNA, 16 nt, Pseudomonas aeruginosa PA01
ugccgccgcuggccug

SEQ ID NO: 1537290 - RNA, 22 nt, Pseudomonas aeruginosa PA01
ugccgccgcuggccuggccacc

SEQ ID NO: 1537291 - RNA, 21 nt, Pseudomonas aeruginosa PA01
ugccuugccaagguguggccg

SEQ ID NO: 1537292 - RNA, 15 nt, Pseudomonas aeruginosa PA01
ugccuucaccggcgg

SEQ ID NO: 1537293 - RNA, 16 nt, Pseudomonas aeruginosa PA01
ugccugcaccgggccg

SEQ ID NO: 1537294 - RNA, 17 nt, Pseudomonas aeruginosa PA01
ugccuagcacccgggua

SEQ ID NO: 1537295 - RNA, 20 nt, Pseudomonas aeruginosa PA01
ugaccucccgcgccagcucg

SEQ ID NO: 1537296 - RNA, 18 nt, Pseudomonas aeruginosa PA01
ugacgagccgcaggguga

SEQ ID NO: 1537297 - RNA, 18 nt, Pseudomonas aeruginosa PA01
ugacgagggacugaagag

SEQ ID NO: 1537298 - RNA, 15 nt, Pseudomonas aeruginosa PA01
ugacgaggacgccgc

SEQ ID NO: 1537299 - RNA, 22 nt, Pseudomonas aeruginosa PA01
ugacgcuggcugacagcuuguc

SEQ ID NO: 1537300 - RNA, 16 nt, Pseudomonas aeruginosa PA01
ugacgaugaagcgguu

SEQ ID NO: 1537301 - RNA, 17 nt, Pseudomonas aeruginosa PA01
ugacgauggccagcccg

SEQ ID NO: 1537302 - RNA, 15 nt, Pseudomonas aeruginosa PA01
ugacgauggcccaga

SEQ ID NO: 1537303 - RNA, 21 nt, Pseudomonas aeruginosa PA01
ugacccacuccggcaggcgcu

SEQ ID NO: 1537304 - RNA, 16 nt, Pseudomonas aeruginosa PA01
ugaccaucuuuuccug

SEQ ID NO: 1537305 - RNA, 18 nt, Pseudomonas aeruginosa PA01
ugaccgucagccaggcug

SEQ ID NO: 1537306 - RNA, 16 nt, Pseudomonas aeruginosa PA01
ugaccguccagcgcgc

SEQ ID NO: 1537307 - RNA, 20 nt, Pseudomonas aeruginosa PA01
ugaccggauguucgaaggcc

SEQ ID NO: 1537308 - RNA, 15 nt, Pseudomonas aeruginosa PA01
ugacccgcaguuccu

SEQ ID NO: 1537309 - RNA, 18 nt, Pseudomonas aeruginosa PA01
ugacccgcaguuccuugg

SEQ ID NO: 1537310 - RNA, 13 nt, Pseudomonas aeruginosa PA01
ugacccgccccug

SEQ ID NO: 1537311 - RNA, 17 nt, Pseudomonas aeruginosa PA01
ugacccgcaccuugccc

SEQ ID NO: 1537312 - RNA, 20 nt, Pseudomonas aeruginosa PA01
ugaccccggcgaugcugcug

SEQ ID NO: 1537313 - RNA, 12 nt, Pseudomonas aeruginosa PA01
ugaccccaccgg

SEQ ID NO: 1537314 - RNA, 21 nt, Pseudomonas aeruginosa PA01
ugagaacguuuccaugcggug

SEQ ID NO: 1537315 - RNA, 16 nt, Pseudomonas aeruginosa PA01
ugagcgacccgcugaa

SEQ ID NO: 1537316 - RNA, 17 nt, Pseudomonas aeruginosa PA01
ugagcgaaaacagccgu

SEQ ID NO: 1537317 - RNA, 16 nt, Pseudomonas aeruginosa PA01
ugagccccagguaggc

SEQ ID NO: 1537318 - RNA, 18 nt, Pseudomonas aeruginosa PA01
ugagccauucggcuuccu

SEQ ID NO: 1537319 - RNA, 17 nt, Pseudomonas aeruginosa PA01
ugagccagccugcagcc

SEQ ID NO: 1537320 - RNA, 16 nt, Pseudomonas aeruginosa PA01
ugagcaccggcaguga

SEQ ID NO: 1537321 - RNA, 15 nt, Pseudomonas aeruginosa PA01
ugaggccgagccgac

SEQ ID NO: 1537322 - RNA, 17 nt, Pseudomonas aeruginosa PA01
ugaggcagguggcgcag

SEQ ID NO: 1537323 - RNA, 15 nt, Pseudomonas aeruginosa PA01
ugaggcuguccagca

SEQ ID NO: 1537324 - RNA, 23 nt, Pseudomonas aeruginosa PA01
ugaggcucgccggguuguccagg

SEQ ID NO: 1537325 - RNA, 19 nt, Pseudomonas aeruginosa PA01
ugaggcguucgaucuccuc

SEQ ID NO: 1537326 - RNA, 15 nt, Pseudomonas aeruginosa PA01
ugaggcgcagcagcg

SEQ ID NO: 1537327 - RNA, 22 nt, Pseudomonas aeruginosa PA01
ugaggccuuucuucugcugugc

SEQ ID NO: 1537328 - RNA, 13 nt, Pseudomonas aeruginosa PA01
ugaggccuggucc

SEQ ID NO: 1537329 - RNA, 17 nt, Pseudomonas aeruginosa PA01
ugagguaggccagcccc

SEQ ID NO: 1537330 - RNA, 16 nt, Pseudomonas aeruginosa PA01
ugaggguguugcgaug

SEQ ID NO: 1537331 - RNA, 22 nt, Pseudomonas aeruginosa PA01
ugaggguguugcgauggaaguu

SEQ ID NO: 1537332 - RNA, 17 nt, Pseudomonas aeruginosa PA01
ugagggucagaccagcc

SEQ ID NO: 1537333 - RNA, 12 nt, Pseudomonas aeruginosa PA01
ugagggucagcg

SEQ ID NO: 1537334 - RNA, 21 nt, Pseudomonas aeruginosa PA01
ugagggucagcuugccgcagg

SEQ ID NO: 1537335 - RNA, 16 nt, Pseudomonas aeruginosa PA01
ugagggccgcgcugcu

SEQ ID NO: 1537336 - RNA, 15 nt, Pseudomonas aeruginosa PA01
ugaguagaaaagaaa

SEQ ID NO: 1537337 - RNA, 14 nt, Pseudomonas aeruginosa PA01
ugaguaguuucuga

SEQ ID NO: 1537338 - RNA, 16 nt, Pseudomonas aeruginosa PA01
ugagguucaugccgcg

SEQ ID NO: 1537339 - RNA, 17 nt, Pseudomonas aeruginosa PA01
ugaggaccuggccgcgu

SEQ ID NO: 1537340 - RNA, 19 nt, Pseudomonas aeruginosa PA01
ugaggaucacgauggccgg

SEQ ID NO: 1537341 - RNA, 23 nt, Pseudomonas aeruginosa PA01
ugaggaucacgcaagugcccugg

SEQ ID NO: 1537342 - RNA, 15 nt, Pseudomonas aeruginosa PA01
ugaggaucagccagc

SEQ ID NO: 1537343 - RNA, 14 nt, Pseudomonas aeruginosa PA01
ugaggacugccagg

SEQ ID NO: 1537344 - RNA, 16 nt, Pseudomonas aeruginosa PA01
ugaggaaguugcgcag

SEQ ID NO: 1537345 - RNA, 19 nt, Pseudomonas aeruginosa PA01
ugaggaaguugcgcagcaa

SEQ ID NO: 1537346 - RNA, 22 nt, Pseudomonas aeruginosa PA01
ugagcuucgccggguguuuuuc

SEQ ID NO: 1537347 - RNA, 15 nt, Pseudomonas aeruginosa PA01
ugagcggaaacaagc

SEQ ID NO: 1537348 - RNA, 18 nt, Pseudomonas aeruginosa PA01
ugagcggaaacaagcucu

SEQ ID NO: 1537349 - RNA, 19 nt, Pseudomonas aeruginosa PA01
ugcaggcacggaagcgcug

SEQ ID NO: 1537350 - RNA, 12 nt, Pseudomonas aeruginosa PA01
ugcaggccgcgc

SEQ ID NO: 1537351 - RNA, 22 nt, Pseudomonas aeruginosa PA01
ugcaggccgcgcgauggccggc

SEQ ID NO: 1537352 - RNA, 18 nt, Pseudomonas aeruginosa PA01
ugcaggccgacguagccg

SEQ ID NO: 1537353 - RNA, 20 nt, Pseudomonas aeruginosa PA01
ugcaggccgagaccgcagcc

SEQ ID NO: 1537354 - RNA, 23 nt, Pseudomonas aeruginosa PA01
ugcaggccgagaccgcagcccag

SEQ ID NO: 1537355 - RNA, 14 nt, Pseudomonas aeruginosa PA01
ugcaggccaccgga

SEQ ID NO: 1537356 - RNA, 18 nt, Pseudomonas aeruginosa PA01
ugcaggcgguagcgccgc

SEQ ID NO: 1537357 - RNA, 16 nt, Pseudomonas aeruginosa PA01
ugcaggcucgacaggu

SEQ ID NO: 1537358 - RNA, 17 nt, Pseudomonas aeruginosa PA01
ugcaggccgugccagag

SEQ ID NO: 1537359 - RNA, 21 nt, Pseudomonas aeruginosa PA01
ugcaggcgauucaagugucga

SEQ ID NO: 1537360 - RNA, 19 nt, Pseudomonas aeruginosa PA01
ugcagggcgucgccgggaa

SEQ ID NO: 1537361 - RNA, 15 nt, Pseudomonas aeruginosa PA01
ugcagggucacgcgu

SEQ ID NO: 1537362 - RNA, 15 nt, Pseudomonas aeruginosa PA01
ugcagggucacgcug

SEQ ID NO: 1537363 - RNA, 19 nt, Pseudomonas aeruginosa PA01
ugcagggucgccgggucga

SEQ ID NO: 1537364 - RNA, 20 nt, Pseudomonas aeruginosa PA01
ugcagggucagucgagcagu

SEQ ID NO: 1537365 - RNA, 19 nt, Pseudomonas aeruginosa PA01
ugcagggccgccagccgcc

SEQ ID NO: 1537366 - RNA, 22 nt, Pseudomonas aeruginosa PA01
ugcaggaacagguucggcaggc

SEQ ID NO: 1537367 - RNA, 19 nt, Pseudomonas aeruginosa PA01
ugcaggaagcgccgggccg

SEQ ID NO: 1537368 - RNA, 13 nt, Pseudomonas aeruginosa PA01
ugcaggacccgcg

SEQ ID NO: 1537369 - RNA, 16 nt, Pseudomonas aeruginosa PA01
ugcagcuucuccaggg

SEQ ID NO: 1537370 - RNA, 18 nt, Pseudomonas aeruginosa PA01
ugcagcuucuccagggaa

SEQ ID NO: 1537371 - RNA, 22 nt, Pseudomonas aeruginosa PA01
ugcagcucguuggccaccugca

SEQ ID NO: 1537372 - RNA, 22 nt, Pseudomonas aeruginosa PA01
ugcagcucggcacgcagcagcu

SEQ ID NO: 1537373 - RNA, 15 nt, Pseudomonas aeruginosa PA01
ugcagcgucgcgcgu

SEQ ID NO: 1537374 - RNA, 19 nt, Pseudomonas aeruginosa PA01
ugcagcggcauggucagcc

SEQ ID NO: 1537375 - RNA, 17 nt, Pseudomonas aeruginosa PA01
ugcagcgcuuguagcag

SEQ ID NO: 1537376 - RNA, 23 nt, Pseudomonas aeruginosa PA01
ugcagcgccuguuccagggccug

SEQ ID NO: 1537377 - RNA, 22 nt, Pseudomonas aeruginosa PA01
ugcagcagguagugcucggcca

SEQ ID NO: 1537378 - RNA, 13 nt, Pseudomonas aeruginosa PA01
ugcagcagcgccu

SEQ ID NO: 1537379 - RNA, 19 nt, Pseudomonas aeruginosa PA01
ugcagcaggaucagcgcau

SEQ ID NO: 1537380 - RNA, 14 nt, Pseudomonas aeruginosa PA01
ugcagcagaaguug

SEQ ID NO: 1537381 - RNA, 18 nt, Pseudomonas aeruginosa PA01
ugcagccacccagcagca

SEQ ID NO: 1537382 - RNA, 15 nt, Pseudomonas aeruginosa PA01
ugcagccagccgucg

SEQ ID NO: 1537383 - RNA, 16 nt, Pseudomonas aeruginosa PA01
ugcagccagcuucagc

SEQ ID NO: 1537384 - RNA, 19 nt, Pseudomonas aeruginosa PA01
ugcagcgacuccagccagg

SEQ ID NO: 1537385 - RNA, 17 nt, Pseudomonas aeruginosa PA01
ugcagacgguucagcag

SEQ ID NO: 1537386 - RNA, 18 nt, Pseudomonas aeruginosa PA01
ugcagacgcugccgagga

SEQ ID NO: 1537387 - RNA, 15 nt, Pseudomonas aeruginosa PA01
ugcagagcggccagg

SEQ ID NO: 1537388 - RNA, 15 nt, Pseudomonas aeruginosa PA01
ugcagagaggcuggc

SEQ ID NO: 1537389 - RNA, 21 nt, Pseudomonas aeruginosa PA01
ugcagaagacgcccagcaggg

SEQ ID NO: 1537390 - RNA, 23 nt, Pseudomonas aeruginosa PA01
ugcagaagacgcccagcagggcc

SEQ ID NO: 1537391 - RNA, 20 nt, Pseudomonas aeruginosa PA01
ugcacaacgggugcugcgga

SEQ ID NO: 1537392 - RNA, 16 nt, Pseudomonas aeruginosa PA01
ugcacguuccagcucg

SEQ ID NO: 1537393 - RNA, 15 nt, Pseudomonas aeruginosa PA01
ugcacgugcagcucg

SEQ ID NO: 1537394 - RNA, 21 nt, Pseudomonas aeruginosa PA01
ugcacagccauagcgccggca

SEQ ID NO: 1537395 - RNA, 15 nt, Pseudomonas aeruginosa PA01
ugcacauccagcccu

SEQ ID NO: 1537396 - RNA, 20 nt, Pseudomonas aeruginosa PA01
ugcacauccagcccuggaaa

SEQ ID NO: 1537397 - RNA, 20 nt, Pseudomonas aeruginosa PA01
ugaucaccuggaucgccagg

SEQ ID NO: 1537398 - RNA, 22 nt, Pseudomonas aeruginosa PA01
ugaucacguagaugccggugcu

SEQ ID NO: 1537399 - RNA, 20 nt, Pseudomonas aeruginosa PA01
ugaucagccgcaggcagaac

SEQ ID NO: 1537400 - RNA, 19 nt, Pseudomonas aeruginosa PA01
ugaucagcuucuucagcag

SEQ ID NO: 1537401 - RNA, 21 nt, Pseudomonas aeruginosa PA01
ugaucagcuucuucagcagcg

SEQ ID NO: 1537402 - RNA, 12 nt, Pseudomonas aeruginosa PA01
ugaucagcggcc

SEQ ID NO: 1537403 - RNA, 18 nt, Pseudomonas aeruginosa PA01
ugauccagcuggcgcguu

SEQ ID NO: 1537404 - RNA, 17 nt, Pseudomonas aeruginosa PA01
ugaucgacgccagcucg

SEQ ID NO: 1537405 - RNA, 21 nt, Pseudomonas aeruginosa PA01
ugaucgacgccagcucggccg

SEQ ID NO: 1537406 - RNA, 17 nt, Pseudomonas aeruginosa PA01
ugaucgccgcgccgccg

SEQ ID NO: 1537407 - RNA, 16 nt, Pseudomonas aeruginosa PA01
ugaucggcuccagcuu

SEQ ID NO: 1537408 - RNA, 13 nt, Pseudomonas aeruginosa PA01
ugaucggcagccg

SEQ ID NO: 1537409 - RNA, 22 nt, Pseudomonas aeruginosa PA01
ugaugaagccgcgaccgggcau

SEQ ID NO: 1537410 - RNA, 18 nt, Pseudomonas aeruginosa PA01
ugauuucguuggcccaga

SEQ ID NO: 1537411 - RNA, 13 nt, Pseudomonas aeruginosa PA01
ugauuguucuucc

SEQ ID NO: 1537412 - RNA, 17 nt, Pseudomonas aeruginosa PA01
ugauggugugcagcagc

SEQ ID NO: 1537413 - RNA, 14 nt, Pseudomonas aeruginosa PA01
ugaugguuucuucc

SEQ ID NO: 1537414 - RNA, 19 nt, Pseudomonas aeruginosa PA01
ugaugugcgcaggcuggcc

SEQ ID NO: 1537415 - RNA, 18 nt, Pseudomonas aeruginosa PA01
ugauguccccccuacgaa

SEQ ID NO: 1537416 - RNA, 14 nt, Pseudomonas aeruginosa PA01
gaccgccgccgccu

SEQ ID NO: 1537417 - RNA, 12 nt, Pseudomonas aeruginosa PA01
gaccgccgccug

SEQ ID NO: 1537418 - RNA, 16 nt, Pseudomonas aeruginosa PA01
gaccgccugccagacc

SEQ ID NO: 1537419 - RNA, 15 nt, Pseudomonas aeruginosa PA01
gaccgcgagcgccgc

SEQ ID NO: 1537420 - RNA, 18 nt, Pseudomonas aeruginosa PA01
gaccgcgagcgccgccuu

SEQ ID NO: 1537421 - RNA, 21 nt, Pseudomonas aeruginosa PA01
gaccgcgaauggcagcaggca

SEQ ID NO: 1537422 - RNA, 17 nt, Pseudomonas aeruginosa PA01
gaccgcgacaacccugu

SEQ ID NO: 1537423 - RNA, 22 nt, Pseudomonas aeruginosa PA01
gaccgcccgccucaggccggga

SEQ ID NO: 1537424 - RNA, 12 nt, Pseudomonas aeruginosa PA01
gaccgccaggcg

SEQ ID NO: 1537425 - RNA, 15 nt, Pseudomonas aeruginosa PA01
gaccgccaggcggcc

SEQ ID NO: 1537426 - RNA, 23 nt, Pseudomonas aeruginosa PA01
gaccgcccaggcugccgccgccg

SEQ ID NO: 1537427 - RNA, 22 nt, Pseudomonas aeruginosa PA01
gaccgcccagggggccgggccg

SEQ ID NO: 1537428 - RNA, 16 nt, Pseudomonas aeruginosa PA01
gaccgcgcgccugcaa

SEQ ID NO: 1537429 - RNA, 21 nt, Pseudomonas aeruginosa PA01
gaccgccugcucgcggcuggc

SEQ ID NO: 1537430 - RNA, 16 nt, Pseudomonas aeruginosa PA01
gaccgcucccaggcaa

SEQ ID NO: 1537431 - RNA, 13 nt, Pseudomonas aeruginosa PA01
gaccggcgcgccu

SEQ ID NO: 1537432 - RNA, 22 nt, Pseudomonas aeruginosa PA01
gaccggccuuuuucaugggugc

SEQ ID NO: 1537433 - RNA, 16 nt, Pseudomonas aeruginosa PA01
gaccggcagcgccgcc

SEQ ID NO: 1537434 - RNA, 19 nt, Pseudomonas aeruginosa PA01
gaccggcagucccugccag

SEQ ID NO: 1537435 - RNA, 18 nt, Pseudomonas aeruginosa PA01
gaccgguuccagcggccg

SEQ ID NO: 1537436 - RNA, 16 nt, Pseudomonas aeruginosa PA01
gaccgucagccaggcu

SEQ ID NO: 1537437 - RNA, 23 nt, Pseudomonas aeruginosa PA01
gaccggcuuggucacgccguuca

SEQ ID NO: 1537438 - RNA, 16 nt, Pseudomonas aeruginosa PA01
gaccgggauccguucg

SEQ ID NO: 1537439 - RNA, 13 nt, Pseudomonas aeruginosa PA01
gaccgggcggauc

SEQ ID NO: 1537440 - RNA, 19 nt, Pseudomonas aeruginosa PA01
gaccgggcggcgcggcgca

SEQ ID NO: 1537441 - RNA, 14 nt, Pseudomonas aeruginosa PA01
gaccuccagccggc

SEQ ID NO: 1537442 - RNA, 14 nt, Pseudomonas aeruginosa PA01
gaccuccgccagga

SEQ ID NO: 1537443 - RNA, 15 nt, Pseudomonas aeruginosa PA01
gaccuccugcacaua

SEQ ID NO: 1537444 - RNA, 22 nt, Pseudomonas aeruginosa PA01
gaccucgggcagcuuggcgguc

SEQ ID NO: 1537445 - RNA, 18 nt, Pseudomonas aeruginosa PA01
gaccucguugcaggcacg

SEQ ID NO: 1537446 - RNA, 18 nt, Pseudomonas aeruginosa PA01
gaccucgaagcuggccag

SEQ ID NO: 1537447 - RNA, 12 nt, Pseudomonas aeruginosa PA01
gaccguccuggc

SEQ ID NO: 1537448 - RNA, 16 nt, Pseudomonas aeruginosa PA01
gaccgugaugcccagc

SEQ ID NO: 1537449 - RNA, 20 nt, Pseudomonas aeruginosa PA01
gaccguggauuucagcaggc

SEQ ID NO: 1537450 - RNA, 17 nt, Pseudomonas aeruginosa PA01
gaccguuucgccgccgg

SEQ ID NO: 1537451 - RNA, 20 nt, Pseudomonas aeruginosa PA01
gaccuguaccgcuccccacu

SEQ ID NO: 1537452 - RNA, 16 nt, Pseudomonas aeruginosa PA01
gaccuggccgccguug

SEQ ID NO: 1537453 - RNA, 15 nt, Pseudomonas aeruginosa PA01
gaccuggccgucccu

SEQ ID NO: 1537454 - RNA, 21 nt, Pseudomonas aeruginosa PA01
gaccugucggcucgcgccggc

SEQ ID NO: 1537455 - RNA, 21 nt, Pseudomonas aeruginosa PA01
gaccugucccgauuccgcgca

SEQ ID NO: 1537456 - RNA, 16 nt, Pseudomonas aeruginosa PA01
gaccuguugcagagcg

SEQ ID NO: 1537457 - RNA, 20 nt, Pseudomonas aeruginosa PA01
gaccuggugggcggcggcua

SEQ ID NO: 1537458 - RNA, 18 nt, Pseudomonas aeruginosa PA01
gaccugcggggcggauga

SEQ ID NO: 1537459 - RNA, 15 nt, Pseudomonas aeruginosa PA01
gaccugccgcccggc

SEQ ID NO: 1537460 - RNA, 21 nt, Pseudomonas aeruginosa PA01
gaccugccgcccggccaggcc

SEQ ID NO: 1537461 - RNA, 14 nt, Pseudomonas aeruginosa PA01
gaccugcaauucca

SEQ ID NO: 1537462 - RNA, 21 nt, Pseudomonas aeruginosa PA01
gaccugagaucagcgcccggc

SEQ ID NO: 1537463 - RNA, 14 nt, Pseudomonas aeruginosa PA01
gaccugcagcgccu

SEQ ID NO: 1537464 - RNA, 19 nt, Pseudomonas aeruginosa PA01
gacccucauggaaaccccg

SEQ ID NO: 1537465 - RNA, 16 nt, Pseudomonas aeruginosa PA01
gacccgguacagcgcc

SEQ ID NO: 1537466 - RNA, 23 nt, Pseudomonas aeruginosa PA01
gacccgguacuccuccagcaucc

SEQ ID NO: 1537467 - RNA, 20 nt, Pseudomonas aeruginosa PA01
gacccggucgcugaccagcc

SEQ ID NO: 1537468 - RNA, 19 nt, Pseudomonas aeruginosa PA01
gacccgcaacaccuguacc

SEQ ID NO: 1537469 - RNA, 15 nt, Pseudomonas aeruginosa PA01
gacccgacugcagcg

SEQ ID NO: 1537470 - RNA, 14 nt, Pseudomonas aeruginosa PA01
gacccgccagcggc

SEQ ID NO: 1537471 - RNA, 17 nt, Pseudomonas aeruginosa PA01
gacccggccgaccaggu

SEQ ID NO: 1537472 - RNA, 19 nt, Pseudomonas aeruginosa PA01
gacccgcuugagccauucg

SEQ ID NO: 1537473 - RNA, 13 nt, Pseudomonas aeruginosa PA01
gacccggacagcc

SEQ ID NO: 1537474 - RNA, 14 nt, Pseudomonas aeruginosa PA01
gacccggacagccu

SEQ ID NO: 1537475 - RNA, 14 nt, Pseudomonas aeruginosa PA01
gacccgcugaagga

SEQ ID NO: 1537476 - RNA, 13 nt, Pseudomonas aeruginosa PA01
gacccgcugcugg

SEQ ID NO: 1537477 - RNA, 22 nt, Pseudomonas aeruginosa PA01
gacccggauaccccgguugugc

SEQ ID NO: 1537478 - RNA, 16 nt, Pseudomonas aeruginosa PA01
gaccgaacagcgcgcc

SEQ ID NO: 1537479 - RNA, 15 nt, Pseudomonas aeruginosa PA01
gaccgaucaugcccu

SEQ ID NO: 1537480 - RNA, 15 nt, Pseudomonas aeruginosa PA01
gaccgauccagcagu

SEQ ID NO: 1537481 - RNA, 17 nt, Pseudomonas aeruginosa PA01
gaccgcagcccaguucg

SEQ ID NO: 1537482 - RNA, 12 nt, Pseudomonas aeruginosa PA01
gaccgcagccgg

SEQ ID NO: 1537483 - RNA, 14 nt, Pseudomonas aeruginosa PA01
gaccgcagccggcg

SEQ ID NO: 1537484 - RNA, 13 nt, Pseudomonas aeruginosa PA01
gaccccggccugg

SEQ ID NO: 1537485 - RNA, 20 nt, Pseudomonas aeruginosa PA01
gaccccggccuggcuggccu

SEQ ID NO: 1537486 - RNA, 21 nt, Pseudomonas aeruginosa PA01
gaccccgccggggcgugcagg

SEQ ID NO: 1537487 - RNA, 19 nt, Pseudomonas aeruginosa PA01
gacccccugccgcccucgg

SEQ ID NO: 1537488 - RNA, 13 nt, Pseudomonas aeruginosa PA01
gaccccauccgca

SEQ ID NO: 1537489 - RNA, 16 nt, Pseudomonas aeruginosa PA01
gacccaggugcgcagg

SEQ ID NO: 1537490 - RNA, 14 nt, Pseudomonas aeruginosa PA01
gacccagagccgcu

SEQ ID NO: 1537491 - RNA, 19 nt, Pseudomonas aeruginosa PA01
gaccaucuuuuccugcugg

SEQ ID NO: 1537492 - RNA, 19 nt, Pseudomonas aeruginosa PA01
gaccaucuggaucaggaag

SEQ ID NO: 1537493 - RNA, 15 nt, Pseudomonas aeruginosa PA01
gaccaucggcggcgg

SEQ ID NO: 1537494 - RNA, 17 nt, Pseudomonas aeruginosa PA01
gaccaucggcggcggcc

SEQ ID NO: 1537495 - RNA, 19 nt, Pseudomonas aeruginosa PA01
gaccauguucaccagcgcu

SEQ ID NO: 1537496 - RNA, 19 nt, Pseudomonas aeruginosa PA01
gaccaugguguuggcggcc

SEQ ID NO: 1537497 - RNA, 16 nt, Pseudomonas aeruginosa PA01
gaccaucaccagcgcc

SEQ ID NO: 1537498 - RNA, 14 nt, Pseudomonas aeruginosa PA01
gaccauccagccug

SEQ ID NO: 1537499 - RNA, 16 nt, Pseudomonas aeruginosa PA01
gacgcgacugcugcug

SEQ ID NO: 1537500 - RNA, 23 nt, Pseudomonas aeruginosa PA01
gacgcgaccuccggcgccaggcc

SEQ ID NO: 1537501 - RNA, 14 nt, Pseudomonas aeruginosa PA01
gacgcgcagcggcg

SEQ ID NO: 1537502 - RNA, 15 nt, Pseudomonas aeruginosa PA01
gacgcgcagcggcgc

SEQ ID NO: 1537503 - RNA, 14 nt, Pseudomonas aeruginosa PA01
gacgcgcaugcagg

SEQ ID NO: 1537504 - RNA, 17 nt, Pseudomonas aeruginosa PA01
gacgcggacagccuggg

SEQ ID NO: 1537505 - RNA, 20 nt, Pseudomonas aeruginosa PA01
gacgcgccaggugcgcuggu

SEQ ID NO: 1537506 - RNA, 18 nt, Pseudomonas aeruginosa PA01
gacgccguccaccagcca

SEQ ID NO: 1537507 - RNA, 19 nt, Pseudomonas aeruginosa PA01
gacgccguagcgcaguucg

SEQ ID NO: 1537508 - RNA, 14 nt, Pseudomonas aeruginosa PA01
gacgccgggcuggu

SEQ ID NO: 1537509 - RNA, 23 nt, Pseudomonas aeruginosa PA01
gacgccggucgggcacuuguugg

SEQ ID NO: 1537510 - RNA, 17 nt, Pseudomonas aeruginosa PA01
gacgccggugacccacu

SEQ ID NO: 1537511 - RNA, 22 nt, Pseudomonas aeruginosa PA01
gacgccucgucggaggcgagga

SEQ ID NO: 1537512 - RNA, 21 nt, Pseudomonas aeruginosa PA01
gacgccucccaccgcgcggca

SEQ ID NO: 1537513 - RNA, 13 nt, Pseudomonas aeruginosa PA01
gacgcauaaccgc

SEQ ID NO: 1537514 - RNA, 14 nt, Pseudomonas aeruginosa PA01
gacgcauaaccgcu

SEQ ID NO: 1537515 - RNA, 18 nt, Pseudomonas aeruginosa PA01
gacgccaccagccaggcg

SEQ ID NO: 1537516 - RNA, 14 nt, Pseudomonas aeruginosa PA01
gacgccaccaggcc

SEQ ID NO: 1537517 - RNA, 23 nt, Pseudomonas aeruginosa PA01
gacgccacccgcaucgaggccgc

SEQ ID NO: 1537518 - RNA, 13 nt, Pseudomonas aeruginosa PA01
gacgccauggcgc

SEQ ID NO: 1537519 - RNA, 16 nt, Pseudomonas aeruginosa PA01
gacgcccuccagcacc

SEQ ID NO: 1537520 - RNA, 19 nt, Pseudomonas aeruginosa PA01
gacgcccuccagcaccgcc

SEQ ID NO: 1537521 - RNA, 19 nt, Pseudomonas aeruginosa PA01
gacgccgaagccgcuggca

SEQ ID NO: 1537522 - RNA, 13 nt, Pseudomonas aeruginosa PA01
gacgccgccgagc

SEQ ID NO: 1537523 - RNA, 21 nt, Pseudomonas aeruginosa PA01
gacgccgcccggcaccggggu

SEQ ID NO: 1537524 - RNA, 11 nt, Pseudomonas aeruginosa PA01
gacgccgagca

SEQ ID NO: 1537525 - RNA, 11 nt, Pseudomonas aeruginosa PA01
gacgccgagcc

SEQ ID NO: 1537526 - RNA, 14 nt, Pseudomonas aeruginosa PA01
gacgccgagccagc

SEQ ID NO: 1537527 - RNA, 14 nt, Pseudomonas aeruginosa PA01
gacgccgagcugac

SEQ ID NO: 1537528 - RNA, 19 nt, Pseudomonas aeruginosa PA01
gacgccgagcugaccacca

SEQ ID NO: 1537529 - RNA, 12 nt, Pseudomonas aeruginosa PA01
gacggcauuccu

SEQ ID NO: 1537530 - RNA, 18 nt, Pseudomonas aeruginosa PA01
gacggcgcauauccacca

SEQ ID NO: 1537531 - RNA, 21 nt, Pseudomonas aeruginosa PA01
gacggaccgcgacaacccugu

SEQ ID NO: 1537532 - RNA, 15 nt, Pseudomonas aeruginosa PA01
gacggaacaggagcc

SEQ ID NO: 1537533 - RNA, 13 nt, Pseudomonas aeruginosa PA01
gacggaaggugcg

SEQ ID NO: 1537534 - RNA, 16 nt, Pseudomonas aeruginosa PA01
gacggagagcagcagc

SEQ ID NO: 1537535 - RNA, 15 nt, Pseudomonas aeruginosa PA01
gacggcagguggcgg

SEQ ID NO: 1537536 - RNA, 17 nt, Pseudomonas aeruginosa PA01
gacgcuggucaggcuga

SEQ ID NO: 1537537 - RNA, 23 nt, Pseudomonas aeruginosa PA01
gacgcugccguucgcccgcggcg

SEQ ID NO: 1537538 - RNA, 16 nt, Pseudomonas aeruginosa PA01
gacgcugcgaccuggc

SEQ ID NO: 1537539 - RNA, 17 nt, Pseudomonas aeruginosa PA01
gacgcugcaccgcggcg

SEQ ID NO: 1537540 - RNA, 18 nt, Pseudomonas aeruginosa PA01
gacgcugcaccgcggcgc

SEQ ID NO: 1537541 - RNA, 19 nt, Pseudomonas aeruginosa PA01
gacgcucuccgucagggcg

SEQ ID NO: 1537542 - RNA, 22 nt, Pseudomonas aeruginosa PA01
gacgcucugcucggccagcgcc

SEQ ID NO: 1537543 - RNA, 16 nt, Pseudomonas aeruginosa PA01
gacgcggccugggccg

SEQ ID NO: 1537544 - RNA, 17 nt, Pseudomonas aeruginosa PA01
gacgcgucguccgaggc

SEQ ID NO: 1537545 - RNA, 20 nt, Pseudomonas aeruginosa PA01
gacgcuacguuccagggccu

SEQ ID NO: 1537546 - RNA, 22 nt, Pseudomonas aeruginosa PA01
gacgcucggacagcuucugguu

SEQ ID NO: 1537547 - RNA, 19 nt, Pseudomonas aeruginosa PA01
gacgcucggccagcguccu

SEQ ID NO: 1537548 - RNA, 17 nt, Pseudomonas aeruginosa PA01
gacgacaguaccuucca

SEQ ID NO: 1537549 - RNA, 13 nt, Pseudomonas aeruginosa PA01
gacgacaccugca

SEQ ID NO: 1537550 - RNA, 19 nt, Pseudomonas aeruginosa PA01
gacgaauuccgauuucagc

SEQ ID NO: 1537551 - RNA, 22 nt, Pseudomonas aeruginosa PA01
gacgaauuccgauuucagcuuc

SEQ ID NO: 1537552 - RNA, 13 nt, Pseudomonas aeruginosa PA01
gacgaaggucggc

SEQ ID NO: 1537553 - RNA, 17 nt, Pseudomonas aeruginosa PA01
gacgaaggucggcggca

SEQ ID NO: 1537554 - RNA, 20 nt, Pseudomonas aeruginosa PA01
gacgaaggucggcggcagcu

SEQ ID NO: 1537555 - RNA, 17 nt, Pseudomonas aeruginosa PA01
gacgaagcccaggcuga

SEQ ID NO: 1537556 - RNA, 13 nt, Pseudomonas aeruginosa PA01
gacgaagccggcg

SEQ ID NO: 1537557 - RNA, 20 nt, Pseudomonas aeruginosa PA01
gacgaaguugcaggccagcg

SEQ ID NO: 1537558 - RNA, 18 nt, Pseudomonas aeruginosa PA01
gacgaaacgguagcccgc

SEQ ID NO: 1537559 - RNA, 18 nt, Pseudomonas aeruginosa PA01
gacgaaacucaucaggcu

SEQ ID NO: 1537560 - RNA, 20 nt, Pseudomonas aeruginosa PA01
gacgaaacucaucaggcugc

SEQ ID NO: 1537561 - RNA, 21 nt, Pseudomonas aeruginosa PA01
gacgaaacucaucaggcugcc

SEQ ID NO: 1537562 - RNA, 21 nt, Pseudomonas aeruginosa PA01
gacgaacucgacgcgccaggu

SEQ ID NO: 1537563 - RNA, 15 nt, Pseudomonas aeruginosa PA01
gacgaacgagaagcc

SEQ ID NO: 1537564 - RNA, 14 nt, Pseudomonas aeruginosa PA01
gaccuuguccuggc

SEQ ID NO: 1537565 - RNA, 17 nt, Pseudomonas aeruginosa PA01
gaccuuguccaggguuu

SEQ ID NO: 1537566 - RNA, 13 nt, Pseudomonas aeruginosa PA01
gaccuugaacucg

SEQ ID NO: 1537567 - RNA, 17 nt, Pseudomonas aeruginosa PA01
gaccuugccgagcgcga

SEQ ID NO: 1537568 - RNA, 17 nt, Pseudomonas aeruginosa PA01
gaccuucaucaggcggc

SEQ ID NO: 1537569 - RNA, 22 nt, Pseudomonas aeruginosa PA01
gaccuucggaucggucagcgag

SEQ ID NO: 1537570 - RNA, 21 nt, Pseudomonas aeruginosa PA01
gaccuucggugucguauucca

SEQ ID NO: 1537571 - RNA, 14 nt, Pseudomonas aeruginosa PA01
gaccuucaccacca

SEQ ID NO: 1537572 - RNA, 17 nt, Pseudomonas aeruginosa PA01
gaccuuccugccagcgc

SEQ ID NO: 1537573 - RNA, 12 nt, Pseudomonas aeruginosa PA01
gaccuucugcac

SEQ ID NO: 1537574 - RNA, 13 nt, Pseudomonas aeruginosa PA01
gaccuucugcacc

SEQ ID NO: 1537575 - RNA, 14 nt, Pseudomonas aeruginosa PA01
gaccuucugcaccg

SEQ ID NO: 1537576 - RNA, 22 nt, Pseudomonas aeruginosa PA01
gacgaugaucaccaggacccag

SEQ ID NO: 1537577 - RNA, 16 nt, Pseudomonas aeruginosa PA01
gacgauggccgccgcc

SEQ ID NO: 1537578 - RNA, 14 nt, Pseudomonas aeruginosa PA01
gacgauggcgccuu

SEQ ID NO: 1537579 - RNA, 18 nt, Pseudomonas aeruginosa PA01
gacgauguucgaggcgcc

SEQ ID NO: 1537580 - RNA, 17 nt, Pseudomonas aeruginosa PA01
gacgauggucgccgcga

SEQ ID NO: 1537581 - RNA, 20 nt, Pseudomonas aeruginosa PA01
gacgcagggcggcgccugga

SEQ ID NO: 1537582 - RNA, 13 nt, Pseudomonas aeruginosa PA01
gacgcagccguug

SEQ ID NO: 1537583 - RNA, 20 nt, Pseudomonas aeruginosa PA01
gacgcagcgcgcgccgagca

SEQ ID NO: 1537584 - RNA, 23 nt, Pseudomonas aeruginosa PA01
gacgcacucauagcucagcugga

SEQ ID NO: 1537585 - RNA, 19 nt, Pseudomonas aeruginosa PA01
gacgcaaacgccauccgcc

SEQ ID NO: 1537586 - RNA, 20 nt, Pseudomonas aeruginosa PA01
gacgcaaacgccauccgccu

SEQ ID NO: 1537587 - RNA, 12 nt, Pseudomonas aeruginosa PA01
gacgcaccagca

SEQ ID NO: 1537588 - RNA, 16 nt, Pseudomonas aeruginosa PA01
gacgaucuucugcacc

SEQ ID NO: 1537589 - RNA, 15 nt, Pseudomonas aeruginosa PA01
gacgaucacccccag

SEQ ID NO: 1537590 - RNA, 19 nt, Pseudomonas aeruginosa PA01
gacgaucacccccagcgag

SEQ ID NO: 1537591 - RNA, 20 nt, Pseudomonas aeruginosa PA01
gacgaucagcaggaugcagu

SEQ ID NO: 1537592 - RNA, 17 nt, Pseudomonas aeruginosa PA01
gacgaggaacgccucgc

SEQ ID NO: 1537593 - RNA, 23 nt, Pseudomonas aeruginosa PA01
gacgaggaacgccucgcagagcg

SEQ ID NO: 1537594 - RNA, 16 nt, Pseudomonas aeruginosa PA01
gacgaggacgccgccg

SEQ ID NO: 1537595 - RNA, 21 nt, Pseudomonas aeruginosa PA01
gacgaggggcugcggagcguc

SEQ ID NO: 1537596 - RNA, 14 nt, Pseudomonas aeruginosa PA01
gacgagcguccgcc

SEQ ID NO: 1537597 - RNA, 15 nt, Pseudomonas aeruginosa PA01
gacgaggauggucag

SEQ ID NO: 1537598 - RNA, 16 nt, Pseudomonas aeruginosa PA01
gacgaggauggucagg

SEQ ID NO: 1537599 - RNA, 19 nt, Pseudomonas aeruginosa PA01
gacgacugcggcagcuugg

SEQ ID NO: 1537600 - RNA, 15 nt, Pseudomonas aeruginosa PA01
gacgagacgccgagg

SEQ ID NO: 1537601 - RNA, 20 nt, Pseudomonas aeruginosa PA01
gacgagccggacggcggcgu

SEQ ID NO: 1537602 - RNA, 22 nt, Pseudomonas aeruginosa PA01
gacaccccgaaacgguccacca

SEQ ID NO: 1537603 - RNA, 18 nt, Pseudomonas aeruginosa PA01
gacaccccgaaguagcga

SEQ ID NO: 1537604 - RNA, 17 nt, Pseudomonas aeruginosa PA01
gacaccccggucaggcc

SEQ ID NO: 1537605 - RNA, 15 nt, Pseudomonas aeruginosa PA01
gacaccaccagguug

SEQ ID NO: 1537606 - RNA, 16 nt, Pseudomonas aeruginosa PA01
gacacgugccccaggc

SEQ ID NO: 1537607 - RNA, 16 nt, Pseudomonas aeruginosa PA01
gacacgcacucauagc

SEQ ID NO: 1537608 - RNA, 19 nt, Pseudomonas aeruginosa PA01
gacagcgcggaucagucag

SEQ ID NO: 1537609 - RNA, 13 nt, Pseudomonas aeruginosa PA01
gacagcggcuggc

SEQ ID NO: 1537610 - RNA, 18 nt, Pseudomonas aeruginosa PA01
gacagcucuggggucagu

SEQ ID NO: 1537611 - RNA, 14 nt, Pseudomonas aeruginosa PA01
gacaggaacgcccu

SEQ ID NO: 1537612 - RNA, 16 nt, Pseudomonas aeruginosa PA01
gacaggaagagcaggc

SEQ ID NO: 1537613 - RNA, 18 nt, Pseudomonas aeruginosa PA01
gacagcuuggccagcagg

SEQ ID NO: 1537614 - RNA, 20 nt, Pseudomonas aeruginosa PA01
gacagcuuggccagcaggcc

SEQ ID NO: 1537615 - RNA, 16 nt, Pseudomonas aeruginosa PA01
gacagagcggccggcg

SEQ ID NO: 1537616 - RNA, 14 nt, Pseudomonas aeruginosa PA01
gacagcaggcugcc

SEQ ID NO: 1537617 - RNA, 13 nt, Pseudomonas aeruginosa PA01
gacagcaccaugc

SEQ ID NO: 1537618 - RNA, 16 nt, Pseudomonas aeruginosa PA01
gacagcaccaugcccu

SEQ ID NO: 1537619 - RNA, 16 nt, Pseudomonas aeruginosa PA01
gacaagggccagagca

SEQ ID NO: 1537620 - RNA, 17 nt, Pseudomonas aeruginosa PA01
gacaagggccagagcac

SEQ ID NO: 1537621 - RNA, 20 nt, Pseudomonas aeruginosa PA01
gacaagguuugcgccgccgu

SEQ ID NO: 1537622 - RNA, 23 nt, Pseudomonas aeruginosa PA01
gacaaucuugucguucggcccga

SEQ ID NO: 1537623 - RNA, 16 nt, Pseudomonas aeruginosa PA01
gacaacggccguccca

SEQ ID NO: 1537624 - RNA, 18 nt, Pseudomonas aeruginosa PA01
gacaacgacagccccggc

SEQ ID NO: 1537625 - RNA, 22 nt, Pseudomonas aeruginosa PA01
gacaaccgccguagccgucgua

SEQ ID NO: 1537626 - RNA, 16 nt, Pseudomonas aeruginosa PA01
gacaaggagacucagc

SEQ ID NO: 1537627 - RNA, 18 nt, Pseudomonas aeruginosa PA01
gacaacacuuccucgugg

SEQ ID NO: 1537628 - RNA, 23 nt, Pseudomonas aeruginosa PA01
gacaacacuuccucguggggcca

SEQ ID NO: 1537629 - RNA, 20 nt, Pseudomonas aeruginosa PA01
cuuuggucuaauggcaccug

SEQ ID NO: 1537630 - RNA, 15 nt, Pseudomonas aeruginosa PA01
gaccacgaccgcguc

SEQ ID NO: 1537631 - RNA, 14 nt, Pseudomonas aeruginosa PA01
gaccaccgccaggc

SEQ ID NO: 1537632 - RNA, 17 nt, Pseudomonas aeruginosa PA01
gaccaccgccaggcugg

SEQ ID NO: 1537633 - RNA, 11 nt, Pseudomonas aeruginosa PA01
gaccaccauca

SEQ ID NO: 1537634 - RNA, 14 nt, Pseudomonas aeruginosa PA01
gaccaccaucaccg

SEQ ID NO: 1537635 - RNA, 20 nt, Pseudomonas aeruginosa PA01
gaccaccauggucuuuccuu

SEQ ID NO: 1537636 - RNA, 13 nt, Pseudomonas aeruginosa PA01
gaccacgcaggcc

SEQ ID NO: 1537637 - RNA, 16 nt, Pseudomonas aeruginosa PA01
gaccacgcaggccagc

SEQ ID NO: 1537638 - RNA, 19 nt, Pseudomonas aeruginosa PA01
gaccacgcaggccagcgcc

SEQ ID NO: 1537639 - RNA, 16 nt, Pseudomonas aeruginosa PA01
gaccacacaugcaggu

SEQ ID NO: 1537640 - RNA, 12 nt, Pseudomonas aeruginosa PA01
gaccaccagcag

SEQ ID NO: 1537641 - RNA, 13 nt, Pseudomonas aeruginosa PA01
gaccaccagcagc

SEQ ID NO: 1537642 - RNA, 17 nt, Pseudomonas aeruginosa PA01
gaccagcgccaggcgcg

SEQ ID NO: 1537643 - RNA, 19 nt, Pseudomonas aeruginosa PA01
gaccagcucgaagccgccg

SEQ ID NO: 1537644 - RNA, 19 nt, Pseudomonas aeruginosa PA01
gaccagccguccgcgggcg

SEQ ID NO: 1537645 - RNA, 17 nt, Pseudomonas aeruginosa PA01
gaccagccgcaggcugc

SEQ ID NO: 1537646 - RNA, 15 nt, Pseudomonas aeruginosa PA01
gaccagcgaaccgcc

SEQ ID NO: 1537647 - RNA, 19 nt, Pseudomonas aeruginosa PA01
gaccagcgaaccgccggcc

SEQ ID NO: 1537648 - RNA, 15 nt, Pseudomonas aeruginosa PA01
gaccagcggagcguc

SEQ ID NO: 1537649 - RNA, 14 nt, Pseudomonas aeruginosa PA01
gaccagcaacaaac

SEQ ID NO: 1537650 - RNA, 13 nt, Pseudomonas aeruginosa PA01
gaccagaggcuga

SEQ ID NO: 1537651 - RNA, 20 nt, Pseudomonas aeruginosa PA01
gaccagcagggccagcagcg

SEQ ID NO: 1537652 - RNA, 17 nt, Pseudomonas aeruginosa PA01
gaccagcagcggcagcc

SEQ ID NO: 1537653 - RNA, 18 nt, Pseudomonas aeruginosa PA01
gaccagcagcgagcaggc

SEQ ID NO: 1537654 - RNA, 19 nt, Pseudomonas aeruginosa PA01
gaccagcagcgagcaggcg

SEQ ID NO: 1537655 - RNA, 20 nt, Pseudomonas aeruginosa PA01
gaccagcagcgagcaggcga

SEQ ID NO: 1537656 - RNA, 16 nt, Pseudomonas aeruginosa PA01
gaccagcagcgcacca

SEQ ID NO: 1537657 - RNA, 16 nt, Pseudomonas aeruginosa PA01
gaccagcccggcggcg

SEQ ID NO: 1537658 - RNA, 17 nt, Pseudomonas aeruginosa PA01
gaccagcccggcggcgg

SEQ ID NO: 1537659 - RNA, 16 nt, Pseudomonas aeruginosa PA01
gaccagccccaguccc

SEQ ID NO: 1537660 - RNA, 14 nt, Pseudomonas aeruginosa PA01
gaccagcaggaaaa

SEQ ID NO: 1537661 - RNA, 16 nt, Pseudomonas aeruginosa PA01
gaccaguaccagcaau

SEQ ID NO: 1537662 - RNA, 22 nt, Pseudomonas aeruginosa PA01
gaccagucggccguugcgggcg

SEQ ID NO: 1537663 - RNA, 16 nt, Pseudomonas aeruginosa PA01
gaccaguugcccgagu

SEQ ID NO: 1537664 - RNA, 20 nt, Pseudomonas aeruginosa PA01
gaccagguccggcagcgccu

SEQ ID NO: 1537665 - RNA, 20 nt, Pseudomonas aeruginosa PA01
gaccaggucgaguuuccggu

SEQ ID NO: 1537666 - RNA, 14 nt, Pseudomonas aeruginosa PA01
gaccaggugcuggu

SEQ ID NO: 1537667 - RNA, 22 nt, Pseudomonas aeruginosa PA01
gaccaggucgcuggcaccggcc

SEQ ID NO: 1537668 - RNA, 23 nt, Pseudomonas aeruginosa PA01
gaccagguagagcagcccgggca

SEQ ID NO: 1537669 - RNA, 14 nt, Pseudomonas aeruginosa PA01
gaccaggguggcgg

SEQ ID NO: 1537670 - RNA, 21 nt, Pseudomonas aeruginosa PA01
gaccaggaauuccuggccggu

SEQ ID NO: 1537671 - RNA, 13 nt, Pseudomonas aeruginosa PA01
gaccaggacagca

SEQ ID NO: 1537672 - RNA, 14 nt, Pseudomonas aeruginosa PA01
gaccaggcggccgu

SEQ ID NO: 1537673 - RNA, 19 nt, Pseudomonas aeruginosa PA01
gaccaggcggccgucggcc

SEQ ID NO: 1537674 - RNA, 21 nt, Pseudomonas aeruginosa PA01
gaccaggcugaucagcccgcu

SEQ ID NO: 1537675 - RNA, 14 nt, Pseudomonas aeruginosa PA01
gaccaggccgagca

SEQ ID NO: 1537676 - RNA, 19 nt, Pseudomonas aeruginosa PA01
gaccaggccgagcaggaag

SEQ ID NO: 1537677 - RNA, 23 nt, Pseudomonas aeruginosa PA01
gacaucgucucgcgacacgugcc

SEQ ID NO: 1537678 - RNA, 22 nt, Pseudomonas aeruginosa PA01
gacaucucguccucggggaagc

SEQ ID NO: 1537679 - RNA, 16 nt, Pseudomonas aeruginosa PA01
gacaugcaggccggcc

SEQ ID NO: 1537680 - RNA, 21 nt, Pseudomonas aeruginosa PA01
gacaugcaggccggccuccag

SEQ ID NO: 1537681 - RNA, 20 nt, Pseudomonas aeruginosa PA01
gacauccucccugcccgcuc

SEQ ID NO: 1537682 - RNA, 19 nt, Pseudomonas aeruginosa PA01
gacaucgauaacaccagga

SEQ ID NO: 1537683 - RNA, 21 nt, Pseudomonas aeruginosa PA01
gacaucgauaacaccaggagc

SEQ ID NO: 1537684 - RNA, 17 nt, Pseudomonas aeruginosa PA01
gacauccuuggucaggg

SEQ ID NO: 1537685 - RNA, 14 nt, Pseudomonas aeruginosa PA01
gacaguaccuucca

SEQ ID NO: 1537686 - RNA, 23 nt, Pseudomonas aeruginosa PA01
gacagguucaggacgcuccugcg

SEQ ID NO: 1537687 - RNA, 16 nt, Pseudomonas aeruginosa PA01
gacagguccuggaaca

SEQ ID NO: 1537688 - RNA, 18 nt, Pseudomonas aeruginosa PA01
gacaggucgcggaagugc

SEQ ID NO: 1537689 - RNA, 22 nt, Pseudomonas aeruginosa PA01
gacaggucggccggcagcuccg

SEQ ID NO: 1537690 - RNA, 15 nt, Pseudomonas aeruginosa PA01
gacagguacucggcc

SEQ ID NO: 1537691 - RNA, 14 nt, Pseudomonas aeruginosa PA01
gacagggccaggcc

SEQ ID NO: 1537692 - RNA, 19 nt, Pseudomonas aeruginosa PA01
gacaggcgucccuggagca

SEQ ID NO: 1537693 - RNA, 23 nt, Pseudomonas aeruginosa PA01
gacaggcgucccuggagcagggc

SEQ ID NO: 1537694 - RNA, 20 nt, Pseudomonas aeruginosa PA01
gacaggccgaccagcagggc

SEQ ID NO: 1537695 - RNA, 15 nt, Pseudomonas aeruginosa PA01
gacaggcagccggcc

SEQ ID NO: 1537696 - RNA, 16 nt, Pseudomonas aeruginosa PA01
gacaggcagcgccgcc

SEQ ID NO: 1537697 - RNA, 17 nt, Pseudomonas aeruginosa PA01
gacauagcgcagcaccg

SEQ ID NO: 1537698 - RNA, 20 nt, Pseudomonas aeruginosa PA01
gacaguucgccgcccgaggc

SEQ ID NO: 1537699 - RNA, 21 nt, Pseudomonas aeruginosa PA01
gacaguucgcggaacuucgca

SEQ ID NO: 1537700 - RNA, 23 nt, Pseudomonas aeruginosa PA01
gacuucgucgaagaccagggugg

SEQ ID NO: 1537701 - RNA, 15 nt, Pseudomonas aeruginosa PA01
gacuucggcaagcac

SEQ ID NO: 1537702 - RNA, 15 nt, Pseudomonas aeruginosa PA01
gacuucggcgacagc

SEQ ID NO: 1537703 - RNA, 22 nt, Pseudomonas aeruginosa PA01
gacuugaaccccgaacuucccc

SEQ ID NO: 1537704 - RNA, 19 nt, Pseudomonas aeruginosa PA01
gacuuccaggcgcaggcga

SEQ ID NO: 1537705 - RNA, 16 nt, Pseudomonas aeruginosa PA01
gacuuccgccuugucc

SEQ ID NO: 1537706 - RNA, 24 nt, Pseudomonas aeruginosa PA01
gacugugcuuaauacggcgcaggc

SEQ ID NO: 1537707 - RNA, 18 nt, Pseudomonas aeruginosa PA01
gacugguaggacagggcc

SEQ ID NO: 1537708 - RNA, 21 nt, Pseudomonas aeruginosa PA01
gacuggugccggauagaggaa

SEQ ID NO: 1537709 - RNA, 12 nt, Pseudomonas aeruginosa PA01
gacuggugggca

SEQ ID NO: 1537710 - RNA, 20 nt, Pseudomonas aeruginosa PA01
gacuuucuugaccaugguga

SEQ ID NO: 1537711 - RNA, 11 nt, Pseudomonas aeruginosa PA01
gagaacagcag

SEQ ID NO: 1537712 - RNA, 13 nt, Pseudomonas aeruginosa PA01
gagaacagcagcg

SEQ ID NO: 1537713 - RNA, 19 nt, Pseudomonas aeruginosa PA01
gagaacagcagggucaggg

SEQ ID NO: 1537714 - RNA, 19 nt, Pseudomonas aeruginosa PA01
gagaaauccggcuggcgcc

SEQ ID NO: 1537715 - RNA, 16 nt, Pseudomonas aeruginosa PA01
gagacgugaagccccu

SEQ ID NO: 1537716 - RNA, 20 nt, Pseudomonas aeruginosa PA01
gagacuaccgaucggcugcc

SEQ ID NO: 1537717 - RNA, 16 nt, Pseudomonas aeruginosa PA01
gagacgccgccccagc

SEQ ID NO: 1537718 - RNA, 13 nt, Pseudomonas aeruginosa PA01
gagacggcggcga

SEQ ID NO: 1537719 - RNA, 16 nt, Pseudomonas aeruginosa PA01
gagacgaucagcagga

SEQ ID NO: 1537720 - RNA, 21 nt, Pseudomonas aeruginosa PA01
gagaccgaccgacuuggcagu

SEQ ID NO: 1537721 - RNA, 20 nt, Pseudomonas aeruginosa PA01
gagaccuuccugccagcgcg

SEQ ID NO: 1537722 - RNA, 21 nt, Pseudomonas aeruginosa PA01
gagaccucgcccaucgccagg

SEQ ID NO: 1537723 - RNA, 22 nt, Pseudomonas aeruginosa PA01
gagacccccgggaugcccggcc

SEQ ID NO: 1537724 - RNA, 15 nt, Pseudomonas aeruginosa PA01
gagaccccggcggcg

SEQ ID NO: 1537725 - RNA, 16 nt, Pseudomonas aeruginosa PA01
gagaccccggcggcgc

SEQ ID NO: 1537726 - RNA, 19 nt, Pseudomonas aeruginosa PA01
gagaccgauccagcagucg

SEQ ID NO: 1537727 - RNA, 20 nt, Pseudomonas aeruginosa PA01
gagaccgauccagcagucgc

SEQ ID NO: 1537728 - RNA, 16 nt, Pseudomonas aeruginosa PA01
gagacccgccagcggc

SEQ ID NO: 1537729 - RNA, 19 nt, Pseudomonas aeruginosa PA01
gagacccgguacuccucca

SEQ ID NO: 1537730 - RNA, 23 nt, Pseudomonas aeruginosa PA01
gagacccuggcgcugucgcccgg

SEQ ID NO: 1537731 - RNA, 20 nt, Pseudomonas aeruginosa PA01
gagagcguccggcagggccu

SEQ ID NO: 1537732 - RNA, 15 nt, Pseudomonas aeruginosa PA01
gagagcugcaaggcu

SEQ ID NO: 1537733 - RNA, 12 nt, Pseudomonas aeruginosa PA01
gagagcggcgcc

SEQ ID NO: 1537734 - RNA, 13 nt, Pseudomonas aeruginosa PA01
gagagggagcgcc

SEQ ID NO: 1537735 - RNA, 18 nt, Pseudomonas aeruginosa PA01
gagaggggcuacuucgcc

SEQ ID NO: 1537736 - RNA, 23 nt, Pseudomonas aeruginosa PA01
gagaggggcuacuucgccgggug

SEQ ID NO: 1537737 - RNA, 16 nt, Pseudomonas aeruginosa PA01
gagagggucagcaggc

SEQ ID NO: 1537738 - RNA, 10 nt, Pseudomonas aeruginosa PA01
gagagcaggg

SEQ ID NO: 1537739 - RNA, 15 nt, Pseudomonas aeruginosa PA01
gagagcagcacggcc

SEQ ID NO: 1537740 - RNA, 18 nt, Pseudomonas aeruginosa PA01
gagagaauccgccguucc

SEQ ID NO: 1537741 - RNA, 13 nt, Pseudomonas aeruginosa PA01
gagagacccgcca

SEQ ID NO: 1537742 - RNA, 14 nt, Pseudomonas aeruginosa PA01
gagagacccgccag

SEQ ID NO: 1537743 - RNA, 21 nt, Pseudomonas aeruginosa PA01
gagagacccgccagcggcauu

SEQ ID NO: 1537744 - RNA, 13 nt, Pseudomonas aeruginosa PA01
gagaagggcgcgc

SEQ ID NO: 1537745 - RNA, 16 nt, Pseudomonas aeruginosa PA01
gagaagccgaucaggu

SEQ ID NO: 1537746 - RNA, 17 nt, Pseudomonas aeruginosa PA01
gagaagccggggcaggc

SEQ ID NO: 1537747 - RNA, 18 nt, Pseudomonas aeruginosa PA01
gagaagccggggcaggca

SEQ ID NO: 1537748 - RNA, 12 nt, Pseudomonas aeruginosa PA01
gagaaggagaac

SEQ ID NO: 1537749 - RNA, 21 nt, Pseudomonas aeruginosa PA01
gagaacgacaugcucaucuuc

SEQ ID NO: 1537750 - RNA, 19 nt, Pseudomonas aeruginosa PA01
gagaauccgcucggugccu

SEQ ID NO: 1537751 - RNA, 16 nt, Pseudomonas aeruginosa PA01
gagaaugaaaaaggga

SEQ ID NO: 1537752 - RNA, 20 nt, Pseudomonas aeruginosa PA01
gagaaugaaaaagggaugcc

SEQ ID NO: 1537753 - RNA, 23 nt, Pseudomonas aeruginosa PA01
gagacaggaaucgacccagccgc

SEQ ID NO: 1537754 - RNA, 20 nt, Pseudomonas aeruginosa PA01
gacugaacucgguguagcug

SEQ ID NO: 1537755 - RNA, 22 nt, Pseudomonas aeruginosa PA01
gacugaccgucgggucgacccg

SEQ ID NO: 1537756 - RNA, 22 nt, Pseudomonas aeruginosa PA01
gacugacgguggaggcgggcuc

SEQ ID NO: 1537757 - RNA, 22 nt, Pseudomonas aeruginosa PA01
gacugcccagcgccgccagcag

SEQ ID NO: 1537758 - RNA, 16 nt, Pseudomonas aeruginosa PA01
gacuggcaguccaggg

SEQ ID NO: 1537759 - RNA, 19 nt, Pseudomonas aeruginosa PA01
gacuggcagcgauaaccgc

SEQ ID NO: 1537760 - RNA, 18 nt, Pseudomonas aeruginosa PA01
gacuggauucggccugcc

SEQ ID NO: 1537761 - RNA, 23 nt, Pseudomonas aeruginosa PA01
gacucgcugggcgccggcaggcc

SEQ ID NO: 1537762 - RNA, 21 nt, Pseudomonas aeruginosa PA01
gacucggcugcaacgccgcgg

SEQ ID NO: 1537763 - RNA, 17 nt, Pseudomonas aeruginosa PA01
gacuccggcgcagccca

SEQ ID NO: 1537764 - RNA, 19 nt, Pseudomonas aeruginosa PA01
gacuccggcgcagcccagc

SEQ ID NO: 1537765 - RNA, 22 nt, Pseudomonas aeruginosa PA01
gacuccggcgcagcccagccgc

SEQ ID NO: 1537766 - RNA, 21 nt, Pseudomonas aeruginosa PA01
gacuccgggaacagcccgucg

SEQ ID NO: 1537767 - RNA, 23 nt, Pseudomonas aeruginosa PA01
gacucccgcagauagggcaucag

SEQ ID NO: 1537768 - RNA, 22 nt, Pseudomonas aeruginosa PA01
gacuaccuggggauggccggcg

SEQ ID NO: 1537769 - RNA, 18 nt, Pseudomonas aeruginosa PA01
gacguugcgcaggggcgc

SEQ ID NO: 1537770 - RNA, 23 nt, Pseudomonas aeruginosa PA01
gacguugagaaggcgccugagca

SEQ ID NO: 1537771 - RNA, 20 nt, Pseudomonas aeruginosa PA01
gacguuccgcgauagcucag

SEQ ID NO: 1537772 - RNA, 21 nt, Pseudomonas aeruginosa PA01
gacguugcugcccuggcgcgc

SEQ ID NO: 1537773 - RNA, 22 nt, Pseudomonas aeruginosa PA01
gacgucguggauaggcggcgga

SEQ ID NO: 1537774 - RNA, 13 nt, Pseudomonas aeruginosa PA01
gacgucggcggcg

SEQ ID NO: 1537775 - RNA, 14 nt, Pseudomonas aeruginosa PA01
gacgucggcggcgg

SEQ ID NO: 1537776 - RNA, 23 nt, Pseudomonas aeruginosa PA01
gacguccaucagcgucugcagcu

SEQ ID NO: 1537777 - RNA, 19 nt, Pseudomonas aeruginosa PA01
gacgucgaggaaggccagg

SEQ ID NO: 1537778 - RNA, 14 nt, Pseudomonas aeruginosa PA01
gacgugggaaauca

SEQ ID NO: 1537779 - RNA, 22 nt, Pseudomonas aeruginosa PA01
gacggucaggccgagcagcgcc

SEQ ID NO: 1537780 - RNA, 21 nt, Pseudomonas aeruginosa PA01
gacggucagcggacaaccgcc

SEQ ID NO: 1537781 - RNA, 16 nt, Pseudomonas aeruginosa PA01
gacgggugcguccauc

SEQ ID NO: 1537782 - RNA, 23 nt, Pseudomonas aeruginosa PA01
gacggugcagccacccagcagca

SEQ ID NO: 1537783 - RNA, 16 nt, Pseudomonas aeruginosa PA01
gacgguggaggcgggc

SEQ ID NO: 1537784 - RNA, 14 nt, Pseudomonas aeruginosa PA01
gacgguucccagaa

SEQ ID NO: 1537785 - RNA, 14 nt, Pseudomonas aeruginosa PA01
gacgguucgauccc

SEQ ID NO: 1537786 - RNA, 17 nt, Pseudomonas aeruginosa PA01
gacguagggcaucgccg

SEQ ID NO: 1537787 - RNA, 19 nt, Pseudomonas aeruginosa PA01
gacgggcauugucccugcg

SEQ ID NO: 1537788 - RNA, 20 nt, Pseudomonas aeruginosa PA01
gacgggcgcuuccggcuugg

SEQ ID NO: 1537789 - RNA, 14 nt, Pseudomonas aeruginosa PA01
gacggcgugcaggu

SEQ ID NO: 1537790 - RNA, 20 nt, Pseudomonas aeruginosa PA01
gacggcguucggggcccucc

SEQ ID NO: 1537791 - RNA, 13 nt, Pseudomonas aeruginosa PA01
gacggcucgcgca

SEQ ID NO: 1537792 - RNA, 14 nt, Pseudomonas aeruginosa PA01
gacggcugaggcug

SEQ ID NO: 1537793 - RNA, 19 nt, Pseudomonas aeruginosa PA01
gacggcggcgucaucccgu

SEQ ID NO: 1537794 - RNA, 21 nt, Pseudomonas aeruginosa PA01
gagcugcucgauggcggccug

SEQ ID NO: 1537795 - RNA, 11 nt, Pseudomonas aeruginosa PA01
gagcugcucgg

SEQ ID NO: 1537796 - RNA, 19 nt, Pseudomonas aeruginosa PA01
gagcugccgcuucggcugc

SEQ ID NO: 1537797 - RNA, 14 nt, Pseudomonas aeruginosa PA01
gagcucggccaggc

SEQ ID NO: 1537798 - RNA, 15 nt, Pseudomonas aeruginosa PA01
gagcucggccaggca

SEQ ID NO: 1537799 - RNA, 14 nt, Pseudomonas aeruginosa PA01
gagcucccugccgc

SEQ ID NO: 1537800 - RNA, 13 nt, Pseudomonas aeruginosa PA01
gagcuccagggcu

SEQ ID NO: 1537801 - RNA, 14 nt, Pseudomonas aeruginosa PA01
gagcuaauccggcg

SEQ ID NO: 1537802 - RNA, 16 nt, Pseudomonas aeruginosa PA01
gagcguccgccgccgu

SEQ ID NO: 1537803 - RNA, 18 nt, Pseudomonas aeruginosa PA01
gagcgguuauucgcccua

SEQ ID NO: 1537804 - RNA, 12 nt, Pseudomonas aeruginosa PA01
gagcggccggcg

SEQ ID NO: 1537805 - RNA, 21 nt, Pseudomonas aeruginosa PA01
gagcggccugagcugccgcuu

SEQ ID NO: 1537806 - RNA, 23 nt, Pseudomonas aeruginosa PA01
gagcggcaccucgauggcggcgg

SEQ ID NO: 1537807 - RNA, 16 nt, Pseudomonas aeruginosa PA01
gagcggcugccgaggc

SEQ ID NO: 1537808 - RNA, 14 nt, Pseudomonas aeruginosa PA01
gagcggcgcccugg

SEQ ID NO: 1537809 - RNA, 20 nt, Pseudomonas aeruginosa PA01
gagccugcgugagcugggca

SEQ ID NO: 1537810 - RNA, 22 nt, Pseudomonas aeruginosa PA01
gagccguccugcggccgcaacc

SEQ ID NO: 1537811 - RNA, 16 nt, Pseudomonas aeruginosa PA01
gagccgucggcuccgc

SEQ ID NO: 1537812 - RNA, 22 nt, Pseudomonas aeruginosa PA01
gagccuacggaggaaacccaug

SEQ ID NO: 1537813 - RNA, 16 nt, Pseudomonas aeruginosa PA01
gagccuucagcacggc

SEQ ID NO: 1537814 - RNA, 22 nt, Pseudomonas aeruginosa PA01
gagcgaucccaggucggcgggc

SEQ ID NO: 1537815 - RNA, 22 nt, Pseudomonas aeruginosa PA01
gagcgccacgcgagaagccgcc

SEQ ID NO: 1537816 - RNA, 13 nt, Pseudomonas aeruginosa PA01
gagcgccagcacc

SEQ ID NO: 1537817 - RNA, 16 nt, Pseudomonas aeruginosa PA01
gagcgccagcaggugg

SEQ ID NO: 1537818 - RNA, 20 nt, Pseudomonas aeruginosa PA01
gagcgccucgaaggccucgg

SEQ ID NO: 1537819 - RNA, 14 nt, Pseudomonas aeruginosa PA01
gagcgccagcgaga

SEQ ID NO: 1537820 - RNA, 20 nt, Pseudomonas aeruginosa PA01
gagcgccagcgagacgggcg

SEQ ID NO: 1537821 - RNA, 17 nt, Pseudomonas aeruginosa PA01
gagcgcgcccugcaggc

SEQ ID NO: 1537822 - RNA, 16 nt, Pseudomonas aeruginosa PA01
gagcgcgaucagccgc

SEQ ID NO: 1537823 - RNA, 14 nt, Pseudomonas aeruginosa PA01
gagcgcgagcggca

SEQ ID NO: 1537824 - RNA, 14 nt, Pseudomonas aeruginosa PA01
gagcgcgaggcgag

SEQ ID NO: 1537825 - RNA, 20 nt, Pseudomonas aeruginosa PA01
gagcgccgcgcagcgcggcg

SEQ ID NO: 1537826 - RNA, 22 nt, Pseudomonas aeruginosa PA01
gagcgcuucauccugcgcgccu

SEQ ID NO: 1537827 - RNA, 11 nt, Pseudomonas aeruginosa PA01
gaggccagcag

SEQ ID NO: 1537828 - RNA, 13 nt, Pseudomonas aeruginosa PA01
gaggccagcagca

SEQ ID NO: 1537829 - RNA, 17 nt, Pseudomonas aeruginosa PA01
gaggcccucggcggcga

SEQ ID NO: 1537830 - RNA, 16 nt, Pseudomonas aeruginosa PA01
gaggccgagccggcau

SEQ ID NO: 1537831 - RNA, 21 nt, Pseudomonas aeruginosa PA01
gaggcgcuccaccagggccuc

SEQ ID NO: 1537832 - RNA, 16 nt, Pseudomonas aeruginosa PA01
gaggcgcuccaccgcc

SEQ ID NO: 1537833 - RNA, 21 nt, Pseudomonas aeruginosa PA01
gaggcgcucuucacuuccagc

SEQ ID NO: 1537834 - RNA, 22 nt, Pseudomonas aeruginosa PA01
gaggcgcuggccagcgcuucca

SEQ ID NO: 1537835 - RNA, 13 nt, Pseudomonas aeruginosa PA01
gaggcgcgcgccg

SEQ ID NO: 1537836 - RNA, 12 nt, Pseudomonas aeruginosa PA01
gaggcgcaugga

SEQ ID NO: 1537837 - RNA, 18 nt, Pseudomonas aeruginosa PA01
gaggccguaccagucgcc

SEQ ID NO: 1537838 - RNA, 23 nt, Pseudomonas aeruginosa PA01
gaggccgccgcgggcaaccgcgg

SEQ ID NO: 1537839 - RNA, 15 nt, Pseudomonas aeruginosa PA01
gaggcgaggguggcg

SEQ ID NO: 1537840 - RNA, 16 nt, Pseudomonas aeruginosa PA01
gaggcgaggguggcgc

SEQ ID NO: 1537841 - RNA, 13 nt, Pseudomonas aeruginosa PA01
gaggcgaggucgc

SEQ ID NO: 1537842 - RNA, 16 nt, Pseudomonas aeruginosa PA01
gaggauuuccgcgccc

SEQ ID NO: 1537843 - RNA, 18 nt, Pseudomonas aeruginosa PA01
gaggcaacaccaucggcc

SEQ ID NO: 1537844 - RNA, 16 nt, Pseudomonas aeruginosa PA01
gaggagguuggucugc

SEQ ID NO: 1537845 - RNA, 17 nt, Pseudomonas aeruginosa PA01
gaggaucuccaacuggc

SEQ ID NO: 1537846 - RNA, 21 nt, Pseudomonas aeruginosa PA01
gaggaucgcgaagcgcagcac

SEQ ID NO: 1537847 - RNA, 20 nt, Pseudomonas aeruginosa PA01
gaggaucuccgaguccugcu

SEQ ID NO: 1537848 - RNA, 15 nt, Pseudomonas aeruginosa PA01
gaggaucgccagcaa

SEQ ID NO: 1537849 - RNA, 16 nt, Pseudomonas aeruginosa PA01
gaggaucgccagcaau

SEQ ID NO: 1537850 - RNA, 14 nt, Pseudomonas aeruginosa PA01
gaggaucgccagga

SEQ ID NO: 1537851 - RNA, 18 nt, Pseudomonas aeruginosa PA01
gaggaucacgcagcaggc

SEQ ID NO: 1537852 - RNA, 20 nt, Pseudomonas aeruginosa PA01
gaggaucagccacgggcgcc

SEQ ID NO: 1537853 - RNA, 15 nt, Pseudomonas aeruginosa PA01
gagcuuggcccuggc

SEQ ID NO: 1537854 - RNA, 16 nt, Pseudomonas aeruginosa PA01
gagcuuggcccuggcc

SEQ ID NO: 1537855 - RNA, 19 nt, Pseudomonas aeruginosa PA01
gagcuugaugaagcccgcg

SEQ ID NO: 1537856 - RNA, 22 nt, Pseudomonas aeruginosa PA01
gagcuugaugaagcccgcggca

SEQ ID NO: 1537857 - RNA, 16 nt, Pseudomonas aeruginosa PA01
gagcuucccgcauggc

SEQ ID NO: 1537858 - RNA, 13 nt, Pseudomonas aeruginosa PA01
gagcuuugcaggg

SEQ ID NO: 1537859 - RNA, 16 nt, Pseudomonas aeruginosa PA01
gagcuuugcgcagcca

SEQ ID NO: 1537860 - RNA, 22 nt, Pseudomonas aeruginosa PA01
gagcuucgccgcgcaagcucgu

SEQ ID NO: 1537861 - RNA, 14 nt, Pseudomonas aeruginosa PA01
gagcuggccgagcg

SEQ ID NO: 1537862 - RNA, 19 nt, Pseudomonas aeruginosa PA01
gagcuggaagucguccagc

SEQ ID NO: 1537863 - RNA, 14 nt, Pseudomonas aeruginosa PA01
gagcuggcgcaggc

SEQ ID NO: 1537864 - RNA, 16 nt, Pseudomonas aeruginosa PA01
gagcuggcgcaggccu

SEQ ID NO: 1537865 - RNA, 20 nt, Pseudomonas aeruginosa PA01
gagcugguacgcccccuccc

SEQ ID NO: 1537866 - RNA, 17 nt, Pseudomonas aeruginosa PA01
gaggacgcugggacggc

SEQ ID NO: 1537867 - RNA, 14 nt, Pseudomonas aeruginosa PA01
gaggaggcgccggg

SEQ ID NO: 1537868 - RNA, 16 nt, Pseudomonas aeruginosa PA01
gaggaggcgccgggua

SEQ ID NO: 1537869 - RNA, 22 nt, Pseudomonas aeruginosa PA01
gaggaaguuaucggggccaggu

SEQ ID NO: 1537870 - RNA, 22 nt, Pseudomonas aeruginosa PA01
gaggaagccgaccggcgccggg

SEQ ID NO: 1537871 - RNA, 13 nt, Pseudomonas aeruginosa PA01
gaggaaggccagc

SEQ ID NO: 1537872 - RNA, 18 nt, Pseudomonas aeruginosa PA01
gaggaaggccaggucgcc

SEQ ID NO: 1537873 - RNA, 13 nt, Pseudomonas aeruginosa PA01
gaggaaggcgcgc

SEQ ID NO: 1537874 - RNA, 19 nt, Pseudomonas aeruginosa PA01
gaggaagucggcggccgcc

SEQ ID NO: 1537875 - RNA, 22 nt, Pseudomonas aeruginosa PA01
gaggaagucggcggccgccuug

SEQ ID NO: 1537876 - RNA, 18 nt, Pseudomonas aeruginosa PA01
gaggaagugcagggcguc

SEQ ID NO: 1537877 - RNA, 15 nt, Pseudomonas aeruginosa PA01
gaggaacacccagaa

SEQ ID NO: 1537878 - RNA, 17 nt, Pseudomonas aeruginosa PA01
gaggaaaaacgggggcu

SEQ ID NO: 1537879 - RNA, 15 nt, Pseudomonas aeruginosa PA01
gagcaccucgaccug

SEQ ID NO: 1537880 - RNA, 23 nt, Pseudomonas aeruginosa PA01
gagcacggccguccugcggccgu

SEQ ID NO: 1537881 - RNA, 19 nt, Pseudomonas aeruginosa PA01
gagcacggcgcuggucucu

SEQ ID NO: 1537882 - RNA, 14 nt, Pseudomonas aeruginosa PA01
gagcaccgcgccuu

SEQ ID NO: 1537883 - RNA, 19 nt, Pseudomonas aeruginosa PA01
gagcaccgcgccuuccagc

SEQ ID NO: 1537884 - RNA, 22 nt, Pseudomonas aeruginosa PA01
gagcaccgcgccuuccagcccu

SEQ ID NO: 1537885 - RNA, 14 nt, Pseudomonas aeruginosa PA01
gagcaccggcagga

SEQ ID NO: 1537886 - RNA, 16 nt, Pseudomonas aeruginosa PA01
gagcaauugccagagg

SEQ ID NO: 1537887 - RNA, 13 nt, Pseudomonas aeruginosa PA01
gagcaccagcagg

SEQ ID NO: 1537888 - RNA, 22 nt, Pseudomonas aeruginosa PA01
gagcaccaggcgguacaccgcc

SEQ ID NO: 1537889 - RNA, 21 nt, Pseudomonas aeruginosa PA01
gagcaccaccacucgcgagcu

SEQ ID NO: 1537890 - RNA, 21 nt, Pseudomonas aeruginosa PA01
gagcagaacuugcgcaccgcg

SEQ ID NO: 1537891 - RNA, 22 nt, Pseudomonas aeruginosa PA01
gagcacgucgagcaguugcugg

SEQ ID NO: 1537892 - RNA, 14 nt, Pseudomonas aeruginosa PA01
gagcacgucgccuu

SEQ ID NO: 1537893 - RNA, 14 nt, Pseudomonas aeruginosa PA01
gagcagcaccagca

SEQ ID NO: 1537894 - RNA, 13 nt, Pseudomonas aeruginosa PA01
gagcagcagcgcc

SEQ ID NO: 1537895 - RNA, 15 nt, Pseudomonas aeruginosa PA01
gagcagcagcgccgc

SEQ ID NO: 1537896 - RNA, 18 nt, Pseudomonas aeruginosa PA01
gagcagaguuuagccgcc

SEQ ID NO: 1537897 - RNA, 19 nt, Pseudomonas aeruginosa PA01
gagcagaguuuagccgcca

SEQ ID NO: 1537898 - RNA, 24 nt, Pseudomonas aeruginosa PA01
gagcagaguuuagccgccagugca

SEQ ID NO: 1537899 - RNA, 22 nt, Pseudomonas aeruginosa PA01
gagcagacacaaaaaacccggc

SEQ ID NO: 1537900 - RNA, 17 nt, Pseudomonas aeruginosa PA01
gagcaacucggcggcga

SEQ ID NO: 1537901 - RNA, 16 nt, Pseudomonas aeruginosa PA01
gagauagccuccuccg

SEQ ID NO: 1537902 - RNA, 20 nt, Pseudomonas aeruginosa PA01
gagauccuggccggcggcgu

SEQ ID NO: 1537903 - RNA, 15 nt, Pseudomonas aeruginosa PA01
gagauccgccagcag

SEQ ID NO: 1537904 - RNA, 16 nt, Pseudomonas aeruginosa PA01
gagauccgccagcaga

SEQ ID NO: 1537905 - RNA, 17 nt, Pseudomonas aeruginosa PA01
gagauccgccagcagac

SEQ ID NO: 1537906 - RNA, 22 nt, Pseudomonas aeruginosa PA01
gagauauucccgcgacaacggc

SEQ ID NO: 1537907 - RNA, 14 nt, Pseudomonas aeruginosa PA01
gagauucuuccggu

SEQ ID NO: 1537908 - RNA, 17 nt, Pseudomonas aeruginosa PA01
gagauucugcaggcgcu

SEQ ID NO: 1537909 - RNA, 17 nt, Pseudomonas aeruginosa PA01
gagauggcacaguuccu

SEQ ID NO: 1537910 - RNA, 14 nt, Pseudomonas aeruginosa PA01
gagaugugcgcggu

SEQ ID NO: 1537911 - RNA, 16 nt, Pseudomonas aeruginosa PA01
gagaugcucaggcgcu

SEQ ID NO: 1537912 - RNA, 19 nt, Pseudomonas aeruginosa PA01
gagaugcucaggcgcugcu

SEQ ID NO: 1537913 - RNA, 17 nt, Pseudomonas aeruginosa PA01
gagaugcugcgggcgcc

SEQ ID NO: 1537914 - RNA, 17 nt, Pseudomonas aeruginosa PA01
gagcaggccgacggcgc

SEQ ID NO: 1537915 - RNA, 17 nt, Pseudomonas aeruginosa PA01
gagcaggacagcagggu

SEQ ID NO: 1537916 - RNA, 14 nt, Pseudomonas aeruginosa PA01
gagcaggacugccc

SEQ ID NO: 1537917 - RNA, 22 nt, Pseudomonas aeruginosa PA01
gagcagcucauucguaaugaga

SEQ ID NO: 1537918 - RNA, 15 nt, Pseudomonas aeruginosa PA01
gagcagcgcggcggc

SEQ ID NO: 1537919 - RNA, 21 nt, Pseudomonas aeruginosa PA01
gagcagcgcggcggcggccag

SEQ ID NO: 1537920 - RNA, 18 nt, Pseudomonas aeruginosa PA01
gagcagcggacgcagcgg

SEQ ID NO: 1537921 - RNA, 22 nt, Pseudomonas aeruginosa PA01
gagcagcggcgcgccaugcaug

SEQ ID NO: 1537922 - RNA, 15 nt, Pseudomonas aeruginosa PA01
gagcagcgcgcggcu

SEQ ID NO: 1537923 - RNA, 14 nt, Pseudomonas aeruginosa PA01
gagcagcgccagcc

SEQ ID NO: 1537924 - RNA, 15 nt, Pseudomonas aeruginosa PA01
gagcagcgccagcca

SEQ ID NO: 1537925 - RNA, 23 nt, Pseudomonas aeruginosa PA01
gagcagcgccagccaggguacuu

SEQ ID NO: 1537926 - RNA, 13 nt, Pseudomonas aeruginosa PA01
gagcagccaggcg

SEQ ID NO: 1537927 - RNA, 21 nt, Pseudomonas aeruginosa PA01
gagcagcccgggcaacugccg

SEQ ID NO: 1537928 - RNA, 23 nt, Pseudomonas aeruginosa PA01
gagcagcccgggcaacugccgau

SEQ ID NO: 1537929 - RNA, 13 nt, Pseudomonas aeruginosa PA01
gagcagcaggugg

SEQ ID NO: 1537930 - RNA, 12 nt, Pseudomonas aeruginosa PA01
gagcagccaagc

SEQ ID NO: 1537931 - RNA, 17 nt, Pseudomonas aeruginosa PA01
gagcaggccuugcaggg

SEQ ID NO: 1537932 - RNA, 19 nt, Pseudomonas aeruginosa PA01
gagcaggccuugcagggcc

SEQ ID NO: 1537933 - RNA, 14 nt, Pseudomonas aeruginosa PA01
gagcaggcgccgga

SEQ ID NO: 1537934 - RNA, 11 nt, Pseudomonas aeruginosa PA01
gagcaggcugc

SEQ ID NO: 1537935 - RNA, 19 nt, Pseudomonas aeruginosa PA01
gagcaggcggaucgccgcc

SEQ ID NO: 1537936 - RNA, 16 nt, Pseudomonas aeruginosa PA01
gagcaggcggccgucc

SEQ ID NO: 1537937 - RNA, 12 nt, Pseudomonas aeruginosa PA01
gagcaggcggga

SEQ ID NO: 1537938 - RNA, 18 nt, Pseudomonas aeruginosa PA01
gagcagggcgaugccgau

SEQ ID NO: 1537939 - RNA, 14 nt, Pseudomonas aeruginosa PA01
gagcagggcgcuga

SEQ ID NO: 1537940 - RNA, 22 nt, Pseudomonas aeruginosa PA01
gagcagggccgagcgcagcgcc

SEQ ID NO: 1537941 - RNA, 16 nt, Pseudomonas aeruginosa PA01
gagcaggcguuccggg

SEQ ID NO: 1537942 - RNA, 12 nt, Pseudomonas aeruginosa PA01
gagcaggcugcu

SEQ ID NO: 1537943 - RNA, 17 nt, Pseudomonas aeruginosa PA01
gagcagggucgcgagca

SEQ ID NO: 1537944 - RNA, 16 nt, Pseudomonas aeruginosa PA01
gagcagggugaagcug

SEQ ID NO: 1537945 - RNA, 12 nt, Pseudomonas aeruginosa PA01
gagcagggugac

SEQ ID NO: 1537946 - RNA, 23 nt, Pseudomonas aeruginosa PA01
gagcagggugacggugaucgccg

SEQ ID NO: 1537947 - RNA, 20 nt, Pseudomonas aeruginosa PA01
gagcaugucgcuccagaccu

SEQ ID NO: 1537948 - RNA, 21 nt, Pseudomonas aeruginosa PA01
gagcaugucuucgucgcgcuu

SEQ ID NO: 1537949 - RNA, 14 nt, Pseudomonas aeruginosa PA01
gagcaugccgcaga

SEQ ID NO: 1537950 - RNA, 20 nt, Pseudomonas aeruginosa PA01
gagcaugcucacugcgagca

SEQ ID NO: 1537951 - RNA, 15 nt, Pseudomonas aeruginosa PA01
gagcaguugcgggcg

SEQ ID NO: 1537952 - RNA, 23 nt, Pseudomonas aeruginosa PA01
gagcaguuucggaucgacgccuu

SEQ ID NO: 1537953 - RNA, 21 nt, Pseudomonas aeruginosa PA01
gagcaucaccgcgguggaggc

SEQ ID NO: 1537954 - RNA, 17 nt, Pseudomonas aeruginosa PA01
gagcaugaugcaggcag

SEQ ID NO: 1537955 - RNA, 19 nt, Pseudomonas aeruginosa PA01
gagcaucugccgggcgcgc

SEQ ID NO: 1537956 - RNA, 19 nt, Pseudomonas aeruginosa PA01
gagcaucugggucuucagc

SEQ ID NO: 1537957 - RNA, 18 nt, Pseudomonas aeruginosa PA01
gagcaucggcgcggccuu

SEQ ID NO: 1537958 - RNA, 19 nt, Pseudomonas aeruginosa PA01
gagccagguuuccggcagc

SEQ ID NO: 1537959 - RNA, 20 nt, Pseudomonas aeruginosa PA01
gagccagguuuccggcagca

SEQ ID NO: 1537960 - RNA, 18 nt, Pseudomonas aeruginosa PA01
gagccagucgagagcggg

SEQ ID NO: 1537961 - RNA, 9 nt, Pseudomonas aeruginosa PA01
gagccaggc

SEQ ID NO: 1537962 - RNA, 15 nt, Pseudomonas aeruginosa PA01
gagccagccugcagc

SEQ ID NO: 1537963 - RNA, 16 nt, Pseudomonas aeruginosa PA01
gagccagccugcagcc

SEQ ID NO: 1537964 - RNA, 22 nt, Pseudomonas aeruginosa PA01
gagccagcgcucgaacgccgcc

SEQ ID NO: 1537965 - RNA, 17 nt, Pseudomonas aeruginosa PA01
gagccagcccagcggcg

SEQ ID NO: 1537966 - RNA, 20 nt, Pseudomonas aeruginosa PA01
gagccagcccagcggcgcgg

SEQ ID NO: 1537967 - RNA, 14 nt, Pseudomonas aeruginosa PA01
gagccagccgcagc

SEQ ID NO: 1537968 - RNA, 19 nt, Pseudomonas aeruginosa PA01
gagccagccgcagcccggu

SEQ ID NO: 1537969 - RNA, 12 nt, Pseudomonas aeruginosa PA01
gagccagccgcg

SEQ ID NO: 1537970 - RNA, 21 nt, Pseudomonas aeruginosa PA01
gagccagccguggcaggcgcc

SEQ ID NO: 1537971 - RNA, 21 nt, Pseudomonas aeruginosa PA01
gagccacggauaugcgccgcc

SEQ ID NO: 1537972 - RNA, 22 nt, Pseudomonas aeruginosa PA01
gagccacggauaugcgccgcca

SEQ ID NO: 1537973 - RNA, 20 nt, Pseudomonas aeruginosa PA01
gagcccagcggcagggcggc

SEQ ID NO: 1537974 - RNA, 21 nt, Pseudomonas aeruginosa PA01
gagcccagcggcagggcggcg

SEQ ID NO: 1537975 - RNA, 13 nt, Pseudomonas aeruginosa PA01
gagcccaggcaga

SEQ ID NO: 1537976 - RNA, 23 nt, Pseudomonas aeruginosa PA01
gagccauucggcuuccugggcga

SEQ ID NO: 1537977 - RNA, 20 nt, Pseudomonas aeruginosa PA01
gagcccgagugcgcccagca

SEQ ID NO: 1537978 - RNA, 21 nt, Pseudomonas aeruginosa PA01
gagcccgagugcgcccagcag

SEQ ID NO: 1537979 - RNA, 20 nt, Pseudomonas aeruginosa PA01
gagcccgucgaagccaggca

SEQ ID NO: 1537980 - RNA, 20 nt, Pseudomonas aeruginosa PA01
gagccgacauccugucgagg

SEQ ID NO: 1537981 - RNA, 23 nt, Pseudomonas aeruginosa PA01
gagccgaacuccggugucaggcc

SEQ ID NO: 1537982 - RNA, 17 nt, Pseudomonas aeruginosa PA01
gagccgacuuccagcuu

SEQ ID NO: 1537983 - RNA, 14 nt, Pseudomonas aeruginosa PA01
gagccgaucaccag

SEQ ID NO: 1537984 - RNA, 16 nt, Pseudomonas aeruginosa PA01
gagccgaucaccagca

SEQ ID NO: 1537985 - RNA, 13 nt, Pseudomonas aeruginosa PA01
gagccgccgggcg

SEQ ID NO: 1537986 - RNA, 22 nt, Pseudomonas aeruginosa PA01
gagccgccggggaagcugccuu

SEQ ID NO: 1537987 - RNA, 13 nt, Pseudomonas aeruginosa PA01
gagccgcccucgg

SEQ ID NO: 1537988 - RNA, 14 nt, Pseudomonas aeruginosa PA01
gagccgcaggguga

SEQ ID NO: 1537989 - RNA, 21 nt, Pseudomonas aeruginosa PA01
gagccggcgcaucagcgccgg

SEQ ID NO: 1537990 - RNA, 13 nt, Pseudomonas aeruginosa PA01
gagccggccaggc

SEQ ID NO: 1537991 - RNA, 19 nt, Pseudomonas aeruginosa PA01
gagccggauagaucaggcc

SEQ ID NO: 1537992 - RNA, 13 nt, Pseudomonas aeruginosa PA01
gagccggacggcg

SEQ ID NO: 1537993 - RNA, 13 nt, Pseudomonas aeruginosa PA01
gagccgcuggcau

SEQ ID NO: 1537994 - RNA, 22 nt, Pseudomonas aeruginosa PA01
gagccggcugaugcccgggucg

SEQ ID NO: 1537995 - RNA, 16 nt, Pseudomonas aeruginosa PA01
gagccggguaugcagg

SEQ ID NO: 1537996 - RNA, 13 nt, Pseudomonas aeruginosa PA01
gagccgguagugc

SEQ ID NO: 1537997 - RNA, 15 nt, Pseudomonas aeruginosa PA01
gaugugcaccagcaa

SEQ ID NO: 1537998 - RNA, 15 nt, Pseudomonas aeruginosa PA01
gauggcucauggcau

SEQ ID NO: 1537999 - RNA, 20 nt, Pseudomonas aeruginosa PA01
gaugggaacgaguugggcga

SEQ ID NO: 1538000 - RNA, 14 nt, Pseudomonas aeruginosa PA01
gaugucggccugca

SEQ ID NO: 1538001 - RNA, 23 nt, Pseudomonas aeruginosa PA01
gauucaggcggcgaaagccaucu

SEQ ID NO: 1538002 - RNA, 14 nt, Pseudomonas aeruginosa PA01
gauucaucggcggc

SEQ ID NO: 1538003 - RNA, 15 nt, Pseudomonas aeruginosa PA01
gauucaucggcggca

SEQ ID NO: 1538004 - RNA, 16 nt, Pseudomonas aeruginosa PA01
gauuccugucuccgca

SEQ ID NO: 1538005 - RNA, 19 nt, Pseudomonas aeruginosa PA01
gauuccugucuccgcaccu

SEQ ID NO: 1538006 - RNA, 17 nt, Pseudomonas aeruginosa PA01
gauuccuggaccccgcc

SEQ ID NO: 1538007 - RNA, 12 nt, Pseudomonas aeruginosa PA01
gcaaaaaaaggg

SEQ ID NO: 1538008 - RNA, 17 nt, Pseudomonas aeruginosa PA01
gauuuccgcggccggca

SEQ ID NO: 1538009 - RNA, 18 nt, Pseudomonas aeruginosa PA01
gauuuccgcggccggcag

SEQ ID NO: 1538010 - RNA, 17 nt, Pseudomonas aeruginosa PA01
gauuuccgauccuccug

SEQ ID NO: 1538011 - RNA, 19 nt, Pseudomonas aeruginosa PA01
gauuuccucgcugcgggcg

SEQ ID NO: 1538012 - RNA, 15 nt, Pseudomonas aeruginosa PA01
gauuucccccggucc

SEQ ID NO: 1538013 - RNA, 17 nt, Pseudomonas aeruginosa PA01
gauucggguagucuucg

SEQ ID NO: 1538014 - RNA, 18 nt, Pseudomonas aeruginosa PA01
gauucgccgaggaacuuc

SEQ ID NO: 1538015 - RNA, 20 nt, Pseudomonas aeruginosa PA01
gauucgccagccucggcgaa

SEQ ID NO: 1538016 - RNA, 20 nt, Pseudomonas aeruginosa PA01
gauugcagguaguucuccag

SEQ ID NO: 1538017 - RNA, 16 nt, Pseudomonas aeruginosa PA01
gaugcggauguaguuc

SEQ ID NO: 1538018 - RNA, 21 nt, Pseudomonas aeruginosa PA01
gaugcgcuuuuccucgaccca

SEQ ID NO: 1538019 - RNA, 16 nt, Pseudomonas aeruginosa PA01
gaugcgccccagcgcc

SEQ ID NO: 1538020 - RNA, 24 nt, Pseudomonas aeruginosa PA01
gaugccgccugcgucagcgaggcg

SEQ ID NO: 1538021 - RNA, 17 nt, Pseudomonas aeruginosa PA01
gaugccgcgagccagcc

SEQ ID NO: 1538022 - RNA, 14 nt, Pseudomonas aeruginosa PA01
gaugcccgccagca

SEQ ID NO: 1538023 - RNA, 19 nt, Pseudomonas aeruginosa PA01
gaugccgcgguaggucagc

SEQ ID NO: 1538024 - RNA, 21 nt, Pseudomonas aeruginosa PA01
gaugccggccggcagcgagcg

SEQ ID NO: 1538025 - RNA, 17 nt, Pseudomonas aeruginosa PA01
gaugccggcgaugaugg

SEQ ID NO: 1538026 - RNA, 14 nt, Pseudomonas aeruginosa PA01
gaugcccaggccgc

SEQ ID NO: 1538027 - RNA, 16 nt, Pseudomonas aeruginosa PA01
gaugcccaggccgccg

SEQ ID NO: 1538028 - RNA, 17 nt, Pseudomonas aeruginosa PA01
gaugcccagccagggcc

SEQ ID NO: 1538029 - RNA, 18 nt, Pseudomonas aeruginosa PA01
gaugcccagccagggccg

SEQ ID NO: 1538030 - RNA, 17 nt, Pseudomonas aeruginosa PA01
gaugcggcccgccggcg

SEQ ID NO: 1538031 - RNA, 14 nt, Pseudomonas aeruginosa PA01
gaugcuccagguuc

SEQ ID NO: 1538032 - RNA, 15 nt, Pseudomonas aeruginosa PA01
gaugcucaccgcgcu

SEQ ID NO: 1538033 - RNA, 21 nt, Pseudomonas aeruginosa PA01
gaugcugaucacccgcccgcc

SEQ ID NO: 1538034 - RNA, 18 nt, Pseudomonas aeruginosa PA01
gaugcugaucuucugucc

SEQ ID NO: 1538035 - RNA, 22 nt, Pseudomonas aeruginosa PA01
gaugcucggugugaucaccagc

SEQ ID NO: 1538036 - RNA, 16 nt, Pseudomonas aeruginosa PA01
gauggccagccaggac

SEQ ID NO: 1538037 - RNA, 13 nt, Pseudomonas aeruginosa PA01
gauggccagcccg

SEQ ID NO: 1538038 - RNA, 22 nt, Pseudomonas aeruginosa PA01
gauggccagcccggagccguug

SEQ ID NO: 1538039 - RNA, 19 nt, Pseudomonas aeruginosa PA01
gauggccagggggccuggc

SEQ ID NO: 1538040 - RNA, 19 nt, Pseudomonas aeruginosa PA01
gauggcccguuccaccgcc

SEQ ID NO: 1538041 - RNA, 11 nt, Pseudomonas aeruginosa PA01
gauggcccaga

SEQ ID NO: 1538042 - RNA, 17 nt, Pseudomonas aeruginosa PA01
gauggccggcagcagcg

SEQ ID NO: 1538043 - RNA, 16 nt, Pseudomonas aeruginosa PA01
gauggccgccgccgcc

SEQ ID NO: 1538044 - RNA, 20 nt, Pseudomonas aeruginosa PA01
gauggccgccgccgccgucg

SEQ ID NO: 1538045 - RNA, 15 nt, Pseudomonas aeruginosa PA01
gauggccgccguucu

SEQ ID NO: 1538046 - RNA, 19 nt, Pseudomonas aeruginosa PA01
gaugauacgcacgcuggug

SEQ ID NO: 1538047 - RNA, 22 nt, Pseudomonas aeruginosa PA01
gaugauggucaacaccagcgcc

SEQ ID NO: 1538048 - RNA, 19 nt, Pseudomonas aeruginosa PA01
gaugccacugacgcgcagc

SEQ ID NO: 1538049 - RNA, 17 nt, Pseudomonas aeruginosa PA01
gaugcagauccagcggc

SEQ ID NO: 1538050 - RNA, 16 nt, Pseudomonas aeruginosa PA01
gaugaagaucaucugg

SEQ ID NO: 1538051 - RNA, 13 nt, Pseudomonas aeruginosa PA01
gaugaagccgcga

SEQ ID NO: 1538052 - RNA, 18 nt, Pseudomonas aeruginosa PA01
gaugaagccgcgaccggg

SEQ ID NO: 1538053 - RNA, 21 nt, Pseudomonas aeruginosa PA01
gaugaacuggucgcuccagcc

SEQ ID NO: 1538054 - RNA, 14 nt, Pseudomonas aeruginosa PA01
gaugaccccggcga

SEQ ID NO: 1538055 - RNA, 15 nt, Pseudomonas aeruginosa PA01
gaugacccgcucgcc

SEQ ID NO: 1538056 - RNA, 19 nt, Pseudomonas aeruginosa PA01
gaugaccgccccggcagcc

SEQ ID NO: 1538057 - RNA, 23 nt, Pseudomonas aeruginosa PA01
gaugaccaggguggcggcggcga

SEQ ID NO: 1538058 - RNA, 21 nt, Pseudomonas aeruginosa PA01
gaucugccgguaauuggccag

SEQ ID NO: 1538059 - RNA, 11 nt, Pseudomonas aeruginosa PA01
gaucugcaggu

SEQ ID NO: 1538060 - RNA, 13 nt, Pseudomonas aeruginosa PA01
gaucugcaccgcc

SEQ ID NO: 1538061 - RNA, 18 nt, Pseudomonas aeruginosa PA01
gaucucgugggccagcag

SEQ ID NO: 1538062 - RNA, 22 nt, Pseudomonas aeruginosa PA01
gaucucuacuaccgccagcgca

SEQ ID NO: 1538063 - RNA, 17 nt, Pseudomonas aeruginosa PA01
gaucucgcguuccagca

SEQ ID NO: 1538064 - RNA, 19 nt, Pseudomonas aeruginosa PA01
gaucucgcgccccgggacc

SEQ ID NO: 1538065 - RNA, 14 nt, Pseudomonas aeruginosa PA01
gaucucgccauggc

SEQ ID NO: 1538066 - RNA, 16 nt, Pseudomonas aeruginosa PA01
gaucucgccauggcgg

SEQ ID NO: 1538067 - RNA, 22 nt, Pseudomonas aeruginosa PA01
gaucuccacccguucgccggcc

SEQ ID NO: 1538068 - RNA, 23 nt, Pseudomonas aeruginosa PA01
gaucucgaacucgaaggccagcu

SEQ ID NO: 1538069 - RNA, 19 nt, Pseudomonas aeruginosa PA01
gaucuccucgcgcagcggc

SEQ ID NO: 1538070 - RNA, 14 nt, Pseudomonas aeruginosa PA01
gaucuccuccgccc

SEQ ID NO: 1538071 - RNA, 22 nt, Pseudomonas aeruginosa PA01
gaucuccgggagcaucuggccc

SEQ ID NO: 1538072 - RNA, 22 nt, Pseudomonas aeruginosa PA01
gauccccucccgcgccagcgcc

SEQ ID NO: 1538073 - RNA, 21 nt, Pseudomonas aeruginosa PA01
gauccccaacccggccagccc

SEQ ID NO: 1538074 - RNA, 19 nt, Pseudomonas aeruginosa PA01
gaucccaggucggcgggca

SEQ ID NO: 1538075 - RNA, 20 nt, Pseudomonas aeruginosa PA01
gaucccaggucggcgggcac

SEQ ID NO: 1538076 - RNA, 17 nt, Pseudomonas aeruginosa PA01
gaucccgaucgccaaua

SEQ ID NO: 1538077 - RNA, 22 nt, Pseudomonas aeruginosa PA01
gaucccgacgcccuccagcacc

SEQ ID NO: 1538078 - RNA, 16 nt, Pseudomonas aeruginosa PA01
gaugaaacgcagggcc

SEQ ID NO: 1538079 - RNA, 16 nt, Pseudomonas aeruginosa PA01
gaugaaauagccggcg

SEQ ID NO: 1538080 - RNA, 16 nt, Pseudomonas aeruginosa PA01
gaucuuguccgggaag

SEQ ID NO: 1538081 - RNA, 22 nt, Pseudomonas aeruginosa PA01
gaucuucgccuccuucaucuug

SEQ ID NO: 1538082 - RNA, 13 nt, Pseudomonas aeruginosa PA01
gaucuucuguccc

SEQ ID NO: 1538083 - RNA, 17 nt, Pseudomonas aeruginosa PA01
gaucuucuuccccgcca

SEQ ID NO: 1538084 - RNA, 13 nt, Pseudomonas aeruginosa PA01
gaucuucagcagc

SEQ ID NO: 1538085 - RNA, 18 nt, Pseudomonas aeruginosa PA01
gaucuucagcagcaggcg

SEQ ID NO: 1538086 - RNA, 14 nt, Pseudomonas aeruginosa PA01
gaucuucaggccga

SEQ ID NO: 1538087 - RNA, 22 nt, Pseudomonas aeruginosa PA01
gaucuucagguaggcgcgggcg

SEQ ID NO: 1538088 - RNA, 13 nt, Pseudomonas aeruginosa PA01
gaucuggcugccc

SEQ ID NO: 1538089 - RNA, 20 nt, Pseudomonas aeruginosa PA01
gaucugugcggugccgcgca

SEQ ID NO: 1538090 - RNA, 17 nt, Pseudomonas aeruginosa PA01
gaucugcuugcgcgccg

SEQ ID NO: 1538091 - RNA, 14 nt, Pseudomonas aeruginosa PA01
gaucugcugguuga

SEQ ID NO: 1538092 - RNA, 13 nt, Pseudomonas aeruginosa PA01
gaucuggccaccc

SEQ ID NO: 1538093 - RNA, 17 nt, Pseudomonas aeruginosa PA01
gaucuggcccugcaaca

SEQ ID NO: 1538094 - RNA, 18 nt, Pseudomonas aeruginosa PA01
gaucuggcccugcaacag

SEQ ID NO: 1538095 - RNA, 14 nt, Pseudomonas aeruginosa PA01
gaucugcuccugca

SEQ ID NO: 1538096 - RNA, 21 nt, Pseudomonas aeruginosa PA01
gaucugcucguccaggccgca

SEQ ID NO: 1538097 - RNA, 16 nt, Pseudomonas aeruginosa PA01
gaucugcugcaacaug

SEQ ID NO: 1538098 - RNA, 15 nt, Pseudomonas aeruginosa PA01
gauauagcuggucaa

SEQ ID NO: 1538099 - RNA, 16 nt, Pseudomonas aeruginosa PA01
gaucaccggcuggccc

SEQ ID NO: 1538100 - RNA, 17 nt, Pseudomonas aeruginosa PA01
gaucaccgcggcgcuga

SEQ ID NO: 1538101 - RNA, 22 nt, Pseudomonas aeruginosa PA01
gaucaccagggucggcaccugc

SEQ ID NO: 1538102 - RNA, 18 nt, Pseudomonas aeruginosa PA01
gaucaccuucaccggcac

SEQ ID NO: 1538103 - RNA, 22 nt, Pseudomonas aeruginosa PA01
gaucaccuucaccggcacgccc

SEQ ID NO: 1538104 - RNA, 23 nt, Pseudomonas aeruginosa PA01
gaucaccuucucguagcgcucgu

SEQ ID NO: 1538105 - RNA, 18 nt, Pseudomonas aeruginosa PA01
gaucacccgcgaggccgg

SEQ ID NO: 1538106 - RNA, 20 nt, Pseudomonas aeruginosa PA01
gaucacccgcgaggccggcc

SEQ ID NO: 1538107 - RNA, 17 nt, Pseudomonas aeruginosa PA01
gaucacccccagcgagc

SEQ ID NO: 1538108 - RNA, 23 nt, Pseudomonas aeruginosa PA01
gaucacccccagcgagccgagca

SEQ ID NO: 1538109 - RNA, 12 nt, Pseudomonas aeruginosa PA01
gaucaccagcaa

SEQ ID NO: 1538110 - RNA, 13 nt, Pseudomonas aeruginosa PA01
gaucaccaccugg

SEQ ID NO: 1538111 - RNA, 14 nt, Pseudomonas aeruginosa PA01
gaucaccagccacu

SEQ ID NO: 1538112 - RNA, 18 nt, Pseudomonas aeruginosa PA01
gaucaccagcgccaggcc

SEQ ID NO: 1538113 - RNA, 12 nt, Pseudomonas aeruginosa PA01
gaucaccaggac

SEQ ID NO: 1538114 - RNA, 14 nt, Pseudomonas aeruginosa PA01
gaucaccaccaccg

SEQ ID NO: 1538115 - RNA, 13 nt, Pseudomonas aeruginosa PA01
gaucaccaccacg

SEQ ID NO: 1538116 - RNA, 14 nt, Pseudomonas aeruginosa PA01
gaucaccaccacgc

SEQ ID NO: 1538117 - RNA, 22 nt, Pseudomonas aeruginosa PA01
gaucaauugccgguagccggcg

SEQ ID NO: 1538118 - RNA, 20 nt, Pseudomonas aeruginosa PA01
gauccaggugcgcggcagga

SEQ ID NO: 1538119 - RNA, 20 nt, Pseudomonas aeruginosa PA01
gauccaggucgaucagcagc

SEQ ID NO: 1538120 - RNA, 23 nt, Pseudomonas aeruginosa PA01
gauccaggucgaucagcagcagc

SEQ ID NO: 1538121 - RNA, 16 nt, Pseudomonas aeruginosa PA01
gaucaucgccugcugg

SEQ ID NO: 1538122 - RNA, 23 nt, Pseudomonas aeruginosa PA01
gaucaucgccugcugguggguga

SEQ ID NO: 1538123 - RNA, 14 nt, Pseudomonas aeruginosa PA01
gaucaucggcuggc

SEQ ID NO: 1538124 - RNA, 14 nt, Pseudomonas aeruginosa PA01
gaucaucggcuggu

SEQ ID NO: 1538125 - RNA, 22 nt, Pseudomonas aeruginosa PA01
gaucaucaucagguagagggcg

SEQ ID NO: 1538126 - RNA, 21 nt, Pseudomonas aeruginosa PA01
gaucauccgcaccauccgccg

SEQ ID NO: 1538127 - RNA, 23 nt, Pseudomonas aeruginosa PA01
gaucaucugcugcagcaucaggc

SEQ ID NO: 1538128 - RNA, 13 nt, Pseudomonas aeruginosa PA01
gaucaucugggcc

SEQ ID NO: 1538129 - RNA, 14 nt, Pseudomonas aeruginosa PA01
gaucaucugggcca

SEQ ID NO: 1538130 - RNA, 12 nt, Pseudomonas aeruginosa PA01
gaucaccugcuu

SEQ ID NO: 1538131 - RNA, 17 nt, Pseudomonas aeruginosa PA01
gaucacgauggccggca

SEQ ID NO: 1538132 - RNA, 20 nt, Pseudomonas aeruginosa PA01
gaucacgauggccggcagca

SEQ ID NO: 1538133 - RNA, 22 nt, Pseudomonas aeruginosa PA01
gaucacgauggccggcagcagc

SEQ ID NO: 1538134 - RNA, 14 nt, Pseudomonas aeruginosa PA01
gaucacgcagcagg

SEQ ID NO: 1538135 - RNA, 19 nt, Pseudomonas aeruginosa PA01
gaucagcacccggucggcc

SEQ ID NO: 1538136 - RNA, 21 nt, Pseudomonas aeruginosa PA01
gauagcgcgcaggcgcuaucc

SEQ ID NO: 1538137 - RNA, 13 nt, Pseudomonas aeruginosa PA01
gauaggcggcgga

SEQ ID NO: 1538138 - RNA, 23 nt, Pseudomonas aeruginosa PA01
gauagcgauaggccuugccuucg

SEQ ID NO: 1538139 - RNA, 14 nt, Pseudomonas aeruginosa PA01
gauagccuccuccg

SEQ ID NO: 1538140 - RNA, 17 nt, Pseudomonas aeruginosa PA01
gauagucguucuuccug

SEQ ID NO: 1538141 - RNA, 17 nt, Pseudomonas aeruginosa PA01
gauagugcggccaggcg

SEQ ID NO: 1538142 - RNA, 22 nt, Pseudomonas aeruginosa PA01
gauaagcucggcuugacuggca

SEQ ID NO: 1538143 - RNA, 15 nt, Pseudomonas aeruginosa PA01
gauacuccagcagcg

SEQ ID NO: 1538144 - RNA, 13 nt, Pseudomonas aeruginosa PA01
gauacuccuucaa

SEQ ID NO: 1538145 - RNA, 15 nt, Pseudomonas aeruginosa PA01
gauagccaaccagau

SEQ ID NO: 1538146 - RNA, 16 nt, Pseudomonas aeruginosa PA01
gaggguguucagcggc

SEQ ID NO: 1538147 - RNA, 18 nt, Pseudomonas aeruginosa PA01
gaggguguucagcggcgc

SEQ ID NO: 1538148 - RNA, 21 nt, Pseudomonas aeruginosa PA01
gaggguggcgcccaugccgcc

SEQ ID NO: 1538149 - RNA, 22 nt, Pseudomonas aeruginosa PA01
gaggguugcacaagccguuacg

SEQ ID NO: 1538150 - RNA, 18 nt, Pseudomonas aeruginosa PA01
gagguagaacaggcugcc

SEQ ID NO: 1538151 - RNA, 16 nt, Pseudomonas aeruginosa PA01
gagguagaagcggccg

SEQ ID NO: 1538152 - RNA, 13 nt, Pseudomonas aeruginosa PA01
gagguaagugauu

SEQ ID NO: 1538153 - RNA, 16 nt, Pseudomonas aeruginosa PA01
gagggucagaccagcc

SEQ ID NO: 1538154 - RNA, 18 nt, Pseudomonas aeruginosa PA01
gaggguauugaggaucca

SEQ ID NO: 1538155 - RNA, 21 nt, Pseudomonas aeruginosa PA01
gagggggccucggccagcgcc

SEQ ID NO: 1538156 - RNA, 15 nt, Pseudomonas aeruginosa PA01
gaggguggaacccau

SEQ ID NO: 1538157 - RNA, 23 nt, Pseudomonas aeruginosa PA01
gagggugaucagccgagguucuu

SEQ ID NO: 1538158 - RNA, 19 nt, Pseudomonas aeruginosa PA01
gagggugaucagcuccgcc

SEQ ID NO: 1538159 - RNA, 12 nt, Pseudomonas aeruginosa PA01
gagggucgccuu

SEQ ID NO: 1538160 - RNA, 14 nt, Pseudomonas aeruginosa PA01
gagggucugcucga

SEQ ID NO: 1538161 - RNA, 19 nt, Pseudomonas aeruginosa PA01
gagggucugcugguagcug

SEQ ID NO: 1538162 - RNA, 13 nt, Pseudomonas aeruginosa PA01
gaggggcgacgga

SEQ ID NO: 1538163 - RNA, 16 nt, Pseudomonas aeruginosa PA01
gaggggcggagcagcc

SEQ ID NO: 1538164 - RNA, 23 nt, Pseudomonas aeruginosa PA01
gagggcugagacgcugccguucg

SEQ ID NO: 1538165 - RNA, 17 nt, Pseudomonas aeruginosa PA01
gagggcugggcagcgcc

SEQ ID NO: 1538166 - RNA, 15 nt, Pseudomonas aeruginosa PA01
gagggcguccuugcc

SEQ ID NO: 1538167 - RNA, 22 nt, Pseudomonas aeruginosa PA01
gagggcguccuugcccggcgcc

SEQ ID NO: 1538168 - RNA, 15 nt, Pseudomonas aeruginosa PA01
gagggccgcgcugcu

SEQ ID NO: 1538169 - RNA, 20 nt, Pseudomonas aeruginosa PA01
gagggccggguugcgccucc

SEQ ID NO: 1538170 - RNA, 22 nt, Pseudomonas aeruginosa PA01
gagggcgaugcccuuggccagc

SEQ ID NO: 1538171 - RNA, 15 nt, Pseudomonas aeruginosa PA01
gagggcgaccgccag

SEQ ID NO: 1538172 - RNA, 18 nt, Pseudomonas aeruginosa PA01
gagggcgaccgccaggcg

SEQ ID NO: 1538173 - RNA, 20 nt, Pseudomonas aeruginosa PA01
gagggcgaccgccaggcggc

SEQ ID NO: 1538174 - RNA, 21 nt, Pseudomonas aeruginosa PA01
gagggcgaccgccaggcggcc

SEQ ID NO: 1538175 - RNA, 19 nt, Pseudomonas aeruginosa PA01
gagggcgcgcaguagcugg

SEQ ID NO: 1538176 - RNA, 20 nt, Pseudomonas aeruginosa PA01
gagggcgcguugcccagccc

SEQ ID NO: 1538177 - RNA, 22 nt, Pseudomonas aeruginosa PA01
gagggcggcggcucaggccgcc

SEQ ID NO: 1538178 - RNA, 14 nt, Pseudomonas aeruginosa PA01
gaggcugugggucg

SEQ ID NO: 1538179 - RNA, 21 nt, Pseudomonas aeruginosa PA01
gaggcuggcgcucugcagugu

SEQ ID NO: 1538180 - RNA, 16 nt, Pseudomonas aeruginosa PA01
gagggcaaaggcgcgc

SEQ ID NO: 1538181 - RNA, 16 nt, Pseudomonas aeruginosa PA01
gagggaucgcgcggcu

SEQ ID NO: 1538182 - RNA, 22 nt, Pseudomonas aeruginosa PA01
gagggaggucgcacgcagcgcc

SEQ ID NO: 1538183 - RNA, 22 nt, Pseudomonas aeruginosa PA01
gagggauaccaacuuucccucu

SEQ ID NO: 1538184 - RNA, 20 nt, Pseudomonas aeruginosa PA01
gaggcguucgaucuccucgc

SEQ ID NO: 1538185 - RNA, 16 nt, Pseudomonas aeruginosa PA01
gaggcuaacgccgagg

SEQ ID NO: 1538186 - RNA, 16 nt, Pseudomonas aeruginosa PA01
gaggcggucaugcgcc

SEQ ID NO: 1538187 - RNA, 16 nt, Pseudomonas aeruginosa PA01
gaggcgucggcgggaa

SEQ ID NO: 1538188 - RNA, 22 nt, Pseudomonas aeruginosa PA01
gaggcggucuuuuugcagggaa

SEQ ID NO: 1538189 - RNA, 18 nt, Pseudomonas aeruginosa PA01
gaggcucccagguggaaa

SEQ ID NO: 1538190 - RNA, 13 nt, Pseudomonas aeruginosa PA01
gaggcucagccga

SEQ ID NO: 1538191 - RNA, 13 nt, Pseudomonas aeruginosa PA01
gaggcuggggacg

SEQ ID NO: 1538192 - RNA, 14 nt, Pseudomonas aeruginosa PA01
gaggcuggggacgg

SEQ ID NO: 1538193 - RNA, 14 nt, Pseudomonas aeruginosa PA01
gaggcuguccagca

SEQ ID NO: 1538194 - RNA, 19 nt, Pseudomonas aeruginosa PA01
gagguuaacaguugagcug

SEQ ID NO: 1538195 - RNA, 16 nt, Pseudomonas aeruginosa PA01
gaggugguauugcagc

SEQ ID NO: 1538196 - RNA, 22 nt, Pseudomonas aeruginosa PA01
gagguggcugaagccccagccc

SEQ ID NO: 1538197 - RNA, 17 nt, Pseudomonas aeruginosa PA01
gagguggaugaacagcg

SEQ ID NO: 1538198 - RNA, 16 nt, Pseudomonas aeruginosa PA01
gagguaggccagcccc

SEQ ID NO: 1538199 - RNA, 15 nt, Pseudomonas aeruginosa PA01
gaggucuuggccagc

SEQ ID NO: 1538200 - RNA, 13 nt, Pseudomonas aeruginosa PA01
gaggucggccugg

SEQ ID NO: 1538201 - RNA, 19 nt, Pseudomonas aeruginosa PA01
gaggucggcgaacagggug

SEQ ID NO: 1538202 - RNA, 14 nt, Pseudomonas aeruginosa PA01
gaggucgcggacga

SEQ ID NO: 1538203 - RNA, 19 nt, Pseudomonas aeruginosa PA01
gaggucgcgggccaggccc

SEQ ID NO: 1538204 - RNA, 21 nt, Pseudomonas aeruginosa PA01
gagguuuccaguugcagggug

SEQ ID NO: 1538205 - RNA, 16 nt, Pseudomonas aeruginosa PA01
gagguucuugcccagc

SEQ ID NO: 1538206 - RNA, 16 nt, Pseudomonas aeruginosa PA01
gaguaaaacggcaggc

SEQ ID NO: 1538207 - RNA, 20 nt, Pseudomonas aeruginosa PA01
gaguaccgcugcggccggcg

SEQ ID NO: 1538208 - RNA, 18 nt, Pseudomonas aeruginosa PA01
gaguccccuaggggacgc

SEQ ID NO: 1538209 - RNA, 16 nt, Pseudomonas aeruginosa PA01
gagucccuugcggcag

SEQ ID NO: 1538210 - RNA, 16 nt, Pseudomonas aeruginosa PA01
gaguaggggcagaccu

SEQ ID NO: 1538211 - RNA, 16 nt, Pseudomonas aeruginosa PA01
gaguagccggcggcga

SEQ ID NO: 1538212 - RNA, 13 nt, Pseudomonas aeruginosa PA01
gaguagaaaagaa

SEQ ID NO: 1538213 - RNA, 17 nt, Pseudomonas aeruginosa PA01
gaguagaaaagaaaauu

SEQ ID NO: 1538214 - RNA, 18 nt, Pseudomonas aeruginosa PA01
gagucgacccaggcccag

SEQ ID NO: 1538215 - RNA, 19 nt, Pseudomonas aeruginosa PA01
gagucgaucaggucgccgc

SEQ ID NO: 1538216 - RNA, 16 nt, Pseudomonas aeruginosa PA01
gaguugcuuggcgcgc

SEQ ID NO: 1538217 - RNA, 20 nt, Pseudomonas aeruginosa PA01
gaguugcuuggcgcgcuggc

SEQ ID NO: 1538218 - RNA, 23 nt, Pseudomonas aeruginosa PA01
gaguugcagggcuugugcagaga

SEQ ID NO: 1538219 - RNA, 18 nt, Pseudomonas aeruginosa PA01
gaguugccuguccagcuc

SEQ ID NO: 1538220 - RNA, 15 nt, Pseudomonas aeruginosa PA01
gaguggcgcagcgcc

SEQ ID NO: 1538221 - RNA, 13 nt, Pseudomonas aeruginosa PA01
gaguggaugucgu

SEQ ID NO: 1538222 - RNA, 13 nt, Pseudomonas aeruginosa PA01
gcagaccagcagc

SEQ ID NO: 1538223 - RNA, 21 nt, Pseudomonas aeruginosa PA01
gcagaccagcgaaccgccggc

SEQ ID NO: 1538224 - RNA, 13 nt, Pseudomonas aeruginosa PA01
gcagaccaggccg

SEQ ID NO: 1538225 - RNA, 17 nt, Pseudomonas aeruginosa PA01
gcagaccaucagcugga

SEQ ID NO: 1538226 - RNA, 22 nt, Pseudomonas aeruginosa PA01
gcagacgaucuccugcugggcg

SEQ ID NO: 1538227 - RNA, 21 nt, Pseudomonas aeruginosa PA01
gcagacgaucuggcagucguc

SEQ ID NO: 1538228 - RNA, 20 nt, Pseudomonas aeruginosa PA01
gcagacgauugaccucccgc

SEQ ID NO: 1538229 - RNA, 22 nt, Pseudomonas aeruginosa PA01
gcagacgauugaccucccgcgc

SEQ ID NO: 1538230 - RNA, 19 nt, Pseudomonas aeruginosa PA01
gcagaccuggugggcggcg

SEQ ID NO: 1538231 - RNA, 22 nt, Pseudomonas aeruginosa PA01
gcagaccuggugggcggcggcu

SEQ ID NO: 1538232 - RNA, 19 nt, Pseudomonas aeruginosa PA01
gcagaccuucgaagacccc

SEQ ID NO: 1538233 - RNA, 19 nt, Pseudomonas aeruginosa PA01
gcagacgcccugaggcuuu

SEQ ID NO: 1538234 - RNA, 17 nt, Pseudomonas aeruginosa PA01
gcagacgguucagcagc

SEQ ID NO: 1538235 - RNA, 15 nt, Pseudomonas aeruginosa PA01
gcagagacgcagcgc

SEQ ID NO: 1538236 - RNA, 21 nt, Pseudomonas aeruginosa PA01
gcagacuccggcgcagcccag

SEQ ID NO: 1538237 - RNA, 23 nt, Pseudomonas aeruginosa PA01
gcagacuccggcgcagcccagcc

SEQ ID NO: 1538238 - RNA, 18 nt, Pseudomonas aeruginosa PA01
gcagagaaaaggccgcuu

SEQ ID NO: 1538239 - RNA, 16 nt, Pseudomonas aeruginosa PA01
gcagaguggcgcggcu

SEQ ID NO: 1538240 - RNA, 18 nt, Pseudomonas aeruginosa PA01
gcagaguuuagccgccag

SEQ ID NO: 1538241 - RNA, 14 nt, Pseudomonas aeruginosa PA01
gcagauaaagcugg

SEQ ID NO: 1538242 - RNA, 15 nt, Pseudomonas aeruginosa PA01
gcagauaaagcugga

SEQ ID NO: 1538243 - RNA, 18 nt, Pseudomonas aeruginosa PA01
gcagagggucgccagcga

SEQ ID NO: 1538244 - RNA, 14 nt, Pseudomonas aeruginosa PA01
gcagagcggcaggc

SEQ ID NO: 1538245 - RNA, 21 nt, Pseudomonas aeruginosa PA01
gcagagcggccaggucgaggu

SEQ ID NO: 1538246 - RNA, 18 nt, Pseudomonas aeruginosa PA01
gcagagccagccgcagcc

SEQ ID NO: 1538247 - RNA, 15 nt, Pseudomonas aeruginosa PA01
gcagaaaaacccagc

SEQ ID NO: 1538248 - RNA, 13 nt, Pseudomonas aeruginosa PA01
gcagaaccgccag

SEQ ID NO: 1538249 - RNA, 14 nt, Pseudomonas aeruginosa PA01
gcagaaccgccagc

SEQ ID NO: 1538250 - RNA, 22 nt, Pseudomonas aeruginosa PA01
gcagaaccagacgcucggccag

SEQ ID NO: 1538251 - RNA, 23 nt, Pseudomonas aeruginosa PA01
gcagaaccagacgcucggccagc

SEQ ID NO: 1538252 - RNA, 17 nt, Pseudomonas aeruginosa PA01
gcagaaccgccagcagu

SEQ ID NO: 1538253 - RNA, 20 nt, Pseudomonas aeruginosa PA01
gcagaacgcggaaaccugca

SEQ ID NO: 1538254 - RNA, 13 nt, Pseudomonas aeruginosa PA01
gcagaagggcgga

SEQ ID NO: 1538255 - RNA, 11 nt, Pseudomonas aeruginosa PA01
gcacuuugcau

SEQ ID NO: 1538256 - RNA, 17 nt, Pseudomonas aeruginosa PA01
gcacuugcggcaguccu

SEQ ID NO: 1538257 - RNA, 14 nt, Pseudomonas aeruginosa PA01
gcacgcguggcgag

SEQ ID NO: 1538258 - RNA, 17 nt, Pseudomonas aeruginosa PA01
gcacuucucgaacagcu

SEQ ID NO: 1538259 - RNA, 19 nt, Pseudomonas aeruginosa PA01
gcacuucucgaacagcucc

SEQ ID NO: 1538260 - RNA, 20 nt, Pseudomonas aeruginosa PA01
gcacuucccaggugcccugg

SEQ ID NO: 1538261 - RNA, 17 nt, Pseudomonas aeruginosa PA01
gcacuucccgcccccuc

SEQ ID NO: 1538262 - RNA, 19 nt, Pseudomonas aeruginosa PA01
gcacuuccggacugcccag

SEQ ID NO: 1538263 - RNA, 16 nt, Pseudomonas aeruginosa PA01
gcagccacucggccag

SEQ ID NO: 1538264 - RNA, 22 nt, Pseudomonas aeruginosa PA01
gcagccacuguccaugaaugcc

SEQ ID NO: 1538265 - RNA, 15 nt, Pseudomonas aeruginosa PA01
gcagccagacccagu

SEQ ID NO: 1538266 - RNA, 17 nt, Pseudomonas aeruginosa PA01
gcagccagacccagugg

SEQ ID NO: 1538267 - RNA, 14 nt, Pseudomonas aeruginosa PA01
gcagcaggcgggcg

SEQ ID NO: 1538268 - RNA, 14 nt, Pseudomonas aeruginosa PA01
gcagcaggccggcg

SEQ ID NO: 1538269 - RNA, 17 nt, Pseudomonas aeruginosa PA01
gcagcagggucagcagc

SEQ ID NO: 1538270 - RNA, 18 nt, Pseudomonas aeruginosa PA01
gcagcagggucagcagcg

SEQ ID NO: 1538271 - RNA, 20 nt, Pseudomonas aeruginosa PA01
gcagcagggucagcagcgcc

SEQ ID NO: 1538272 - RNA, 15 nt, Pseudomonas aeruginosa PA01
gcagcagggucgggg

SEQ ID NO: 1538273 - RNA, 19 nt, Pseudomonas aeruginosa PA01
gcagccauuuuagaaaaau

SEQ ID NO: 1538274 - RNA, 22 nt, Pseudomonas aeruginosa PA01
gcagcccaguucgcgcaggacc

SEQ ID NO: 1538275 - RNA, 14 nt, Pseudomonas aeruginosa PA01
gcagcccagccgcu

SEQ ID NO: 1538276 - RNA, 13 nt, Pseudomonas aeruginosa PA01
gcagccccgaggc

SEQ ID NO: 1538277 - RNA, 17 nt, Pseudomonas aeruginosa PA01
gcagccccgaggccagc

SEQ ID NO: 1538278 - RNA, 17 nt, Pseudomonas aeruginosa PA01
gcagccauggcuggugc

SEQ ID NO: 1538279 - RNA, 14 nt, Pseudomonas aeruginosa PA01
gcagccagccgccg

SEQ ID NO: 1538280 - RNA, 11 nt, Pseudomonas aeruginosa PA01
gcagccaggcg

SEQ ID NO: 1538281 - RNA, 13 nt, Pseudomonas aeruginosa PA01
gcagccaggcgaa

SEQ ID NO: 1538282 - RNA, 21 nt, Pseudomonas aeruginosa PA01
gcagccaggcgaggaacagcg

SEQ ID NO: 1538283 - RNA, 20 nt, Pseudomonas aeruginosa PA01
gcagccagcuucagccgacc

SEQ ID NO: 1538284 - RNA, 19 nt, Pseudomonas aeruginosa PA01
gcagccguuggccagcagg

SEQ ID NO: 1538285 - RNA, 20 nt, Pseudomonas aeruginosa PA01
gcagccguuggccagcaggc

SEQ ID NO: 1538286 - RNA, 20 nt, Pseudomonas aeruginosa PA01
gcagccgguggucuucagca

SEQ ID NO: 1538287 - RNA, 12 nt, Pseudomonas aeruginosa PA01
gcagccugcugg

SEQ ID NO: 1538288 - RNA, 14 nt, Pseudomonas aeruginosa PA01
gcagccuggggguc

SEQ ID NO: 1538289 - RNA, 15 nt, Pseudomonas aeruginosa PA01
gcagccugggggucu

SEQ ID NO: 1538290 - RNA, 22 nt, Pseudomonas aeruginosa PA01
gcagccuucgcaaagcgagcgc

SEQ ID NO: 1538291 - RNA, 22 nt, Pseudomonas aeruginosa PA01
gcagccuuggcaugaccgagca

SEQ ID NO: 1538292 - RNA, 18 nt, Pseudomonas aeruginosa PA01
gcagccuuggccacggca

SEQ ID NO: 1538293 - RNA, 19 nt, Pseudomonas aeruginosa PA01
gcagccuuggccacggcau

SEQ ID NO: 1538294 - RNA, 19 nt, Pseudomonas aeruginosa PA01
gcagccgcaaggccagggc

SEQ ID NO: 1538295 - RNA, 22 nt, Pseudomonas aeruginosa PA01
gcagccgcaaggccagggcggc

SEQ ID NO: 1538296 - RNA, 23 nt, Pseudomonas aeruginosa PA01
gcagccgcaaggccagggcggcg

SEQ ID NO: 1538297 - RNA, 12 nt, Pseudomonas aeruginosa PA01
gcagccgcagga

SEQ ID NO: 1538298 - RNA, 20 nt, Pseudomonas aeruginosa PA01
gcagccgcaggaugccgccu

SEQ ID NO: 1538299 - RNA, 22 nt, Pseudomonas aeruginosa PA01
gcagccggggcucaggccuugg

SEQ ID NO: 1538300 - RNA, 16 nt, Pseudomonas aeruginosa PA01
gcagaugcuccaggga

SEQ ID NO: 1538301 - RNA, 15 nt, Pseudomonas aeruginosa PA01
gcagaugaucgccac

SEQ ID NO: 1538302 - RNA, 19 nt, Pseudomonas aeruginosa PA01
gcagaugcggggcgaccag

SEQ ID NO: 1538303 - RNA, 20 nt, Pseudomonas aeruginosa PA01
gcagaucggugcgggcagac

SEQ ID NO: 1538304 - RNA, 14 nt, Pseudomonas aeruginosa PA01
gcagauccagcggc

SEQ ID NO: 1538305 - RNA, 15 nt, Pseudomonas aeruginosa PA01
gcagauccagcggca

SEQ ID NO: 1538306 - RNA, 16 nt, Pseudomonas aeruginosa PA01
gcagcacagccccagc

SEQ ID NO: 1538307 - RNA, 14 nt, Pseudomonas aeruginosa PA01
gcagcacggcggcu

SEQ ID NO: 1538308 - RNA, 22 nt, Pseudomonas aeruginosa PA01
gcagcacggcggcuacccgcgc

SEQ ID NO: 1538309 - RNA, 14 nt, Pseudomonas aeruginosa PA01
gcagcacggccucg

SEQ ID NO: 1538310 - RNA, 19 nt, Pseudomonas aeruginosa PA01
gcagcacggcgauacccag

SEQ ID NO: 1538311 - RNA, 21 nt, Pseudomonas aeruginosa PA01
gcagcacuuccugaaggcgcg

SEQ ID NO: 1538312 - RNA, 16 nt, Pseudomonas aeruginosa PA01
gcagcagcucguccau

SEQ ID NO: 1538313 - RNA, 22 nt, Pseudomonas aeruginosa PA01
gcaggcucuuggucgcggucug

SEQ ID NO: 1538314 - RNA, 15 nt, Pseudomonas aeruginosa PA01
gcaggcugccggacg

SEQ ID NO: 1538315 - RNA, 14 nt, Pseudomonas aeruginosa PA01
gcaggcugccguug

SEQ ID NO: 1538316 - RNA, 19 nt, Pseudomonas aeruginosa PA01
gcaggcucaugcccagcuu

SEQ ID NO: 1538317 - RNA, 16 nt, Pseudomonas aeruginosa PA01
gcaggcucucgcgcag

SEQ ID NO: 1538318 - RNA, 20 nt, Pseudomonas aeruginosa PA01
gcaggcucucgcgcagcagg

SEQ ID NO: 1538319 - RNA, 19 nt, Pseudomonas aeruginosa PA01
gcaggcucgacaggucggc

SEQ ID NO: 1538320 - RNA, 13 nt, Pseudomonas aeruginosa PA01
gcaggcugugcca

SEQ ID NO: 1538321 - RNA, 20 nt, Pseudomonas aeruginosa PA01
gcaggcuguacagcaggagc

SEQ ID NO: 1538322 - RNA, 17 nt, Pseudomonas aeruginosa PA01
gcaggcucacgcguucg

SEQ ID NO: 1538323 - RNA, 21 nt, Pseudomonas aeruginosa PA01
gcaggcugguaugcagcaacc

SEQ ID NO: 1538324 - RNA, 18 nt, Pseudomonas aeruginosa PA01
gcagggccagccagagcc

SEQ ID NO: 1538325 - RNA, 13 nt, Pseudomonas aeruginosa PA01
gcagggccgagcg

SEQ ID NO: 1538326 - RNA, 20 nt, Pseudomonas aeruginosa PA01
gcagggccgagcgcagcgcc

SEQ ID NO: 1538327 - RNA, 13 nt, Pseudomonas aeruginosa PA01
gcagggccaggcc

SEQ ID NO: 1538328 - RNA, 23 nt, Pseudomonas aeruginosa PA01
gcaggcucaguucggccagcggc

SEQ ID NO: 1538329 - RNA, 17 nt, Pseudomonas aeruginosa PA01
gcaggcucaucgcccgc

SEQ ID NO: 1538330 - RNA, 16 nt, Pseudomonas aeruginosa PA01
gcaggcucagcgcaug

SEQ ID NO: 1538331 - RNA, 12 nt, Pseudomonas aeruginosa PA01
gcaggcgcuggc

SEQ ID NO: 1538332 - RNA, 15 nt, Pseudomonas aeruginosa PA01
gcaggcgcugcagcc

SEQ ID NO: 1538333 - RNA, 22 nt, Pseudomonas aeruginosa PA01
gcaggcgcuauccgccguuacg

SEQ ID NO: 1538334 - RNA, 16 nt, Pseudomonas aeruginosa PA01
gcaggcgcuccuggug

SEQ ID NO: 1538335 - RNA, 12 nt, Pseudomonas aeruginosa PA01
gcaggcgcucgg

SEQ ID NO: 1538336 - RNA, 18 nt, Pseudomonas aeruginosa PA01
gcaggcgccgauggcugu

SEQ ID NO: 1538337 - RNA, 14 nt, Pseudomonas aeruginosa PA01
gcaggcgccggccg

SEQ ID NO: 1538338 - RNA, 16 nt, Pseudomonas aeruginosa PA01
gcaggcgcaucaggcc

SEQ ID NO: 1538339 - RNA, 22 nt, Pseudomonas aeruginosa PA01
gcaggcgccaaccgggcagcag

SEQ ID NO: 1538340 - RNA, 16 nt, Pseudomonas aeruginosa PA01
gcaggaucggcgcggu

SEQ ID NO: 1538341 - RNA, 15 nt, Pseudomonas aeruginosa PA01
gcaggauguccuugu

SEQ ID NO: 1538342 - RNA, 14 nt, Pseudomonas aeruginosa PA01
gcaggaugccgccu

SEQ ID NO: 1538343 - RNA, 15 nt, Pseudomonas aeruginosa PA01
gcaggaugccgccug

SEQ ID NO: 1538344 - RNA, 16 nt, Pseudomonas aeruginosa PA01
gcaggaugccgccugc

SEQ ID NO: 1538345 - RNA, 13 nt, Pseudomonas aeruginosa PA01
gcaggaucaggcu

SEQ ID NO: 1538346 - RNA, 16 nt, Pseudomonas aeruginosa PA01
gcaggaucaccugcuu

SEQ ID NO: 1538347 - RNA, 17 nt, Pseudomonas aeruginosa PA01
gcaggaucgagcccugg

SEQ ID NO: 1538348 - RNA, 23 nt, Pseudomonas aeruginosa PA01
gcaggaucaguucgugccaggcg

SEQ ID NO: 1538349 - RNA, 18 nt, Pseudomonas aeruginosa PA01
gcaggaggauacggcgca

SEQ ID NO: 1538350 - RNA, 20 nt, Pseudomonas aeruginosa PA01
gcaggaggauacggcgcagc

SEQ ID NO: 1538351 - RNA, 18 nt, Pseudomonas aeruginosa PA01
gcaggagaagcgccucgc

SEQ ID NO: 1538352 - RNA, 23 nt, Pseudomonas aeruginosa PA01
gcaggagcaugucuucgucgcgc

SEQ ID NO: 1538353 - RNA, 22 nt, Pseudomonas aeruginosa PA01
gcaggccgcgcgauggccggcg

SEQ ID NO: 1538354 - RNA, 16 nt, Pseudomonas aeruginosa PA01
gcaggccgccggcggc

SEQ ID NO: 1538355 - RNA, 23 nt, Pseudomonas aeruginosa PA01
gcaggccgaagcgugggcggccg

SEQ ID NO: 1538356 - RNA, 14 nt, Pseudomonas aeruginosa PA01
gcaggccgccgagu

SEQ ID NO: 1538357 - RNA, 21 nt, Pseudomonas aeruginosa PA01
gcaggccgggaauggagaugc

SEQ ID NO: 1538358 - RNA, 18 nt, Pseudomonas aeruginosa PA01
gcaggccggcgagccagg

SEQ ID NO: 1538359 - RNA, 21 nt, Pseudomonas aeruginosa PA01
gcaggccggugaucucgcggc

SEQ ID NO: 1538360 - RNA, 12 nt, Pseudomonas aeruginosa PA01
gcaggccgggcg

SEQ ID NO: 1538361 - RNA, 16 nt, Pseudomonas aeruginosa PA01
gcaggccgggcggacg

SEQ ID NO: 1538362 - RNA, 18 nt, Pseudomonas aeruginosa PA01
gcaggaugcugcacagcc

SEQ ID NO: 1538363 - RNA, 20 nt, Pseudomonas aeruginosa PA01
gcaggccgaauccgccggcg

SEQ ID NO: 1538364 - RNA, 20 nt, Pseudomonas aeruginosa PA01
gcaggccgagaccgcagccc

SEQ ID NO: 1538365 - RNA, 16 nt, Pseudomonas aeruginosa PA01
gcaggccgagcugcuc

SEQ ID NO: 1538366 - RNA, 20 nt, Pseudomonas aeruginosa PA01
gcaggccgaggucggcggcg

SEQ ID NO: 1538367 - RNA, 20 nt, Pseudomonas aeruginosa PA01
gcaggccgaucaccagcgcc

SEQ ID NO: 1538368 - RNA, 23 nt, Pseudomonas aeruginosa PA01
gcaggccgaucucgugggccagc

SEQ ID NO: 1538369 - RNA, 14 nt, Pseudomonas aeruginosa PA01
gcaggccgcuggcg

SEQ ID NO: 1538370 - RNA, 18 nt, Pseudomonas aeruginosa PA01
gcagcuccggcagcaggg

SEQ ID NO: 1538371 - RNA, 16 nt, Pseudomonas aeruginosa PA01
gcagcuccggcgggcg

SEQ ID NO: 1538372 - RNA, 17 nt, Pseudomonas aeruginosa PA01
gcagcuccggcgggcgg

SEQ ID NO: 1538373 - RNA, 16 nt, Pseudomonas aeruginosa PA01
gcagcuccgggcuggc

SEQ ID NO: 1538374 - RNA, 18 nt, Pseudomonas aeruginosa PA01
gcagcuccucggcguggc

SEQ ID NO: 1538375 - RNA, 12 nt, Pseudomonas aeruginosa PA01
gcagcuccaccg

SEQ ID NO: 1538376 - RNA, 16 nt, Pseudomonas aeruginosa PA01
gcagcucgacuuccug

SEQ ID NO: 1538377 - RNA, 20 nt, Pseudomonas aeruginosa PA01
gcagcucgccgcuacccagg

SEQ ID NO: 1538378 - RNA, 20 nt, Pseudomonas aeruginosa PA01
gcagcucgcuaugcagcagg

SEQ ID NO: 1538379 - RNA, 22 nt, Pseudomonas aeruginosa PA01
gcagcucggccgagggcagccu

SEQ ID NO: 1538380 - RNA, 18 nt, Pseudomonas aeruginosa PA01
gcagcucggcacgcagca

SEQ ID NO: 1538381 - RNA, 20 nt, Pseudomonas aeruginosa PA01
gcagcucggcacgcagcagc

SEQ ID NO: 1538382 - RNA, 16 nt, Pseudomonas aeruginosa PA01
gcagcgacucgcuggg

SEQ ID NO: 1538383 - RNA, 17 nt, Pseudomonas aeruginosa PA01
gcagcgacucgcugggc

SEQ ID NO: 1538384 - RNA, 15 nt, Pseudomonas aeruginosa PA01
gcagcgacuccagcc

SEQ ID NO: 1538385 - RNA, 19 nt, Pseudomonas aeruginosa PA01
gcagcgacuccagccaggc

SEQ ID NO: 1538386 - RNA, 20 nt, Pseudomonas aeruginosa PA01
gcagcgacuccagccaggcg

SEQ ID NO: 1538387 - RNA, 14 nt, Pseudomonas aeruginosa PA01
gcagcguuccagcg

SEQ ID NO: 1538388 - RNA, 16 nt, Pseudomonas aeruginosa PA01
gcagcguuccagcgcu

SEQ ID NO: 1538389 - RNA, 20 nt, Pseudomonas aeruginosa PA01
gcaggacgccgaacccgccu

SEQ ID NO: 1538390 - RNA, 17 nt, Pseudomonas aeruginosa PA01
gcaggaccacgcugguc

SEQ ID NO: 1538391 - RNA, 21 nt, Pseudomonas aeruginosa PA01
gcaggacggauaacggcagcc

SEQ ID NO: 1538392 - RNA, 14 nt, Pseudomonas aeruginosa PA01
gcaggaccgccaug

SEQ ID NO: 1538393 - RNA, 17 nt, Pseudomonas aeruginosa PA01
gcaggaccgccauggcg

SEQ ID NO: 1538394 - RNA, 14 nt, Pseudomonas aeruginosa PA01
gcaggacagcaggg

SEQ ID NO: 1538395 - RNA, 20 nt, Pseudomonas aeruginosa PA01
gcaggacagcagggucgcgc

SEQ ID NO: 1538396 - RNA, 15 nt, Pseudomonas aeruginosa PA01
gcaggaaggcuuccg

SEQ ID NO: 1538397 - RNA, 20 nt, Pseudomonas aeruginosa PA01
gcaggaaggcuuccggcucc

SEQ ID NO: 1538398 - RNA, 23 nt, Pseudomonas aeruginosa PA01
gcaggaaguugauggucaggcug

SEQ ID NO: 1538399 - RNA, 21 nt, Pseudomonas aeruginosa PA01
gcaggaagcugacgaacaucg

SEQ ID NO: 1538400 - RNA, 21 nt, Pseudomonas aeruginosa PA01
gcaggaacucgaucagcgcgg

SEQ ID NO: 1538401 - RNA, 23 nt, Pseudomonas aeruginosa PA01
gcaggaacucgaucagcgcggcc

SEQ ID NO: 1538402 - RNA, 19 nt, Pseudomonas aeruginosa PA01
gcagcucgaaauccggugc

SEQ ID NO: 1538403 - RNA, 18 nt, Pseudomonas aeruginosa PA01
gcaggaaauccgccgcgc

SEQ ID NO: 1538404 - RNA, 21 nt, Pseudomonas aeruginosa PA01
gcaggaaccgacgcgcaggag

SEQ ID NO: 1538405 - RNA, 12 nt, Pseudomonas aeruginosa PA01
gcaggaacaggu

SEQ ID NO: 1538406 - RNA, 17 nt, Pseudomonas aeruginosa PA01
gcagcuucugcagggcg

SEQ ID NO: 1538407 - RNA, 18 nt, Pseudomonas aeruginosa PA01
gcagucgucaagcgcgga

SEQ ID NO: 1538408 - RNA, 17 nt, Pseudomonas aeruginosa PA01
gcagucgucgcagccga

SEQ ID NO: 1538409 - RNA, 14 nt, Pseudomonas aeruginosa PA01
gcaguacgcucugg

SEQ ID NO: 1538410 - RNA, 18 nt, Pseudomonas aeruginosa PA01
gcaguacgaucagccagg

SEQ ID NO: 1538411 - RNA, 19 nt, Pseudomonas aeruginosa PA01
gcaguggcgccagccagcc

SEQ ID NO: 1538412 - RNA, 20 nt, Pseudomonas aeruginosa PA01
gcaguggcgccagccagccc

SEQ ID NO: 1538413 - RNA, 13 nt, Pseudomonas aeruginosa PA01
gcagugggaagcu

SEQ ID NO: 1538414 - RNA, 21 nt, Pseudomonas aeruginosa PA01
gcaguggugauccgcacccgc

SEQ ID NO: 1538415 - RNA, 16 nt, Pseudomonas aeruginosa PA01
gcagugugcaccgagu

SEQ ID NO: 1538416 - RNA, 15 nt, Pseudomonas aeruginosa PA01
gcaguugcaguaccu

SEQ ID NO: 1538417 - RNA, 19 nt, Pseudomonas aeruginosa PA01
gcaguugcaguaccugcuc

SEQ ID NO: 1538418 - RNA, 15 nt, Pseudomonas aeruginosa PA01
gcaguugccaggagg

SEQ ID NO: 1538419 - RNA, 13 nt, Pseudomonas aeruginosa PA01
gcaguugcaacag

SEQ ID NO: 1538420 - RNA, 22 nt, Pseudomonas aeruginosa PA01
gcaguucgucgccacgcccgcc

SEQ ID NO: 1538421 - RNA, 22 nt, Pseudomonas aeruginosa PA01
gcaguucgccguucagcuccca

SEQ ID NO: 1538422 - RNA, 15 nt, Pseudomonas aeruginosa PA01
gcaguucgcgggccg

SEQ ID NO: 1538423 - RNA, 17 nt, Pseudomonas aeruginosa PA01
gcaguucgcgggccgcg

SEQ ID NO: 1538424 - RNA, 16 nt, Pseudomonas aeruginosa PA01
gcaguucgaccuccag

SEQ ID NO: 1538425 - RNA, 18 nt, Pseudomonas aeruginosa PA01
gcauaaccgucgcuggag

SEQ ID NO: 1538426 - RNA, 19 nt, Pseudomonas aeruginosa PA01
gcaggggcuuucuucgccu

SEQ ID NO: 1538427 - RNA, 20 nt, Pseudomonas aeruginosa PA01
gcaggguaccgcuggcgcug

SEQ ID NO: 1538428 - RNA, 14 nt, Pseudomonas aeruginosa PA01
gcagggucagcagc

SEQ ID NO: 1538429 - RNA, 15 nt, Pseudomonas aeruginosa PA01
gcagggucagcagcg

SEQ ID NO: 1538430 - RNA, 20 nt, Pseudomonas aeruginosa PA01
gcagggucagcagcgccagu

SEQ ID NO: 1538431 - RNA, 17 nt, Pseudomonas aeruginosa PA01
gcagggcguagugcucc

SEQ ID NO: 1538432 - RNA, 20 nt, Pseudomonas aeruginosa PA01
gcagggcggcgaugaccagg

SEQ ID NO: 1538433 - RNA, 20 nt, Pseudomonas aeruginosa PA01
gcagggcggcgccuggagca

SEQ ID NO: 1538434 - RNA, 16 nt, Pseudomonas aeruginosa PA01
gcagggcggcgcugug

SEQ ID NO: 1538435 - RNA, 21 nt, Pseudomonas aeruginosa PA01
gcagggcucgugccaucaggc

SEQ ID NO: 1538436 - RNA, 13 nt, Pseudomonas aeruginosa PA01
gcaggggcgcgcc

SEQ ID NO: 1538437 - RNA, 15 nt, Pseudomonas aeruginosa PA01
gcaggggcgcggcgc

SEQ ID NO: 1538438 - RNA, 22 nt, Pseudomonas aeruginosa PA01
gcagggcggauaaucgcagcgc

SEQ ID NO: 1538439 - RNA, 14 nt, Pseudomonas aeruginosa PA01
gcagggcgcccgcc

SEQ ID NO: 1538440 - RNA, 21 nt, Pseudomonas aeruginosa PA01
gcagggcgaugccgauggcgc

SEQ ID NO: 1538441 - RNA, 16 nt, Pseudomonas aeruginosa PA01
gcagggcgauggccag

SEQ ID NO: 1538442 - RNA, 17 nt, Pseudomonas aeruginosa PA01
gcagggucgccgggucg

SEQ ID NO: 1538443 - RNA, 21 nt, Pseudomonas aeruginosa PA01
gcaggguauuuuccagcaggc

SEQ ID NO: 1538444 - RNA, 12 nt, Pseudomonas aeruginosa PA01
gcagggucaggg

SEQ ID NO: 1538445 - RNA, 15 nt, Pseudomonas aeruginosa PA01
gcagggucaggguga

SEQ ID NO: 1538446 - RNA, 14 nt, Pseudomonas aeruginosa PA01
gcaggguccaugga

SEQ ID NO: 1538447 - RNA, 22 nt, Pseudomonas aeruginosa PA01
gcagggucgcguuggcgugcuc

SEQ ID NO: 1538448 - RNA, 15 nt, Pseudomonas aeruginosa PA01
gcagggucucgcugc

SEQ ID NO: 1538449 - RNA, 16 nt, Pseudomonas aeruginosa PA01
gcagggugcggcugcu

SEQ ID NO: 1538450 - RNA, 14 nt, Pseudomonas aeruginosa PA01
gcagggugcgggcg

SEQ ID NO: 1538451 - RNA, 13 nt, Pseudomonas aeruginosa PA01
gcaggguggccag

SEQ ID NO: 1538452 - RNA, 21 nt, Pseudomonas aeruginosa PA01
gcagguacagcgacucgcugc

SEQ ID NO: 1538453 - RNA, 22 nt, Pseudomonas aeruginosa PA01
gcaggguucggggaacagcgcc

SEQ ID NO: 1538454 - RNA, 16 nt, Pseudomonas aeruginosa PA01
gcagguacucgccggc

SEQ ID NO: 1538455 - RNA, 18 nt, Pseudomonas aeruginosa PA01
gcagguagaccacgcagg

SEQ ID NO: 1538456 - RNA, 20 nt, Pseudomonas aeruginosa PA01
gcagguagcgcugcgcccgc

SEQ ID NO: 1538457 - RNA, 22 nt, Pseudomonas aeruginosa PA01
gcagguagcgcugcgcccgcuc

SEQ ID NO: 1538458 - RNA, 15 nt, Pseudomonas aeruginosa PA01
gcagguagcugagca

SEQ ID NO: 1538459 - RNA, 18 nt, Pseudomonas aeruginosa PA01
gcagguagcugagcaggc

SEQ ID NO: 1538460 - RNA, 15 nt, Pseudomonas aeruginosa PA01
gcagguagccagggg

SEQ ID NO: 1538461 - RNA, 16 nt, Pseudomonas aeruginosa PA01
gcagguagccaggggu

SEQ ID NO: 1538462 - RNA, 14 nt, Pseudomonas aeruginosa PA01
gcagguagccgcgc

SEQ ID NO: 1538463 - RNA, 21 nt, Pseudomonas aeruginosa PA01
gcagguaguccagccagugca

SEQ ID NO: 1538464 - RNA, 15 nt, Pseudomonas aeruginosa PA01
gcagguaucgcuggg

SEQ ID NO: 1538465 - RNA, 20 nt, Pseudomonas aeruginosa PA01
gcagguaucgcugggcgccu

SEQ ID NO: 1538466 - RNA, 16 nt, Pseudomonas aeruginosa PA01
gcaggucgagcaguuc

SEQ ID NO: 1538467 - RNA, 21 nt, Pseudomonas aeruginosa PA01
gcaggucgagcaguuccggca

SEQ ID NO: 1538468 - RNA, 15 nt, Pseudomonas aeruginosa PA01
gcaggucgcgcuggg

SEQ ID NO: 1538469 - RNA, 17 nt, Pseudomonas aeruginosa PA01
gcaggucgcgcugggcg

SEQ ID NO: 1538470 - RNA, 22 nt, Pseudomonas aeruginosa PA01
gcaggucgcggccccagcacug

SEQ ID NO: 1538471 - RNA, 14 nt, Pseudomonas aeruginosa PA01
gcaggucgcuggcg

SEQ ID NO: 1538472 - RNA, 15 nt, Pseudomonas aeruginosa PA01
gcaggucgcuggcgu

SEQ ID NO: 1538473 - RNA, 15 nt, Pseudomonas aeruginosa PA01
gcaggucggacaggc

SEQ ID NO: 1538474 - RNA, 17 nt, Pseudomonas aeruginosa PA01
gcagguccgcgccucgc

SEQ ID NO: 1538475 - RNA, 17 nt, Pseudomonas aeruginosa PA01
gcagguccggguugucg

SEQ ID NO: 1538476 - RNA, 20 nt, Pseudomonas aeruginosa PA01
gcagguccgacggaaauagg

SEQ ID NO: 1538477 - RNA, 22 nt, Pseudomonas aeruginosa PA01
gcagguucaucgccgccaggca

SEQ ID NO: 1538478 - RNA, 16 nt, Pseudomonas aeruginosa PA01
gcagguugaccccgcg

SEQ ID NO: 1538479 - RNA, 18 nt, Pseudomonas aeruginosa PA01
gcagguugagggccgcgc

SEQ ID NO: 1538480 - RNA, 15 nt, Pseudomonas aeruginosa PA01
gcagguucagcaggu

SEQ ID NO: 1538481 - RNA, 13 nt, Pseudomonas aeruginosa PA01
gcagguggccgga

SEQ ID NO: 1538482 - RNA, 16 nt, Pseudomonas aeruginosa PA01
gcagguggcuggucag

SEQ ID NO: 1538483 - RNA, 20 nt, Pseudomonas aeruginosa PA01
gcagguggucguugcgcgcc

SEQ ID NO: 1538484 - RNA, 21 nt, Pseudomonas aeruginosa PA01
gcagguggugguagagcggca

SEQ ID NO: 1538485 - RNA, 14 nt, Pseudomonas aeruginosa PA01
gcacgccgguggcc

SEQ ID NO: 1538486 - RNA, 19 nt, Pseudomonas aeruginosa PA01
gcacgccgguggccaggcu

SEQ ID NO: 1538487 - RNA, 12 nt, Pseudomonas aeruginosa PA01
gcacgccgucgc

SEQ ID NO: 1538488 - RNA, 14 nt, Pseudomonas aeruginosa PA01
gcacgcaggccgcu

SEQ ID NO: 1538489 - RNA, 17 nt, Pseudomonas aeruginosa PA01
gcacgcaggccgcugcc

SEQ ID NO: 1538490 - RNA, 20 nt, Pseudomonas aeruginosa PA01
gcacgcaauagugcagcucc

SEQ ID NO: 1538491 - RNA, 14 nt, Pseudomonas aeruginosa PA01
gcacgcaauggcgc

SEQ ID NO: 1538492 - RNA, 17 nt, Pseudomonas aeruginosa PA01
gcacgcaauggcgcagc

SEQ ID NO: 1538493 - RNA, 20 nt, Pseudomonas aeruginosa PA01
gcacgcacgcgccugcuuca

SEQ ID NO: 1538494 - RNA, 16 nt, Pseudomonas aeruginosa PA01
gcacgcagcgccgcgu

SEQ ID NO: 1538495 - RNA, 13 nt, Pseudomonas aeruginosa PA01
gcacgaacagggu

SEQ ID NO: 1538496 - RNA, 17 nt, Pseudomonas aeruginosa PA01
gcaccugguggacaccc

SEQ ID NO: 1538497 - RNA, 22 nt, Pseudomonas aeruginosa PA01
gcacgaaccauugcggcccgcc

SEQ ID NO: 1538498 - RNA, 18 nt, Pseudomonas aeruginosa PA01
gcacgaaccguccgcagc

SEQ ID NO: 1538499 - RNA, 16 nt, Pseudomonas aeruginosa PA01
gcaccuggaccgggau

SEQ ID NO: 1538500 - RNA, 20 nt, Pseudomonas aeruginosa PA01
gcaccuggcagugcgccggc

SEQ ID NO: 1538501 - RNA, 22 nt, Pseudomonas aeruginosa PA01
gcaccuggcagugcgccggcau

SEQ ID NO: 1538502 - RNA, 19 nt, Pseudomonas aeruginosa PA01
gcaccugggugcuuuccug

SEQ ID NO: 1538503 - RNA, 21 nt, Pseudomonas aeruginosa PA01
gcaccugggugcuuuccugcu

SEQ ID NO: 1538504 - RNA, 20 nt, Pseudomonas aeruginosa PA01
gcaccugggcguuggccagc

SEQ ID NO: 1538505 - RNA, 23 nt, Pseudomonas aeruginosa PA01
gcaccugggcguuggccagcgcc

SEQ ID NO: 1538506 - RNA, 18 nt, Pseudomonas aeruginosa PA01
gcaccuggcgaugcccug

SEQ ID NO: 1538507 - RNA, 22 nt, Pseudomonas aeruginosa PA01
gcaccuggcgaugcccuggccg

SEQ ID NO: 1538508 - RNA, 22 nt, Pseudomonas aeruginosa PA01
gcaccuggcggucgccgccggc

SEQ ID NO: 1538509 - RNA, 20 nt, Pseudomonas aeruginosa PA01
gcaccugggacucccgcaga

SEQ ID NO: 1538510 - RNA, 22 nt, Pseudomonas aeruginosa PA01
gcaccuacccgagcaacugcuc

SEQ ID NO: 1538511 - RNA, 14 nt, Pseudomonas aeruginosa PA01
gcaccugcgggcug

SEQ ID NO: 1538512 - RNA, 21 nt, Pseudomonas aeruginosa PA01
gcaccugcgggcugcgugcca

SEQ ID NO: 1538513 - RNA, 16 nt, Pseudomonas aeruginosa PA01
gcaccugcgccccggu

SEQ ID NO: 1538514 - RNA, 16 nt, Pseudomonas aeruginosa PA01
gcaccgcuugccagcc

SEQ ID NO: 1538515 - RNA, 21 nt, Pseudomonas aeruginosa PA01
gcaccggccacucgcagccgc

SEQ ID NO: 1538516 - RNA, 17 nt, Pseudomonas aeruginosa PA01
gcaccgugcgcgcggcc

SEQ ID NO: 1538517 - RNA, 18 nt, Pseudomonas aeruginosa PA01
gcaccggcaggacgauga

SEQ ID NO: 1538518 - RNA, 20 nt, Pseudomonas aeruginosa PA01
gcaccguggcgccauccucc

SEQ ID NO: 1538519 - RNA, 19 nt, Pseudomonas aeruginosa PA01
gcaccguggucagcaccag

SEQ ID NO: 1538520 - RNA, 20 nt, Pseudomonas aeruginosa PA01
gcaccguggucagcaccagg

SEQ ID NO: 1538521 - RNA, 21 nt, Pseudomonas aeruginosa PA01
gcaccccgagcccggccggga

SEQ ID NO: 1538522 - RNA, 16 nt, Pseudomonas aeruginosa PA01
gcaccccgagcggcgc

SEQ ID NO: 1538523 - RNA, 14 nt, Pseudomonas aeruginosa PA01
gcacccccagcagg

SEQ ID NO: 1538524 - RNA, 16 nt, Pseudomonas aeruginosa PA01
gcacccccagcaggcc

SEQ ID NO: 1538525 - RNA, 20 nt, Pseudomonas aeruginosa PA01
gcacccccagcaggccagcc

SEQ ID NO: 1538526 - RNA, 19 nt, Pseudomonas aeruginosa PA01
gcacccagucuucgcuggc

SEQ ID NO: 1538527 - RNA, 20 nt, Pseudomonas aeruginosa PA01
gcacccagucuucgcuggcg

SEQ ID NO: 1538528 - RNA, 16 nt, Pseudomonas aeruginosa PA01
gcacccaggccacgcc

SEQ ID NO: 1538529 - RNA, 14 nt, Pseudomonas aeruginosa PA01
gcacccgcucggcc

SEQ ID NO: 1538530 - RNA, 18 nt, Pseudomonas aeruginosa PA01
gcaccccuugcagccagc

SEQ ID NO: 1538531 - RNA, 14 nt, Pseudomonas aeruginosa PA01
gcaccgagcaggca

SEQ ID NO: 1538532 - RNA, 20 nt, Pseudomonas aeruginosa PA01
gcacccuggacccgggccuc

SEQ ID NO: 1538533 - RNA, 22 nt, Pseudomonas aeruginosa PA01
gcacccgcuguuucuccaguuc

SEQ ID NO: 1538534 - RNA, 13 nt, Pseudomonas aeruginosa PA01
gcaccgccugcaa

SEQ ID NO: 1538535 - RNA, 19 nt, Pseudomonas aeruginosa PA01
gcaccgccucgugcagcaa

SEQ ID NO: 1538536 - RNA, 13 nt, Pseudomonas aeruginosa PA01
gcaccgcgccggc

SEQ ID NO: 1538537 - RNA, 12 nt, Pseudomonas aeruginosa PA01
gcaccgcgccuu

SEQ ID NO: 1538538 - RNA, 15 nt, Pseudomonas aeruginosa PA01
gcaccgccuggcgca

SEQ ID NO: 1538539 - RNA, 18 nt, Pseudomonas aeruginosa PA01
gcacagcguggccagcgc

SEQ ID NO: 1538540 - RNA, 17 nt, Pseudomonas aeruginosa PA01
gcacagcgcccagacac

SEQ ID NO: 1538541 - RNA, 17 nt, Pseudomonas aeruginosa PA01
gcacaguacgccuugca

SEQ ID NO: 1538542 - RNA, 14 nt, Pseudomonas aeruginosa PA01
gcacaggcuggcca

SEQ ID NO: 1538543 - RNA, 16 nt, Pseudomonas aeruginosa PA01
gcacaccuccagcggc

SEQ ID NO: 1538544 - RNA, 18 nt, Pseudomonas aeruginosa PA01
gcacagccccagccucgg

SEQ ID NO: 1538545 - RNA, 13 nt, Pseudomonas aeruginosa PA01
gcacagccccagc

SEQ ID NO: 1538546 - RNA, 16 nt, Pseudomonas aeruginosa PA01
gcacagccauuucugc

SEQ ID NO: 1538547 - RNA, 14 nt, Pseudomonas aeruginosa PA01
gcacagccaggggc

SEQ ID NO: 1538548 - RNA, 13 nt, Pseudomonas aeruginosa PA01
gcaaugcccagcg

SEQ ID NO: 1538549 - RNA, 19 nt, Pseudomonas aeruginosa PA01
gcaaugcccagcgcaggcc

SEQ ID NO: 1538550 - RNA, 19 nt, Pseudomonas aeruginosa PA01
gcaaugccagcgccacgcc

SEQ ID NO: 1538551 - RNA, 16 nt, Pseudomonas aeruginosa PA01
gcacaccgcgcgcgcc

SEQ ID NO: 1538552 - RNA, 18 nt, Pseudomonas aeruginosa PA01
gcacaccgcgcgcgccug

SEQ ID NO: 1538553 - RNA, 15 nt, Pseudomonas aeruginosa PA01
gcaccaugcagcggc

SEQ ID NO: 1538554 - RNA, 20 nt, Pseudomonas aeruginosa PA01
gcaccaugcccgcugggcag

SEQ ID NO: 1538555 - RNA, 18 nt, Pseudomonas aeruginosa PA01
gcaccaugcgcggcagga

SEQ ID NO: 1538556 - RNA, 18 nt, Pseudomonas aeruginosa PA01
gcaccaucagccagccca

SEQ ID NO: 1538557 - RNA, 20 nt, Pseudomonas aeruginosa PA01
gcaccaucagccagcccagu

SEQ ID NO: 1538558 - RNA, 20 nt, Pseudomonas aeruginosa PA01
gcaccagccaguccggcagc

SEQ ID NO: 1538559 - RNA, 21 nt, Pseudomonas aeruginosa PA01
gcacaugugcguauggaucug

SEQ ID NO: 1538560 - RNA, 15 nt, Pseudomonas aeruginosa PA01
gcaccacagcaccac

SEQ ID NO: 1538561 - RNA, 21 nt, Pseudomonas aeruginosa PA01
gcaccacagcaccacgcuccu

SEQ ID NO: 1538562 - RNA, 22 nt, Pseudomonas aeruginosa PA01
gcaccaccacucgcgagcuggc

SEQ ID NO: 1538563 - RNA, 14 nt, Pseudomonas aeruginosa PA01
gcaccagcacuucc

SEQ ID NO: 1538564 - RNA, 10 nt, Pseudomonas aeruginosa PA01
gcaccagcag

SEQ ID NO: 1538565 - RNA, 13 nt, Pseudomonas aeruginosa PA01
gcaccagcaggcg

SEQ ID NO: 1538566 - RNA, 15 nt, Pseudomonas aeruginosa PA01
gcaccagcaggcgca

SEQ ID NO: 1538567 - RNA, 11 nt, Pseudomonas aeruginosa PA01
gcaccagcagg

SEQ ID NO: 1538568 - RNA, 15 nt, Pseudomonas aeruginosa PA01
gcaccagcaggagca

SEQ ID NO: 1538569 - RNA, 19 nt, Pseudomonas aeruginosa PA01
gcaaggcacacgcccggca

SEQ ID NO: 1538570 - RNA, 15 nt, Pseudomonas aeruginosa PA01
gcaaggcagcguccg

SEQ ID NO: 1538571 - RNA, 17 nt, Pseudomonas aeruginosa PA01
gcaaggaacuggaagcc

SEQ ID NO: 1538572 - RNA, 14 nt, Pseudomonas aeruginosa PA01
gcaaggaccugcug

SEQ ID NO: 1538573 - RNA, 21 nt, Pseudomonas aeruginosa PA01
gcaaggaccugcugcccggca

SEQ ID NO: 1538574 - RNA, 19 nt, Pseudomonas aeruginosa PA01
gcaagcucgucacccgcgc

SEQ ID NO: 1538575 - RNA, 22 nt, Pseudomonas aeruginosa PA01
gcaagcgguauugucgaugggc

SEQ ID NO: 1538576 - RNA, 18 nt, Pseudomonas aeruginosa PA01
gcaacuggucgcggcugc

SEQ ID NO: 1538577 - RNA, 13 nt, Pseudomonas aeruginosa PA01
gcaacucggcggc

SEQ ID NO: 1538578 - RNA, 13 nt, Pseudomonas aeruginosa PA01
gcaacugaccugg

SEQ ID NO: 1538579 - RNA, 15 nt, Pseudomonas aeruginosa PA01
gcaacugaccuggcc

SEQ ID NO: 1538580 - RNA, 18 nt, Pseudomonas aeruginosa PA01
gcaacugacggcggaagg

SEQ ID NO: 1538581 - RNA, 14 nt, Pseudomonas aeruginosa PA01
gcaacucgccgccg

SEQ ID NO: 1538582 - RNA, 22 nt, Pseudomonas aeruginosa PA01
gcaacugccaaccgcgcucggc

SEQ ID NO: 1538583 - RNA, 17 nt, Pseudomonas aeruginosa PA01
gcaacugaucagccggg

SEQ ID NO: 1538584 - RNA, 19 nt, Pseudomonas aeruginosa PA01
gcaacugcucgaacugcuc

SEQ ID NO: 1538585 - RNA, 14 nt, Pseudomonas aeruginosa PA01
gcaacugcucgggc

SEQ ID NO: 1538586 - RNA, 22 nt, Pseudomonas aeruginosa PA01
gcaaggcuucggcggucaggcu

SEQ ID NO: 1538587 - RNA, 12 nt, Pseudomonas aeruginosa PA01
gcaaggcgguga

SEQ ID NO: 1538588 - RNA, 13 nt, Pseudomonas aeruginosa PA01
gcaaggcggccuc

SEQ ID NO: 1538589 - RNA, 16 nt, Pseudomonas aeruginosa PA01
gcaauccggcgcugcc

SEQ ID NO: 1538590 - RNA, 24 nt, Pseudomonas aeruginosa PA01
gcaaucagcgcgauuuugggcuca

SEQ ID NO: 1538591 - RNA, 16 nt, Pseudomonas aeruginosa PA01
gcaaucagcgggccuu

SEQ ID NO: 1538592 - RNA, 14 nt, Pseudomonas aeruginosa PA01
gcaacacaugcagg

SEQ ID NO: 1538593 - RNA, 15 nt, Pseudomonas aeruginosa PA01
gcaacacaugcaggc

SEQ ID NO: 1538594 - RNA, 15 nt, Pseudomonas aeruginosa PA01
gcaacagaucuuccu

SEQ ID NO: 1538595 - RNA, 14 nt, Pseudomonas aeruginosa PA01
gcaacaccgcgcag

SEQ ID NO: 1538596 - RNA, 19 nt, Pseudomonas aeruginosa PA01
gcaacaccuggcgcucgcc

SEQ ID NO: 1538597 - RNA, 19 nt, Pseudomonas aeruginosa PA01
gcaacaguggguaggccag

SEQ ID NO: 1538598 - RNA, 20 nt, Pseudomonas aeruginosa PA01
gcaacaguggguaggccagg

SEQ ID NO: 1538599 - RNA, 17 nt, Pseudomonas aeruginosa PA01
gcaacaguucugccgca

SEQ ID NO: 1538600 - RNA, 19 nt, Pseudomonas aeruginosa PA01
gcaacaguugccgcagcag

SEQ ID NO: 1538601 - RNA, 21 nt, Pseudomonas aeruginosa PA01
gcaacaguugccgcagcagcg

SEQ ID NO: 1538602 - RNA, 23 nt, Pseudomonas aeruginosa PA01
gcaacaguugccgcagcagcggc

SEQ ID NO: 1538603 - RNA, 18 nt, Pseudomonas aeruginosa PA01
gcaacagggcauuggcca

SEQ ID NO: 1538604 - RNA, 23 nt, Pseudomonas aeruginosa PA01
gcaacagggcauuggccaucagc

SEQ ID NO: 1538605 - RNA, 16 nt, Pseudomonas aeruginosa PA01
gcaacgccgcccccag

SEQ ID NO: 1538606 - RNA, 18 nt, Pseudomonas aeruginosa PA01
gcaacgccggcccgugcc

SEQ ID NO: 1538607 - RNA, 21 nt, Pseudomonas aeruginosa PA01
gcaacgcggagcaggcggaga

SEQ ID NO: 1538608 - RNA, 18 nt, Pseudomonas aeruginosa PA01
gcaacgcgcccacuccuc

SEQ ID NO: 1538609 - RNA, 16 nt, Pseudomonas aeruginosa PA01
gcaacgcccgcgagcc

SEQ ID NO: 1538610 - RNA, 14 nt, Pseudomonas aeruginosa PA01
gcaacgccgccaac

SEQ ID NO: 1538611 - RNA, 13 nt, Pseudomonas aeruginosa PA01
gcaacgccaggcc

SEQ ID NO: 1538612 - RNA, 13 nt, Pseudomonas aeruginosa PA01
gcaacgccaggcu

SEQ ID NO: 1538613 - RNA, 21 nt, Pseudomonas aeruginosa PA01
gcaacgcaaguaacacucgug

SEQ ID NO: 1538614 - RNA, 17 nt, Pseudomonas aeruginosa PA01
gcaacgcuguccgccau

SEQ ID NO: 1538615 - RNA, 13 nt, Pseudomonas aeruginosa PA01
gcaacgcggcguc

SEQ ID NO: 1538616 - RNA, 16 nt, Pseudomonas aeruginosa PA01
gcaacgcggcgucagg

SEQ ID NO: 1538617 - RNA, 18 nt, Pseudomonas aeruginosa PA01
gcaacgcuuccagcaccu

SEQ ID NO: 1538618 - RNA, 12 nt, Pseudomonas aeruginosa PA01
gcaacgggcggc

SEQ ID NO: 1538619 - RNA, 13 nt, Pseudomonas aeruginosa PA01
gcaacgaaaagcc

SEQ ID NO: 1538620 - RNA, 22 nt, Pseudomonas aeruginosa PA01
gcaaccuguggaauguccugcc

SEQ ID NO: 1538621 - RNA, 15 nt, Pseudomonas aeruginosa PA01
gcaaccguuccagcg

SEQ ID NO: 1538622 - RNA, 21 nt, Pseudomonas aeruginosa PA01
gcaacccugcccagugggcca

SEQ ID NO: 1538623 - RNA, 20 nt, Pseudomonas aeruginosa PA01
gcaaccgcggcggccucagu

SEQ ID NO: 1538624 - RNA, 18 nt, Pseudomonas aeruginosa PA01
gcaaccgcagacuccggc

SEQ ID NO: 1538625 - RNA, 21 nt, Pseudomonas aeruginosa PA01
gcaaccgauauggcuggcgca

SEQ ID NO: 1538626 - RNA, 12 nt, Pseudomonas aeruginosa PA01
gcaaccgcccga

SEQ ID NO: 1538627 - RNA, 16 nt, Pseudomonas aeruginosa PA01
gccccuucagcuccag

SEQ ID NO: 1538628 - RNA, 20 nt, Pseudomonas aeruginosa PA01
gcccgaccgguuccagcggc

SEQ ID NO: 1538629 - RNA, 19 nt, Pseudomonas aeruginosa PA01
gcccgaccccacgccggcc

SEQ ID NO: 1538630 - RNA, 15 nt, Pseudomonas aeruginosa PA01
gccccuggcucaggc

SEQ ID NO: 1538631 - RNA, 20 nt, Pseudomonas aeruginosa PA01
gccccugcggaccgcagaac

SEQ ID NO: 1538632 - RNA, 18 nt, Pseudomonas aeruginosa PA01
gccccugcggcgccgguu

SEQ ID NO: 1538633 - RNA, 13 nt, Pseudomonas aeruginosa PA01
gccccugcgccuc

SEQ ID NO: 1538634 - RNA, 14 nt, Pseudomonas aeruginosa PA01
gccccugcuccucg

SEQ ID NO: 1538635 - RNA, 15 nt, Pseudomonas aeruginosa PA01
gccccggcgucggcg

SEQ ID NO: 1538636 - RNA, 21 nt, Pseudomonas aeruginosa PA01
gccccggcgucggcgcgggcg

SEQ ID NO: 1538637 - RNA, 17 nt, Pseudomonas aeruginosa PA01
gccccggcggcgaucuu

SEQ ID NO: 1538638 - RNA, 13 nt, Pseudomonas aeruginosa PA01
gccccggcuuggc

SEQ ID NO: 1538639 - RNA, 13 nt, Pseudomonas aeruginosa PA01
gccccgggcgccg

SEQ ID NO: 1538640 - RNA, 19 nt, Pseudomonas aeruginosa PA01
gccccgcucgucauggcgc

SEQ ID NO: 1538641 - RNA, 13 nt, Pseudomonas aeruginosa PA01
gccccgcuggccc

SEQ ID NO: 1538642 - RNA, 14 nt, Pseudomonas aeruginosa PA01
gccccgcuggccca

SEQ ID NO: 1538643 - RNA, 18 nt, Pseudomonas aeruginosa PA01
gccccgcgaacgcggggc

SEQ ID NO: 1538644 - RNA, 13 nt, Pseudomonas aeruginosa PA01
gccccggccggca

SEQ ID NO: 1538645 - RNA, 13 nt, Pseudomonas aeruginosa PA01
gccccggccgcgc

SEQ ID NO: 1538646 - RNA, 19 nt, Pseudomonas aeruginosa PA01
gccccggcagccaccaggu

SEQ ID NO: 1538647 - RNA, 16 nt, Pseudomonas aeruginosa PA01
gccccggcaggcaggc

SEQ ID NO: 1538648 - RNA, 22 nt, Pseudomonas aeruginosa PA01
gccccggaccggcucucuucgg

SEQ ID NO: 1538649 - RNA, 13 nt, Pseudomonas aeruginosa PA01
gccccggcccggc

SEQ ID NO: 1538650 - RNA, 21 nt, Pseudomonas aeruginosa PA01
gccccggccagguacuggcga

SEQ ID NO: 1538651 - RNA, 13 nt, Pseudomonas aeruginosa PA01
gccccggcccagc

SEQ ID NO: 1538652 - RNA, 16 nt, Pseudomonas aeruginosa PA01
gccccggcccagccgc

SEQ ID NO: 1538653 - RNA, 17 nt, Pseudomonas aeruginosa PA01
gcccgcagaucuucccc

SEQ ID NO: 1538654 - RNA, 15 nt, Pseudomonas aeruginosa PA01
gcccgcagccacagg

SEQ ID NO: 1538655 - RNA, 14 nt, Pseudomonas aeruginosa PA01
gcccgcagccacgg

SEQ ID NO: 1538656 - RNA, 23 nt, Pseudomonas aeruginosa PA01
gcccgcaguuccucgccgcugcu

SEQ ID NO: 1538657 - RNA, 13 nt, Pseudomonas aeruginosa PA01
gcccgccaccugg

SEQ ID NO: 1538658 - RNA, 18 nt, Pseudomonas aeruginosa PA01
gcccgccaccuggcgggc

SEQ ID NO: 1538659 - RNA, 16 nt, Pseudomonas aeruginosa PA01
gcccgcaugccagggc

SEQ ID NO: 1538660 - RNA, 19 nt, Pseudomonas aeruginosa PA01
gcccgcaugccagggccuu

SEQ ID NO: 1538661 - RNA, 20 nt, Pseudomonas aeruginosa PA01
gcccgccaagggcgccgccg

SEQ ID NO: 1538662 - RNA, 15 nt, Pseudomonas aeruginosa PA01
gcccgagccggacga

SEQ ID NO: 1538663 - RNA, 18 nt, Pseudomonas aeruginosa PA01
gcccgcaccacccgcugc

SEQ ID NO: 1538664 - RNA, 15 nt, Pseudomonas aeruginosa PA01
gcccgagcgacugga

SEQ ID NO: 1538665 - RNA, 21 nt, Pseudomonas aeruginosa PA01
gcccgagaagccggggcaggc

SEQ ID NO: 1538666 - RNA, 23 nt, Pseudomonas aeruginosa PA01
gcccgacugcgaaaaagaacgcc

SEQ ID NO: 1538667 - RNA, 16 nt, Pseudomonas aeruginosa PA01
gcccgagagggugguc

SEQ ID NO: 1538668 - RNA, 22 nt, Pseudomonas aeruginosa PA01
gcccgagaggguggucgcgcuc

SEQ ID NO: 1538669 - RNA, 13 nt, Pseudomonas aeruginosa PA01
gcccgccagcagg

SEQ ID NO: 1538670 - RNA, 15 nt, Pseudomonas aeruginosa PA01
gcccgccagcaggcg

SEQ ID NO: 1538671 - RNA, 16 nt, Pseudomonas aeruginosa PA01
gcccgccagcaggcgc

SEQ ID NO: 1538672 - RNA, 22 nt, Pseudomonas aeruginosa PA01
gcccgccagcaggcgccggcgg

SEQ ID NO: 1538673 - RNA, 13 nt, Pseudomonas aeruginosa PA01
gcccgccgcggcg

SEQ ID NO: 1538674 - RNA, 12 nt, Pseudomonas aeruginosa PA01
gcccgccgccug

SEQ ID NO: 1538675 - RNA, 14 nt, Pseudomonas aeruginosa PA01
gcccgcguccuccu

SEQ ID NO: 1538676 - RNA, 16 nt, Pseudomonas aeruginosa PA01
gcccgcguccuccugg

SEQ ID NO: 1538677 - RNA, 13 nt, Pseudomonas aeruginosa PA01
gcccgcgccgcga

SEQ ID NO: 1538678 - RNA, 14 nt, Pseudomonas aeruginosa PA01
gcccgcgccuccag

SEQ ID NO: 1538679 - RNA, 20 nt, Pseudomonas aeruginosa PA01
gcccgcgccuccaggcgcgc

SEQ ID NO: 1538680 - RNA, 13 nt, Pseudomonas aeruginosa PA01
gcccgcgccgccg

SEQ ID NO: 1538681 - RNA, 16 nt, Pseudomonas aeruginosa PA01
gcccgcgagccgcgca

SEQ ID NO: 1538682 - RNA, 22 nt, Pseudomonas aeruginosa PA01
gcccgcgagccguccugcggcc

SEQ ID NO: 1538683 - RNA, 23 nt, Pseudomonas aeruginosa PA01
gcccgcgagccguccugcggccg

SEQ ID NO: 1538684 - RNA, 16 nt, Pseudomonas aeruginosa PA01
gcccgccgcggcgagc

SEQ ID NO: 1538685 - RNA, 18 nt, Pseudomonas aeruginosa PA01
gcccgucaugaccagagc

SEQ ID NO: 1538686 - RNA, 21 nt, Pseudomonas aeruginosa PA01
gcccgucaugaccagagccgc

SEQ ID NO: 1538687 - RNA, 23 nt, Pseudomonas aeruginosa PA01
gcccgucaugaccagagccgccg

SEQ ID NO: 1538688 - RNA, 14 nt, Pseudomonas aeruginosa PA01
gcccguagcacaug

SEQ ID NO: 1538689 - RNA, 17 nt, Pseudomonas aeruginosa PA01
gcccgggguuggcgcug

SEQ ID NO: 1538690 - RNA, 19 nt, Pseudomonas aeruginosa PA01
gcccggguugcccucgcag

SEQ ID NO: 1538691 - RNA, 22 nt, Pseudomonas aeruginosa PA01
gcccggguugcccucgcagccg

SEQ ID NO: 1538692 - RNA, 13 nt, Pseudomonas aeruginosa PA01
gcccgggcgcaac

SEQ ID NO: 1538693 - RNA, 12 nt, Pseudomonas aeruginosa PA01
gcccggccuggu

SEQ ID NO: 1538694 - RNA, 18 nt, Pseudomonas aeruginosa PA01
gcccggccuucaccgcgc

SEQ ID NO: 1538695 - RNA, 13 nt, Pseudomonas aeruginosa PA01
gcccggccgcugc

SEQ ID NO: 1538696 - RNA, 18 nt, Pseudomonas aeruginosa PA01
gcccggcgugagcagggc

SEQ ID NO: 1538697 - RNA, 17 nt, Pseudomonas aeruginosa PA01
gcccggcuccagccggg

SEQ ID NO: 1538698 - RNA, 21 nt, Pseudomonas aeruginosa PA01
gcccggcguuucgccgggccu

SEQ ID NO: 1538699 - RNA, 21 nt, Pseudomonas aeruginosa PA01
gcccgcugcgcugccagcgcc

SEQ ID NO: 1538700 - RNA, 12 nt, Pseudomonas aeruginosa PA01
gcccgcugggca

SEQ ID NO: 1538701 - RNA, 20 nt, Pseudomonas aeruginosa PA01
gcccgcugggcagguggugg

SEQ ID NO: 1538702 - RNA, 18 nt, Pseudomonas aeruginosa PA01
gcccgcuucgagcgggcu

SEQ ID NO: 1538703 - RNA, 22 nt, Pseudomonas aeruginosa PA01
gcccggccauccuggccggucg

SEQ ID NO: 1538704 - RNA, 16 nt, Pseudomonas aeruginosa PA01
gcccggccaggccgcc

SEQ ID NO: 1538705 - RNA, 17 nt, Pseudomonas aeruginosa PA01
gcccggccaggcgcggc

SEQ ID NO: 1538706 - RNA, 17 nt, Pseudomonas aeruginosa PA01
gcccgcugaccgggcgg

SEQ ID NO: 1538707 - RNA, 20 nt, Pseudomonas aeruginosa PA01
gcccgcucaagggcuggcag

SEQ ID NO: 1538708 - RNA, 19 nt, Pseudomonas aeruginosa PA01
gcccgcucaugagauccgc

SEQ ID NO: 1538709 - RNA, 24 nt, Pseudomonas aeruginosa PA01
gcccgcucaugagauccgccagca

SEQ ID NO: 1538710 - RNA, 13 nt, Pseudomonas aeruginosa PA01
gcccuccaggcga

SEQ ID NO: 1538711 - RNA, 14 nt, Pseudomonas aeruginosa PA01
gcccuccaggcgaa

SEQ ID NO: 1538712 - RNA, 13 nt, Pseudomonas aeruginosa PA01
gcccuccagcacc

SEQ ID NO: 1538713 - RNA, 14 nt, Pseudomonas aeruginosa PA01
gcccuccagcaccg

SEQ ID NO: 1538714 - RNA, 20 nt, Pseudomonas aeruginosa PA01
gcccuccagcaccgccuggc

SEQ ID NO: 1538715 - RNA, 17 nt, Pseudomonas aeruginosa PA01
gcccucagggaagaugc

SEQ ID NO: 1538716 - RNA, 21 nt, Pseudomonas aeruginosa PA01
gcccucagcggcggugcgccg

SEQ ID NO: 1538717 - RNA, 22 nt, Pseudomonas aeruginosa PA01
gcccuccggcgcguuggcuggc

SEQ ID NO: 1538718 - RNA, 17 nt, Pseudomonas aeruginosa PA01
gcccuccugggccuguc

SEQ ID NO: 1538719 - RNA, 13 nt, Pseudomonas aeruginosa PA01
gcccucgaacggc

SEQ ID NO: 1538720 - RNA, 16 nt, Pseudomonas aeruginosa PA01
gcccucgucgcaccug

SEQ ID NO: 1538721 - RNA, 13 nt, Pseudomonas aeruginosa PA01
gcccgugucgccu

SEQ ID NO: 1538722 - RNA, 14 nt, Pseudomonas aeruginosa PA01
gcccgugucgccuu

SEQ ID NO: 1538723 - RNA, 20 nt, Pseudomonas aeruginosa PA01
gcccgucgaccaucaccagc

SEQ ID NO: 1538724 - RNA, 22 nt, Pseudomonas aeruginosa PA01
gcccguccuccaaagccuggag

SEQ ID NO: 1538725 - RNA, 21 nt, Pseudomonas aeruginosa PA01
gcccuggcuuuccagggccug

SEQ ID NO: 1538726 - RNA, 19 nt, Pseudomonas aeruginosa PA01
gcccugggguuucugcugg

SEQ ID NO: 1538727 - RNA, 22 nt, Pseudomonas aeruginosa PA01
gcccugggguuucugcuggcca

SEQ ID NO: 1538728 - RNA, 19 nt, Pseudomonas aeruginosa PA01
gcccugggccccggccggc

SEQ ID NO: 1538729 - RNA, 13 nt, Pseudomonas aeruginosa PA01
gcccugggccggc

SEQ ID NO: 1538730 - RNA, 19 nt, Pseudomonas aeruginosa PA01
gcccugggccggcgccagc

SEQ ID NO: 1538731 - RNA, 23 nt, Pseudomonas aeruginosa PA01
gcccugggccggcgccagcaggc

SEQ ID NO: 1538732 - RNA, 17 nt, Pseudomonas aeruginosa PA01
gcccugggcgaacagca

SEQ ID NO: 1538733 - RNA, 22 nt, Pseudomonas aeruginosa PA01
gcccugggcgaacagcacccag

SEQ ID NO: 1538734 - RNA, 16 nt, Pseudomonas aeruginosa PA01
gcccugcugcucgcca

SEQ ID NO: 1538735 - RNA, 14 nt, Pseudomonas aeruginosa PA01
gcccugcuggcgca

SEQ ID NO: 1538736 - RNA, 14 nt, Pseudomonas aeruginosa PA01
gcccuggcgcgcgc

SEQ ID NO: 1538737 - RNA, 16 nt, Pseudomonas aeruginosa PA01
gcccuggcgcgcgccc

SEQ ID NO: 1538738 - RNA, 17 nt, Pseudomonas aeruginosa PA01
gcccuggcgcaggcggc

SEQ ID NO: 1538739 - RNA, 15 nt, Pseudomonas aeruginosa PA01
gcccugcucgccggc

SEQ ID NO: 1538740 - RNA, 14 nt, Pseudomonas aeruginosa PA01
gcccugcgcgcgcg

SEQ ID NO: 1538741 - RNA, 23 nt, Pseudomonas aeruginosa PA01
gcccugcgucgcagagacgcagc

SEQ ID NO: 1538742 - RNA, 20 nt, Pseudomonas aeruginosa PA01
gcccugcucuuccagcgggc

SEQ ID NO: 1538743 - RNA, 24 nt, Pseudomonas aeruginosa PA01
gcccugcguggaaccgcggcgccc

SEQ ID NO: 1538744 - RNA, 16 nt, Pseudomonas aeruginosa PA01
gcccugcgccagcauc

SEQ ID NO: 1538745 - RNA, 18 nt, Pseudomonas aeruginosa PA01
gcccugccggcgcagauc

SEQ ID NO: 1538746 - RNA, 19 nt, Pseudomonas aeruginosa PA01
gcccucucaggagcgccgc

SEQ ID NO: 1538747 - RNA, 22 nt, Pseudomonas aeruginosa PA01
gcccucucaggagcgccgcgca

SEQ ID NO: 1538748 - RNA, 14 nt, Pseudomonas aeruginosa PA01
gcccaucaacgagc

SEQ ID NO: 1538749 - RNA, 15 nt, Pseudomonas aeruginosa PA01
gcccaguucgccggc

SEQ ID NO: 1538750 - RNA, 21 nt, Pseudomonas aeruginosa PA01
gcccaguucgccggccagcac

SEQ ID NO: 1538751 - RNA, 21 nt, Pseudomonas aeruginosa PA01
gcccaguucuucgccgcccgc

SEQ ID NO: 1538752 - RNA, 18 nt, Pseudomonas aeruginosa PA01
gcccaguugcgcggcgag

SEQ ID NO: 1538753 - RNA, 22 nt, Pseudomonas aeruginosa PA01
gcccaguucgcugccgccgcgc

SEQ ID NO: 1538754 - RNA, 14 nt, Pseudomonas aeruginosa PA01
gcccaucgccucca

SEQ ID NO: 1538755 - RNA, 21 nt, Pseudomonas aeruginosa PA01
gcccaucgccuccacggcggc

SEQ ID NO: 1538756 - RNA, 19 nt, Pseudomonas aeruginosa PA01
gcccaucgacugcaacaga

SEQ ID NO: 1538757 - RNA, 23 nt, Pseudomonas aeruginosa PA01
gcccaucgagguauugcgcgugg

SEQ ID NO: 1538758 - RNA, 17 nt, Pseudomonas aeruginosa PA01
gcccauccgccgcagga

SEQ ID NO: 1538759 - RNA, 21 nt, Pseudomonas aeruginosa PA01
gcccauccgccgcaggaaggc

SEQ ID NO: 1538760 - RNA, 19 nt, Pseudomonas aeruginosa PA01
gcccagguagccggcgagc

SEQ ID NO: 1538761 - RNA, 21 nt, Pseudomonas aeruginosa PA01
gcccagguagccggcgagcgc

SEQ ID NO: 1538762 - RNA, 19 nt, Pseudomonas aeruginosa PA01
gcccagguagucgcccagc

SEQ ID NO: 1538763 - RNA, 15 nt, Pseudomonas aeruginosa PA01
gcccaggcgucgcgc

SEQ ID NO: 1538764 - RNA, 23 nt, Pseudomonas aeruginosa PA01
gcccaggcgucgcgccagcaccg

SEQ ID NO: 1538765 - RNA, 13 nt, Pseudomonas aeruginosa PA01
gcccagggccagc

SEQ ID NO: 1538766 - RNA, 16 nt, Pseudomonas aeruginosa PA01
gcccagggccagcagc

SEQ ID NO: 1538767 - RNA, 20 nt, Pseudomonas aeruginosa PA01
gcccagggccagcggguuga

SEQ ID NO: 1538768 - RNA, 14 nt, Pseudomonas aeruginosa PA01
gcccagggcccaga

SEQ ID NO: 1538769 - RNA, 16 nt, Pseudomonas aeruginosa PA01
gcccagggcccagagc

SEQ ID NO: 1538770 - RNA, 17 nt, Pseudomonas aeruginosa PA01
gcccagggcccagagca

SEQ ID NO: 1538771 - RNA, 13 nt, Pseudomonas aeruginosa PA01
gcccaggcugccg

SEQ ID NO: 1538772 - RNA, 17 nt, Pseudomonas aeruginosa PA01
gcccaggcugccgccgc

SEQ ID NO: 1538773 - RNA, 18 nt, Pseudomonas aeruginosa PA01
gcccaggcugccgccgcc

SEQ ID NO: 1538774 - RNA, 20 nt, Pseudomonas aeruginosa PA01
gcccaggcugccggccaggu

SEQ ID NO: 1538775 - RNA, 16 nt, Pseudomonas aeruginosa PA01
gcccaggcuggcggcc

SEQ ID NO: 1538776 - RNA, 14 nt, Pseudomonas aeruginosa PA01
gcccaggcgccgcu

SEQ ID NO: 1538777 - RNA, 19 nt, Pseudomonas aeruginosa PA01
gcccaggcgguuguucagc

SEQ ID NO: 1538778 - RNA, 14 nt, Pseudomonas aeruginosa PA01
gcccaggcgcucgg

SEQ ID NO: 1538779 - RNA, 14 nt, Pseudomonas aeruginosa PA01
gcccaggcgcuggc

SEQ ID NO: 1538780 - RNA, 20 nt, Pseudomonas aeruginosa PA01
gcccaggcccagcgcggcgc

SEQ ID NO: 1538781 - RNA, 14 nt, Pseudomonas aeruginosa PA01
gcccaggccgccga

SEQ ID NO: 1538782 - RNA, 21 nt, Pseudomonas aeruginosa PA01
gcccaggccgccgauccagga

SEQ ID NO: 1538783 - RNA, 15 nt, Pseudomonas aeruginosa PA01
gcccaggccgcuggc

SEQ ID NO: 1538784 - RNA, 20 nt, Pseudomonas aeruginosa PA01
gcccaggccgggucgcagcc

SEQ ID NO: 1538785 - RNA, 14 nt, Pseudomonas aeruginosa PA01
gcccaggccggguu

SEQ ID NO: 1538786 - RNA, 19 nt, Pseudomonas aeruginosa PA01
gcccagugguuccaggagg

SEQ ID NO: 1538787 - RNA, 16 nt, Pseudomonas aeruginosa PA01
gcccagugcccggcag

SEQ ID NO: 1538788 - RNA, 17 nt, Pseudomonas aeruginosa PA01
gcccaguaccacgcagc

SEQ ID NO: 1538789 - RNA, 16 nt, Pseudomonas aeruginosa PA01
gcccaguacccgcugg

SEQ ID NO: 1538790 - RNA, 23 nt, Pseudomonas aeruginosa PA01
gcccaggugcgccgagcgcucgc

SEQ ID NO: 1538791 - RNA, 16 nt, Pseudomonas aeruginosa PA01
gcccagguggcaggcc

SEQ ID NO: 1538792 - RNA, 14 nt, Pseudomonas aeruginosa PA01
gccaugcucuucag

SEQ ID NO: 1538793 - RNA, 13 nt, Pseudomonas aeruginosa PA01
gccaugcgcccgc

SEQ ID NO: 1538794 - RNA, 18 nt, Pseudomonas aeruginosa PA01
gcccacucgauggugggc

SEQ ID NO: 1538795 - RNA, 21 nt, Pseudomonas aeruginosa PA01
gcccacucgauggugggcucu

SEQ ID NO: 1538796 - RNA, 17 nt, Pseudomonas aeruginosa PA01
gcccagaaaaaagcccc

SEQ ID NO: 1538797 - RNA, 19 nt, Pseudomonas aeruginosa PA01
gcccagaaaaaagccccgc

SEQ ID NO: 1538798 - RNA, 15 nt, Pseudomonas aeruginosa PA01
gcccaggcccagcgc

SEQ ID NO: 1538799 - RNA, 19 nt, Pseudomonas aeruginosa PA01
gcccagcgguacuaucccg

SEQ ID NO: 1538800 - RNA, 16 nt, Pseudomonas aeruginosa PA01
gcccagcucgccgcuc

SEQ ID NO: 1538801 - RNA, 20 nt, Pseudomonas aeruginosa PA01
gcccagcgcuuccucgggca

SEQ ID NO: 1538802 - RNA, 15 nt, Pseudomonas aeruginosa PA01
gcccagcggcagggc

SEQ ID NO: 1538803 - RNA, 17 nt, Pseudomonas aeruginosa PA01
gcccagcguggccagcg

SEQ ID NO: 1538804 - RNA, 20 nt, Pseudomonas aeruginosa PA01
gcccagcguggccagcgaac

SEQ ID NO: 1538805 - RNA, 13 nt, Pseudomonas aeruginosa PA01
gcccagcggcgcc

SEQ ID NO: 1538806 - RNA, 14 nt, Pseudomonas aeruginosa PA01
gcccagcggcuggc

SEQ ID NO: 1538807 - RNA, 17 nt, Pseudomonas aeruginosa PA01
gcccagcguucggcgcu

SEQ ID NO: 1538808 - RNA, 20 nt, Pseudomonas aeruginosa PA01
gcccagcguucggcgcuggc

SEQ ID NO: 1538809 - RNA, 14 nt, Pseudomonas aeruginosa PA01
gcccagcagcacca

SEQ ID NO: 1538810 - RNA, 13 nt, Pseudomonas aeruginosa PA01
gcccagcagcagg

SEQ ID NO: 1538811 - RNA, 14 nt, Pseudomonas aeruginosa PA01
gcccagccgcggcg

SEQ ID NO: 1538812 - RNA, 22 nt, Pseudomonas aeruginosa PA01
gcccagcgagccgaucaccagc

SEQ ID NO: 1538813 - RNA, 20 nt, Pseudomonas aeruginosa PA01
gcccagcgcggcgccccagg

SEQ ID NO: 1538814 - RNA, 19 nt, Pseudomonas aeruginosa PA01
gcccaugaaaaagccccgc

SEQ ID NO: 1538815 - RNA, 21 nt, Pseudomonas aeruginosa PA01
gcccaugaaaaauggccgcuu

SEQ ID NO: 1538816 - RNA, 20 nt, Pseudomonas aeruginosa PA01
gcccaucggcgucggcuggu

SEQ ID NO: 1538817 - RNA, 22 nt, Pseudomonas aeruginosa PA01
gcccaugugcuugaccgccgcc

SEQ ID NO: 1538818 - RNA, 14 nt, Pseudomonas aeruginosa PA01
gcccaugcgcggcg

SEQ ID NO: 1538819 - RNA, 20 nt, Pseudomonas aeruginosa PA01
gcccauugcccggccaggcg

SEQ ID NO: 1538820 - RNA, 17 nt, Pseudomonas aeruginosa PA01
gccccaaggggccgcgc

SEQ ID NO: 1538821 - RNA, 16 nt, Pseudomonas aeruginosa PA01
gccccacuuccggccc

SEQ ID NO: 1538822 - RNA, 17 nt, Pseudomonas aeruginosa PA01
gccccagagcccgccga

SEQ ID NO: 1538823 - RNA, 15 nt, Pseudomonas aeruginosa PA01
gccccagaccugaua

SEQ ID NO: 1538824 - RNA, 23 nt, Pseudomonas aeruginosa PA01
gccccacggcgcggccgugccuc

SEQ ID NO: 1538825 - RNA, 21 nt, Pseudomonas aeruginosa PA01
gccccacuggaagaaggcgau

SEQ ID NO: 1538826 - RNA, 19 nt, Pseudomonas aeruginosa PA01
gccccagaucgccagcgcc

SEQ ID NO: 1538827 - RNA, 18 nt, Pseudomonas aeruginosa PA01
gccccagcacgccgagca

SEQ ID NO: 1538828 - RNA, 18 nt, Pseudomonas aeruginosa PA01
gccccagcacugguggac

SEQ ID NO: 1538829 - RNA, 14 nt, Pseudomonas aeruginosa PA01
gccccagcgcgagc

SEQ ID NO: 1538830 - RNA, 16 nt, Pseudomonas aeruginosa PA01
gccccagcggcaggca

SEQ ID NO: 1538831 - RNA, 18 nt, Pseudomonas aeruginosa PA01
gccccagcggcaggcacg

SEQ ID NO: 1538832 - RNA, 15 nt, Pseudomonas aeruginosa PA01
gccccaggcacggcu

SEQ ID NO: 1538833 - RNA, 16 nt, Pseudomonas aeruginosa PA01
gccccagccucggcag

SEQ ID NO: 1538834 - RNA, 19 nt, Pseudomonas aeruginosa PA01
gccccagccucggcagggc

SEQ ID NO: 1538835 - RNA, 13 nt, Pseudomonas aeruginosa PA01
gccccagccuugc

SEQ ID NO: 1538836 - RNA, 23 nt, Pseudomonas aeruginosa PA01
gccccagccuugcuggacuuccc

SEQ ID NO: 1538837 - RNA, 21 nt, Pseudomonas aeruginosa PA01
gccccagcgccugggccgcgc

SEQ ID NO: 1538838 - RNA, 16 nt, Pseudomonas aeruginosa PA01
gcccccauaccgccuc

SEQ ID NO: 1538839 - RNA, 18 nt, Pseudomonas aeruginosa PA01
gcccccacgacgcacuca

SEQ ID NO: 1538840 - RNA, 12 nt, Pseudomonas aeruginosa PA01
gcccccagcgcg

SEQ ID NO: 1538841 - RNA, 16 nt, Pseudomonas aeruginosa PA01
gcccccagcgcgccgc

SEQ ID NO: 1538842 - RNA, 12 nt, Pseudomonas aeruginosa PA01
gccccaggcgag

SEQ ID NO: 1538843 - RNA, 12 nt, Pseudomonas aeruginosa PA01
gccccaggcgau

SEQ ID NO: 1538844 - RNA, 21 nt, Pseudomonas aeruginosa PA01
gccccaggcgcccaggcagca

SEQ ID NO: 1538845 - RNA, 17 nt, Pseudomonas aeruginosa PA01
gccccagcccagggcga

SEQ ID NO: 1538846 - RNA, 15 nt, Pseudomonas aeruginosa PA01
gccccaggccgccgc

SEQ ID NO: 1538847 - RNA, 15 nt, Pseudomonas aeruginosa PA01
gccccaguccucgua

SEQ ID NO: 1538848 - RNA, 17 nt, Pseudomonas aeruginosa PA01
gccccagggccggcgcc

SEQ ID NO: 1538849 - RNA, 22 nt, Pseudomonas aeruginosa PA01
gcccccgccgcugaggcucgcc

SEQ ID NO: 1538850 - RNA, 14 nt, Pseudomonas aeruginosa PA01
gcccccgccggccg

SEQ ID NO: 1538851 - RNA, 14 nt, Pseudomonas aeruginosa PA01
gccccgaggccagc

SEQ ID NO: 1538852 - RNA, 17 nt, Pseudomonas aeruginosa PA01
gccccgaggggcggcuu

SEQ ID NO: 1538853 - RNA, 13 nt, Pseudomonas aeruginosa PA01
gccccgagaaaac

SEQ ID NO: 1538854 - RNA, 19 nt, Pseudomonas aeruginosa PA01
gccccgacugucgugccuc

SEQ ID NO: 1538855 - RNA, 15 nt, Pseudomonas aeruginosa PA01
gccccgcaccagcca

SEQ ID NO: 1538856 - RNA, 17 nt, Pseudomonas aeruginosa PA01
gccccgcaccagccagc

SEQ ID NO: 1538857 - RNA, 17 nt, Pseudomonas aeruginosa PA01
gccccgcaaugcggggc

SEQ ID NO: 1538858 - RNA, 15 nt, Pseudomonas aeruginosa PA01
gccccgagcgggccg

SEQ ID NO: 1538859 - RNA, 12 nt, Pseudomonas aeruginosa PA01
gccccgccgagg

SEQ ID NO: 1538860 - RNA, 16 nt, Pseudomonas aeruginosa PA01
gccccgccgccaggcg

SEQ ID NO: 1538861 - RNA, 15 nt, Pseudomonas aeruginosa PA01
gccccgccaggagcc

SEQ ID NO: 1538862 - RNA, 17 nt, Pseudomonas aeruginosa PA01
gccagcagggccgccga

SEQ ID NO: 1538863 - RNA, 23 nt, Pseudomonas aeruginosa PA01
gccagcagguggucgaugggcga

SEQ ID NO: 1538864 - RNA, 22 nt, Pseudomonas aeruginosa PA01
gccagcagucguugacggugcu

SEQ ID NO: 1538865 - RNA, 20 nt, Pseudomonas aeruginosa PA01
gccagcagggucucgcugcu

SEQ ID NO: 1538866 - RNA, 13 nt, Pseudomonas aeruginosa PA01
gccagcagggugg

SEQ ID NO: 1538867 - RNA, 18 nt, Pseudomonas aeruginosa PA01
gccagcagguacagcagc

SEQ ID NO: 1538868 - RNA, 22 nt, Pseudomonas aeruginosa PA01
gccagcagguacagcagcuuca

SEQ ID NO: 1538869 - RNA, 16 nt, Pseudomonas aeruginosa PA01
gccagcaggccgagcg

SEQ ID NO: 1538870 - RNA, 16 nt, Pseudomonas aeruginosa PA01
gccagcaggcgcagca

SEQ ID NO: 1538871 - RNA, 13 nt, Pseudomonas aeruginosa PA01
gccagcaggcuca

SEQ ID NO: 1538872 - RNA, 22 nt, Pseudomonas aeruginosa PA01
gccagcaggcucaugcccagcu

SEQ ID NO: 1538873 - RNA, 11 nt, Pseudomonas aeruginosa PA01
gccagcaggau

SEQ ID NO: 1538874 - RNA, 21 nt, Pseudomonas aeruginosa PA01
gccagcaggaucgacagcagc

SEQ ID NO: 1538875 - RNA, 15 nt, Pseudomonas aeruginosa PA01
gccagcagcagaagg

SEQ ID NO: 1538876 - RNA, 14 nt, Pseudomonas aeruginosa PA01
gccagcagcacgcc

SEQ ID NO: 1538877 - RNA, 13 nt, Pseudomonas aeruginosa PA01
gccagcgcggcgc

SEQ ID NO: 1538878 - RNA, 18 nt, Pseudomonas aeruginosa PA01
gccagcgcggcucgggcg

SEQ ID NO: 1538879 - RNA, 21 nt, Pseudomonas aeruginosa PA01
gccagcgcggcucgggcggca

SEQ ID NO: 1538880 - RNA, 18 nt, Pseudomonas aeruginosa PA01
gccagcggcuccucggcc

SEQ ID NO: 1538881 - RNA, 24 nt, Pseudomonas aeruginosa PA01
gccagcggcuccucggccugggcg

SEQ ID NO: 1538882 - RNA, 19 nt, Pseudomonas aeruginosa PA01
gccagcgguacccgccggc

SEQ ID NO: 1538883 - RNA, 15 nt, Pseudomonas aeruginosa PA01
gccagcgggcgccgc

SEQ ID NO: 1538884 - RNA, 18 nt, Pseudomonas aeruginosa PA01
gccagcgcggugcgcgcc

SEQ ID NO: 1538885 - RNA, 19 nt, Pseudomonas aeruginosa PA01
gccagcgguucaggucgag

SEQ ID NO: 1538886 - RNA, 19 nt, Pseudomonas aeruginosa PA01
gccagcgguugagcagggc

SEQ ID NO: 1538887 - RNA, 14 nt, Pseudomonas aeruginosa PA01
gccagcgcgcgccg

SEQ ID NO: 1538888 - RNA, 22 nt, Pseudomonas aeruginosa PA01
gccagcgcgcgccgacaggcau

SEQ ID NO: 1538889 - RNA, 12 nt, Pseudomonas aeruginosa PA01
gccagcgcgcgc

SEQ ID NO: 1538890 - RNA, 15 nt, Pseudomonas aeruginosa PA01
gccagcgccaggagc

SEQ ID NO: 1538891 - RNA, 16 nt, Pseudomonas aeruginosa PA01
gccagcgccaggagca

SEQ ID NO: 1538892 - RNA, 21 nt, Pseudomonas aeruginosa PA01
gccagcgccaggagcagggcg

SEQ ID NO: 1538893 - RNA, 14 nt, Pseudomonas aeruginosa PA01
gccagcgccagguu

SEQ ID NO: 1538894 - RNA, 18 nt, Pseudomonas aeruginosa PA01
gccagcgcaucgaggccg

SEQ ID NO: 1538895 - RNA, 15 nt, Pseudomonas aeruginosa PA01
gccagcgccagcagg

SEQ ID NO: 1538896 - RNA, 16 nt, Pseudomonas aeruginosa PA01
gccagcgccagcaggu

SEQ ID NO: 1538897 - RNA, 13 nt, Pseudomonas aeruginosa PA01
gccagcgccacgc

SEQ ID NO: 1538898 - RNA, 17 nt, Pseudomonas aeruginosa PA01
gccagcgccaccagcag

SEQ ID NO: 1538899 - RNA, 19 nt, Pseudomonas aeruginosa PA01
gccagcgccaccagcaggg

SEQ ID NO: 1538900 - RNA, 13 nt, Pseudomonas aeruginosa PA01
gccaggccccagg

SEQ ID NO: 1538901 - RNA, 18 nt, Pseudomonas aeruginosa PA01
gccaggcccucggcgacc

SEQ ID NO: 1538902 - RNA, 15 nt, Pseudomonas aeruginosa PA01
gccaggcccggcgcu

SEQ ID NO: 1538903 - RNA, 18 nt, Pseudomonas aeruginosa PA01
gccaggcccggcgcugcu

SEQ ID NO: 1538904 - RNA, 12 nt, Pseudomonas aeruginosa PA01
gccagggacgcg

SEQ ID NO: 1538905 - RNA, 16 nt, Pseudomonas aeruginosa PA01
gccagggacgcgcagc

SEQ ID NO: 1538906 - RNA, 18 nt, Pseudomonas aeruginosa PA01
gccagggaggcgcuggcc

SEQ ID NO: 1538907 - RNA, 19 nt, Pseudomonas aeruginosa PA01
gccagggaggcgcuggcca

SEQ ID NO: 1538908 - RNA, 20 nt, Pseudomonas aeruginosa PA01
gccaggcccugggcggcggg

SEQ ID NO: 1538909 - RNA, 17 nt, Pseudomonas aeruginosa PA01
gccaggcccuuggucag

SEQ ID NO: 1538910 - RNA, 19 nt, Pseudomonas aeruginosa PA01
gccaggcccuuggucaggc

SEQ ID NO: 1538911 - RNA, 17 nt, Pseudomonas aeruginosa PA01
gccaggccgagcgcgcc

SEQ ID NO: 1538912 - RNA, 13 nt, Pseudomonas aeruginosa PA01
gccagggaaauca

SEQ ID NO: 1538913 - RNA, 19 nt, Pseudomonas aeruginosa PA01
gccagggcauguuccucca

SEQ ID NO: 1538914 - RNA, 18 nt, Pseudomonas aeruginosa PA01
gccagggcauugaccuug

SEQ ID NO: 1538915 - RNA, 13 nt, Pseudomonas aeruginosa PA01
gccagggccuugc

SEQ ID NO: 1538916 - RNA, 17 nt, Pseudomonas aeruginosa PA01
gccagggcgaggccgcu

SEQ ID NO: 1538917 - RNA, 18 nt, Pseudomonas aeruginosa PA01
gccagggcgaggccgcuc

SEQ ID NO: 1538918 - RNA, 14 nt, Pseudomonas aeruginosa PA01
gccagggcccacag

SEQ ID NO: 1538919 - RNA, 23 nt, Pseudomonas aeruginosa PA01
gccagggcaacgccaggcuguca

SEQ ID NO: 1538920 - RNA, 15 nt, Pseudomonas aeruginosa PA01
gccagggcagcaggu

SEQ ID NO: 1538921 - RNA, 21 nt, Pseudomonas aeruginosa PA01
gccagggauuccuuggucagg

SEQ ID NO: 1538922 - RNA, 23 nt, Pseudomonas aeruginosa PA01
gccagggcagggaguccgccagc

SEQ ID NO: 1538923 - RNA, 15 nt, Pseudomonas aeruginosa PA01
gccaggucgucgcgc

SEQ ID NO: 1538924 - RNA, 19 nt, Pseudomonas aeruginosa PA01
gccaggucguugcgccggc

SEQ ID NO: 1538925 - RNA, 15 nt, Pseudomonas aeruginosa PA01
gccaggucgagggca

SEQ ID NO: 1538926 - RNA, 14 nt, Pseudomonas aeruginosa PA01
gccaggucgauccc

SEQ ID NO: 1538927 - RNA, 19 nt, Pseudomonas aeruginosa PA01
gccaggucgauccccaacc

SEQ ID NO: 1538928 - RNA, 20 nt, Pseudomonas aeruginosa PA01
gccagguccgccugguccag

SEQ ID NO: 1538929 - RNA, 18 nt, Pseudomonas aeruginosa PA01
gccagguccgaacagagg

SEQ ID NO: 1538930 - RNA, 15 nt, Pseudomonas aeruginosa PA01
gccagguaguccagc

SEQ ID NO: 1538931 - RNA, 22 nt, Pseudomonas aeruginosa PA01
gccagguacuggcgauggauga

SEQ ID NO: 1538932 - RNA, 14 nt, Pseudomonas aeruginosa PA01
gccagguagccugg

SEQ ID NO: 1538933 - RNA, 15 nt, Pseudomonas aeruginosa PA01
gccagguagccugga

SEQ ID NO: 1538934 - RNA, 12 nt, Pseudomonas aeruginosa PA01
gccaggucagcc

SEQ ID NO: 1538935 - RNA, 23 nt, Pseudomonas aeruginosa PA01
gccagguaauagccguugaggcc

SEQ ID NO: 1538936 - RNA, 14 nt, Pseudomonas aeruginosa PA01
gccaggaagcgggc

SEQ ID NO: 1538937 - RNA, 15 nt, Pseudomonas aeruginosa PA01
gccaggaagcgggcc

SEQ ID NO: 1538938 - RNA, 17 nt, Pseudomonas aeruginosa PA01
gccaggaccagcccguu

SEQ ID NO: 1538939 - RNA, 17 nt, Pseudomonas aeruginosa PA01
gccaggaccaucggcac

SEQ ID NO: 1538940 - RNA, 22 nt, Pseudomonas aeruginosa PA01
gccaggaccucgaagcuggcca

SEQ ID NO: 1538941 - RNA, 23 nt, Pseudomonas aeruginosa PA01
gccaggaagagcccgccacgcuu

SEQ ID NO: 1538942 - RNA, 15 nt, Pseudomonas aeruginosa PA01
gccaggaagccgcgc

SEQ ID NO: 1538943 - RNA, 18 nt, Pseudomonas aeruginosa PA01
gccaggaagccgcgcccc

SEQ ID NO: 1538944 - RNA, 17 nt, Pseudomonas aeruginosa PA01
gccagcucgaacagcac

SEQ ID NO: 1538945 - RNA, 17 nt, Pseudomonas aeruginosa PA01
gccaggcaggccgggcu

SEQ ID NO: 1538946 - RNA, 22 nt, Pseudomonas aeruginosa PA01
gccaggacgccaccaggccgcu

SEQ ID NO: 1538947 - RNA, 15 nt, Pseudomonas aeruginosa PA01
gccaggacgcuggcg

SEQ ID NO: 1538948 - RNA, 16 nt, Pseudomonas aeruginosa PA01
gccaggacgcuggcga

SEQ ID NO: 1538949 - RNA, 16 nt, Pseudomonas aeruginosa PA01
gccaggacggcagggu

SEQ ID NO: 1538950 - RNA, 13 nt, Pseudomonas aeruginosa PA01
gccaggcauccag

SEQ ID NO: 1538951 - RNA, 17 nt, Pseudomonas aeruginosa PA01
gccaggcauccagcacc

SEQ ID NO: 1538952 - RNA, 12 nt, Pseudomonas aeruginosa PA01
gccaggccacgg

SEQ ID NO: 1538953 - RNA, 21 nt, Pseudomonas aeruginosa PA01
gccaggcauuccuccaggguc

SEQ ID NO: 1538954 - RNA, 22 nt, Pseudomonas aeruginosa PA01
gccaggcauuccuccagggucg

SEQ ID NO: 1538955 - RNA, 13 nt, Pseudomonas aeruginosa PA01
gccagcuccagcg

SEQ ID NO: 1538956 - RNA, 21 nt, Pseudomonas aeruginosa PA01
gccagcuccagcgcccaggug

SEQ ID NO: 1538957 - RNA, 21 nt, Pseudomonas aeruginosa PA01
gccagcgucgccugccaggcg

SEQ ID NO: 1538958 - RNA, 22 nt, Pseudomonas aeruginosa PA01
gccagcgucgccugccaggcgg

SEQ ID NO: 1538959 - RNA, 19 nt, Pseudomonas aeruginosa PA01
gccagcuccgccugaccgc

SEQ ID NO: 1538960 - RNA, 16 nt, Pseudomonas aeruginosa PA01
gccagcucgcugucca

SEQ ID NO: 1538961 - RNA, 23 nt, Pseudomonas aeruginosa PA01
gccagcucggacaagggccagag

SEQ ID NO: 1538962 - RNA, 12 nt, Pseudomonas aeruginosa PA01
gccagcucggcc

SEQ ID NO: 1538963 - RNA, 13 nt, Pseudomonas aeruginosa PA01
gccagcuucucca

SEQ ID NO: 1538964 - RNA, 22 nt, Pseudomonas aeruginosa PA01
gccagcuuguaguagcgcccga

SEQ ID NO: 1538965 - RNA, 15 nt, Pseudomonas aeruginosa PA01
gccagcuuguccgcc

SEQ ID NO: 1538966 - RNA, 18 nt, Pseudomonas aeruginosa PA01
gccaguucucgcagcagg

SEQ ID NO: 1538967 - RNA, 15 nt, Pseudomonas aeruginosa PA01
gccaguucgcggcgc

SEQ ID NO: 1538968 - RNA, 16 nt, Pseudomonas aeruginosa PA01
gccaguucgcggcgca

SEQ ID NO: 1538969 - RNA, 19 nt, Pseudomonas aeruginosa PA01
gccaguuucuaucucccua

SEQ ID NO: 1538970 - RNA, 18 nt, Pseudomonas aeruginosa PA01
gccaguuggacgcggccu

SEQ ID NO: 1538971 - RNA, 13 nt, Pseudomonas aeruginosa PA01
gccagugcaugcg

SEQ ID NO: 1538972 - RNA, 20 nt, Pseudomonas aeruginosa PA01
gccagugcaugcguucgccg

SEQ ID NO: 1538973 - RNA, 23 nt, Pseudomonas aeruginosa PA01
gccagugccugcaccacgcaggc

SEQ ID NO: 1538974 - RNA, 23 nt, Pseudomonas aeruginosa PA01
gccagugcagccguugccccaga

SEQ ID NO: 1538975 - RNA, 18 nt, Pseudomonas aeruginosa PA01
gccagucgagacgccagc

SEQ ID NO: 1538976 - RNA, 21 nt, Pseudomonas aeruginosa PA01
gccagucgagacgccagccgc

SEQ ID NO: 1538977 - RNA, 15 nt, Pseudomonas aeruginosa PA01
gccaguccggcagca

SEQ ID NO: 1538978 - RNA, 14 nt, Pseudomonas aeruginosa PA01
gccauccccgaggc

SEQ ID NO: 1538979 - RNA, 21 nt, Pseudomonas aeruginosa PA01
gccauagcgccggcaccgagg

SEQ ID NO: 1538980 - RNA, 14 nt, Pseudomonas aeruginosa PA01
gccauagcgcgccg

SEQ ID NO: 1538981 - RNA, 13 nt, Pseudomonas aeruginosa PA01
gccauacagcgcc

SEQ ID NO: 1538982 - RNA, 16 nt, Pseudomonas aeruginosa PA01
gccaucggucgcgccc

SEQ ID NO: 1538983 - RNA, 18 nt, Pseudomonas aeruginosa PA01
gccaucggucgcgccccc

SEQ ID NO: 1538984 - RNA, 23 nt, Pseudomonas aeruginosa PA01
gccaucggucgcgcccccaucug

SEQ ID NO: 1538985 - RNA, 14 nt, Pseudomonas aeruginosa PA01
gccaugcacacgcu

SEQ ID NO: 1538986 - RNA, 21 nt, Pseudomonas aeruginosa PA01
gccaugcacacgcucccaaca

SEQ ID NO: 1538987 - RNA, 14 nt, Pseudomonas aeruginosa PA01
gccaugcaggccag

SEQ ID NO: 1538988 - RNA, 17 nt, Pseudomonas aeruginosa PA01
gccaugccguucaggcc

SEQ ID NO: 1538989 - RNA, 18 nt, Pseudomonas aeruginosa PA01
gccaucgcuuuccuggcc

SEQ ID NO: 1538990 - RNA, 18 nt, Pseudomonas aeruginosa PA01
gccaucgccggcccgcgc

SEQ ID NO: 1538991 - RNA, 22 nt, Pseudomonas aeruginosa PA01
gccaucgccggcccgcgcggca

SEQ ID NO: 1538992 - RNA, 15 nt, Pseudomonas aeruginosa PA01
gccacgggcgccagc

SEQ ID NO: 1538993 - RNA, 15 nt, Pseudomonas aeruginosa PA01
gccacggccagcagg

SEQ ID NO: 1538994 - RNA, 22 nt, Pseudomonas aeruginosa PA01
gccacggcgagagcgccgacca

SEQ ID NO: 1538995 - RNA, 17 nt, Pseudomonas aeruginosa PA01
gccacggccgcugcgca

SEQ ID NO: 1538996 - RNA, 24 nt, Pseudomonas aeruginosa PA01
gccacggccgcugcgcaggccgag

SEQ ID NO: 1538997 - RNA, 23 nt, Pseudomonas aeruginosa PA01
gccacggaaggccacgccgccgu

SEQ ID NO: 1538998 - RNA, 18 nt, Pseudomonas aeruginosa PA01
gccacggauaugcgccgc

SEQ ID NO: 1538999 - RNA, 22 nt, Pseudomonas aeruginosa PA01
gccacgcucucgaacagcagca

SEQ ID NO: 1539000 - RNA, 18 nt, Pseudomonas aeruginosa PA01
gccacgcugaucaucagc

SEQ ID NO: 1539001 - RNA, 20 nt, Pseudomonas aeruginosa PA01
gccacgcugaucaucagcag

SEQ ID NO: 1539002 - RNA, 15 nt, Pseudomonas aeruginosa PA01
gccacgcgaccagcg

SEQ ID NO: 1539003 - RNA, 17 nt, Pseudomonas aeruginosa PA01
gccacgcgaccagcgcc

SEQ ID NO: 1539004 - RNA, 20 nt, Pseudomonas aeruginosa PA01
gccacgcgcaucgugcagcc

SEQ ID NO: 1539005 - RNA, 16 nt, Pseudomonas aeruginosa PA01
gccacgucgccccagg

SEQ ID NO: 1539006 - RNA, 17 nt, Pseudomonas aeruginosa PA01
gccacgucgccccaggg

SEQ ID NO: 1539007 - RNA, 19 nt, Pseudomonas aeruginosa PA01
gccacgucgccccagggaa

SEQ ID NO: 1539008 - RNA, 23 nt, Pseudomonas aeruginosa PA01
gccacugacgcgcagcgccgccg

SEQ ID NO: 1539009 - RNA, 16 nt, Pseudomonas aeruginosa PA01
gccacucggccaggcg

SEQ ID NO: 1539010 - RNA, 19 nt, Pseudomonas aeruginosa PA01
gccacucggccaggcgcca

SEQ ID NO: 1539011 - RNA, 20 nt, Pseudomonas aeruginosa PA01
gccacucggcgugccgggcc

SEQ ID NO: 1539012 - RNA, 15 nt, Pseudomonas aeruginosa PA01
gccacucgcagccgc

SEQ ID NO: 1539013 - RNA, 19 nt, Pseudomonas aeruginosa PA01
gccacucgcagccgcgcuc

SEQ ID NO: 1539014 - RNA, 21 nt, Pseudomonas aeruginosa PA01
gccacucccggcccuugagca

SEQ ID NO: 1539015 - RNA, 16 nt, Pseudomonas aeruginosa PA01
gccacuccgggcuggu

SEQ ID NO: 1539016 - RNA, 19 nt, Pseudomonas aeruginosa PA01
gccacuauuccuugcgcca

SEQ ID NO: 1539017 - RNA, 19 nt, Pseudomonas aeruginosa PA01
gccacgugcacgccgugca

SEQ ID NO: 1539018 - RNA, 18 nt, Pseudomonas aeruginosa PA01
gccagaagcgacugucca

SEQ ID NO: 1539019 - RNA, 14 nt, Pseudomonas aeruginosa PA01
gccagaaggccugc

SEQ ID NO: 1539020 - RNA, 19 nt, Pseudomonas aeruginosa PA01
gccacugccgccucagcga

SEQ ID NO: 1539021 - RNA, 18 nt, Pseudomonas aeruginosa PA01
gccacugauaccgcuggc

SEQ ID NO: 1539022 - RNA, 23 nt, Pseudomonas aeruginosa PA01
gccacugauaccgcuggccaggu

SEQ ID NO: 1539023 - RNA, 21 nt, Pseudomonas aeruginosa PA01
gccagaccggcagcgccgcca

SEQ ID NO: 1539024 - RNA, 23 nt, Pseudomonas aeruginosa PA01
gccagaauuccagcaggucggca

SEQ ID NO: 1539025 - RNA, 15 nt, Pseudomonas aeruginosa PA01
gccagcagacggcac

SEQ ID NO: 1539026 - RNA, 18 nt, Pseudomonas aeruginosa PA01
gccagaugcgcgucgccg

SEQ ID NO: 1539027 - RNA, 20 nt, Pseudomonas aeruginosa PA01
gccagaggcugcgcuccagg

SEQ ID NO: 1539028 - RNA, 22 nt, Pseudomonas aeruginosa PA01
gccagaugacgauggccgccgc

SEQ ID NO: 1539029 - RNA, 16 nt, Pseudomonas aeruginosa PA01
gcauagcaggccugga

SEQ ID NO: 1539030 - RNA, 23 nt, Pseudomonas aeruginosa PA01
gccacaguuucauggugcccagc

SEQ ID NO: 1539031 - RNA, 21 nt, Pseudomonas aeruginosa PA01
gccacaggcguuauccgccga

SEQ ID NO: 1539032 - RNA, 21 nt, Pseudomonas aeruginosa PA01
gccacaggcguuauccgccgc

SEQ ID NO: 1539033 - RNA, 22 nt, Pseudomonas aeruginosa PA01
gccacaggcguuauccgccgcc

SEQ ID NO: 1539034 - RNA, 23 nt, Pseudomonas aeruginosa PA01
gccacaggcguuauccgccgccg

SEQ ID NO: 1539035 - RNA, 16 nt, Pseudomonas aeruginosa PA01
gcauagcgcagccgcu

SEQ ID NO: 1539036 - RNA, 18 nt, Pseudomonas aeruginosa PA01
gcauaggaggcgcuuucc

SEQ ID NO: 1539037 - RNA, 17 nt, Pseudomonas aeruginosa PA01
gcauagccggcgcgccc

SEQ ID NO: 1539038 - RNA, 16 nt, Pseudomonas aeruginosa PA01
gccaccagggccuugc

SEQ ID NO: 1539039 - RNA, 14 nt, Pseudomonas aeruginosa PA01
gccaccaggccgcu

SEQ ID NO: 1539040 - RNA, 22 nt, Pseudomonas aeruginosa PA01
gccaccaggccgcugccgccgc

SEQ ID NO: 1539041 - RNA, 13 nt, Pseudomonas aeruginosa PA01
gccaccagggugc

SEQ ID NO: 1539042 - RNA, 13 nt, Pseudomonas aeruginosa PA01
gccaccagcgagu

SEQ ID NO: 1539043 - RNA, 14 nt, Pseudomonas aeruginosa PA01
gccaccagccaggc

SEQ ID NO: 1539044 - RNA, 15 nt, Pseudomonas aeruginosa PA01
gccaccagccaggcg

SEQ ID NO: 1539045 - RNA, 16 nt, Pseudomonas aeruginosa PA01
gccaccagagccagcc

SEQ ID NO: 1539046 - RNA, 20 nt, Pseudomonas aeruginosa PA01
gccaccagagccagccgcga

SEQ ID NO: 1539047 - RNA, 12 nt, Pseudomonas aeruginosa PA01
gccaccagcagg

SEQ ID NO: 1539048 - RNA, 13 nt, Pseudomonas aeruginosa PA01
gccaccagcagga

SEQ ID NO: 1539049 - RNA, 22 nt, Pseudomonas aeruginosa PA01
gccaccagcaggaagccgacca

SEQ ID NO: 1539050 - RNA, 14 nt, Pseudomonas aeruginosa PA01
gccaccagcagggc

SEQ ID NO: 1539051 - RNA, 24 nt, Pseudomonas aeruginosa PA01
gccaccagcagggccaggccgagc

SEQ ID NO: 1539052 - RNA, 21 nt, Pseudomonas aeruginosa PA01
gccaccacggcgaagccgcgc

SEQ ID NO: 1539053 - RNA, 18 nt, Pseudomonas aeruginosa PA01
gccaccacuucgcggacc

SEQ ID NO: 1539054 - RNA, 21 nt, Pseudomonas aeruginosa PA01
gccacgccauucgaauggcgc

SEQ ID NO: 1539055 - RNA, 18 nt, Pseudomonas aeruginosa PA01
gccacgcccgccguggcg

SEQ ID NO: 1539056 - RNA, 13 nt, Pseudomonas aeruginosa PA01
gccacgaacaggc

SEQ ID NO: 1539057 - RNA, 14 nt, Pseudomonas aeruginosa PA01
gccacgacccugcu

SEQ ID NO: 1539058 - RNA, 16 nt, Pseudomonas aeruginosa PA01
gccacgcaccagcucc

SEQ ID NO: 1539059 - RNA, 17 nt, Pseudomonas aeruginosa PA01
gccacgcaguucgcggg

SEQ ID NO: 1539060 - RNA, 13 nt, Pseudomonas aeruginosa PA01
gccaccugcauca

SEQ ID NO: 1539061 - RNA, 15 nt, Pseudomonas aeruginosa PA01
gccaccugcaucacg

SEQ ID NO: 1539062 - RNA, 14 nt, Pseudomonas aeruginosa PA01
gccaccuggcucug

SEQ ID NO: 1539063 - RNA, 16 nt, Pseudomonas aeruginosa PA01
gccaccgccaggaccu

SEQ ID NO: 1539064 - RNA, 14 nt, Pseudomonas aeruginosa PA01
gccaccgccaccgc

SEQ ID NO: 1539065 - RNA, 18 nt, Pseudomonas aeruginosa PA01
gccaccgggaucagcggc

SEQ ID NO: 1539066 - RNA, 22 nt, Pseudomonas aeruginosa PA01
gccaccgggugcagguucaccg

SEQ ID NO: 1539067 - RNA, 19 nt, Pseudomonas aeruginosa PA01
gccgccaugcucggccagc

SEQ ID NO: 1539068 - RNA, 13 nt, Pseudomonas aeruginosa PA01
gccgcccagcacc

SEQ ID NO: 1539069 - RNA, 17 nt, Pseudomonas aeruginosa PA01
gccgccagcucauggag

SEQ ID NO: 1539070 - RNA, 13 nt, Pseudomonas aeruginosa PA01
gccgccaggcaga

SEQ ID NO: 1539071 - RNA, 24 nt, Pseudomonas aeruginosa PA01
gccgccaggcagaccaggccgagc

SEQ ID NO: 1539072 - RNA, 22 nt, Pseudomonas aeruginosa PA01
gccgccaggcagaccugcagca

SEQ ID NO: 1539073 - RNA, 23 nt, Pseudomonas aeruginosa PA01
gccgccaggcagaccugcagcag

SEQ ID NO: 1539074 - RNA, 18 nt, Pseudomonas aeruginosa PA01
gccgccagucggccuggc

SEQ ID NO: 1539075 - RNA, 19 nt, Pseudomonas aeruginosa PA01
gccgccagucggccuggcu

SEQ ID NO: 1539076 - RNA, 21 nt, Pseudomonas aeruginosa PA01
gccgccaguucggccaucagc

SEQ ID NO: 1539077 - RNA, 16 nt, Pseudomonas aeruginosa PA01
gccgccaggcaggccg

SEQ ID NO: 1539078 - RNA, 15 nt, Pseudomonas aeruginosa PA01
gccgccagggcgucg

SEQ ID NO: 1539079 - RNA, 13 nt, Pseudomonas aeruginosa PA01
gccgccaggguca

SEQ ID NO: 1539080 - RNA, 15 nt, Pseudomonas aeruginosa PA01
gccgccagggucagc

SEQ ID NO: 1539081 - RNA, 13 nt, Pseudomonas aeruginosa PA01
gccgccccagccu

SEQ ID NO: 1539082 - RNA, 16 nt, Pseudomonas aeruginosa PA01
gccgcccccagcgcgc

SEQ ID NO: 1539083 - RNA, 18 nt, Pseudomonas aeruginosa PA01
gccgcccccagcgcgccg

SEQ ID NO: 1539084 - RNA, 22 nt, Pseudomonas aeruginosa PA01
gccgcccccagcgcgccgccga

SEQ ID NO: 1539085 - RNA, 19 nt, Pseudomonas aeruginosa PA01
gccgcccagguugaugccg

SEQ ID NO: 1539086 - RNA, 15 nt, Pseudomonas aeruginosa PA01
gccgcccagcgcagc

SEQ ID NO: 1539087 - RNA, 17 nt, Pseudomonas aeruginosa PA01
gccgcccagcgcagccu

SEQ ID NO: 1539088 - RNA, 19 nt, Pseudomonas aeruginosa PA01
gccgcccagcgcagccugc

SEQ ID NO: 1539089 - RNA, 21 nt, Pseudomonas aeruginosa PA01
gccgcccagcgcagccugcug

SEQ ID NO: 1539090 - RNA, 15 nt, Pseudomonas aeruginosa PA01
gccgcccagcagcac

SEQ ID NO: 1539091 - RNA, 14 nt, Pseudomonas aeruginosa PA01
gccgcccuccauca

SEQ ID NO: 1539092 - RNA, 14 nt, Pseudomonas aeruginosa PA01
gccgcccucgggcc

SEQ ID NO: 1539093 - RNA, 19 nt, Pseudomonas aeruginosa PA01
gccgcccucgggccgcagg

SEQ ID NO: 1539094 - RNA, 16 nt, Pseudomonas aeruginosa PA01
gccgcccucggggccg

SEQ ID NO: 1539095 - RNA, 23 nt, Pseudomonas aeruginosa PA01
gccgcccggucuagcgccccggc

SEQ ID NO: 1539096 - RNA, 13 nt, Pseudomonas aeruginosa PA01
gccgcccggccgc

SEQ ID NO: 1539097 - RNA, 16 nt, Pseudomonas aeruginosa PA01
gccgcccggcagcggc

SEQ ID NO: 1539098 - RNA, 14 nt, Pseudomonas aeruginosa PA01
gccgcccggccagg

SEQ ID NO: 1539099 - RNA, 15 nt, Pseudomonas aeruginosa PA01
gccgcccggccaggc

SEQ ID NO: 1539100 - RNA, 16 nt, Pseudomonas aeruginosa PA01
gccgcccggccaggcc

SEQ ID NO: 1539101 - RNA, 22 nt, Pseudomonas aeruginosa PA01
gccgcccgcggaccgggcggcg

SEQ ID NO: 1539102 - RNA, 16 nt, Pseudomonas aeruginosa PA01
gccgcccgcgccucca

SEQ ID NO: 1539103 - RNA, 18 nt, Pseudomonas aeruginosa PA01
gccgcccgagccgcugca

SEQ ID NO: 1539104 - RNA, 18 nt, Pseudomonas aeruginosa PA01
gccgccucgauggcggca

SEQ ID NO: 1539105 - RNA, 24 nt, Pseudomonas aeruginosa PA01
gccgccucgcugggcgggcguccg

SEQ ID NO: 1539106 - RNA, 18 nt, Pseudomonas aeruginosa PA01
gccgccucgaaggccggc

SEQ ID NO: 1539107 - RNA, 21 nt, Pseudomonas aeruginosa PA01
gccgccguucucauugcgccg

SEQ ID NO: 1539108 - RNA, 17 nt, Pseudomonas aeruginosa PA01
gccgccguugaggaagu

SEQ ID NO: 1539109 - RNA, 18 nt, Pseudomonas aeruginosa PA01
gccgccguggcugugcug

SEQ ID NO: 1539110 - RNA, 18 nt, Pseudomonas aeruginosa PA01
gccgcgaagcccagcgcc

SEQ ID NO: 1539111 - RNA, 20 nt, Pseudomonas aeruginosa PA01
gccgcgaagcccagcgccgc

SEQ ID NO: 1539112 - RNA, 15 nt, Pseudomonas aeruginosa PA01
gccgcgacgcuccag

SEQ ID NO: 1539113 - RNA, 15 nt, Pseudomonas aeruginosa PA01
gccgcgacggcugcu

SEQ ID NO: 1539114 - RNA, 22 nt, Pseudomonas aeruginosa PA01
gccgcgcaccucgaccgcgccg

SEQ ID NO: 1539115 - RNA, 18 nt, Pseudomonas aeruginosa PA01
gccgcccuguucgucugg

SEQ ID NO: 1539116 - RNA, 23 nt, Pseudomonas aeruginosa PA01
gccgcccuguucgucuggcgccu

SEQ ID NO: 1539117 - RNA, 13 nt, Pseudomonas aeruginosa PA01
gccgccgcagccg

SEQ ID NO: 1539118 - RNA, 13 nt, Pseudomonas aeruginosa PA01
gccgccgcccagc

SEQ ID NO: 1539119 - RNA, 14 nt, Pseudomonas aeruginosa PA01
gccgccgcccagca

SEQ ID NO: 1539120 - RNA, 17 nt, Pseudomonas aeruginosa PA01
gccgccgcccagcagca

SEQ ID NO: 1539121 - RNA, 14 nt, Pseudomonas aeruginosa PA01
gccgccgccgagaa

SEQ ID NO: 1539122 - RNA, 13 nt, Pseudomonas aeruginosa PA01
gccgccggccugc

SEQ ID NO: 1539123 - RNA, 16 nt, Pseudomonas aeruginosa PA01
gccgccggcgcccugc

SEQ ID NO: 1539124 - RNA, 18 nt, Pseudomonas aeruginosa PA01
gccgccggcgcccugcuc

SEQ ID NO: 1539125 - RNA, 21 nt, Pseudomonas aeruginosa PA01
gccgccggcgcccugcucugg

SEQ ID NO: 1539126 - RNA, 13 nt, Pseudomonas aeruginosa PA01
gccgccggcgccg

SEQ ID NO: 1539127 - RNA, 15 nt, Pseudomonas aeruginosa PA01
gccgccggcggccag

SEQ ID NO: 1539128 - RNA, 22 nt, Pseudomonas aeruginosa PA01
gccgccguagaguucggcugcg

SEQ ID NO: 1539129 - RNA, 22 nt, Pseudomonas aeruginosa PA01
gccgccgguucgcaggccaggc

SEQ ID NO: 1539130 - RNA, 15 nt, Pseudomonas aeruginosa PA01
gccgccgucgcggcc

SEQ ID NO: 1539131 - RNA, 18 nt, Pseudomonas aeruginosa PA01
gccgcauuggccaggccc

SEQ ID NO: 1539132 - RNA, 21 nt, Pseudomonas aeruginosa PA01
gccgccaccgccaccgccgga

SEQ ID NO: 1539133 - RNA, 19 nt, Pseudomonas aeruginosa PA01
gccgccagcaacggcuccu

SEQ ID NO: 1539134 - RNA, 17 nt, Pseudomonas aeruginosa PA01
gccgccagccgccagga

SEQ ID NO: 1539135 - RNA, 19 nt, Pseudomonas aeruginosa PA01
gccgccagccagagcagcg

SEQ ID NO: 1539136 - RNA, 14 nt, Pseudomonas aeruginosa PA01
gccgccagcaggcc

SEQ ID NO: 1539137 - RNA, 22 nt, Pseudomonas aeruginosa PA01
gccgccagcaggccgaaggcca

SEQ ID NO: 1539138 - RNA, 19 nt, Pseudomonas aeruginosa PA01
gccgccagcauggcgaagc

SEQ ID NO: 1539139 - RNA, 15 nt, Pseudomonas aeruginosa PA01
gccgcaggucuuguc

SEQ ID NO: 1539140 - RNA, 22 nt, Pseudomonas aeruginosa PA01
gccgcaggucuugucgcggguc

SEQ ID NO: 1539141 - RNA, 18 nt, Pseudomonas aeruginosa PA01
gccgcagguuggccccgc

SEQ ID NO: 1539142 - RNA, 17 nt, Pseudomonas aeruginosa PA01
gccgcagggugaauaac

SEQ ID NO: 1539143 - RNA, 16 nt, Pseudomonas aeruginosa PA01
gccgcagggugcggcu

SEQ ID NO: 1539144 - RNA, 15 nt, Pseudomonas aeruginosa PA01
gccgcaggccgcggc

SEQ ID NO: 1539145 - RNA, 22 nt, Pseudomonas aeruginosa PA01
gccgcaguuguuccucgcggcu

SEQ ID NO: 1539146 - RNA, 21 nt, Pseudomonas aeruginosa PA01
gccgcaggcaguggcgccagc

SEQ ID NO: 1539147 - RNA, 15 nt, Pseudomonas aeruginosa PA01
gccgcagcgcagccg

SEQ ID NO: 1539148 - RNA, 16 nt, Pseudomonas aeruginosa PA01
gccgcagcgccccucc

SEQ ID NO: 1539149 - RNA, 17 nt, Pseudomonas aeruginosa PA01
gccgcagcggcaugccc

SEQ ID NO: 1539150 - RNA, 20 nt, Pseudomonas aeruginosa PA01
gccgcagcggcaugcccugc

SEQ ID NO: 1539151 - RNA, 13 nt, Pseudomonas aeruginosa PA01
gccgcagcccggu

SEQ ID NO: 1539152 - RNA, 21 nt, Pseudomonas aeruginosa PA01
gccgcagaugcuccagggagc

SEQ ID NO: 1539153 - RNA, 20 nt, Pseudomonas aeruginosa PA01
gccgcagcaagucgaacagg

SEQ ID NO: 1539154 - RNA, 22 nt, Pseudomonas aeruginosa PA01
gccgcagcaagucgaacaggcc

SEQ ID NO: 1539155 - RNA, 19 nt, Pseudomonas aeruginosa PA01
gccgcagacaucgccgagg

SEQ ID NO: 1539156 - RNA, 12 nt, Pseudomonas aeruginosa PA01
gccgcacuucca

SEQ ID NO: 1539157 - RNA, 13 nt, Pseudomonas aeruginosa PA01
gccgcagaccagc

SEQ ID NO: 1539158 - RNA, 17 nt, Pseudomonas aeruginosa PA01
gccgcagaccagcgaac

SEQ ID NO: 1539159 - RNA, 14 nt, Pseudomonas aeruginosa PA01
gccgcagagcauca

SEQ ID NO: 1539160 - RNA, 19 nt, Pseudomonas aeruginosa PA01
gccgcagagccagccgcag

SEQ ID NO: 1539161 - RNA, 20 nt, Pseudomonas aeruginosa PA01
gccgcaccccauccucgccg

SEQ ID NO: 1539162 - RNA, 15 nt, Pseudomonas aeruginosa PA01
gccgauggcgccgcc

SEQ ID NO: 1539163 - RNA, 17 nt, Pseudomonas aeruginosa PA01
gccgauggcgccgccga

SEQ ID NO: 1539164 - RNA, 19 nt, Pseudomonas aeruginosa PA01
gccgaugucguagccgcgc

SEQ ID NO: 1539165 - RNA, 15 nt, Pseudomonas aeruginosa PA01
gccgaugucgccggc

SEQ ID NO: 1539166 - RNA, 22 nt, Pseudomonas aeruginosa PA01
gccgaugcgcuacggcaucacc

SEQ ID NO: 1539167 - RNA, 19 nt, Pseudomonas aeruginosa PA01
gccgauggcgcaccacugc

SEQ ID NO: 1539168 - RNA, 15 nt, Pseudomonas aeruginosa PA01
gccgauggccccggc

SEQ ID NO: 1539169 - RNA, 16 nt, Pseudomonas aeruginosa PA01
gccgaucaccagcaau

SEQ ID NO: 1539170 - RNA, 18 nt, Pseudomonas aeruginosa PA01
gccgaucaccagcgccag

SEQ ID NO: 1539171 - RNA, 17 nt, Pseudomonas aeruginosa PA01
gccgaucaacgcggcca

SEQ ID NO: 1539172 - RNA, 22 nt, Pseudomonas aeruginosa PA01
gccgaucaacgcggccagcagc

SEQ ID NO: 1539173 - RNA, 23 nt, Pseudomonas aeruginosa PA01
gccgaucaacgcggccagcagca

SEQ ID NO: 1539174 - RNA, 22 nt, Pseudomonas aeruginosa PA01
gccgaucaccaccagcgccgcc

SEQ ID NO: 1539175 - RNA, 18 nt, Pseudomonas aeruginosa PA01
gcccugguacagcgccug

SEQ ID NO: 1539176 - RNA, 23 nt, Pseudomonas aeruginosa PA01
gcccugguaggugcgcuggcgcc

SEQ ID NO: 1539177 - RNA, 15 nt, Pseudomonas aeruginosa PA01
gcccuggguggucug

SEQ ID NO: 1539178 - RNA, 21 nt, Pseudomonas aeruginosa PA01
gcccuggguggucugcacggc

SEQ ID NO: 1539179 - RNA, 14 nt, Pseudomonas aeruginosa PA01
gcccugggcggcgg

SEQ ID NO: 1539180 - RNA, 23 nt, Pseudomonas aeruginosa PA01
gcccuggucgacauagcgcagca

SEQ ID NO: 1539181 - RNA, 21 nt, Pseudomonas aeruginosa PA01
gccgaugccgaccuugccggu

SEQ ID NO: 1539182 - RNA, 18 nt, Pseudomonas aeruginosa PA01
gccgaugaaagagcccgc

SEQ ID NO: 1539183 - RNA, 17 nt, Pseudomonas aeruginosa PA01
gccgaugaacgccgcga

SEQ ID NO: 1539184 - RNA, 18 nt, Pseudomonas aeruginosa PA01
gccgaucagcccgucggc

SEQ ID NO: 1539185 - RNA, 17 nt, Pseudomonas aeruginosa PA01
gccgaucuucagcagca

SEQ ID NO: 1539186 - RNA, 22 nt, Pseudomonas aeruginosa PA01
gccggccagggcgcgguaggga

SEQ ID NO: 1539187 - RNA, 14 nt, Pseudomonas aeruginosa PA01
gccggccagggucg

SEQ ID NO: 1539188 - RNA, 18 nt, Pseudomonas aeruginosa PA01
gccggccagggucgccag

SEQ ID NO: 1539189 - RNA, 21 nt, Pseudomonas aeruginosa PA01
gccggccaggucguugcgccg

SEQ ID NO: 1539190 - RNA, 14 nt, Pseudomonas aeruginosa PA01
gccggccauccagc

SEQ ID NO: 1539191 - RNA, 15 nt, Pseudomonas aeruginosa PA01
gccggccauccagcc

SEQ ID NO: 1539192 - RNA, 17 nt, Pseudomonas aeruginosa PA01
gccggccaugcaggcca

SEQ ID NO: 1539193 - RNA, 20 nt, Pseudomonas aeruginosa PA01
gccggcauuggcacccugga

SEQ ID NO: 1539194 - RNA, 15 nt, Pseudomonas aeruginosa PA01
gccggcaucgccaug

SEQ ID NO: 1539195 - RNA, 18 nt, Pseudomonas aeruginosa PA01
gccggcaugcucagccgc

SEQ ID NO: 1539196 - RNA, 14 nt, Pseudomonas aeruginosa PA01
gccggcccauccgc

SEQ ID NO: 1539197 - RNA, 16 nt, Pseudomonas aeruginosa PA01
gccggcccgcgcggca

SEQ ID NO: 1539198 - RNA, 17 nt, Pseudomonas aeruginosa PA01
gccggccgccagcaggu

SEQ ID NO: 1539199 - RNA, 16 nt, Pseudomonas aeruginosa PA01
gccggccgggagcuac

SEQ ID NO: 1539200 - RNA, 18 nt, Pseudomonas aeruginosa PA01
gccggccgcgucgcccag

SEQ ID NO: 1539201 - RNA, 21 nt, Pseudomonas aeruginosa PA01
gccggccgcgucgcccaggcc

SEQ ID NO: 1539202 - RNA, 14 nt, Pseudomonas aeruginosa PA01
gccggccggggccg

SEQ ID NO: 1539203 - RNA, 15 nt, Pseudomonas aeruginosa PA01
gccggccugcgcgca

SEQ ID NO: 1539204 - RNA, 22 nt, Pseudomonas aeruginosa PA01
gccggccugcgcgcaccaggcc

SEQ ID NO: 1539205 - RNA, 16 nt, Pseudomonas aeruginosa PA01
gccggcgaagggcagg

SEQ ID NO: 1539206 - RNA, 20 nt, Pseudomonas aeruginosa PA01
gccggcgaagggcaggccga

SEQ ID NO: 1539207 - RNA, 17 nt, Pseudomonas aeruginosa PA01
gccggcgaacagccagc

SEQ ID NO: 1539208 - RNA, 21 nt, Pseudomonas aeruginosa PA01
gccggcgaaccaggcggccga

SEQ ID NO: 1539209 - RNA, 23 nt, Pseudomonas aeruginosa PA01
gccggccgugcggagggucaggc

SEQ ID NO: 1539210 - RNA, 24 nt, Pseudomonas aeruginosa PA01
gccggccgucgcgcaccacccauc

SEQ ID NO: 1539211 - RNA, 13 nt, Pseudomonas aeruginosa PA01
gccggccggggcg

SEQ ID NO: 1539212 - RNA, 15 nt, Pseudomonas aeruginosa PA01
gccggccggggcgcg

SEQ ID NO: 1539213 - RNA, 18 nt, Pseudomonas aeruginosa PA01
gccggccggggcgcgccc

SEQ ID NO: 1539214 - RNA, 19 nt, Pseudomonas aeruginosa PA01
gccggccggggcgcgcccg

SEQ ID NO: 1539215 - RNA, 14 nt, Pseudomonas aeruginosa PA01
gccggccucgcgca

SEQ ID NO: 1539216 - RNA, 16 nt, Pseudomonas aeruginosa PA01
gccggccucgcugccg

SEQ ID NO: 1539217 - RNA, 21 nt, Pseudomonas aeruginosa PA01
gccggccucgcugccgccgca

SEQ ID NO: 1539218 - RNA, 16 nt, Pseudomonas aeruginosa PA01
gccggccuccagcacu

SEQ ID NO: 1539219 - RNA, 22 nt, Pseudomonas aeruginosa PA01
gccggcgauggccgccugcagg

SEQ ID NO: 1539220 - RNA, 18 nt, Pseudomonas aeruginosa PA01
gccggcgaucgccaggcg

SEQ ID NO: 1539221 - RNA, 16 nt, Pseudomonas aeruginosa PA01
gccggcgaucgccggc

SEQ ID NO: 1539222 - RNA, 19 nt, Pseudomonas aeruginosa PA01
gccggcgaucauccagccc

SEQ ID NO: 1539223 - RNA, 22 nt, Pseudomonas aeruginosa PA01
gccggcgaggaucgcgcuggcc

SEQ ID NO: 1539224 - RNA, 13 nt, Pseudomonas aeruginosa PA01
gccggcgaccuug

SEQ ID NO: 1539225 - RNA, 19 nt, Pseudomonas aeruginosa PA01
gccggcgaccuuguccagg

SEQ ID NO: 1539226 - RNA, 15 nt, Pseudomonas aeruginosa PA01
gccggcgacgaggua

SEQ ID NO: 1539227 - RNA, 15 nt, Pseudomonas aeruginosa PA01
gccggcgacgcagga

SEQ ID NO: 1539228 - RNA, 22 nt, Pseudomonas aeruginosa PA01
gccggcgccaucgaucagcagc

SEQ ID NO: 1539229 - RNA, 13 nt, Pseudomonas aeruginosa PA01
gccggcgcccugc

SEQ ID NO: 1539230 - RNA, 20 nt, Pseudomonas aeruginosa PA01
gccggcgcagaucgcggcgc

SEQ ID NO: 1539231 - RNA, 18 nt, Pseudomonas aeruginosa PA01
gccggcgaugcccaggcc

SEQ ID NO: 1539232 - RNA, 14 nt, Pseudomonas aeruginosa PA01
gccggggaacaggu

SEQ ID NO: 1539233 - RNA, 15 nt, Pseudomonas aeruginosa PA01
gccggggcagcaggg

SEQ ID NO: 1539234 - RNA, 11 nt, Pseudomonas aeruginosa PA01
gccgggcuucg

SEQ ID NO: 1539235 - RNA, 16 nt, Pseudomonas aeruginosa PA01
gccgggcuucuucagg

SEQ ID NO: 1539236 - RNA, 18 nt, Pseudomonas aeruginosa PA01
gccggggcggauucaggc

SEQ ID NO: 1539237 - RNA, 12 nt, Pseudomonas aeruginosa PA01
gccggggcgcgc

SEQ ID NO: 1539238 - RNA, 19 nt, Pseudomonas aeruginosa PA01
gccggggcgcgcccgccag

SEQ ID NO: 1539239 - RNA, 14 nt, Pseudomonas aeruginosa PA01
gccggggccguuca

SEQ ID NO: 1539240 - RNA, 22 nt, Pseudomonas aeruginosa PA01
gccgggccgaucaccaccugga

SEQ ID NO: 1539241 - RNA, 24 nt, Pseudomonas aeruginosa PA01
gccgggccgaucuucgccgacaga

SEQ ID NO: 1539242 - RNA, 14 nt, Pseudomonas aeruginosa PA01
gccgggccgcagcg

SEQ ID NO: 1539243 - RNA, 18 nt, Pseudomonas aeruginosa PA01
gccgggcagugcgcccuc

SEQ ID NO: 1539244 - RNA, 17 nt, Pseudomonas aeruginosa PA01
gccgggcaccccgagcg

SEQ ID NO: 1539245 - RNA, 17 nt, Pseudomonas aeruginosa PA01
gccgggccagcuccagc

SEQ ID NO: 1539246 - RNA, 20 nt, Pseudomonas aeruginosa PA01
gccgggcaucaugccgagca

SEQ ID NO: 1539247 - RNA, 19 nt, Pseudomonas aeruginosa PA01
gccgggcauucgcagcggc

SEQ ID NO: 1539248 - RNA, 21 nt, Pseudomonas aeruginosa PA01
gccgggcauucgcagcggccc

SEQ ID NO: 1539249 - RNA, 22 nt, Pseudomonas aeruginosa PA01
gccggcuuccaccagacgcagc

SEQ ID NO: 1539250 - RNA, 23 nt, Pseudomonas aeruginosa PA01
gccgggcaacgauucgacgcagc

SEQ ID NO: 1539251 - RNA, 23 nt, Pseudomonas aeruginosa PA01
gccgggcaacgcgcagaggcgcu

SEQ ID NO: 1539252 - RNA, 20 nt, Pseudomonas aeruginosa PA01
gccgggauuguugcggcggg

SEQ ID NO: 1539253 - RNA, 14 nt, Pseudomonas aeruginosa PA01
gccggcugugcagg

SEQ ID NO: 1539254 - RNA, 19 nt, Pseudomonas aeruginosa PA01
gccggcugugcagggcagc

SEQ ID NO: 1539255 - RNA, 15 nt, Pseudomonas aeruginosa PA01
gccggcugccgaaga

SEQ ID NO: 1539256 - RNA, 22 nt, Pseudomonas aeruginosa PA01
gccggcugcuccgggcggcugu

SEQ ID NO: 1539257 - RNA, 20 nt, Pseudomonas aeruginosa PA01
gccggcuccuugcgccguug

SEQ ID NO: 1539258 - RNA, 19 nt, Pseudomonas aeruginosa PA01
gccggcucgcccagcaggc

SEQ ID NO: 1539259 - RNA, 21 nt, Pseudomonas aeruginosa PA01
gccggcgcgucccugggcgca

SEQ ID NO: 1539260 - RNA, 20 nt, Pseudomonas aeruginosa PA01
gccggcgcguucucugucgg

SEQ ID NO: 1539261 - RNA, 12 nt, Pseudomonas aeruginosa PA01
gccggcgccgcc

SEQ ID NO: 1539262 - RNA, 14 nt, Pseudomonas aeruginosa PA01
gccggcgcccuucg

SEQ ID NO: 1539263 - RNA, 23 nt, Pseudomonas aeruginosa PA01
gccggcgcuucugcgagccgcgc

SEQ ID NO: 1539264 - RNA, 20 nt, Pseudomonas aeruginosa PA01
gccggcgcucggccaggucg

SEQ ID NO: 1539265 - RNA, 14 nt, Pseudomonas aeruginosa PA01
gccggcggccaggg

SEQ ID NO: 1539266 - RNA, 14 nt, Pseudomonas aeruginosa PA01
gccgcuggggaccg

SEQ ID NO: 1539267 - RNA, 19 nt, Pseudomonas aeruginosa PA01
gccgcugggccacguucug

SEQ ID NO: 1539268 - RNA, 21 nt, Pseudomonas aeruginosa PA01
gccgcuggugaucgaccacac

SEQ ID NO: 1539269 - RNA, 15 nt, Pseudomonas aeruginosa PA01
gccggacgcaccagc

SEQ ID NO: 1539270 - RNA, 18 nt, Pseudomonas aeruginosa PA01
gccggacgcaccagcagg

SEQ ID NO: 1539271 - RNA, 19 nt, Pseudomonas aeruginosa PA01
gccggacgcaccagcaggc

SEQ ID NO: 1539272 - RNA, 14 nt, Pseudomonas aeruginosa PA01
gccggacggcggcg

SEQ ID NO: 1539273 - RNA, 17 nt, Pseudomonas aeruginosa PA01
gccggacgcgacugcug

SEQ ID NO: 1539274 - RNA, 19 nt, Pseudomonas aeruginosa PA01
gccggacgcgacugcugcu

SEQ ID NO: 1539275 - RNA, 19 nt, Pseudomonas aeruginosa PA01
gccggaccagaucggcgcg

SEQ ID NO: 1539276 - RNA, 20 nt, Pseudomonas aeruginosa PA01
gccggaccagaucggcgcgc

SEQ ID NO: 1539277 - RNA, 21 nt, Pseudomonas aeruginosa PA01
gccggaccagccggucccggg

SEQ ID NO: 1539278 - RNA, 15 nt, Pseudomonas aeruginosa PA01
gccggauuucacggc

SEQ ID NO: 1539279 - RNA, 16 nt, Pseudomonas aeruginosa PA01
gccggcagcgccgcgc

SEQ ID NO: 1539280 - RNA, 12 nt, Pseudomonas aeruginosa PA01
gccggcaccagc

SEQ ID NO: 1539281 - RNA, 14 nt, Pseudomonas aeruginosa PA01
gccggcaccagcag

SEQ ID NO: 1539282 - RNA, 22 nt, Pseudomonas aeruginosa PA01
gccggcaggaggaucgcggccu

SEQ ID NO: 1539283 - RNA, 15 nt, Pseudomonas aeruginosa PA01
gccggcagcucggcc

SEQ ID NO: 1539284 - RNA, 17 nt, Pseudomonas aeruginosa PA01
gccggcauccagcaucc

SEQ ID NO: 1539285 - RNA, 14 nt, Pseudomonas aeruginosa PA01
gccggcaacagcag

SEQ ID NO: 1539286 - RNA, 15 nt, Pseudomonas aeruginosa PA01
gccggcaacagcagc

SEQ ID NO: 1539287 - RNA, 16 nt, Pseudomonas aeruginosa PA01
gccggauuggccgagg

SEQ ID NO: 1539288 - RNA, 18 nt, Pseudomonas aeruginosa PA01
gccggauuggccgaggug

SEQ ID NO: 1539289 - RNA, 23 nt, Pseudomonas aeruginosa PA01
gccggaucgguaggcucugcucc

SEQ ID NO: 1539290 - RNA, 17 nt, Pseudomonas aeruginosa PA01
gccggaggggcggccgc

SEQ ID NO: 1539291 - RNA, 22 nt, Pseudomonas aeruginosa PA01
gccggaggggcggccgccgagc

SEQ ID NO: 1539292 - RNA, 23 nt, Pseudomonas aeruginosa PA01
gccggaggggcggccgccgagca

SEQ ID NO: 1539293 - RNA, 15 nt, Pseudomonas aeruginosa PA01
gccgcggcuggcagg

SEQ ID NO: 1539294 - RNA, 16 nt, Pseudomonas aeruginosa PA01
gccgcggcuggcaggu

SEQ ID NO: 1539295 - RNA, 14 nt, Pseudomonas aeruginosa PA01
gccgcggcuguagc

SEQ ID NO: 1539296 - RNA, 17 nt, Pseudomonas aeruginosa PA01
gccgcgggaggccgccu

SEQ ID NO: 1539297 - RNA, 19 nt, Pseudomonas aeruginosa PA01
gccgcgggcaaccgcggcg

SEQ ID NO: 1539298 - RNA, 20 nt, Pseudomonas aeruginosa PA01
gccgcgggcgaacggcagcg

SEQ ID NO: 1539299 - RNA, 18 nt, Pseudomonas aeruginosa PA01
gccgcgccccacggcgcg

SEQ ID NO: 1539300 - RNA, 21 nt, Pseudomonas aeruginosa PA01
gccgcgccccacggcgcggcc

SEQ ID NO: 1539301 - RNA, 21 nt, Pseudomonas aeruginosa PA01
gccgcggcguugucggccagc

SEQ ID NO: 1539302 - RNA, 13 nt, Pseudomonas aeruginosa PA01
gccgcgccagcag

SEQ ID NO: 1539303 - RNA, 16 nt, Pseudomonas aeruginosa PA01
gccgcgccagcaggcg

SEQ ID NO: 1539304 - RNA, 14 nt, Pseudomonas aeruginosa PA01
gccgcgcagcgcgg

SEQ ID NO: 1539305 - RNA, 19 nt, Pseudomonas aeruginosa PA01
gccgcgcagaucgcgucca

SEQ ID NO: 1539306 - RNA, 12 nt, Pseudomonas aeruginosa PA01
gccgcgcaggaa

SEQ ID NO: 1539307 - RNA, 22 nt, Pseudomonas aeruginosa PA01
gccgcgccaaaaagcaggacgg

SEQ ID NO: 1539308 - RNA, 20 nt, Pseudomonas aeruginosa PA01
gccgcgccaacuggcgcaac

SEQ ID NO: 1539309 - RNA, 16 nt, Pseudomonas aeruginosa PA01
gccgcgguaggucagc

SEQ ID NO: 1539310 - RNA, 15 nt, Pseudomonas aeruginosa PA01
gccgcggugcgggcc

SEQ ID NO: 1539311 - RNA, 22 nt, Pseudomonas aeruginosa PA01
gccgcgggucugcucggcgccc

SEQ ID NO: 1539312 - RNA, 23 nt, Pseudomonas aeruginosa PA01
gccgcgggcguugcgcgccucgc

SEQ ID NO: 1539313 - RNA, 23 nt, Pseudomonas aeruginosa PA01
gccgcggguagcguuggaguagg

SEQ ID NO: 1539314 - RNA, 21 nt, Pseudomonas aeruginosa PA01
gccgcguucagucccgcggcg

SEQ ID NO: 1539315 - RNA, 22 nt, Pseudomonas aeruginosa PA01
gccgcguucagucccgcggcgc

SEQ ID NO: 1539316 - RNA, 18 nt, Pseudomonas aeruginosa PA01
gccgcguucgccgagcug

SEQ ID NO: 1539317 - RNA, 18 nt, Pseudomonas aeruginosa PA01
gccgcguucgccgaggcg

SEQ ID NO: 1539318 - RNA, 15 nt, Pseudomonas aeruginosa PA01
gccgcguugucccug

SEQ ID NO: 1539319 - RNA, 19 nt, Pseudomonas aeruginosa PA01
gccgcguugucccuguccc

SEQ ID NO: 1539320 - RNA, 22 nt, Pseudomonas aeruginosa PA01
gccgcguugucccugucccgcc

SEQ ID NO: 1539321 - RNA, 21 nt, Pseudomonas aeruginosa PA01
gccgcucgaugcccgccagca

SEQ ID NO: 1539322 - RNA, 17 nt, Pseudomonas aeruginosa PA01
gccgcucggccgccagc

SEQ ID NO: 1539323 - RNA, 15 nt, Pseudomonas aeruginosa PA01
gccgcucgcgcacgg

SEQ ID NO: 1539324 - RNA, 18 nt, Pseudomonas aeruginosa PA01
gccgcuagcccugcugcu

SEQ ID NO: 1539325 - RNA, 16 nt, Pseudomonas aeruginosa PA01
gccgcuggcauuccag

SEQ ID NO: 1539326 - RNA, 17 nt, Pseudomonas aeruginosa PA01
gccgcuggaaccggccg

SEQ ID NO: 1539327 - RNA, 21 nt, Pseudomonas aeruginosa PA01
gccgcugaucaguaccggcag

SEQ ID NO: 1539328 - RNA, 13 nt, Pseudomonas aeruginosa PA01
gccgcuggcggca

SEQ ID NO: 1539329 - RNA, 15 nt, Pseudomonas aeruginosa PA01
gccgcuggcggcaug

SEQ ID NO: 1539330 - RNA, 21 nt, Pseudomonas aeruginosa PA01
gccgcuggccuggccacccuu

SEQ ID NO: 1539331 - RNA, 22 nt, Pseudomonas aeruginosa PA01
gccgcuggcguuguugccgccg

SEQ ID NO: 1539332 - RNA, 15 nt, Pseudomonas aeruginosa PA01
gccgcuggcggccuu

SEQ ID NO: 1539333 - RNA, 13 nt, Pseudomonas aeruginosa PA01
gccgcuggcggcg

SEQ ID NO: 1539334 - RNA, 19 nt, Pseudomonas aeruginosa PA01
gccgcugaaguccuggccg

SEQ ID NO: 1539335 - RNA, 21 nt, Pseudomonas aeruginosa PA01
gccgcugaauaccaccgggcc

SEQ ID NO: 1539336 - RNA, 22 nt, Pseudomonas aeruginosa PA01
gccgcugaauaccaccgggccg

SEQ ID NO: 1539337 - RNA, 15 nt, Pseudomonas aeruginosa PA01
gccgcucugcuggcc

SEQ ID NO: 1539338 - RNA, 14 nt, Pseudomonas aeruginosa PA01
gccgcucuggcugc

SEQ ID NO: 1539339 - RNA, 23 nt, Pseudomonas aeruginosa PA01
gccgcucuucugguaggccagca

SEQ ID NO: 1539340 - RNA, 20 nt, Pseudomonas aeruginosa PA01
gccgcugaaaucggagaagu

SEQ ID NO: 1539341 - RNA, 17 nt, Pseudomonas aeruginosa PA01
gccgcugaggcucgccg

SEQ ID NO: 1539342 - RNA, 23 nt, Pseudomonas aeruginosa PA01
gccgcugacggucugccagcucu

SEQ ID NO: 1539343 - RNA, 20 nt, Pseudomonas aeruginosa PA01
gccgcucguuggcggccagc

SEQ ID NO: 1539344 - RNA, 19 nt, Pseudomonas aeruginosa PA01
gccgcucggcguagccggc

SEQ ID NO: 1539345 - RNA, 23 nt, Pseudomonas aeruginosa PA01
gccucgucgccaugcggcaggcc

SEQ ID NO: 1539346 - RNA, 20 nt, Pseudomonas aeruginosa PA01
gccucgucgagcgcagcgac

SEQ ID NO: 1539347 - RNA, 21 nt, Pseudomonas aeruginosa PA01
gccucgucgaaacggaacagg

SEQ ID NO: 1539348 - RNA, 15 nt, Pseudomonas aeruginosa PA01
gccucgucgacgccc

SEQ ID NO: 1539349 - RNA, 19 nt, Pseudomonas aeruginosa PA01
gccucgucgacgcccuggc

SEQ ID NO: 1539350 - RNA, 20 nt, Pseudomonas aeruginosa PA01
gccucgguggcccacuccag

SEQ ID NO: 1539351 - RNA, 20 nt, Pseudomonas aeruginosa PA01
gccucgguuuccggccaggc

SEQ ID NO: 1539352 - RNA, 15 nt, Pseudomonas aeruginosa PA01
gccucguucagcagc

SEQ ID NO: 1539353 - RNA, 18 nt, Pseudomonas aeruginosa PA01
gccucguucagcagcaug

SEQ ID NO: 1539354 - RNA, 19 nt, Pseudomonas aeruginosa PA01
gccucguucgucgccgacu

SEQ ID NO: 1539355 - RNA, 22 nt, Pseudomonas aeruginosa PA01
gccucgucguucagcccacccc

SEQ ID NO: 1539356 - RNA, 14 nt, Pseudomonas aeruginosa PA01
gccucgucgcgcca

SEQ ID NO: 1539357 - RNA, 20 nt, Pseudomonas aeruginosa PA01
gccucgucgcgccaggcgaa

SEQ ID NO: 1539358 - RNA, 20 nt, Pseudomonas aeruginosa PA01
gccucgugcagcaagccgca

SEQ ID NO: 1539359 - RNA, 22 nt, Pseudomonas aeruginosa PA01
gccucgugcagcaagccgcagc

SEQ ID NO: 1539360 - RNA, 16 nt, Pseudomonas aeruginosa PA01
gccucguggaacagcg

SEQ ID NO: 1539361 - RNA, 18 nt, Pseudomonas aeruginosa PA01
gccucguggaacagcgcg

SEQ ID NO: 1539362 - RNA, 19 nt, Pseudomonas aeruginosa PA01
gccucggcggacagcccgc

SEQ ID NO: 1539363 - RNA, 14 nt, Pseudomonas aeruginosa PA01
gccucggcgcgcgc

SEQ ID NO: 1539364 - RNA, 17 nt, Pseudomonas aeruginosa PA01
gccucggcgcgcgcccc

SEQ ID NO: 1539365 - RNA, 16 nt, Pseudomonas aeruginosa PA01
gccucggcgcgggccu

SEQ ID NO: 1539366 - RNA, 13 nt, Pseudomonas aeruginosa PA01
gccucggcgaagu

SEQ ID NO: 1539367 - RNA, 22 nt, Pseudomonas aeruginosa PA01
gccucggccaucgagcgcucca

SEQ ID NO: 1539368 - RNA, 18 nt, Pseudomonas aeruginosa PA01
gccucggcccuggcggcg

SEQ ID NO: 1539369 - RNA, 19 nt, Pseudomonas aeruginosa PA01
gccucggcgaugccggaga

SEQ ID NO: 1539370 - RNA, 17 nt, Pseudomonas aeruginosa PA01
gccucggccagcgccgc

SEQ ID NO: 1539371 - RNA, 15 nt, Pseudomonas aeruginosa PA01
gccucggcgucgcgc

SEQ ID NO: 1539372 - RNA, 14 nt, Pseudomonas aeruginosa PA01
gccucggcggcggc

SEQ ID NO: 1539373 - RNA, 15 nt, Pseudomonas aeruginosa PA01
gccucggcggcggcc

SEQ ID NO: 1539374 - RNA, 16 nt, Pseudomonas aeruginosa PA01
gccucggcggcggccu

SEQ ID NO: 1539375 - RNA, 18 nt, Pseudomonas aeruginosa PA01
gccucggcggcggccugc

SEQ ID NO: 1539376 - RNA, 21 nt, Pseudomonas aeruginosa PA01
gccucggcggcggccugcucg

SEQ ID NO: 1539377 - RNA, 14 nt, Pseudomonas aeruginosa PA01
gccucggcgggaga

SEQ ID NO: 1539378 - RNA, 21 nt, Pseudomonas aeruginosa PA01
gccucggggccguccgccagg

SEQ ID NO: 1539379 - RNA, 23 nt, Pseudomonas aeruginosa PA01
gccucggggccguccgccagguc

SEQ ID NO: 1539380 - RNA, 20 nt, Pseudomonas aeruginosa PA01
gccucgggccggagcaggcc

SEQ ID NO: 1539381 - RNA, 16 nt, Pseudomonas aeruginosa PA01
gccucgcgccgcgcca

SEQ ID NO: 1539382 - RNA, 22 nt, Pseudomonas aeruginosa PA01
gccucgcgccgcgccagcaggc

SEQ ID NO: 1539383 - RNA, 15 nt, Pseudomonas aeruginosa PA01
gccucgcgcguggcc

SEQ ID NO: 1539384 - RNA, 19 nt, Pseudomonas aeruginosa PA01
gccucgcgcguggccgcca

SEQ ID NO: 1539385 - RNA, 16 nt, Pseudomonas aeruginosa PA01
gccucgcggcguucgg

SEQ ID NO: 1539386 - RNA, 15 nt, Pseudomonas aeruginosa PA01
gccucgcugccgccg

SEQ ID NO: 1539387 - RNA, 16 nt, Pseudomonas aeruginosa PA01
gccucgcugccgccgc

SEQ ID NO: 1539388 - RNA, 17 nt, Pseudomonas aeruginosa PA01
gccucgcugccgccgca

SEQ ID NO: 1539389 - RNA, 17 nt, Pseudomonas aeruginosa PA01
gccucgcuagucuuccu

SEQ ID NO: 1539390 - RNA, 21 nt, Pseudomonas aeruginosa PA01
gccucgcuagucuuccugcac

SEQ ID NO: 1539391 - RNA, 22 nt, Pseudomonas aeruginosa PA01
gccucgcggguaucgauccagc

SEQ ID NO: 1539392 - RNA, 23 nt, Pseudomonas aeruginosa PA01
gccucgcggguaucgauccagcc

SEQ ID NO: 1539393 - RNA, 18 nt, Pseudomonas aeruginosa PA01
gccucgcgggucugcgcc

SEQ ID NO: 1539394 - RNA, 20 nt, Pseudomonas aeruginosa PA01
gccucgcugagcaccgggac

SEQ ID NO: 1539395 - RNA, 17 nt, Pseudomonas aeruginosa PA01
gccucggagaacagcag

SEQ ID NO: 1539396 - RNA, 19 nt, Pseudomonas aeruginosa PA01
gccucgcuggcguucucca

SEQ ID NO: 1539397 - RNA, 13 nt, Pseudomonas aeruginosa PA01
gccucggcagggc

SEQ ID NO: 1539398 - RNA, 23 nt, Pseudomonas aeruginosa PA01
gccucggcagggcgcccgcccgg

SEQ ID NO: 1539399 - RNA, 23 nt, Pseudomonas aeruginosa PA01
gccucgacgcucuccgucagggc

SEQ ID NO: 1539400 - RNA, 23 nt, Pseudomonas aeruginosa PA01
gccucgaggaucuugcgcccggc

SEQ ID NO: 1539401 - RNA, 17 nt, Pseudomonas aeruginosa PA01
gccucgaggaacagguc

SEQ ID NO: 1539402 - RNA, 17 nt, Pseudomonas aeruginosa PA01
gccucgaucgccucggg

SEQ ID NO: 1539403 - RNA, 21 nt, Pseudomonas aeruginosa PA01
gccucgaucgccucgggcgag

SEQ ID NO: 1539404 - RNA, 16 nt, Pseudomonas aeruginosa PA01
gccucgaacauggcca

SEQ ID NO: 1539405 - RNA, 19 nt, Pseudomonas aeruginosa PA01
gccucgaggucggccuggc

SEQ ID NO: 1539406 - RNA, 15 nt, Pseudomonas aeruginosa PA01
gccucgauggcggca

SEQ ID NO: 1539407 - RNA, 15 nt, Pseudomonas aeruginosa PA01
gccucgaucuucuuc

SEQ ID NO: 1539408 - RNA, 22 nt, Pseudomonas aeruginosa PA01
gccucgaucuucuuccccgcca

SEQ ID NO: 1539409 - RNA, 12 nt, Pseudomonas aeruginosa PA01
gccucgaugaau

SEQ ID NO: 1539410 - RNA, 19 nt, Pseudomonas aeruginosa PA01
gccucgaugaucgccgggu

SEQ ID NO: 1539411 - RNA, 16 nt, Pseudomonas aeruginosa PA01
gccucgaugauggugc

SEQ ID NO: 1539412 - RNA, 15 nt, Pseudomonas aeruginosa PA01
gccucgccccagacc

SEQ ID NO: 1539413 - RNA, 17 nt, Pseudomonas aeruginosa PA01
gccucgcagagcgccag

SEQ ID NO: 1539414 - RNA, 18 nt, Pseudomonas aeruginosa PA01
gccucgcagagcgccagc

SEQ ID NO: 1539415 - RNA, 22 nt, Pseudomonas aeruginosa PA01
gccucgcagagcgccagccagc

SEQ ID NO: 1539416 - RNA, 23 nt, Pseudomonas aeruginosa PA01
gccucgcagagcgccagccagcg

SEQ ID NO: 1539417 - RNA, 12 nt, Pseudomonas aeruginosa PA01
gccucccgccgc

SEQ ID NO: 1539418 - RNA, 17 nt, Pseudomonas aeruginosa PA01
gccucccgccgcggcgu

SEQ ID NO: 1539419 - RNA, 22 nt, Pseudomonas aeruginosa PA01
gccucccggcucgccgacuucc

SEQ ID NO: 1539420 - RNA, 24 nt, Pseudomonas aeruginosa PA01
gccuccggcacgcugccgccgaug

SEQ ID NO: 1539421 - RNA, 17 nt, Pseudomonas aeruginosa PA01
gccuccgcucugcuggc

SEQ ID NO: 1539422 - RNA, 19 nt, Pseudomonas aeruginosa PA01
gccuccgcucugcuggcca

SEQ ID NO: 1539423 - RNA, 17 nt, Pseudomonas aeruginosa PA01
gccuccugcaacgccug

SEQ ID NO: 1539424 - RNA, 18 nt, Pseudomonas aeruginosa PA01
gccucgaccaucggcggc

SEQ ID NO: 1539425 - RNA, 19 nt, Pseudomonas aeruginosa PA01
gccucgaccaucggcggcg

SEQ ID NO: 1539426 - RNA, 21 nt, Pseudomonas aeruginosa PA01
gccucgaagaaaaggcccggc

SEQ ID NO: 1539427 - RNA, 18 nt, Pseudomonas aeruginosa PA01
gccuccuggcggcguggc

SEQ ID NO: 1539428 - RNA, 14 nt, Pseudomonas aeruginosa PA01
gccucauacgaaaa

SEQ ID NO: 1539429 - RNA, 14 nt, Pseudomonas aeruginosa PA01
gccucaguaccugc

SEQ ID NO: 1539430 - RNA, 15 nt, Pseudomonas aeruginosa PA01
gccucagcggcuggc

SEQ ID NO: 1539431 - RNA, 20 nt, Pseudomonas aeruginosa PA01
gccucaggcgcugcgcggcc

SEQ ID NO: 1539432 - RNA, 14 nt, Pseudomonas aeruginosa PA01
gccucaggccggga

SEQ ID NO: 1539433 - RNA, 17 nt, Pseudomonas aeruginosa PA01
gccucagcgacaucccg

SEQ ID NO: 1539434 - RNA, 15 nt, Pseudomonas aeruginosa PA01
gccucagaacugcuc

SEQ ID NO: 1539435 - RNA, 19 nt, Pseudomonas aeruginosa PA01
gccucagaacugcucggcg

SEQ ID NO: 1539436 - RNA, 19 nt, Pseudomonas aeruginosa PA01
gccuccagcaacgccgccc

SEQ ID NO: 1539437 - RNA, 23 nt, Pseudomonas aeruginosa PA01
gccuccagcaacgccgcccccag

SEQ ID NO: 1539438 - RNA, 20 nt, Pseudomonas aeruginosa PA01
gccuccagcaccgggauggu

SEQ ID NO: 1539439 - RNA, 14 nt, Pseudomonas aeruginosa PA01
gccuccagcacucg

SEQ ID NO: 1539440 - RNA, 22 nt, Pseudomonas aeruginosa PA01
gccuccagcacucgcuccuccg

SEQ ID NO: 1539441 - RNA, 14 nt, Pseudomonas aeruginosa PA01
gccuccaggcuggc

SEQ ID NO: 1539442 - RNA, 15 nt, Pseudomonas aeruginosa PA01
gccuccaggcuggcc

SEQ ID NO: 1539443 - RNA, 16 nt, Pseudomonas aeruginosa PA01
gccuccaggcuggccu

SEQ ID NO: 1539444 - RNA, 13 nt, Pseudomonas aeruginosa PA01
gccuccaggcgcg

SEQ ID NO: 1539445 - RNA, 19 nt, Pseudomonas aeruginosa PA01
gccuccaggcgcgccugga

SEQ ID NO: 1539446 - RNA, 20 nt, Pseudomonas aeruginosa PA01
gccuccaccagcgccggcgg

SEQ ID NO: 1539447 - RNA, 21 nt, Pseudomonas aeruginosa PA01
gccuccaccagcgccggcggc

SEQ ID NO: 1539448 - RNA, 15 nt, Pseudomonas aeruginosa PA01
gccuccacggcggcc

SEQ ID NO: 1539449 - RNA, 16 nt, Pseudomonas aeruginosa PA01
gccgugcagcagcgac

SEQ ID NO: 1539450 - RNA, 18 nt, Pseudomonas aeruginosa PA01
gccgugcaucaccggcag

SEQ ID NO: 1539451 - RNA, 19 nt, Pseudomonas aeruginosa PA01
gccgugcaucaccggcagc

SEQ ID NO: 1539452 - RNA, 22 nt, Pseudomonas aeruginosa PA01
gccgugcaucaccggcagcagc

SEQ ID NO: 1539453 - RNA, 20 nt, Pseudomonas aeruginosa PA01
gccgucguuuuguccggcgg

SEQ ID NO: 1539454 - RNA, 17 nt, Pseudomonas aeruginosa PA01
gccgugcagcuuggcga

SEQ ID NO: 1539455 - RNA, 14 nt, Pseudomonas aeruginosa PA01
gccguugaggaagu

SEQ ID NO: 1539456 - RNA, 15 nt, Pseudomonas aeruginosa PA01
gccguugaccagcgc

SEQ ID NO: 1539457 - RNA, 21 nt, Pseudomonas aeruginosa PA01
gccguucucccgcgcgcugug

SEQ ID NO: 1539458 - RNA, 23 nt, Pseudomonas aeruginosa PA01
gccguggucgcgcaggcggugga

SEQ ID NO: 1539459 - RNA, 15 nt, Pseudomonas aeruginosa PA01
gccguggcuccugga

SEQ ID NO: 1539460 - RNA, 19 nt, Pseudomonas aeruginosa PA01
gccguggcugugcuggcca

SEQ ID NO: 1539461 - RNA, 12 nt, Pseudomonas aeruginosa PA01
gccguggcggcg

SEQ ID NO: 1539462 - RNA, 16 nt, Pseudomonas aeruginosa PA01
gccgugggccggcgcg

SEQ ID NO: 1539463 - RNA, 17 nt, Pseudomonas aeruginosa PA01
gccgugggccggcgcgc

SEQ ID NO: 1539464 - RNA, 18 nt, Pseudomonas aeruginosa PA01
gccgugguggccguggcg

SEQ ID NO: 1539465 - RNA, 15 nt, Pseudomonas aeruginosa PA01
gccgggguccgccgg

SEQ ID NO: 1539466 - RNA, 13 nt, Pseudomonas aeruginosa PA01
gccggguagggcg

SEQ ID NO: 1539467 - RNA, 14 nt, Pseudomonas aeruginosa PA01
gccggguauccagc

SEQ ID NO: 1539468 - RNA, 18 nt, Pseudomonas aeruginosa PA01
gccggggucaggccgagg

SEQ ID NO: 1539469 - RNA, 17 nt, Pseudomonas aeruginosa PA01
gccgggggucgcggcga

SEQ ID NO: 1539470 - RNA, 21 nt, Pseudomonas aeruginosa PA01
gccgggggucucguagcagcc

SEQ ID NO: 1539471 - RNA, 15 nt, Pseudomonas aeruginosa PA01
gccgggucgaccuug

SEQ ID NO: 1539472 - RNA, 22 nt, Pseudomonas aeruginosa PA01
gccgggucgacuucgcaccagc

SEQ ID NO: 1539473 - RNA, 21 nt, Pseudomonas aeruginosa PA01
gccggguucccaguugcuggg

SEQ ID NO: 1539474 - RNA, 22 nt, Pseudomonas aeruginosa PA01
gccggguugcgccgcaaguggc

SEQ ID NO: 1539475 - RNA, 15 nt, Pseudomonas aeruginosa PA01
gccggguuucacggc

SEQ ID NO: 1539476 - RNA, 16 nt, Pseudomonas aeruginosa PA01
gccgucggcgcggggc

SEQ ID NO: 1539477 - RNA, 17 nt, Pseudomonas aeruginosa PA01
gccgucggcgcggggcg

SEQ ID NO: 1539478 - RNA, 15 nt, Pseudomonas aeruginosa PA01
gccgucguccggguu

SEQ ID NO: 1539479 - RNA, 15 nt, Pseudomonas aeruginosa PA01
gccgucguagcgcag

SEQ ID NO: 1539480 - RNA, 12 nt, Pseudomonas aeruginosa PA01
gccucacccugc

SEQ ID NO: 1539481 - RNA, 17 nt, Pseudomonas aeruginosa PA01
gccucaacgaccgccca

SEQ ID NO: 1539482 - RNA, 17 nt, Pseudomonas aeruginosa PA01
gccuagcacccggguau

SEQ ID NO: 1539483 - RNA, 16 nt, Pseudomonas aeruginosa PA01
gccuacugggcguggc

SEQ ID NO: 1539484 - RNA, 17 nt, Pseudomonas aeruginosa PA01
gccuacuugaucagccg

SEQ ID NO: 1539485 - RNA, 18 nt, Pseudomonas aeruginosa PA01
gccuacuugaucagccgc

SEQ ID NO: 1539486 - RNA, 21 nt, Pseudomonas aeruginosa PA01
gccuacuugaucagccgcagg

SEQ ID NO: 1539487 - RNA, 22 nt, Pseudomonas aeruginosa PA01
gccuacgguacaguucaggcug

SEQ ID NO: 1539488 - RNA, 23 nt, Pseudomonas aeruginosa PA01
gccuacgguacaguucaggcugg

SEQ ID NO: 1539489 - RNA, 19 nt, Pseudomonas aeruginosa PA01
gccuaccgucacgcggacc

SEQ ID NO: 1539490 - RNA, 21 nt, Pseudomonas aeruginosa PA01
gccuaccauuagaggaaccca

SEQ ID NO: 1539491 - RNA, 15 nt, Pseudomonas aeruginosa PA01
gccuaccagaccgca

SEQ ID NO: 1539492 - RNA, 17 nt, Pseudomonas aeruginosa PA01
gccuaccagaccgcagc

SEQ ID NO: 1539493 - RNA, 19 nt, Pseudomonas aeruginosa PA01
gccuaccagaccgcagccg

SEQ ID NO: 1539494 - RNA, 21 nt, Pseudomonas aeruginosa PA01
gccuaccagaccgcagccggc

SEQ ID NO: 1539495 - RNA, 18 nt, Pseudomonas aeruginosa PA01
gccguugcuaccggcgga

SEQ ID NO: 1539496 - RNA, 18 nt, Pseudomonas aeruginosa PA01
gccguuggccagcaggcg

SEQ ID NO: 1539497 - RNA, 15 nt, Pseudomonas aeruginosa PA01
gccguuggccgagcg

SEQ ID NO: 1539498 - RNA, 22 nt, Pseudomonas aeruginosa PA01
gccguuggcgaggacuuucuug

SEQ ID NO: 1539499 - RNA, 14 nt, Pseudomonas aeruginosa PA01
gccguugccagcau

SEQ ID NO: 1539500 - RNA, 16 nt, Pseudomonas aeruginosa PA01
gccugccaggcgggga

SEQ ID NO: 1539501 - RNA, 16 nt, Pseudomonas aeruginosa PA01
gccugccagaccgugg

SEQ ID NO: 1539502 - RNA, 20 nt, Pseudomonas aeruginosa PA01
gccugcagguuguccagggc

SEQ ID NO: 1539503 - RNA, 20 nt, Pseudomonas aeruginosa PA01
gccugcagcgacuccagcca

SEQ ID NO: 1539504 - RNA, 20 nt, Pseudomonas aeruginosa PA01
gccugcagcaggucgagcag

SEQ ID NO: 1539505 - RNA, 13 nt, Pseudomonas aeruginosa PA01
gccugcagccagc

SEQ ID NO: 1539506 - RNA, 18 nt, Pseudomonas aeruginosa PA01
gccugccccacuuccggc

SEQ ID NO: 1539507 - RNA, 22 nt, Pseudomonas aeruginosa PA01
gccugccuuccuugaccacggc

SEQ ID NO: 1539508 - RNA, 15 nt, Pseudomonas aeruginosa PA01
gccugccguuuuacu

SEQ ID NO: 1539509 - RNA, 19 nt, Pseudomonas aeruginosa PA01
gccugcgauucguucagag

SEQ ID NO: 1539510 - RNA, 20 nt, Pseudomonas aeruginosa PA01
gccugcgccucggcccuggc

SEQ ID NO: 1539511 - RNA, 16 nt, Pseudomonas aeruginosa PA01
gccugcgcgcaccagg

SEQ ID NO: 1539512 - RNA, 19 nt, Pseudomonas aeruginosa PA01
gccugcgcgcaccaggccu

SEQ ID NO: 1539513 - RNA, 13 nt, Pseudomonas aeruginosa PA01
gccugcgcagggc

SEQ ID NO: 1539514 - RNA, 22 nt, Pseudomonas aeruginosa PA01
gccugcaacacccaggccuggg

SEQ ID NO: 1539515 - RNA, 16 nt, Pseudomonas aeruginosa PA01
gccugcaacgccgcca

SEQ ID NO: 1539516 - RNA, 18 nt, Pseudomonas aeruginosa PA01
gccugcaacgccgccaac

SEQ ID NO: 1539517 - RNA, 21 nt, Pseudomonas aeruginosa PA01
gccugcaacguccucgcgccg

SEQ ID NO: 1539518 - RNA, 22 nt, Pseudomonas aeruginosa PA01
gccugcaacucgucguccagcg

SEQ ID NO: 1539519 - RNA, 13 nt, Pseudomonas aeruginosa PA01
gccugaugcagga

SEQ ID NO: 1539520 - RNA, 13 nt, Pseudomonas aeruginosa PA01
gccugagcuggcu

SEQ ID NO: 1539521 - RNA, 12 nt, Pseudomonas aeruginosa PA01
gccucuuccugg

SEQ ID NO: 1539522 - RNA, 12 nt, Pseudomonas aeruginosa PA01
gccucugaccgc

SEQ ID NO: 1539523 - RNA, 18 nt, Pseudomonas aeruginosa PA01
gccucugaccgcgcccgg

SEQ ID NO: 1539524 - RNA, 22 nt, Pseudomonas aeruginosa PA01
gccucuaugaaccggggcggcc

SEQ ID NO: 1539525 - RNA, 14 nt, Pseudomonas aeruginosa PA01
gccucuccgagacg

SEQ ID NO: 1539526 - RNA, 18 nt, Pseudomonas aeruginosa PA01
gccucuccgagacgcugc

SEQ ID NO: 1539527 - RNA, 20 nt, Pseudomonas aeruginosa PA01
gccucuccgagacgcugcac

SEQ ID NO: 1539528 - RNA, 19 nt, Pseudomonas aeruginosa PA01
gccugugcaccgaagggaa

SEQ ID NO: 1539529 - RNA, 17 nt, Pseudomonas aeruginosa PA01
gccugucgcuccggcag

SEQ ID NO: 1539530 - RNA, 23 nt, Pseudomonas aeruginosa PA01
gccuguggauagaaaagcaagga

SEQ ID NO: 1539531 - RNA, 13 nt, Pseudomonas aeruginosa PA01
gccuguccagcuc

SEQ ID NO: 1539532 - RNA, 18 nt, Pseudomonas aeruginosa PA01
gccuguccagcuccccca

SEQ ID NO: 1539533 - RNA, 19 nt, Pseudomonas aeruginosa PA01
gccugucgauuucccccgg

SEQ ID NO: 1539534 - RNA, 16 nt, Pseudomonas aeruginosa PA01
gccugucgcagcgggc

SEQ ID NO: 1539535 - RNA, 17 nt, Pseudomonas aeruginosa PA01
gccuguccgggaaugcu

SEQ ID NO: 1539536 - RNA, 13 nt, Pseudomonas aeruginosa PA01
gccugucacgccg

SEQ ID NO: 1539537 - RNA, 16 nt, Pseudomonas aeruginosa PA01
gccugguucccucaac

SEQ ID NO: 1539538 - RNA, 20 nt, Pseudomonas aeruginosa PA01
gccugguuguaggcgccgcc

SEQ ID NO: 1539539 - RNA, 22 nt, Pseudomonas aeruginosa PA01
gccugguuguaggcgccgccgu

SEQ ID NO: 1539540 - RNA, 18 nt, Pseudomonas aeruginosa PA01
gccuguaccgcuuccugg

SEQ ID NO: 1539541 - RNA, 13 nt, Pseudomonas aeruginosa PA01
gccugggccgcgc

SEQ ID NO: 1539542 - RNA, 21 nt, Pseudomonas aeruginosa PA01
gccugggccgcgcugucggcc

SEQ ID NO: 1539543 - RNA, 23 nt, Pseudomonas aeruginosa PA01
gccugggacggaacgucggccug

SEQ ID NO: 1539544 - RNA, 21 nt, Pseudomonas aeruginosa PA01
gccuggcuacgcuccguaggg

SEQ ID NO: 1539545 - RNA, 18 nt, Pseudomonas aeruginosa PA01
gccuggcucgaucggcag

SEQ ID NO: 1539546 - RNA, 13 nt, Pseudomonas aeruginosa PA01
gccuggcuggcca

SEQ ID NO: 1539547 - RNA, 16 nt, Pseudomonas aeruginosa PA01
gccuggcugccgagca

SEQ ID NO: 1539548 - RNA, 13 nt, Pseudomonas aeruginosa PA01
gccuggccacccu

SEQ ID NO: 1539549 - RNA, 18 nt, Pseudomonas aeruginosa PA01
gccuggcgcaacgccggc

SEQ ID NO: 1539550 - RNA, 19 nt, Pseudomonas aeruginosa PA01
gccuggcgcgcgcgccagg

SEQ ID NO: 1539551 - RNA, 16 nt, Pseudomonas aeruginosa PA01
gccuggcgucgcacug

SEQ ID NO: 1539552 - RNA, 19 nt, Pseudomonas aeruginosa PA01
gccuggcgcauggcgcucu

SEQ ID NO: 1539553 - RNA, 17 nt, Pseudomonas aeruginosa PA01
gccuggcgcucagcgcc

SEQ ID NO: 1539554 - RNA, 23 nt, Pseudomonas aeruginosa PA01
gccuggucggcgcggcgcuccag

SEQ ID NO: 1539555 - RNA, 15 nt, Pseudomonas aeruginosa PA01
gccuggucggcggcc

SEQ ID NO: 1539556 - RNA, 19 nt, Pseudomonas aeruginosa PA01
gccugguccagcagguucu

SEQ ID NO: 1539557 - RNA, 21 nt, Pseudomonas aeruginosa PA01
gccuggucgaaagccugccgg

SEQ ID NO: 1539558 - RNA, 14 nt, Pseudomonas aeruginosa PA01
gccuggugcaccug

SEQ ID NO: 1539559 - RNA, 13 nt, Pseudomonas aeruginosa PA01
gccuggugcaggu

SEQ ID NO: 1539560 - RNA, 18 nt, Pseudomonas aeruginosa PA01
gccugggguagccggccg

SEQ ID NO: 1539561 - RNA, 18 nt, Pseudomonas aeruginosa PA01
gccugggucaccagcacc

SEQ ID NO: 1539562 - RNA, 22 nt, Pseudomonas aeruginosa PA01
gccugggugaacagcggcccga

SEQ ID NO: 1539563 - RNA, 22 nt, Pseudomonas aeruginosa PA01
gccugggcguacaggccccagg

SEQ ID NO: 1539564 - RNA, 14 nt, Pseudomonas aeruginosa PA01
gccugggcgccgcc

SEQ ID NO: 1539565 - RNA, 15 nt, Pseudomonas aeruginosa PA01
gccugggcgccgcca

SEQ ID NO: 1539566 - RNA, 17 nt, Pseudomonas aeruginosa PA01
gccugggcgccgccagc

SEQ ID NO: 1539567 - RNA, 15 nt, Pseudomonas aeruginosa PA01
gccugcgcuuccggc

SEQ ID NO: 1539568 - RNA, 17 nt, Pseudomonas aeruginosa PA01
gccugcgcuuccggcag

SEQ ID NO: 1539569 - RNA, 18 nt, Pseudomonas aeruginosa PA01
gccugcgcuuccggcagc

SEQ ID NO: 1539570 - RNA, 13 nt, Pseudomonas aeruginosa PA01
gccugcggccagc

SEQ ID NO: 1539571 - RNA, 16 nt, Pseudomonas aeruginosa PA01
gccugcggccagcgcc

SEQ ID NO: 1539572 - RNA, 19 nt, Pseudomonas aeruginosa PA01
gccugcgucgcauccacca

SEQ ID NO: 1539573 - RNA, 14 nt, Pseudomonas aeruginosa PA01
gccugcucggccug

SEQ ID NO: 1539574 - RNA, 15 nt, Pseudomonas aeruginosa PA01
gccugcucggccugc

SEQ ID NO: 1539575 - RNA, 17 nt, Pseudomonas aeruginosa PA01
gccugcucgcgcagcca

SEQ ID NO: 1539576 - RNA, 20 nt, Pseudomonas aeruginosa PA01
gccugcucgcgcagccaggc

SEQ ID NO: 1539577 - RNA, 17 nt, Pseudomonas aeruginosa PA01
gccugcuccagcggagc

SEQ ID NO: 1539578 - RNA, 16 nt, Pseudomonas aeruginosa PA01
gccugcuccucggcag

SEQ ID NO: 1539579 - RNA, 20 nt, Pseudomonas aeruginosa PA01
gccugcucagcguccucagc

SEQ ID NO: 1539580 - RNA, 13 nt, Pseudomonas aeruginosa PA01
gccuggcaggucg

SEQ ID NO: 1539581 - RNA, 14 nt, Pseudomonas aeruginosa PA01
gccuggcaggucgu

SEQ ID NO: 1539582 - RNA, 12 nt, Pseudomonas aeruginosa PA01
gccuggagcaga

SEQ ID NO: 1539583 - RNA, 23 nt, Pseudomonas aeruginosa PA01
gccuggagcgccucgaaggccuc

SEQ ID NO: 1539584 - RNA, 15 nt, Pseudomonas aeruginosa PA01
gccuggcccuggacc

SEQ ID NO: 1539585 - RNA, 13 nt, Pseudomonas aeruginosa PA01
gccuggcccuggc

SEQ ID NO: 1539586 - RNA, 14 nt, Pseudomonas aeruginosa PA01
gccuggcccuggcg

SEQ ID NO: 1539587 - RNA, 17 nt, Pseudomonas aeruginosa PA01
gccuggcccuggcgcag

SEQ ID NO: 1539588 - RNA, 21 nt, Pseudomonas aeruginosa PA01
gccuggcccuggcgcaggcgg

SEQ ID NO: 1539589 - RNA, 15 nt, Pseudomonas aeruginosa PA01
gccuggccggccagc

SEQ ID NO: 1539590 - RNA, 13 nt, Pseudomonas aeruginosa PA01
gccuggccgcgca

SEQ ID NO: 1539591 - RNA, 16 nt, Pseudomonas aeruginosa PA01
gccuggccgcgcagga

SEQ ID NO: 1539592 - RNA, 20 nt, Pseudomonas aeruginosa PA01
gccuggccaggcgcuccucc

SEQ ID NO: 1539593 - RNA, 21 nt, Pseudomonas aeruginosa PA01
gccuggccaggcgcuccucca

SEQ ID NO: 1539594 - RNA, 23 nt, Pseudomonas aeruginosa PA01
gccuggccaggcgcuccuccagc

SEQ ID NO: 1539595 - RNA, 14 nt, Pseudomonas aeruginosa PA01
gccuggaacaccag

SEQ ID NO: 1539596 - RNA, 21 nt, Pseudomonas aeruginosa PA01
gccuggaacaccaggccgcaa

SEQ ID NO: 1539597 - RNA, 16 nt, Pseudomonas aeruginosa PA01
gccugcuuggcggcgg

SEQ ID NO: 1539598 - RNA, 13 nt, Pseudomonas aeruginosa PA01
gccugcuugcagg

SEQ ID NO: 1539599 - RNA, 16 nt, Pseudomonas aeruginosa PA01
gccugcugcgggcgcu

SEQ ID NO: 1539600 - RNA, 22 nt, Pseudomonas aeruginosa PA01
gccugcugcgggcgcugcaugg

SEQ ID NO: 1539601 - RNA, 15 nt, Pseudomonas aeruginosa PA01
gccugcugcgccggc

SEQ ID NO: 1539602 - RNA, 16 nt, Pseudomonas aeruginosa PA01
gccugcugcgcgugua

SEQ ID NO: 1539603 - RNA, 22 nt, Pseudomonas aeruginosa PA01
gccugcugcgcguguaccccca

SEQ ID NO: 1539604 - RNA, 21 nt, Pseudomonas aeruginosa PA01
gccugcugcucgaccgccugc

SEQ ID NO: 1539605 - RNA, 12 nt, Pseudomonas aeruginosa PA01
gccugcuggccg

SEQ ID NO: 1539606 - RNA, 17 nt, Pseudomonas aeruginosa PA01
gccugcuucagcccggc

SEQ ID NO: 1539607 - RNA, 20 nt, Pseudomonas aeruginosa PA01
gccugcuugaaauggcggac

SEQ ID NO: 1539608 - RNA, 13 nt, Pseudomonas aeruginosa PA01
gccugcuggcugc

SEQ ID NO: 1539609 - RNA, 14 nt, Pseudomonas aeruginosa PA01
gcgggcgaagcgca

SEQ ID NO: 1539610 - RNA, 20 nt, Pseudomonas aeruginosa PA01
gcgggcgacgugggccugcu

SEQ ID NO: 1539611 - RNA, 13 nt, Pseudomonas aeruginosa PA01
gcgggccuucagg

SEQ ID NO: 1539612 - RNA, 24 nt, Pseudomonas aeruginosa PA01
gcgggccuucaggcugcgcgcauc

SEQ ID NO: 1539613 - RNA, 19 nt, Pseudomonas aeruginosa PA01
gcgggccuucgccagcggc

SEQ ID NO: 1539614 - RNA, 19 nt, Pseudomonas aeruginosa PA01
gcgggccuugaccaccgcc

SEQ ID NO: 1539615 - RNA, 15 nt, Pseudomonas aeruginosa PA01
gcgggcgaugaggcu

SEQ ID NO: 1539616 - RNA, 19 nt, Pseudomonas aeruginosa PA01
gcgggcgcaagcccaaggg

SEQ ID NO: 1539617 - RNA, 23 nt, Pseudomonas aeruginosa PA01
gcgggccucggcggguguggucc

SEQ ID NO: 1539618 - RNA, 20 nt, Pseudomonas aeruginosa PA01
gcgggccaugcgcucggggu

SEQ ID NO: 1539619 - RNA, 13 nt, Pseudomonas aeruginosa PA01
gcgggccaggcgg

SEQ ID NO: 1539620 - RNA, 16 nt, Pseudomonas aeruginosa PA01
gcgggccagccguucg

SEQ ID NO: 1539621 - RNA, 14 nt, Pseudomonas aeruginosa PA01
gcgggccaggcccu

SEQ ID NO: 1539622 - RNA, 23 nt, Pseudomonas aeruginosa PA01
gcgggccaggcccuuggucaggc

SEQ ID NO: 1539623 - RNA, 17 nt, Pseudomonas aeruginosa PA01
gcgggccaggccgagcg

SEQ ID NO: 1539624 - RNA, 12 nt, Pseudomonas aeruginosa PA01
gcgggccagcag

SEQ ID NO: 1539625 - RNA, 13 nt, Pseudomonas aeruginosa PA01
gcgggccagcagc

SEQ ID NO: 1539626 - RNA, 14 nt, Pseudomonas aeruginosa PA01
gcgggccagcagcu

SEQ ID NO: 1539627 - RNA, 18 nt, Pseudomonas aeruginosa PA01
gcgggccagcaggcgcuc

SEQ ID NO: 1539628 - RNA, 14 nt, Pseudomonas aeruginosa PA01
gcgggccagcaggg

SEQ ID NO: 1539629 - RNA, 13 nt, Pseudomonas aeruginosa PA01
gcgggcaugcugc

SEQ ID NO: 1539630 - RNA, 17 nt, Pseudomonas aeruginosa PA01
gcgggcauggaucuccc

SEQ ID NO: 1539631 - RNA, 13 nt, Pseudomonas aeruginosa PA01
gcgggcauccagc

SEQ ID NO: 1539632 - RNA, 18 nt, Pseudomonas aeruginosa PA01
gcgggcauccagcggacg

SEQ ID NO: 1539633 - RNA, 15 nt, Pseudomonas aeruginosa PA01
gcggggcgcucgccc

SEQ ID NO: 1539634 - RNA, 15 nt, Pseudomonas aeruginosa PA01
gcggggcgcagcagg

SEQ ID NO: 1539635 - RNA, 16 nt, Pseudomonas aeruginosa PA01
gcggggcgcagcagga

SEQ ID NO: 1539636 - RNA, 13 nt, Pseudomonas aeruginosa PA01
gcggggcgcgcug

SEQ ID NO: 1539637 - RNA, 23 nt, Pseudomonas aeruginosa PA01
gcggggcuuuuuccaacgcgcga

SEQ ID NO: 1539638 - RNA, 17 nt, Pseudomonas aeruginosa PA01
gcggggauggcgggcuc

SEQ ID NO: 1539639 - RNA, 15 nt, Pseudomonas aeruginosa PA01
gcggggaagccuucg

SEQ ID NO: 1539640 - RNA, 14 nt, Pseudomonas aeruginosa PA01
gcggggaaggcguc

SEQ ID NO: 1539641 - RNA, 18 nt, Pseudomonas aeruginosa PA01
gcgggucuucaggccgca

SEQ ID NO: 1539642 - RNA, 15 nt, Pseudomonas aeruginosa PA01
gcgggucgcggcugg

SEQ ID NO: 1539643 - RNA, 21 nt, Pseudomonas aeruginosa PA01
gcgggucgucgaagcgcagca

SEQ ID NO: 1539644 - RNA, 17 nt, Pseudomonas aeruginosa PA01
gcgggucugcgccucgc

SEQ ID NO: 1539645 - RNA, 22 nt, Pseudomonas aeruginosa PA01
gcgggucugcgccucgcuggcg

SEQ ID NO: 1539646 - RNA, 23 nt, Pseudomonas aeruginosa PA01
gcgggucugcucggcgcccuggg

SEQ ID NO: 1539647 - RNA, 14 nt, Pseudomonas aeruginosa PA01
gcgggucaccaccg

SEQ ID NO: 1539648 - RNA, 14 nt, Pseudomonas aeruginosa PA01
gcgggucaugaggu

SEQ ID NO: 1539649 - RNA, 17 nt, Pseudomonas aeruginosa PA01
gcgggucgagccaggcg

SEQ ID NO: 1539650 - RNA, 22 nt, Pseudomonas aeruginosa PA01
gcggcucgugucgacucagcgg

SEQ ID NO: 1539651 - RNA, 19 nt, Pseudomonas aeruginosa PA01
gcggcugugcucgaggaag

SEQ ID NO: 1539652 - RNA, 21 nt, Pseudomonas aeruginosa PA01
gcggcugccggugccaccguc

SEQ ID NO: 1539653 - RNA, 17 nt, Pseudomonas aeruginosa PA01
gcggcuguugccguucu

SEQ ID NO: 1539654 - RNA, 15 nt, Pseudomonas aeruginosa PA01
gcggcggcucaggcc

SEQ ID NO: 1539655 - RNA, 23 nt, Pseudomonas aeruginosa PA01
gcggcucggcgggcugccgcgga

SEQ ID NO: 1539656 - RNA, 22 nt, Pseudomonas aeruginosa PA01
gcggcucggccagggccgcucg

SEQ ID NO: 1539657 - RNA, 16 nt, Pseudomonas aeruginosa PA01
gcggcugaaggccgaa

SEQ ID NO: 1539658 - RNA, 14 nt, Pseudomonas aeruginosa PA01
gcggcucuggcgca

SEQ ID NO: 1539659 - RNA, 16 nt, Pseudomonas aeruginosa PA01
gcggcucuggcgcagg

SEQ ID NO: 1539660 - RNA, 18 nt, Pseudomonas aeruginosa PA01
gcggcucuggcgcaggga

SEQ ID NO: 1539661 - RNA, 17 nt, Pseudomonas aeruginosa PA01
gcggcgggacuggggca

SEQ ID NO: 1539662 - RNA, 13 nt, Pseudomonas aeruginosa PA01
gcggcggcggccg

SEQ ID NO: 1539663 - RNA, 14 nt, Pseudomonas aeruginosa PA01
gcggcggcggccag

SEQ ID NO: 1539664 - RNA, 15 nt, Pseudomonas aeruginosa PA01
gcggcggcggccagc

SEQ ID NO: 1539665 - RNA, 16 nt, Pseudomonas aeruginosa PA01
gcggcggcggaccucc

SEQ ID NO: 1539666 - RNA, 19 nt, Pseudomonas aeruginosa PA01
gcggcggccugcucgcgca

SEQ ID NO: 1539667 - RNA, 14 nt, Pseudomonas aeruginosa PA01
gcggcggcgcgggu

SEQ ID NO: 1539668 - RNA, 13 nt, Pseudomonas aeruginosa PA01
gcggcggcgcguc

SEQ ID NO: 1539669 - RNA, 18 nt, Pseudomonas aeruginosa PA01
gcggcggacaggcagccg

SEQ ID NO: 1539670 - RNA, 18 nt, Pseudomonas aeruginosa PA01
gcggcgcuugcgggcgcg

SEQ ID NO: 1539671 - RNA, 19 nt, Pseudomonas aeruginosa PA01
gcggcgcuugcgggcgcgc

SEQ ID NO: 1539672 - RNA, 17 nt, Pseudomonas aeruginosa PA01
gcggcgcuuguagccca

SEQ ID NO: 1539673 - RNA, 18 nt, Pseudomonas aeruginosa PA01
gcgggauguacgccaggg

SEQ ID NO: 1539674 - RNA, 17 nt, Pseudomonas aeruginosa PA01
gcgggaugugcaccagc

SEQ ID NO: 1539675 - RNA, 20 nt, Pseudomonas aeruginosa PA01
gcggcuucgcgcuccaggcc

SEQ ID NO: 1539676 - RNA, 14 nt, Pseudomonas aeruginosa PA01
gcggcuugcguucg

SEQ ID NO: 1539677 - RNA, 18 nt, Pseudomonas aeruginosa PA01
gcggcuucagagcuggac

SEQ ID NO: 1539678 - RNA, 20 nt, Pseudomonas aeruginosa PA01
gcgggcaccgccagcccgcc

SEQ ID NO: 1539679 - RNA, 18 nt, Pseudomonas aeruginosa PA01
gcgggcaaccgcggcggc

SEQ ID NO: 1539680 - RNA, 19 nt, Pseudomonas aeruginosa PA01
gcgggauugucgccgccga

SEQ ID NO: 1539681 - RNA, 20 nt, Pseudomonas aeruginosa PA01
gcggucgccgaacagccgcc

SEQ ID NO: 1539682 - RNA, 19 nt, Pseudomonas aeruginosa PA01
gcggucggaaagcagggcg

SEQ ID NO: 1539683 - RNA, 16 nt, Pseudomonas aeruginosa PA01
gcggucgccgccggcg

SEQ ID NO: 1539684 - RNA, 18 nt, Pseudomonas aeruginosa PA01
gcggguucccugcgccuc

SEQ ID NO: 1539685 - RNA, 19 nt, Pseudomonas aeruginosa PA01
gcggguucagcccgccgug

SEQ ID NO: 1539686 - RNA, 20 nt, Pseudomonas aeruginosa PA01
gcggguucagcccgccgugc

SEQ ID NO: 1539687 - RNA, 23 nt, Pseudomonas aeruginosa PA01
gcggguucagucggccaggcgcc

SEQ ID NO: 1539688 - RNA, 19 nt, Pseudomonas aeruginosa PA01
gcggguucgugccaggcgg

SEQ ID NO: 1539689 - RNA, 16 nt, Pseudomonas aeruginosa PA01
gcggguucuugccgcu

SEQ ID NO: 1539690 - RNA, 20 nt, Pseudomonas aeruginosa PA01
gcggguucuugccgcuguug

SEQ ID NO: 1539691 - RNA, 21 nt, Pseudomonas aeruginosa PA01
gcgguauugucgaugggcagg

SEQ ID NO: 1539692 - RNA, 19 nt, Pseudomonas aeruginosa PA01
gcgguauucuccagcaggc

SEQ ID NO: 1539693 - RNA, 20 nt, Pseudomonas aeruginosa PA01
gcgguauucuccagcaggcu

SEQ ID NO: 1539694 - RNA, 13 nt, Pseudomonas aeruginosa PA01
gcggugcggaugg

SEQ ID NO: 1539695 - RNA, 13 nt, Pseudomonas aeruginosa PA01
gcggugcggucgg

SEQ ID NO: 1539696 - RNA, 19 nt, Pseudomonas aeruginosa PA01
gcgguggccacgucgcccc

SEQ ID NO: 1539697 - RNA, 16 nt, Pseudomonas aeruginosa PA01
gcgguggaggcggcgg

SEQ ID NO: 1539698 - RNA, 15 nt, Pseudomonas aeruginosa PA01
gcggucggccaggcg

SEQ ID NO: 1539699 - RNA, 22 nt, Pseudomonas aeruginosa PA01
gcggucggcgagggcaccacgu

SEQ ID NO: 1539700 - RNA, 13 nt, Pseudomonas aeruginosa PA01
gcggugcgccggc

SEQ ID NO: 1539701 - RNA, 15 nt, Pseudomonas aeruginosa PA01
gcggugcgcgccauc

SEQ ID NO: 1539702 - RNA, 18 nt, Pseudomonas aeruginosa PA01
gcggucguagcccauggu

SEQ ID NO: 1539703 - RNA, 19 nt, Pseudomonas aeruginosa PA01
gcgguggccgcguaccagu

SEQ ID NO: 1539704 - RNA, 18 nt, Pseudomonas aeruginosa PA01
gcgguguagaccaccagc

SEQ ID NO: 1539705 - RNA, 20 nt, Pseudomonas aeruginosa PA01
gcgguguagaccaccagcag

SEQ ID NO: 1539706 - RNA, 16 nt, Pseudomonas aeruginosa PA01
gcgguggggccgccga

SEQ ID NO: 1539707 - RNA, 19 nt, Pseudomonas aeruginosa PA01
gcggugggcgagggcgcgc

SEQ ID NO: 1539708 - RNA, 18 nt, Pseudomonas aeruginosa PA01
gcguagaccuucucgucc

SEQ ID NO: 1539709 - RNA, 17 nt, Pseudomonas aeruginosa PA01
gcguagaaacgcgccuc

SEQ ID NO: 1539710 - RNA, 21 nt, Pseudomonas aeruginosa PA01
gcguagaguucgcugcgcgcc

SEQ ID NO: 1539711 - RNA, 17 nt, Pseudomonas aeruginosa PA01
gcguagguggcgccgcc

SEQ ID NO: 1539712 - RNA, 18 nt, Pseudomonas aeruginosa PA01
gcguagguggcgccgccg

SEQ ID NO: 1539713 - RNA, 17 nt, Pseudomonas aeruginosa PA01
gcguagaccaccucgac

SEQ ID NO: 1539714 - RNA, 16 nt, Pseudomonas aeruginosa PA01
gcguacuugccagggc

SEQ ID NO: 1539715 - RNA, 23 nt, Pseudomonas aeruginosa PA01
gcguaccagcuugucgccuuccu

SEQ ID NO: 1539716 - RNA, 21 nt, Pseudomonas aeruginosa PA01
gcguaccaggaugcccugcuc

SEQ ID NO: 1539717 - RNA, 14 nt, Pseudomonas aeruginosa PA01
gcggugugcucagg

SEQ ID NO: 1539718 - RNA, 17 nt, Pseudomonas aeruginosa PA01
gcgguuauccgccggug

SEQ ID NO: 1539719 - RNA, 21 nt, Pseudomonas aeruginosa PA01
gcgguuauucgcccuaccgcc

SEQ ID NO: 1539720 - RNA, 14 nt, Pseudomonas aeruginosa PA01
gcgguuggcccgcg

SEQ ID NO: 1539721 - RNA, 19 nt, Pseudomonas aeruginosa PA01
gcgguugccgcugcggcgg

SEQ ID NO: 1539722 - RNA, 15 nt, Pseudomonas aeruginosa PA01
gcgguucgccgagcg

SEQ ID NO: 1539723 - RNA, 19 nt, Pseudomonas aeruginosa PA01
gcgguuucuucgccuugcc

SEQ ID NO: 1539724 - RNA, 12 nt, Pseudomonas aeruginosa PA01
gcggcgcggcgg

SEQ ID NO: 1539725 - RNA, 13 nt, Pseudomonas aeruginosa PA01
gcggcgcggcggg

SEQ ID NO: 1539726 - RNA, 22 nt, Pseudomonas aeruginosa PA01
gcggcgcggagauccccuccuc

SEQ ID NO: 1539727 - RNA, 21 nt, Pseudomonas aeruginosa PA01
gcggcgcgccuucagcgccuc

SEQ ID NO: 1539728 - RNA, 22 nt, Pseudomonas aeruginosa PA01
gcggcgcguccaccuggcggcu

SEQ ID NO: 1539729 - RNA, 20 nt, Pseudomonas aeruginosa PA01
gcggcgcugaggaucagcca

SEQ ID NO: 1539730 - RNA, 22 nt, Pseudomonas aeruginosa PA01
gcggcgcugaggaucagccagc

SEQ ID NO: 1539731 - RNA, 14 nt, Pseudomonas aeruginosa PA01
gcggcgcuccaggc

SEQ ID NO: 1539732 - RNA, 21 nt, Pseudomonas aeruginosa PA01
gcggcgcucgaggggcgacgg

SEQ ID NO: 1539733 - RNA, 16 nt, Pseudomonas aeruginosa PA01
gcggcgauaggcgcgc

SEQ ID NO: 1539734 - RNA, 18 nt, Pseudomonas aeruginosa PA01
gcggcgaucuucuccgcc

SEQ ID NO: 1539735 - RNA, 18 nt, Pseudomonas aeruginosa PA01
gcggcgcgauauccgcca

SEQ ID NO: 1539736 - RNA, 12 nt, Pseudomonas aeruginosa PA01
gcggcgccuucg

SEQ ID NO: 1539737 - RNA, 15 nt, Pseudomonas aeruginosa PA01
gcggcgcgaggccgu

SEQ ID NO: 1539738 - RNA, 17 nt, Pseudomonas aeruginosa PA01
gcggcgauggccgccag

SEQ ID NO: 1539739 - RNA, 19 nt, Pseudomonas aeruginosa PA01
gcggcgauggccgccagca

SEQ ID NO: 1539740 - RNA, 20 nt, Pseudomonas aeruginosa PA01
gcggcgauggcguccaccgc

SEQ ID NO: 1539741 - RNA, 16 nt, Pseudomonas aeruginosa PA01
gcggcgaugucggccu

SEQ ID NO: 1539742 - RNA, 22 nt, Pseudomonas aeruginosa PA01
gcggcgagcaucucggccaggc

SEQ ID NO: 1539743 - RNA, 20 nt, Pseudomonas aeruginosa PA01
gcggcgagguugcccacggc

SEQ ID NO: 1539744 - RNA, 14 nt, Pseudomonas aeruginosa PA01
gcggcgagcguucg

SEQ ID NO: 1539745 - RNA, 14 nt, Pseudomonas aeruginosa PA01
gcggcgagcgccgc

SEQ ID NO: 1539746 - RNA, 13 nt, Pseudomonas aeruginosa PA01
gcggcgacggcuc

SEQ ID NO: 1539747 - RNA, 16 nt, Pseudomonas aeruginosa PA01
gcggcgacgaaggucg

SEQ ID NO: 1539748 - RNA, 17 nt, Pseudomonas aeruginosa PA01
gcggcgaccagcgcggu

SEQ ID NO: 1539749 - RNA, 16 nt, Pseudomonas aeruginosa PA01
gcggcgaccauccagc

SEQ ID NO: 1539750 - RNA, 20 nt, Pseudomonas aeruginosa PA01
gcggcgaccauccagccugc

SEQ ID NO: 1539751 - RNA, 20 nt, Pseudomonas aeruginosa PA01
gcggcgaccauguucaccag

SEQ ID NO: 1539752 - RNA, 17 nt, Pseudomonas aeruginosa PA01
gcggcgaccccgaucac

SEQ ID NO: 1539753 - RNA, 20 nt, Pseudomonas aeruginosa PA01
gcggcgaccgaacagcgcgc

SEQ ID NO: 1539754 - RNA, 20 nt, Pseudomonas aeruginosa PA01
gcggcgaagguggcgaccug

SEQ ID NO: 1539755 - RNA, 16 nt, Pseudomonas aeruginosa PA01
gcggcgacaccgccag

SEQ ID NO: 1539756 - RNA, 17 nt, Pseudomonas aeruginosa PA01
gcggcgacaccgccagc

SEQ ID NO: 1539757 - RNA, 18 nt, Pseudomonas aeruginosa PA01
gcggcgacaccgccagca

SEQ ID NO: 1539758 - RNA, 20 nt, Pseudomonas aeruginosa PA01
gcggcgacaccgccagcacc

SEQ ID NO: 1539759 - RNA, 22 nt, Pseudomonas aeruginosa PA01
gcggcgacaccgccagcaccug

SEQ ID NO: 1539760 - RNA, 13 nt, Pseudomonas aeruginosa PA01
gcggccugcucgg

SEQ ID NO: 1539761 - RNA, 19 nt, Pseudomonas aeruginosa PA01
gcggccugggccgaaggcc

SEQ ID NO: 1539762 - RNA, 19 nt, Pseudomonas aeruginosa PA01
gcggccuucuugcugccgg

SEQ ID NO: 1539763 - RNA, 18 nt, Pseudomonas aeruginosa PA01
gcggcgaacaucauccac

SEQ ID NO: 1539764 - RNA, 13 nt, Pseudomonas aeruginosa PA01
gcggccggccagg

SEQ ID NO: 1539765 - RNA, 21 nt, Pseudomonas aeruginosa PA01
gcggccgucgcuggcuuccug

SEQ ID NO: 1539766 - RNA, 21 nt, Pseudomonas aeruginosa PA01
gcggccggugccuucggcggc

SEQ ID NO: 1539767 - RNA, 16 nt, Pseudomonas aeruginosa PA01
gcggccggcgcggacg

SEQ ID NO: 1539768 - RNA, 16 nt, Pseudomonas aeruginosa PA01
gcggccgggucgaggu

SEQ ID NO: 1539769 - RNA, 15 nt, Pseudomonas aeruginosa PA01
gcggccugccccgcc

SEQ ID NO: 1539770 - RNA, 19 nt, Pseudomonas aeruginosa PA01
gcggccugagcugccgcuu

SEQ ID NO: 1539771 - RNA, 22 nt, Pseudomonas aeruginosa PA01
gcggccguucuccgggucgggc

SEQ ID NO: 1539772 - RNA, 18 nt, Pseudomonas aeruginosa PA01
gcggccguuguccagggu

SEQ ID NO: 1539773 - RNA, 22 nt, Pseudomonas aeruginosa PA01
gcggccuacuugaucagccgca

SEQ ID NO: 1539774 - RNA, 23 nt, Pseudomonas aeruginosa PA01
gcggccgccuugaccugcugggc

SEQ ID NO: 1539775 - RNA, 19 nt, Pseudomonas aeruginosa PA01
gcggccggauggccgccgu

SEQ ID NO: 1539776 - RNA, 18 nt, Pseudomonas aeruginosa PA01
gcggccgcgagcgcggcc

SEQ ID NO: 1539777 - RNA, 15 nt, Pseudomonas aeruginosa PA01
gcggccgccgcgcag

SEQ ID NO: 1539778 - RNA, 20 nt, Pseudomonas aeruginosa PA01
gcggcccugcgccgcagcgg

SEQ ID NO: 1539779 - RNA, 19 nt, Pseudomonas aeruginosa PA01
gcggcccugcucgccggcg

SEQ ID NO: 1539780 - RNA, 22 nt, Pseudomonas aeruginosa PA01
gcggcccuugucgccgcugggc

SEQ ID NO: 1539781 - RNA, 21 nt, Pseudomonas aeruginosa PA01
gcggccgaacucuggcggcgu

SEQ ID NO: 1539782 - RNA, 18 nt, Pseudomonas aeruginosa PA01
gcggccgaauccuccagc

SEQ ID NO: 1539783 - RNA, 21 nt, Pseudomonas aeruginosa PA01
gcggccgaauccuccagccgg

SEQ ID NO: 1539784 - RNA, 21 nt, Pseudomonas aeruginosa PA01
gcggccgcaaccagcccuggc

SEQ ID NO: 1539785 - RNA, 18 nt, Pseudomonas aeruginosa PA01
gcggccgaggcuuccucg

SEQ ID NO: 1539786 - RNA, 15 nt, Pseudomonas aeruginosa PA01
gcggccgcaugccgg

SEQ ID NO: 1539787 - RNA, 17 nt, Pseudomonas aeruginosa PA01
gcggccgcaugccgggg

SEQ ID NO: 1539788 - RNA, 16 nt, Pseudomonas aeruginosa PA01
gcggcaggccguccuu

SEQ ID NO: 1539789 - RNA, 20 nt, Pseudomonas aeruginosa PA01
gcggcaggcgccaaccgggc

SEQ ID NO: 1539790 - RNA, 14 nt, Pseudomonas aeruginosa PA01
gcggcaggcgccgg

SEQ ID NO: 1539791 - RNA, 15 nt, Pseudomonas aeruginosa PA01
gcggcaggcgccggc

SEQ ID NO: 1539792 - RNA, 16 nt, Pseudomonas aeruginosa PA01
gcggcaggcgccggcc

SEQ ID NO: 1539793 - RNA, 18 nt, Pseudomonas aeruginosa PA01
gcggcaggcgccggccgg

SEQ ID NO: 1539794 - RNA, 18 nt, Pseudomonas aeruginosa PA01
gcggcaggccuuccacgc

SEQ ID NO: 1539795 - RNA, 17 nt, Pseudomonas aeruginosa PA01
gcggcagcugcggcggc

SEQ ID NO: 1539796 - RNA, 16 nt, Pseudomonas aeruginosa PA01
gcggcagcgugcucac

SEQ ID NO: 1539797 - RNA, 17 nt, Pseudomonas aeruginosa PA01
gcggcaggagcaugaag

SEQ ID NO: 1539798 - RNA, 20 nt, Pseudomonas aeruginosa PA01
gcggcaggcacgcugccagc

SEQ ID NO: 1539799 - RNA, 15 nt, Pseudomonas aeruginosa PA01
gcggcagccgcggcu

SEQ ID NO: 1539800 - RNA, 14 nt, Pseudomonas aeruginosa PA01
gcggcagcgccagg

SEQ ID NO: 1539801 - RNA, 15 nt, Pseudomonas aeruginosa PA01
gcggcagcgccaggu

SEQ ID NO: 1539802 - RNA, 20 nt, Pseudomonas aeruginosa PA01
gcggcagcgccaucaggccc

SEQ ID NO: 1539803 - RNA, 19 nt, Pseudomonas aeruginosa PA01
gcggcagccacucggccag

SEQ ID NO: 1539804 - RNA, 14 nt, Pseudomonas aeruginosa PA01
gcggcagcgguucg

SEQ ID NO: 1539805 - RNA, 18 nt, Pseudomonas aeruginosa PA01
gcggcagguaguggcccu

SEQ ID NO: 1539806 - RNA, 14 nt, Pseudomonas aeruginosa PA01
gcggcaggcggcgg

SEQ ID NO: 1539807 - RNA, 17 nt, Pseudomonas aeruginosa PA01
gcggcaggcggcggcgu

SEQ ID NO: 1539808 - RNA, 18 nt, Pseudomonas aeruginosa PA01
gcggcauccgccgcuggg

SEQ ID NO: 1539809 - RNA, 15 nt, Pseudomonas aeruginosa PA01
gcggcauagcgcagc

SEQ ID NO: 1539810 - RNA, 19 nt, Pseudomonas aeruginosa PA01
gcggcauagaugccggccu

SEQ ID NO: 1539811 - RNA, 20 nt, Pseudomonas aeruginosa PA01
gcggcauagaugccggccuc

SEQ ID NO: 1539812 - RNA, 22 nt, Pseudomonas aeruginosa PA01
gcggcagugcucgaucaggcug

SEQ ID NO: 1539813 - RNA, 18 nt, Pseudomonas aeruginosa PA01
gcgcuguaggcgagcagc

SEQ ID NO: 1539814 - RNA, 17 nt, Pseudomonas aeruginosa PA01
gcgcugguugcccaggg

SEQ ID NO: 1539815 - RNA, 14 nt, Pseudomonas aeruginosa PA01
gcgcugucggccuc

SEQ ID NO: 1539816 - RNA, 22 nt, Pseudomonas aeruginosa PA01
gcgcuggucgacguaggcggcg

SEQ ID NO: 1539817 - RNA, 18 nt, Pseudomonas aeruginosa PA01
gcgcugguagcgcuccag

SEQ ID NO: 1539818 - RNA, 22 nt, Pseudomonas aeruginosa PA01
gcgcuggucguucucgcgcauc

SEQ ID NO: 1539819 - RNA, 17 nt, Pseudomonas aeruginosa PA01
gcgcugugcacggucug

SEQ ID NO: 1539820 - RNA, 16 nt, Pseudomonas aeruginosa PA01
gcgcuguuggccuggg

SEQ ID NO: 1539821 - RNA, 19 nt, Pseudomonas aeruginosa PA01
gcgcuguuugcggcgcagg

SEQ ID NO: 1539822 - RNA, 19 nt, Pseudomonas aeruginosa PA01
gcggcagaucggugcgggc

SEQ ID NO: 1539823 - RNA, 12 nt, Pseudomonas aeruginosa PA01
gcggcagcagcc

SEQ ID NO: 1539824 - RNA, 15 nt, Pseudomonas aeruginosa PA01
gcggcacuccaggaa

SEQ ID NO: 1539825 - RNA, 14 nt, Pseudomonas aeruginosa PA01
gcggccagcgcggc

SEQ ID NO: 1539826 - RNA, 17 nt, Pseudomonas aeruginosa PA01
gcggccaguucgggguc

SEQ ID NO: 1539827 - RNA, 21 nt, Pseudomonas aeruginosa PA01
gcggccagcgugaagaccugg

SEQ ID NO: 1539828 - RNA, 19 nt, Pseudomonas aeruginosa PA01
gcggccauugcccgguggc

SEQ ID NO: 1539829 - RNA, 16 nt, Pseudomonas aeruginosa PA01
gcggcccagcggcagg

SEQ ID NO: 1539830 - RNA, 17 nt, Pseudomonas aeruginosa PA01
gcggccccaaggggccg

SEQ ID NO: 1539831 - RNA, 20 nt, Pseudomonas aeruginosa PA01
gcggccccuucagcuccagc

SEQ ID NO: 1539832 - RNA, 14 nt, Pseudomonas aeruginosa PA01
gcggccccagcacu

SEQ ID NO: 1539833 - RNA, 12 nt, Pseudomonas aeruginosa PA01
gcggcccgagca

SEQ ID NO: 1539834 - RNA, 14 nt, Pseudomonas aeruginosa PA01
gcggcccgagggcg

SEQ ID NO: 1539835 - RNA, 13 nt, Pseudomonas aeruginosa PA01
gcggccccggcgu

SEQ ID NO: 1539836 - RNA, 22 nt, Pseudomonas aeruginosa PA01
gcggcccgccgccggggcgggc

SEQ ID NO: 1539837 - RNA, 12 nt, Pseudomonas aeruginosa PA01
gcggccagcagc

SEQ ID NO: 1539838 - RNA, 13 nt, Pseudomonas aeruginosa PA01
gcggccagcagca

SEQ ID NO: 1539839 - RNA, 16 nt, Pseudomonas aeruginosa PA01
gcggccagcagcacgg

SEQ ID NO: 1539840 - RNA, 15 nt, Pseudomonas aeruginosa PA01
gcggcaucggccugg

SEQ ID NO: 1539841 - RNA, 19 nt, Pseudomonas aeruginosa PA01
gcggcaucggcgccgcgca

SEQ ID NO: 1539842 - RNA, 14 nt, Pseudomonas aeruginosa PA01
gcggcauggucagc

SEQ ID NO: 1539843 - RNA, 15 nt, Pseudomonas aeruginosa PA01
gcggcaugcccugcc

SEQ ID NO: 1539844 - RNA, 11 nt, Pseudomonas aeruginosa PA01
gcggcaugccg

SEQ ID NO: 1539845 - RNA, 15 nt, Pseudomonas aeruginosa PA01
gcggcaugccguaga

SEQ ID NO: 1539846 - RNA, 18 nt, Pseudomonas aeruginosa PA01
gcggccaaccucucccca

SEQ ID NO: 1539847 - RNA, 15 nt, Pseudomonas aeruginosa PA01
gcggcauuccgggcg

SEQ ID NO: 1539848 - RNA, 15 nt, Pseudomonas aeruginosa PA01
gcggcauugagcgcc

SEQ ID NO: 1539849 - RNA, 21 nt, Pseudomonas aeruginosa PA01
gcggcauugagcgccagcagg

SEQ ID NO: 1539850 - RNA, 15 nt, Pseudomonas aeruginosa PA01
gcucgcucuuuccau

SEQ ID NO: 1539851 - RNA, 20 nt, Pseudomonas aeruginosa PA01
gcucgcugaaauccaccagc

SEQ ID NO: 1539852 - RNA, 23 nt, Pseudomonas aeruginosa PA01
gcucgcugaaauccaccagcacg

SEQ ID NO: 1539853 - RNA, 22 nt, Pseudomonas aeruginosa PA01
gcucgcugucgcucagcgggcc

SEQ ID NO: 1539854 - RNA, 15 nt, Pseudomonas aeruginosa PA01
gcucggaucaggcgg

SEQ ID NO: 1539855 - RNA, 19 nt, Pseudomonas aeruginosa PA01
gcucggaucaggcgggcuc

SEQ ID NO: 1539856 - RNA, 20 nt, Pseudomonas aeruginosa PA01
gcucggacgacaucucgucc

SEQ ID NO: 1539857 - RNA, 18 nt, Pseudomonas aeruginosa PA01
gcucgcuucagcgagcgg

SEQ ID NO: 1539858 - RNA, 21 nt, Pseudomonas aeruginosa PA01
gcucggccugaucaucugggc

SEQ ID NO: 1539859 - RNA, 17 nt, Pseudomonas aeruginosa PA01
gcucggccgagggcagc

SEQ ID NO: 1539860 - RNA, 18 nt, Pseudomonas aeruginosa PA01
gcucggccgagggcagcc

SEQ ID NO: 1539861 - RNA, 17 nt, Pseudomonas aeruginosa PA01
gcucggcacgcagcagc

SEQ ID NO: 1539862 - RNA, 18 nt, Pseudomonas aeruginosa PA01
gcucggccagggccgcuc

SEQ ID NO: 1539863 - RNA, 17 nt, Pseudomonas aeruginosa PA01
gcucggccaggucgcga

SEQ ID NO: 1539864 - RNA, 19 nt, Pseudomonas aeruginosa PA01
gcucggccaggucgcgacu

SEQ ID NO: 1539865 - RNA, 23 nt, Pseudomonas aeruginosa PA01
gcucggccaguucgcggcgcagu

SEQ ID NO: 1539866 - RNA, 23 nt, Pseudomonas aeruginosa PA01
gcucggcgcccuggguggucugc

SEQ ID NO: 1539867 - RNA, 23 nt, Pseudomonas aeruginosa PA01
gcucggcggcaggcugcgccgcu

SEQ ID NO: 1539868 - RNA, 18 nt, Pseudomonas aeruginosa PA01
gcucggcgaccuugcgca

SEQ ID NO: 1539869 - RNA, 21 nt, Pseudomonas aeruginosa PA01
gcucggcgauggcgcgcgggc

SEQ ID NO: 1539870 - RNA, 17 nt, Pseudomonas aeruginosa PA01
gcucgcggcguaggccu

SEQ ID NO: 1539871 - RNA, 21 nt, Pseudomonas aeruginosa PA01
gcucgcggcuggccgccucgc

SEQ ID NO: 1539872 - RNA, 17 nt, Pseudomonas aeruginosa PA01
gcucgcggaccagcucc

SEQ ID NO: 1539873 - RNA, 18 nt, Pseudomonas aeruginosa PA01
gcucgcggaccagcuccg

SEQ ID NO: 1539874 - RNA, 16 nt, Pseudomonas aeruginosa PA01
gcucgcgggccgccug

SEQ ID NO: 1539875 - RNA, 21 nt, Pseudomonas aeruginosa PA01
gcucgcgguaggccagcuccu

SEQ ID NO: 1539876 - RNA, 13 nt, Pseudomonas aeruginosa PA01
gcucgcgccagcc

SEQ ID NO: 1539877 - RNA, 17 nt, Pseudomonas aeruginosa PA01
gcucgcgccagccccag

SEQ ID NO: 1539878 - RNA, 17 nt, Pseudomonas aeruginosa PA01
gcucgcgcagccaggcg

SEQ ID NO: 1539879 - RNA, 17 nt, Pseudomonas aeruginosa PA01
gcucgcgcaccgcggcc

SEQ ID NO: 1539880 - RNA, 19 nt, Pseudomonas aeruginosa PA01
gcucgcgcaccgcggccag

SEQ ID NO: 1539881 - RNA, 16 nt, Pseudomonas aeruginosa PA01
gcucgcgcggggcgcg

SEQ ID NO: 1539882 - RNA, 21 nt, Pseudomonas aeruginosa PA01
gcucgcgcaaccagccggaga

SEQ ID NO: 1539883 - RNA, 18 nt, Pseudomonas aeruginosa PA01
gcucgcgccggcgcguuc

SEQ ID NO: 1539884 - RNA, 16 nt, Pseudomonas aeruginosa PA01
gcucgcgcuucucgac

SEQ ID NO: 1539885 - RNA, 23 nt, Pseudomonas aeruginosa PA01
gcucgccggguuguccaggcgau

SEQ ID NO: 1539886 - RNA, 16 nt, Pseudomonas aeruginosa PA01
gcucgccggguagggc

SEQ ID NO: 1539887 - RNA, 18 nt, Pseudomonas aeruginosa PA01
gcucgcgcaagcgcccgg

SEQ ID NO: 1539888 - RNA, 14 nt, Pseudomonas aeruginosa PA01
gcucgccucgggcc

SEQ ID NO: 1539889 - RNA, 15 nt, Pseudomonas aeruginosa PA01
gcucgccucgggcca

SEQ ID NO: 1539890 - RNA, 21 nt, Pseudomonas aeruginosa PA01
gcucgccucgggccaugagca

SEQ ID NO: 1539891 - RNA, 21 nt, Pseudomonas aeruginosa PA01
gcucgccggcguccuccucca

SEQ ID NO: 1539892 - RNA, 16 nt, Pseudomonas aeruginosa PA01
gcucgccggcgcgggc

SEQ ID NO: 1539893 - RNA, 17 nt, Pseudomonas aeruginosa PA01
gcucgccggcgcgggcg

SEQ ID NO: 1539894 - RNA, 20 nt, Pseudomonas aeruginosa PA01
gcucgccggcgcgggcggcc

SEQ ID NO: 1539895 - RNA, 13 nt, Pseudomonas aeruginosa PA01
gcucgcagccggu

SEQ ID NO: 1539896 - RNA, 13 nt, Pseudomonas aeruginosa PA01
gcucgcagagggc

SEQ ID NO: 1539897 - RNA, 20 nt, Pseudomonas aeruginosa PA01
gcuccugcaggcccugccag

SEQ ID NO: 1539898 - RNA, 12 nt, Pseudomonas aeruginosa PA01
gcuccucggccu

SEQ ID NO: 1539899 - RNA, 15 nt, Pseudomonas aeruginosa PA01
gcuccucggccuggg

SEQ ID NO: 1539900 - RNA, 15 nt, Pseudomonas aeruginosa PA01
gcuccucggccuugc

SEQ ID NO: 1539901 - RNA, 21 nt, Pseudomonas aeruginosa PA01
gcuccucggcagcgcuggcga

SEQ ID NO: 1539902 - RNA, 21 nt, Pseudomonas aeruginosa PA01
gcuccucgccguacagcaggc

SEQ ID NO: 1539903 - RNA, 17 nt, Pseudomonas aeruginosa PA01
gcuccucgauccgcucc

SEQ ID NO: 1539904 - RNA, 21 nt, Pseudomonas aeruginosa PA01
gcuccucgauccgcuccagca

SEQ ID NO: 1539905 - RNA, 13 nt, Pseudomonas aeruginosa PA01
gcuccucagaggc

SEQ ID NO: 1539906 - RNA, 12 nt, Pseudomonas aeruginosa PA01
gcuccuccucgc

SEQ ID NO: 1539907 - RNA, 22 nt, Pseudomonas aeruginosa PA01
gcuccuccagcaggaccuggcc

SEQ ID NO: 1539908 - RNA, 14 nt, Pseudomonas aeruginosa PA01
gcuccuccagcgcc

SEQ ID NO: 1539909 - RNA, 13 nt, Pseudomonas aeruginosa PA01
gcucgacccgccc

SEQ ID NO: 1539910 - RNA, 14 nt, Pseudomonas aeruginosa PA01
gcucgauggcggcc

SEQ ID NO: 1539911 - RNA, 21 nt, Pseudomonas aeruginosa PA01
gcucgaugcccgccagcaggc

SEQ ID NO: 1539912 - RNA, 19 nt, Pseudomonas aeruginosa PA01
gcucgauugcugaggggug

SEQ ID NO: 1539913 - RNA, 15 nt, Pseudomonas aeruginosa PA01
gcucgaacgggcacu

SEQ ID NO: 1539914 - RNA, 15 nt, Pseudomonas aeruginosa PA01
gcucgacauugcugc

SEQ ID NO: 1539915 - RNA, 13 nt, Pseudomonas aeruginosa PA01
gcucgaccaccuc

SEQ ID NO: 1539916 - RNA, 14 nt, Pseudomonas aeruginosa PA01
gcucgaccaccucg

SEQ ID NO: 1539917 - RNA, 14 nt, Pseudomonas aeruginosa PA01
gcucgaaugcuguu

SEQ ID NO: 1539918 - RNA, 15 nt, Pseudomonas aeruginosa PA01
gcuccgacuccugca

SEQ ID NO: 1539919 - RNA, 17 nt, Pseudomonas aeruginosa PA01
gcuccgacuccugcaac

SEQ ID NO: 1539920 - RNA, 23 nt, Pseudomonas aeruginosa PA01
gcuccgagcaggccuugcagggc

SEQ ID NO: 1539921 - RNA, 20 nt, Pseudomonas aeruginosa PA01
gcuccgggcuggccaccagc

SEQ ID NO: 1539922 - RNA, 23 nt, Pseudomonas aeruginosa PA01
gcuccgggcuggccaccagcacc

SEQ ID NO: 1539923 - RNA, 21 nt, Pseudomonas aeruginosa PA01
gcuccgugucggcggcgccuu

SEQ ID NO: 1539924 - RNA, 22 nt, Pseudomonas aeruginosa PA01
gcuccgucgcuucgcccgccgc

SEQ ID NO: 1539925 - RNA, 20 nt, Pseudomonas aeruginosa PA01
gcuccgucuguucggccagg

SEQ ID NO: 1539926 - RNA, 23 nt, Pseudomonas aeruginosa PA01
gcuccguagggcgacgcccgagg

SEQ ID NO: 1539927 - RNA, 17 nt, Pseudomonas aeruginosa PA01
gcuccgguggcggacug

SEQ ID NO: 1539928 - RNA, 17 nt, Pseudomonas aeruginosa PA01
gcuccaguugcagcacc

SEQ ID NO: 1539929 - RNA, 18 nt, Pseudomonas aeruginosa PA01
gcuccaguugcagcaccc

SEQ ID NO: 1539930 - RNA, 12 nt, Pseudomonas aeruginosa PA01
gcuccauccagu

SEQ ID NO: 1539931 - RNA, 20 nt, Pseudomonas aeruginosa PA01
gcucccugcaauggggcggc

SEQ ID NO: 1539932 - RNA, 22 nt, Pseudomonas aeruginosa PA01
gcucccugcaauggggcggccg

SEQ ID NO: 1539933 - RNA, 13 nt, Pseudomonas aeruginosa PA01
gcuagucuuccug

SEQ ID NO: 1539934 - RNA, 14 nt, Pseudomonas aeruginosa PA01
gcuagucuuccugc

SEQ ID NO: 1539935 - RNA, 15 nt, Pseudomonas aeruginosa PA01
gcuagucuuccugca

SEQ ID NO: 1539936 - RNA, 19 nt, Pseudomonas aeruginosa PA01
gcuaggcuggaagccgcgc

SEQ ID NO: 1539937 - RNA, 17 nt, Pseudomonas aeruginosa PA01
gcucacugcgagcacca

SEQ ID NO: 1539938 - RNA, 15 nt, Pseudomonas aeruginosa PA01
gcucaggccucgagg

SEQ ID NO: 1539939 - RNA, 17 nt, Pseudomonas aeruginosa PA01
gcucagcacccuggcca

SEQ ID NO: 1539940 - RNA, 18 nt, Pseudomonas aeruginosa PA01
gcucagcacggcgacggu

SEQ ID NO: 1539941 - RNA, 14 nt, Pseudomonas aeruginosa PA01
gcucacccuguccc

SEQ ID NO: 1539942 - RNA, 20 nt, Pseudomonas aeruginosa PA01
gcucacucccguccagcgcu

SEQ ID NO: 1539943 - RNA, 23 nt, Pseudomonas aeruginosa PA01
gcucaccggaccguggugacggu

SEQ ID NO: 1539944 - RNA, 23 nt, Pseudomonas aeruginosa PA01
gcucaccgagaaccaguacuuga

SEQ ID NO: 1539945 - RNA, 16 nt, Pseudomonas aeruginosa PA01
gcuccaacgcaggcgc

SEQ ID NO: 1539946 - RNA, 24 nt, Pseudomonas aeruginosa PA01
gcuccaauccgauuccgcgcagga

SEQ ID NO: 1539947 - RNA, 15 nt, Pseudomonas aeruginosa PA01
gcuccaaugcaccug

SEQ ID NO: 1539948 - RNA, 16 nt, Pseudomonas aeruginosa PA01
gcucauccugcccgua

SEQ ID NO: 1539949 - RNA, 18 nt, Pseudomonas aeruginosa PA01
gcuccagucggggcaggc

SEQ ID NO: 1539950 - RNA, 20 nt, Pseudomonas aeruginosa PA01
gcuccagucggggcaggcgc

SEQ ID NO: 1539951 - RNA, 22 nt, Pseudomonas aeruginosa PA01
gcuccagucggggcaggcgcag

SEQ ID NO: 1539952 - RNA, 23 nt, Pseudomonas aeruginosa PA01
gcuccagucggggcaggcgcagg

SEQ ID NO: 1539953 - RNA, 15 nt, Pseudomonas aeruginosa PA01
gcuccagccgcugca

SEQ ID NO: 1539954 - RNA, 22 nt, Pseudomonas aeruginosa PA01
gcuccagccgcugcagggcggc

SEQ ID NO: 1539955 - RNA, 14 nt, Pseudomonas aeruginosa PA01
gcuccagccaggcc

SEQ ID NO: 1539956 - RNA, 15 nt, Pseudomonas aeruginosa PA01
gcuccagccaggccc

SEQ ID NO: 1539957 - RNA, 17 nt, Pseudomonas aeruginosa PA01
gcuccagcagggccagc

SEQ ID NO: 1539958 - RNA, 20 nt, Pseudomonas aeruginosa PA01
gcuccagcagggccagcgcc

SEQ ID NO: 1539959 - RNA, 19 nt, Pseudomonas aeruginosa PA01
gcuccagcagucgcacagc

SEQ ID NO: 1539960 - RNA, 15 nt, Pseudomonas aeruginosa PA01
gcuccagcaaugcca

SEQ ID NO: 1539961 - RNA, 19 nt, Pseudomonas aeruginosa PA01
gcuccagcaaugccagcgc

SEQ ID NO: 1539962 - RNA, 20 nt, Pseudomonas aeruginosa PA01
gcuccagcaaugccagcgcc

SEQ ID NO: 1539963 - RNA, 22 nt, Pseudomonas aeruginosa PA01
gcucauccgcugguagcccagg

SEQ ID NO: 1539964 - RNA, 17 nt, Pseudomonas aeruginosa PA01
gcucaucauugaaauca

SEQ ID NO: 1539965 - RNA, 17 nt, Pseudomonas aeruginosa PA01
gcucaggcugugcagga

SEQ ID NO: 1539966 - RNA, 14 nt, Pseudomonas aeruginosa PA01
gcucaggcgcugcu

SEQ ID NO: 1539967 - RNA, 16 nt, Pseudomonas aeruginosa PA01
gcucaggcgcugcugg

SEQ ID NO: 1539968 - RNA, 23 nt, Pseudomonas aeruginosa PA01
gcucaggcggccgaacuggauga

SEQ ID NO: 1539969 - RNA, 14 nt, Pseudomonas aeruginosa PA01
gcucaggcagcgau

SEQ ID NO: 1539970 - RNA, 21 nt, Pseudomonas aeruginosa PA01
gcucaggcagcgaucgccgcc

SEQ ID NO: 1539971 - RNA, 14 nt, Pseudomonas aeruginosa PA01
gcucaggccaagca

SEQ ID NO: 1539972 - RNA, 11 nt, Pseudomonas aeruginosa PA01
gcucaggcgaa

SEQ ID NO: 1539973 - RNA, 19 nt, Pseudomonas aeruginosa PA01
gcucaggcgcagcguccug

SEQ ID NO: 1539974 - RNA, 22 nt, Pseudomonas aeruginosa PA01
gcuaaccggucgcaauggcgga

SEQ ID NO: 1539975 - RNA, 12 nt, Pseudomonas aeruginosa PA01
gcuacagcaauu

SEQ ID NO: 1539976 - RNA, 21 nt, Pseudomonas aeruginosa PA01
gcuacggaaggucgccgggcu

SEQ ID NO: 1539977 - RNA, 15 nt, Pseudomonas aeruginosa PA01
gcuacguuccagggc

SEQ ID NO: 1539978 - RNA, 18 nt, Pseudomonas aeruginosa PA01
gcuacguuccagggccug

SEQ ID NO: 1539979 - RNA, 14 nt, Pseudomonas aeruginosa PA01
gcuacggcaucacc

SEQ ID NO: 1539980 - RNA, 16 nt, Pseudomonas aeruginosa PA01
gcuacccucaggggug

SEQ ID NO: 1539981 - RNA, 22 nt, Pseudomonas aeruginosa PA01
gcuacccucaggggugcagccc

SEQ ID NO: 1539982 - RNA, 15 nt, Pseudomonas aeruginosa PA01
gcuaccgucggccug

SEQ ID NO: 1539983 - RNA, 20 nt, Pseudomonas aeruginosa PA01
gcgucucggcugccgccagc

SEQ ID NO: 1539984 - RNA, 21 nt, Pseudomonas aeruginosa PA01
gcgucucggcugccgccagcu

SEQ ID NO: 1539985 - RNA, 13 nt, Pseudomonas aeruginosa PA01
gcgucugggacgg

SEQ ID NO: 1539986 - RNA, 16 nt, Pseudomonas aeruginosa PA01
gcgucugccgcuggcg

SEQ ID NO: 1539987 - RNA, 11 nt, Pseudomonas aeruginosa PA01
gcgugaaaaca

SEQ ID NO: 1539988 - RNA, 18 nt, Pseudomonas aeruginosa PA01
gcgugcagguagcagccg

SEQ ID NO: 1539989 - RNA, 18 nt, Pseudomonas aeruginosa PA01
gcgugaaguagccgccgg

SEQ ID NO: 1539990 - RNA, 16 nt, Pseudomonas aeruginosa PA01
gcgugaagcuggagca

SEQ ID NO: 1539991 - RNA, 16 nt, Pseudomonas aeruginosa PA01
gcgugcauggccgggc

SEQ ID NO: 1539992 - RNA, 17 nt, Pseudomonas aeruginosa PA01
gcgugcauggccgggcc

SEQ ID NO: 1539993 - RNA, 19 nt, Pseudomonas aeruginosa PA01
gcgugcccauccgcucggc

SEQ ID NO: 1539994 - RNA, 14 nt, Pseudomonas aeruginosa PA01
gcgugcccgcugca

SEQ ID NO: 1539995 - RNA, 14 nt, Pseudomonas aeruginosa PA01
gcgugcuccagcac

SEQ ID NO: 1539996 - RNA, 21 nt, Pseudomonas aeruginosa PA01
gcguggaaccgcggcgcccuc

SEQ ID NO: 1539997 - RNA, 15 nt, Pseudomonas aeruginosa PA01
gcgugggccagccca

SEQ ID NO: 1539998 - RNA, 15 nt, Pseudomonas aeruginosa PA01
gcgugggccagggau

SEQ ID NO: 1539999 - RNA, 14 nt, Pseudomonas aeruginosa PA01
gcgugggcgccggc

SEQ ID NO: 1540000 - RNA, 15 nt, Pseudomonas aeruginosa PA01
gcgugggcgccggcg

SEQ ID NO: 1540001 - RNA, 14 nt, Pseudomonas aeruginosa PA01
gcgugggcggucgg

SEQ ID NO: 1540002 - RNA, 14 nt, Pseudomonas aeruginosa PA01
gcgugggcggccgg

SEQ ID NO: 1540003 - RNA, 19 nt, Pseudomonas aeruginosa PA01
gcguggguccacgccgggc

SEQ ID NO: 1540004 - RNA, 23 nt, Pseudomonas aeruginosa PA01
gcgugcuuggcgaggcgcgccug

SEQ ID NO: 1540005 - RNA, 19 nt, Pseudomonas aeruginosa PA01
gcgugcugggucuccuccu

SEQ ID NO: 1540006 - RNA, 11 nt, Pseudomonas aeruginosa PA01
gcgugcucggc

SEQ ID NO: 1540007 - RNA, 16 nt, Pseudomonas aeruginosa PA01
gcgugcugcacggagu

SEQ ID NO: 1540008 - RNA, 18 nt, Pseudomonas aeruginosa PA01
gcguucccccuuuuucgg

SEQ ID NO: 1540009 - RNA, 17 nt, Pseudomonas aeruginosa PA01
gcguuccgggcagcggc

SEQ ID NO: 1540010 - RNA, 19 nt, Pseudomonas aeruginosa PA01
gcguuauccgccccacccc

SEQ ID NO: 1540011 - RNA, 18 nt, Pseudomonas aeruginosa PA01
gcguuaugcgcccuaccu

SEQ ID NO: 1540012 - RNA, 13 nt, Pseudomonas aeruginosa PA01
gcguucgcccugc

SEQ ID NO: 1540013 - RNA, 15 nt, Pseudomonas aeruginosa PA01
gcguucgcuccgggc

SEQ ID NO: 1540014 - RNA, 19 nt, Pseudomonas aeruginosa PA01
gcguucgcuccgggcccgu

SEQ ID NO: 1540015 - RNA, 17 nt, Pseudomonas aeruginosa PA01
gcguucgccggguuuuu

SEQ ID NO: 1540016 - RNA, 19 nt, Pseudomonas aeruginosa PA01
gcguuccuggcgcgcggcc

SEQ ID NO: 1540017 - RNA, 20 nt, Pseudomonas aeruginosa PA01
gcguuccuucaacagcgaag

SEQ ID NO: 1540018 - RNA, 16 nt, Pseudomonas aeruginosa PA01
gcgugguaucggcgcu

SEQ ID NO: 1540019 - RNA, 19 nt, Pseudomonas aeruginosa PA01
gcguggugcauccgccgca

SEQ ID NO: 1540020 - RNA, 22 nt, Pseudomonas aeruginosa PA01
gcgugguggcggggaacagcau

SEQ ID NO: 1540021 - RNA, 16 nt, Pseudomonas aeruginosa PA01
gcguugauccgguuga

SEQ ID NO: 1540022 - RNA, 15 nt, Pseudomonas aeruginosa PA01
gcguugacugccugc

SEQ ID NO: 1540023 - RNA, 19 nt, Pseudomonas aeruginosa PA01
gcguugacugccugcaggu

SEQ ID NO: 1540024 - RNA, 19 nt, Pseudomonas aeruginosa PA01
gcguugaacugcccgcagg

SEQ ID NO: 1540025 - RNA, 15 nt, Pseudomonas aeruginosa PA01
gcguucggcgcuggc

SEQ ID NO: 1540026 - RNA, 20 nt, Pseudomonas aeruginosa PA01
gcguucggggcccuccaggc

SEQ ID NO: 1540027 - RNA, 18 nt, Pseudomonas aeruginosa PA01
gcguucucccugagccug

SEQ ID NO: 1540028 - RNA, 22 nt, Pseudomonas aeruginosa PA01
gcguucgucguggccauagagc

SEQ ID NO: 1540029 - RNA, 16 nt, Pseudomonas aeruginosa PA01
gcguucugcugcuugc

SEQ ID NO: 1540030 - RNA, 13 nt, Pseudomonas aeruginosa PA01
gcguucuuggccg

SEQ ID NO: 1540031 - RNA, 20 nt, Pseudomonas aeruginosa PA01
gcguuuuucauuuccgccgg

SEQ ID NO: 1540032 - RNA, 16 nt, Pseudomonas aeruginosa PA01
gcguuuuuucuuucca

SEQ ID NO: 1540033 - RNA, 22 nt, Pseudomonas aeruginosa PA01
gcgcgccauggcgguuccucca

SEQ ID NO: 1540034 - RNA, 13 nt, Pseudomonas aeruginosa PA01
gcgcgccaguccc

SEQ ID NO: 1540035 - RNA, 14 nt, Pseudomonas aeruginosa PA01
gcgcgccagcgcca

SEQ ID NO: 1540036 - RNA, 13 nt, Pseudomonas aeruginosa PA01
gcgcgccagcgcc

SEQ ID NO: 1540037 - RNA, 16 nt, Pseudomonas aeruginosa PA01
gcgcgaucagccgcuc

SEQ ID NO: 1540038 - RNA, 22 nt, Pseudomonas aeruginosa PA01
gcgcgaucagccgcuccaggau

SEQ ID NO: 1540039 - RNA, 15 nt, Pseudomonas aeruginosa PA01
gcgcgcaucuggugc

SEQ ID NO: 1540040 - RNA, 24 nt, Pseudomonas aeruginosa PA01
gcgcgccaccgccuggucgccggg

SEQ ID NO: 1540041 - RNA, 18 nt, Pseudomonas aeruginosa PA01
gcgcgccagaagcggccg

SEQ ID NO: 1540042 - RNA, 14 nt, Pseudomonas aeruginosa PA01
gcgcgaggcgcagg

SEQ ID NO: 1540043 - RNA, 15 nt, Pseudomonas aeruginosa PA01
gcgcgaggcgcaggc

SEQ ID NO: 1540044 - RNA, 22 nt, Pseudomonas aeruginosa PA01
gcgcgauacccuggccggccuc

SEQ ID NO: 1540045 - RNA, 16 nt, Pseudomonas aeruginosa PA01
gcgcgauauccgccag

SEQ ID NO: 1540046 - RNA, 18 nt, Pseudomonas aeruginosa PA01
gcgcgauauccgccaggg

SEQ ID NO: 1540047 - RNA, 14 nt, Pseudomonas aeruginosa PA01
gcgcgauaucgcag

SEQ ID NO: 1540048 - RNA, 22 nt, Pseudomonas aeruginosa PA01
gcgcgauaucgcaggccaggcc

SEQ ID NO: 1540049 - RNA, 23 nt, Pseudomonas aeruginosa PA01
gcgcgauaucgcaggccaggccc

SEQ ID NO: 1540050 - RNA, 12 nt, Pseudomonas aeruginosa PA01
gcgcgacgaggc

SEQ ID NO: 1540051 - RNA, 14 nt, Pseudomonas aeruginosa PA01
gcgcgacgaggcgc

SEQ ID NO: 1540052 - RNA, 18 nt, Pseudomonas aeruginosa PA01
gcgcgacugucgagcagg

SEQ ID NO: 1540053 - RNA, 20 nt, Pseudomonas aeruginosa PA01
gcgcgacuuggacagcgucu

SEQ ID NO: 1540054 - RNA, 13 nt, Pseudomonas aeruginosa PA01
gcgcgagaaaaac

SEQ ID NO: 1540055 - RNA, 15 nt, Pseudomonas aeruginosa PA01
gcgcgaaccagcagc

SEQ ID NO: 1540056 - RNA, 16 nt, Pseudomonas aeruginosa PA01
gcgcgaaccagcagca

SEQ ID NO: 1540057 - RNA, 18 nt, Pseudomonas aeruginosa PA01
gcgccguucacgccuggc

SEQ ID NO: 1540058 - RNA, 19 nt, Pseudomonas aeruginosa PA01
gcgccguucacgccuggcg

SEQ ID NO: 1540059 - RNA, 23 nt, Pseudomonas aeruginosa PA01
gcgccguucacgccuggcggcug

SEQ ID NO: 1540060 - RNA, 19 nt, Pseudomonas aeruginosa PA01
gcgcgaaucuucggcgcgc

SEQ ID NO: 1540061 - RNA, 23 nt, Pseudomonas aeruginosa PA01
gcgcgaaggucguuggcaaagcc

SEQ ID NO: 1540062 - RNA, 22 nt, Pseudomonas aeruginosa PA01
gcgcgaagccaggaagcggcgg

SEQ ID NO: 1540063 - RNA, 14 nt, Pseudomonas aeruginosa PA01
gcgcgacaggcugg

SEQ ID NO: 1540064 - RNA, 18 nt, Pseudomonas aeruginosa PA01
gcgcgacacauggucggc

SEQ ID NO: 1540065 - RNA, 14 nt, Pseudomonas aeruginosa PA01
gcgcgacaucggcg

SEQ ID NO: 1540066 - RNA, 17 nt, Pseudomonas aeruginosa PA01
gcgcggaucagucagga

SEQ ID NO: 1540067 - RNA, 20 nt, Pseudomonas aeruginosa PA01
gcgcggauccccucccgcgc

SEQ ID NO: 1540068 - RNA, 18 nt, Pseudomonas aeruginosa PA01
gcgcggcagguggcuggc

SEQ ID NO: 1540069 - RNA, 21 nt, Pseudomonas aeruginosa PA01
gcgcggcacagcguggccagc

SEQ ID NO: 1540070 - RNA, 19 nt, Pseudomonas aeruginosa PA01
gcgcggccagcgcggccgc

SEQ ID NO: 1540071 - RNA, 19 nt, Pseudomonas aeruginosa PA01
gcgcggcauagcgcagccg

SEQ ID NO: 1540072 - RNA, 21 nt, Pseudomonas aeruginosa PA01
gcgcggcauagcgcagccgcu

SEQ ID NO: 1540073 - RNA, 16 nt, Pseudomonas aeruginosa PA01
gcgcggcgcuccaggc

SEQ ID NO: 1540074 - RNA, 20 nt, Pseudomonas aeruginosa PA01
gcgcggcgcggacauggcgc

SEQ ID NO: 1540075 - RNA, 14 nt, Pseudomonas aeruginosa PA01
gcgcggcgccugcu

SEQ ID NO: 1540076 - RNA, 17 nt, Pseudomonas aeruginosa PA01
gcgcggcgccgguugcu

SEQ ID NO: 1540077 - RNA, 18 nt, Pseudomonas aeruginosa PA01
gcgcggcgccagcgcccc

SEQ ID NO: 1540078 - RNA, 15 nt, Pseudomonas aeruginosa PA01
gcgcggcgcagcggc

SEQ ID NO: 1540079 - RNA, 17 nt, Pseudomonas aeruginosa PA01
gcgcggcgcagcggcga

SEQ ID NO: 1540080 - RNA, 22 nt, Pseudomonas aeruginosa PA01
gcgcggaauccuucgcggcggc

SEQ ID NO: 1540081 - RNA, 14 nt, Pseudomonas aeruginosa PA01
gcgcggacggccug

SEQ ID NO: 1540082 - RNA, 16 nt, Pseudomonas aeruginosa PA01
gcgcggacgaaccccg

SEQ ID NO: 1540083 - RNA, 17 nt, Pseudomonas aeruginosa PA01
gcgcggauauagcuggu

SEQ ID NO: 1540084 - RNA, 19 nt, Pseudomonas aeruginosa PA01
gcgcgcuuuccggcgcggc

SEQ ID NO: 1540085 - RNA, 15 nt, Pseudomonas aeruginosa PA01
gcgcgcuuccuccag

SEQ ID NO: 1540086 - RNA, 19 nt, Pseudomonas aeruginosa PA01
gcgcgcuuccuccaguagc

SEQ ID NO: 1540087 - RNA, 15 nt, Pseudomonas aeruginosa PA01
gcgcgcuggcgcagc

SEQ ID NO: 1540088 - RNA, 13 nt, Pseudomonas aeruginosa PA01
gcgcgccgcagua

SEQ ID NO: 1540089 - RNA, 12 nt, Pseudomonas aeruginosa PA01
gcgcgccgcgca

SEQ ID NO: 1540090 - RNA, 23 nt, Pseudomonas aeruginosa PA01
gcgcgccgccgaucugcuggguc

SEQ ID NO: 1540091 - RNA, 14 nt, Pseudomonas aeruginosa PA01
gcgcgccgccgccg

SEQ ID NO: 1540092 - RNA, 14 nt, Pseudomonas aeruginosa PA01
gcgcgcucucgccg

SEQ ID NO: 1540093 - RNA, 18 nt, Pseudomonas aeruginosa PA01
gcgcgcucuucgccgcgg

SEQ ID NO: 1540094 - RNA, 23 nt, Pseudomonas aeruginosa PA01
gcgcggggcccggcuccagccgg

SEQ ID NO: 1540095 - RNA, 17 nt, Pseudomonas aeruginosa PA01
gcgcgggccuucgccuu

SEQ ID NO: 1540096 - RNA, 15 nt, Pseudomonas aeruginosa PA01
gcgcgggccgacggc

SEQ ID NO: 1540097 - RNA, 20 nt, Pseudomonas aeruginosa PA01
gcgcgggccgacggcccucc

SEQ ID NO: 1540098 - RNA, 12 nt, Pseudomonas aeruginosa PA01
gcgcgggcgccg

SEQ ID NO: 1540099 - RNA, 13 nt, Pseudomonas aeruginosa PA01
gcgcgggcggccu

SEQ ID NO: 1540100 - RNA, 14 nt, Pseudomonas aeruginosa PA01
gcgcgggcggccuc

SEQ ID NO: 1540101 - RNA, 14 nt, Pseudomonas aeruginosa PA01
gcgcgucggccgcu

SEQ ID NO: 1540102 - RNA, 21 nt, Pseudomonas aeruginosa PA01
gcgcgucggugccgcccggcg

SEQ ID NO: 1540103 - RNA, 19 nt, Pseudomonas aeruginosa PA01
gcgcgucgguggcaggaaa

SEQ ID NO: 1540104 - RNA, 23 nt, Pseudomonas aeruginosa PA01
gcgcguuccacguccuccaggcu

SEQ ID NO: 1540105 - RNA, 16 nt, Pseudomonas aeruginosa PA01
gcgcguucagccacgg

SEQ ID NO: 1540106 - RNA, 20 nt, Pseudomonas aeruginosa PA01
gcgcuacgcucgccgacggc

SEQ ID NO: 1540107 - RNA, 19 nt, Pseudomonas aeruginosa PA01
gcgcuaccgcgcauggcgg

SEQ ID NO: 1540108 - RNA, 14 nt, Pseudomonas aeruginosa PA01
gcgcguuucucagc

SEQ ID NO: 1540109 - RNA, 12 nt, Pseudomonas aeruginosa PA01
gcgcucagggaa

SEQ ID NO: 1540110 - RNA, 19 nt, Pseudomonas aeruginosa PA01
gcgcuaucggcccggggcu

SEQ ID NO: 1540111 - RNA, 19 nt, Pseudomonas aeruginosa PA01
gcgcucaacgccucgcggc

SEQ ID NO: 1540112 - RNA, 21 nt, Pseudomonas aeruginosa PA01
gcgcucaccgaggcgaacggc

SEQ ID NO: 1540113 - RNA, 13 nt, Pseudomonas aeruginosa PA01
gcgcucucgccgg

SEQ ID NO: 1540114 - RNA, 14 nt, Pseudomonas aeruginosa PA01
gcgcucucgccggc

SEQ ID NO: 1540115 - RNA, 19 nt, Pseudomonas aeruginosa PA01
gcgcugcaucggcgcgccg

SEQ ID NO: 1540116 - RNA, 23 nt, Pseudomonas aeruginosa PA01
gcgcugccacaguuucauggugc

SEQ ID NO: 1540117 - RNA, 13 nt, Pseudomonas aeruginosa PA01
gcgcugccagcgc

SEQ ID NO: 1540118 - RNA, 16 nt, Pseudomonas aeruginosa PA01
gcgcugccaguggcgg

SEQ ID NO: 1540119 - RNA, 20 nt, Pseudomonas aeruginosa PA01
gcgcugccccuggcucaggc

SEQ ID NO: 1540120 - RNA, 21 nt, Pseudomonas aeruginosa PA01
gcgcugccccuggcucaggca

SEQ ID NO: 1540121 - RNA, 16 nt, Pseudomonas aeruginosa PA01
gcgcugcaaucgcugc

SEQ ID NO: 1540122 - RNA, 19 nt, Pseudomonas aeruginosa PA01
gcgcugcccggguugaggu

SEQ ID NO: 1540123 - RNA, 15 nt, Pseudomonas aeruginosa PA01
gcgcugcccggcgcg

SEQ ID NO: 1540124 - RNA, 16 nt, Pseudomonas aeruginosa PA01
gcgcugccggccaggg

SEQ ID NO: 1540125 - RNA, 23 nt, Pseudomonas aeruginosa PA01
gcgcugccggccagggucgccag

SEQ ID NO: 1540126 - RNA, 12 nt, Pseudomonas aeruginosa PA01
gcgcugccucgg

SEQ ID NO: 1540127 - RNA, 15 nt, Pseudomonas aeruginosa PA01
gcgcugcgccaggcc

SEQ ID NO: 1540128 - RNA, 21 nt, Pseudomonas aeruginosa PA01
gcgcugcgugcgccgcucgcg

SEQ ID NO: 1540129 - RNA, 21 nt, Pseudomonas aeruginosa PA01
gcgcugcguggguagccgccc

SEQ ID NO: 1540130 - RNA, 20 nt, Pseudomonas aeruginosa PA01
gcgcugcgggucauuggcga

SEQ ID NO: 1540131 - RNA, 17 nt, Pseudomonas aeruginosa PA01
gcgcugcggcagggugg

SEQ ID NO: 1540132 - RNA, 14 nt, Pseudomonas aeruginosa PA01
gcgcugcgcggccu

SEQ ID NO: 1540133 - RNA, 16 nt, Pseudomonas aeruginosa PA01
gcgcugcgcggccugc

SEQ ID NO: 1540134 - RNA, 13 nt, Pseudomonas aeruginosa PA01
gcgcuccaggcgg

SEQ ID NO: 1540135 - RNA, 14 nt, Pseudomonas aeruginosa PA01
gcgcuccgccaggc

SEQ ID NO: 1540136 - RNA, 18 nt, Pseudomonas aeruginosa PA01
gcgcuccggaacgccugc

SEQ ID NO: 1540137 - RNA, 21 nt, Pseudomonas aeruginosa PA01
gcgcuccuggagguucggcag

SEQ ID NO: 1540138 - RNA, 13 nt, Pseudomonas aeruginosa PA01
gcgcuccuggugc

SEQ ID NO: 1540139 - RNA, 21 nt, Pseudomonas aeruginosa PA01
gcgcuccggcgcgccauggcg

SEQ ID NO: 1540140 - RNA, 20 nt, Pseudomonas aeruginosa PA01
gcgcucaugaaaaagccccu

SEQ ID NO: 1540141 - RNA, 15 nt, Pseudomonas aeruginosa PA01
gcgcuccaccagggc

SEQ ID NO: 1540142 - RNA, 20 nt, Pseudomonas aeruginosa PA01
gcgcuccaccagggccucgg

SEQ ID NO: 1540143 - RNA, 23 nt, Pseudomonas aeruginosa PA01
gcgcuccaccagggccucggggc

SEQ ID NO: 1540144 - RNA, 14 nt, Pseudomonas aeruginosa PA01
gcgcuccacccagg

SEQ ID NO: 1540145 - RNA, 16 nt, Pseudomonas aeruginosa PA01
gcgcuccacccaggcg

SEQ ID NO: 1540146 - RNA, 18 nt, Pseudomonas aeruginosa PA01
gcgcuccaccgcccccgg

SEQ ID NO: 1540147 - RNA, 22 nt, Pseudomonas aeruginosa PA01
gcgcucgacgaucaggugcagg

SEQ ID NO: 1540148 - RNA, 16 nt, Pseudomonas aeruginosa PA01
gcgcucggccaggucg

SEQ ID NO: 1540149 - RNA, 17 nt, Pseudomonas aeruginosa PA01
gcgcucggccgccuggc

SEQ ID NO: 1540150 - RNA, 21 nt, Pseudomonas aeruginosa PA01
gcgcucgacauacuccgccgc

SEQ ID NO: 1540151 - RNA, 18 nt, Pseudomonas aeruginosa PA01
gcgcuccuucuccggggc

SEQ ID NO: 1540152 - RNA, 13 nt, Pseudomonas aeruginosa PA01
gcgcuccuuggcu

SEQ ID NO: 1540153 - RNA, 15 nt, Pseudomonas aeruginosa PA01
gcgcuccuuggcugg

SEQ ID NO: 1540154 - RNA, 20 nt, Pseudomonas aeruginosa PA01
gcgcuccuuggcuggccagc

SEQ ID NO: 1540155 - RNA, 16 nt, Pseudomonas aeruginosa PA01
gcgcucggucagcucc

SEQ ID NO: 1540156 - RNA, 19 nt, Pseudomonas aeruginosa PA01
gcgcucggcgcucggcucc

SEQ ID NO: 1540157 - RNA, 14 nt, Pseudomonas aeruginosa PA01
gcgcucggcggccu

SEQ ID NO: 1540158 - RNA, 15 nt, Pseudomonas aeruginosa PA01
gcgcucggcggccuc

SEQ ID NO: 1540159 - RNA, 16 nt, Pseudomonas aeruginosa PA01
gcgcucggcggccucg

SEQ ID NO: 1540160 - RNA, 17 nt, Pseudomonas aeruginosa PA01
gcgcucggcggccucgc

SEQ ID NO: 1540161 - RNA, 20 nt, Pseudomonas aeruginosa PA01
gcgcucggcggcgcgcagcg

SEQ ID NO: 1540162 - RNA, 20 nt, Pseudomonas aeruginosa PA01
gcgcucggcuccagccaggc

SEQ ID NO: 1540163 - RNA, 20 nt, Pseudomonas aeruginosa PA01
gcgcucgggauggcccccac

SEQ ID NO: 1540164 - RNA, 23 nt, Pseudomonas aeruginosa PA01
gcgcucguagguuuccggguccu

SEQ ID NO: 1540165 - RNA, 16 nt, Pseudomonas aeruginosa PA01
gcgcucguagccggcg

SEQ ID NO: 1540166 - RNA, 20 nt, Pseudomonas aeruginosa PA01
gcgcucguagccggcgcggc

SEQ ID NO: 1540167 - RNA, 17 nt, Pseudomonas aeruginosa PA01
gcgccgagcuggcgcgc

SEQ ID NO: 1540168 - RNA, 20 nt, Pseudomonas aeruginosa PA01
gcgccgagcuggcgcgcguc

SEQ ID NO: 1540169 - RNA, 13 nt, Pseudomonas aeruginosa PA01
gcgccgaggcccu

SEQ ID NO: 1540170 - RNA, 19 nt, Pseudomonas aeruginosa PA01
gcgccgcaaguggcggcug

SEQ ID NO: 1540171 - RNA, 12 nt, Pseudomonas aeruginosa PA01
gcgccgaugccg

SEQ ID NO: 1540172 - RNA, 17 nt, Pseudomonas aeruginosa PA01
gcgccgaugcccaggcc

SEQ ID NO: 1540173 - RNA, 18 nt, Pseudomonas aeruginosa PA01
gcgccgaugcccaggccg

SEQ ID NO: 1540174 - RNA, 22 nt, Pseudomonas aeruginosa PA01
gcgccgccaccgccaccgccgg

SEQ ID NO: 1540175 - RNA, 13 nt, Pseudomonas aeruginosa PA01
gcgccgccagcag

SEQ ID NO: 1540176 - RNA, 14 nt, Pseudomonas aeruginosa PA01
gcgccgccagcagg

SEQ ID NO: 1540177 - RNA, 22 nt, Pseudomonas aeruginosa PA01
gcgccgccagcaggucggccug

SEQ ID NO: 1540178 - RNA, 24 nt, Pseudomonas aeruginosa PA01
gcgccgccagcaggucggccugcu

SEQ ID NO: 1540179 - RNA, 20 nt, Pseudomonas aeruginosa PA01
gcgccgccacgugcacgccg

SEQ ID NO: 1540180 - RNA, 13 nt, Pseudomonas aeruginosa PA01
gcgccgccaggcc

SEQ ID NO: 1540181 - RNA, 23 nt, Pseudomonas aeruginosa PA01
gcgccgccaggcccugggcggcg

SEQ ID NO: 1540182 - RNA, 12 nt, Pseudomonas aeruginosa PA01
gcgccgccaggc

SEQ ID NO: 1540183 - RNA, 23 nt, Pseudomonas aeruginosa PA01
gcgccgccaggcagaccaggccg

SEQ ID NO: 1540184 - RNA, 15 nt, Pseudomonas aeruginosa PA01
gcgccgcagggccca

SEQ ID NO: 1540185 - RNA, 18 nt, Pseudomonas aeruginosa PA01
gcgccgcauuggccaggc

SEQ ID NO: 1540186 - RNA, 15 nt, Pseudomonas aeruginosa PA01
gcgccgacccagagc

SEQ ID NO: 1540187 - RNA, 19 nt, Pseudomonas aeruginosa PA01
gcgccgacccagagcgcgc

SEQ ID NO: 1540188 - RNA, 21 nt, Pseudomonas aeruginosa PA01
gcgccgacccagagcgcgccc

SEQ ID NO: 1540189 - RNA, 17 nt, Pseudomonas aeruginosa PA01
gcgccgacgccaccagc

SEQ ID NO: 1540190 - RNA, 23 nt, Pseudomonas aeruginosa PA01
gcgccgacgccaccagccaggcg

SEQ ID NO: 1540191 - RNA, 16 nt, Pseudomonas aeruginosa PA01
gcgccgaccgcgcgcc

SEQ ID NO: 1540192 - RNA, 17 nt, Pseudomonas aeruginosa PA01
gcgccgaccgcgcgccu

SEQ ID NO: 1540193 - RNA, 18 nt, Pseudomonas aeruginosa PA01
gcgccgaccgcgcgccug

SEQ ID NO: 1540194 - RNA, 14 nt, Pseudomonas aeruginosa PA01
gcgccgagccggcu

SEQ ID NO: 1540195 - RNA, 22 nt, Pseudomonas aeruginosa PA01
gcgccgagcauuccgacaagga

SEQ ID NO: 1540196 - RNA, 18 nt, Pseudomonas aeruginosa PA01
gcgccgaacagggcgagc

SEQ ID NO: 1540197 - RNA, 21 nt, Pseudomonas aeruginosa PA01
gcgccgaaaaaaaggggcccg

SEQ ID NO: 1540198 - RNA, 20 nt, Pseudomonas aeruginosa PA01
gcgcccuuguacucgauggu

SEQ ID NO: 1540199 - RNA, 22 nt, Pseudomonas aeruginosa PA01
gcgccgaaggcgucaguuccgc

SEQ ID NO: 1540200 - RNA, 12 nt, Pseudomonas aeruginosa PA01
gcgccgaaggcc

SEQ ID NO: 1540201 - RNA, 14 nt, Pseudomonas aeruginosa PA01
gcgccggugcauga

SEQ ID NO: 1540202 - RNA, 23 nt, Pseudomonas aeruginosa PA01
gcgccggugcaugaaggcgcuga

SEQ ID NO: 1540203 - RNA, 15 nt, Pseudomonas aeruginosa PA01
gcgccggugaggcgc

SEQ ID NO: 1540204 - RNA, 21 nt, Pseudomonas aeruginosa PA01
gcgccggugaggcgcagcagc

SEQ ID NO: 1540205 - RNA, 22 nt, Pseudomonas aeruginosa PA01
gcgccggugaggcgcagcagcg

SEQ ID NO: 1540206 - RNA, 17 nt, Pseudomonas aeruginosa PA01
gcgccggcggaucacag

SEQ ID NO: 1540207 - RNA, 22 nt, Pseudomonas aeruginosa PA01
gcgccgguuucgaccggcgcgc

SEQ ID NO: 1540208 - RNA, 13 nt, Pseudomonas aeruginosa PA01
gcgccgguugcug

SEQ ID NO: 1540209 - RNA, 23 nt, Pseudomonas aeruginosa PA01
gcgccggccuccagcgccuggcg

SEQ ID NO: 1540210 - RNA, 12 nt, Pseudomonas aeruginosa PA01
gcgccggcgcug

SEQ ID NO: 1540211 - RNA, 16 nt, Pseudomonas aeruginosa PA01
gcgccggcgcgcggcg

SEQ ID NO: 1540212 - RNA, 13 nt, Pseudomonas aeruginosa PA01
gcgccggccgggc

SEQ ID NO: 1540213 - RNA, 16 nt, Pseudomonas aeruginosa PA01
gcgccggcgaucgcca

SEQ ID NO: 1540214 - RNA, 17 nt, Pseudomonas aeruginosa PA01
gcgccggcgaucgccag

SEQ ID NO: 1540215 - RNA, 18 nt, Pseudomonas aeruginosa PA01
gcgccgucaccagcagcc

SEQ ID NO: 1540216 - RNA, 21 nt, Pseudomonas aeruginosa PA01
gcgccgucaccagcagccccg

SEQ ID NO: 1540217 - RNA, 16 nt, Pseudomonas aeruginosa PA01
gcgccguacgcaccgc

SEQ ID NO: 1540218 - RNA, 21 nt, Pseudomonas aeruginosa PA01
gcgccgucaucgcugaccugg

SEQ ID NO: 1540219 - RNA, 19 nt, Pseudomonas aeruginosa PA01
gcgccguggaucgcccggc

SEQ ID NO: 1540220 - RNA, 15 nt, Pseudomonas aeruginosa PA01
gcgccggccagagcu

SEQ ID NO: 1540221 - RNA, 17 nt, Pseudomonas aeruginosa PA01
gcgccggcaugacggau

SEQ ID NO: 1540222 - RNA, 13 nt, Pseudomonas aeruginosa PA01
gcgccggcccagc

SEQ ID NO: 1540223 - RNA, 16 nt, Pseudomonas aeruginosa PA01
gcgccggcccagcagg

SEQ ID NO: 1540224 - RNA, 15 nt, Pseudomonas aeruginosa PA01
gcgccggaucggcug

SEQ ID NO: 1540225 - RNA, 18 nt, Pseudomonas aeruginosa PA01
gcgccggcagcucggccg

SEQ ID NO: 1540226 - RNA, 14 nt, Pseudomonas aeruginosa PA01
gcgccggcaggccu

SEQ ID NO: 1540227 - RNA, 17 nt, Pseudomonas aeruginosa PA01
gcgccgcgggucaccag

SEQ ID NO: 1540228 - RNA, 16 nt, Pseudomonas aeruginosa PA01
gcgccggagcugguca

SEQ ID NO: 1540229 - RNA, 12 nt, Pseudomonas aeruginosa PA01
gcgccgcggccc

SEQ ID NO: 1540230 - RNA, 15 nt, Pseudomonas aeruginosa PA01
gcgccgcggcccggc

SEQ ID NO: 1540231 - RNA, 13 nt, Pseudomonas aeruginosa PA01
gcgccgcggcggc

SEQ ID NO: 1540232 - RNA, 22 nt, Pseudomonas aeruginosa PA01
gcgccgcggcggcgugcaggcc

SEQ ID NO: 1540233 - RNA, 14 nt, Pseudomonas aeruginosa PA01
gcgccgcggcuggc

SEQ ID NO: 1540234 - RNA, 21 nt, Pseudomonas aeruginosa PA01
gcgccgcgcguucgcgcgagg

SEQ ID NO: 1540235 - RNA, 18 nt, Pseudomonas aeruginosa PA01
gcgccgcccggcucgccg

SEQ ID NO: 1540236 - RNA, 22 nt, Pseudomonas aeruginosa PA01
gcgccgcccggcucgccgccgg

SEQ ID NO: 1540237 - RNA, 13 nt, Pseudomonas aeruginosa PA01
gcgccgcccccgg

SEQ ID NO: 1540238 - RNA, 19 nt, Pseudomonas aeruginosa PA01
gcgccgccaggcgcgucuc

SEQ ID NO: 1540239 - RNA, 19 nt, Pseudomonas aeruginosa PA01
gcgccgccaggcaggccgg

SEQ ID NO: 1540240 - RNA, 20 nt, Pseudomonas aeruginosa PA01
gcgccgccaggcaggccggg

SEQ ID NO: 1540241 - RNA, 23 nt, Pseudomonas aeruginosa PA01
gcgccgccaggcaggccgggcug

SEQ ID NO: 1540242 - RNA, 15 nt, Pseudomonas aeruginosa PA01
gcgccccugcggcgc

SEQ ID NO: 1540243 - RNA, 23 nt, Pseudomonas aeruginosa PA01
gcgccccggucucgcgcagcggc

SEQ ID NO: 1540244 - RNA, 19 nt, Pseudomonas aeruginosa PA01
gcgccccuuggccagcacc

SEQ ID NO: 1540245 - RNA, 14 nt, Pseudomonas aeruginosa PA01
gcgcccgagggcgc

SEQ ID NO: 1540246 - RNA, 21 nt, Pseudomonas aeruginosa PA01
gcgcccgauaggcgccggcgc

SEQ ID NO: 1540247 - RNA, 23 nt, Pseudomonas aeruginosa PA01
gcgcccgccgcgagcgccgccgg

SEQ ID NO: 1540248 - RNA, 20 nt, Pseudomonas aeruginosa PA01
gcgcccgaugaucgagcgca

SEQ ID NO: 1540249 - RNA, 21 nt, Pseudomonas aeruginosa PA01
gcgcccccagcgcccgcacca

SEQ ID NO: 1540250 - RNA, 12 nt, Pseudomonas aeruginosa PA01
gcgccccagcgc

SEQ ID NO: 1540251 - RNA, 16 nt, Pseudomonas aeruginosa PA01
gcgcccccaucugcac

SEQ ID NO: 1540252 - RNA, 15 nt, Pseudomonas aeruginosa PA01
gcgccccggccgcgc

SEQ ID NO: 1540253 - RNA, 22 nt, Pseudomonas aeruginosa PA01
gcgccccgccuaccggggcgcg

SEQ ID NO: 1540254 - RNA, 14 nt, Pseudomonas aeruginosa PA01
gcgcccccuggccg

SEQ ID NO: 1540255 - RNA, 18 nt, Pseudomonas aeruginosa PA01
gcgccccaggcgcccagg

SEQ ID NO: 1540256 - RNA, 15 nt, Pseudomonas aeruginosa PA01
gcgccccaggcgggc

SEQ ID NO: 1540257 - RNA, 19 nt, Pseudomonas aeruginosa PA01
gcgcccuagucgaggggaa

SEQ ID NO: 1540258 - RNA, 12 nt, Pseudomonas aeruginosa PA01
gcgcccucccgc

SEQ ID NO: 1540259 - RNA, 18 nt, Pseudomonas aeruginosa PA01
gcgcccggcuucggcggc

SEQ ID NO: 1540260 - RNA, 16 nt, Pseudomonas aeruginosa PA01
gcgcccguagcacaug

SEQ ID NO: 1540261 - RNA, 15 nt, Pseudomonas aeruginosa PA01
gcgcccugcaggccg

SEQ ID NO: 1540262 - RNA, 17 nt, Pseudomonas aeruginosa PA01
gcgcccuucagcgccuc

SEQ ID NO: 1540263 - RNA, 14 nt, Pseudomonas aeruginosa PA01
gcgcccugggcgcg

SEQ ID NO: 1540264 - RNA, 16 nt, Pseudomonas aeruginosa PA01
gcgcccggcgccaggc

SEQ ID NO: 1540265 - RNA, 14 nt, Pseudomonas aeruginosa PA01
gcgcccggcgcccu

SEQ ID NO: 1540266 - RNA, 23 nt, Pseudomonas aeruginosa PA01
gcgcccggccuucaccgcgccgc

SEQ ID NO: 1540267 - RNA, 19 nt, Pseudomonas aeruginosa PA01
gcgcccggcgaacagcgcu

SEQ ID NO: 1540268 - RNA, 19 nt, Pseudomonas aeruginosa PA01
gcgcccggcacgcuccagg

SEQ ID NO: 1540269 - RNA, 12 nt, Pseudomonas aeruginosa PA01
gcgcccggccuc

SEQ ID NO: 1540270 - RNA, 18 nt, Pseudomonas aeruginosa PA01
gcgcccggccuccccggc

SEQ ID NO: 1540271 - RNA, 14 nt, Pseudomonas aeruginosa PA01
gcgcccggccaggc

SEQ ID NO: 1540272 - RNA, 18 nt, Pseudomonas aeruginosa PA01
gcgcccggccaggccgcc

SEQ ID NO: 1540273 - RNA, 22 nt, Pseudomonas aeruginosa PA01
gcgcccggccaggccgcccagg

SEQ ID NO: 1540274 - RNA, 21 nt, Pseudomonas aeruginosa PA01
gcgcccgccuuguucgccagc

SEQ ID NO: 1540275 - RNA, 22 nt, Pseudomonas aeruginosa PA01
gcgcccgccgucauggcgggcg

SEQ ID NO: 1540276 - RNA, 12 nt, Pseudomonas aeruginosa PA01
gcgcccgccggc

SEQ ID NO: 1540277 - RNA, 22 nt, Pseudomonas aeruginosa PA01
gcgccaguccacgacgaacggc

SEQ ID NO: 1540278 - RNA, 15 nt, Pseudomonas aeruginosa PA01
gcgccaugccguuca

SEQ ID NO: 1540279 - RNA, 22 nt, Pseudomonas aeruginosa PA01
gcgccaugccguucaggccggc

SEQ ID NO: 1540280 - RNA, 23 nt, Pseudomonas aeruginosa PA01
gcgccaugccguucaggccggcg

SEQ ID NO: 1540281 - RNA, 15 nt, Pseudomonas aeruginosa PA01
gcgcccaggcccagc

SEQ ID NO: 1540282 - RNA, 13 nt, Pseudomonas aeruginosa PA01
gcgcccaggcugc

SEQ ID NO: 1540283 - RNA, 14 nt, Pseudomonas aeruginosa PA01
gcgcccaggcugcc

SEQ ID NO: 1540284 - RNA, 15 nt, Pseudomonas aeruginosa PA01
gcgcccaggcugccg

SEQ ID NO: 1540285 - RNA, 17 nt, Pseudomonas aeruginosa PA01
gcgcccaggcugccggc

SEQ ID NO: 1540286 - RNA, 21 nt, Pseudomonas aeruginosa PA01
gcgcccaggcugccggccagg

SEQ ID NO: 1540287 - RNA, 16 nt, Pseudomonas aeruginosa PA01
gcgcccagggacgcgc

SEQ ID NO: 1540288 - RNA, 15 nt, Pseudomonas aeruginosa PA01
gcgccauugccgcca

SEQ ID NO: 1540289 - RNA, 18 nt, Pseudomonas aeruginosa PA01
gcgccauugccgccaggu

SEQ ID NO: 1540290 - RNA, 20 nt, Pseudomonas aeruginosa PA01
gcgccauugccgccaggugu

SEQ ID NO: 1540291 - RNA, 12 nt, Pseudomonas aeruginosa PA01
gcgccaugcugu

SEQ ID NO: 1540292 - RNA, 19 nt, Pseudomonas aeruginosa PA01
gcgcccaaugcaucggccg

SEQ ID NO: 1540293 - RNA, 14 nt, Pseudomonas aeruginosa PA01
gcgccaggccgccg

SEQ ID NO: 1540294 - RNA, 15 nt, Pseudomonas aeruginosa PA01
gcgccaggccgccga

SEQ ID NO: 1540295 - RNA, 17 nt, Pseudomonas aeruginosa PA01
gcgccagggccagggaa

SEQ ID NO: 1540296 - RNA, 21 nt, Pseudomonas aeruginosa PA01
gcgccagggccagggaaauca

SEQ ID NO: 1540297 - RNA, 12 nt, Pseudomonas aeruginosa PA01
gcgccagggacg

SEQ ID NO: 1540298 - RNA, 21 nt, Pseudomonas aeruginosa PA01
gcgccagggacgcgcagcggc

SEQ ID NO: 1540299 - RNA, 18 nt, Pseudomonas aeruginosa PA01
gcgccagguuggccuggc

SEQ ID NO: 1540300 - RNA, 20 nt, Pseudomonas aeruginosa PA01
gcgccagguuggccuggccc

SEQ ID NO: 1540301 - RNA, 19 nt, Pseudomonas aeruginosa PA01
gcgccaguacuccgagggc

SEQ ID NO: 1540302 - RNA, 22 nt, Pseudomonas aeruginosa PA01
gcgccaguacuccgagggccgc

SEQ ID NO: 1540303 - RNA, 23 nt, Pseudomonas aeruginosa PA01
gcgccagggccgggucaucaccg

SEQ ID NO: 1540304 - RNA, 10 nt, Pseudomonas aeruginosa PA01
gcgccaggcu

SEQ ID NO: 1540305 - RNA, 19 nt, Pseudomonas aeruginosa PA01
gcgccagguagugccgccc

SEQ ID NO: 1540306 - RNA, 20 nt, Pseudomonas aeruginosa PA01
gcgccagguagugccgcccu

SEQ ID NO: 1540307 - RNA, 23 nt, Pseudomonas aeruginosa PA01
gcgcaggauguugaacaggcucg

SEQ ID NO: 1540308 - RNA, 17 nt, Pseudomonas aeruginosa PA01
gcgcaggaccacgcugg

SEQ ID NO: 1540309 - RNA, 15 nt, Pseudomonas aeruginosa PA01
gcgcaggaccuggcu

SEQ ID NO: 1540310 - RNA, 14 nt, Pseudomonas aeruginosa PA01
gcgcaggccgccgg

SEQ ID NO: 1540311 - RNA, 14 nt, Pseudomonas aeruginosa PA01
gcgcaggccgggaa

SEQ ID NO: 1540312 - RNA, 13 nt, Pseudomonas aeruginosa PA01
gcgcaggccgggc

SEQ ID NO: 1540313 - RNA, 22 nt, Pseudomonas aeruginosa PA01
gcgccacucggcgugccgggcc

SEQ ID NO: 1540314 - RNA, 22 nt, Pseudomonas aeruginosa PA01
gcgccagaacggcuuguucagc

SEQ ID NO: 1540315 - RNA, 12 nt, Pseudomonas aeruginosa PA01
gcgccagcgaga

SEQ ID NO: 1540316 - RNA, 19 nt, Pseudomonas aeruginosa PA01
gcgccagcgagacgggcga

SEQ ID NO: 1540317 - RNA, 16 nt, Pseudomonas aeruginosa PA01
gcgccagcgccacggc

SEQ ID NO: 1540318 - RNA, 13 nt, Pseudomonas aeruginosa PA01
gcgccagcggccc

SEQ ID NO: 1540319 - RNA, 16 nt, Pseudomonas aeruginosa PA01
gcgccagcggcccggc

SEQ ID NO: 1540320 - RNA, 14 nt, Pseudomonas aeruginosa PA01
gcgccagcggcagc

SEQ ID NO: 1540321 - RNA, 22 nt, Pseudomonas aeruginosa PA01
gcgccagagaucgcccagcggc

SEQ ID NO: 1540322 - RNA, 13 nt, Pseudomonas aeruginosa PA01
gcgccagagcagg

SEQ ID NO: 1540323 - RNA, 15 nt, Pseudomonas aeruginosa PA01
gcgaucagggccucg

SEQ ID NO: 1540324 - RNA, 15 nt, Pseudomonas aeruginosa PA01
gcgauccaccgccag

SEQ ID NO: 1540325 - RNA, 14 nt, Pseudomonas aeruginosa PA01
gcgaucaucgccac

SEQ ID NO: 1540326 - RNA, 22 nt, Pseudomonas aeruginosa PA01
gcgauagaccaggaaggccggg

SEQ ID NO: 1540327 - RNA, 16 nt, Pseudomonas aeruginosa PA01
gcgauagacgccggcg

SEQ ID NO: 1540328 - RNA, 16 nt, Pseudomonas aeruginosa PA01
gcgauacaggcgguga

SEQ ID NO: 1540329 - RNA, 12 nt, Pseudomonas aeruginosa PA01
gcgaggggcgga

SEQ ID NO: 1540330 - RNA, 22 nt, Pseudomonas aeruginosa PA01
gcgagggggccucggccagcgc

SEQ ID NO: 1540331 - RNA, 13 nt, Pseudomonas aeruginosa PA01
gcgagggcggcga

SEQ ID NO: 1540332 - RNA, 13 nt, Pseudomonas aeruginosa PA01
gcgagggcggcgc

SEQ ID NO: 1540333 - RNA, 14 nt, Pseudomonas aeruginosa PA01
gcgagggcggcggc

SEQ ID NO: 1540334 - RNA, 15 nt, Pseudomonas aeruginosa PA01
gcgauccuggcggca

SEQ ID NO: 1540335 - RNA, 15 nt, Pseudomonas aeruginosa PA01
gcgaucgccgcggcg

SEQ ID NO: 1540336 - RNA, 13 nt, Pseudomonas aeruginosa PA01
gcgauccuccgcc

SEQ ID NO: 1540337 - RNA, 16 nt, Pseudomonas aeruginosa PA01
gcgauccuccgccagc

SEQ ID NO: 1540338 - RNA, 20 nt, Pseudomonas aeruginosa PA01
gcgauccgcccgcaugccag

SEQ ID NO: 1540339 - RNA, 13 nt, Pseudomonas aeruginosa PA01
gcgauccgcugca

SEQ ID NO: 1540340 - RNA, 13 nt, Pseudomonas aeruginosa PA01
gcgaugaucuggc

SEQ ID NO: 1540341 - RNA, 18 nt, Pseudomonas aeruginosa PA01
gcgaugaucuggccaccc

SEQ ID NO: 1540342 - RNA, 24 nt, Pseudomonas aeruginosa PA01
gcgaugaccagcucggcgggacgg

SEQ ID NO: 1540343 - RNA, 17 nt, Pseudomonas aeruginosa PA01
gcgaugaccgccccggc

SEQ ID NO: 1540344 - RNA, 17 nt, Pseudomonas aeruginosa PA01
gcgagcaacgcagguca

SEQ ID NO: 1540345 - RNA, 17 nt, Pseudomonas aeruginosa PA01
gcgagcgaaacggcgcu

SEQ ID NO: 1540346 - RNA, 12 nt, Pseudomonas aeruginosa PA01
gcgagcgcccgc

SEQ ID NO: 1540347 - RNA, 13 nt, Pseudomonas aeruginosa PA01
gcgagcgccgcgg

SEQ ID NO: 1540348 - RNA, 15 nt, Pseudomonas aeruginosa PA01
gcgagcgccgcggcg

SEQ ID NO: 1540349 - RNA, 15 nt, Pseudomonas aeruginosa PA01
gcgagccgcgcugcu

SEQ ID NO: 1540350 - RNA, 16 nt, Pseudomonas aeruginosa PA01
gcgagccgcgcugcug

SEQ ID NO: 1540351 - RNA, 14 nt, Pseudomonas aeruginosa PA01
gcgagccgccgggc

SEQ ID NO: 1540352 - RNA, 20 nt, Pseudomonas aeruginosa PA01
gcgagccgcgacggcugcuc

SEQ ID NO: 1540353 - RNA, 16 nt, Pseudomonas aeruginosa PA01
gcgagccgaucaccag

SEQ ID NO: 1540354 - RNA, 17 nt, Pseudomonas aeruginosa PA01
gcgagccgaucaccagc

SEQ ID NO: 1540355 - RNA, 16 nt, Pseudomonas aeruginosa PA01
gcgagccgcagcggcu

SEQ ID NO: 1540356 - RNA, 20 nt, Pseudomonas aeruginosa PA01
gcgaggagccguagggcgca

SEQ ID NO: 1540357 - RNA, 17 nt, Pseudomonas aeruginosa PA01
gcgaggagguuggucug

SEQ ID NO: 1540358 - RNA, 23 nt, Pseudomonas aeruginosa PA01
gcgaggagguuggucugcucggc

SEQ ID NO: 1540359 - RNA, 16 nt, Pseudomonas aeruginosa PA01
gcgaggauuuccggcu

SEQ ID NO: 1540360 - RNA, 20 nt, Pseudomonas aeruginosa PA01
gcgaggaucgcgcuggccag

SEQ ID NO: 1540361 - RNA, 13 nt, Pseudomonas aeruginosa PA01
gcgaggcgcccgc

SEQ ID NO: 1540362 - RNA, 12 nt, Pseudomonas aeruginosa PA01
gcgaggccgcuc

SEQ ID NO: 1540363 - RNA, 20 nt, Pseudomonas aeruginosa PA01
gcgaggcgcucuucacuucc

SEQ ID NO: 1540364 - RNA, 16 nt, Pseudomonas aeruginosa PA01
gcgaggcccgcgccgc

SEQ ID NO: 1540365 - RNA, 22 nt, Pseudomonas aeruginosa PA01
gcgaggcccguauggcgggccu

SEQ ID NO: 1540366 - RNA, 18 nt, Pseudomonas aeruginosa PA01
gcgaggcguuccaggugg

SEQ ID NO: 1540367 - RNA, 19 nt, Pseudomonas aeruginosa PA01
gcgaggcuaacgccgagga

SEQ ID NO: 1540368 - RNA, 21 nt, Pseudomonas aeruginosa PA01
gcgacucguugcacgcaggcc

SEQ ID NO: 1540369 - RNA, 20 nt, Pseudomonas aeruginosa PA01
gcgacuggggcaucucggcc

SEQ ID NO: 1540370 - RNA, 20 nt, Pseudomonas aeruginosa PA01
gcgagacuaccgaucggcug

SEQ ID NO: 1540371 - RNA, 22 nt, Pseudomonas aeruginosa PA01
gcgagacuaccgaucggcugcc

SEQ ID NO: 1540372 - RNA, 15 nt, Pseudomonas aeruginosa PA01
gcgagaggggcgcuc

SEQ ID NO: 1540373 - RNA, 13 nt, Pseudomonas aeruginosa PA01
gcgagaggucggc

SEQ ID NO: 1540374 - RNA, 19 nt, Pseudomonas aeruginosa PA01
gcgacgaucagcccgccgg

SEQ ID NO: 1540375 - RNA, 21 nt, Pseudomonas aeruginosa PA01
gcgacgaucagcccgccggcg

SEQ ID NO: 1540376 - RNA, 15 nt, Pseudomonas aeruginosa PA01
gcgacgagccggacg

SEQ ID NO: 1540377 - RNA, 18 nt, Pseudomonas aeruginosa PA01
gcgacgaggcgcggcgga

SEQ ID NO: 1540378 - RNA, 22 nt, Pseudomonas aeruginosa PA01
gcgacgaucacccccagcgagc

SEQ ID NO: 1540379 - RNA, 21 nt, Pseudomonas aeruginosa PA01
gcgaccuugacgaagccggcg

SEQ ID NO: 1540380 - RNA, 19 nt, Pseudomonas aeruginosa PA01
gcgacgaagacgcugcgca

SEQ ID NO: 1540381 - RNA, 16 nt, Pseudomonas aeruginosa PA01
gcgacgaaggccuggu

SEQ ID NO: 1540382 - RNA, 22 nt, Pseudomonas aeruginosa PA01
gcgacgacuugcccaccccgga

SEQ ID NO: 1540383 - RNA, 16 nt, Pseudomonas aeruginosa PA01
gcgcacaaaaaagccc

SEQ ID NO: 1540384 - RNA, 19 nt, Pseudomonas aeruginosa PA01
gcgcacaaaaaagcccgcc

SEQ ID NO: 1540385 - RNA, 14 nt, Pseudomonas aeruginosa PA01
gcgcacgcuguaga

SEQ ID NO: 1540386 - RNA, 18 nt, Pseudomonas aeruginosa PA01
gcgcacgcuucuccucgg

SEQ ID NO: 1540387 - RNA, 19 nt, Pseudomonas aeruginosa PA01
gcgcacgcuucuccucggc

SEQ ID NO: 1540388 - RNA, 15 nt, Pseudomonas aeruginosa PA01
gcgcacggaucgcgc

SEQ ID NO: 1540389 - RNA, 19 nt, Pseudomonas aeruginosa PA01
gcgcacggccugcaccugc

SEQ ID NO: 1540390 - RNA, 21 nt, Pseudomonas aeruginosa PA01
gcgcacgguucacaaagccuu

SEQ ID NO: 1540391 - RNA, 13 nt, Pseudomonas aeruginosa PA01
gcgcagcacuucc

SEQ ID NO: 1540392 - RNA, 13 nt, Pseudomonas aeruginosa PA01
gcgcagcggcagc

SEQ ID NO: 1540393 - RNA, 12 nt, Pseudomonas aeruginosa PA01
gcgcagcgcggc

SEQ ID NO: 1540394 - RNA, 14 nt, Pseudomonas aeruginosa PA01
gcgcagcgcggggg

SEQ ID NO: 1540395 - RNA, 15 nt, Pseudomonas aeruginosa PA01
gcgcagcgcgggggc

SEQ ID NO: 1540396 - RNA, 15 nt, Pseudomonas aeruginosa PA01
gcgcagcggcaggcc

SEQ ID NO: 1540397 - RNA, 13 nt, Pseudomonas aeruginosa PA01
gcgcagcggcgga

SEQ ID NO: 1540398 - RNA, 19 nt, Pseudomonas aeruginosa PA01
gcgcagcggcggauacagg

SEQ ID NO: 1540399 - RNA, 21 nt, Pseudomonas aeruginosa PA01
gcgcagcuccggcagcagggu

SEQ ID NO: 1540400 - RNA, 13 nt, Pseudomonas aeruginosa PA01
gcgcagcuccucg

SEQ ID NO: 1540401 - RNA, 14 nt, Pseudomonas aeruginosa PA01
gcgcagcuccucgg

SEQ ID NO: 1540402 - RNA, 15 nt, Pseudomonas aeruginosa PA01
gcgcagcuccucggc

SEQ ID NO: 1540403 - RNA, 16 nt, Pseudomonas aeruginosa PA01
gcgcagcuugcucgau

SEQ ID NO: 1540404 - RNA, 22 nt, Pseudomonas aeruginosa PA01
gcgcagcuucugcagggcggcu

SEQ ID NO: 1540405 - RNA, 14 nt, Pseudomonas aeruginosa PA01
gcgcagcaguaccu

SEQ ID NO: 1540406 - RNA, 17 nt, Pseudomonas aeruginosa PA01
gcgcagccagagcucca

SEQ ID NO: 1540407 - RNA, 12 nt, Pseudomonas aeruginosa PA01
gcgcagcaggau

SEQ ID NO: 1540408 - RNA, 13 nt, Pseudomonas aeruginosa PA01
gcgcagcaggauc

SEQ ID NO: 1540409 - RNA, 22 nt, Pseudomonas aeruginosa PA01
gcgcagcagguagugcggcggg

SEQ ID NO: 1540410 - RNA, 18 nt, Pseudomonas aeruginosa PA01
gcgcagcagggcgucggc

SEQ ID NO: 1540411 - RNA, 24 nt, Pseudomonas aeruginosa PA01
gcgcagccauucgccgcgacgcuc

SEQ ID NO: 1540412 - RNA, 15 nt, Pseudomonas aeruginosa PA01
gcgcagcccagccgc

SEQ ID NO: 1540413 - RNA, 15 nt, Pseudomonas aeruginosa PA01
gcgcagccaggcgag

SEQ ID NO: 1540414 - RNA, 19 nt, Pseudomonas aeruginosa PA01
gcgauguucaccgcggccu

SEQ ID NO: 1540415 - RNA, 22 nt, Pseudomonas aeruginosa PA01
gcgauguucaccgcggccuugg

SEQ ID NO: 1540416 - RNA, 15 nt, Pseudomonas aeruginosa PA01
gcgauguugaacagc

SEQ ID NO: 1540417 - RNA, 20 nt, Pseudomonas aeruginosa PA01
gcgauucgcggcgacagcac

SEQ ID NO: 1540418 - RNA, 24 nt, Pseudomonas aeruginosa PA01
gcgauucccgaggguggcgcuggc

SEQ ID NO: 1540419 - RNA, 13 nt, Pseudomonas aeruginosa PA01
gcgauugaacucg

SEQ ID NO: 1540420 - RNA, 22 nt, Pseudomonas aeruginosa PA01
gcgaugguugccguacuucagg

SEQ ID NO: 1540421 - RNA, 22 nt, Pseudomonas aeruginosa PA01
gcgauguaggucaccgcgccgg

SEQ ID NO: 1540422 - RNA, 14 nt, Pseudomonas aeruginosa PA01
gcgaugucggccug

SEQ ID NO: 1540423 - RNA, 20 nt, Pseudomonas aeruginosa PA01
gcgauguccuggaucggcag

SEQ ID NO: 1540424 - RNA, 17 nt, Pseudomonas aeruginosa PA01
gcgauggcucgcggcgc

SEQ ID NO: 1540425 - RNA, 18 nt, Pseudomonas aeruginosa PA01
gcgauggcucgcggcgcu

SEQ ID NO: 1540426 - RNA, 18 nt, Pseudomonas aeruginosa PA01
gcgauggccgccagcagg

SEQ ID NO: 1540427 - RNA, 19 nt, Pseudomonas aeruginosa PA01
gcgauggccgccagcaggc

SEQ ID NO: 1540428 - RNA, 14 nt, Pseudomonas aeruginosa PA01
gcgauggccgccug

SEQ ID NO: 1540429 - RNA, 21 nt, Pseudomonas aeruginosa PA01
gcgauggccgccugcagggcg

SEQ ID NO: 1540430 - RNA, 13 nt, Pseudomonas aeruginosa PA01
gcgauggccggcg

SEQ ID NO: 1540431 - RNA, 11 nt, Pseudomonas aeruginosa PA01
gcgauggacuc

SEQ ID NO: 1540432 - RNA, 17 nt, Pseudomonas aeruginosa PA01
gcgauuggagaugcuca

SEQ ID NO: 1540433 - RNA, 18 nt, Pseudomonas aeruginosa PA01
gcgcaacgcuuccagcac

SEQ ID NO: 1540434 - RNA, 16 nt, Pseudomonas aeruginosa PA01
gcgcaacgggcggcgg

SEQ ID NO: 1540435 - RNA, 17 nt, Pseudomonas aeruginosa PA01
gcgcaacgggcggcggg

SEQ ID NO: 1540436 - RNA, 15 nt, Pseudomonas aeruginosa PA01
gcgaaaucggcaggc

SEQ ID NO: 1540437 - RNA, 23 nt, Pseudomonas aeruginosa PA01
gcgaaauggucaccaugaucauc

SEQ ID NO: 1540438 - RNA, 19 nt, Pseudomonas aeruginosa PA01
gccuuuuuugugcccggcg

SEQ ID NO: 1540439 - RNA, 23 nt, Pseudomonas aeruginosa PA01
gcgaacaaucggucgcccucggc

SEQ ID NO: 1540440 - RNA, 14 nt, Pseudomonas aeruginosa PA01
gcgaaccggccuuu

SEQ ID NO: 1540441 - RNA, 14 nt, Pseudomonas aeruginosa PA01
gcgaacagcaccuu

SEQ ID NO: 1540442 - RNA, 18 nt, Pseudomonas aeruginosa PA01
gcgaacuucaggccggcg

SEQ ID NO: 1540443 - RNA, 21 nt, Pseudomonas aeruginosa PA01
gcgaacgguccugcggaucga

SEQ ID NO: 1540444 - RNA, 20 nt, Pseudomonas aeruginosa PA01
gcgaacgcuugagccccggc

SEQ ID NO: 1540445 - RNA, 15 nt, Pseudomonas aeruginosa PA01
gcgaacgccgcagcu

SEQ ID NO: 1540446 - RNA, 14 nt, Pseudomonas aeruginosa PA01
gcgaacggcugguc

SEQ ID NO: 1540447 - RNA, 21 nt, Pseudomonas aeruginosa PA01
gccuuuugacuugacccgacu

SEQ ID NO: 1540448 - RNA, 23 nt, Pseudomonas aeruginosa PA01
gccuuucuuuucugccacccggc

SEQ ID NO: 1540449 - RNA, 19 nt, Pseudomonas aeruginosa PA01
gccuuucggggugcagggg

SEQ ID NO: 1540450 - RNA, 21 nt, Pseudomonas aeruginosa PA01
gcgaaggucgaaggcgcggcg

SEQ ID NO: 1540451 - RNA, 18 nt, Pseudomonas aeruginosa PA01
gcgaaggcuccgcugcuc

SEQ ID NO: 1540452 - RNA, 19 nt, Pseudomonas aeruginosa PA01
gcgaagaaagccccugccg

SEQ ID NO: 1540453 - RNA, 13 nt, Pseudomonas aeruginosa PA01
gcgaaggccacca

SEQ ID NO: 1540454 - RNA, 15 nt, Pseudomonas aeruginosa PA01
gcgaaggccaccauc

SEQ ID NO: 1540455 - RNA, 18 nt, Pseudomonas aeruginosa PA01
gcgaaggccacgccgacg

SEQ ID NO: 1540456 - RNA, 11 nt, Pseudomonas aeruginosa PA01
gcgaagucgca

SEQ ID NO: 1540457 - RNA, 14 nt, Pseudomonas aeruginosa PA01
gcgaaguccggguu

SEQ ID NO: 1540458 - RNA, 15 nt, Pseudomonas aeruginosa PA01
gcgaagucggcgcgc

SEQ ID NO: 1540459 - RNA, 16 nt, Pseudomonas aeruginosa PA01
gcgaagucggcgcgcc

SEQ ID NO: 1540460 - RNA, 22 nt, Pseudomonas aeruginosa PA01
gcgacaccaugcuccgccuggc

SEQ ID NO: 1540461 - RNA, 23 nt, Pseudomonas aeruginosa PA01
gcgacaccaugcuccgccuggcg

SEQ ID NO: 1540462 - RNA, 20 nt, Pseudomonas aeruginosa PA01
gcgacacgugccccaggccg

SEQ ID NO: 1540463 - RNA, 15 nt, Pseudomonas aeruginosa PA01
gcgacaccgccagca

SEQ ID NO: 1540464 - RNA, 16 nt, Pseudomonas aeruginosa PA01
gcgacaccgccagcac

SEQ ID NO: 1540465 - RNA, 15 nt, Pseudomonas aeruginosa PA01
gcgacaaaucggcau

SEQ ID NO: 1540466 - RNA, 16 nt, Pseudomonas aeruginosa PA01
gcgacaacccuguccc

SEQ ID NO: 1540467 - RNA, 17 nt, Pseudomonas aeruginosa PA01
gcgacccgggucaggcc

SEQ ID NO: 1540468 - RNA, 19 nt, Pseudomonas aeruginosa PA01
gcgacccgcacguugaggu

SEQ ID NO: 1540469 - RNA, 18 nt, Pseudomonas aeruginosa PA01
gcgaccgucgaaccaggg

SEQ ID NO: 1540470 - RNA, 17 nt, Pseudomonas aeruginosa PA01
gcgaccgucggccgggg

SEQ ID NO: 1540471 - RNA, 17 nt, Pseudomonas aeruginosa PA01
gcgacccuggccgcgcg

SEQ ID NO: 1540472 - RNA, 21 nt, Pseudomonas aeruginosa PA01
gcgaccgugaggcgcaggggc

SEQ ID NO: 1540473 - RNA, 22 nt, Pseudomonas aeruginosa PA01
gcgaccucagucgugcaggugu

SEQ ID NO: 1540474 - RNA, 19 nt, Pseudomonas aeruginosa PA01
gcgaccugcucgcgcaccg

SEQ ID NO: 1540475 - RNA, 20 nt, Pseudomonas aeruginosa PA01
gcgaccugcucgcgcaccgc

SEQ ID NO: 1540476 - RNA, 23 nt, Pseudomonas aeruginosa PA01
gcgaccugcucgcgcaccgcggc

SEQ ID NO: 1540477 - RNA, 20 nt, Pseudomonas aeruginosa PA01
gcgaccucguugcaggcacg

SEQ ID NO: 1540478 - RNA, 17 nt, Pseudomonas aeruginosa PA01
gcgaccugguggcgccg

SEQ ID NO: 1540479 - RNA, 19 nt, Pseudomonas aeruginosa PA01
gcgaccagguccggagggc

SEQ ID NO: 1540480 - RNA, 22 nt, Pseudomonas aeruginosa PA01
gcgaccagcucgaagccgccgu

SEQ ID NO: 1540481 - RNA, 20 nt, Pseudomonas aeruginosa PA01
gcgacccagaccugccgccc

SEQ ID NO: 1540482 - RNA, 17 nt, Pseudomonas aeruginosa PA01
gcgacccagcgcugguu

SEQ ID NO: 1540483 - RNA, 16 nt, Pseudomonas aeruginosa PA01
gcgaccaguugcucgc

SEQ ID NO: 1540484 - RNA, 14 nt, Pseudomonas aeruginosa PA01
gcgacagccgggca

SEQ ID NO: 1540485 - RNA, 21 nt, Pseudomonas aeruginosa PA01
gcgacacucugguagcugcgg

SEQ ID NO: 1540486 - RNA, 15 nt, Pseudomonas aeruginosa PA01
gccuucgggcggcuu

SEQ ID NO: 1540487 - RNA, 20 nt, Pseudomonas aeruginosa PA01
gccuucguggccgcgggagg

SEQ ID NO: 1540488 - RNA, 22 nt, Pseudomonas aeruginosa PA01
gccuucucgucgccgcccggca

SEQ ID NO: 1540489 - RNA, 18 nt, Pseudomonas aeruginosa PA01
gccuucgucggcuucugg

SEQ ID NO: 1540490 - RNA, 20 nt, Pseudomonas aeruginosa PA01
gccuugcagggccgccagcc

SEQ ID NO: 1540491 - RNA, 22 nt, Pseudomonas aeruginosa PA01
gccuugcagggccgccagccgc

SEQ ID NO: 1540492 - RNA, 19 nt, Pseudomonas aeruginosa PA01
gccuugacccgcaguuccu

SEQ ID NO: 1540493 - RNA, 23 nt, Pseudomonas aeruginosa PA01
gccuugacccgcaguuccuuggg

SEQ ID NO: 1540494 - RNA, 19 nt, Pseudomonas aeruginosa PA01
gccuugagcggcgcccugg

SEQ ID NO: 1540495 - RNA, 20 nt, Pseudomonas aeruginosa PA01
gccuugaggaugucgcggcu

SEQ ID NO: 1540496 - RNA, 18 nt, Pseudomonas aeruginosa PA01
gccuugaggcgggccagc

SEQ ID NO: 1540497 - RNA, 23 nt, Pseudomonas aeruginosa PA01
gccuugaggcgggccagcagggu

SEQ ID NO: 1540498 - RNA, 22 nt, Pseudomonas aeruginosa PA01
gccuugaccaccgccaggcugg

SEQ ID NO: 1540499 - RNA, 17 nt, Pseudomonas aeruginosa PA01
gccuucuuuucuuccgc

SEQ ID NO: 1540500 - RNA, 15 nt, Pseudomonas aeruginosa PA01
gccuugccguccagc

SEQ ID NO: 1540501 - RNA, 15 nt, Pseudomonas aeruginosa PA01
gccuugcccuggccg

SEQ ID NO: 1540502 - RNA, 15 nt, Pseudomonas aeruginosa PA01
gccuugcgccaggcc

SEQ ID NO: 1540503 - RNA, 16 nt, Pseudomonas aeruginosa PA01
gccuugcgccaggccu

SEQ ID NO: 1540504 - RNA, 16 nt, Pseudomonas aeruginosa PA01
gccuugcggcccccag

SEQ ID NO: 1540505 - RNA, 14 nt, Pseudomonas aeruginosa PA01
gccuuggccacggc

SEQ ID NO: 1540506 - RNA, 19 nt, Pseudomonas aeruginosa PA01
gccuuggcaugaccgagca

SEQ ID NO: 1540507 - RNA, 12 nt, Pseudomonas aeruginosa PA01
gccuugcucagg

SEQ ID NO: 1540508 - RNA, 18 nt, Pseudomonas aeruginosa PA01
gccuugcguaccagcgcg

SEQ ID NO: 1540509 - RNA, 19 nt, Pseudomonas aeruginosa PA01
gccuugcguaccagcgcgc

SEQ ID NO: 1540510 - RNA, 17 nt, Pseudomonas aeruginosa PA01
gccuugcugcggguuga

SEQ ID NO: 1540511 - RNA, 13 nt, Pseudomonas aeruginosa PA01
gccuugcuggcga

SEQ ID NO: 1540512 - RNA, 22 nt, Pseudomonas aeruginosa PA01
gccuugugcgccagcucggccu

SEQ ID NO: 1540513 - RNA, 17 nt, Pseudomonas aeruginosa PA01
gccuuguucgccagcac

SEQ ID NO: 1540514 - RNA, 18 nt, Pseudomonas aeruginosa PA01
gccuuguucgccagcacc

SEQ ID NO: 1540515 - RNA, 16 nt, Pseudomonas aeruginosa PA01
gccuuggccuccaccc

SEQ ID NO: 1540516 - RNA, 16 nt, Pseudomonas aeruginosa PA01
gccuguucgcccaagg

SEQ ID NO: 1540517 - RNA, 19 nt, Pseudomonas aeruginosa PA01
gccuuaccagaagccggcc

SEQ ID NO: 1540518 - RNA, 20 nt, Pseudomonas aeruginosa PA01
gccuucagcgccagcaggcg

SEQ ID NO: 1540519 - RNA, 20 nt, Pseudomonas aeruginosa PA01
gccuucagcgccgccaggcc

SEQ ID NO: 1540520 - RNA, 16 nt, Pseudomonas aeruginosa PA01
gccuucagcgccucca

SEQ ID NO: 1540521 - RNA, 21 nt, Pseudomonas aeruginosa PA01
gccuucagcgccuccagcacc

SEQ ID NO: 1540522 - RNA, 14 nt, Pseudomonas aeruginosa PA01
gccuucaccgcgcc

SEQ ID NO: 1540523 - RNA, 15 nt, Pseudomonas aeruginosa PA01
gccuucaccggcgga

SEQ ID NO: 1540524 - RNA, 20 nt, Pseudomonas aeruginosa PA01
gccuucaccguucccagcag

SEQ ID NO: 1540525 - RNA, 21 nt, Pseudomonas aeruginosa PA01
gccuucaccguucccagcagc

SEQ ID NO: 1540526 - RNA, 18 nt, Pseudomonas aeruginosa PA01
gccuuccaccaccagggu

SEQ ID NO: 1540527 - RNA, 20 nt, Pseudomonas aeruginosa PA01
gccuucaguucguugggccg

SEQ ID NO: 1540528 - RNA, 17 nt, Pseudomonas aeruginosa PA01
gccuuccggcaccacca

SEQ ID NO: 1540529 - RNA, 17 nt, Pseudomonas aeruginosa PA01
gccuucccacuccgucc

SEQ ID NO: 1540530 - RNA, 10 nt, Pseudomonas aeruginosa PA01
gccuucccag

SEQ ID NO: 1540531 - RNA, 12 nt, Pseudomonas aeruginosa PA01
gccuuccagcuu

SEQ ID NO: 1540532 - RNA, 22 nt, Pseudomonas aeruginosa PA01
gccuuccagcuugcgccagagc

SEQ ID NO: 1540533 - RNA, 14 nt, Pseudomonas aeruginosa PA01
gccuuccaggcgug

SEQ ID NO: 1540534 - RNA, 19 nt, Pseudomonas aeruginosa PA01
gccuuccaggcuguagccg

SEQ ID NO: 1540535 - RNA, 15 nt, Pseudomonas aeruginosa PA01
gccuucgaucucaug

SEQ ID NO: 1540536 - RNA, 17 nt, Pseudomonas aeruginosa PA01
gccuucgcaaagcgagc

SEQ ID NO: 1540537 - RNA, 14 nt, Pseudomonas aeruginosa PA01
gccuucgccagcgg

SEQ ID NO: 1540538 - RNA, 16 nt, Pseudomonas aeruginosa PA01
gccuucgccagcggcc

SEQ ID NO: 1540539 - RNA, 18 nt, Pseudomonas aeruginosa PA01
gccuucgccagcggccag

SEQ ID NO: 1540540 - RNA, 13 nt, Pseudomonas aeruginosa PA01
gccuucgcccagg

SEQ ID NO: 1540541 - RNA, 14 nt, Pseudomonas aeruginosa PA01
gccuucgcccaggu

SEQ ID NO: 1540542 - RNA, 12 nt, Pseudomonas aeruginosa PA01
gccuuccucggc

SEQ ID NO: 1540543 - RNA, 21 nt, Pseudomonas aeruginosa PA01
gccuuccucggccgccaggcg

SEQ ID NO: 1540544 - RNA, 23 nt, Pseudomonas aeruginosa PA01
gccuuccucggccgccaggcgcg

SEQ ID NO: 1540545 - RNA, 17 nt, Pseudomonas aeruginosa PA01
gccuucggcggccgggu

SEQ ID NO: 1540546 - RNA, 22 nt, Pseudomonas aeruginosa PA01
gccuucgucgaugaacagcgac

SEQ ID NO: 1540547 - RNA, 19 nt, Pseudomonas aeruginosa PA01
gccuucggagaacagcgag

SEQ ID NO: 1540548 - RNA, 15 nt, Pseudomonas aeruginosa PA01
gccuucggcaggacc

SEQ ID NO: 1540549 - RNA, 23 nt, Pseudomonas aeruginosa PA01
gccuuccuugaccacggcgagga

SEQ ID NO: 1540550 - RNA, 15 nt, Pseudomonas aeruginosa PA01
gccuucgcgggccag

SEQ ID NO: 1540551 - RNA, 23 nt, Pseudomonas aeruginosa PA01
gccuucgccgucgagccagccca

SEQ ID NO: 1540552 - RNA, 13 nt, Pseudomonas aeruginosa PA01
gugcggccgauga

SEQ ID NO: 1540553 - RNA, 12 nt, Pseudomonas aeruginosa PA01
gugcggcugggu

SEQ ID NO: 1540554 - RNA, 20 nt, Pseudomonas aeruginosa PA01
gugcgguauagcucauggcc

SEQ ID NO: 1540555 - RNA, 20 nt, Pseudomonas aeruginosa PA01
gugcgcugguaccugccggc

SEQ ID NO: 1540556 - RNA, 23 nt, Pseudomonas aeruginosa PA01
gugcgcugcguucuuccccugca

SEQ ID NO: 1540557 - RNA, 18 nt, Pseudomonas aeruginosa PA01
gugcgcuggaacggccag

SEQ ID NO: 1540558 - RNA, 15 nt, Pseudomonas aeruginosa PA01
gugcgcucgcggacc

SEQ ID NO: 1540559 - RNA, 16 nt, Pseudomonas aeruginosa PA01
gugcgcuccgccaggc

SEQ ID NO: 1540560 - RNA, 12 nt, Pseudomonas aeruginosa PA01
gugcgcggcagg

SEQ ID NO: 1540561 - RNA, 19 nt, Pseudomonas aeruginosa PA01
gugcgcgaaugguucaucu

SEQ ID NO: 1540562 - RNA, 17 nt, Pseudomonas aeruginosa PA01
gugcgccuccaggaccu

SEQ ID NO: 1540563 - RNA, 13 nt, Pseudomonas aeruginosa PA01
gugcgccgcagcg

SEQ ID NO: 1540564 - RNA, 15 nt, Pseudomonas aeruginosa PA01
gugcgccgcagcgca

SEQ ID NO: 1540565 - RNA, 16 nt, Pseudomonas aeruginosa PA01
gugcgccgggugccgg

SEQ ID NO: 1540566 - RNA, 14 nt, Pseudomonas aeruginosa PA01
gugcgccgcggguc

SEQ ID NO: 1540567 - RNA, 18 nt, Pseudomonas aeruginosa PA01
gugcgccagcucggccug

SEQ ID NO: 1540568 - RNA, 13 nt, Pseudomonas aeruginosa PA01
gugcgaggcuggc

SEQ ID NO: 1540569 - RNA, 13 nt, Pseudomonas aeruginosa PA01
gugcgcccagcag

SEQ ID NO: 1540570 - RNA, 19 nt, Pseudomonas aeruginosa PA01
gugccgccggccaccagca

SEQ ID NO: 1540571 - RNA, 20 nt, Pseudomonas aeruginosa PA01
gugccgccggccaccagcag

SEQ ID NO: 1540572 - RNA, 23 nt, Pseudomonas aeruginosa PA01
gugccgccggggcgcaggucgcu

SEQ ID NO: 1540573 - RNA, 19 nt, Pseudomonas aeruginosa PA01
gugccgcgaauguggugga

SEQ ID NO: 1540574 - RNA, 20 nt, Pseudomonas aeruginosa PA01
gugccuucccagccgaggca

SEQ ID NO: 1540575 - RNA, 20 nt, Pseudomonas aeruginosa PA01
gugccuugaauugcugccac

SEQ ID NO: 1540576 - RNA, 15 nt, Pseudomonas aeruginosa PA01
gugcugggcgaccuu

SEQ ID NO: 1540577 - RNA, 13 nt, Pseudomonas aeruginosa PA01
gugcuggccaccc

SEQ ID NO: 1540578 - RNA, 23 nt, Pseudomonas aeruginosa PA01
gugcuggccacccuugcguccug

SEQ ID NO: 1540579 - RNA, 19 nt, Pseudomonas aeruginosa PA01
gugcuggcgucgccuucca

SEQ ID NO: 1540580 - RNA, 14 nt, Pseudomonas aeruginosa PA01
gugcuggcggaagg

SEQ ID NO: 1540581 - RNA, 14 nt, Pseudomonas aeruginosa PA01
gugcugcgcgcggc

SEQ ID NO: 1540582 - RNA, 16 nt, Pseudomonas aeruginosa PA01
gugcugcggcagguag

SEQ ID NO: 1540583 - RNA, 19 nt, Pseudomonas aeruginosa PA01
gugcugcccagggcccaga

SEQ ID NO: 1540584 - RNA, 19 nt, Pseudomonas aeruginosa PA01
gugcucgcggaccagcucc

SEQ ID NO: 1540585 - RNA, 22 nt, Pseudomonas aeruginosa PA01
gugcucggccugaucaucuggg

SEQ ID NO: 1540586 - RNA, 13 nt, Pseudomonas aeruginosa PA01
gugcugaacauca

SEQ ID NO: 1540587 - RNA, 19 nt, Pseudomonas aeruginosa PA01
gugcucaggacguccuggc

SEQ ID NO: 1540588 - RNA, 16 nt, Pseudomonas aeruginosa PA01
gugcggugccgcgcag

SEQ ID NO: 1540589 - RNA, 15 nt, Pseudomonas aeruginosa PA01
gugcgucgagggccu

SEQ ID NO: 1540590 - RNA, 21 nt, Pseudomonas aeruginosa PA01
gugaugccgcggacggcacgg

SEQ ID NO: 1540591 - RNA, 17 nt, Pseudomonas aeruginosa PA01
gugaugcgucgcaccag

SEQ ID NO: 1540592 - RNA, 22 nt, Pseudomonas aeruginosa PA01
gugaugcgucgcaccaggugcu

SEQ ID NO: 1540593 - RNA, 19 nt, Pseudomonas aeruginosa PA01
gugaucuugaucugcaugc

SEQ ID NO: 1540594 - RNA, 16 nt, Pseudomonas aeruginosa PA01
gucgcugccgccgcgc

SEQ ID NO: 1540595 - RNA, 15 nt, Pseudomonas aeruginosa PA01
gucgcugcucagggc

SEQ ID NO: 1540596 - RNA, 18 nt, Pseudomonas aeruginosa PA01
gucgcugagcggcuggug

SEQ ID NO: 1540597 - RNA, 14 nt, Pseudomonas aeruginosa PA01
gucgcgggccaggc

SEQ ID NO: 1540598 - RNA, 17 nt, Pseudomonas aeruginosa PA01
gucgcgggccaggcccu

SEQ ID NO: 1540599 - RNA, 16 nt, Pseudomonas aeruginosa PA01
gucgcuggccugcagg

SEQ ID NO: 1540600 - RNA, 15 nt, Pseudomonas aeruginosa PA01
gucgcugcuggcgcc

SEQ ID NO: 1540601 - RNA, 14 nt, Pseudomonas aeruginosa PA01
gucgcuggccagcu

SEQ ID NO: 1540602 - RNA, 18 nt, Pseudomonas aeruginosa PA01
gugauguccccccuacga

SEQ ID NO: 1540603 - RNA, 22 nt, Pseudomonas aeruginosa PA01
gugaugucgcggcaggcggcgg

SEQ ID NO: 1540604 - RNA, 18 nt, Pseudomonas aeruginosa PA01
gugcaccaucgcauaggu

SEQ ID NO: 1540605 - RNA, 22 nt, Pseudomonas aeruginosa PA01
gugcaccaucgcauagguggga

SEQ ID NO: 1540606 - RNA, 21 nt, Pseudomonas aeruginosa PA01
gugcagaagacgcccagcagg

SEQ ID NO: 1540607 - RNA, 23 nt, Pseudomonas aeruginosa PA01
gugcagaagacgcccagcagggc

SEQ ID NO: 1540608 - RNA, 22 nt, Pseudomonas aeruginosa PA01
gugauuuacaggacugugcuua

SEQ ID NO: 1540609 - RNA, 12 nt, Pseudomonas aeruginosa PA01
gugccacaggcc

SEQ ID NO: 1540610 - RNA, 14 nt, Pseudomonas aeruginosa PA01
gugccagaaaaucg

SEQ ID NO: 1540611 - RNA, 15 nt, Pseudomonas aeruginosa PA01
gugccagcaccuuca

SEQ ID NO: 1540612 - RNA, 15 nt, Pseudomonas aeruginosa PA01
gugcagagaggcugg

SEQ ID NO: 1540613 - RNA, 12 nt, Pseudomonas aeruginosa PA01
gugcagccagac

SEQ ID NO: 1540614 - RNA, 14 nt, Pseudomonas aeruginosa PA01
gugcagccacccag

SEQ ID NO: 1540615 - RNA, 18 nt, Pseudomonas aeruginosa PA01
gugcagccacccagcagc

SEQ ID NO: 1540616 - RNA, 19 nt, Pseudomonas aeruginosa PA01
gugcagccacccagcagca

SEQ ID NO: 1540617 - RNA, 21 nt, Pseudomonas aeruginosa PA01
gugcccgcugcaugugccagg

SEQ ID NO: 1540618 - RNA, 21 nt, Pseudomonas aeruginosa PA01
gugccgaccuucaccaccagc

SEQ ID NO: 1540619 - RNA, 23 nt, Pseudomonas aeruginosa PA01
gugcccuuuuccuccagggugcc

SEQ ID NO: 1540620 - RNA, 11 nt, Pseudomonas aeruginosa PA01
gugcccuggaa

SEQ ID NO: 1540621 - RNA, 14 nt, Pseudomonas aeruginosa PA01
gugcccugggcggc

SEQ ID NO: 1540622 - RNA, 14 nt, Pseudomonas aeruginosa PA01
gugccaggaccagc

SEQ ID NO: 1540623 - RNA, 17 nt, Pseudomonas aeruginosa PA01
gugcccagcggcgccuc

SEQ ID NO: 1540624 - RNA, 18 nt, Pseudomonas aeruginosa PA01
gugcccaggcgcuggcgc

SEQ ID NO: 1540625 - RNA, 15 nt, Pseudomonas aeruginosa PA01
gugcccaucaggcuc

SEQ ID NO: 1540626 - RNA, 19 nt, Pseudomonas aeruginosa PA01
gugcccaucaggcucaggc

SEQ ID NO: 1540627 - RNA, 20 nt, Pseudomonas aeruginosa PA01
gugcccaucaggcucaggcg

SEQ ID NO: 1540628 - RNA, 15 nt, Pseudomonas aeruginosa PA01
gugccaggccugggu

SEQ ID NO: 1540629 - RNA, 23 nt, Pseudomonas aeruginosa PA01
gugccaggcucgccgccagcagg

SEQ ID NO: 1540630 - RNA, 23 nt, Pseudomonas aeruginosa PA01
gugccagggcuucccaggccagc

SEQ ID NO: 1540631 - RNA, 19 nt, Pseudomonas aeruginosa PA01
gugcccccggcaacacccu

SEQ ID NO: 1540632 - RNA, 21 nt, Pseudomonas aeruginosa PA01
gugcccgccggcgcgcccagg

SEQ ID NO: 1540633 - RNA, 19 nt, Pseudomonas aeruginosa PA01
gugcccgaugccgcgccgg

SEQ ID NO: 1540634 - RNA, 18 nt, Pseudomonas aeruginosa PA01
gugcuucagguagcucau

SEQ ID NO: 1540635 - RNA, 18 nt, Pseudomonas aeruginosa PA01
gugcuucaucggcccggc

SEQ ID NO: 1540636 - RNA, 16 nt, Pseudomonas aeruginosa PA01
gugcugguggcccugg

SEQ ID NO: 1540637 - RNA, 18 nt, Pseudomonas aeruginosa PA01
guggaugccgguggcgcc

SEQ ID NO: 1540638 - RNA, 14 nt, Pseudomonas aeruginosa PA01
guggaugaacagcg

SEQ ID NO: 1540639 - RNA, 14 nt, Pseudomonas aeruginosa PA01
gugcuugugguagu

SEQ ID NO: 1540640 - RNA, 15 nt, Pseudomonas aeruginosa PA01
guggaucgcccggcu

SEQ ID NO: 1540641 - RNA, 22 nt, Pseudomonas aeruginosa PA01
guggaucgcggcguaggcgcgc

SEQ ID NO: 1540642 - RNA, 15 nt, Pseudomonas aeruginosa PA01
gugcuugcagucgcg

SEQ ID NO: 1540643 - RNA, 16 nt, Pseudomonas aeruginosa PA01
guggaugugcugguug

SEQ ID NO: 1540644 - RNA, 17 nt, Pseudomonas aeruginosa PA01
guggaugugcugguugg

SEQ ID NO: 1540645 - RNA, 21 nt, Pseudomonas aeruginosa PA01
guggauuucagcaggccgagg

SEQ ID NO: 1540646 - RNA, 21 nt, Pseudomonas aeruginosa PA01
guggcaaaaaugcccuuggcu

SEQ ID NO: 1540647 - RNA, 16 nt, Pseudomonas aeruginosa PA01
guggccagcgcccagg

SEQ ID NO: 1540648 - RNA, 17 nt, Pseudomonas aeruginosa PA01
guggccagcgcccaggc

SEQ ID NO: 1540649 - RNA, 15 nt, Pseudomonas aeruginosa PA01
guggcaacugccgcc

SEQ ID NO: 1540650 - RNA, 17 nt, Pseudomonas aeruginosa PA01
guggccacgucgcccca

SEQ ID NO: 1540651 - RNA, 15 nt, Pseudomonas aeruginosa PA01
guggcgcgcaucggu

SEQ ID NO: 1540652 - RNA, 17 nt, Pseudomonas aeruginosa PA01
guggcgcuacgcucgcc

SEQ ID NO: 1540653 - RNA, 13 nt, Pseudomonas aeruginosa PA01
guggcgcccagcc

SEQ ID NO: 1540654 - RNA, 15 nt, Pseudomonas aeruginosa PA01
guggcgccgccggcg

SEQ ID NO: 1540655 - RNA, 16 nt, Pseudomonas aeruginosa PA01
guggcgccauccucca

SEQ ID NO: 1540656 - RNA, 13 nt, Pseudomonas aeruginosa PA01
guggcgcagccgu

SEQ ID NO: 1540657 - RNA, 23 nt, Pseudomonas aeruginosa PA01
guggcuacggaugcugucccaac

SEQ ID NO: 1540658 - RNA, 14 nt, Pseudomonas aeruginosa PA01
guggcggccgccgg

SEQ ID NO: 1540659 - RNA, 16 nt, Pseudomonas aeruginosa PA01
guggcgcuugagcagc

SEQ ID NO: 1540660 - RNA, 22 nt, Pseudomonas aeruginosa PA01
guggcgcuugagcagccaggcg

SEQ ID NO: 1540661 - RNA, 15 nt, Pseudomonas aeruginosa PA01
guggcgcugccuucg

SEQ ID NO: 1540662 - RNA, 17 nt, Pseudomonas aeruginosa PA01
guggcgcugucgccggu

SEQ ID NO: 1540663 - RNA, 20 nt, Pseudomonas aeruginosa PA01
guggcgaaaaucgaaggguu

SEQ ID NO: 1540664 - RNA, 21 nt, Pseudomonas aeruginosa PA01
guggccauagagccgcugggu

SEQ ID NO: 1540665 - RNA, 16 nt, Pseudomonas aeruginosa PA01
guggcgaccugguagc

SEQ ID NO: 1540666 - RNA, 19 nt, Pseudomonas aeruginosa PA01
guggcgacgaagacgcugc

SEQ ID NO: 1540667 - RNA, 17 nt, Pseudomonas aeruginosa PA01
guggcgacgcagcacgg

SEQ ID NO: 1540668 - RNA, 13 nt, Pseudomonas aeruginosa PA01
guggcgacgccgg

SEQ ID NO: 1540669 - RNA, 14 nt, Pseudomonas aeruginosa PA01
guggcgacgcgcag

SEQ ID NO: 1540670 - RNA, 23 nt, Pseudomonas aeruginosa PA01
guggcgcaacaccuugcgcaccg

SEQ ID NO: 1540671 - RNA, 16 nt, Pseudomonas aeruginosa PA01
guggcgaucaggcagc

SEQ ID NO: 1540672 - RNA, 16 nt, Pseudomonas aeruginosa PA01
guggcgcagcaucauc

SEQ ID NO: 1540673 - RNA, 12 nt, Pseudomonas aeruginosa PA01
gugggugccggg

SEQ ID NO: 1540674 - RNA, 17 nt, Pseudomonas aeruginosa PA01
guggguauccagcggcc

SEQ ID NO: 1540675 - RNA, 21 nt, Pseudomonas aeruginosa PA01
gugggucacggugaggaccug

SEQ ID NO: 1540676 - RNA, 17 nt, Pseudomonas aeruginosa PA01
guggcugcgcucaccug

SEQ ID NO: 1540677 - RNA, 16 nt, Pseudomonas aeruginosa PA01
guggcucgaucagccg

SEQ ID NO: 1540678 - RNA, 18 nt, Pseudomonas aeruginosa PA01
guggcucggcggcaggcu

SEQ ID NO: 1540679 - RNA, 23 nt, Pseudomonas aeruginosa PA01
guggcuggugaugccgcggacgg

SEQ ID NO: 1540680 - RNA, 15 nt, Pseudomonas aeruginosa PA01
guggucagcaccagg

SEQ ID NO: 1540681 - RNA, 18 nt, Pseudomonas aeruginosa PA01
guggucagcaccagggcc

SEQ ID NO: 1540682 - RNA, 22 nt, Pseudomonas aeruginosa PA01
guggucagcaccagggccaggg

SEQ ID NO: 1540683 - RNA, 13 nt, Pseudomonas aeruginosa PA01
gugguggcgggga

SEQ ID NO: 1540684 - RNA, 20 nt, Pseudomonas aeruginosa PA01
gugguggcggggaacagcau

SEQ ID NO: 1540685 - RNA, 16 nt, Pseudomonas aeruginosa PA01
guggugcuaucgaugc

SEQ ID NO: 1540686 - RNA, 14 nt, Pseudomonas aeruginosa PA01
gugguugaggcgcu

SEQ ID NO: 1540687 - RNA, 16 nt, Pseudomonas aeruginosa PA01
gugucugguuccuggu

SEQ ID NO: 1540688 - RNA, 16 nt, Pseudomonas aeruginosa PA01
gugugcgcugcaucgg

SEQ ID NO: 1540689 - RNA, 15 nt, Pseudomonas aeruginosa PA01
guuacagcaggaaaa

SEQ ID NO: 1540690 - RNA, 13 nt, Pseudomonas aeruginosa PA01
guuaccuuggcca

SEQ ID NO: 1540691 - RNA, 13 nt, Pseudomonas aeruginosa PA01
guuacgcgcagcg

SEQ ID NO: 1540692 - RNA, 17 nt, Pseudomonas aeruginosa PA01
guuccuccagagugcgc

SEQ ID NO: 1540693 - RNA, 21 nt, Pseudomonas aeruginosa PA01
guuccuccagagugcgcagca

SEQ ID NO: 1540694 - RNA, 19 nt, Pseudomonas aeruginosa PA01
guuccuguaccaggggaug

SEQ ID NO: 1540695 - RNA, 16 nt, Pseudomonas aeruginosa PA01
guucgcaggccaggcg

SEQ ID NO: 1540696 - RNA, 20 nt, Pseudomonas aeruginosa PA01
guucgccaaaaaaagccccg

SEQ ID NO: 1540697 - RNA, 15 nt, Pseudomonas aeruginosa PA01
guucgccagcaggcg

SEQ ID NO: 1540698 - RNA, 14 nt, Pseudomonas aeruginosa PA01
guucgcuccgggcc

SEQ ID NO: 1540699 - RNA, 14 nt, Pseudomonas aeruginosa PA01
guucgccggccagc

SEQ ID NO: 1540700 - RNA, 18 nt, Pseudomonas aeruginosa PA01
guucccguccgggcacgc

SEQ ID NO: 1540701 - RNA, 14 nt, Pseudomonas aeruginosa PA01
guucccccagcacc

SEQ ID NO: 1540702 - RNA, 18 nt, Pseudomonas aeruginosa PA01
guucccccagcaccugga

SEQ ID NO: 1540703 - RNA, 17 nt, Pseudomonas aeruginosa PA01
guucccgccgcucugcu

SEQ ID NO: 1540704 - RNA, 16 nt, Pseudomonas aeruginosa PA01
guuccaccaggcgucg

SEQ ID NO: 1540705 - RNA, 16 nt, Pseudomonas aeruginosa PA01
guuccacgagagaaau

SEQ ID NO: 1540706 - RNA, 18 nt, Pseudomonas aeruginosa PA01
guucagccgguacugcgc

SEQ ID NO: 1540707 - RNA, 14 nt, Pseudomonas aeruginosa PA01
guucagcccgccgu

SEQ ID NO: 1540708 - RNA, 16 nt, Pseudomonas aeruginosa PA01
guucagcggcgcgucg

SEQ ID NO: 1540709 - RNA, 11 nt, Pseudomonas aeruginosa PA01
guucagcagcg

SEQ ID NO: 1540710 - RNA, 18 nt, Pseudomonas aeruginosa PA01
guuagaauaccggccugu

SEQ ID NO: 1540711 - RNA, 22 nt, Pseudomonas aeruginosa PA01
guuagaauaccggccugucacg

SEQ ID NO: 1540712 - RNA, 19 nt, Pseudomonas aeruginosa PA01
guucagggaggaacccagg

SEQ ID NO: 1540713 - RNA, 23 nt, Pseudomonas aeruginosa PA01
guucagggcguagcggaagccgu

SEQ ID NO: 1540714 - RNA, 18 nt, Pseudomonas aeruginosa PA01
guucaguucugggcggcc

SEQ ID NO: 1540715 - RNA, 19 nt, Pseudomonas aeruginosa PA01
guucauguagcgcuccuuc

SEQ ID NO: 1540716 - RNA, 19 nt, Pseudomonas aeruginosa PA01
guucuucgacgcuggucag

SEQ ID NO: 1540717 - RNA, 18 nt, Pseudomonas aeruginosa PA01
guucguugaccguccaca

SEQ ID NO: 1540718 - RNA, 19 nt, Pseudomonas aeruginosa PA01
guucgucuuccagcggcca

SEQ ID NO: 1540719 - RNA, 14 nt, Pseudomonas aeruginosa PA01
guucgucgcccauc

SEQ ID NO: 1540720 - RNA, 17 nt, Pseudomonas aeruginosa PA01
guucgucgcccaucucg

SEQ ID NO: 1540721 - RNA, 19 nt, Pseudomonas aeruginosa PA01
guucggcagguugcucgcc

SEQ ID NO: 1540722 - RNA, 16 nt, Pseudomonas aeruginosa PA01
guucuugcugacguug

SEQ ID NO: 1540723 - RNA, 16 nt, Pseudomonas aeruginosa PA01
guucuugaccuucugc

SEQ ID NO: 1540724 - RNA, 20 nt, Pseudomonas aeruginosa PA01
guucuugaccuucugcaccg

SEQ ID NO: 1540725 - RNA, 19 nt, Pseudomonas aeruginosa PA01
guugaagaacggcccgcuc

SEQ ID NO: 1540726 - RNA, 13 nt, Pseudomonas aeruginosa PA01
guugaacugcccg

SEQ ID NO: 1540727 - RNA, 13 nt, Pseudomonas aeruginosa PA01
guugaacugcggu

SEQ ID NO: 1540728 - RNA, 17 nt, Pseudomonas aeruginosa PA01
guugaccccgcggccga

SEQ ID NO: 1540729 - RNA, 21 nt, Pseudomonas aeruginosa PA01
guugaccgccagacaggccag

SEQ ID NO: 1540730 - RNA, 14 nt, Pseudomonas aeruginosa PA01
guugagggccuuga

SEQ ID NO: 1540731 - RNA, 16 nt, Pseudomonas aeruginosa PA01
guugaucaccgcggug

SEQ ID NO: 1540732 - RNA, 17 nt, Pseudomonas aeruginosa PA01
guugagcuggccgagcg

SEQ ID NO: 1540733 - RNA, 17 nt, Pseudomonas aeruginosa PA01
guugagcugugguugug

SEQ ID NO: 1540734 - RNA, 11 nt, Pseudomonas aeruginosa PA01
guugaggaagu

SEQ ID NO: 1540735 - RNA, 22 nt, Pseudomonas aeruginosa PA01
guugaggaaaucaccgcugcgc

SEQ ID NO: 1540736 - RNA, 15 nt, Pseudomonas aeruginosa PA01
guugaccuucugucc

SEQ ID NO: 1540737 - RNA, 14 nt, Pseudomonas aeruginosa PA01
guugaccugcagcg

SEQ ID NO: 1540738 - RNA, 17 nt, Pseudomonas aeruginosa PA01
guugcagagcggccagg

SEQ ID NO: 1540739 - RNA, 15 nt, Pseudomonas aeruginosa PA01
guugcagggucgccg

SEQ ID NO: 1540740 - RNA, 22 nt, Pseudomonas aeruginosa PA01
guugcaggccggcgagccaggu

SEQ ID NO: 1540741 - RNA, 18 nt, Pseudomonas aeruginosa PA01
guugcacagcgcccagac

SEQ ID NO: 1540742 - RNA, 21 nt, Pseudomonas aeruginosa PA01
guugcaauagaaaagaauaau

SEQ ID NO: 1540743 - RNA, 15 nt, Pseudomonas aeruginosa PA01
guugcacgcaggccg

SEQ ID NO: 1540744 - RNA, 23 nt, Pseudomonas aeruginosa PA01
guugaugccguuguggcaggcgc

SEQ ID NO: 1540745 - RNA, 17 nt, Pseudomonas aeruginosa PA01
guugcucgcaccaggcc

SEQ ID NO: 1540746 - RNA, 21 nt, Pseudomonas aeruginosa PA01
guugcucgcaccaggccaggu

SEQ ID NO: 1540747 - RNA, 21 nt, Pseudomonas aeruginosa PA01
guugcucaccaaugccagugc

SEQ ID NO: 1540748 - RNA, 14 nt, Pseudomonas aeruginosa PA01
guugcgccgcagca

SEQ ID NO: 1540749 - RNA, 15 nt, Pseudomonas aeruginosa PA01
guugcgccgcagcaa

SEQ ID NO: 1540750 - RNA, 16 nt, Pseudomonas aeruginosa PA01
guugcgccgcagcaag

SEQ ID NO: 1540751 - RNA, 18 nt, Pseudomonas aeruginosa PA01
guugcgccagaccagccc

SEQ ID NO: 1540752 - RNA, 17 nt, Pseudomonas aeruginosa PA01
guugcgcggcagguggc

SEQ ID NO: 1540753 - RNA, 17 nt, Pseudomonas aeruginosa PA01
guugcgcgcauagcagg

SEQ ID NO: 1540754 - RNA, 19 nt, Pseudomonas aeruginosa PA01
guugcgccggcccagcagg

SEQ ID NO: 1540755 - RNA, 12 nt, Pseudomonas aeruginosa PA01
guugcggagagg

SEQ ID NO: 1540756 - RNA, 14 nt, Pseudomonas aeruginosa PA01
guugcggcgguggc

SEQ ID NO: 1540757 - RNA, 16 nt, Pseudomonas aeruginosa PA01
guugccuguccagcuc

SEQ ID NO: 1540758 - RNA, 13 nt, Pseudomonas aeruginosa PA01
guugcgcaucugc

SEQ ID NO: 1540759 - RNA, 19 nt, Pseudomonas aeruginosa PA01
guugcgcacccgcucggcc

SEQ ID NO: 1540760 - RNA, 16 nt, Pseudomonas aeruginosa PA01
guugcccgagugccgg

SEQ ID NO: 1540761 - RNA, 16 nt, Pseudomonas aeruginosa PA01
guugccauccagcgcc

SEQ ID NO: 1540762 - RNA, 16 nt, Pseudomonas aeruginosa PA01
guugcccacggccagg

SEQ ID NO: 1540763 - RNA, 13 nt, Pseudomonas aeruginosa PA01
guugcccagcccc

SEQ ID NO: 1540764 - RNA, 13 nt, Pseudomonas aeruginosa PA01
guugccagccggc

SEQ ID NO: 1540765 - RNA, 13 nt, Pseudomonas aeruginosa PA01
guugccagcagcg

SEQ ID NO: 1540766 - RNA, 16 nt, Pseudomonas aeruginosa PA01
guugccggcaaacgcc

SEQ ID NO: 1540767 - RNA, 10 nt, Pseudomonas aeruginosa PA01
guugccuggc

SEQ ID NO: 1540768 - RNA, 14 nt, Pseudomonas aeruginosa PA01
guugccgcugcagg

SEQ ID NO: 1540769 - RNA, 19 nt, Pseudomonas aeruginosa PA01
guugccgcugcaggccacc

SEQ ID NO: 1540770 - RNA, 15 nt, Pseudomonas aeruginosa PA01
guugccgccgaucag

SEQ ID NO: 1540771 - RNA, 23 nt, Pseudomonas aeruginosa PA01
guugccauagccgacgaaggcga

SEQ ID NO: 1540772 - RNA, 19 nt, Pseudomonas aeruginosa PA01
guugccgaccgagcagcgg

SEQ ID NO: 1540773 - RNA, 17 nt, Pseudomonas aeruginosa PA01
guugcccucgcagccgg

SEQ ID NO: 1540774 - RNA, 15 nt, Pseudomonas aeruginosa PA01
guugcccucgcgcug

SEQ ID NO: 1540775 - RNA, 18 nt, Pseudomonas aeruginosa PA01
guugccgaucaguggucg

SEQ ID NO: 1540776 - RNA, 12 nt, Pseudomonas aeruginosa PA01
guugccgcagca

SEQ ID NO: 1540777 - RNA, 16 nt, Pseudomonas aeruginosa PA01
guugccgcagcagcgg

SEQ ID NO: 1540778 - RNA, 15 nt, Pseudomonas aeruginosa PA01
guugccgccagcgcg

SEQ ID NO: 1540779 - RNA, 17 nt, Pseudomonas aeruginosa PA01
guuggcgaacuucaggc

SEQ ID NO: 1540780 - RNA, 20 nt, Pseudomonas aeruginosa PA01
guuggcgaaguucccgccgc

SEQ ID NO: 1540781 - RNA, 14 nt, Pseudomonas aeruginosa PA01
guuggcccagaccu

SEQ ID NO: 1540782 - RNA, 14 nt, Pseudomonas aeruginosa PA01
guuggccacguagg

SEQ ID NO: 1540783 - RNA, 19 nt, Pseudomonas aeruginosa PA01
guuggccaaccaggaagga

SEQ ID NO: 1540784 - RNA, 20 nt, Pseudomonas aeruginosa PA01
guuggccagcagccaggccu

SEQ ID NO: 1540785 - RNA, 22 nt, Pseudomonas aeruginosa PA01
guuggccagcgccaccagcagg

SEQ ID NO: 1540786 - RNA, 17 nt, Pseudomonas aeruginosa PA01
guuggacgcggccuggg

SEQ ID NO: 1540787 - RNA, 21 nt, Pseudomonas aeruginosa PA01
guuggaaccaguugccgagcu

SEQ ID NO: 1540788 - RNA, 13 nt, Pseudomonas aeruginosa PA01
guugcuguagaau

SEQ ID NO: 1540789 - RNA, 14 nt, Pseudomonas aeruginosa PA01
guugcuggcacagg

SEQ ID NO: 1540790 - RNA, 22 nt, Pseudomonas aeruginosa PA01
guugguguugauggucaccuug

SEQ ID NO: 1540791 - RNA, 13 nt, Pseudomonas aeruginosa PA01
guuggugcccuug

SEQ ID NO: 1540792 - RNA, 13 nt, Pseudomonas aeruginosa PA01
guuggucugcucg

SEQ ID NO: 1540793 - RNA, 20 nt, Pseudomonas aeruginosa PA01
guuggucggcaccagggcuu

SEQ ID NO: 1540794 - RNA, 14 nt, Pseudomonas aeruginosa PA01
guugggcagggugu

SEQ ID NO: 1540795 - RNA, 14 nt, Pseudomonas aeruginosa PA01
guuggcgcucggcc

SEQ ID NO: 1540796 - RNA, 20 nt, Pseudomonas aeruginosa PA01
guuggcuacccgcagggcuc

SEQ ID NO: 1540797 - RNA, 19 nt, Pseudomonas aeruginosa PA01
guuggcgugcaucaccuug

SEQ ID NO: 1540798 - RNA, 16 nt, Pseudomonas aeruginosa PA01
guuggccuggcccggc

SEQ ID NO: 1540799 - RNA, 16 nt, Pseudomonas aeruginosa PA01
guuggcggccaucagg

SEQ ID NO: 1540800 - RNA, 13 nt, Pseudomonas aeruginosa PA01
guuuccucgaagc

SEQ ID NO: 1540801 - RNA, 13 nt, Pseudomonas aeruginosa PA01
guuucgcagcgcu

SEQ ID NO: 1540802 - RNA, 17 nt, Pseudomonas aeruginosa PA01
guuguagaucggcagca

SEQ ID NO: 1540803 - RNA, 19 nt, Pseudomonas aeruginosa PA01
guuguaggccaugaucauc

SEQ ID NO: 1540804 - RNA, 17 nt, Pseudomonas aeruginosa PA01
guuguucgcgcaccuug

SEQ ID NO: 1540805 - RNA, 20 nt, Pseudomonas aeruginosa PA01
uaaaacggcaggcaaaaaaa

SEQ ID NO: 1540806 - RNA, 17 nt, Pseudomonas aeruginosa PA01
uaaaauccacaaucuau

SEQ ID NO: 1540807 - RNA, 20 nt, Pseudomonas aeruginosa PA01
uaaauccgucauacaacugu

SEQ ID NO: 1540808 - RNA, 21 nt, Pseudomonas aeruginosa PA01
uaaagcuggaccaccguggcg

SEQ ID NO: 1540809 - RNA, 22 nt, Pseudomonas aeruginosa PA01
uaaaugcccgggagguuugcca

SEQ ID NO: 1540810 - RNA, 14 nt, Pseudomonas aeruginosa PA01
uaaccaacagcguu

SEQ ID NO: 1540811 - RNA, 15 nt, Pseudomonas aeruginosa PA01
uaaccaacagcguuc

SEQ ID NO: 1540812 - RNA, 21 nt, Pseudomonas aeruginosa PA01
uaacgguagcggcaggagcau

SEQ ID NO: 1540813 - RNA, 23 nt, Pseudomonas aeruginosa PA01
uaacggcagccgcguugucccug

SEQ ID NO: 1540814 - RNA, 12 nt, Pseudomonas aeruginosa PA01
uaacgccgagga

SEQ ID NO: 1540815 - RNA, 20 nt, Pseudomonas aeruginosa PA01
uaacgccaacggcguuaucc

SEQ ID NO: 1540816 - RNA, 12 nt, Pseudomonas aeruginosa PA01
uaacgccacagg

SEQ ID NO: 1540817 - RNA, 19 nt, Pseudomonas aeruginosa PA01
uaagagaaugcgauugcug

SEQ ID NO: 1540818 - RNA, 21 nt, Pseudomonas aeruginosa PA01
uaguguugaagccgccaucga

SEQ ID NO: 1540819 - RNA, 22 nt, Pseudomonas aeruginosa PA01
uagguagagaugcagcagguag

SEQ ID NO: 1540820 - RNA, 19 nt, Pseudomonas aeruginosa PA01
uagguauccgccggccggg

SEQ ID NO: 1540821 - RNA, 23 nt, Pseudomonas aeruginosa PA01
uauccagcggccgcgaggacaac

SEQ ID NO: 1540822 - RNA, 15 nt, Pseudomonas aeruginosa PA01
uauccagggccagga

SEQ ID NO: 1540823 - RNA, 13 nt, Pseudomonas aeruginosa PA01
uauccccguaucc

SEQ ID NO: 1540824 - RNA, 19 nt, Pseudomonas aeruginosa PA01
uaucucuuuuuaagagaau

SEQ ID NO: 1540825 - RNA, 20 nt, Pseudomonas aeruginosa PA01
uaucucuuuuuaagagaaug

SEQ ID NO: 1540826 - RNA, 14 nt, Pseudomonas aeruginosa PA01
uaucgaucucgauc

SEQ ID NO: 1540827 - RNA, 15 nt, Pseudomonas aeruginosa PA01
uagccguccgggucg

SEQ ID NO: 1540828 - RNA, 16 nt, Pseudomonas aeruginosa PA01
uagccgugcagcagcg

SEQ ID NO: 1540829 - RNA, 18 nt, Pseudomonas aeruginosa PA01
uagccggccaaccaccgg

SEQ ID NO: 1540830 - RNA, 13 nt, Pseudomonas aeruginosa PA01
uagccggccaggg

SEQ ID NO: 1540831 - RNA, 16 nt, Pseudomonas aeruginosa PA01
uagccggcuuccucgc

SEQ ID NO: 1540832 - RNA, 17 nt, Pseudomonas aeruginosa PA01
uagccggcuuccucgcc

SEQ ID NO: 1540833 - RNA, 14 nt, Pseudomonas aeruginosa PA01
uagccuccuccggc

SEQ ID NO: 1540834 - RNA, 22 nt, Pseudomonas aeruginosa PA01
uagcgaaagaacaacuccugca

SEQ ID NO: 1540835 - RNA, 19 nt, Pseudomonas aeruginosa PA01
uagccugcggccagcgcca

SEQ ID NO: 1540836 - RNA, 21 nt, Pseudomonas aeruginosa PA01
uagccugcggccagcgccagg

SEQ ID NO: 1540837 - RNA, 18 nt, Pseudomonas aeruginosa PA01
uagccaggggucaggccg

SEQ ID NO: 1540838 - RNA, 21 nt, Pseudomonas aeruginosa PA01
uagccgaucaacgcggccagc

SEQ ID NO: 1540839 - RNA, 24 nt, Pseudomonas aeruginosa PA01
uagccgaucaacgcggccagcagc

SEQ ID NO: 1540840 - RNA, 20 nt, Pseudomonas aeruginosa PA01
uagccgcaagcggauauccc

SEQ ID NO: 1540841 - RNA, 17 nt, Pseudomonas aeruginosa PA01
uagccggcgagcgccug

SEQ ID NO: 1540842 - RNA, 20 nt, Pseudomonas aeruginosa PA01
uagccggcgaucagcgcuuc

SEQ ID NO: 1540843 - RNA, 20 nt, Pseudomonas aeruginosa PA01
uagccggcgaucauccagcc

SEQ ID NO: 1540844 - RNA, 23 nt, Pseudomonas aeruginosa PA01
uagccggcgaugccgcccagcac

SEQ ID NO: 1540845 - RNA, 21 nt, Pseudomonas aeruginosa PA01
uagccggcgaugugcggcgug

SEQ ID NO: 1540846 - RNA, 17 nt, Pseudomonas aeruginosa PA01
uagccggcgcgcccggc

SEQ ID NO: 1540847 - RNA, 16 nt, Pseudomonas aeruginosa PA01
uagccggcgcggcgca

SEQ ID NO: 1540848 - RNA, 20 nt, Pseudomonas aeruginosa PA01
uagcacauggucuucccaga

SEQ ID NO: 1540849 - RNA, 22 nt, Pseudomonas aeruginosa PA01
uagcacauggucuucccagacc

SEQ ID NO: 1540850 - RNA, 21 nt, Pseudomonas aeruginosa PA01
uagcaccgauuuccccaaggc

SEQ ID NO: 1540851 - RNA, 22 nt, Pseudomonas aeruginosa PA01
uagaucauuuuccgggucaugc

SEQ ID NO: 1540852 - RNA, 23 nt, Pseudomonas aeruginosa PA01
uagaucgcccgcaguuccucgcc

SEQ ID NO: 1540853 - RNA, 21 nt, Pseudomonas aeruginosa PA01
uagcucagucgguagagcaaa

SEQ ID NO: 1540854 - RNA, 15 nt, Pseudomonas aeruginosa PA01
uagcucagcuggaua

SEQ ID NO: 1540855 - RNA, 16 nt, Pseudomonas aeruginosa PA01
uagcgacggaaggugc

SEQ ID NO: 1540856 - RNA, 22 nt, Pseudomonas aeruginosa PA01
uagcguguaauugacgaugaag

SEQ ID NO: 1540857 - RNA, 14 nt, Pseudomonas aeruginosa PA01
uagcugcuccagcc

SEQ ID NO: 1540858 - RNA, 20 nt, Pseudomonas aeruginosa PA01
uagcugcagcgccccagcac

SEQ ID NO: 1540859 - RNA, 15 nt, Pseudomonas aeruginosa PA01
uagcucugccgaucc

SEQ ID NO: 1540860 - RNA, 12 nt, Pseudomonas aeruginosa PA01
uagcucugcugg

SEQ ID NO: 1540861 - RNA, 16 nt, Pseudomonas aeruginosa PA01
uaggaacaguugcgga

SEQ ID NO: 1540862 - RNA, 13 nt, Pseudomonas aeruginosa PA01
uagcuuuccaggg

SEQ ID NO: 1540863 - RNA, 15 nt, Pseudomonas aeruginosa PA01
uagcuuuccagggca

SEQ ID NO: 1540864 - RNA, 19 nt, Pseudomonas aeruginosa PA01
uaggcgccggcgcgcggcg

SEQ ID NO: 1540865 - RNA, 21 nt, Pseudomonas aeruginosa PA01
uagggcgaauaacgccacagg

SEQ ID NO: 1540866 - RNA, 12 nt, Pseudomonas aeruginosa PA01
uagggccgaggu

SEQ ID NO: 1540867 - RNA, 13 nt, Pseudomonas aeruginosa PA01
uagggcaucagcc

SEQ ID NO: 1540868 - RNA, 19 nt, Pseudomonas aeruginosa PA01
uagggcaucagccccucgg

SEQ ID NO: 1540869 - RNA, 17 nt, Pseudomonas aeruginosa PA01
uagggcggauagcgcgc

SEQ ID NO: 1540870 - RNA, 15 nt, Pseudomonas aeruginosa PA01
uagggcggcgcggcg

SEQ ID NO: 1540871 - RNA, 15 nt, Pseudomonas aeruginosa PA01
uaggggagcacggca

SEQ ID NO: 1540872 - RNA, 16 nt, Pseudomonas aeruginosa PA01
uagggggugaagcgca

SEQ ID NO: 1540873 - RNA, 17 nt, Pseudomonas aeruginosa PA01
uagggggugaagcgcag

SEQ ID NO: 1540874 - RNA, 16 nt, Pseudomonas aeruginosa PA01
uaggcgacgaagcugg

SEQ ID NO: 1540875 - RNA, 13 nt, Pseudomonas aeruginosa PA01
uaggcgaagccca

SEQ ID NO: 1540876 - RNA, 12 nt, Pseudomonas aeruginosa PA01
uaggccuggccg

SEQ ID NO: 1540877 - RNA, 16 nt, Pseudomonas aeruginosa PA01
uaggagccggccaggc

SEQ ID NO: 1540878 - RNA, 18 nt, Pseudomonas aeruginosa PA01
uaggagcgagagcgcugc

SEQ ID NO: 1540879 - RNA, 20 nt, Pseudomonas aeruginosa PA01
uaggagcgagagcgcugccg

SEQ ID NO: 1540880 - RNA, 16 nt, Pseudomonas aeruginosa PA01
uagaccgcuucgauga

SEQ ID NO: 1540881 - RNA, 12 nt, Pseudomonas aeruginosa PA01
uagaccaaggca

SEQ ID NO: 1540882 - RNA, 15 nt, Pseudomonas aeruginosa PA01
uagaccaccagcagg

SEQ ID NO: 1540883 - RNA, 19 nt, Pseudomonas aeruginosa PA01
uagaccagcaccgccugca

SEQ ID NO: 1540884 - RNA, 13 nt, Pseudomonas aeruginosa PA01
uagaccagcagcg

SEQ ID NO: 1540885 - RNA, 19 nt, Pseudomonas aeruginosa PA01
uagaccaccagcaggaucg

SEQ ID NO: 1540886 - RNA, 13 nt, Pseudomonas aeruginosa PA01
uagaccaccagcg

SEQ ID NO: 1540887 - RNA, 19 nt, Pseudomonas aeruginosa PA01
uagaccaccgugcgcaccu

SEQ ID NO: 1540888 - RNA, 17 nt, Pseudomonas aeruginosa PA01
uagaccacgcaggccag

SEQ ID NO: 1540889 - RNA, 18 nt, Pseudomonas aeruginosa PA01
uagaccacgcaggccagc

SEQ ID NO: 1540890 - RNA, 23 nt, Pseudomonas aeruginosa PA01
uagaccacgcaggccagcgccag

SEQ ID NO: 1540891 - RNA, 23 nt, Pseudomonas aeruginosa PA01
uagacgccucccaccgcgcggca

SEQ ID NO: 1540892 - RNA, 18 nt, Pseudomonas aeruginosa PA01
uagaguacucggcuacga

SEQ ID NO: 1540893 - RNA, 17 nt, Pseudomonas aeruginosa PA01
uagaggaucuccgaguc

SEQ ID NO: 1540894 - RNA, 22 nt, Pseudomonas aeruginosa PA01
uagaggaugccggccucgagga

SEQ ID NO: 1540895 - RNA, 11 nt, Pseudomonas aeruginosa PA01
uagagcggcac

SEQ ID NO: 1540896 - RNA, 20 nt, Pseudomonas aeruginosa PA01
uagagcgggccguuggcuuc

SEQ ID NO: 1540897 - RNA, 17 nt, Pseudomonas aeruginosa PA01
uagagcgcggcgcaggc

SEQ ID NO: 1540898 - RNA, 22 nt, Pseudomonas aeruginosa PA01
uagagcacgcccauggagaaua

SEQ ID NO: 1540899 - RNA, 18 nt, Pseudomonas aeruginosa PA01
uagaaaccgauguuggug

SEQ ID NO: 1540900 - RNA, 14 nt, Pseudomonas aeruginosa PA01
uagaacgccaggau

SEQ ID NO: 1540901 - RNA, 22 nt, Pseudomonas aeruginosa PA01
uacagcaauuacacccaacuug

SEQ ID NO: 1540902 - RNA, 15 nt, Pseudomonas aeruginosa PA01
uacagcgaggcccgc

SEQ ID NO: 1540903 - RNA, 19 nt, Pseudomonas aeruginosa PA01
uacagccugacguugccgc

SEQ ID NO: 1540904 - RNA, 16 nt, Pseudomonas aeruginosa PA01
uacaaugauggcccuu

SEQ ID NO: 1540905 - RNA, 15 nt, Pseudomonas aeruginosa PA01
uacagcgccacggcc

SEQ ID NO: 1540906 - RNA, 21 nt, Pseudomonas aeruginosa PA01
uacauagcgggucaugagguu

SEQ ID NO: 1540907 - RNA, 16 nt, Pseudomonas aeruginosa PA01
uacaggcgcagcagca

SEQ ID NO: 1540908 - RNA, 15 nt, Pseudomonas aeruginosa PA01
uaccgagggugcaga

SEQ ID NO: 1540909 - RNA, 15 nt, Pseudomonas aeruginosa PA01
uaccgagaucaccuu

SEQ ID NO: 1540910 - RNA, 17 nt, Pseudomonas aeruginosa PA01
uaccgacggucggcagg

SEQ ID NO: 1540911 - RNA, 18 nt, Pseudomonas aeruginosa PA01
uaccugccggcacgcuca

SEQ ID NO: 1540912 - RNA, 23 nt, Pseudomonas aeruginosa PA01
uaccugcgaauugcgcuggaagu

SEQ ID NO: 1540913 - RNA, 22 nt, Pseudomonas aeruginosa PA01
uaccucgaagcccagcgccugc

SEQ ID NO: 1540914 - RNA, 15 nt, Pseudomonas aeruginosa PA01
uaccucgccaggcug

SEQ ID NO: 1540915 - RNA, 14 nt, Pseudomonas aeruginosa PA01
uacccggcagggcc

SEQ ID NO: 1540916 - RNA, 18 nt, Pseudomonas aeruginosa PA01
uacccguacgcugccagg

SEQ ID NO: 1540917 - RNA, 13 nt, Pseudomonas aeruginosa PA01
uacccagggugcg

SEQ ID NO: 1540918 - RNA, 18 nt, Pseudomonas aeruginosa PA01
uacccagguaagcggcgu

SEQ ID NO: 1540919 - RNA, 21 nt, Pseudomonas aeruginosa PA01
uacgccgcgcugcgccaggcc

SEQ ID NO: 1540920 - RNA, 21 nt, Pseudomonas aeruginosa PA01
uacgacuucggcgacagccgg

SEQ ID NO: 1540921 - RNA, 19 nt, Pseudomonas aeruginosa PA01
uaccuggcgguacagcccc

SEQ ID NO: 1540922 - RNA, 17 nt, Pseudomonas aeruginosa PA01
uacgcucgggcccuccc

SEQ ID NO: 1540923 - RNA, 23 nt, Pseudomonas aeruginosa PA01
uacgcugcauguccgcaggcagg

SEQ ID NO: 1540924 - RNA, 15 nt, Pseudomonas aeruginosa PA01
uacgcucgccgacgg

SEQ ID NO: 1540925 - RNA, 13 nt, Pseudomonas aeruginosa PA01
uacgcucaggaag

SEQ ID NO: 1540926 - RNA, 14 nt, Pseudomonas aeruginosa PA01
uacgguacaguuca

SEQ ID NO: 1540927 - RNA, 20 nt, Pseudomonas aeruginosa PA01
uaagugccgaccacaugggc

SEQ ID NO: 1540928 - RNA, 22 nt, Pseudomonas aeruginosa PA01
uaagugccgaccacaugggcga

SEQ ID NO: 1540929 - RNA, 19 nt, Pseudomonas aeruginosa PA01
uaagguuuuccgucacugg

SEQ ID NO: 1540930 - RNA, 14 nt, Pseudomonas aeruginosa PA01
uaaggcaugcccag

SEQ ID NO: 1540931 - RNA, 23 nt, Pseudomonas aeruginosa PA01
uaauggcaccuggauaucaccuc

SEQ ID NO: 1540932 - RNA, 13 nt, Pseudomonas aeruginosa PA01
uaauccaucgcuu

SEQ ID NO: 1540933 - RNA, 14 nt, Pseudomonas aeruginosa PA01
ggcucaacuggucc

SEQ ID NO: 1540934 - RNA, 19 nt, Pseudomonas aeruginosa PA01
ggcucaacugguccugagg

SEQ ID NO: 1540935 - RNA, 23 nt, Pseudomonas aeruginosa PA01
ggcucagccgaccaccuucaggc

SEQ ID NO: 1540936 - RNA, 12 nt, Pseudomonas aeruginosa PA01
ggcucagccgcu

SEQ ID NO: 1540937 - RNA, 23 nt, Pseudomonas aeruginosa PA01
ggcucagcgcuucggcuccagca

SEQ ID NO: 1540938 - RNA, 14 nt, Pseudomonas aeruginosa PA01
ggcucagaaguccc

SEQ ID NO: 1540939 - RNA, 17 nt, Pseudomonas aeruginosa PA01
ggcucagaagucccagc

SEQ ID NO: 1540940 - RNA, 17 nt, Pseudomonas aeruginosa PA01
ggcucacgccccagcgc

SEQ ID NO: 1540941 - RNA, 12 nt, Pseudomonas aeruginosa PA01
ggcucacucccg

SEQ ID NO: 1540942 - RNA, 20 nt, Pseudomonas aeruginosa PA01
ggcucacucccguccagcgc

SEQ ID NO: 1540943 - RNA, 16 nt, Pseudomonas aeruginosa PA01
ggcucagcucucccga

SEQ ID NO: 1540944 - RNA, 14 nt, Pseudomonas aeruginosa PA01
ggcucagcccaggc

SEQ ID NO: 1540945 - RNA, 16 nt, Pseudomonas aeruginosa PA01
ggcucagcccaggcgc

SEQ ID NO: 1540946 - RNA, 14 nt, Pseudomonas aeruginosa PA01
ggcucaggccgccg

SEQ ID NO: 1540947 - RNA, 14 nt, Pseudomonas aeruginosa PA01
ggcucaggccgggc

SEQ ID NO: 1540948 - RNA, 13 nt, Pseudomonas aeruginosa PA01
ggcucaucgcccg

SEQ ID NO: 1540949 - RNA, 13 nt, Pseudomonas aeruginosa PA01
ggcuccucggccu

SEQ ID NO: 1540950 - RNA, 13 nt, Pseudomonas aeruginosa PA01
ggcuccucugccu

SEQ ID NO: 1540951 - RNA, 20 nt, Pseudomonas aeruginosa PA01
ggcuccgcugcucagggcuc

SEQ ID NO: 1540952 - RNA, 14 nt, Pseudomonas aeruginosa PA01
ggcucgaucggcag

SEQ ID NO: 1540953 - RNA, 20 nt, Pseudomonas aeruginosa PA01
ggcucgaggccgagccggca

SEQ ID NO: 1540954 - RNA, 20 nt, Pseudomonas aeruginosa PA01
ggcucgaugaguugcagggc

SEQ ID NO: 1540955 - RNA, 20 nt, Pseudomonas aeruginosa PA01
ggcuccgaugaagcaggcgg

SEQ ID NO: 1540956 - RNA, 12 nt, Pseudomonas aeruginosa PA01
ggcuccccugga

SEQ ID NO: 1540957 - RNA, 21 nt, Pseudomonas aeruginosa PA01
ggcuccccuggagcccccguu

SEQ ID NO: 1540958 - RNA, 16 nt, Pseudomonas aeruginosa PA01
ggcuccagcaccagca

SEQ ID NO: 1540959 - RNA, 21 nt, Pseudomonas aeruginosa PA01
ggcuccacugcuuggccaggc

SEQ ID NO: 1540960 - RNA, 10 nt, Pseudomonas aeruginosa PA01
ggcuccagcc

SEQ ID NO: 1540961 - RNA, 15 nt, Pseudomonas aeruginosa PA01
ggcuccagccaggcc

SEQ ID NO: 1540962 - RNA, 15 nt, Pseudomonas aeruginosa PA01
ggcuccagccgggcu

SEQ ID NO: 1540963 - RNA, 13 nt, Pseudomonas aeruginosa PA01
ggcuccaggggag

SEQ ID NO: 1540964 - RNA, 18 nt, Pseudomonas aeruginosa PA01
ggcuccaggggagccccg

SEQ ID NO: 1540965 - RNA, 21 nt, Pseudomonas aeruginosa PA01
ggcuccagcuugucgucggcc

SEQ ID NO: 1540966 - RNA, 22 nt, Pseudomonas aeruginosa PA01
ggcucuuugcgacugacgcuca

SEQ ID NO: 1540967 - RNA, 21 nt, Pseudomonas aeruginosa PA01
ggcucuucuucgaaccgcaga

SEQ ID NO: 1540968 - RNA, 17 nt, Pseudomonas aeruginosa PA01
ggcucugcuucuguccc

SEQ ID NO: 1540969 - RNA, 15 nt, Pseudomonas aeruginosa PA01
ggcucuguuccucgg

SEQ ID NO: 1540970 - RNA, 19 nt, Pseudomonas aeruginosa PA01
ggcucuguuccucggcggc

SEQ ID NO: 1540971 - RNA, 20 nt, Pseudomonas aeruginosa PA01
ggcucuguuccucggcggcg

SEQ ID NO: 1540972 - RNA, 22 nt, Pseudomonas aeruginosa PA01
ggcucuguuccucggcggcggu

SEQ ID NO: 1540973 - RNA, 22 nt, Pseudomonas aeruginosa PA01
ggcucuccccgcucccgcggcc

SEQ ID NO: 1540974 - RNA, 14 nt, Pseudomonas aeruginosa PA01
ggcucucgcgcagc

SEQ ID NO: 1540975 - RNA, 15 nt, Pseudomonas aeruginosa PA01
ggcucucgcgcagca

SEQ ID NO: 1540976 - RNA, 19 nt, Pseudomonas aeruginosa PA01
ggcucggcgagcgaaggau

SEQ ID NO: 1540977 - RNA, 17 nt, Pseudomonas aeruginosa PA01
ggcucggcugcuugccg

SEQ ID NO: 1540978 - RNA, 15 nt, Pseudomonas aeruginosa PA01
ggcucggcggcaggc

SEQ ID NO: 1540979 - RNA, 13 nt, Pseudomonas aeruginosa PA01
ggcucgggcggca

SEQ ID NO: 1540980 - RNA, 18 nt, Pseudomonas aeruginosa PA01
ggcucgggcggcaagggc

SEQ ID NO: 1540981 - RNA, 16 nt, Pseudomonas aeruginosa PA01
ggcucgguuccagcuc

SEQ ID NO: 1540982 - RNA, 16 nt, Pseudomonas aeruginosa PA01
ggcucgccccggcggc

SEQ ID NO: 1540983 - RNA, 17 nt, Pseudomonas aeruginosa PA01
ggcucgccccggcggcg

SEQ ID NO: 1540984 - RNA, 14 nt, Pseudomonas aeruginosa PA01
ggcucgccgccagc

SEQ ID NO: 1540985 - RNA, 16 nt, Pseudomonas aeruginosa PA01
ggcucgccgccagcag

SEQ ID NO: 1540986 - RNA, 21 nt, Pseudomonas aeruginosa PA01
ggcucgccggguuguccaggc

SEQ ID NO: 1540987 - RNA, 16 nt, Pseudomonas aeruginosa PA01
ggcucgcgcagcggcg

SEQ ID NO: 1540988 - RNA, 18 nt, Pseudomonas aeruginosa PA01
ggcucgcgguucgaggac

SEQ ID NO: 1540989 - RNA, 16 nt, Pseudomonas aeruginosa PA01
ggcucgcggcgcucgu

SEQ ID NO: 1540990 - RNA, 16 nt, Pseudomonas aeruginosa PA01
ggcucggcagcggauc

SEQ ID NO: 1540991 - RNA, 16 nt, Pseudomonas aeruginosa PA01
ggcugaagcggccgcc

SEQ ID NO: 1540992 - RNA, 23 nt, Pseudomonas aeruginosa PA01
ggcugaacagcgccaccagcaug

SEQ ID NO: 1540993 - RNA, 22 nt, Pseudomonas aeruginosa PA01
ggcugagaccuuccugccagcg

SEQ ID NO: 1540994 - RNA, 14 nt, Pseudomonas aeruginosa PA01
ggcugagacgcugc

SEQ ID NO: 1540995 - RNA, 16 nt, Pseudomonas aeruginosa PA01
ggcugagcgccaggcg

SEQ ID NO: 1540996 - RNA, 19 nt, Pseudomonas aeruginosa PA01
ggcugagcgccaggcgcaa

SEQ ID NO: 1540997 - RNA, 21 nt, Pseudomonas aeruginosa PA01
ggcugaucggccgccagugca

SEQ ID NO: 1540998 - RNA, 19 nt, Pseudomonas aeruginosa PA01
ggcugaucggcgcgccggc

SEQ ID NO: 1540999 - RNA, 20 nt, Pseudomonas aeruginosa PA01
ggcugaggcguuccaguucg

SEQ ID NO: 1541000 - RNA, 18 nt, Pseudomonas aeruginosa PA01
ggcugaucuugccgcugg

SEQ ID NO: 1541001 - RNA, 15 nt, Pseudomonas aeruginosa PA01
ggcugcaacgccggc

SEQ ID NO: 1541002 - RNA, 14 nt, Pseudomonas aeruginosa PA01
ggcugcgugccagc

SEQ ID NO: 1541003 - RNA, 12 nt, Pseudomonas aeruginosa PA01
ggcugcucgccu

SEQ ID NO: 1541004 - RNA, 17 nt, Pseudomonas aeruginosa PA01
ggcugcugcugcggcuu

SEQ ID NO: 1541005 - RNA, 13 nt, Pseudomonas aeruginosa PA01
ggcugcuccggau

SEQ ID NO: 1541006 - RNA, 12 nt, Pseudomonas aeruginosa PA01
ggcugcggccuc

SEQ ID NO: 1541007 - RNA, 14 nt, Pseudomonas aeruginosa PA01
ggcugcgcuccagg

SEQ ID NO: 1541008 - RNA, 15 nt, Pseudomonas aeruginosa PA01
ggcugcgcuccaggc

SEQ ID NO: 1541009 - RNA, 13 nt, Pseudomonas aeruginosa PA01
ggcugcgcucggc

SEQ ID NO: 1541010 - RNA, 18 nt, Pseudomonas aeruginosa PA01
ggcugcgcaucgccuggg

SEQ ID NO: 1541011 - RNA, 17 nt, Pseudomonas aeruginosa PA01
ggcugcgcggaguggau

SEQ ID NO: 1541012 - RNA, 15 nt, Pseudomonas aeruginosa PA01
ggcugccggccaggu

SEQ ID NO: 1541013 - RNA, 17 nt, Pseudomonas aeruginosa PA01
ggcugccaccgagggca

SEQ ID NO: 1541014 - RNA, 20 nt, Pseudomonas aeruginosa PA01
ggcugccaccgagggcagga

SEQ ID NO: 1541015 - RNA, 14 nt, Pseudomonas aeruginosa PA01
ggcugcaucggcuc

SEQ ID NO: 1541016 - RNA, 17 nt, Pseudomonas aeruginosa PA01
ggcugcagggccaggga

SEQ ID NO: 1541017 - RNA, 21 nt, Pseudomonas aeruginosa PA01
ggcugcagguaggcgguggcg

SEQ ID NO: 1541018 - RNA, 22 nt, Pseudomonas aeruginosa PA01
ggcugcuugccgcucaggcugu

SEQ ID NO: 1541019 - RNA, 18 nt, Pseudomonas aeruginosa PA01
ggcugcuugccggugcca

SEQ ID NO: 1541020 - RNA, 12 nt, Pseudomonas aeruginosa PA01
ggcuggccagca

SEQ ID NO: 1541021 - RNA, 13 nt, Pseudomonas aeruginosa PA01
ggcuggccagcaa

SEQ ID NO: 1541022 - RNA, 13 nt, Pseudomonas aeruginosa PA01
ggcuggccagcag

SEQ ID NO: 1541023 - RNA, 16 nt, Pseudomonas aeruginosa PA01
ggcuggccagcaggcu

SEQ ID NO: 1541024 - RNA, 13 nt, Pseudomonas aeruginosa PA01
ggcuggccgagga

SEQ ID NO: 1541025 - RNA, 21 nt, Pseudomonas aeruginosa PA01
ggcuggccgaggacccggcgg

SEQ ID NO: 1541026 - RNA, 14 nt, Pseudomonas aeruginosa PA01
ggcuggcccucggc

SEQ ID NO: 1541027 - RNA, 23 nt, Pseudomonas aeruginosa PA01
ggcuggccaugauccggugcagg

SEQ ID NO: 1541028 - RNA, 13 nt, Pseudomonas aeruginosa PA01
ggcuggccccggu

SEQ ID NO: 1541029 - RNA, 18 nt, Pseudomonas aeruginosa PA01
ggcuggcgaccggguccu

SEQ ID NO: 1541030 - RNA, 17 nt, Pseudomonas aeruginosa PA01
ggcuggcgcaggaccgc

SEQ ID NO: 1541031 - RNA, 19 nt, Pseudomonas aeruginosa PA01
ggcuggcggcaucggcgcc

SEQ ID NO: 1541032 - RNA, 13 nt, Pseudomonas aeruginosa PA01
ggcuggcggccag

SEQ ID NO: 1541033 - RNA, 23 nt, Pseudomonas aeruginosa PA01
ggcugggcgcccuucagcgccuc

SEQ ID NO: 1541034 - RNA, 18 nt, Pseudomonas aeruginosa PA01
ggcugggccgaaccgggg

SEQ ID NO: 1541035 - RNA, 14 nt, Pseudomonas aeruginosa PA01
ggcuggcggcucgg

SEQ ID NO: 1541036 - RNA, 15 nt, Pseudomonas aeruginosa PA01
ggcuggcgccgcggg

SEQ ID NO: 1541037 - RNA, 16 nt, Pseudomonas aeruginosa PA01
ggcuguagccucccgc

SEQ ID NO: 1541038 - RNA, 18 nt, Pseudomonas aeruginosa PA01
ggcuguagccucccgccg

SEQ ID NO: 1541039 - RNA, 13 nt, Pseudomonas aeruginosa PA01
ggcuguagcgcuc

SEQ ID NO: 1541040 - RNA, 22 nt, Pseudomonas aeruginosa PA01
ggcuguagcucugcuggcugua

SEQ ID NO: 1541041 - RNA, 21 nt, Pseudomonas aeruginosa PA01
ggcugguggucaccgccagcg

SEQ ID NO: 1541042 - RNA, 23 nt, Pseudomonas aeruginosa PA01
ggcugguggucaccgccagcggg

SEQ ID NO: 1541043 - RNA, 16 nt, Pseudomonas aeruginosa PA01
ggcugguugccagcag

SEQ ID NO: 1541044 - RNA, 17 nt, Pseudomonas aeruginosa PA01
ggcugguugccagcagc

SEQ ID NO: 1541045 - RNA, 15 nt, Pseudomonas aeruginosa PA01
ggcugggucggcugg

SEQ ID NO: 1541046 - RNA, 18 nt, Pseudomonas aeruginosa PA01
ggcuggguucggcgagga

SEQ ID NO: 1541047 - RNA, 16 nt, Pseudomonas aeruginosa PA01
ggcuggucggcuuccg

SEQ ID NO: 1541048 - RNA, 15 nt, Pseudomonas aeruginosa PA01
ggcuuccucgcccuc

SEQ ID NO: 1541049 - RNA, 23 nt, Pseudomonas aeruginosa PA01
ggcuuccugguggaacagccgca

SEQ ID NO: 1541050 - RNA, 18 nt, Pseudomonas aeruginosa PA01
ggcuuccagccagcccuc

SEQ ID NO: 1541051 - RNA, 15 nt, Pseudomonas aeruginosa PA01
ggcuuggcccugcgc

SEQ ID NO: 1541052 - RNA, 13 nt, Pseudomonas aeruginosa PA01
ggcuucggcggcg

SEQ ID NO: 1541053 - RNA, 16 nt, Pseudomonas aeruginosa PA01
ggcuuccggcuccagu

SEQ ID NO: 1541054 - RNA, 14 nt, Pseudomonas aeruginosa PA01
gggaaacaccaggc

SEQ ID NO: 1541055 - RNA, 10 nt, Pseudomonas aeruginosa PA01
ggcuuguccu

SEQ ID NO: 1541056 - RNA, 16 nt, Pseudomonas aeruginosa PA01
ggcuuguccuuggccu

SEQ ID NO: 1541057 - RNA, 18 nt, Pseudomonas aeruginosa PA01
ggcuuguccuuggccucc

SEQ ID NO: 1541058 - RNA, 20 nt, Pseudomonas aeruginosa PA01
gggcgcucguugcgccgcuc

SEQ ID NO: 1541059 - RNA, 18 nt, Pseudomonas aeruginosa PA01
gggcgcucuggccgcgcu

SEQ ID NO: 1541060 - RNA, 16 nt, Pseudomonas aeruginosa PA01
gggcgcguugcccagc

SEQ ID NO: 1541061 - RNA, 21 nt, Pseudomonas aeruginosa PA01
gggcguaacggcucgccgggu

SEQ ID NO: 1541062 - RNA, 22 nt, Pseudomonas aeruginosa PA01
gggcguacaggccccaggcgau

SEQ ID NO: 1541063 - RNA, 15 nt, Pseudomonas aeruginosa PA01
gggcggucggcgagg

SEQ ID NO: 1541064 - RNA, 16 nt, Pseudomonas aeruginosa PA01
gggcguccggcgagca

SEQ ID NO: 1541065 - RNA, 14 nt, Pseudomonas aeruginosa PA01
gggcguagcggaag

SEQ ID NO: 1541066 - RNA, 17 nt, Pseudomonas aeruginosa PA01
gggcguaguagggacgg

SEQ ID NO: 1541067 - RNA, 14 nt, Pseudomonas aeruginosa PA01
gggcgugcuccagc

SEQ ID NO: 1541068 - RNA, 15 nt, Pseudomonas aeruginosa PA01
gggcgugcuccagca

SEQ ID NO: 1541069 - RNA, 23 nt, Pseudomonas aeruginosa PA01
gggcguugcgcgccucgccccag

SEQ ID NO: 1541070 - RNA, 18 nt, Pseudomonas aeruginosa PA01
gggcgucuccugccgccg

SEQ ID NO: 1541071 - RNA, 18 nt, Pseudomonas aeruginosa PA01
gggcgucgaaggcggcgc

SEQ ID NO: 1541072 - RNA, 14 nt, Pseudomonas aeruginosa PA01
gggcgucgucgggg

SEQ ID NO: 1541073 - RNA, 17 nt, Pseudomonas aeruginosa PA01
gggcgucggcgugcugg

SEQ ID NO: 1541074 - RNA, 16 nt, Pseudomonas aeruginosa PA01
gggcugcgugccagca

SEQ ID NO: 1541075 - RNA, 12 nt, Pseudomonas aeruginosa PA01
gggcugcugucc

SEQ ID NO: 1541076 - RNA, 12 nt, Pseudomonas aeruginosa PA01
gggcugccagca

SEQ ID NO: 1541077 - RNA, 13 nt, Pseudomonas aeruginosa PA01
gggcugccgcaga

SEQ ID NO: 1541078 - RNA, 13 nt, Pseudomonas aeruginosa PA01
gggcuugccgggg

SEQ ID NO: 1541079 - RNA, 19 nt, Pseudomonas aeruginosa PA01
gggcugcuguugccaggga

SEQ ID NO: 1541080 - RNA, 17 nt, Pseudomonas aeruginosa PA01
gggcuggccaccagcac

SEQ ID NO: 1541081 - RNA, 18 nt, Pseudomonas aeruginosa PA01
gggcuggccaccagcacc

SEQ ID NO: 1541082 - RNA, 16 nt, Pseudomonas aeruginosa PA01
gggcuggccaccgcca

SEQ ID NO: 1541083 - RNA, 17 nt, Pseudomonas aeruginosa PA01
gggcuggcagguugugc

SEQ ID NO: 1541084 - RNA, 17 nt, Pseudomonas aeruginosa PA01
ggggaaagcuccucggc

SEQ ID NO: 1541085 - RNA, 18 nt, Pseudomonas aeruginosa PA01
ggggaaucugcgccaggu

SEQ ID NO: 1541086 - RNA, 22 nt, Pseudomonas aeruginosa PA01
ggggacaugucgaggguugggc

SEQ ID NO: 1541087 - RNA, 22 nt, Pseudomonas aeruginosa PA01
ggggaaaccuucgguggcgacc

SEQ ID NO: 1541088 - RNA, 19 nt, Pseudomonas aeruginosa PA01
gggcuuuuuuggguuggcg

SEQ ID NO: 1541089 - RNA, 20 nt, Pseudomonas aeruginosa PA01
gggcuuuuucaugggcgcgc

SEQ ID NO: 1541090 - RNA, 19 nt, Pseudomonas aeruginosa PA01
gggcuggacguacauggga

SEQ ID NO: 1541091 - RNA, 23 nt, Pseudomonas aeruginosa PA01
gggccuuuuucacuacaggaccu

SEQ ID NO: 1541092 - RNA, 15 nt, Pseudomonas aeruginosa PA01
gggccuuggccucca

SEQ ID NO: 1541093 - RNA, 19 nt, Pseudomonas aeruginosa PA01
gggcgaagucggcuugggu

SEQ ID NO: 1541094 - RNA, 20 nt, Pseudomonas aeruginosa PA01
gggcgaauaacgccacaggc

SEQ ID NO: 1541095 - RNA, 19 nt, Pseudomonas aeruginosa PA01
gggcgaaacggcaggccag

SEQ ID NO: 1541096 - RNA, 21 nt, Pseudomonas aeruginosa PA01
gggcgaacaacgccgccggcg

SEQ ID NO: 1541097 - RNA, 18 nt, Pseudomonas aeruginosa PA01
gggcgaacagcacccagg

SEQ ID NO: 1541098 - RNA, 16 nt, Pseudomonas aeruginosa PA01
gggcgaacagcagcgg

SEQ ID NO: 1541099 - RNA, 21 nt, Pseudomonas aeruginosa PA01
gggcgaacagcgagacccggu

SEQ ID NO: 1541100 - RNA, 18 nt, Pseudomonas aeruginosa PA01
gggccuuguucagggugg

SEQ ID NO: 1541101 - RNA, 14 nt, Pseudomonas aeruginosa PA01
gggccuugagcagg

SEQ ID NO: 1541102 - RNA, 23 nt, Pseudomonas aeruginosa PA01
gggccuugagcaggcguuccggg

SEQ ID NO: 1541103 - RNA, 14 nt, Pseudomonas aeruginosa PA01
gggcgaccugcucg

SEQ ID NO: 1541104 - RNA, 15 nt, Pseudomonas aeruginosa PA01
gggcgaccugcucgc

SEQ ID NO: 1541105 - RNA, 15 nt, Pseudomonas aeruginosa PA01
gggcgagagacugaa

SEQ ID NO: 1541106 - RNA, 17 nt, Pseudomonas aeruginosa PA01
gggcgagcagggcacag

SEQ ID NO: 1541107 - RNA, 17 nt, Pseudomonas aeruginosa PA01
gggcgacauagcggcug

SEQ ID NO: 1541108 - RNA, 19 nt, Pseudomonas aeruginosa PA01
gggcgaccuucagcggguc

SEQ ID NO: 1541109 - RNA, 16 nt, Pseudomonas aeruginosa PA01
gggcgaccgccaggcg

SEQ ID NO: 1541110 - RNA, 18 nt, Pseudomonas aeruginosa PA01
gggccggcaugcucagcc

SEQ ID NO: 1541111 - RNA, 18 nt, Pseudomonas aeruginosa PA01
gggccggcgauggcccag

SEQ ID NO: 1541112 - RNA, 23 nt, Pseudomonas aeruginosa PA01
gggccgcucgagggcgaccgcca

SEQ ID NO: 1541113 - RNA, 22 nt, Pseudomonas aeruginosa PA01
gggccuugaccaccgccaggcu

SEQ ID NO: 1541114 - RNA, 15 nt, Pseudomonas aeruginosa PA01
gggccuucaggcugc

SEQ ID NO: 1541115 - RNA, 16 nt, Pseudomonas aeruginosa PA01
gggccggcgccagcag

SEQ ID NO: 1541116 - RNA, 14 nt, Pseudomonas aeruginosa PA01
gggccugcucagcg

SEQ ID NO: 1541117 - RNA, 12 nt, Pseudomonas aeruginosa PA01
gggccugcucgg

SEQ ID NO: 1541118 - RNA, 19 nt, Pseudomonas aeruginosa PA01
gggccugcugcgggcgcug

SEQ ID NO: 1541119 - RNA, 17 nt, Pseudomonas aeruginosa PA01
gggcgcgcagcagguag

SEQ ID NO: 1541120 - RNA, 15 nt, Pseudomonas aeruginosa PA01
gggcgcgccugagcu

SEQ ID NO: 1541121 - RNA, 13 nt, Pseudomonas aeruginosa PA01
gggcgcgcgccgg

SEQ ID NO: 1541122 - RNA, 12 nt, Pseudomonas aeruginosa PA01
gggcgcgcgccg

SEQ ID NO: 1541123 - RNA, 18 nt, Pseudomonas aeruginosa PA01
gggcgcggacaagcccag

SEQ ID NO: 1541124 - RNA, 15 nt, Pseudomonas aeruginosa PA01
gggcgcgcugcgaau

SEQ ID NO: 1541125 - RNA, 16 nt, Pseudomonas aeruginosa PA01
gggcgcccgccaaggc

SEQ ID NO: 1541126 - RNA, 13 nt, Pseudomonas aeruginosa PA01
gggcgccucgccg

SEQ ID NO: 1541127 - RNA, 18 nt, Pseudomonas aeruginosa PA01
gggcgccucgccgcggca

SEQ ID NO: 1541128 - RNA, 20 nt, Pseudomonas aeruginosa PA01
gggcgccuuuuuucauccug

SEQ ID NO: 1541129 - RNA, 17 nt, Pseudomonas aeruginosa PA01
gggcgccuguccgggaa

SEQ ID NO: 1541130 - RNA, 18 nt, Pseudomonas aeruginosa PA01
gggcgaguucggcgagca

SEQ ID NO: 1541131 - RNA, 20 nt, Pseudomonas aeruginosa PA01
gggcgaguucggcgagcagg

SEQ ID NO: 1541132 - RNA, 14 nt, Pseudomonas aeruginosa PA01
gggcgagggcggcg

SEQ ID NO: 1541133 - RNA, 18 nt, Pseudomonas aeruginosa PA01
gggcgaggucgccacgca

SEQ ID NO: 1541134 - RNA, 19 nt, Pseudomonas aeruginosa PA01
gggcgaggucggccugcgg

SEQ ID NO: 1541135 - RNA, 15 nt, Pseudomonas aeruginosa PA01
gggcgaugaggcugu

SEQ ID NO: 1541136 - RNA, 20 nt, Pseudomonas aeruginosa PA01
gggcgcaaggccagcggcau

SEQ ID NO: 1541137 - RNA, 20 nt, Pseudomonas aeruginosa PA01
gggcgcauaacgccaacggc

SEQ ID NO: 1541138 - RNA, 14 nt, Pseudomonas aeruginosa PA01
gggcgcaccgccuc

SEQ ID NO: 1541139 - RNA, 12 nt, Pseudomonas aeruginosa PA01
gggcgccagggg

SEQ ID NO: 1541140 - RNA, 19 nt, Pseudomonas aeruginosa PA01
gggcgccaggugcaggaag

SEQ ID NO: 1541141 - RNA, 19 nt, Pseudomonas aeruginosa PA01
gggaaauccuugagcaccc

SEQ ID NO: 1541142 - RNA, 12 nt, Pseudomonas aeruginosa PA01
gggaacagcgcc

SEQ ID NO: 1541143 - RNA, 18 nt, Pseudomonas aeruginosa PA01
gggaacagcgccagcggc

SEQ ID NO: 1541144 - RNA, 22 nt, Pseudomonas aeruginosa PA01
gggaacagcgccagcggcagcg

SEQ ID NO: 1541145 - RNA, 19 nt, Pseudomonas aeruginosa PA01
gggagccgccggacuugga

SEQ ID NO: 1541146 - RNA, 19 nt, Pseudomonas aeruginosa PA01
gggaacgaugccgcaggca

SEQ ID NO: 1541147 - RNA, 17 nt, Pseudomonas aeruginosa PA01
gggaacagcauggugaa

SEQ ID NO: 1541148 - RNA, 14 nt, Pseudomonas aeruginosa PA01
gggaguccaggcgg

SEQ ID NO: 1541149 - RNA, 16 nt, Pseudomonas aeruginosa PA01
gggaguccaggcgggc

SEQ ID NO: 1541150 - RNA, 14 nt, Pseudomonas aeruginosa PA01
gggaguccgccagc

SEQ ID NO: 1541151 - RNA, 15 nt, Pseudomonas aeruginosa PA01
gggaggugcggcggu

SEQ ID NO: 1541152 - RNA, 16 nt, Pseudomonas aeruginosa PA01
gggaggaagcuccccg

SEQ ID NO: 1541153 - RNA, 18 nt, Pseudomonas aeruginosa PA01
gggagcgccggcgcgguc

SEQ ID NO: 1541154 - RNA, 13 nt, Pseudomonas aeruginosa PA01
gggagcgcucgcg

SEQ ID NO: 1541155 - RNA, 11 nt, Pseudomonas aeruginosa PA01
gggagcggccg

SEQ ID NO: 1541156 - RNA, 14 nt, Pseudomonas aeruginosa PA01
gggauagcuuucca

SEQ ID NO: 1541157 - RNA, 13 nt, Pseudomonas aeruginosa PA01
gggauauccaggu

SEQ ID NO: 1541158 - RNA, 14 nt, Pseudomonas aeruginosa PA01
gggaugccauggca

SEQ ID NO: 1541159 - RNA, 22 nt, Pseudomonas aeruginosa PA01
gggaucuccucgacggcgggag

SEQ ID NO: 1541160 - RNA, 18 nt, Pseudomonas aeruginosa PA01
gggaugccgccggcaucc

SEQ ID NO: 1541161 - RNA, 12 nt, Pseudomonas aeruginosa PA01
gggaugccgggc

SEQ ID NO: 1541162 - RNA, 15 nt, Pseudomonas aeruginosa PA01
gggauggucgagggc

SEQ ID NO: 1541163 - RNA, 17 nt, Pseudomonas aeruginosa PA01
gggauguacgccagggu

SEQ ID NO: 1541164 - RNA, 20 nt, Pseudomonas aeruginosa PA01
gggcaccgucaccuguucgg

SEQ ID NO: 1541165 - RNA, 19 nt, Pseudomonas aeruginosa PA01
gggcauugucccugcggga

SEQ ID NO: 1541166 - RNA, 14 nt, Pseudomonas aeruginosa PA01
gggcauugaccuug

SEQ ID NO: 1541167 - RNA, 20 nt, Pseudomonas aeruginosa PA01
gggccacuucgcgguccagg

SEQ ID NO: 1541168 - RNA, 18 nt, Pseudomonas aeruginosa PA01
gggcccggcuccagccgg

SEQ ID NO: 1541169 - RNA, 22 nt, Pseudomonas aeruginosa PA01
gggcccgugguagucgagccgg

SEQ ID NO: 1541170 - RNA, 15 nt, Pseudomonas aeruginosa PA01
gggccgcgcugucgg

SEQ ID NO: 1541171 - RNA, 22 nt, Pseudomonas aeruginosa PA01
gggccgcggcguugucggccag

SEQ ID NO: 1541172 - RNA, 13 nt, Pseudomonas aeruginosa PA01
gggccgcgcucgg

SEQ ID NO: 1541173 - RNA, 14 nt, Pseudomonas aeruginosa PA01
gggcccuccaggcg

SEQ ID NO: 1541174 - RNA, 16 nt, Pseudomonas aeruginosa PA01
gggcccggcaggcagu

SEQ ID NO: 1541175 - RNA, 15 nt, Pseudomonas aeruginosa PA01
gggcagggaguccgc

SEQ ID NO: 1541176 - RNA, 16 nt, Pseudomonas aeruginosa PA01
gggcagggcagccgcc

SEQ ID NO: 1541177 - RNA, 17 nt, Pseudomonas aeruginosa PA01
gggcagggcagccgccg

SEQ ID NO: 1541178 - RNA, 11 nt, Pseudomonas aeruginosa PA01
gggcaggugga

SEQ ID NO: 1541179 - RNA, 21 nt, Pseudomonas aeruginosa PA01
gggcacgccgguggccaggcu

SEQ ID NO: 1541180 - RNA, 22 nt, Pseudomonas aeruginosa PA01
gggcagcucguugcacagcgcc

SEQ ID NO: 1541181 - RNA, 19 nt, Pseudomonas aeruginosa PA01
gggcaggcaugcggccccg

SEQ ID NO: 1541182 - RNA, 19 nt, Pseudomonas aeruginosa PA01
gggcaggauaucgcccagg

SEQ ID NO: 1541183 - RNA, 20 nt, Pseudomonas aeruginosa PA01
gggcaggauaucgcccaggg

SEQ ID NO: 1541184 - RNA, 21 nt, Pseudomonas aeruginosa PA01
gggcaggauaucgcccagggc

SEQ ID NO: 1541185 - RNA, 24 nt, Pseudomonas aeruginosa PA01
gggcaggauaucgcccagggccag

SEQ ID NO: 1541186 - RNA, 17 nt, Pseudomonas aeruginosa PA01
gggcaggccgaggccgg

SEQ ID NO: 1541187 - RNA, 14 nt, Pseudomonas aeruginosa PA01
gggcaucagccccu

SEQ ID NO: 1541188 - RNA, 15 nt, Pseudomonas aeruginosa PA01
gggcaucagccccuc

SEQ ID NO: 1541189 - RNA, 19 nt, Pseudomonas aeruginosa PA01
gggcaugaccgauggcgcc

SEQ ID NO: 1541190 - RNA, 16 nt, Pseudomonas aeruginosa PA01
gggcaugcucggccag

SEQ ID NO: 1541191 - RNA, 21 nt, Pseudomonas aeruginosa PA01
gggcaugccgugggcgccgcc

SEQ ID NO: 1541192 - RNA, 12 nt, Pseudomonas aeruginosa PA01
ggggagccgagg

SEQ ID NO: 1541193 - RNA, 13 nt, Pseudomonas aeruginosa PA01
ggguagcugcugg

SEQ ID NO: 1541194 - RNA, 14 nt, Pseudomonas aeruginosa PA01
ggguaggccaggca

SEQ ID NO: 1541195 - RNA, 15 nt, Pseudomonas aeruginosa PA01
ggguacgcgggccuc

SEQ ID NO: 1541196 - RNA, 14 nt, Pseudomonas aeruginosa PA01
ggggagcgccggcg

SEQ ID NO: 1541197 - RNA, 18 nt, Pseudomonas aeruginosa PA01
ggguagccauggcggauc

SEQ ID NO: 1541198 - RNA, 20 nt, Pseudomonas aeruginosa PA01
ggguacuucgugccacaggc

SEQ ID NO: 1541199 - RNA, 20 nt, Pseudomonas aeruginosa PA01
ggguauccagcggccgcgag

SEQ ID NO: 1541200 - RNA, 13 nt, Pseudomonas aeruginosa PA01
ggguccgguacug

SEQ ID NO: 1541201 - RNA, 17 nt, Pseudomonas aeruginosa PA01
gggucaucaccggcagg

SEQ ID NO: 1541202 - RNA, 23 nt, Pseudomonas aeruginosa PA01
gggucaugccgccaucgaccagg

SEQ ID NO: 1541203 - RNA, 15 nt, Pseudomonas aeruginosa PA01
ggguccuggguggcg

SEQ ID NO: 1541204 - RNA, 23 nt, Pseudomonas aeruginosa PA01
gggucguacaccgcgcggcacag

SEQ ID NO: 1541205 - RNA, 19 nt, Pseudomonas aeruginosa PA01
gggucgucgaagcgcagca

SEQ ID NO: 1541206 - RNA, 14 nt, Pseudomonas aeruginosa PA01
gggugcgggcgcgg

SEQ ID NO: 1541207 - RNA, 18 nt, Pseudomonas aeruginosa PA01
gggugaacucaugcaggc

SEQ ID NO: 1541208 - RNA, 20 nt, Pseudomonas aeruginosa PA01
gggucuugcgcagggcggcg

SEQ ID NO: 1541209 - RNA, 22 nt, Pseudomonas aeruginosa PA01
ggguggcgacgucgccccagcc

SEQ ID NO: 1541210 - RNA, 15 nt, Pseudomonas aeruginosa PA01
gggugcggugggcga

SEQ ID NO: 1541211 - RNA, 15 nt, Pseudomonas aeruginosa PA01
gggugcugcccaggg

SEQ ID NO: 1541212 - RNA, 19 nt, Pseudomonas aeruginosa PA01
ggguuccucuaaugguagg

SEQ ID NO: 1541213 - RNA, 21 nt, Pseudomonas aeruginosa PA01
ggguucggcgagaggucggcg

SEQ ID NO: 1541214 - RNA, 12 nt, Pseudomonas aeruginosa PA01
ggguugcccagc

SEQ ID NO: 1541215 - RNA, 16 nt, Pseudomonas aeruginosa PA01
ggguugcccagcaggc

SEQ ID NO: 1541216 - RNA, 20 nt, Pseudomonas aeruginosa PA01
ggguuggcgcaggccgggcg

SEQ ID NO: 1541217 - RNA, 23 nt, Pseudomonas aeruginosa PA01
ggguugggcagcgucgccgggcg

SEQ ID NO: 1541218 - RNA, 17 nt, Pseudomonas aeruginosa PA01
ggguuggccgcagcagc

SEQ ID NO: 1541219 - RNA, 14 nt, Pseudomonas aeruginosa PA01
gguaaagcgcccgc

SEQ ID NO: 1541220 - RNA, 23 nt, Pseudomonas aeruginosa PA01
gguaaggcaccaccgccgccagc

SEQ ID NO: 1541221 - RNA, 16 nt, Pseudomonas aeruginosa PA01
gguaaggcaugcccag

SEQ ID NO: 1541222 - RNA, 21 nt, Pseudomonas aeruginosa PA01
gguaacgcggauacuccuuca

SEQ ID NO: 1541223 - RNA, 15 nt, Pseudomonas aeruginosa PA01
gguagagacggcggc

SEQ ID NO: 1541224 - RNA, 13 nt, Pseudomonas aeruginosa PA01
gguagacgccucc

SEQ ID NO: 1541225 - RNA, 20 nt, Pseudomonas aeruginosa PA01
gguacucggcccgggccugg

SEQ ID NO: 1541226 - RNA, 15 nt, Pseudomonas aeruginosa PA01
gguacuccuccagca

SEQ ID NO: 1541227 - RNA, 14 nt, Pseudomonas aeruginosa PA01
gguacuaucccggu

SEQ ID NO: 1541228 - RNA, 17 nt, Pseudomonas aeruginosa PA01
gguacugcgccaguucc

SEQ ID NO: 1541229 - RNA, 13 nt, Pseudomonas aeruginosa PA01
gguagaaauccuc

SEQ ID NO: 1541230 - RNA, 17 nt, Pseudomonas aeruginosa PA01
gguacgguuggccagcg

SEQ ID NO: 1541231 - RNA, 16 nt, Pseudomonas aeruginosa PA01
gguacgcccuccagca

SEQ ID NO: 1541232 - RNA, 19 nt, Pseudomonas aeruginosa PA01
gguaccguugcgcaggcgu

SEQ ID NO: 1541233 - RNA, 20 nt, Pseudomonas aeruginosa PA01
gguacccggcagggccagcg

SEQ ID NO: 1541234 - RNA, 12 nt, Pseudomonas aeruginosa PA01
gguaccagggaa

SEQ ID NO: 1541235 - RNA, 18 nt, Pseudomonas aeruginosa PA01
gguacagcgacucgcugc

SEQ ID NO: 1541236 - RNA, 20 nt, Pseudomonas aeruginosa PA01
gguacagcgacucgcugccg

SEQ ID NO: 1541237 - RNA, 22 nt, Pseudomonas aeruginosa PA01
gguacagcgccuggucggcggc

SEQ ID NO: 1541238 - RNA, 17 nt, Pseudomonas aeruginosa PA01
gguacaguucaggcugg

SEQ ID NO: 1541239 - RNA, 20 nt, Pseudomonas aeruginosa PA01
gguacaguucaggcugggcc

SEQ ID NO: 1541240 - RNA, 14 nt, Pseudomonas aeruginosa PA01
gguacagcccccag

SEQ ID NO: 1541241 - RNA, 19 nt, Pseudomonas aeruginosa PA01
gguacagcccccaggcacc

SEQ ID NO: 1541242 - RNA, 18 nt, Pseudomonas aeruginosa PA01
gguaauccagggagaaca

SEQ ID NO: 1541243 - RNA, 15 nt, Pseudomonas aeruginosa PA01
gguaggugcgcuggc

SEQ ID NO: 1541244 - RNA, 15 nt, Pseudomonas aeruginosa PA01
gguaggcucugcucc

SEQ ID NO: 1541245 - RNA, 11 nt, Pseudomonas aeruginosa PA01
gguaggaggaa

SEQ ID NO: 1541246 - RNA, 18 nt, Pseudomonas aeruginosa PA01
gguaggccaugagguugg

SEQ ID NO: 1541247 - RNA, 19 nt, Pseudomonas aeruginosa PA01
gguaggccaugagguuggc

SEQ ID NO: 1541248 - RNA, 15 nt, Pseudomonas aeruginosa PA01
gguaggagcgagagc

SEQ ID NO: 1541249 - RNA, 14 nt, Pseudomonas aeruginosa PA01
gguagcuggaaagc

SEQ ID NO: 1541250 - RNA, 18 nt, Pseudomonas aeruginosa PA01
gguagcguuggaguaggg

SEQ ID NO: 1541251 - RNA, 15 nt, Pseudomonas aeruginosa PA01
gguagcugcgcaggg

SEQ ID NO: 1541252 - RNA, 20 nt, Pseudomonas aeruginosa PA01
gguagaugccacugacgcgc

SEQ ID NO: 1541253 - RNA, 15 nt, Pseudomonas aeruginosa PA01
gguagauguccagug

SEQ ID NO: 1541254 - RNA, 15 nt, Pseudomonas aeruginosa PA01
gguaguccagcaggu

SEQ ID NO: 1541255 - RNA, 15 nt, Pseudomonas aeruginosa PA01
gguaguccagccagu

SEQ ID NO: 1541256 - RNA, 18 nt, Pseudomonas aeruginosa PA01
gguaguccagccagugca

SEQ ID NO: 1541257 - RNA, 14 nt, Pseudomonas aeruginosa PA01
gguagugcggcggg

SEQ ID NO: 1541258 - RNA, 13 nt, Pseudomonas aeruginosa PA01
gguagugcuucag

SEQ ID NO: 1541259 - RNA, 20 nt, Pseudomonas aeruginosa PA01
ggucacgccgaaguucuuca

SEQ ID NO: 1541260 - RNA, 15 nt, Pseudomonas aeruginosa PA01
ggucaccgcucgcca

SEQ ID NO: 1541261 - RNA, 24 nt, Pseudomonas aeruginosa PA01
ggucaccuugaccuugucggccga

SEQ ID NO: 1541262 - RNA, 23 nt, Pseudomonas aeruginosa PA01
ggucaccguggagaggucgccga

SEQ ID NO: 1541263 - RNA, 12 nt, Pseudomonas aeruginosa PA01
ggucacgaaggc

SEQ ID NO: 1541264 - RNA, 23 nt, Pseudomonas aeruginosa PA01
ggucagcgaguugaccuuggcca

SEQ ID NO: 1541265 - RNA, 19 nt, Pseudomonas aeruginosa PA01
ggucagccggccgaucuuc

SEQ ID NO: 1541266 - RNA, 17 nt, Pseudomonas aeruginosa PA01
ggucagccgaugcucgc

SEQ ID NO: 1541267 - RNA, 18 nt, Pseudomonas aeruginosa PA01
ggucagccgaugcucgcg

SEQ ID NO: 1541268 - RNA, 18 nt, Pseudomonas aeruginosa PA01
ggucagcaguugccgggu

SEQ ID NO: 1541269 - RNA, 13 nt, Pseudomonas aeruginosa PA01
gguauggcugcug

SEQ ID NO: 1541270 - RNA, 22 nt, Pseudomonas aeruginosa PA01
ggucaccaugaucaucggcugg

SEQ ID NO: 1541271 - RNA, 21 nt, Pseudomonas aeruginosa PA01
gguauucgcguucggucaggc

SEQ ID NO: 1541272 - RNA, 20 nt, Pseudomonas aeruginosa PA01
gguguccaccaccagcaggc

SEQ ID NO: 1541273 - RNA, 15 nt, Pseudomonas aeruginosa PA01
ggugucgaccuccgc

SEQ ID NO: 1541274 - RNA, 19 nt, Pseudomonas aeruginosa PA01
gguguccuuugccugaugc

SEQ ID NO: 1541275 - RNA, 13 nt, Pseudomonas aeruginosa PA01
ggugucgggugug

SEQ ID NO: 1541276 - RNA, 19 nt, Pseudomonas aeruginosa PA01
ggugucguauuccaggggc

SEQ ID NO: 1541277 - RNA, 24 nt, Pseudomonas aeruginosa PA01
ggugguacggcugagaccuuccug

SEQ ID NO: 1541278 - RNA, 17 nt, Pseudomonas aeruginosa PA01
gguggugaucagcggcc

SEQ ID NO: 1541279 - RNA, 15 nt, Pseudomonas aeruginosa PA01
gguggcugaagcccc

SEQ ID NO: 1541280 - RNA, 17 nt, Pseudomonas aeruginosa PA01
gguggcugaagccccag

SEQ ID NO: 1541281 - RNA, 16 nt, Pseudomonas aeruginosa PA01
ggugcguucgcgggcg

SEQ ID NO: 1541282 - RNA, 16 nt, Pseudomonas aeruginosa PA01
ggugcuagcggguggc

SEQ ID NO: 1541283 - RNA, 17 nt, Pseudomonas aeruginosa PA01
ggugcuaugcgccgggc

SEQ ID NO: 1541284 - RNA, 17 nt, Pseudomonas aeruginosa PA01
ggugcgguuggagcgga

SEQ ID NO: 1541285 - RNA, 18 nt, Pseudomonas aeruginosa PA01
ggugcggguggucgccgc

SEQ ID NO: 1541286 - RNA, 17 nt, Pseudomonas aeruginosa PA01
ggugcggugggcgaggg

SEQ ID NO: 1541287 - RNA, 18 nt, Pseudomonas aeruginosa PA01
gguggcgaccaggacagc

SEQ ID NO: 1541288 - RNA, 14 nt, Pseudomonas aeruginosa PA01
gguggcgacgcgca

SEQ ID NO: 1541289 - RNA, 21 nt, Pseudomonas aeruginosa PA01
gguggaauaccgcugcgcggg

SEQ ID NO: 1541290 - RNA, 23 nt, Pseudomonas aeruginosa PA01
gguggacacccugcugcugcuca

SEQ ID NO: 1541291 - RNA, 19 nt, Pseudomonas aeruginosa PA01
gguggagaggcgugcuggc

SEQ ID NO: 1541292 - RNA, 17 nt, Pseudomonas aeruginosa PA01
gguggaggccguggugg

SEQ ID NO: 1541293 - RNA, 15 nt, Pseudomonas aeruginosa PA01
gguggaggcggcggu

SEQ ID NO: 1541294 - RNA, 14 nt, Pseudomonas aeruginosa PA01
ggugcaccuggcga

SEQ ID NO: 1541295 - RNA, 13 nt, Pseudomonas aeruginosa PA01
ggugcacggccag

SEQ ID NO: 1541296 - RNA, 22 nt, Pseudomonas aeruginosa PA01
ggugcacggccaggccacggcc

SEQ ID NO: 1541297 - RNA, 20 nt, Pseudomonas aeruginosa PA01
ggugcagaagacgcccagca

SEQ ID NO: 1541298 - RNA, 16 nt, Pseudomonas aeruginosa PA01
ggugcagccacccagc

SEQ ID NO: 1541299 - RNA, 20 nt, Pseudomonas aeruginosa PA01
ggugcagagcagagucgccg

SEQ ID NO: 1541300 - RNA, 21 nt, Pseudomonas aeruginosa PA01
ggugcagagcagagucgccgg

SEQ ID NO: 1541301 - RNA, 16 nt, Pseudomonas aeruginosa PA01
ggugaucgaccacaca

SEQ ID NO: 1541302 - RNA, 21 nt, Pseudomonas aeruginosa PA01
ggugcccuggaagccggcagg

SEQ ID NO: 1541303 - RNA, 14 nt, Pseudomonas aeruginosa PA01
ggugcagcggaagc

SEQ ID NO: 1541304 - RNA, 18 nt, Pseudomonas aeruginosa PA01
ggugccgaccuucaccac

SEQ ID NO: 1541305 - RNA, 22 nt, Pseudomonas aeruginosa PA01
ggugccgccggccaccagcagc

SEQ ID NO: 1541306 - RNA, 11 nt, Pseudomonas aeruginosa PA01
ggugccgggcu

SEQ ID NO: 1541307 - RNA, 16 nt, Pseudomonas aeruginosa PA01
ggugccuucggcggcg

SEQ ID NO: 1541308 - RNA, 22 nt, Pseudomonas aeruginosa PA01
ggugcgcuccuguugcuggccg

SEQ ID NO: 1541309 - RNA, 16 nt, Pseudomonas aeruginosa PA01
ggugcgcugguuggcg

SEQ ID NO: 1541310 - RNA, 12 nt, Pseudomonas aeruginosa PA01
ggucgcagccgc

SEQ ID NO: 1541311 - RNA, 23 nt, Pseudomonas aeruginosa PA01
ggucgauccgaccuggggcggcc

SEQ ID NO: 1541312 - RNA, 17 nt, Pseudomonas aeruginosa PA01
ggucgcaccgccagcag

SEQ ID NO: 1541313 - RNA, 18 nt, Pseudomonas aeruginosa PA01
ggucgcccucggccaggc

SEQ ID NO: 1541314 - RNA, 19 nt, Pseudomonas aeruginosa PA01
ggucgcccucggccaggca

SEQ ID NO: 1541315 - RNA, 14 nt, Pseudomonas aeruginosa PA01
ggucgccagcgccu

SEQ ID NO: 1541316 - RNA, 14 nt, Pseudomonas aeruginosa PA01
ggucgagucggguc

SEQ ID NO: 1541317 - RNA, 23 nt, Pseudomonas aeruginosa PA01
ggucgaugcccaccugaacgcgc

SEQ ID NO: 1541318 - RNA, 16 nt, Pseudomonas aeruginosa PA01
ggucgaucuccuccuc

SEQ ID NO: 1541319 - RNA, 20 nt, Pseudomonas aeruginosa PA01
ggucgaugacguugcugccc

SEQ ID NO: 1541320 - RNA, 16 nt, Pseudomonas aeruginosa PA01
ggucgcacgcagcgcc

SEQ ID NO: 1541321 - RNA, 13 nt, Pseudomonas aeruginosa PA01
ggucgccgcagcc

SEQ ID NO: 1541322 - RNA, 15 nt, Pseudomonas aeruginosa PA01
ggucgccgcagcccu

SEQ ID NO: 1541323 - RNA, 15 nt, Pseudomonas aeruginosa PA01
ggucgccgcccacgc

SEQ ID NO: 1541324 - RNA, 14 nt, Pseudomonas aeruginosa PA01
ggucgcugcucagg

SEQ ID NO: 1541325 - RNA, 21 nt, Pseudomonas aeruginosa PA01
ggucgccucgggggugcccau

SEQ ID NO: 1541326 - RNA, 21 nt, Pseudomonas aeruginosa PA01
ggucgccuugaccagcggccc

SEQ ID NO: 1541327 - RNA, 18 nt, Pseudomonas aeruginosa PA01
ggucgccucgaacauggc

SEQ ID NO: 1541328 - RNA, 13 nt, Pseudomonas aeruginosa PA01
ggucggccaggcg

SEQ ID NO: 1541329 - RNA, 20 nt, Pseudomonas aeruginosa PA01
ggucggccaggggagcgccg

SEQ ID NO: 1541330 - RNA, 14 nt, Pseudomonas aeruginosa PA01
ggucggccaguucc

SEQ ID NO: 1541331 - RNA, 17 nt, Pseudomonas aeruginosa PA01
ggucggccaucuggcug

SEQ ID NO: 1541332 - RNA, 17 nt, Pseudomonas aeruginosa PA01
ggucgcuuuuuccgcug

SEQ ID NO: 1541333 - RNA, 17 nt, Pseudomonas aeruginosa PA01
ggucggacuccgcccag

SEQ ID NO: 1541334 - RNA, 20 nt, Pseudomonas aeruginosa PA01
ggucgcuguccuccagcggc

SEQ ID NO: 1541335 - RNA, 15 nt, Pseudomonas aeruginosa PA01
ggucaggacagcgug

SEQ ID NO: 1541336 - RNA, 19 nt, Pseudomonas aeruginosa PA01
ggucagcuugcccucaggg

SEQ ID NO: 1541337 - RNA, 14 nt, Pseudomonas aeruginosa PA01
ggucagguaggcau

SEQ ID NO: 1541338 - RNA, 15 nt, Pseudomonas aeruginosa PA01
ggucaggcugaucgg

SEQ ID NO: 1541339 - RNA, 22 nt, Pseudomonas aeruginosa PA01
ggucagggucgagucgggucuu

SEQ ID NO: 1541340 - RNA, 22 nt, Pseudomonas aeruginosa PA01
gguccuggcgcgagaagccagc

SEQ ID NO: 1541341 - RNA, 16 nt, Pseudomonas aeruginosa PA01
ggucgaacagcggcug

SEQ ID NO: 1541342 - RNA, 15 nt, Pseudomonas aeruginosa PA01
ggucgacgccgccga

SEQ ID NO: 1541343 - RNA, 18 nt, Pseudomonas aeruginosa PA01
ggucgacggcgugcaggu

SEQ ID NO: 1541344 - RNA, 16 nt, Pseudomonas aeruginosa PA01
ggugaacgccaggcag

SEQ ID NO: 1541345 - RNA, 21 nt, Pseudomonas aeruginosa PA01
ggugaccgcccagggggccgg

SEQ ID NO: 1541346 - RNA, 17 nt, Pseudomonas aeruginosa PA01
ggugaacuucuccaggu

SEQ ID NO: 1541347 - RNA, 20 nt, Pseudomonas aeruginosa PA01
ggugaagcccaggcgcucgg

SEQ ID NO: 1541348 - RNA, 19 nt, Pseudomonas aeruginosa PA01
ggugauaccgccggcggcg

SEQ ID NO: 1541349 - RNA, 16 nt, Pseudomonas aeruginosa PA01
ggugacgcagggcggu

SEQ ID NO: 1541350 - RNA, 14 nt, Pseudomonas aeruginosa PA01
ggucuucccagacc

SEQ ID NO: 1541351 - RNA, 22 nt, Pseudomonas aeruginosa PA01
ggucuucccguaaggccaggcu

SEQ ID NO: 1541352 - RNA, 16 nt, Pseudomonas aeruginosa PA01
ggucuugaucccaggg

SEQ ID NO: 1541353 - RNA, 20 nt, Pseudomonas aeruginosa PA01
ggucuguugguggggcgccg

SEQ ID NO: 1541354 - RNA, 17 nt, Pseudomonas aeruginosa PA01
ggucuucagugcacguu

SEQ ID NO: 1541355 - RNA, 14 nt, Pseudomonas aeruginosa PA01
ggucggccugcggg

SEQ ID NO: 1541356 - RNA, 22 nt, Pseudomonas aeruginosa PA01
ggucggccuguucgcccaaggc

SEQ ID NO: 1541357 - RNA, 18 nt, Pseudomonas aeruginosa PA01
ggucggcgaacagggugg

SEQ ID NO: 1541358 - RNA, 19 nt, Pseudomonas aeruginosa PA01
ggucguagagguugcgccc

SEQ ID NO: 1541359 - RNA, 20 nt, Pseudomonas aeruginosa PA01
ggucguaggaacgugcggcc

SEQ ID NO: 1541360 - RNA, 14 nt, Pseudomonas aeruginosa PA01
ggucgucuggguca

SEQ ID NO: 1541361 - RNA, 11 nt, Pseudomonas aeruginosa PA01
ggucgugcagc

SEQ ID NO: 1541362 - RNA, 12 nt, Pseudomonas aeruginosa PA01
ggucgugcagca

SEQ ID NO: 1541363 - RNA, 18 nt, Pseudomonas aeruginosa PA01
ggucgugcagcacauaga

SEQ ID NO: 1541364 - RNA, 15 nt, Pseudomonas aeruginosa PA01
ggucgugcagcagcg

SEQ ID NO: 1541365 - RNA, 15 nt, Pseudomonas aeruginosa PA01
ggucguggcggaagg

SEQ ID NO: 1541366 - RNA, 21 nt, Pseudomonas aeruginosa PA01
ggucgugcuugcagucgcgga

SEQ ID NO: 1541367 - RNA, 21 nt, Pseudomonas aeruginosa PA01
ggucgugguccagcucgguca

SEQ ID NO: 1541368 - RNA, 15 nt, Pseudomonas aeruginosa PA01
ggucguuagcucagu

SEQ ID NO: 1541369 - RNA, 17 nt, Pseudomonas aeruginosa PA01
ggucguuagcucagucg

SEQ ID NO: 1541370 - RNA, 16 nt, Pseudomonas aeruginosa PA01
guaaggcaugcccagg

SEQ ID NO: 1541371 - RNA, 10 nt, Pseudomonas aeruginosa PA01
guaacuguac

SEQ ID NO: 1541372 - RNA, 17 nt, Pseudomonas aeruginosa PA01
guaacgguagcggcagg

SEQ ID NO: 1541373 - RNA, 21 nt, Pseudomonas aeruginosa PA01
guaacccgcggcgagguugcc

SEQ ID NO: 1541374 - RNA, 17 nt, Pseudomonas aeruginosa PA01
guaacaagcauucugga

SEQ ID NO: 1541375 - RNA, 21 nt, Pseudomonas aeruginosa PA01
guaacaagcauucuggaugca

SEQ ID NO: 1541376 - RNA, 15 nt, Pseudomonas aeruginosa PA01
ggugugccgucaggc

SEQ ID NO: 1541377 - RNA, 13 nt, Pseudomonas aeruginosa PA01
ggugugcagcagc

SEQ ID NO: 1541378 - RNA, 17 nt, Pseudomonas aeruginosa PA01
ggugugcagcagcacgg

SEQ ID NO: 1541379 - RNA, 18 nt, Pseudomonas aeruginosa PA01
gguuaacaguugagcugu

SEQ ID NO: 1541380 - RNA, 18 nt, Pseudomonas aeruginosa PA01
guacccguacgcugccag

SEQ ID NO: 1541381 - RNA, 15 nt, Pseudomonas aeruginosa PA01
guacccggcagggcc

SEQ ID NO: 1541382 - RNA, 13 nt, Pseudomonas aeruginosa PA01
guaccgcuggcgc

SEQ ID NO: 1541383 - RNA, 18 nt, Pseudomonas aeruginosa PA01
guaccgcugcggccggcg

SEQ ID NO: 1541384 - RNA, 15 nt, Pseudomonas aeruginosa PA01
guaccgcugcgugcc

SEQ ID NO: 1541385 - RNA, 20 nt, Pseudomonas aeruginosa PA01
guaccgcugcgugccagggc

SEQ ID NO: 1541386 - RNA, 21 nt, Pseudomonas aeruginosa PA01
guaccgcugcgugccagggcu

SEQ ID NO: 1541387 - RNA, 19 nt, Pseudomonas aeruginosa PA01
guacuggucgcgcgcggcc

SEQ ID NO: 1541388 - RNA, 22 nt, Pseudomonas aeruginosa PA01
guacuggucgcgcgcggccagc

SEQ ID NO: 1541389 - RNA, 19 nt, Pseudomonas aeruginosa PA01
guacugggucuuguaguuc

SEQ ID NO: 1541390 - RNA, 24 nt, Pseudomonas aeruginosa PA01
guacugguccggguuggcgcaggc

SEQ ID NO: 1541391 - RNA, 20 nt, Pseudomonas aeruginosa PA01
guacuugaaggugcccaggg

SEQ ID NO: 1541392 - RNA, 14 nt, Pseudomonas aeruginosa PA01
guacuugccagggc

SEQ ID NO: 1541393 - RNA, 19 nt, Pseudomonas aeruginosa PA01
guacuugccagggcaggga

SEQ ID NO: 1541394 - RNA, 15 nt, Pseudomonas aeruginosa PA01
guagagacggcggcg

SEQ ID NO: 1541395 - RNA, 16 nt, Pseudomonas aeruginosa PA01
guagagaugcagcagg

SEQ ID NO: 1541396 - RNA, 16 nt, Pseudomonas aeruginosa PA01
guagagcaggcugcua

SEQ ID NO: 1541397 - RNA, 13 nt, Pseudomonas aeruginosa PA01
guagagcgcggcg

SEQ ID NO: 1541398 - RNA, 13 nt, Pseudomonas aeruginosa PA01
guagacgaugccg

SEQ ID NO: 1541399 - RNA, 17 nt, Pseudomonas aeruginosa PA01
guagacgaugccguucu

SEQ ID NO: 1541400 - RNA, 14 nt, Pseudomonas aeruginosa PA01
guagaccaccagcg

SEQ ID NO: 1541401 - RNA, 21 nt, Pseudomonas aeruginosa PA01
guagaccaccgugcgcaccuc

SEQ ID NO: 1541402 - RNA, 18 nt, Pseudomonas aeruginosa PA01
guagaccacgcaggccag

SEQ ID NO: 1541403 - RNA, 14 nt, Pseudomonas aeruginosa PA01
guagaccugggaac

SEQ ID NO: 1541404 - RNA, 18 nt, Pseudomonas aeruginosa PA01
guacucauggccgcagcg

SEQ ID NO: 1541405 - RNA, 21 nt, Pseudomonas aeruginosa PA01
guacguggcgcuugagcagcc

SEQ ID NO: 1541406 - RNA, 14 nt, Pseudomonas aeruginosa PA01
guacguaucccagc

SEQ ID NO: 1541407 - RNA, 15 nt, Pseudomonas aeruginosa PA01
guacguccagggcac

SEQ ID NO: 1541408 - RNA, 15 nt, Pseudomonas aeruginosa PA01
guaccucgccaggcu

SEQ ID NO: 1541409 - RNA, 22 nt, Pseudomonas aeruginosa PA01
guacgcucaccaccaccgcgcc

SEQ ID NO: 1541410 - RNA, 22 nt, Pseudomonas aeruginosa PA01
guacgcugcauguccgcaggca

SEQ ID NO: 1541411 - RNA, 16 nt, Pseudomonas aeruginosa PA01
guaggcgcggguggcg

SEQ ID NO: 1541412 - RNA, 20 nt, Pseudomonas aeruginosa PA01
guaggcgucgucgaccucga

SEQ ID NO: 1541413 - RNA, 16 nt, Pseudomonas aeruginosa PA01
guaggcuuggucgggc

SEQ ID NO: 1541414 - RNA, 16 nt, Pseudomonas aeruginosa PA01
guagggacggugcagg

SEQ ID NO: 1541415 - RNA, 15 nt, Pseudomonas aeruginosa PA01
guagggucgcagcag

SEQ ID NO: 1541416 - RNA, 14 nt, Pseudomonas aeruginosa PA01
guagggccgagguc

SEQ ID NO: 1541417 - RNA, 16 nt, Pseudomonas aeruginosa PA01
guagggguggccaggc

SEQ ID NO: 1541418 - RNA, 17 nt, Pseudomonas aeruginosa PA01
guagggguggccaggcg

SEQ ID NO: 1541419 - RNA, 22 nt, Pseudomonas aeruginosa PA01
guagggcggauaacgccacagg

SEQ ID NO: 1541420 - RNA, 14 nt, Pseudomonas aeruginosa PA01
guaggcgagcagcg

SEQ ID NO: 1541421 - RNA, 21 nt, Pseudomonas aeruginosa PA01
guaggccugguagaucugugc

SEQ ID NO: 1541422 - RNA, 14 nt, Pseudomonas aeruginosa PA01
guaggcgaagccca

SEQ ID NO: 1541423 - RNA, 20 nt, Pseudomonas aeruginosa PA01
guaggccgucgcugccgagc

SEQ ID NO: 1541424 - RNA, 15 nt, Pseudomonas aeruginosa PA01
guagcucugcuggcu

SEQ ID NO: 1541425 - RNA, 15 nt, Pseudomonas aeruginosa PA01
guagcugcagcgccc

SEQ ID NO: 1541426 - RNA, 20 nt, Pseudomonas aeruginosa PA01
guagcgccccuuggccagca

SEQ ID NO: 1541427 - RNA, 12 nt, Pseudomonas aeruginosa PA01
guagcgccaggc

SEQ ID NO: 1541428 - RNA, 21 nt, Pseudomonas aeruginosa PA01
guagcgcagguugcgcuggcg

SEQ ID NO: 1541429 - RNA, 23 nt, Pseudomonas aeruginosa PA01
guagcgcaguucgccgccgagcg

SEQ ID NO: 1541430 - RNA, 17 nt, Pseudomonas aeruginosa PA01
guagcgacggaagcccu

SEQ ID NO: 1541431 - RNA, 20 nt, Pseudomonas aeruginosa PA01
guagcgaaucugcagggcau

SEQ ID NO: 1541432 - RNA, 21 nt, Pseudomonas aeruginosa PA01
guagccuggauacgggcgcca

SEQ ID NO: 1541433 - RNA, 15 nt, Pseudomonas aeruginosa PA01
guagccugcggccag

SEQ ID NO: 1541434 - RNA, 20 nt, Pseudomonas aeruginosa PA01
guagccgucgaacagcagcu

SEQ ID NO: 1541435 - RNA, 16 nt, Pseudomonas aeruginosa PA01
guagaugccggugcug

SEQ ID NO: 1541436 - RNA, 17 nt, Pseudomonas aeruginosa PA01
guagaugcggcugugcu

SEQ ID NO: 1541437 - RNA, 23 nt, Pseudomonas aeruginosa PA01
guagaucggcagcaucagccgcg

SEQ ID NO: 1541438 - RNA, 19 nt, Pseudomonas aeruginosa PA01
guagaguucgcugcgcgcc

SEQ ID NO: 1541439 - RNA, 20 nt, Pseudomonas aeruginosa PA01
guagucggugaagcgcggcg

SEQ ID NO: 1541440 - RNA, 20 nt, Pseudomonas aeruginosa PA01
guagucguagaacaccaccc

SEQ ID NO: 1541441 - RNA, 14 nt, Pseudomonas aeruginosa PA01
guagucgcccagcg

SEQ ID NO: 1541442 - RNA, 16 nt, Pseudomonas aeruginosa PA01
guaguccagccagugc

SEQ ID NO: 1541443 - RNA, 17 nt, Pseudomonas aeruginosa PA01
guagucccagaccaccc

SEQ ID NO: 1541444 - RNA, 18 nt, Pseudomonas aeruginosa PA01
guaguccgcugcgagcag

SEQ ID NO: 1541445 - RNA, 15 nt, Pseudomonas aeruginosa PA01
guagugcuucaggua

SEQ ID NO: 1541446 - RNA, 21 nt, Pseudomonas aeruginosa PA01
guagugcuccggggcgcuguu

SEQ ID NO: 1541447 - RNA, 15 nt, Pseudomonas aeruginosa PA01
guagugcucggccag

SEQ ID NO: 1541448 - RNA, 22 nt, Pseudomonas aeruginosa PA01
guagugcaucagccuggccagc

SEQ ID NO: 1541449 - RNA, 17 nt, Pseudomonas aeruginosa PA01
guagguggauugcagcg

SEQ ID NO: 1541450 - RNA, 14 nt, Pseudomonas aeruginosa PA01
guagugggcgaggc

SEQ ID NO: 1541451 - RNA, 14 nt, Pseudomonas aeruginosa PA01
gucgccgaccaggc

SEQ ID NO: 1541452 - RNA, 18 nt, Pseudomonas aeruginosa PA01
gucgccgaacagccgccc

SEQ ID NO: 1541453 - RNA, 16 nt, Pseudomonas aeruginosa PA01
gucgccgaacggcagc

SEQ ID NO: 1541454 - RNA, 16 nt, Pseudomonas aeruginosa PA01
gucgcccuucuuccag

SEQ ID NO: 1541455 - RNA, 15 nt, Pseudomonas aeruginosa PA01
gucgcccgggcgcca

SEQ ID NO: 1541456 - RNA, 13 nt, Pseudomonas aeruginosa PA01
gucgcccucggcc

SEQ ID NO: 1541457 - RNA, 17 nt, Pseudomonas aeruginosa PA01
gucgcccucggccaggc

SEQ ID NO: 1541458 - RNA, 23 nt, Pseudomonas aeruginosa PA01
gucgccccacagcggugggaaga

SEQ ID NO: 1541459 - RNA, 17 nt, Pseudomonas aeruginosa PA01
gucgccgcccggcagcg

SEQ ID NO: 1541460 - RNA, 18 nt, Pseudomonas aeruginosa PA01
gucgccgcccggcagcgg

SEQ ID NO: 1541461 - RNA, 12 nt, Pseudomonas aeruginosa PA01
gucgccgcagcc

SEQ ID NO: 1541462 - RNA, 15 nt, Pseudomonas aeruginosa PA01
gucgccgacccugca

SEQ ID NO: 1541463 - RNA, 15 nt, Pseudomonas aeruginosa PA01
gucgcccagcgccug

SEQ ID NO: 1541464 - RNA, 22 nt, Pseudomonas aeruginosa PA01
gucgccagcagguagccagggg

SEQ ID NO: 1541465 - RNA, 12 nt, Pseudomonas aeruginosa PA01
gucgccagcagg

SEQ ID NO: 1541466 - RNA, 17 nt, Pseudomonas aeruginosa PA01
gucgccacgcccgccgu

SEQ ID NO: 1541467 - RNA, 15 nt, Pseudomonas aeruginosa PA01
gucgccugccaggcg

SEQ ID NO: 1541468 - RNA, 17 nt, Pseudomonas aeruginosa PA01
gucgcgcuggaccuggc

SEQ ID NO: 1541469 - RNA, 16 nt, Pseudomonas aeruginosa PA01
gucgcggaagugcggg

SEQ ID NO: 1541470 - RNA, 15 nt, Pseudomonas aeruginosa PA01
gucgcggacccgcgc

SEQ ID NO: 1541471 - RNA, 12 nt, Pseudomonas aeruginosa PA01
gucgcggcuggc

SEQ ID NO: 1541472 - RNA, 14 nt, Pseudomonas aeruginosa PA01
gucgcggcuggccg

SEQ ID NO: 1541473 - RNA, 18 nt, Pseudomonas aeruginosa PA01
gucgcggcugaagaagcu

SEQ ID NO: 1541474 - RNA, 15 nt, Pseudomonas aeruginosa PA01
gucgcggcugaaggc

SEQ ID NO: 1541475 - RNA, 20 nt, Pseudomonas aeruginosa PA01
gucgcggcugacgaaguccu

SEQ ID NO: 1541476 - RNA, 18 nt, Pseudomonas aeruginosa PA01
gucgcggcuuucuuccag

SEQ ID NO: 1541477 - RNA, 20 nt, Pseudomonas aeruginosa PA01
gucgcggccaucggcgaagc

SEQ ID NO: 1541478 - RNA, 20 nt, Pseudomonas aeruginosa PA01
gucgcggcgccuggcguagc

SEQ ID NO: 1541479 - RNA, 22 nt, Pseudomonas aeruginosa PA01
gucgccgcugaauaccaccggg

SEQ ID NO: 1541480 - RNA, 19 nt, Pseudomonas aeruginosa PA01
gucgccggaggggcggccg

SEQ ID NO: 1541481 - RNA, 13 nt, Pseudomonas aeruginosa PA01
gucgccgccgagu

SEQ ID NO: 1541482 - RNA, 15 nt, Pseudomonas aeruginosa PA01
gucgccucgggggug

SEQ ID NO: 1541483 - RNA, 23 nt, Pseudomonas aeruginosa PA01
guccuucaugaacacauagacca

SEQ ID NO: 1541484 - RNA, 20 nt, Pseudomonas aeruginosa PA01
guccuucggccaguccuuga

SEQ ID NO: 1541485 - RNA, 22 nt, Pseudomonas aeruginosa PA01
guccuugaguagcuggcgcagg

SEQ ID NO: 1541486 - RNA, 19 nt, Pseudomonas aeruginosa PA01
guccuugaguucccagacc

SEQ ID NO: 1541487 - RNA, 14 nt, Pseudomonas aeruginosa PA01
guccuugaucggau

SEQ ID NO: 1541488 - RNA, 23 nt, Pseudomonas aeruginosa PA01
gucgagcugguggauguucgccg

SEQ ID NO: 1541489 - RNA, 16 nt, Pseudomonas aeruginosa PA01
gucgaggaucuucucc

SEQ ID NO: 1541490 - RNA, 21 nt, Pseudomonas aeruginosa PA01
gucgagcugcucggcgguggg

SEQ ID NO: 1541491 - RNA, 18 nt, Pseudomonas aeruginosa PA01
gucgagcuggcgcaggcc

SEQ ID NO: 1541492 - RNA, 22 nt, Pseudomonas aeruginosa PA01
gucgagggugguuuccaggcuc

SEQ ID NO: 1541493 - RNA, 14 nt, Pseudomonas aeruginosa PA01
gucgagguagauca

SEQ ID NO: 1541494 - RNA, 19 nt, Pseudomonas aeruginosa PA01
gucgaggcccucggcggcg

SEQ ID NO: 1541495 - RNA, 17 nt, Pseudomonas aeruginosa PA01
gucgagggcugggcagc

SEQ ID NO: 1541496 - RNA, 22 nt, Pseudomonas aeruginosa PA01
gucgaggcggagaagccgcuga

SEQ ID NO: 1541497 - RNA, 12 nt, Pseudomonas aeruginosa PA01
gucgaggcugcc

SEQ ID NO: 1541498 - RNA, 22 nt, Pseudomonas aeruginosa PA01
gucgaggcugucgcggacccgc

SEQ ID NO: 1541499 - RNA, 13 nt, Pseudomonas aeruginosa PA01
gucgagugcuccg

SEQ ID NO: 1541500 - RNA, 15 nt, Pseudomonas aeruginosa PA01
gucgcacgcagcgcc

SEQ ID NO: 1541501 - RNA, 16 nt, Pseudomonas aeruginosa PA01
gucgcacagccagggg

SEQ ID NO: 1541502 - RNA, 19 nt, Pseudomonas aeruginosa PA01
gucgcauaaaaaagccccg

SEQ ID NO: 1541503 - RNA, 13 nt, Pseudomonas aeruginosa PA01
gucgcagcgggcu

SEQ ID NO: 1541504 - RNA, 15 nt, Pseudomonas aeruginosa PA01
gucgcaggccuggua

SEQ ID NO: 1541505 - RNA, 13 nt, Pseudomonas aeruginosa PA01
gucgcagccgagc

SEQ ID NO: 1541506 - RNA, 13 nt, Pseudomonas aeruginosa PA01
gucgcagcggccg

SEQ ID NO: 1541507 - RNA, 15 nt, Pseudomonas aeruginosa PA01
gucgauauugccgcg

SEQ ID NO: 1541508 - RNA, 17 nt, Pseudomonas aeruginosa PA01
gucgauaccagcgccgc

SEQ ID NO: 1541509 - RNA, 17 nt, Pseudomonas aeruginosa PA01
gucgaucaggaacaccc

SEQ ID NO: 1541510 - RNA, 19 nt, Pseudomonas aeruginosa PA01
gucgaucagcagcagcgcc

SEQ ID NO: 1541511 - RNA, 23 nt, Pseudomonas aeruginosa PA01
gucgaucaucugcugcagcauca

SEQ ID NO: 1541512 - RNA, 18 nt, Pseudomonas aeruginosa PA01
gucauugucguaaaggac

SEQ ID NO: 1541513 - RNA, 21 nt, Pseudomonas aeruginosa PA01
guccaucccugcuucgaccag

SEQ ID NO: 1541514 - RNA, 21 nt, Pseudomonas aeruginosa PA01
guccaucguucaguugccucu

SEQ ID NO: 1541515 - RNA, 15 nt, Pseudomonas aeruginosa PA01
guccaucgccaggcc

SEQ ID NO: 1541516 - RNA, 17 nt, Pseudomonas aeruginosa PA01
guccaucgccaggccau

SEQ ID NO: 1541517 - RNA, 14 nt, Pseudomonas aeruginosa PA01
guccccggccccgc

SEQ ID NO: 1541518 - RNA, 20 nt, Pseudomonas aeruginosa PA01
guccccuccagguaggggaa

SEQ ID NO: 1541519 - RNA, 15 nt, Pseudomonas aeruginosa PA01
guccccuuccuccuc

SEQ ID NO: 1541520 - RNA, 17 nt, Pseudomonas aeruginosa PA01
guccccuuccuccucgc

SEQ ID NO: 1541521 - RNA, 20 nt, Pseudomonas aeruginosa PA01
gucccagaccacccggcugc

SEQ ID NO: 1541522 - RNA, 23 nt, Pseudomonas aeruginosa PA01
gucccagaccacccggcugcaug

SEQ ID NO: 1541523 - RNA, 20 nt, Pseudomonas aeruginosa PA01
gucccagaccagcagcggca

SEQ ID NO: 1541524 - RNA, 20 nt, Pseudomonas aeruginosa PA01
guccgccacuucaagcuggc

SEQ ID NO: 1541525 - RNA, 13 nt, Pseudomonas aeruginosa PA01
guccgccagcagg

SEQ ID NO: 1541526 - RNA, 14 nt, Pseudomonas aeruginosa PA01
guccgccagccggc

SEQ ID NO: 1541527 - RNA, 17 nt, Pseudomonas aeruginosa PA01
gucccgcgcgccgagcc

SEQ ID NO: 1541528 - RNA, 23 nt, Pseudomonas aeruginosa PA01
guccgaggcggauuugccgccga

SEQ ID NO: 1541529 - RNA, 14 nt, Pseudomonas aeruginosa PA01
gucccgcaguagcu

SEQ ID NO: 1541530 - RNA, 21 nt, Pseudomonas aeruginosa PA01
guccggcaccgcucugcagug

SEQ ID NO: 1541531 - RNA, 14 nt, Pseudomonas aeruginosa PA01
guccggcagggccu

SEQ ID NO: 1541532 - RNA, 13 nt, Pseudomonas aeruginosa PA01
guccggcacuucc

SEQ ID NO: 1541533 - RNA, 15 nt, Pseudomonas aeruginosa PA01
guccggccagccugg

SEQ ID NO: 1541534 - RNA, 15 nt, Pseudomonas aeruginosa PA01
guccggcggcugcug

SEQ ID NO: 1541535 - RNA, 14 nt, Pseudomonas aeruginosa PA01
guccgugguacacc

SEQ ID NO: 1541536 - RNA, 16 nt, Pseudomonas aeruginosa PA01
guccugcccuccugcu

SEQ ID NO: 1541537 - RNA, 23 nt, Pseudomonas aeruginosa PA01
guccugcccuccugcucgaucca

SEQ ID NO: 1541538 - RNA, 14 nt, Pseudomonas aeruginosa PA01
guccugccgcaggc

SEQ ID NO: 1541539 - RNA, 15 nt, Pseudomonas aeruginosa PA01
guccugcggccgggu

SEQ ID NO: 1541540 - RNA, 16 nt, Pseudomonas aeruginosa PA01
guccugcuugaccuug

SEQ ID NO: 1541541 - RNA, 19 nt, Pseudomonas aeruginosa PA01
guccugggccaccuggcuc

SEQ ID NO: 1541542 - RNA, 21 nt, Pseudomonas aeruginosa PA01
guccugggccaccuggcucug

SEQ ID NO: 1541543 - RNA, 22 nt, Pseudomonas aeruginosa PA01
guccuggcggcaaggcacacgc

SEQ ID NO: 1541544 - RNA, 16 nt, Pseudomonas aeruginosa PA01
guccuggcgguagccc

SEQ ID NO: 1541545 - RNA, 19 nt, Pseudomonas aeruginosa PA01
guccuggcgguagcccggc

SEQ ID NO: 1541546 - RNA, 21 nt, Pseudomonas aeruginosa PA01
guccuggcgguagcccggcag

SEQ ID NO: 1541547 - RNA, 14 nt, Pseudomonas aeruginosa PA01
guccuggccgagcc

SEQ ID NO: 1541548 - RNA, 20 nt, Pseudomonas aeruginosa PA01
guccuggcgaguggcgaagc

SEQ ID NO: 1541549 - RNA, 22 nt, Pseudomonas aeruginosa PA01
guccuggcgcgagaagccagcc

SEQ ID NO: 1541550 - RNA, 18 nt, Pseudomonas aeruginosa PA01
guccguucggcgcccagg

SEQ ID NO: 1541551 - RNA, 21 nt, Pseudomonas aeruginosa PA01
guccguucaggcaaccgggua

SEQ ID NO: 1541552 - RNA, 16 nt, Pseudomonas aeruginosa PA01
guccucagccucaccc

SEQ ID NO: 1541553 - RNA, 22 nt, Pseudomonas aeruginosa PA01
guccucagccucacccugcugg

SEQ ID NO: 1541554 - RNA, 18 nt, Pseudomonas aeruginosa PA01
guccucguacaugcgcga

SEQ ID NO: 1541555 - RNA, 13 nt, Pseudomonas aeruginosa PA01
guccuccaaagcc

SEQ ID NO: 1541556 - RNA, 23 nt, Pseudomonas aeruginosa PA01
gucaacaccagcgccgccaggca

SEQ ID NO: 1541557 - RNA, 16 nt, Pseudomonas aeruginosa PA01
gucaacgccuggccac

SEQ ID NO: 1541558 - RNA, 21 nt, Pseudomonas aeruginosa PA01
gucacggcgaaaccggccagc

SEQ ID NO: 1541559 - RNA, 19 nt, Pseudomonas aeruginosa PA01
gucacggcgugccgcaggc

SEQ ID NO: 1541560 - RNA, 18 nt, Pseudomonas aeruginosa PA01
gucacggucuuggcggcg

SEQ ID NO: 1541561 - RNA, 17 nt, Pseudomonas aeruginosa PA01
gucacggugacggugca

SEQ ID NO: 1541562 - RNA, 19 nt, Pseudomonas aeruginosa PA01
gucacggugacggugcagc

SEQ ID NO: 1541563 - RNA, 20 nt, Pseudomonas aeruginosa PA01
gucacggugacggugcagcc

SEQ ID NO: 1541564 - RNA, 23 nt, Pseudomonas aeruginosa PA01
gucacgccgaaguucuucagcag

SEQ ID NO: 1541565 - RNA, 17 nt, Pseudomonas aeruginosa PA01
gucacgccgaggcugcg

SEQ ID NO: 1541566 - RNA, 20 nt, Pseudomonas aeruginosa PA01
gucacgccgcggcugaugcc

SEQ ID NO: 1541567 - RNA, 13 nt, Pseudomonas aeruginosa PA01
gucacgcugggca

SEQ ID NO: 1541568 - RNA, 14 nt, Pseudomonas aeruginosa PA01
gucaccccgaccag

SEQ ID NO: 1541569 - RNA, 12 nt, Pseudomonas aeruginosa PA01
gucaccgccagc

SEQ ID NO: 1541570 - RNA, 13 nt, Pseudomonas aeruginosa PA01
gucaggcugcgca

SEQ ID NO: 1541571 - RNA, 22 nt, Pseudomonas aeruginosa PA01
gucaggcuggugccgcuguagg

SEQ ID NO: 1541572 - RNA, 13 nt, Pseudomonas aeruginosa PA01
gucaggcgcuggu

SEQ ID NO: 1541573 - RNA, 14 nt, Pseudomonas aeruginosa PA01
gucaggcgccggcc

SEQ ID NO: 1541574 - RNA, 15 nt, Pseudomonas aeruginosa PA01
gucaggcgccggccu

SEQ ID NO: 1541575 - RNA, 19 nt, Pseudomonas aeruginosa PA01
gucaggccgagggcugccg

SEQ ID NO: 1541576 - RNA, 15 nt, Pseudomonas aeruginosa PA01
gucaggccgaccagc

SEQ ID NO: 1541577 - RNA, 13 nt, Pseudomonas aeruginosa PA01
gucaggccgaugg

SEQ ID NO: 1541578 - RNA, 18 nt, Pseudomonas aeruginosa PA01
gucagcuggcgcgccucc

SEQ ID NO: 1541579 - RNA, 16 nt, Pseudomonas aeruginosa PA01
gucagcuucgccgccc

SEQ ID NO: 1541580 - RNA, 16 nt, Pseudomonas aeruginosa PA01
gucagcuugcccucag

SEQ ID NO: 1541581 - RNA, 23 nt, Pseudomonas aeruginosa PA01
gucaggaucggcgcccagcacca

SEQ ID NO: 1541582 - RNA, 19 nt, Pseudomonas aeruginosa PA01
gucagcggguuggcuucca

SEQ ID NO: 1541583 - RNA, 15 nt, Pseudomonas aeruginosa PA01
gucagccgcaggccg

SEQ ID NO: 1541584 - RNA, 15 nt, Pseudomonas aeruginosa PA01
gucagcaggcugccg

SEQ ID NO: 1541585 - RNA, 14 nt, Pseudomonas aeruginosa PA01
gucagcgccagcaa

SEQ ID NO: 1541586 - RNA, 13 nt, Pseudomonas aeruginosa PA01
gucagcaccaggg

SEQ ID NO: 1541587 - RNA, 18 nt, Pseudomonas aeruginosa PA01
gucagcaacugccaaccg

SEQ ID NO: 1541588 - RNA, 16 nt, Pseudomonas aeruginosa PA01
gucagccagccgagca

SEQ ID NO: 1541589 - RNA, 19 nt, Pseudomonas aeruginosa PA01
gucagccagguucuugaug

SEQ ID NO: 1541590 - RNA, 23 nt, Pseudomonas aeruginosa PA01
gucagcccauacaccaggccggc

SEQ ID NO: 1541591 - RNA, 19 nt, Pseudomonas aeruginosa PA01
gucagcccguguucggcca

SEQ ID NO: 1541592 - RNA, 20 nt, Pseudomonas aeruginosa PA01
gucaugaccagagccgccga

SEQ ID NO: 1541593 - RNA, 21 nt, Pseudomonas aeruginosa PA01
gucaugaaggaaaccggccag

SEQ ID NO: 1541594 - RNA, 17 nt, Pseudomonas aeruginosa PA01
gucagguauucgccggc

SEQ ID NO: 1541595 - RNA, 17 nt, Pseudomonas aeruginosa PA01
gucagggugccgaugga

SEQ ID NO: 1541596 - RNA, 20 nt, Pseudomonas aeruginosa PA01
gucagguugaccuucugucc

SEQ ID NO: 1541597 - RNA, 15 nt, Pseudomonas aeruginosa PA01
gucaggucguacacg

SEQ ID NO: 1541598 - RNA, 19 nt, Pseudomonas aeruginosa PA01
ggcggauuuccugcggcac

SEQ ID NO: 1541599 - RNA, 16 nt, Pseudomonas aeruginosa PA01
ggcggauuugccgccg

SEQ ID NO: 1541600 - RNA, 19 nt, Pseudomonas aeruginosa PA01
ggcggauuugccgccgagg

SEQ ID NO: 1541601 - RNA, 21 nt, Pseudomonas aeruginosa PA01
ggcggauuugccgccgagggc

SEQ ID NO: 1541602 - RNA, 14 nt, Pseudomonas aeruginosa PA01
ggcggaucugcucg

SEQ ID NO: 1541603 - RNA, 15 nt, Pseudomonas aeruginosa PA01
ggcggaugagccgcu

SEQ ID NO: 1541604 - RNA, 21 nt, Pseudomonas aeruginosa PA01
ggcggcaagggcacgugcagc

SEQ ID NO: 1541605 - RNA, 22 nt, Pseudomonas aeruginosa PA01
ggcggcaagggcacgugcagcg

SEQ ID NO: 1541606 - RNA, 22 nt, Pseudomonas aeruginosa PA01
ggcggcaaggcacacgcccggc

SEQ ID NO: 1541607 - RNA, 13 nt, Pseudomonas aeruginosa PA01
ggcggacgaucac

SEQ ID NO: 1541608 - RNA, 15 nt, Pseudomonas aeruginosa PA01
ggcggacgcaggccg

SEQ ID NO: 1541609 - RNA, 22 nt, Pseudomonas aeruginosa PA01
ggcggacugcucgccgccggcg

SEQ ID NO: 1541610 - RNA, 20 nt, Pseudomonas aeruginosa PA01
ggcggacaacccggcgcugg

SEQ ID NO: 1541611 - RNA, 17 nt, Pseudomonas aeruginosa PA01
ggcggaauuccugcucg

SEQ ID NO: 1541612 - RNA, 14 nt, Pseudomonas aeruginosa PA01
ggcggacagcccgc

SEQ ID NO: 1541613 - RNA, 16 nt, Pseudomonas aeruginosa PA01
ggcggacagcccgcgc

SEQ ID NO: 1541614 - RNA, 20 nt, Pseudomonas aeruginosa PA01
ggcggacagcccgcgcucgg

SEQ ID NO: 1541615 - RNA, 14 nt, Pseudomonas aeruginosa PA01
ggcggaucacaggc

SEQ ID NO: 1541616 - RNA, 18 nt, Pseudomonas aeruginosa PA01
ggcggaucgaucagcagc

SEQ ID NO: 1541617 - RNA, 18 nt, Pseudomonas aeruginosa PA01
ggcggaucgaucgaucag

SEQ ID NO: 1541618 - RNA, 19 nt, Pseudomonas aeruginosa PA01
ggcggauaaccgcgagcgg

SEQ ID NO: 1541619 - RNA, 16 nt, Pseudomonas aeruginosa PA01
ggcggauaacgccgcu

SEQ ID NO: 1541620 - RNA, 17 nt, Pseudomonas aeruginosa PA01
ggcggaguagccggcgg

SEQ ID NO: 1541621 - RNA, 19 nt, Pseudomonas aeruginosa PA01
ggcggaguagccggcggcg

SEQ ID NO: 1541622 - RNA, 15 nt, Pseudomonas aeruginosa PA01
ggcggagaagccgcu

SEQ ID NO: 1541623 - RNA, 18 nt, Pseudomonas aeruginosa PA01
ggcggcagccgcggcugu

SEQ ID NO: 1541624 - RNA, 16 nt, Pseudomonas aeruginosa PA01
ggcggcagcugcggcg

SEQ ID NO: 1541625 - RNA, 17 nt, Pseudomonas aeruginosa PA01
ggcggcaggcugcgccg

SEQ ID NO: 1541626 - RNA, 20 nt, Pseudomonas aeruginosa PA01
ggcggcaucggcgccgcgca

SEQ ID NO: 1541627 - RNA, 20 nt, Pseudomonas aeruginosa PA01
ggcggcauugagggcgagga

SEQ ID NO: 1541628 - RNA, 22 nt, Pseudomonas aeruginosa PA01
ggcggccccuucagcuccagca

SEQ ID NO: 1541629 - RNA, 13 nt, Pseudomonas aeruginosa PA01
ggcggccgagggc

SEQ ID NO: 1541630 - RNA, 24 nt, Pseudomonas aeruginosa PA01
ggcggccgaguucgcgcaggcgcu

SEQ ID NO: 1541631 - RNA, 12 nt, Pseudomonas aeruginosa PA01
ggcggccgcaug

SEQ ID NO: 1541632 - RNA, 15 nt, Pseudomonas aeruginosa PA01
ggcggccgaacugga

SEQ ID NO: 1541633 - RNA, 14 nt, Pseudomonas aeruginosa PA01
ggcggccaucaggc

SEQ ID NO: 1541634 - RNA, 23 nt, Pseudomonas aeruginosa PA01
ggcggccagggcaugggucagcg

SEQ ID NO: 1541635 - RNA, 14 nt, Pseudomonas aeruginosa PA01
ggcggccaggcgcu

SEQ ID NO: 1541636 - RNA, 14 nt, Pseudomonas aeruginosa PA01
ggcggcgacccaga

SEQ ID NO: 1541637 - RNA, 21 nt, Pseudomonas aeruginosa PA01
ggcggcgaccgaacagcgcgc

SEQ ID NO: 1541638 - RNA, 16 nt, Pseudomonas aeruginosa PA01
ggcggcgaaggccgcu

SEQ ID NO: 1541639 - RNA, 19 nt, Pseudomonas aeruginosa PA01
ggcggcgaagucugccugu

SEQ ID NO: 1541640 - RNA, 20 nt, Pseudomonas aeruginosa PA01
ggcggcgccggugaggcgca

SEQ ID NO: 1541641 - RNA, 18 nt, Pseudomonas aeruginosa PA01
ggcggcgccuugcggucc

SEQ ID NO: 1541642 - RNA, 20 nt, Pseudomonas aeruginosa PA01
ggcggcgcgaaccagcagca

SEQ ID NO: 1541643 - RNA, 14 nt, Pseudomonas aeruginosa PA01
ggcggcgccaggcc

SEQ ID NO: 1541644 - RNA, 18 nt, Pseudomonas aeruginosa PA01
ggcggcgccaggccggcg

SEQ ID NO: 1541645 - RNA, 14 nt, Pseudomonas aeruginosa PA01
ggcggccgccggcg

SEQ ID NO: 1541646 - RNA, 20 nt, Pseudomonas aeruginosa PA01
ggcggccgccuugaccugcu

SEQ ID NO: 1541647 - RNA, 15 nt, Pseudomonas aeruginosa PA01
ggcggccggcgcgga

SEQ ID NO: 1541648 - RNA, 14 nt, Pseudomonas aeruginosa PA01
ggcggccgggucga

SEQ ID NO: 1541649 - RNA, 15 nt, Pseudomonas aeruginosa PA01
ggcggccugcucgcg

SEQ ID NO: 1541650 - RNA, 17 nt, Pseudomonas aeruginosa PA01
ggcggccuucggcgucg

SEQ ID NO: 1541651 - RNA, 13 nt, Pseudomonas aeruginosa PA01
ggcggccggugcc

SEQ ID NO: 1541652 - RNA, 16 nt, Pseudomonas aeruginosa PA01
ggcggccucggccucg

SEQ ID NO: 1541653 - RNA, 14 nt, Pseudomonas aeruginosa PA01
ggcggcggcgcggg

SEQ ID NO: 1541654 - RNA, 17 nt, Pseudomonas aeruginosa PA01
ggcggcggcggaccucc

SEQ ID NO: 1541655 - RNA, 23 nt, Pseudomonas aeruginosa PA01
ggcggcggagucguagcgcaugc

SEQ ID NO: 1541656 - RNA, 13 nt, Pseudomonas aeruginosa PA01
ggcggcggccagc

SEQ ID NO: 1541657 - RNA, 14 nt, Pseudomonas aeruginosa PA01
ggcggcggccagca

SEQ ID NO: 1541658 - RNA, 14 nt, Pseudomonas aeruginosa PA01
ggcggcggaccucc

SEQ ID NO: 1541659 - RNA, 18 nt, Pseudomonas aeruginosa PA01
ggcggcggaccuccgcca

SEQ ID NO: 1541660 - RNA, 19 nt, Pseudomonas aeruginosa PA01
ggcggcggaccuccgccag

SEQ ID NO: 1541661 - RNA, 15 nt, Pseudomonas aeruginosa PA01
ggcggcggacgacga

SEQ ID NO: 1541662 - RNA, 20 nt, Pseudomonas aeruginosa PA01
ggcggcgcuguuugcggcgc

SEQ ID NO: 1541663 - RNA, 18 nt, Pseudomonas aeruginosa PA01
ggcggcgcggcggguggc

SEQ ID NO: 1541664 - RNA, 19 nt, Pseudomonas aeruginosa PA01
ggcggcgcggcggguggcg

SEQ ID NO: 1541665 - RNA, 15 nt, Pseudomonas aeruginosa PA01
ggcggcgcggagcug

SEQ ID NO: 1541666 - RNA, 14 nt, Pseudomonas aeruginosa PA01
ggcggcgcgcagcg

SEQ ID NO: 1541667 - RNA, 15 nt, Pseudomonas aeruginosa PA01
ggcggcgcgcagcga

SEQ ID NO: 1541668 - RNA, 17 nt, Pseudomonas aeruginosa PA01
ggcggcgguagccgagg

SEQ ID NO: 1541669 - RNA, 13 nt, Pseudomonas aeruginosa PA01
ggcggcgggacug

SEQ ID NO: 1541670 - RNA, 19 nt, Pseudomonas aeruginosa PA01
ggcggcgguucgccgagcg

SEQ ID NO: 1541671 - RNA, 17 nt, Pseudomonas aeruginosa PA01
ggcggcguuggccgagg

SEQ ID NO: 1541672 - RNA, 18 nt, Pseudomonas aeruginosa PA01
ggcggcgugcaggccgau

SEQ ID NO: 1541673 - RNA, 14 nt, Pseudomonas aeruginosa PA01
ggcggcgugcaggg

SEQ ID NO: 1541674 - RNA, 22 nt, Pseudomonas aeruginosa PA01
ggcggcgucgucgcugcgcggg

SEQ ID NO: 1541675 - RNA, 13 nt, Pseudomonas aeruginosa PA01
ggcgcggcggaag

SEQ ID NO: 1541676 - RNA, 14 nt, Pseudomonas aeruginosa PA01
ggcgcggcggaggc

SEQ ID NO: 1541677 - RNA, 21 nt, Pseudomonas aeruginosa PA01
ggcgcgggccuucaggcugcg

SEQ ID NO: 1541678 - RNA, 16 nt, Pseudomonas aeruginosa PA01
ggcgcgggcgaagcgc

SEQ ID NO: 1541679 - RNA, 18 nt, Pseudomonas aeruginosa PA01
ggcgcgggcgaaggccuc

SEQ ID NO: 1541680 - RNA, 16 nt, Pseudomonas aeruginosa PA01
ggcgcgggcggcggcg

SEQ ID NO: 1541681 - RNA, 14 nt, Pseudomonas aeruginosa PA01
ggcgcgggcggccu

SEQ ID NO: 1541682 - RNA, 23 nt, Pseudomonas aeruginosa PA01
ggcgcgggcauggaucucccgua

SEQ ID NO: 1541683 - RNA, 13 nt, Pseudomonas aeruginosa PA01
ggcgcgggcggcc

SEQ ID NO: 1541684 - RNA, 23 nt, Pseudomonas aeruginosa PA01
ggcgcggccgaacucuggcggcg

SEQ ID NO: 1541685 - RNA, 16 nt, Pseudomonas aeruginosa PA01
ggcgcggccggcgccg

SEQ ID NO: 1541686 - RNA, 13 nt, Pseudomonas aeruginosa PA01
ggcgcggcgcgga

SEQ ID NO: 1541687 - RNA, 21 nt, Pseudomonas aeruginosa PA01
ggcgcggccuucuugcugccg

SEQ ID NO: 1541688 - RNA, 15 nt, Pseudomonas aeruginosa PA01
ggcgcggcgcagcgg

SEQ ID NO: 1541689 - RNA, 14 nt, Pseudomonas aeruginosa PA01
ggcgcggcgccagc

SEQ ID NO: 1541690 - RNA, 16 nt, Pseudomonas aeruginosa PA01
ggcgcggacggccugc

SEQ ID NO: 1541691 - RNA, 22 nt, Pseudomonas aeruginosa PA01
ggcgcggaugucgggcucgacg

SEQ ID NO: 1541692 - RNA, 15 nt, Pseudomonas aeruginosa PA01
ggcgcguacuugcca

SEQ ID NO: 1541693 - RNA, 19 nt, Pseudomonas aeruginosa PA01
ggcgcguacuugccagggc

SEQ ID NO: 1541694 - RNA, 20 nt, Pseudomonas aeruginosa PA01
ggcgcguacuugccagggca

SEQ ID NO: 1541695 - RNA, 17 nt, Pseudomonas aeruginosa PA01
ggcgcgucaugccgccg

SEQ ID NO: 1541696 - RNA, 16 nt, Pseudomonas aeruginosa PA01
ggcgcguccaccuggc

SEQ ID NO: 1541697 - RNA, 16 nt, Pseudomonas aeruginosa PA01
ggcgcguccagcucca

SEQ ID NO: 1541698 - RNA, 22 nt, Pseudomonas aeruginosa PA01
ggcgcguccagcuccaccaggc

SEQ ID NO: 1541699 - RNA, 20 nt, Pseudomonas aeruginosa PA01
ggcgcgucuccagcucggcg

SEQ ID NO: 1541700 - RNA, 23 nt, Pseudomonas aeruginosa PA01
ggcgcgucgcugccgccgcgccc

SEQ ID NO: 1541701 - RNA, 20 nt, Pseudomonas aeruginosa PA01
ggcgcgucgcugcgcaacug

SEQ ID NO: 1541702 - RNA, 14 nt, Pseudomonas aeruginosa PA01
ggcgcgucgcggcc

SEQ ID NO: 1541703 - RNA, 21 nt, Pseudomonas aeruginosa PA01
ggcgcgguugccgcugcggcg

SEQ ID NO: 1541704 - RNA, 16 nt, Pseudomonas aeruginosa PA01
ggcgcggggccccggc

SEQ ID NO: 1541705 - RNA, 18 nt, Pseudomonas aeruginosa PA01
ggcgcggggcccggcucc

SEQ ID NO: 1541706 - RNA, 22 nt, Pseudomonas aeruginosa PA01
ggcgcggguucgugccaggcgg

SEQ ID NO: 1541707 - RNA, 14 nt, Pseudomonas aeruginosa PA01
ggcgcgcggccgcg

SEQ ID NO: 1541708 - RNA, 13 nt, Pseudomonas aeruginosa PA01
ggcgcgcgcgcug

SEQ ID NO: 1541709 - RNA, 14 nt, Pseudomonas aeruginosa PA01
ggcgcgcggccagc

SEQ ID NO: 1541710 - RNA, 15 nt, Pseudomonas aeruginosa PA01
ggcgcgcgggccuuc

SEQ ID NO: 1541711 - RNA, 16 nt, Pseudomonas aeruginosa PA01
ggcgcgcuccggcgcg

SEQ ID NO: 1541712 - RNA, 22 nt, Pseudomonas aeruginosa PA01
ggcgcgcugcgaaucgucgccg

SEQ ID NO: 1541713 - RNA, 11 nt, Pseudomonas aeruginosa PA01
ggcgcgcuggc

SEQ ID NO: 1541714 - RNA, 22 nt, Pseudomonas aeruginosa PA01
ggcgcggagauccccuccucca

SEQ ID NO: 1541715 - RNA, 20 nt, Pseudomonas aeruginosa PA01
ggcgcggacgauggucgccg

SEQ ID NO: 1541716 - RNA, 13 nt, Pseudomonas aeruginosa PA01
ggcgcgcgccggg

SEQ ID NO: 1541717 - RNA, 14 nt, Pseudomonas aeruginosa PA01
ggcgcgcgccgggc

SEQ ID NO: 1541718 - RNA, 22 nt, Pseudomonas aeruginosa PA01
ggcgcgccuggaucagcgccuc

SEQ ID NO: 1541719 - RNA, 18 nt, Pseudomonas aeruginosa PA01
ggcgcgcgccucagcggc

SEQ ID NO: 1541720 - RNA, 22 nt, Pseudomonas aeruginosa PA01
ggcgcgccggugaucgagccgc

SEQ ID NO: 1541721 - RNA, 22 nt, Pseudomonas aeruginosa PA01
ggcgcgccgcaguacgaggggc

SEQ ID NO: 1541722 - RNA, 16 nt, Pseudomonas aeruginosa PA01
ggcgcgccgugcggcg

SEQ ID NO: 1541723 - RNA, 17 nt, Pseudomonas aeruginosa PA01
ggcgcgccgugcggcgu

SEQ ID NO: 1541724 - RNA, 11 nt, Pseudomonas aeruginosa PA01
ggcgcgcgccg

SEQ ID NO: 1541725 - RNA, 13 nt, Pseudomonas aeruginosa PA01
ggcgcgccaaggc

SEQ ID NO: 1541726 - RNA, 23 nt, Pseudomonas aeruginosa PA01
ggcgcgccaaggccgccaggccu

SEQ ID NO: 1541727 - RNA, 13 nt, Pseudomonas aeruginosa PA01
ggcgcgcccaggc

SEQ ID NO: 1541728 - RNA, 12 nt, Pseudomonas aeruginosa PA01
ggcgcgcccggc

SEQ ID NO: 1541729 - RNA, 19 nt, Pseudomonas aeruginosa PA01
ggcggaaaaagcgcggagg

SEQ ID NO: 1541730 - RNA, 22 nt, Pseudomonas aeruginosa PA01
ggcggaagaaaagaaggcggau

SEQ ID NO: 1541731 - RNA, 16 nt, Pseudomonas aeruginosa PA01
ggcggaaauacggcuc

SEQ ID NO: 1541732 - RNA, 13 nt, Pseudomonas aeruginosa PA01
ggcgcuugggcgc

SEQ ID NO: 1541733 - RNA, 19 nt, Pseudomonas aeruginosa PA01
ggcgcuugagcagccaggc

SEQ ID NO: 1541734 - RNA, 20 nt, Pseudomonas aeruginosa PA01
ggcgcuugagcagccaggcg

SEQ ID NO: 1541735 - RNA, 23 nt, Pseudomonas aeruginosa PA01
ggcgcugucgccggucaggcugc

SEQ ID NO: 1541736 - RNA, 14 nt, Pseudomonas aeruginosa PA01
ggcgcuggcgcgga

SEQ ID NO: 1541737 - RNA, 17 nt, Pseudomonas aeruginosa PA01
ggcgcuguaggcgagca

SEQ ID NO: 1541738 - RNA, 14 nt, Pseudomonas aeruginosa PA01
ggcgcugggcggcu

SEQ ID NO: 1541739 - RNA, 16 nt, Pseudomonas aeruginosa PA01
ggcgcugggcggcugg

SEQ ID NO: 1541740 - RNA, 19 nt, Pseudomonas aeruginosa PA01
ggcgcugggcggcuggccg

SEQ ID NO: 1541741 - RNA, 16 nt, Pseudomonas aeruginosa PA01
ggcgcuggccagcgcu

SEQ ID NO: 1541742 - RNA, 15 nt, Pseudomonas aeruginosa PA01
ggcgcuggccaggua

SEQ ID NO: 1541743 - RNA, 20 nt, Pseudomonas aeruginosa PA01
ggcgcuggcgccgaugcugu

SEQ ID NO: 1541744 - RNA, 14 nt, Pseudomonas aeruginosa PA01
ggcgcugcgcggcg

SEQ ID NO: 1541745 - RNA, 18 nt, Pseudomonas aeruginosa PA01
ggcgcugccggccagggu

SEQ ID NO: 1541746 - RNA, 17 nt, Pseudomonas aeruginosa PA01
ggcgcuggaacagcggu

SEQ ID NO: 1541747 - RNA, 20 nt, Pseudomonas aeruginosa PA01
ggcgcugcgguaccagcgca

SEQ ID NO: 1541748 - RNA, 16 nt, Pseudomonas aeruginosa PA01
ggcgcucgacgaucag

SEQ ID NO: 1541749 - RNA, 14 nt, Pseudomonas aeruginosa PA01
ggcgcucgaggggc

SEQ ID NO: 1541750 - RNA, 13 nt, Pseudomonas aeruginosa PA01
ggcgcucgcgggc

SEQ ID NO: 1541751 - RNA, 14 nt, Pseudomonas aeruginosa PA01
ggcgcucggcggcg

SEQ ID NO: 1541752 - RNA, 13 nt, Pseudomonas aeruginosa PA01
ggcgcucggcucc

SEQ ID NO: 1541753 - RNA, 17 nt, Pseudomonas aeruginosa PA01
ggcgcucggcuccagcc

SEQ ID NO: 1541754 - RNA, 22 nt, Pseudomonas aeruginosa PA01
ggcgcucggcuccagccaggcc

SEQ ID NO: 1541755 - RNA, 13 nt, Pseudomonas aeruginosa PA01
ggcgcucucgccg

SEQ ID NO: 1541756 - RNA, 21 nt, Pseudomonas aeruginosa PA01
ggcgcucuucacuuccagcug

SEQ ID NO: 1541757 - RNA, 16 nt, Pseudomonas aeruginosa PA01
ggcgcugaacagcugg

SEQ ID NO: 1541758 - RNA, 14 nt, Pseudomonas aeruginosa PA01
ggcgcucggcgacg

SEQ ID NO: 1541759 - RNA, 17 nt, Pseudomonas aeruginosa PA01
ggcgcugccgaacagca

SEQ ID NO: 1541760 - RNA, 20 nt, Pseudomonas aeruginosa PA01
ggcgcugccgaacagcaggg

SEQ ID NO: 1541761 - RNA, 20 nt, Pseudomonas aeruginosa PA01
ggcgcugcaaucgcugccgg

SEQ ID NO: 1541762 - RNA, 21 nt, Pseudomonas aeruginosa PA01
ggcgcugaccgcucccaggca

SEQ ID NO: 1541763 - RNA, 14 nt, Pseudomonas aeruginosa PA01
ggcgcugagcgaga

SEQ ID NO: 1541764 - RNA, 23 nt, Pseudomonas aeruginosa PA01
ggcgcugagcgccucgaucgccu

SEQ ID NO: 1541765 - RNA, 13 nt, Pseudomonas aeruginosa PA01
ggcgcugaggaag

SEQ ID NO: 1541766 - RNA, 20 nt, Pseudomonas aeruginosa PA01
ggcgcugaggaagagcagcg

SEQ ID NO: 1541767 - RNA, 23 nt, Pseudomonas aeruginosa PA01
ggcgcugaggaagagcagcgcgg

SEQ ID NO: 1541768 - RNA, 16 nt, Pseudomonas aeruginosa PA01
ggcgcuacgcucgccg

SEQ ID NO: 1541769 - RNA, 22 nt, Pseudomonas aeruginosa PA01
ggcgcuaccgcgcauggcggcg

SEQ ID NO: 1541770 - RNA, 18 nt, Pseudomonas aeruginosa PA01
ggcgcguucacuccacga

SEQ ID NO: 1541771 - RNA, 20 nt, Pseudomonas aeruginosa PA01
ggcgcguuuuuccgcgagga

SEQ ID NO: 1541772 - RNA, 18 nt, Pseudomonas aeruginosa PA01
ggcgcuccaacagcaggu

SEQ ID NO: 1541773 - RNA, 19 nt, Pseudomonas aeruginosa PA01
ggcgcuccagacucuccag

SEQ ID NO: 1541774 - RNA, 12 nt, Pseudomonas aeruginosa PA01
ggcgcuccacca

SEQ ID NO: 1541775 - RNA, 18 nt, Pseudomonas aeruginosa PA01
ggcgcuccaccagggccu

SEQ ID NO: 1541776 - RNA, 19 nt, Pseudomonas aeruginosa PA01
ggcgcuccaccagggccuc

SEQ ID NO: 1541777 - RNA, 17 nt, Pseudomonas aeruginosa PA01
ggcgcuccuugagcagc

SEQ ID NO: 1541778 - RNA, 13 nt, Pseudomonas aeruginosa PA01
ggcgcuccuccag

SEQ ID NO: 1541779 - RNA, 20 nt, Pseudomonas aeruginosa PA01
ggcgguaguaggguucgccg

SEQ ID NO: 1541780 - RNA, 15 nt, Pseudomonas aeruginosa PA01
ggcgguaugccggag

SEQ ID NO: 1541781 - RNA, 15 nt, Pseudomonas aeruginosa PA01
ggcggucaugcgccc

SEQ ID NO: 1541782 - RNA, 19 nt, Pseudomonas aeruginosa PA01
ggcggucgccgacccagag

SEQ ID NO: 1541783 - RNA, 15 nt, Pseudomonas aeruginosa PA01
ggcggucgaggcccu

SEQ ID NO: 1541784 - RNA, 14 nt, Pseudomonas aeruginosa PA01
ggcggucaggccaa

SEQ ID NO: 1541785 - RNA, 20 nt, Pseudomonas aeruginosa PA01
ggcggucccagaccagcagc

SEQ ID NO: 1541786 - RNA, 17 nt, Pseudomonas aeruginosa PA01
ggcggucggccagggga

SEQ ID NO: 1541787 - RNA, 16 nt, Pseudomonas aeruginosa PA01
ggcggucggcgagggc

SEQ ID NO: 1541788 - RNA, 20 nt, Pseudomonas aeruginosa PA01
ggcggucggcucagccgacc

SEQ ID NO: 1541789 - RNA, 17 nt, Pseudomonas aeruginosa PA01
ggcgggcugccgcggaa

SEQ ID NO: 1541790 - RNA, 13 nt, Pseudomonas aeruginosa PA01
ggcgggcucgccc

SEQ ID NO: 1541791 - RNA, 17 nt, Pseudomonas aeruginosa PA01
ggcggggcgcagcagga

SEQ ID NO: 1541792 - RNA, 22 nt, Pseudomonas aeruginosa PA01
ggcggguucagcccgccgugcg

SEQ ID NO: 1541793 - RNA, 22 nt, Pseudomonas aeruginosa PA01
ggcggguaguguuugcgcaggg

SEQ ID NO: 1541794 - RNA, 17 nt, Pseudomonas aeruginosa PA01
ggcgggucacgccgagg

SEQ ID NO: 1541795 - RNA, 15 nt, Pseudomonas aeruginosa PA01
ggcgguacagccccc

SEQ ID NO: 1541796 - RNA, 14 nt, Pseudomonas aeruginosa PA01
ggcgguacaggcgc

SEQ ID NO: 1541797 - RNA, 23 nt, Pseudomonas aeruginosa PA01
ggcggcuuuuucauuucuucggg

SEQ ID NO: 1541798 - RNA, 17 nt, Pseudomonas aeruginosa PA01
ggcgggagagggcggcg

SEQ ID NO: 1541799 - RNA, 13 nt, Pseudomonas aeruginosa PA01
ggcgggagcggcc

SEQ ID NO: 1541800 - RNA, 15 nt, Pseudomonas aeruginosa PA01
ggcgggagcggccug

SEQ ID NO: 1541801 - RNA, 14 nt, Pseudomonas aeruginosa PA01
ggcgggaggucaca

SEQ ID NO: 1541802 - RNA, 21 nt, Pseudomonas aeruginosa PA01
ggcgggaucaggucgccagcg

SEQ ID NO: 1541803 - RNA, 18 nt, Pseudomonas aeruginosa PA01
ggcgggaucgacgccgcu

SEQ ID NO: 1541804 - RNA, 19 nt, Pseudomonas aeruginosa PA01
ggcggcuccggcgccaggc

SEQ ID NO: 1541805 - RNA, 15 nt, Pseudomonas aeruginosa PA01
ggcggcuggcguggg

SEQ ID NO: 1541806 - RNA, 20 nt, Pseudomonas aeruginosa PA01
ggcggcuucgcgcuccaggc

SEQ ID NO: 1541807 - RNA, 20 nt, Pseudomonas aeruginosa PA01
ggcgggcguuuucguuggcg

SEQ ID NO: 1541808 - RNA, 19 nt, Pseudomonas aeruginosa PA01
ggcgggcucuaugcgcggg

SEQ ID NO: 1541809 - RNA, 15 nt, Pseudomonas aeruginosa PA01
ggcgggccgcucgcg

SEQ ID NO: 1541810 - RNA, 20 nt, Pseudomonas aeruginosa PA01
ggcgggcgaaguagaagcgc

SEQ ID NO: 1541811 - RNA, 16 nt, Pseudomonas aeruginosa PA01
ggcgggauugucgccg

SEQ ID NO: 1541812 - RNA, 15 nt, Pseudomonas aeruginosa PA01
ggcgggccagcaggc

SEQ ID NO: 1541813 - RNA, 18 nt, Pseudomonas aeruginosa PA01
ggcgggccagcaggcgcu

SEQ ID NO: 1541814 - RNA, 18 nt, Pseudomonas aeruginosa PA01
ggcgggccagcagggugg

SEQ ID NO: 1541815 - RNA, 15 nt, Pseudomonas aeruginosa PA01
ggcgggccagcuggc

SEQ ID NO: 1541816 - RNA, 12 nt, Pseudomonas aeruginosa PA01
ggcguccagcag

SEQ ID NO: 1541817 - RNA, 22 nt, Pseudomonas aeruginosa PA01
ggcguccgcggccugcucggcu

SEQ ID NO: 1541818 - RNA, 20 nt, Pseudomonas aeruginosa PA01
ggcgucccggcgccgcccuu

SEQ ID NO: 1541819 - RNA, 19 nt, Pseudomonas aeruginosa PA01
ggcgucccggguucugcuc

SEQ ID NO: 1541820 - RNA, 19 nt, Pseudomonas aeruginosa PA01
ggcgucccguuccggcgca

SEQ ID NO: 1541821 - RNA, 16 nt, Pseudomonas aeruginosa PA01
ggcguccauggcggcg

SEQ ID NO: 1541822 - RNA, 19 nt, Pseudomonas aeruginosa PA01
ggcguccacuccggcagca

SEQ ID NO: 1541823 - RNA, 18 nt, Pseudomonas aeruginosa PA01
ggcguauaaccgcucgcg

SEQ ID NO: 1541824 - RNA, 14 nt, Pseudomonas aeruginosa PA01
ggcguauccucggc

SEQ ID NO: 1541825 - RNA, 20 nt, Pseudomonas aeruginosa PA01
ggcguaggccgucgcugccg

SEQ ID NO: 1541826 - RNA, 19 nt, Pseudomonas aeruginosa PA01
ggcguagggcgaauaacgc

SEQ ID NO: 1541827 - RNA, 16 nt, Pseudomonas aeruginosa PA01
ggcguagggggccggg

SEQ ID NO: 1541828 - RNA, 17 nt, Pseudomonas aeruginosa PA01
ggcguagcgcggcagcg

SEQ ID NO: 1541829 - RNA, 13 nt, Pseudomonas aeruginosa PA01
ggcguagccggcg

SEQ ID NO: 1541830 - RNA, 23 nt, Pseudomonas aeruginosa PA01
ggcguagccggcgauccgcugca

SEQ ID NO: 1541831 - RNA, 14 nt, Pseudomonas aeruginosa PA01
ggcguagagccugg

SEQ ID NO: 1541832 - RNA, 17 nt, Pseudomonas aeruginosa PA01
ggcguagaggcucggcg

SEQ ID NO: 1541833 - RNA, 12 nt, Pseudomonas aeruginosa PA01
ggcgguuuccag

SEQ ID NO: 1541834 - RNA, 16 nt, Pseudomonas aeruginosa PA01
ggcgguuucgccgagg

SEQ ID NO: 1541835 - RNA, 19 nt, Pseudomonas aeruginosa PA01
ggcgguuauuccgcgggac

SEQ ID NO: 1541836 - RNA, 16 nt, Pseudomonas aeruginosa PA01
ggcguaccucgccagg

SEQ ID NO: 1541837 - RNA, 17 nt, Pseudomonas aeruginosa PA01
ggcguaacggcucgccg

SEQ ID NO: 1541838 - RNA, 22 nt, Pseudomonas aeruginosa PA01
ggcggugaccguuucgccgccg

SEQ ID NO: 1541839 - RNA, 16 nt, Pseudomonas aeruginosa PA01
ggcggugaccagcggc

SEQ ID NO: 1541840 - RNA, 15 nt, Pseudomonas aeruginosa PA01
ggcggugcgccggcg

SEQ ID NO: 1541841 - RNA, 13 nt, Pseudomonas aeruginosa PA01
ggcgugggccagc

SEQ ID NO: 1541842 - RNA, 22 nt, Pseudomonas aeruginosa PA01
ggcguggggaagacggccagga

SEQ ID NO: 1541843 - RNA, 21 nt, Pseudomonas aeruginosa PA01
ggcguggcucgaucagccggc

SEQ ID NO: 1541844 - RNA, 22 nt, Pseudomonas aeruginosa PA01
ggcguggcucgaucagccggcg

SEQ ID NO: 1541845 - RNA, 16 nt, Pseudomonas aeruginosa PA01
ggcguggcggccgccg

SEQ ID NO: 1541846 - RNA, 22 nt, Pseudomonas aeruginosa PA01
ggcgugucgaggaaggccagca

SEQ ID NO: 1541847 - RNA, 14 nt, Pseudomonas aeruginosa PA01
ggcgugucgagggc

SEQ ID NO: 1541848 - RNA, 17 nt, Pseudomonas aeruginosa PA01
ggcguggucuuccucgg

SEQ ID NO: 1541849 - RNA, 17 nt, Pseudomonas aeruginosa PA01
ggcgugguggcggggaa

SEQ ID NO: 1541850 - RNA, 16 nt, Pseudomonas aeruginosa PA01
ggcguggucggcggcc

SEQ ID NO: 1541851 - RNA, 13 nt, Pseudomonas aeruginosa PA01
ggcguggccggcg

SEQ ID NO: 1541852 - RNA, 23 nt, Pseudomonas aeruginosa PA01
ggcgugcugggucuccuccucca

SEQ ID NO: 1541853 - RNA, 22 nt, Pseudomonas aeruginosa PA01
ggcgugcaguacuuggccagca

SEQ ID NO: 1541854 - RNA, 14 nt, Pseudomonas aeruginosa PA01
ggcgugccgcaggc

SEQ ID NO: 1541855 - RNA, 16 nt, Pseudomonas aeruginosa PA01
ggcgugccgccaggcc

SEQ ID NO: 1541856 - RNA, 20 nt, Pseudomonas aeruginosa PA01
ggcgugacugcaaucgacca

SEQ ID NO: 1541857 - RNA, 20 nt, Pseudomonas aeruginosa PA01
ggcgugcaggccgccgagug

SEQ ID NO: 1541858 - RNA, 14 nt, Pseudomonas aeruginosa PA01
ggcgucuccugccg

SEQ ID NO: 1541859 - RNA, 19 nt, Pseudomonas aeruginosa PA01
ggcgucuuccggcucgccg

SEQ ID NO: 1541860 - RNA, 16 nt, Pseudomonas aeruginosa PA01
ggcgucuucggcggcg

SEQ ID NO: 1541861 - RNA, 18 nt, Pseudomonas aeruginosa PA01
ggcgucugggacggcagc

SEQ ID NO: 1541862 - RNA, 15 nt, Pseudomonas aeruginosa PA01
ggcgugaacgcggcg

SEQ ID NO: 1541863 - RNA, 15 nt, Pseudomonas aeruginosa PA01
ggcgugaagccgccg

SEQ ID NO: 1541864 - RNA, 22 nt, Pseudomonas aeruginosa PA01
ggcgugaagccgccgcccagca

SEQ ID NO: 1541865 - RNA, 13 nt, Pseudomonas aeruginosa PA01
ggcgucgggcagg

SEQ ID NO: 1541866 - RNA, 21 nt, Pseudomonas aeruginosa PA01
ggcgucgggcgaaacggcagg

SEQ ID NO: 1541867 - RNA, 16 nt, Pseudomonas aeruginosa PA01
ggcgucggcgcgggcg

SEQ ID NO: 1541868 - RNA, 23 nt, Pseudomonas aeruginosa PA01
ggcgucggagagauagucgccgu

SEQ ID NO: 1541869 - RNA, 16 nt, Pseudomonas aeruginosa PA01
ggcgucgcgcuugccu

SEQ ID NO: 1541870 - RNA, 11 nt, Pseudomonas aeruginosa PA01
ggcgucgccgg

SEQ ID NO: 1541871 - RNA, 15 nt, Pseudomonas aeruginosa PA01
ggcgucgcaccuggg

SEQ ID NO: 1541872 - RNA, 18 nt, Pseudomonas aeruginosa PA01
ggcgucgcacugcugcuu

SEQ ID NO: 1541873 - RNA, 16 nt, Pseudomonas aeruginosa PA01
ggcgucgaaggcggcg

SEQ ID NO: 1541874 - RNA, 20 nt, Pseudomonas aeruginosa PA01
ggcgucgaacaccggcgccg

SEQ ID NO: 1541875 - RNA, 21 nt, Pseudomonas aeruginosa PA01
ggcguccgcuggccugcagca

SEQ ID NO: 1541876 - RNA, 15 nt, Pseudomonas aeruginosa PA01
ggcguccgguaggag

SEQ ID NO: 1541877 - RNA, 19 nt, Pseudomonas aeruginosa PA01
ggcguuggcgucgcugccg

SEQ ID NO: 1541878 - RNA, 22 nt, Pseudomonas aeruginosa PA01
ggcguugcagugcgccgcagcg

SEQ ID NO: 1541879 - RNA, 17 nt, Pseudomonas aeruginosa PA01
ggcguucggaccugucc

SEQ ID NO: 1541880 - RNA, 22 nt, Pseudomonas aeruginosa PA01
ggcguucgaggguacuccuggc

SEQ ID NO: 1541881 - RNA, 20 nt, Pseudomonas aeruginosa PA01
ggcguucgccuugcggggcg

SEQ ID NO: 1541882 - RNA, 16 nt, Pseudomonas aeruginosa PA01
ggcguuguugccgccg

SEQ ID NO: 1541883 - RNA, 19 nt, Pseudomonas aeruginosa PA01
ggcguugguacagcucgcg

SEQ ID NO: 1541884 - RNA, 17 nt, Pseudomonas aeruginosa PA01
ggcguuguccaggcugu

SEQ ID NO: 1541885 - RNA, 21 nt, Pseudomonas aeruginosa PA01
ggcguugucggcaaccgggcg

SEQ ID NO: 1541886 - RNA, 18 nt, Pseudomonas aeruginosa PA01
ggcguugucggccagcag

SEQ ID NO: 1541887 - RNA, 16 nt, Pseudomonas aeruginosa PA01
ggcguuucgccgggcc

SEQ ID NO: 1541888 - RNA, 22 nt, Pseudomonas aeruginosa PA01
ggcguuuuuucuuuccagcgcc

SEQ ID NO: 1541889 - RNA, 22 nt, Pseudomonas aeruginosa PA01
ggcguuuuucauggcggcauca

SEQ ID NO: 1541890 - RNA, 16 nt, Pseudomonas aeruginosa PA01
ggcuacccucucccca

SEQ ID NO: 1541891 - RNA, 22 nt, Pseudomonas aeruginosa PA01
ggcuaucgaucacugccuggca

SEQ ID NO: 1541892 - RNA, 13 nt, Pseudomonas aeruginosa PA01
ggccuuggucucg

SEQ ID NO: 1541893 - RNA, 20 nt, Pseudomonas aeruginosa PA01
ggcgaaaucgagcugcucga

SEQ ID NO: 1541894 - RNA, 19 nt, Pseudomonas aeruginosa PA01
ggcgaacaccgggccgccg

SEQ ID NO: 1541895 - RNA, 21 nt, Pseudomonas aeruginosa PA01
ggcgaacaccgggccgccggc

SEQ ID NO: 1541896 - RNA, 17 nt, Pseudomonas aeruginosa PA01
ggcgaacacgucggcgc

SEQ ID NO: 1541897 - RNA, 19 nt, Pseudomonas aeruginosa PA01
ggcgaacacgucggcgcgc

SEQ ID NO: 1541898 - RNA, 17 nt, Pseudomonas aeruginosa PA01
ggcgaaaccggccagcg

SEQ ID NO: 1541899 - RNA, 20 nt, Pseudomonas aeruginosa PA01
ggcgaaaccggccagcgcgg

SEQ ID NO: 1541900 - RNA, 16 nt, Pseudomonas aeruginosa PA01
ggcgaaccaggcggcc

SEQ ID NO: 1541901 - RNA, 24 nt, Pseudomonas aeruginosa PA01
ggcgaacccucggugcggccgagg

SEQ ID NO: 1541902 - RNA, 19 nt, Pseudomonas aeruginosa PA01
ggcgaacagguagccccgg

SEQ ID NO: 1541903 - RNA, 15 nt, Pseudomonas aeruginosa PA01
ggcgaacagccagcg

SEQ ID NO: 1541904 - RNA, 18 nt, Pseudomonas aeruginosa PA01
ggcgaaauugccuccgcu

SEQ ID NO: 1541905 - RNA, 12 nt, Pseudomonas aeruginosa PA01
ggcgaacagcac

SEQ ID NO: 1541906 - RNA, 21 nt, Pseudomonas aeruginosa PA01
ggcgaacgccgggucuucagu

SEQ ID NO: 1541907 - RNA, 19 nt, Pseudomonas aeruginosa PA01
ggcgaacgcuugagccccg

SEQ ID NO: 1541908 - RNA, 20 nt, Pseudomonas aeruginosa PA01
ggcgaacucguagacgaaua

SEQ ID NO: 1541909 - RNA, 16 nt, Pseudomonas aeruginosa PA01
ggcgaagccggcggcg

SEQ ID NO: 1541910 - RNA, 18 nt, Pseudomonas aeruginosa PA01
ggcgaagcgcagcuccgg

SEQ ID NO: 1541911 - RNA, 15 nt, Pseudomonas aeruginosa PA01
ggcgaagcgcaggcu

SEQ ID NO: 1541912 - RNA, 22 nt, Pseudomonas aeruginosa PA01
ggcgaagcggcccuugucgccg

SEQ ID NO: 1541913 - RNA, 17 nt, Pseudomonas aeruginosa PA01
ggcgaagcggcuggccg

SEQ ID NO: 1541914 - RNA, 13 nt, Pseudomonas aeruginosa PA01
ggcgaagcccagc

SEQ ID NO: 1541915 - RNA, 15 nt, Pseudomonas aeruginosa PA01
ggcgaagccggcggc

SEQ ID NO: 1541916 - RNA, 22 nt, Pseudomonas aeruginosa PA01
ggcgaagccgcgcccggccucc

SEQ ID NO: 1541917 - RNA, 16 nt, Pseudomonas aeruginosa PA01
ggcgaagcuggggcug

SEQ ID NO: 1541918 - RNA, 16 nt, Pseudomonas aeruginosa PA01
ggcgaagggcaggccg

SEQ ID NO: 1541919 - RNA, 16 nt, Pseudomonas aeruginosa PA01
ggcgaagguggcgacc

SEQ ID NO: 1541920 - RNA, 21 nt, Pseudomonas aeruginosa PA01
ggcgaauaaccauugcgcggg

SEQ ID NO: 1541921 - RNA, 20 nt, Pseudomonas aeruginosa PA01
ggcgaauaaccgcaucgcgg

SEQ ID NO: 1541922 - RNA, 17 nt, Pseudomonas aeruginosa PA01
ggcgaauaaccgcucgc

SEQ ID NO: 1541923 - RNA, 20 nt, Pseudomonas aeruginosa PA01
ggcgaauaccagugccgcgg

SEQ ID NO: 1541924 - RNA, 17 nt, Pseudomonas aeruginosa PA01
ggcgaauagccggcgcu

SEQ ID NO: 1541925 - RNA, 18 nt, Pseudomonas aeruginosa PA01
ggcgaauagccggcgcug

SEQ ID NO: 1541926 - RNA, 13 nt, Pseudomonas aeruginosa PA01
ggcgaagucgccg

SEQ ID NO: 1541927 - RNA, 17 nt, Pseudomonas aeruginosa PA01
ggcgaaguaggaguagg

SEQ ID NO: 1541928 - RNA, 18 nt, Pseudomonas aeruginosa PA01
ggcgaaguagaagcgcgc

SEQ ID NO: 1541929 - RNA, 15 nt, Pseudomonas aeruginosa PA01
ggcgaagucggcgcg

SEQ ID NO: 1541930 - RNA, 16 nt, Pseudomonas aeruginosa PA01
ggcgaagucggcgcgc

SEQ ID NO: 1541931 - RNA, 17 nt, Pseudomonas aeruginosa PA01
ggcgaagucggcgcgcc

SEQ ID NO: 1541932 - RNA, 15 nt, Pseudomonas aeruginosa PA01
ggcgaagucugccug

SEQ ID NO: 1541933 - RNA, 17 nt, Pseudomonas aeruginosa PA01
ggcgaaguucccgccgc

SEQ ID NO: 1541934 - RNA, 14 nt, Pseudomonas aeruginosa PA01
ggcgaccagcucga

SEQ ID NO: 1541935 - RNA, 13 nt, Pseudomonas aeruginosa PA01
ggcgaccagcgcg

SEQ ID NO: 1541936 - RNA, 14 nt, Pseudomonas aeruginosa PA01
ggcgaccagccggg

SEQ ID NO: 1541937 - RNA, 13 nt, Pseudomonas aeruginosa PA01
ggcgaccagcauc

SEQ ID NO: 1541938 - RNA, 24 nt, Pseudomonas aeruginosa PA01
ggcgaccaccgccgggaccacgcu

SEQ ID NO: 1541939 - RNA, 16 nt, Pseudomonas aeruginosa PA01
ggcgacauagccggcg

SEQ ID NO: 1541940 - RNA, 15 nt, Pseudomonas aeruginosa PA01
ggcgaauucggggcu

SEQ ID NO: 1541941 - RNA, 22 nt, Pseudomonas aeruginosa PA01
ggcgaauucgucgccgccgagg

SEQ ID NO: 1541942 - RNA, 15 nt, Pseudomonas aeruginosa PA01
ggcgacaccgccagc

SEQ ID NO: 1541943 - RNA, 17 nt, Pseudomonas aeruginosa PA01
ggcgacaccgccagcac

SEQ ID NO: 1541944 - RNA, 12 nt, Pseudomonas aeruginosa PA01
ggcgacgaaggc

SEQ ID NO: 1541945 - RNA, 22 nt, Pseudomonas aeruginosa PA01
ggcgacgaaggucggcggcagc

SEQ ID NO: 1541946 - RNA, 23 nt, Pseudomonas aeruginosa PA01
ggcgacgaaggucggcggcagcu

SEQ ID NO: 1541947 - RNA, 17 nt, Pseudomonas aeruginosa PA01
ggcgacgaagcccaggc

SEQ ID NO: 1541948 - RNA, 21 nt, Pseudomonas aeruginosa PA01
ggcgaccuuguccugcggccg

SEQ ID NO: 1541949 - RNA, 16 nt, Pseudomonas aeruginosa PA01
ggcgacgaaacggcuc

SEQ ID NO: 1541950 - RNA, 17 nt, Pseudomonas aeruginosa PA01
ggcgacgaaacggcucu

SEQ ID NO: 1541951 - RNA, 15 nt, Pseudomonas aeruginosa PA01
ggcgaccugcucgcg

SEQ ID NO: 1541952 - RNA, 22 nt, Pseudomonas aeruginosa PA01
ggcgaccugcggugucccuucu

SEQ ID NO: 1541953 - RNA, 20 nt, Pseudomonas aeruginosa PA01
ggcgaccucagucgugcagg

SEQ ID NO: 1541954 - RNA, 19 nt, Pseudomonas aeruginosa PA01
ggcgaccgcaucguuggcg

SEQ ID NO: 1541955 - RNA, 21 nt, Pseudomonas aeruginosa PA01
ggcgacccgccguucgcccgc

SEQ ID NO: 1541956 - RNA, 19 nt, Pseudomonas aeruginosa PA01
ggcgacccuggggucgccg

SEQ ID NO: 1541957 - RNA, 19 nt, Pseudomonas aeruginosa PA01
ggcgacccgggucaggccg

SEQ ID NO: 1541958 - RNA, 14 nt, Pseudomonas aeruginosa PA01
ggcgacccaggccg

SEQ ID NO: 1541959 - RNA, 19 nt, Pseudomonas aeruginosa PA01
ggcgacgucccuuccccga

SEQ ID NO: 1541960 - RNA, 22 nt, Pseudomonas aeruginosa PA01
ggcgacggucaggccgagcagc

SEQ ID NO: 1541961 - RNA, 18 nt, Pseudomonas aeruginosa PA01
ggcgacgugggccugcuc

SEQ ID NO: 1541962 - RNA, 19 nt, Pseudomonas aeruginosa PA01
ggcgacguucugcucgcug

SEQ ID NO: 1541963 - RNA, 20 nt, Pseudomonas aeruginosa PA01
ggcgacguugcgcaggggcg

SEQ ID NO: 1541964 - RNA, 16 nt, Pseudomonas aeruginosa PA01
ggcgacgcgcaggccg

SEQ ID NO: 1541965 - RNA, 14 nt, Pseudomonas aeruginosa PA01
ggcgacgcaggacg

SEQ ID NO: 1541966 - RNA, 16 nt, Pseudomonas aeruginosa PA01
ggcgacgaugccgccg

SEQ ID NO: 1541967 - RNA, 16 nt, Pseudomonas aeruginosa PA01
ggcgaggcgcucgacg

SEQ ID NO: 1541968 - RNA, 19 nt, Pseudomonas aeruginosa PA01
ggcgaggacgccgggcugg

SEQ ID NO: 1541969 - RNA, 19 nt, Pseudomonas aeruginosa PA01
ggcgaggaucacgcagcag

SEQ ID NO: 1541970 - RNA, 21 nt, Pseudomonas aeruginosa PA01
ggcgaggaucacgcagcaggc

SEQ ID NO: 1541971 - RNA, 18 nt, Pseudomonas aeruginosa PA01
ggcgaggauuuccucgcg

SEQ ID NO: 1541972 - RNA, 14 nt, Pseudomonas aeruginosa PA01
ggcgaggaacagca

SEQ ID NO: 1541973 - RNA, 14 nt, Pseudomonas aeruginosa PA01
ggcgagcugcacgu

SEQ ID NO: 1541974 - RNA, 12 nt, Pseudomonas aeruginosa PA01
ggcgagcgagcg

SEQ ID NO: 1541975 - RNA, 19 nt, Pseudomonas aeruginosa PA01
ggcgagccgccgggcggcg

SEQ ID NO: 1541976 - RNA, 13 nt, Pseudomonas aeruginosa PA01
ggcgagagcgccg

SEQ ID NO: 1541977 - RNA, 15 nt, Pseudomonas aeruginosa PA01
ggcgagcagcggcgc

SEQ ID NO: 1541978 - RNA, 15 nt, Pseudomonas aeruginosa PA01
ggcgagcagggcgcu

SEQ ID NO: 1541979 - RNA, 20 nt, Pseudomonas aeruginosa PA01
ggcgagcagggcgcugagcg

SEQ ID NO: 1541980 - RNA, 17 nt, Pseudomonas aeruginosa PA01
ggcgagaggucggcgcg

SEQ ID NO: 1541981 - RNA, 18 nt, Pseudomonas aeruginosa PA01
ggccugccgaugggccuu

SEQ ID NO: 1541982 - RNA, 22 nt, Pseudomonas aeruginosa PA01
ggccugcagguuguccagggca

SEQ ID NO: 1541983 - RNA, 14 nt, Pseudomonas aeruginosa PA01
ggccugcagccugg

SEQ ID NO: 1541984 - RNA, 21 nt, Pseudomonas aeruginosa PA01
ggccugcagcgacuccagcca

SEQ ID NO: 1541985 - RNA, 17 nt, Pseudomonas aeruginosa PA01
ggccugcagguccgggu

SEQ ID NO: 1541986 - RNA, 21 nt, Pseudomonas aeruginosa PA01
ggccugcaccugcucggggcc

SEQ ID NO: 1541987 - RNA, 13 nt, Pseudomonas aeruginosa PA01
ggccugcaccagc

SEQ ID NO: 1541988 - RNA, 18 nt, Pseudomonas aeruginosa PA01
ggccugcaacacccaggc

SEQ ID NO: 1541989 - RNA, 22 nt, Pseudomonas aeruginosa PA01
ggccugcaacacccaggccugg

SEQ ID NO: 1541990 - RNA, 16 nt, Pseudomonas aeruginosa PA01
ggccugcuugcaggag

SEQ ID NO: 1541991 - RNA, 19 nt, Pseudomonas aeruginosa PA01
ggccuggaauaccccgcgg

SEQ ID NO: 1541992 - RNA, 17 nt, Pseudomonas aeruginosa PA01
ggccugcugcgccggca

SEQ ID NO: 1541993 - RNA, 12 nt, Pseudomonas aeruginosa PA01
ggccugcugcuc

SEQ ID NO: 1541994 - RNA, 17 nt, Pseudomonas aeruginosa PA01
ggccugcugcucgaccg

SEQ ID NO: 1541995 - RNA, 17 nt, Pseudomonas aeruginosa PA01
ggccugcucggcucgcg

SEQ ID NO: 1541996 - RNA, 18 nt, Pseudomonas aeruginosa PA01
ggccugcgcgcaccaggc

SEQ ID NO: 1541997 - RNA, 12 nt, Pseudomonas aeruginosa PA01
ggccugcuccuc

SEQ ID NO: 1541998 - RNA, 14 nt, Pseudomonas aeruginosa PA01
ggccugcuccucgg

SEQ ID NO: 1541999 - RNA, 22 nt, Pseudomonas aeruginosa PA01
ggccugcucgcgcagccaggcg

SEQ ID NO: 1542000 - RNA, 18 nt, Pseudomonas aeruginosa PA01
ggccuugcuuugcgccuc

SEQ ID NO: 1542001 - RNA, 16 nt, Pseudomonas aeruginosa PA01
ggccuugacgcgggac

SEQ ID NO: 1542002 - RNA, 20 nt, Pseudomonas aeruginosa PA01
ggccuguggauagaaaagca

SEQ ID NO: 1542003 - RNA, 22 nt, Pseudomonas aeruginosa PA01
ggccuucucgucgccgcccggc

SEQ ID NO: 1542004 - RNA, 20 nt, Pseudomonas aeruginosa PA01
ggccuucacgcagcucugcg

SEQ ID NO: 1542005 - RNA, 15 nt, Pseudomonas aeruginosa PA01
ggccuucgccgacca

SEQ ID NO: 1542006 - RNA, 18 nt, Pseudomonas aeruginosa PA01
ggccuucgccgaccaggu

SEQ ID NO: 1542007 - RNA, 13 nt, Pseudomonas aeruginosa PA01
ggccuucgcugaa

SEQ ID NO: 1542008 - RNA, 20 nt, Pseudomonas aeruginosa PA01
ggccugggcgaagucgacga

SEQ ID NO: 1542009 - RNA, 22 nt, Pseudomonas aeruginosa PA01
ggccugggccgaaggccaggcc

SEQ ID NO: 1542010 - RNA, 13 nt, Pseudomonas aeruginosa PA01
ggccuggcugccg

SEQ ID NO: 1542011 - RNA, 14 nt, Pseudomonas aeruginosa PA01
ggccuggcuggccu

SEQ ID NO: 1542012 - RNA, 19 nt, Pseudomonas aeruginosa PA01
ggccuggcccucggugcgg

SEQ ID NO: 1542013 - RNA, 17 nt, Pseudomonas aeruginosa PA01
ggccuggcgcaacaggc

SEQ ID NO: 1542014 - RNA, 16 nt, Pseudomonas aeruginosa PA01
ggccuggcgcagcggc

SEQ ID NO: 1542015 - RNA, 22 nt, Pseudomonas aeruginosa PA01
ggccuggucgaaagccugccgg

SEQ ID NO: 1542016 - RNA, 21 nt, Pseudomonas aeruginosa PA01
ggccugggugaacagcggccc

SEQ ID NO: 1542017 - RNA, 18 nt, Pseudomonas aeruginosa PA01
ggccugggucaccagcac

SEQ ID NO: 1542018 - RNA, 17 nt, Pseudomonas aeruginosa PA01
ggccuggugcaccuggc

SEQ ID NO: 1542019 - RNA, 16 nt, Pseudomonas aeruginosa PA01
ggccuggugcacgccg

SEQ ID NO: 1542020 - RNA, 15 nt, Pseudomonas aeruginosa PA01
ggccuggugccgggc

SEQ ID NO: 1542021 - RNA, 16 nt, Pseudomonas aeruginosa PA01
ggccuacccgcgcuuc

SEQ ID NO: 1542022 - RNA, 17 nt, Pseudomonas aeruginosa PA01
ggccguuguagagacag

SEQ ID NO: 1542023 - RNA, 21 nt, Pseudomonas aeruginosa PA01
ggccuacuucucgacgaaggc

SEQ ID NO: 1542024 - RNA, 14 nt, Pseudomonas aeruginosa PA01
ggccucaagcaagc

SEQ ID NO: 1542025 - RNA, 20 nt, Pseudomonas aeruginosa PA01
ggccucaacgaccgcccagg

SEQ ID NO: 1542026 - RNA, 14 nt, Pseudomonas aeruginosa PA01
ggccucaggccugg

SEQ ID NO: 1542027 - RNA, 15 nt, Pseudomonas aeruginosa PA01
ggccguugcgcaggc

SEQ ID NO: 1542028 - RNA, 17 nt, Pseudomonas aeruginosa PA01
ggccguucucgaagagc

SEQ ID NO: 1542029 - RNA, 17 nt, Pseudomonas aeruginosa PA01
ggccguugaccagcgcg

SEQ ID NO: 1542030 - RNA, 19 nt, Pseudomonas aeruginosa PA01
ggccgugggccgccgaacg

SEQ ID NO: 1542031 - RNA, 15 nt, Pseudomonas aeruginosa PA01
ggccgugggccggcg

SEQ ID NO: 1542032 - RNA, 20 nt, Pseudomonas aeruginosa PA01
ggccgugccucagagucgca

SEQ ID NO: 1542033 - RNA, 14 nt, Pseudomonas aeruginosa PA01
ggccgugccagagc

SEQ ID NO: 1542034 - RNA, 22 nt, Pseudomonas aeruginosa PA01
ggccgucguuuuguccggcggc

SEQ ID NO: 1542035 - RNA, 18 nt, Pseudomonas aeruginosa PA01
ggccgucgcugccgagcu

SEQ ID NO: 1542036 - RNA, 12 nt, Pseudomonas aeruginosa PA01
ggccgucgggca

SEQ ID NO: 1542037 - RNA, 19 nt, Pseudomonas aeruginosa PA01
ggccucggagucaggcucc

SEQ ID NO: 1542038 - RNA, 14 nt, Pseudomonas aeruginosa PA01
ggccucggccagcg

SEQ ID NO: 1542039 - RNA, 23 nt, Pseudomonas aeruginosa PA01
ggccucggcccgguuuuccgcuu

SEQ ID NO: 1542040 - RNA, 20 nt, Pseudomonas aeruginosa PA01
ggccucggcgaagucgccgu

SEQ ID NO: 1542041 - RNA, 15 nt, Pseudomonas aeruginosa PA01
ggccucggcgcgggc

SEQ ID NO: 1542042 - RNA, 19 nt, Pseudomonas aeruginosa PA01
ggccucggcgcgggccuuc

SEQ ID NO: 1542043 - RNA, 14 nt, Pseudomonas aeruginosa PA01
ggccucguuuuugg

SEQ ID NO: 1542044 - RNA, 23 nt, Pseudomonas aeruginosa PA01
ggccucuccgagacgcugcaccg

SEQ ID NO: 1542045 - RNA, 17 nt, Pseudomonas aeruginosa PA01
ggccucuucgcaacggc

SEQ ID NO: 1542046 - RNA, 17 nt, Pseudomonas aeruginosa PA01
ggccucuucgucggcga

SEQ ID NO: 1542047 - RNA, 22 nt, Pseudomonas aeruginosa PA01
ggccugacgcaagcgcucggcc

SEQ ID NO: 1542048 - RNA, 19 nt, Pseudomonas aeruginosa PA01
ggccuccggacgcugcaug

SEQ ID NO: 1542049 - RNA, 23 nt, Pseudomonas aeruginosa PA01
ggccuccucguaggcguccuggc

SEQ ID NO: 1542050 - RNA, 14 nt, Pseudomonas aeruginosa PA01
ggccuccaggcugg

SEQ ID NO: 1542051 - RNA, 22 nt, Pseudomonas aeruginosa PA01
ggccuccacccgcgaagccugc

SEQ ID NO: 1542052 - RNA, 13 nt, Pseudomonas aeruginosa PA01
ggccuccagcgcc

SEQ ID NO: 1542053 - RNA, 17 nt, Pseudomonas aeruginosa PA01
ggccuccagcgccuggc

SEQ ID NO: 1542054 - RNA, 16 nt, Pseudomonas aeruginosa PA01
ggccucgcgcaacugc

SEQ ID NO: 1542055 - RNA, 18 nt, Pseudomonas aeruginosa PA01
ggccucgcgugcgcuggu

SEQ ID NO: 1542056 - RNA, 19 nt, Pseudomonas aeruginosa PA01
ggccucgccggucgcgcuc

SEQ ID NO: 1542057 - RNA, 22 nt, Pseudomonas aeruginosa PA01
ggccucgcaauugaucauccag

SEQ ID NO: 1542058 - RNA, 20 nt, Pseudomonas aeruginosa PA01
ggccucgaucucguccucgg

SEQ ID NO: 1542059 - RNA, 12 nt, Pseudomonas aeruginosa PA01
ggccucgagcau

SEQ ID NO: 1542060 - RNA, 18 nt, Pseudomonas aeruginosa PA01
ggcgccggcucgcccagc

SEQ ID NO: 1542061 - RNA, 17 nt, Pseudomonas aeruginosa PA01
ggcgccggcgcgcggcg

SEQ ID NO: 1542062 - RNA, 13 nt, Pseudomonas aeruginosa PA01
ggcgccggccucc

SEQ ID NO: 1542063 - RNA, 15 nt, Pseudomonas aeruginosa PA01
ggcgccggccuccag

SEQ ID NO: 1542064 - RNA, 21 nt, Pseudomonas aeruginosa PA01
ggcgccggccuccagcgccug

SEQ ID NO: 1542065 - RNA, 15 nt, Pseudomonas aeruginosa PA01
ggcgccggccucgca

SEQ ID NO: 1542066 - RNA, 13 nt, Pseudomonas aeruginosa PA01
ggcgccgcggguc

SEQ ID NO: 1542067 - RNA, 19 nt, Pseudomonas aeruginosa PA01
ggcgccgcucgaugcccgc

SEQ ID NO: 1542068 - RNA, 15 nt, Pseudomonas aeruginosa PA01
ggcgccgggcugccg

SEQ ID NO: 1542069 - RNA, 14 nt, Pseudomonas aeruginosa PA01
ggcgccgggucaga

SEQ ID NO: 1542070 - RNA, 16 nt, Pseudomonas aeruginosa PA01
ggcgccggugaggcgc

SEQ ID NO: 1542071 - RNA, 21 nt, Pseudomonas aeruginosa PA01
ggcgccggugaggcgcagcag

SEQ ID NO: 1542072 - RNA, 12 nt, Pseudomonas aeruginosa PA01
ggcgccggugca

SEQ ID NO: 1542073 - RNA, 18 nt, Pseudomonas aeruginosa PA01
ggcgccggugcaugaagg

SEQ ID NO: 1542074 - RNA, 21 nt, Pseudomonas aeruginosa PA01
ggcgccgguugcugcugggug

SEQ ID NO: 1542075 - RNA, 24 nt, Pseudomonas aeruginosa PA01
ggcgccguuguucaggcgcgcggu

SEQ ID NO: 1542076 - RNA, 20 nt, Pseudomonas aeruginosa PA01
ggcgccguggaucgcccggc

SEQ ID NO: 1542077 - RNA, 16 nt, Pseudomonas aeruginosa PA01
ggcgcgaggcgcccgc

SEQ ID NO: 1542078 - RNA, 18 nt, Pseudomonas aeruginosa PA01
ggcgcgaggcgcccgccg

SEQ ID NO: 1542079 - RNA, 16 nt, Pseudomonas aeruginosa PA01
ggcgcgacugucgagc

SEQ ID NO: 1542080 - RNA, 13 nt, Pseudomonas aeruginosa PA01
ggcgcgagaaaaa

SEQ ID NO: 1542081 - RNA, 17 nt, Pseudomonas aeruginosa PA01
ggcgcgagaagccagcc

SEQ ID NO: 1542082 - RNA, 21 nt, Pseudomonas aeruginosa PA01
ggcgcgaugccgaugccgccg

SEQ ID NO: 1542083 - RNA, 16 nt, Pseudomonas aeruginosa PA01
ggcgcgaucggggcag

SEQ ID NO: 1542084 - RNA, 16 nt, Pseudomonas aeruginosa PA01
ggcgcgcagggccagc

SEQ ID NO: 1542085 - RNA, 15 nt, Pseudomonas aeruginosa PA01
ggcgcgcagggccgc

SEQ ID NO: 1542086 - RNA, 19 nt, Pseudomonas aeruginosa PA01
ggcgcgcagggccgcggcg

SEQ ID NO: 1542087 - RNA, 17 nt, Pseudomonas aeruginosa PA01
ggcgcgcacuuccucgg

SEQ ID NO: 1542088 - RNA, 18 nt, Pseudomonas aeruginosa PA01
ggcgcgcacuuccucggc

SEQ ID NO: 1542089 - RNA, 22 nt, Pseudomonas aeruginosa PA01
ggcgcgcacuuccucggcgacc

SEQ ID NO: 1542090 - RNA, 18 nt, Pseudomonas aeruginosa PA01
ggcgcgcaaaaaaagggg

SEQ ID NO: 1542091 - RNA, 18 nt, Pseudomonas aeruginosa PA01
ggcgcgcaccagcggguc

SEQ ID NO: 1542092 - RNA, 21 nt, Pseudomonas aeruginosa PA01
ggcgcgcaccagcgggucguc

SEQ ID NO: 1542093 - RNA, 14 nt, Pseudomonas aeruginosa PA01
ggcgcgcaccugcg

SEQ ID NO: 1542094 - RNA, 17 nt, Pseudomonas aeruginosa PA01
ggcgcgcacggaggcgc

SEQ ID NO: 1542095 - RNA, 18 nt, Pseudomonas aeruginosa PA01
ggcgcgaccgucggccgg

SEQ ID NO: 1542096 - RNA, 19 nt, Pseudomonas aeruginosa PA01
ggcgcgaaccagcagcagg

SEQ ID NO: 1542097 - RNA, 21 nt, Pseudomonas aeruginosa PA01
ggcgccugcugcgcggguguc

SEQ ID NO: 1542098 - RNA, 22 nt, Pseudomonas aeruginosa PA01
ggcgccuucagcgccgccaggc

SEQ ID NO: 1542099 - RNA, 21 nt, Pseudomonas aeruginosa PA01
ggcgccucgcaaaggucggcg

SEQ ID NO: 1542100 - RNA, 16 nt, Pseudomonas aeruginosa PA01
ggcgccauccuccagc

SEQ ID NO: 1542101 - RNA, 23 nt, Pseudomonas aeruginosa PA01
ggcgccaucgaucagcagcgcca

SEQ ID NO: 1542102 - RNA, 23 nt, Pseudomonas aeruginosa PA01
ggcgccauaccggcaaggcggcc

SEQ ID NO: 1542103 - RNA, 17 nt, Pseudomonas aeruginosa PA01
ggcgcccacaaccugcc

SEQ ID NO: 1542104 - RNA, 13 nt, Pseudomonas aeruginosa PA01
ggcgccagccgcc

SEQ ID NO: 1542105 - RNA, 14 nt, Pseudomonas aeruginosa PA01
ggcgccagcgguuc

SEQ ID NO: 1542106 - RNA, 18 nt, Pseudomonas aeruginosa PA01
ggcgccagcuccagcgcc

SEQ ID NO: 1542107 - RNA, 21 nt, Pseudomonas aeruginosa PA01
ggcgccagcucggacaagggc

SEQ ID NO: 1542108 - RNA, 11 nt, Pseudomonas aeruginosa PA01
ggcgccaggcc

SEQ ID NO: 1542109 - RNA, 16 nt, Pseudomonas aeruginosa PA01
ggcgccaggccggagc

SEQ ID NO: 1542110 - RNA, 15 nt, Pseudomonas aeruginosa PA01
ggcgccaggccggcg

SEQ ID NO: 1542111 - RNA, 15 nt, Pseudomonas aeruginosa PA01
ggcgccagggccggg

SEQ ID NO: 1542112 - RNA, 13 nt, Pseudomonas aeruginosa PA01
ggcgccagagcgc

SEQ ID NO: 1542113 - RNA, 18 nt, Pseudomonas aeruginosa PA01
ggcgcccgccaaggcccu

SEQ ID NO: 1542114 - RNA, 19 nt, Pseudomonas aeruginosa PA01
ggcgcccgccaaggcccug

SEQ ID NO: 1542115 - RNA, 14 nt, Pseudomonas aeruginosa PA01
ggcgcccgagggcg

SEQ ID NO: 1542116 - RNA, 17 nt, Pseudomonas aeruginosa PA01
ggcgcccgccugcagga

SEQ ID NO: 1542117 - RNA, 13 nt, Pseudomonas aeruginosa PA01
ggcgcccggccgg

SEQ ID NO: 1542118 - RNA, 18 nt, Pseudomonas aeruginosa PA01
ggcgcccagcaccacagc

SEQ ID NO: 1542119 - RNA, 17 nt, Pseudomonas aeruginosa PA01
ggcgcccacuccaacca

SEQ ID NO: 1542120 - RNA, 15 nt, Pseudomonas aeruginosa PA01
ggcgcccagaaaaaa

SEQ ID NO: 1542121 - RNA, 19 nt, Pseudomonas aeruginosa PA01
ggcgcccagaaaaaagccc

SEQ ID NO: 1542122 - RNA, 14 nt, Pseudomonas aeruginosa PA01
ggcgcccaggcagc

SEQ ID NO: 1542123 - RNA, 15 nt, Pseudomonas aeruginosa PA01
ggcgcccaggcagca

SEQ ID NO: 1542124 - RNA, 18 nt, Pseudomonas aeruginosa PA01
ggcgcccaggcagcagag

SEQ ID NO: 1542125 - RNA, 15 nt, Pseudomonas aeruginosa PA01
ggcgcccagggcuuc

SEQ ID NO: 1542126 - RNA, 21 nt, Pseudomonas aeruginosa PA01
ggcgccccagaucgccagcgc

SEQ ID NO: 1542127 - RNA, 19 nt, Pseudomonas aeruginosa PA01
ggcgccccaggcgcccagg

SEQ ID NO: 1542128 - RNA, 20 nt, Pseudomonas aeruginosa PA01
ggcgccccggcccagccgcg

SEQ ID NO: 1542129 - RNA, 14 nt, Pseudomonas aeruginosa PA01
ggcgcccggucagg

SEQ ID NO: 1542130 - RNA, 18 nt, Pseudomonas aeruginosa PA01
ggcgcccggucagguugg

SEQ ID NO: 1542131 - RNA, 15 nt, Pseudomonas aeruginosa PA01
ggcgcccugccgggc

SEQ ID NO: 1542132 - RNA, 22 nt, Pseudomonas aeruginosa PA01
ggcgcccuggccgucggccugc

SEQ ID NO: 1542133 - RNA, 15 nt, Pseudomonas aeruginosa PA01
ggcgcccugggcgcg

SEQ ID NO: 1542134 - RNA, 23 nt, Pseudomonas aeruginosa PA01
ggcgccgaaaaaaaggggcccga

SEQ ID NO: 1542135 - RNA, 17 nt, Pseudomonas aeruginosa PA01
ggcgcccuugacccggu

SEQ ID NO: 1542136 - RNA, 23 nt, Pseudomonas aeruginosa PA01
ggcgcccuugacguucaggcugu

SEQ ID NO: 1542137 - RNA, 15 nt, Pseudomonas aeruginosa PA01
ggcgccgaggcccua

SEQ ID NO: 1542138 - RNA, 21 nt, Pseudomonas aeruginosa PA01
ggcgccgaccgcaccgccagc

SEQ ID NO: 1542139 - RNA, 23 nt, Pseudomonas aeruginosa PA01
ggcgccgaccgcaccgccagcgu

SEQ ID NO: 1542140 - RNA, 15 nt, Pseudomonas aeruginosa PA01
ggcgccgaugcccag

SEQ ID NO: 1542141 - RNA, 17 nt, Pseudomonas aeruginosa PA01
ggcgccgaugcccaggc

SEQ ID NO: 1542142 - RNA, 13 nt, Pseudomonas aeruginosa PA01
ggcgccgcgcauc

SEQ ID NO: 1542143 - RNA, 18 nt, Pseudomonas aeruginosa PA01
ggcgccgcgcauccucgg

SEQ ID NO: 1542144 - RNA, 16 nt, Pseudomonas aeruginosa PA01
ggcgccgcgcggcgcc

SEQ ID NO: 1542145 - RNA, 21 nt, Pseudomonas aeruginosa PA01
ggcgccgcgccuucugcaccu

SEQ ID NO: 1542146 - RNA, 12 nt, Pseudomonas aeruginosa PA01
ggcgccgccagc

SEQ ID NO: 1542147 - RNA, 16 nt, Pseudomonas aeruginosa PA01
ggcgccgccagccaga

SEQ ID NO: 1542148 - RNA, 15 nt, Pseudomonas aeruginosa PA01
ggcgccgcagggccc

SEQ ID NO: 1542149 - RNA, 19 nt, Pseudomonas aeruginosa PA01
ggcgccgccgacgccaugg

SEQ ID NO: 1542150 - RNA, 21 nt, Pseudomonas aeruginosa PA01
ggcgccgccgacgccaugggu

SEQ ID NO: 1542151 - RNA, 13 nt, Pseudomonas aeruginosa PA01
ggcgccgccggcg

SEQ ID NO: 1542152 - RNA, 24 nt, Pseudomonas aeruginosa PA01
ggcgccgccggugaacagguagcu

SEQ ID NO: 1542153 - RNA, 12 nt, Pseudomonas aeruginosa PA01
ggcgcaccagca

SEQ ID NO: 1542154 - RNA, 20 nt, Pseudomonas aeruginosa PA01
ggcgcaccaggccaggcugc

SEQ ID NO: 1542155 - RNA, 17 nt, Pseudomonas aeruginosa PA01
ggcgcaacgccggcagg

SEQ ID NO: 1542156 - RNA, 22 nt, Pseudomonas aeruginosa PA01
ggcgcaacagaucuuccucgga

SEQ ID NO: 1542157 - RNA, 14 nt, Pseudomonas aeruginosa PA01
ggcgcaacaggcgc

SEQ ID NO: 1542158 - RNA, 21 nt, Pseudomonas aeruginosa PA01
ggcgcaacaggcgcaugccau

SEQ ID NO: 1542159 - RNA, 15 nt, Pseudomonas aeruginosa PA01
ggcgcaaggccagcg

SEQ ID NO: 1542160 - RNA, 18 nt, Pseudomonas aeruginosa PA01
ggcgcaagggcgccgccg

SEQ ID NO: 1542161 - RNA, 17 nt, Pseudomonas aeruginosa PA01
ggcgcaaucagggcugg

SEQ ID NO: 1542162 - RNA, 16 nt, Pseudomonas aeruginosa PA01
ggcgcagccgcugcug

SEQ ID NO: 1542163 - RNA, 21 nt, Pseudomonas aeruginosa PA01
ggcgcagccucgcgcucggcg

SEQ ID NO: 1542164 - RNA, 16 nt, Pseudomonas aeruginosa PA01
ggcgcagcagcgacuc

SEQ ID NO: 1542165 - RNA, 21 nt, Pseudomonas aeruginosa PA01
ggcgcagcagcgacucgcugg

SEQ ID NO: 1542166 - RNA, 15 nt, Pseudomonas aeruginosa PA01
ggcgcagcagggcgu

SEQ ID NO: 1542167 - RNA, 20 nt, Pseudomonas aeruginosa PA01
ggcgcagcagggcgucggcg

SEQ ID NO: 1542168 - RNA, 15 nt, Pseudomonas aeruginosa PA01
ggcgcagccagagcu

SEQ ID NO: 1542169 - RNA, 14 nt, Pseudomonas aeruginosa PA01
ggcgcagccaggcg

SEQ ID NO: 1542170 - RNA, 13 nt, Pseudomonas aeruginosa PA01
ggcgcagcccagc

SEQ ID NO: 1542171 - RNA, 17 nt, Pseudomonas aeruginosa PA01
ggcgcagcccagccgcu

SEQ ID NO: 1542172 - RNA, 21 nt, Pseudomonas aeruginosa PA01
ggcgcagcccagccgcucgcg

SEQ ID NO: 1542173 - RNA, 22 nt, Pseudomonas aeruginosa PA01
ggcgcagccgcaaggccagggc

SEQ ID NO: 1542174 - RNA, 19 nt, Pseudomonas aeruginosa PA01
ggcgcacgccgcggaaggc

SEQ ID NO: 1542175 - RNA, 14 nt, Pseudomonas aeruginosa PA01
ggcgcacgccggcc

SEQ ID NO: 1542176 - RNA, 16 nt, Pseudomonas aeruginosa PA01
ggcgcacgccggccuc

SEQ ID NO: 1542177 - RNA, 14 nt, Pseudomonas aeruginosa PA01
ggcgcacgcgcagu

SEQ ID NO: 1542178 - RNA, 17 nt, Pseudomonas aeruginosa PA01
ggcgcacugccaggagc

SEQ ID NO: 1542179 - RNA, 23 nt, Pseudomonas aeruginosa PA01
ggcgcacugccaggagcacgccg

SEQ ID NO: 1542180 - RNA, 23 nt, Pseudomonas aeruginosa PA01
ggcgcacugagggucagccgcag

SEQ ID NO: 1542181 - RNA, 16 nt, Pseudomonas aeruginosa PA01
ggcgcagaucgcggcg

SEQ ID NO: 1542182 - RNA, 21 nt, Pseudomonas aeruginosa PA01
ggcgcagaucgcggcgcaggc

SEQ ID NO: 1542183 - RNA, 17 nt, Pseudomonas aeruginosa PA01
ggcgcagacaggccucc

SEQ ID NO: 1542184 - RNA, 16 nt, Pseudomonas aeruginosa PA01
ggcgcaggucggccuc

SEQ ID NO: 1542185 - RNA, 23 nt, Pseudomonas aeruginosa PA01
ggcgcaggucggccucggcgagg

SEQ ID NO: 1542186 - RNA, 15 nt, Pseudomonas aeruginosa PA01
ggcgcagcggcagcg

SEQ ID NO: 1542187 - RNA, 16 nt, Pseudomonas aeruginosa PA01
ggcgcagggagaacgc

SEQ ID NO: 1542188 - RNA, 15 nt, Pseudomonas aeruginosa PA01
ggcgcagcguccugc

SEQ ID NO: 1542189 - RNA, 15 nt, Pseudomonas aeruginosa PA01
ggcgcaggaccgcca

SEQ ID NO: 1542190 - RNA, 12 nt, Pseudomonas aeruginosa PA01
ggcgcaggcugu

SEQ ID NO: 1542191 - RNA, 19 nt, Pseudomonas aeruginosa PA01
ggcgcaggcugucggccag

SEQ ID NO: 1542192 - RNA, 21 nt, Pseudomonas aeruginosa PA01
ggcgcaggcugucggccagcc

SEQ ID NO: 1542193 - RNA, 22 nt, Pseudomonas aeruginosa PA01
ggcgcaggcuuggucagggucg

SEQ ID NO: 1542194 - RNA, 19 nt, Pseudomonas aeruginosa PA01
ggcgcaggccgggcggacg

SEQ ID NO: 1542195 - RNA, 21 nt, Pseudomonas aeruginosa PA01
ggcgcaggcgaacugccgacg

SEQ ID NO: 1542196 - RNA, 15 nt, Pseudomonas aeruginosa PA01
ggcgcauccgcccga

SEQ ID NO: 1542197 - RNA, 14 nt, Pseudomonas aeruginosa PA01
ggcgcaucagcgcc

SEQ ID NO: 1542198 - RNA, 14 nt, Pseudomonas aeruginosa PA01
ggcgcauagcggcc

SEQ ID NO: 1542199 - RNA, 18 nt, Pseudomonas aeruginosa PA01
ggcgcauaaccgcucgcg

SEQ ID NO: 1542200 - RNA, 17 nt, Pseudomonas aeruginosa PA01
ggcgcauagccaccgcc

SEQ ID NO: 1542201 - RNA, 18 nt, Pseudomonas aeruginosa PA01
ggcgccaacugcuugccg

SEQ ID NO: 1542202 - RNA, 15 nt, Pseudomonas aeruginosa PA01
ggcgcauguccagcc

SEQ ID NO: 1542203 - RNA, 15 nt, Pseudomonas aeruginosa PA01
ggcgcaugcccaggg

SEQ ID NO: 1542204 - RNA, 20 nt, Pseudomonas aeruginosa PA01
ggcgcaugcccagggccagc

SEQ ID NO: 1542205 - RNA, 21 nt, Pseudomonas aeruginosa PA01
ggcgcaugcccagggccagca

SEQ ID NO: 1542206 - RNA, 18 nt, Pseudomonas aeruginosa PA01
ggcgauaucccgccgccg

SEQ ID NO: 1542207 - RNA, 23 nt, Pseudomonas aeruginosa PA01
ggcgaucacgccgcgcaccagca

SEQ ID NO: 1542208 - RNA, 16 nt, Pseudomonas aeruginosa PA01
ggcgaucacggcgccc

SEQ ID NO: 1542209 - RNA, 21 nt, Pseudomonas aeruginosa PA01
ggcgaucagcucgcgguaggc

SEQ ID NO: 1542210 - RNA, 17 nt, Pseudomonas aeruginosa PA01
ggcgaucuccgggagca

SEQ ID NO: 1542211 - RNA, 21 nt, Pseudomonas aeruginosa PA01
ggcgaucgccaggcgauccag

SEQ ID NO: 1542212 - RNA, 22 nt, Pseudomonas aeruginosa PA01
ggcgaucgccagguggaagcgc

SEQ ID NO: 1542213 - RNA, 13 nt, Pseudomonas aeruginosa PA01
ggcgauccgcgca

SEQ ID NO: 1542214 - RNA, 14 nt, Pseudomonas aeruginosa PA01
ggcgauccacagca

SEQ ID NO: 1542215 - RNA, 16 nt, Pseudomonas aeruginosa PA01
ggcgauccacagcagg

SEQ ID NO: 1542216 - RNA, 22 nt, Pseudomonas aeruginosa PA01
ggcgaucccguagaccggcucc

SEQ ID NO: 1542217 - RNA, 14 nt, Pseudomonas aeruginosa PA01
ggcgaucaggccaa

SEQ ID NO: 1542218 - RNA, 17 nt, Pseudomonas aeruginosa PA01
ggcgaucaggccaagcu

SEQ ID NO: 1542219 - RNA, 15 nt, Pseudomonas aeruginosa PA01
ggcgagucgaucagg

SEQ ID NO: 1542220 - RNA, 16 nt, Pseudomonas aeruginosa PA01
ggcgaggguggcgccc

SEQ ID NO: 1542221 - RNA, 13 nt, Pseudomonas aeruginosa PA01
ggcgagggcgcgc

SEQ ID NO: 1542222 - RNA, 16 nt, Pseudomonas aeruginosa PA01
ggcgagggcggcgacc

SEQ ID NO: 1542223 - RNA, 19 nt, Pseudomonas aeruginosa PA01
ggcgaguucggcgagcagg

SEQ ID NO: 1542224 - RNA, 16 nt, Pseudomonas aeruginosa PA01
ggcgaguugcgcgagg

SEQ ID NO: 1542225 - RNA, 16 nt, Pseudomonas aeruginosa PA01
ggcgaguuccauuugu

SEQ ID NO: 1542226 - RNA, 16 nt, Pseudomonas aeruginosa PA01
ggcgauggccgccagc

SEQ ID NO: 1542227 - RNA, 17 nt, Pseudomonas aeruginosa PA01
ggcgauggccgccagca

SEQ ID NO: 1542228 - RNA, 13 nt, Pseudomonas aeruginosa PA01
ggcgauggucagg

SEQ ID NO: 1542229 - RNA, 16 nt, Pseudomonas aeruginosa PA01
ggcgaugucgcgggca

SEQ ID NO: 1542230 - RNA, 16 nt, Pseudomonas aeruginosa PA01
ggcgaugucggccugc

SEQ ID NO: 1542231 - RNA, 22 nt, Pseudomonas aeruginosa PA01
ggcgauguagcugccggcgucg

SEQ ID NO: 1542232 - RNA, 18 nt, Pseudomonas aeruginosa PA01
ggcgauguucgcccccuu

SEQ ID NO: 1542233 - RNA, 21 nt, Pseudomonas aeruginosa PA01
ggcgauguugacgauggcgcc

SEQ ID NO: 1542234 - RNA, 23 nt, Pseudomonas aeruginosa PA01
ggcgcaaaauguauaggagccug

SEQ ID NO: 1542235 - RNA, 14 nt, Pseudomonas aeruginosa PA01
ggcgcaaccagacc

SEQ ID NO: 1542236 - RNA, 17 nt, Pseudomonas aeruginosa PA01
ggcgcaaccagaccagc

SEQ ID NO: 1542237 - RNA, 22 nt, Pseudomonas aeruginosa PA01
ggcgcaacccugcccagugggc

SEQ ID NO: 1542238 - RNA, 21 nt, Pseudomonas aeruginosa PA01
ggcgaugccgcgccaggcgca

SEQ ID NO: 1542239 - RNA, 13 nt, Pseudomonas aeruginosa PA01
ggcgaugccgacg

SEQ ID NO: 1542240 - RNA, 13 nt, Pseudomonas aeruginosa PA01
ggcgaugccgagg

SEQ ID NO: 1542241 - RNA, 16 nt, Pseudomonas aeruginosa PA01
ggcgaugccgaggagg

SEQ ID NO: 1542242 - RNA, 15 nt, Pseudomonas aeruginosa PA01
ggcgaugccgcccag

SEQ ID NO: 1542243 - RNA, 16 nt, Pseudomonas aeruginosa PA01
ggcgaugccgcccagc

SEQ ID NO: 1542244 - RNA, 14 nt, Pseudomonas aeruginosa PA01
ggcgauggccagcg

SEQ ID NO: 1542245 - RNA, 23 nt, Pseudomonas aeruginosa PA01
ggcgauggaugacccgcucgccg

SEQ ID NO: 1542246 - RNA, 13 nt, Pseudomonas aeruginosa PA01
ggcgauggcgcgc

SEQ ID NO: 1542247 - RNA, 16 nt, Pseudomonas aeruginosa PA01
ggcgauggcgcgcggg

SEQ ID NO: 1542248 - RNA, 16 nt, Pseudomonas aeruginosa PA01
ggcgaucugugcgagc

SEQ ID NO: 1542249 - RNA, 21 nt, Pseudomonas aeruginosa PA01
ggcgaugaccagcucggcggg

SEQ ID NO: 1542250 - RNA, 22 nt, Pseudomonas aeruginosa PA01
ggcgaugaccaggguggcggcg

SEQ ID NO: 1542251 - RNA, 18 nt, Pseudomonas aeruginosa PA01
ggccggaucggccuuggc

SEQ ID NO: 1542252 - RNA, 13 nt, Pseudomonas aeruginosa PA01
ggccggagccgcg

SEQ ID NO: 1542253 - RNA, 13 nt, Pseudomonas aeruginosa PA01
ggccggcagcucc

SEQ ID NO: 1542254 - RNA, 16 nt, Pseudomonas aeruginosa PA01
ggccggcagcuccggc

SEQ ID NO: 1542255 - RNA, 19 nt, Pseudomonas aeruginosa PA01
ggccggcagcuccggcggg

SEQ ID NO: 1542256 - RNA, 17 nt, Pseudomonas aeruginosa PA01
ggccggcagcagcgcca

SEQ ID NO: 1542257 - RNA, 14 nt, Pseudomonas aeruginosa PA01
ggccggcaggcugu

SEQ ID NO: 1542258 - RNA, 12 nt, Pseudomonas aeruginosa PA01
ggccggcacccu

SEQ ID NO: 1542259 - RNA, 15 nt, Pseudomonas aeruginosa PA01
ggccggcgccagcag

SEQ ID NO: 1542260 - RNA, 17 nt, Pseudomonas aeruginosa PA01
ggccggcgccagcaggc

SEQ ID NO: 1542261 - RNA, 17 nt, Pseudomonas aeruginosa PA01
ggccggcgauggcccag

SEQ ID NO: 1542262 - RNA, 16 nt, Pseudomonas aeruginosa PA01
ggccggccuccagcgc

SEQ ID NO: 1542263 - RNA, 18 nt, Pseudomonas aeruginosa PA01
ggccggccuccagcgccu

SEQ ID NO: 1542264 - RNA, 23 nt, Pseudomonas aeruginosa PA01
ggccggccuccagcgccucgccg

SEQ ID NO: 1542265 - RNA, 13 nt, Pseudomonas aeruginosa PA01
ggccggcgagggc

SEQ ID NO: 1542266 - RNA, 19 nt, Pseudomonas aeruginosa PA01
ggccggccagggagcgcga

SEQ ID NO: 1542267 - RNA, 17 nt, Pseudomonas aeruginosa PA01
ggccggcagcgagcggg

SEQ ID NO: 1542268 - RNA, 23 nt, Pseudomonas aeruginosa PA01
ggccggcagcgagcgggucagca

SEQ ID NO: 1542269 - RNA, 18 nt, Pseudomonas aeruginosa PA01
ggccggcaugcucagccg

SEQ ID NO: 1542270 - RNA, 15 nt, Pseudomonas aeruginosa PA01
ggccgcucgagggcg

SEQ ID NO: 1542271 - RNA, 18 nt, Pseudomonas aeruginosa PA01
ggccgcucggccuugagc

SEQ ID NO: 1542272 - RNA, 14 nt, Pseudomonas aeruginosa PA01
ggccgcugccgccg

SEQ ID NO: 1542273 - RNA, 20 nt, Pseudomonas aeruginosa PA01
ggccgcugccgcucuggcug

SEQ ID NO: 1542274 - RNA, 21 nt, Pseudomonas aeruginosa PA01
ggccgcugccguugcaggccc

SEQ ID NO: 1542275 - RNA, 13 nt, Pseudomonas aeruginosa PA01
ggccgcugccugu

SEQ ID NO: 1542276 - RNA, 21 nt, Pseudomonas aeruginosa PA01
ggccgcugccugucgcagcgg

SEQ ID NO: 1542277 - RNA, 14 nt, Pseudomonas aeruginosa PA01
ggccgcucaccgcc

SEQ ID NO: 1542278 - RNA, 17 nt, Pseudomonas aeruginosa PA01
ggccgcuacgcggcggg

SEQ ID NO: 1542279 - RNA, 18 nt, Pseudomonas aeruginosa PA01
ggccgcuacgcggcggga

SEQ ID NO: 1542280 - RNA, 18 nt, Pseudomonas aeruginosa PA01
ggccgcuugaagcggcca

SEQ ID NO: 1542281 - RNA, 17 nt, Pseudomonas aeruginosa PA01
ggccgcuuacgcggccu

SEQ ID NO: 1542282 - RNA, 18 nt, Pseudomonas aeruginosa PA01
ggccgcuuacgcggccuu

SEQ ID NO: 1542283 - RNA, 17 nt, Pseudomonas aeruginosa PA01
ggccgcuucaagcggcc

SEQ ID NO: 1542284 - RNA, 23 nt, Pseudomonas aeruginosa PA01
ggccgcuuccggcccggccaggu

SEQ ID NO: 1542285 - RNA, 17 nt, Pseudomonas aeruginosa PA01
ggccgcuucgccgcccu

SEQ ID NO: 1542286 - RNA, 20 nt, Pseudomonas aeruginosa PA01
ggccgcuucgccgcccucgc

SEQ ID NO: 1542287 - RNA, 20 nt, Pseudomonas aeruginosa PA01
ggccgcggcuggcaggugcc

SEQ ID NO: 1542288 - RNA, 16 nt, Pseudomonas aeruginosa PA01
ggccgcggggaggaag

SEQ ID NO: 1542289 - RNA, 19 nt, Pseudomonas aeruginosa PA01
ggccgcggugggcuccagc

SEQ ID NO: 1542290 - RNA, 17 nt, Pseudomonas aeruginosa PA01
ggccgcguaagcggccu

SEQ ID NO: 1542291 - RNA, 18 nt, Pseudomonas aeruginosa PA01
ggccgcguaagcggccuu

SEQ ID NO: 1542292 - RNA, 17 nt, Pseudomonas aeruginosa PA01
ggccgcgucgcccaggc

SEQ ID NO: 1542293 - RNA, 21 nt, Pseudomonas aeruginosa PA01
ggccgcgucgcccaggccgcu

SEQ ID NO: 1542294 - RNA, 23 nt, Pseudomonas aeruginosa PA01
ggccgcggcccugcgccgcagcg

SEQ ID NO: 1542295 - RNA, 19 nt, Pseudomonas aeruginosa PA01
ggccgcgcugucggccucg

SEQ ID NO: 1542296 - RNA, 15 nt, Pseudomonas aeruginosa PA01
ggccgucggccugcu

SEQ ID NO: 1542297 - RNA, 14 nt, Pseudomonas aeruginosa PA01
ggccgucgcgccgc

SEQ ID NO: 1542298 - RNA, 15 nt, Pseudomonas aeruginosa PA01
ggccguccaggcugc

SEQ ID NO: 1542299 - RNA, 19 nt, Pseudomonas aeruginosa PA01
ggccguccuugaguagcug

SEQ ID NO: 1542300 - RNA, 21 nt, Pseudomonas aeruginosa PA01
ggccgucccugaccagcaggg

SEQ ID NO: 1542301 - RNA, 15 nt, Pseudomonas aeruginosa PA01
ggccgucacggccuc

SEQ ID NO: 1542302 - RNA, 18 nt, Pseudomonas aeruginosa PA01
ggccguagaccaccagca

SEQ ID NO: 1542303 - RNA, 21 nt, Pseudomonas aeruginosa PA01
ggccguagaccaccagcagca

SEQ ID NO: 1542304 - RNA, 18 nt, Pseudomonas aeruginosa PA01
ggccguagccggugccga

SEQ ID NO: 1542305 - RNA, 23 nt, Pseudomonas aeruginosa PA01
ggccguagccgucgaacagcagc

SEQ ID NO: 1542306 - RNA, 17 nt, Pseudomonas aeruginosa PA01
ggccgguagucggggca

SEQ ID NO: 1542307 - RNA, 15 nt, Pseudomonas aeruginosa PA01
ggccggugccgcccu

SEQ ID NO: 1542308 - RNA, 17 nt, Pseudomonas aeruginosa PA01
ggccggugccgcccugg

SEQ ID NO: 1542309 - RNA, 15 nt, Pseudomonas aeruginosa PA01
ggccggugccgccgg

SEQ ID NO: 1542310 - RNA, 20 nt, Pseudomonas aeruginosa PA01
ggccggugccuucggcggcg

SEQ ID NO: 1542311 - RNA, 20 nt, Pseudomonas aeruginosa PA01
ggccggugccauacagcgcc

SEQ ID NO: 1542312 - RNA, 21 nt, Pseudomonas aeruginosa PA01
ggccggugccauacagcgccc

SEQ ID NO: 1542313 - RNA, 23 nt, Pseudomonas aeruginosa PA01
ggccgguuuuuuauugccagcga

SEQ ID NO: 1542314 - RNA, 16 nt, Pseudomonas aeruginosa PA01
ggccggcgcggcgcgu

SEQ ID NO: 1542315 - RNA, 11 nt, Pseudomonas aeruginosa PA01
ggccggcggcc

SEQ ID NO: 1542316 - RNA, 22 nt, Pseudomonas aeruginosa PA01
ggccggcggccugagccggccg

SEQ ID NO: 1542317 - RNA, 20 nt, Pseudomonas aeruginosa PA01
ggccggcguacuucggcgcg

SEQ ID NO: 1542318 - RNA, 22 nt, Pseudomonas aeruginosa PA01
ggccggcguaugguggaggaag

SEQ ID NO: 1542319 - RNA, 15 nt, Pseudomonas aeruginosa PA01
ggccggcucagcgcu

SEQ ID NO: 1542320 - RNA, 20 nt, Pseudomonas aeruginosa PA01
ggccgggcaggccgaggccg

SEQ ID NO: 1542321 - RNA, 15 nt, Pseudomonas aeruginosa PA01
ggccgggagcuacag

SEQ ID NO: 1542322 - RNA, 18 nt, Pseudomonas aeruginosa PA01
ggccgggauacagcagcc

SEQ ID NO: 1542323 - RNA, 14 nt, Pseudomonas aeruginosa PA01
ggccgggcuggcca

SEQ ID NO: 1542324 - RNA, 14 nt, Pseudomonas aeruginosa PA01
ggccgggggcggcg

SEQ ID NO: 1542325 - RNA, 14 nt, Pseudomonas aeruginosa PA01
ggccgggcccuggg

SEQ ID NO: 1542326 - RNA, 21 nt, Pseudomonas aeruginosa PA01
ggccgggcggacgcugggcug

SEQ ID NO: 1542327 - RNA, 18 nt, Pseudomonas aeruginosa PA01
ggccgggguauccgggca

SEQ ID NO: 1542328 - RNA, 20 nt, Pseudomonas aeruginosa PA01
ggccggggucaggccgaggc

SEQ ID NO: 1542329 - RNA, 22 nt, Pseudomonas aeruginosa PA01
ggccggguugcgccuccgggcg

SEQ ID NO: 1542330 - RNA, 21 nt, Pseudomonas aeruginosa PA01
ggccgccagcaggccgaaggc

SEQ ID NO: 1542331 - RNA, 21 nt, Pseudomonas aeruginosa PA01
ggccgccgaaaugcugcaggc

SEQ ID NO: 1542332 - RNA, 15 nt, Pseudomonas aeruginosa PA01
ggccgccgaucccga

SEQ ID NO: 1542333 - RNA, 17 nt, Pseudomonas aeruginosa PA01
ggccgccgccgacaggu

SEQ ID NO: 1542334 - RNA, 14 nt, Pseudomonas aeruginosa PA01
ggccgccgccgccg

SEQ ID NO: 1542335 - RNA, 17 nt, Pseudomonas aeruginosa PA01
ggccgagcaccggcagg

SEQ ID NO: 1542336 - RNA, 14 nt, Pseudomonas aeruginosa PA01
ggccgagcaggaag

SEQ ID NO: 1542337 - RNA, 20 nt, Pseudomonas aeruginosa PA01
ggccgagcccagcggcaggg

SEQ ID NO: 1542338 - RNA, 11 nt, Pseudomonas aeruginosa PA01
ggccgcagggg

SEQ ID NO: 1542339 - RNA, 21 nt, Pseudomonas aeruginosa PA01
ggccgagcaggcgcgccaggc

SEQ ID NO: 1542340 - RNA, 12 nt, Pseudomonas aeruginosa PA01
ggccgacgcgcu

SEQ ID NO: 1542341 - RNA, 15 nt, Pseudomonas aeruginosa PA01
ggccgacggcccucc

SEQ ID NO: 1542342 - RNA, 13 nt, Pseudomonas aeruginosa PA01
ggccgacggcgcg

SEQ ID NO: 1542343 - RNA, 13 nt, Pseudomonas aeruginosa PA01
ggccgacgcuucc

SEQ ID NO: 1542344 - RNA, 17 nt, Pseudomonas aeruginosa PA01
ggccgacguccaucagc

SEQ ID NO: 1542345 - RNA, 13 nt, Pseudomonas aeruginosa PA01
ggccgacgccgcu

SEQ ID NO: 1542346 - RNA, 14 nt, Pseudomonas aeruginosa PA01
ggccgaccugcccg

SEQ ID NO: 1542347 - RNA, 13 nt, Pseudomonas aeruginosa PA01
ggccgcgcagcaa

SEQ ID NO: 1542348 - RNA, 14 nt, Pseudomonas aeruginosa PA01
ggccgcgcaggaag

SEQ ID NO: 1542349 - RNA, 16 nt, Pseudomonas aeruginosa PA01
ggccgcgagcgcggcc

SEQ ID NO: 1542350 - RNA, 17 nt, Pseudomonas aeruginosa PA01
ggccgcgccgacccaga

SEQ ID NO: 1542351 - RNA, 21 nt, Pseudomonas aeruginosa PA01
ggccgcgccgacccagagcgc

SEQ ID NO: 1542352 - RNA, 14 nt, Pseudomonas aeruginosa PA01
ggccgcgccgagcc

SEQ ID NO: 1542353 - RNA, 17 nt, Pseudomonas aeruginosa PA01
ggccgcgccgcccuggc

SEQ ID NO: 1542354 - RNA, 16 nt, Pseudomonas aeruginosa PA01
ggccgcgccccacggc

SEQ ID NO: 1542355 - RNA, 23 nt, Pseudomonas aeruginosa PA01
ggccgcgccuuucgcucaggccu

SEQ ID NO: 1542356 - RNA, 15 nt, Pseudomonas aeruginosa PA01
ggccgcgccggcucc

SEQ ID NO: 1542357 - RNA, 15 nt, Pseudomonas aeruginosa PA01
ggccgcgcuccaaca

SEQ ID NO: 1542358 - RNA, 18 nt, Pseudomonas aeruginosa PA01
ggccgcgcuccaacaggc

SEQ ID NO: 1542359 - RNA, 14 nt, Pseudomonas aeruginosa PA01
ggccgccugcucgg

SEQ ID NO: 1542360 - RNA, 19 nt, Pseudomonas aeruginosa PA01
ggccgccugcucggccugc

SEQ ID NO: 1542361 - RNA, 20 nt, Pseudomonas aeruginosa PA01
ggccgccugcucggccugcu

SEQ ID NO: 1542362 - RNA, 18 nt, Pseudomonas aeruginosa PA01
ggccgccuggucggggcc

SEQ ID NO: 1542363 - RNA, 19 nt, Pseudomonas aeruginosa PA01
ggccgccuggucggggccg

SEQ ID NO: 1542364 - RNA, 15 nt, Pseudomonas aeruginosa PA01
ggccgccuuccucgg

SEQ ID NO: 1542365 - RNA, 19 nt, Pseudomonas aeruginosa PA01
ggccgcgaaccgggucguc

SEQ ID NO: 1542366 - RNA, 12 nt, Pseudomonas aeruginosa PA01
ggccgccgcggg

SEQ ID NO: 1542367 - RNA, 15 nt, Pseudomonas aeruginosa PA01
ggccgccggcgacga

SEQ ID NO: 1542368 - RNA, 22 nt, Pseudomonas aeruginosa PA01
ggccgccguuguagcggauguc

SEQ ID NO: 1542369 - RNA, 15 nt, Pseudomonas aeruginosa PA01
ggccgccggcgcccu

SEQ ID NO: 1542370 - RNA, 22 nt, Pseudomonas aeruginosa PA01
ggcccggcgcgguuucgcagcg

SEQ ID NO: 1542371 - RNA, 22 nt, Pseudomonas aeruginosa PA01
ggcccggcgcggcggccgccuc

SEQ ID NO: 1542372 - RNA, 22 nt, Pseudomonas aeruginosa PA01
ggcccgcggaucgcgccgucgc

SEQ ID NO: 1542373 - RNA, 13 nt, Pseudomonas aeruginosa PA01
ggcccgggcgcca

SEQ ID NO: 1542374 - RNA, 19 nt, Pseudomonas aeruginosa PA01
ggcccgggcgccaccgcgu

SEQ ID NO: 1542375 - RNA, 20 nt, Pseudomonas aeruginosa PA01
ggcccgggcgccaccgcguu

SEQ ID NO: 1542376 - RNA, 18 nt, Pseudomonas aeruginosa PA01
ggcccggcuccagccggg

SEQ ID NO: 1542377 - RNA, 21 nt, Pseudomonas aeruginosa PA01
ggcccgccggucaaccgcggg

SEQ ID NO: 1542378 - RNA, 16 nt, Pseudomonas aeruginosa PA01
ggcccgccucggcggc

SEQ ID NO: 1542379 - RNA, 22 nt, Pseudomonas aeruginosa PA01
ggcccgcgagccgcgcagcagu

SEQ ID NO: 1542380 - RNA, 17 nt, Pseudomonas aeruginosa PA01
ggcccgccgccggggcg

SEQ ID NO: 1542381 - RNA, 20 nt, Pseudomonas aeruginosa PA01
ggcccgccgccggggcgggc

SEQ ID NO: 1542382 - RNA, 13 nt, Pseudomonas aeruginosa PA01
ggcccgccgcggc

SEQ ID NO: 1542383 - RNA, 15 nt, Pseudomonas aeruginosa PA01
ggcccgaaggccccu

SEQ ID NO: 1542384 - RNA, 16 nt, Pseudomonas aeruginosa PA01
ggcccgaaggccccuu

SEQ ID NO: 1542385 - RNA, 21 nt, Pseudomonas aeruginosa PA01
ggccccuucagcuccagcagu

SEQ ID NO: 1542386 - RNA, 22 nt, Pseudomonas aeruginosa PA01
ggccccuucagcuccagcaguc

SEQ ID NO: 1542387 - RNA, 21 nt, Pseudomonas aeruginosa PA01
ggcccgacccacuugaacacc

SEQ ID NO: 1542388 - RNA, 23 nt, Pseudomonas aeruginosa PA01
ggccccggugauguaggccgcuu

SEQ ID NO: 1542389 - RNA, 19 nt, Pseudomonas aeruginosa PA01
ggccgaccagcgccgacuu

SEQ ID NO: 1542390 - RNA, 12 nt, Pseudomonas aeruginosa PA01
ggccgaccaggu

SEQ ID NO: 1542391 - RNA, 16 nt, Pseudomonas aeruginosa PA01
ggccgacccgcagcgg

SEQ ID NO: 1542392 - RNA, 17 nt, Pseudomonas aeruginosa PA01
ggccgacccgcagcggc

SEQ ID NO: 1542393 - RNA, 18 nt, Pseudomonas aeruginosa PA01
ggccgacccgcagcggcg

SEQ ID NO: 1542394 - RNA, 19 nt, Pseudomonas aeruginosa PA01
ggccgacccgcagcggcgc

SEQ ID NO: 1542395 - RNA, 15 nt, Pseudomonas aeruginosa PA01
ggccgacccgcaggc

SEQ ID NO: 1542396 - RNA, 18 nt, Pseudomonas aeruginosa PA01
ggccgacccgcaggccgg

SEQ ID NO: 1542397 - RNA, 15 nt, Pseudomonas aeruginosa PA01
ggcccuuuuccucgg

SEQ ID NO: 1542398 - RNA, 19 nt, Pseudomonas aeruginosa PA01
ggccgaaagcacugcggcg

SEQ ID NO: 1542399 - RNA, 13 nt, Pseudomonas aeruginosa PA01
ggcccuggccuug

SEQ ID NO: 1542400 - RNA, 14 nt, Pseudomonas aeruginosa PA01
ggcccugggcggcg

SEQ ID NO: 1542401 - RNA, 16 nt, Pseudomonas aeruginosa PA01
ggcccugggcggcggg

SEQ ID NO: 1542402 - RNA, 18 nt, Pseudomonas aeruginosa PA01
ggcccugggcggcgggcc

SEQ ID NO: 1542403 - RNA, 15 nt, Pseudomonas aeruginosa PA01
ggcccuggcgcaggc

SEQ ID NO: 1542404 - RNA, 20 nt, Pseudomonas aeruginosa PA01
ggcccuggaucaccgcggcg

SEQ ID NO: 1542405 - RNA, 21 nt, Pseudomonas aeruginosa PA01
ggcccuguacauagcggguca

SEQ ID NO: 1542406 - RNA, 14 nt, Pseudomonas aeruginosa PA01
ggcccuuccacuuc

SEQ ID NO: 1542407 - RNA, 16 nt, Pseudomonas aeruginosa PA01
ggcccuucgcccugcg

SEQ ID NO: 1542408 - RNA, 19 nt, Pseudomonas aeruginosa PA01
ggcccuugaacaggcuggc

SEQ ID NO: 1542409 - RNA, 13 nt, Pseudomonas aeruginosa PA01
ggcccggucagcu

SEQ ID NO: 1542410 - RNA, 22 nt, Pseudomonas aeruginosa PA01
ggcccggucagcuucgccgccc

SEQ ID NO: 1542411 - RNA, 23 nt, Pseudomonas aeruginosa PA01
ggcccggucagcuucgccgcccu

SEQ ID NO: 1542412 - RNA, 19 nt, Pseudomonas aeruginosa PA01
ggcccggucuagccgggcc

SEQ ID NO: 1542413 - RNA, 14 nt, Pseudomonas aeruginosa PA01
ggcccguccgcgcc

SEQ ID NO: 1542414 - RNA, 19 nt, Pseudomonas aeruginosa PA01
ggcccgguuuuccgcuucc

SEQ ID NO: 1542415 - RNA, 20 nt, Pseudomonas aeruginosa PA01
ggcccguuccaccgccugga

SEQ ID NO: 1542416 - RNA, 16 nt, Pseudomonas aeruginosa PA01
ggccaagucggccgcc

SEQ ID NO: 1542417 - RNA, 21 nt, Pseudomonas aeruginosa PA01
ggccacgaacugcauggccuu

SEQ ID NO: 1542418 - RNA, 14 nt, Pseudomonas aeruginosa PA01
ggccacgacccugc

SEQ ID NO: 1542419 - RNA, 16 nt, Pseudomonas aeruginosa PA01
ggccacgacccugcug

SEQ ID NO: 1542420 - RNA, 19 nt, Pseudomonas aeruginosa PA01
ggccaccugcggguggccu

SEQ ID NO: 1542421 - RNA, 23 nt, Pseudomonas aeruginosa PA01
ggccaccgucggauggccgucca

SEQ ID NO: 1542422 - RNA, 11 nt, Pseudomonas aeruginosa PA01
ggccagcagca

SEQ ID NO: 1542423 - RNA, 16 nt, Pseudomonas aeruginosa PA01
ggccacguccagcggc

SEQ ID NO: 1542424 - RNA, 21 nt, Pseudomonas aeruginosa PA01
ggccagcagcaucggaccggu

SEQ ID NO: 1542425 - RNA, 15 nt, Pseudomonas aeruginosa PA01
ggccagcagcagaag

SEQ ID NO: 1542426 - RNA, 13 nt, Pseudomonas aeruginosa PA01
ggccagcagcacg

SEQ ID NO: 1542427 - RNA, 14 nt, Pseudomonas aeruginosa PA01
ggccagcccggagc

SEQ ID NO: 1542428 - RNA, 19 nt, Pseudomonas aeruginosa PA01
ggccagcccggccucgccg

SEQ ID NO: 1542429 - RNA, 13 nt, Pseudomonas aeruginosa PA01
ggccagcagcggc

SEQ ID NO: 1542430 - RNA, 17 nt, Pseudomonas aeruginosa PA01
ggccagcagcgccuccu

SEQ ID NO: 1542431 - RNA, 15 nt, Pseudomonas aeruginosa PA01
ggccagccgcgcggc

SEQ ID NO: 1542432 - RNA, 12 nt, Pseudomonas aeruginosa PA01
ggccagccgcgc

SEQ ID NO: 1542433 - RNA, 18 nt, Pseudomonas aeruginosa PA01
ggccagaauuccagcagg

SEQ ID NO: 1542434 - RNA, 13 nt, Pseudomonas aeruginosa PA01
ggccagccuuccu

SEQ ID NO: 1542435 - RNA, 12 nt, Pseudomonas aeruginosa PA01
ggccaucgcgga

SEQ ID NO: 1542436 - RNA, 19 nt, Pseudomonas aeruginosa PA01
ggccaucgccggcccgcgc

SEQ ID NO: 1542437 - RNA, 16 nt, Pseudomonas aeruginosa PA01
ggccaucuggcugccg

SEQ ID NO: 1542438 - RNA, 19 nt, Pseudomonas aeruginosa PA01
ggccaucagugccugcacg

SEQ ID NO: 1542439 - RNA, 22 nt, Pseudomonas aeruginosa PA01
ggccaguccggucagcagcagg

SEQ ID NO: 1542440 - RNA, 15 nt, Pseudomonas aeruginosa PA01
ggccagucaucgcgg

SEQ ID NO: 1542441 - RNA, 19 nt, Pseudomonas aeruginosa PA01
ggcccacagugccaggcuc

SEQ ID NO: 1542442 - RNA, 23 nt, Pseudomonas aeruginosa PA01
ggcccacagugccaggcucgccg

SEQ ID NO: 1542443 - RNA, 16 nt, Pseudomonas aeruginosa PA01
ggcccaauccgcgccg

SEQ ID NO: 1542444 - RNA, 22 nt, Pseudomonas aeruginosa PA01
ggcccaauccgcgccgguggcc

SEQ ID NO: 1542445 - RNA, 23 nt, Pseudomonas aeruginosa PA01
ggcccaacagcggugugcucagg

SEQ ID NO: 1542446 - RNA, 20 nt, Pseudomonas aeruginosa PA01
ggccaugaccucggccagcc

SEQ ID NO: 1542447 - RNA, 16 nt, Pseudomonas aeruginosa PA01
ggccaugaucuggcug

SEQ ID NO: 1542448 - RNA, 23 nt, Pseudomonas aeruginosa PA01
ggccaugaucuggcugucgccga

SEQ ID NO: 1542449 - RNA, 22 nt, Pseudomonas aeruginosa PA01
ggccauuuuucaugggcggggu

SEQ ID NO: 1542450 - RNA, 15 nt, Pseudomonas aeruginosa PA01
ggcccaagccgagcg

SEQ ID NO: 1542451 - RNA, 18 nt, Pseudomonas aeruginosa PA01
ggcccaagccgagcggca

SEQ ID NO: 1542452 - RNA, 13 nt, Pseudomonas aeruginosa PA01
ggccaggcgcugg

SEQ ID NO: 1542453 - RNA, 19 nt, Pseudomonas aeruginosa PA01
ggccaggcgcaccagcagg

SEQ ID NO: 1542454 - RNA, 15 nt, Pseudomonas aeruginosa PA01
ggccaggcgccaggg

SEQ ID NO: 1542455 - RNA, 20 nt, Pseudomonas aeruginosa PA01
ggccaggcgcuccuccagcg

SEQ ID NO: 1542456 - RNA, 14 nt, Pseudomonas aeruginosa PA01
ggccaggcgcggcg

SEQ ID NO: 1542457 - RNA, 16 nt, Pseudomonas aeruginosa PA01
ggccaggcgcggcgcc

SEQ ID NO: 1542458 - RNA, 11 nt, Pseudomonas aeruginosa PA01
ggccaggcgcu

SEQ ID NO: 1542459 - RNA, 17 nt, Pseudomonas aeruginosa PA01
ggccaggccgcccagga

SEQ ID NO: 1542460 - RNA, 14 nt, Pseudomonas aeruginosa PA01
ggccaggccgagca

SEQ ID NO: 1542461 - RNA, 18 nt, Pseudomonas aeruginosa PA01
ggccaggccgagcgcgcc

SEQ ID NO: 1542462 - RNA, 13 nt, Pseudomonas aeruginosa PA01
ggccaggcgguau

SEQ ID NO: 1542463 - RNA, 22 nt, Pseudomonas aeruginosa PA01
ggccagggaaaagcccaggugg

SEQ ID NO: 1542464 - RNA, 18 nt, Pseudomonas aeruginosa PA01
ggccagggaggcgcuggc

SEQ ID NO: 1542465 - RNA, 23 nt, Pseudomonas aeruginosa PA01
ggccagggaggcgcuggccagcg

SEQ ID NO: 1542466 - RNA, 11 nt, Pseudomonas aeruginosa PA01
ggccagggagu

SEQ ID NO: 1542467 - RNA, 23 nt, Pseudomonas aeruginosa PA01
ggccagggagucgcuggccaucu

SEQ ID NO: 1542468 - RNA, 21 nt, Pseudomonas aeruginosa PA01
ggccagcgucgccugccaggc

SEQ ID NO: 1542469 - RNA, 22 nt, Pseudomonas aeruginosa PA01
ggccagcuccagcaccggcggc

SEQ ID NO: 1542470 - RNA, 13 nt, Pseudomonas aeruginosa PA01
ggccagcucgccc

SEQ ID NO: 1542471 - RNA, 14 nt, Pseudomonas aeruginosa PA01
ggccagcuccgccu

SEQ ID NO: 1542472 - RNA, 18 nt, Pseudomonas aeruginosa PA01
ggccagcgugaagaccug

SEQ ID NO: 1542473 - RNA, 23 nt, Pseudomonas aeruginosa PA01
ggccagcggcauccgccgcuggg

SEQ ID NO: 1542474 - RNA, 18 nt, Pseudomonas aeruginosa PA01
ggccagcgcccaggccgg

SEQ ID NO: 1542475 - RNA, 20 nt, Pseudomonas aeruginosa PA01
ggccagcgcccaggccgggu

SEQ ID NO: 1542476 - RNA, 14 nt, Pseudomonas aeruginosa PA01
ggccagcgccgccg

SEQ ID NO: 1542477 - RNA, 19 nt, Pseudomonas aeruginosa PA01
ggccagcgccaccagcagg

SEQ ID NO: 1542478 - RNA, 20 nt, Pseudomonas aeruginosa PA01
ggccaaaccgggaaagucug

SEQ ID NO: 1542479 - RNA, 16 nt, Pseudomonas aeruginosa PA01
ggcauccgccgcuggg

SEQ ID NO: 1542480 - RNA, 18 nt, Pseudomonas aeruginosa PA01
ggcauccucgccccgccg

SEQ ID NO: 1542481 - RNA, 22 nt, Pseudomonas aeruginosa PA01
ggcauccucgccccgccgggag

SEQ ID NO: 1542482 - RNA, 14 nt, Pseudomonas aeruginosa PA01
ggcauccugccgcc

SEQ ID NO: 1542483 - RNA, 12 nt, Pseudomonas aeruginosa PA01
ggcaucgaccag

SEQ ID NO: 1542484 - RNA, 13 nt, Pseudomonas aeruginosa PA01
ggcaucgaccagc

SEQ ID NO: 1542485 - RNA, 14 nt, Pseudomonas aeruginosa PA01
ggcaucgaccagca

SEQ ID NO: 1542486 - RNA, 20 nt, Pseudomonas aeruginosa PA01
ggcaucgaccagggccgggu

SEQ ID NO: 1542487 - RNA, 23 nt, Pseudomonas aeruginosa PA01
ggcaucgacgauguacugcucgg

SEQ ID NO: 1542488 - RNA, 18 nt, Pseudomonas aeruginosa PA01
ggcaucgacgccagcggc

SEQ ID NO: 1542489 - RNA, 19 nt, Pseudomonas aeruginosa PA01
ggcauccuguggcugcagg

SEQ ID NO: 1542490 - RNA, 18 nt, Pseudomonas aeruginosa PA01
ggcaucgaacucacagau

SEQ ID NO: 1542491 - RNA, 23 nt, Pseudomonas aeruginosa PA01
ggcauuggugcugccgaugcuga

SEQ ID NO: 1542492 - RNA, 22 nt, Pseudomonas aeruginosa PA01
ggcauuggcacccuggacccgg

SEQ ID NO: 1542493 - RNA, 13 nt, Pseudomonas aeruginosa PA01
ggcauuccuccag

SEQ ID NO: 1542494 - RNA, 16 nt, Pseudomonas aeruginosa PA01
ggcauucucucuucag

SEQ ID NO: 1542495 - RNA, 21 nt, Pseudomonas aeruginosa PA01
ggcauucucucuucagcaggg

SEQ ID NO: 1542496 - RNA, 13 nt, Pseudomonas aeruginosa PA01
ggcauucguccag

SEQ ID NO: 1542497 - RNA, 15 nt, Pseudomonas aeruginosa PA01
ggcauucgucgccgc

SEQ ID NO: 1542498 - RNA, 20 nt, Pseudomonas aeruginosa PA01
ggcauucucgcgacccuggc

SEQ ID NO: 1542499 - RNA, 20 nt, Pseudomonas aeruginosa PA01
ggcaugaccgauggcgccgc

SEQ ID NO: 1542500 - RNA, 12 nt, Pseudomonas aeruginosa PA01
ggcagaacaucg

SEQ ID NO: 1542501 - RNA, 19 nt, Pseudomonas aeruginosa PA01
ggcagaacacccggguuuc

SEQ ID NO: 1542502 - RNA, 17 nt, Pseudomonas aeruginosa PA01
ggcagggaguccgccag

SEQ ID NO: 1542503 - RNA, 22 nt, Pseudomonas aeruginosa PA01
ggcagggaguccgccagccggc

SEQ ID NO: 1542504 - RNA, 24 nt, Pseudomonas aeruginosa PA01
ggcaggcuggcguugacugccugc

SEQ ID NO: 1542505 - RNA, 14 nt, Pseudomonas aeruginosa PA01
ggcaggcugugcca

SEQ ID NO: 1542506 - RNA, 19 nt, Pseudomonas aeruginosa PA01
ggcaggcugugccauuccu

SEQ ID NO: 1542507 - RNA, 17 nt, Pseudomonas aeruginosa PA01
ggcaggugacgcagggc

SEQ ID NO: 1542508 - RNA, 13 nt, Pseudomonas aeruginosa PA01
ggcagguggcggg

SEQ ID NO: 1542509 - RNA, 16 nt, Pseudomonas aeruginosa PA01
ggcagguggcuggcca

SEQ ID NO: 1542510 - RNA, 19 nt, Pseudomonas aeruginosa PA01
ggcaggugguaagcgagca

SEQ ID NO: 1542511 - RNA, 20 nt, Pseudomonas aeruginosa PA01
ggcagguugcgggagcacug

SEQ ID NO: 1542512 - RNA, 16 nt, Pseudomonas aeruginosa PA01
ggcagguugcucgccu

SEQ ID NO: 1542513 - RNA, 17 nt, Pseudomonas aeruginosa PA01
ggcagggugucgacgac

SEQ ID NO: 1542514 - RNA, 16 nt, Pseudomonas aeruginosa PA01
ggcagguaucgcuggg

SEQ ID NO: 1542515 - RNA, 14 nt, Pseudomonas aeruginosa PA01
ggcagggccucggg

SEQ ID NO: 1542516 - RNA, 14 nt, Pseudomonas aeruginosa PA01
ggcagggcgcccgc

SEQ ID NO: 1542517 - RNA, 12 nt, Pseudomonas aeruginosa PA01
ggcagggcgcgu

SEQ ID NO: 1542518 - RNA, 14 nt, Pseudomonas aeruginosa PA01
ggcagggcgcgucc

SEQ ID NO: 1542519 - RNA, 14 nt, Pseudomonas aeruginosa PA01
ggcaggggcuuucu

SEQ ID NO: 1542520 - RNA, 21 nt, Pseudomonas aeruginosa PA01
ggcagggggucuucgaagguc

SEQ ID NO: 1542521 - RNA, 15 nt, Pseudomonas aeruginosa PA01
ggcaguggcgccagc

SEQ ID NO: 1542522 - RNA, 19 nt, Pseudomonas aeruginosa PA01
ggcaguggcgccagccagc

SEQ ID NO: 1542523 - RNA, 15 nt, Pseudomonas aeruginosa PA01
ggcagguugugcggg

SEQ ID NO: 1542524 - RNA, 15 nt, Pseudomonas aeruginosa PA01
ggcagguugugguug

SEQ ID NO: 1542525 - RNA, 16 nt, Pseudomonas aeruginosa PA01
ggcagguugugguugg

SEQ ID NO: 1542526 - RNA, 21 nt, Pseudomonas aeruginosa PA01
ggcagguugugguugggcagg

SEQ ID NO: 1542527 - RNA, 15 nt, Pseudomonas aeruginosa PA01
ggcaucaaucgcugg

SEQ ID NO: 1542528 - RNA, 15 nt, Pseudomonas aeruginosa PA01
ggcaucccuuuuuca

SEQ ID NO: 1542529 - RNA, 23 nt, Pseudomonas aeruginosa PA01
ggcauccccuuuuuucagccugu

SEQ ID NO: 1542530 - RNA, 19 nt, Pseudomonas aeruginosa PA01
ggcauccccuuuuuuugcg

SEQ ID NO: 1542531 - RNA, 14 nt, Pseudomonas aeruginosa PA01
ggcaucccgcccgg

SEQ ID NO: 1542532 - RNA, 20 nt, Pseudomonas aeruginosa PA01
ggcauccaguuccugcacca

SEQ ID NO: 1542533 - RNA, 19 nt, Pseudomonas aeruginosa PA01
ggcaucaugccgagcauca

SEQ ID NO: 1542534 - RNA, 14 nt, Pseudomonas aeruginosa PA01
ggacagcagggucg

SEQ ID NO: 1542535 - RNA, 16 nt, Pseudomonas aeruginosa PA01
ggacagcuucugguug

SEQ ID NO: 1542536 - RNA, 19 nt, Pseudomonas aeruginosa PA01
ggacagcuuggccagcagg

SEQ ID NO: 1542537 - RNA, 22 nt, Pseudomonas aeruginosa PA01
ggacagcuuggccagcaggccg

SEQ ID NO: 1542538 - RNA, 22 nt, Pseudomonas aeruginosa PA01
ggacagcgucugggugaccagc

SEQ ID NO: 1542539 - RNA, 20 nt, Pseudomonas aeruginosa PA01
ggacagcccgcgcucggccg

SEQ ID NO: 1542540 - RNA, 16 nt, Pseudomonas aeruginosa PA01
ggacaagggccagagc

SEQ ID NO: 1542541 - RNA, 14 nt, Pseudomonas aeruginosa PA01
ggacaagcccagcu

SEQ ID NO: 1542542 - RNA, 13 nt, Pseudomonas aeruginosa PA01
ggaccagggcggg

SEQ ID NO: 1542543 - RNA, 20 nt, Pseudomonas aeruginosa PA01
ggaccaucaccaccucgugc

SEQ ID NO: 1542544 - RNA, 19 nt, Pseudomonas aeruginosa PA01
ggaccagaggcugacccgc

SEQ ID NO: 1542545 - RNA, 12 nt, Pseudomonas aeruginosa PA01
ggaccuccagcc

SEQ ID NO: 1542546 - RNA, 11 nt, Pseudomonas aeruginosa PA01
ggaccuguccc

SEQ ID NO: 1542547 - RNA, 21 nt, Pseudomonas aeruginosa PA01
ggaccuggccgcguucgccga

SEQ ID NO: 1542548 - RNA, 16 nt, Pseudomonas aeruginosa PA01
ggaccugcugcccggc

SEQ ID NO: 1542549 - RNA, 17 nt, Pseudomonas aeruginosa PA01
ggaccugcugcccggca

SEQ ID NO: 1542550 - RNA, 22 nt, Pseudomonas aeruginosa PA01
ggaccucgggcgagaaucgccg

SEQ ID NO: 1542551 - RNA, 12 nt, Pseudomonas aeruginosa PA01
ggaccuccugca

SEQ ID NO: 1542552 - RNA, 21 nt, Pseudomonas aeruginosa PA01
ggacgaacgagaagccgauca

SEQ ID NO: 1542553 - RNA, 17 nt, Pseudomonas aeruginosa PA01
ggacgacgaaagaagcc

SEQ ID NO: 1542554 - RNA, 18 nt, Pseudomonas aeruginosa PA01
ggaccuugucgccgguga

SEQ ID NO: 1542555 - RNA, 16 nt, Pseudomonas aeruginosa PA01
ggaccuuccgccagca

SEQ ID NO: 1542556 - RNA, 15 nt, Pseudomonas aeruginosa PA01
ggaccccggccucca

SEQ ID NO: 1542557 - RNA, 15 nt, Pseudomonas aeruginosa PA01
ggacccgcaccugga

SEQ ID NO: 1542558 - RNA, 14 nt, Pseudomonas aeruginosa PA01
ggacccgggccucc

SEQ ID NO: 1542559 - RNA, 15 nt, Pseudomonas aeruginosa PA01
ggacccgcgccggca

SEQ ID NO: 1542560 - RNA, 21 nt, Pseudomonas aeruginosa PA01
ggacccgcgccggcagcucgg

SEQ ID NO: 1542561 - RNA, 19 nt, Pseudomonas aeruginosa PA01
ggacccgcucggccuuagc

SEQ ID NO: 1542562 - RNA, 13 nt, Pseudomonas aeruginosa PA01
ggacccagaugau

SEQ ID NO: 1542563 - RNA, 14 nt, Pseudomonas aeruginosa PA01
ggacccaguugggc

SEQ ID NO: 1542564 - RNA, 17 nt, Pseudomonas aeruginosa PA01
ggacccaucgaugcuca

SEQ ID NO: 1542565 - RNA, 20 nt, Pseudomonas aeruginosa PA01
ggacccugguaguccagcag

SEQ ID NO: 1542566 - RNA, 14 nt, Pseudomonas aeruginosa PA01
ggaccgcaccuggu

SEQ ID NO: 1542567 - RNA, 20 nt, Pseudomonas aeruginosa PA01
ggaccgacggcaacugagcg

SEQ ID NO: 1542568 - RNA, 16 nt, Pseudomonas aeruginosa PA01
ggaccgggcggcaggc

SEQ ID NO: 1542569 - RNA, 20 nt, Pseudomonas aeruginosa PA01
ggaaguuaucggggccaggu

SEQ ID NO: 1542570 - RNA, 17 nt, Pseudomonas aeruginosa PA01
ggaaggucggcagcagc

SEQ ID NO: 1542571 - RNA, 12 nt, Pseudomonas aeruginosa PA01
gcucgguggcau

SEQ ID NO: 1542572 - RNA, 19 nt, Pseudomonas aeruginosa PA01
ggaaguagugcagcugcga

SEQ ID NO: 1542573 - RNA, 13 nt, Pseudomonas aeruginosa PA01
ggaagucgagcug

SEQ ID NO: 1542574 - RNA, 13 nt, Pseudomonas aeruginosa PA01
ggaagucgcccug

SEQ ID NO: 1542575 - RNA, 16 nt, Pseudomonas aeruginosa PA01
ggaagucgcccugccc

SEQ ID NO: 1542576 - RNA, 17 nt, Pseudomonas aeruginosa PA01
ggaagucguccagcagg

SEQ ID NO: 1542577 - RNA, 23 nt, Pseudomonas aeruginosa PA01
gcucggcggguauccgccgggcc

SEQ ID NO: 1542578 - RNA, 13 nt, Pseudomonas aeruginosa PA01
gcucggcggccuc

SEQ ID NO: 1542579 - RNA, 15 nt, Pseudomonas aeruginosa PA01
gcucggcugcuugcc

SEQ ID NO: 1542580 - RNA, 18 nt, Pseudomonas aeruginosa PA01
gcucggcuucgcguugca

SEQ ID NO: 1542581 - RNA, 22 nt, Pseudomonas aeruginosa PA01
gcucgggcggcaagggcacgug

SEQ ID NO: 1542582 - RNA, 15 nt, Pseudomonas aeruginosa PA01
gcucgggcugccgca

SEQ ID NO: 1542583 - RNA, 21 nt, Pseudomonas aeruginosa PA01
gcucggggauguagcggaagu

SEQ ID NO: 1542584 - RNA, 15 nt, Pseudomonas aeruginosa PA01
gcucggucgagcccc

SEQ ID NO: 1542585 - RNA, 16 nt, Pseudomonas aeruginosa PA01
gcucgguauggcugcu

SEQ ID NO: 1542586 - RNA, 17 nt, Pseudomonas aeruginosa PA01
gcucggucagcggcgca

SEQ ID NO: 1542587 - RNA, 15 nt, Pseudomonas aeruginosa PA01
gcucggucagcuccc

SEQ ID NO: 1542588 - RNA, 23 nt, Pseudomonas aeruginosa PA01
gcucgggguuuccucgaagcgcu

SEQ ID NO: 1542589 - RNA, 17 nt, Pseudomonas aeruginosa PA01
ggacaacaggccgggcg

SEQ ID NO: 1542590 - RNA, 22 nt, Pseudomonas aeruginosa PA01
ggacaacaggccgggcggcggc

SEQ ID NO: 1542591 - RNA, 19 nt, Pseudomonas aeruginosa PA01
ggacgaugaucaccaggac

SEQ ID NO: 1542592 - RNA, 17 nt, Pseudomonas aeruginosa PA01
ggacgagcguccgccgc

SEQ ID NO: 1542593 - RNA, 17 nt, Pseudomonas aeruginosa PA01
ggacgaggaaggcgcgc

SEQ ID NO: 1542594 - RNA, 18 nt, Pseudomonas aeruginosa PA01
ggacgaggauggucaggc

SEQ ID NO: 1542595 - RNA, 17 nt, Pseudomonas aeruginosa PA01
ggacgccgaagcgggcu

SEQ ID NO: 1542596 - RNA, 12 nt, Pseudomonas aeruginosa PA01
ggacgccaggcg

SEQ ID NO: 1542597 - RNA, 12 nt, Pseudomonas aeruginosa PA01
ggacgcaggccg

SEQ ID NO: 1542598 - RNA, 23 nt, Pseudomonas aeruginosa PA01
ggacgauauugguguagcugcag

SEQ ID NO: 1542599 - RNA, 16 nt, Pseudomonas aeruginosa PA01
ggacgcagcgggucga

SEQ ID NO: 1542600 - RNA, 18 nt, Pseudomonas aeruginosa PA01
ggacgcaccagcaggccg

SEQ ID NO: 1542601 - RNA, 22 nt, Pseudomonas aeruginosa PA01
ggacgggugcgcgccaccuggu

SEQ ID NO: 1542602 - RNA, 12 nt, Pseudomonas aeruginosa PA01
ggacggguacug

SEQ ID NO: 1542603 - RNA, 17 nt, Pseudomonas aeruginosa PA01
ggacgucgccagggagg

SEQ ID NO: 1542604 - RNA, 17 nt, Pseudomonas aeruginosa PA01
ggacugaaaccccacca

SEQ ID NO: 1542605 - RNA, 21 nt, Pseudomonas aeruginosa PA01
ggacugcccagcgccgccagc

SEQ ID NO: 1542606 - RNA, 22 nt, Pseudomonas aeruginosa PA01
ggacugcccagcgccgccagca

SEQ ID NO: 1542607 - RNA, 20 nt, Pseudomonas aeruginosa PA01
ggacugguugaccugcagcg

SEQ ID NO: 1542608 - RNA, 18 nt, Pseudomonas aeruginosa PA01
ggacugguaggacagggc

SEQ ID NO: 1542609 - RNA, 20 nt, Pseudomonas aeruginosa PA01
ggacuuggagaagaucgccg

SEQ ID NO: 1542610 - RNA, 16 nt, Pseudomonas aeruginosa PA01
ggagaaacgcuuggcg

SEQ ID NO: 1542611 - RNA, 19 nt, Pseudomonas aeruginosa PA01
ggagaaacucgcgggcgcg

SEQ ID NO: 1542612 - RNA, 18 nt, Pseudomonas aeruginosa PA01
ggagaaacuuucuucgcc

SEQ ID NO: 1542613 - RNA, 16 nt, Pseudomonas aeruginosa PA01
ggagauguccaucagc

SEQ ID NO: 1542614 - RNA, 11 nt, Pseudomonas aeruginosa PA01
ggagagucgga

SEQ ID NO: 1542615 - RNA, 15 nt, Pseudomonas aeruginosa PA01
ggacuuucgaugguu

SEQ ID NO: 1542616 - RNA, 14 nt, Pseudomonas aeruginosa PA01
ggaggcccagauca

SEQ ID NO: 1542617 - RNA, 23 nt, Pseudomonas aeruginosa PA01
ggaggcauugcacaacgggugcu

SEQ ID NO: 1542618 - RNA, 14 nt, Pseudomonas aeruginosa PA01
ggagguucggcagg

SEQ ID NO: 1542619 - RNA, 22 nt, Pseudomonas aeruginosa PA01
ggaggcgcaaaauguauaggag

SEQ ID NO: 1542620 - RNA, 18 nt, Pseudomonas aeruginosa PA01
ggaggcgcacaucacccg

SEQ ID NO: 1542621 - RNA, 13 nt, Pseudomonas aeruginosa PA01
ggaggcgccgcgc

SEQ ID NO: 1542622 - RNA, 16 nt, Pseudomonas aeruginosa PA01
ggaguagccggcggcg

SEQ ID NO: 1542623 - RNA, 15 nt, Pseudomonas aeruginosa PA01
ggaguaccaggccac

SEQ ID NO: 1542624 - RNA, 16 nt, Pseudomonas aeruginosa PA01
ggagguucgaauccuc

SEQ ID NO: 1542625 - RNA, 12 nt, Pseudomonas aeruginosa PA01
ggagcgccgcgc

SEQ ID NO: 1542626 - RNA, 15 nt, Pseudomonas aeruginosa PA01
ggaggaggcgccggg

SEQ ID NO: 1542627 - RNA, 16 nt, Pseudomonas aeruginosa PA01
ggaggauucagcagga

SEQ ID NO: 1542628 - RNA, 22 nt, Pseudomonas aeruginosa PA01
ggaggaucgagccuugcggcgc

SEQ ID NO: 1542629 - RNA, 17 nt, Pseudomonas aeruginosa PA01
ggaggaucgccaggacg

SEQ ID NO: 1542630 - RNA, 19 nt, Pseudomonas aeruginosa PA01
ggaggaucgccaggacgcu

SEQ ID NO: 1542631 - RNA, 17 nt, Pseudomonas aeruginosa PA01
ggaggaucuccaacugg

SEQ ID NO: 1542632 - RNA, 16 nt, Pseudomonas aeruginosa PA01
ggaggaugccgaucac

SEQ ID NO: 1542633 - RNA, 12 nt, Pseudomonas aeruginosa PA01
ggauagccaacc

SEQ ID NO: 1542634 - RNA, 11 nt, Pseudomonas aeruginosa PA01
ggauagcaccg

SEQ ID NO: 1542635 - RNA, 19 nt, Pseudomonas aeruginosa PA01
ggauagaaaagcaaggagc

SEQ ID NO: 1542636 - RNA, 16 nt, Pseudomonas aeruginosa PA01
ggauacucaugcaggc

SEQ ID NO: 1542637 - RNA, 11 nt, Pseudomonas aeruginosa PA01
ggauacuccuu

SEQ ID NO: 1542638 - RNA, 14 nt, Pseudomonas aeruginosa PA01
ggauacggcagggu

SEQ ID NO: 1542639 - RNA, 14 nt, Pseudomonas aeruginosa PA01
ggagucucgggaag

SEQ ID NO: 1542640 - RNA, 22 nt, Pseudomonas aeruginosa PA01
ggaguccaggcgggccagcugg

SEQ ID NO: 1542641 - RNA, 16 nt, Pseudomonas aeruginosa PA01
ggagugcaugccgggg

SEQ ID NO: 1542642 - RNA, 16 nt, Pseudomonas aeruginosa PA01
ggagugaggccgagcc

SEQ ID NO: 1542643 - RNA, 22 nt, Pseudomonas aeruginosa PA01
ggcacgcugcuugcgcaccucc

SEQ ID NO: 1542644 - RNA, 19 nt, Pseudomonas aeruginosa PA01
ggcacgcuggcgagaaugg

SEQ ID NO: 1542645 - RNA, 15 nt, Pseudomonas aeruginosa PA01
ggcacgcugccgccg

SEQ ID NO: 1542646 - RNA, 20 nt, Pseudomonas aeruginosa PA01
ggcacgcugccgccgaugcu

SEQ ID NO: 1542647 - RNA, 19 nt, Pseudomonas aeruginosa PA01
ggcacgcuccagaucgccg

SEQ ID NO: 1542648 - RNA, 22 nt, Pseudomonas aeruginosa PA01
ggcacggggcgccuguccggga

SEQ ID NO: 1542649 - RNA, 14 nt, Pseudomonas aeruginosa PA01
ggcaccggccaggc

SEQ ID NO: 1542650 - RNA, 19 nt, Pseudomonas aeruginosa PA01
ggcaccgucaagggccagg

SEQ ID NO: 1542651 - RNA, 20 nt, Pseudomonas aeruginosa PA01
ggcaccgucgagcaccaggc

SEQ ID NO: 1542652 - RNA, 21 nt, Pseudomonas aeruginosa PA01
ggcaccuugcgaaaagcccgc

SEQ ID NO: 1542653 - RNA, 14 nt, Pseudomonas aeruginosa PA01
ggcacccggcuggg

SEQ ID NO: 1542654 - RNA, 23 nt, Pseudomonas aeruginosa PA01
ggcaauguccgagcaggucgcgg

SEQ ID NO: 1542655 - RNA, 20 nt, Pseudomonas aeruginosa PA01
ggcaauggccggcgggcgcg

SEQ ID NO: 1542656 - RNA, 17 nt, Pseudomonas aeruginosa PA01
ggcaagugggucacggu

SEQ ID NO: 1542657 - RNA, 17 nt, Pseudomonas aeruginosa PA01
ggcaagggccugcucag

SEQ ID NO: 1542658 - RNA, 16 nt, Pseudomonas aeruginosa PA01
ggcaaucugcccggca

SEQ ID NO: 1542659 - RNA, 15 nt, Pseudomonas aeruginosa PA01
ggcaaggcggccuca

SEQ ID NO: 1542660 - RNA, 22 nt, Pseudomonas aeruginosa PA01
ggcaaggccaagucggccgccc

SEQ ID NO: 1542661 - RNA, 19 nt, Pseudomonas aeruginosa PA01
ggcaagcugcacggcgacc

SEQ ID NO: 1542662 - RNA, 22 nt, Pseudomonas aeruginosa PA01
ggcaagcugcacggcgacccgc

SEQ ID NO: 1542663 - RNA, 15 nt, Pseudomonas aeruginosa PA01
ggcaaggaccugcug

SEQ ID NO: 1542664 - RNA, 16 nt, Pseudomonas aeruginosa PA01
ggcaaggaccugcugc

SEQ ID NO: 1542665 - RNA, 20 nt, Pseudomonas aeruginosa PA01
ggcaaggaccugcugcccgg

SEQ ID NO: 1542666 - RNA, 19 nt, Pseudomonas aeruginosa PA01
ggcaagcucgacgagccgc

SEQ ID NO: 1542667 - RNA, 14 nt, Pseudomonas aeruginosa PA01
ggcaacggcugggu

SEQ ID NO: 1542668 - RNA, 16 nt, Pseudomonas aeruginosa PA01
ggcaacgucaggcugu

SEQ ID NO: 1542669 - RNA, 18 nt, Pseudomonas aeruginosa PA01
ggcaacugccgauggucu

SEQ ID NO: 1542670 - RNA, 18 nt, Pseudomonas aeruginosa PA01
ggcaacugccgcccgcuc

SEQ ID NO: 1542671 - RNA, 17 nt, Pseudomonas aeruginosa PA01
ggauuuugggcagcgug

SEQ ID NO: 1542672 - RNA, 16 nt, Pseudomonas aeruginosa PA01
ggauuucagcaggccg

SEQ ID NO: 1542673 - RNA, 17 nt, Pseudomonas aeruginosa PA01
ggcaaaggcgcgcaggg

SEQ ID NO: 1542674 - RNA, 13 nt, Pseudomonas aeruginosa PA01
ggcaaagcgcggg

SEQ ID NO: 1542675 - RNA, 16 nt, Pseudomonas aeruginosa PA01
ggcaaagaccgaccag

SEQ ID NO: 1542676 - RNA, 16 nt, Pseudomonas aeruginosa PA01
ggcaacgcgcagaggc

SEQ ID NO: 1542677 - RNA, 19 nt, Pseudomonas aeruginosa PA01
ggcaacgacgaggccugga

SEQ ID NO: 1542678 - RNA, 16 nt, Pseudomonas aeruginosa PA01
ggcaacgagcaggacu

SEQ ID NO: 1542679 - RNA, 14 nt, Pseudomonas aeruginosa PA01
ggcaacgccaggcu

SEQ ID NO: 1542680 - RNA, 16 nt, Pseudomonas aeruginosa PA01
ggcaaccgcggcggcc

SEQ ID NO: 1542681 - RNA, 18 nt, Pseudomonas aeruginosa PA01
ggcaaccgcggcggccuc

SEQ ID NO: 1542682 - RNA, 18 nt, Pseudomonas aeruginosa PA01
ggcaaccgucgaacaggu

SEQ ID NO: 1542683 - RNA, 20 nt, Pseudomonas aeruginosa PA01
ggcaaccgucgaacaggugg

SEQ ID NO: 1542684 - RNA, 19 nt, Pseudomonas aeruginosa PA01
ggcaacacccucccuaucu

SEQ ID NO: 1542685 - RNA, 17 nt, Pseudomonas aeruginosa PA01
ggaugcagucccgccag

SEQ ID NO: 1542686 - RNA, 18 nt, Pseudomonas aeruginosa PA01
ggaugcagauccagcggc

SEQ ID NO: 1542687 - RNA, 22 nt, Pseudomonas aeruginosa PA01
ggaugcagauccagcggcaggu

SEQ ID NO: 1542688 - RNA, 12 nt, Pseudomonas aeruginosa PA01
ggaugcagccgg

SEQ ID NO: 1542689 - RNA, 16 nt, Pseudomonas aeruginosa PA01
ggaugcagccggggcu

SEQ ID NO: 1542690 - RNA, 18 nt, Pseudomonas aeruginosa PA01
ggaugaucgcgugggcca

SEQ ID NO: 1542691 - RNA, 17 nt, Pseudomonas aeruginosa PA01
ggaugcccuggucggcg

SEQ ID NO: 1542692 - RNA, 22 nt, Pseudomonas aeruginosa PA01
ggaucugcugcaacauggcguc

SEQ ID NO: 1542693 - RNA, 14 nt, Pseudomonas aeruginosa PA01
ggaucucgccacug

SEQ ID NO: 1542694 - RNA, 14 nt, Pseudomonas aeruginosa PA01
ggaucuccucggcc

SEQ ID NO: 1542695 - RNA, 24 nt, Pseudomonas aeruginosa PA01
ggaucucaggaccuuccgccagca

SEQ ID NO: 1542696 - RNA, 12 nt, Pseudomonas aeruginosa PA01
ggaucaccuggc

SEQ ID NO: 1542697 - RNA, 14 nt, Pseudomonas aeruginosa PA01
ggaucaccuucucg

SEQ ID NO: 1542698 - RNA, 21 nt, Pseudomonas aeruginosa PA01
ggaucacgauggccggcagca

SEQ ID NO: 1542699 - RNA, 19 nt, Pseudomonas aeruginosa PA01
ggaucaccggaaccggggu

SEQ ID NO: 1542700 - RNA, 16 nt, Pseudomonas aeruginosa PA01
ggaucaccggcuggcc

SEQ ID NO: 1542701 - RNA, 13 nt, Pseudomonas aeruginosa PA01
ggaucaccggggu

SEQ ID NO: 1542702 - RNA, 19 nt, Pseudomonas aeruginosa PA01
ggaugccgcacaggcuggc

SEQ ID NO: 1542703 - RNA, 12 nt, Pseudomonas aeruginosa PA01
ggauggccagcc

SEQ ID NO: 1542704 - RNA, 19 nt, Pseudomonas aeruginosa PA01
ggauguuccaggcccgccg

SEQ ID NO: 1542705 - RNA, 21 nt, Pseudomonas aeruginosa PA01
ggauguucgccgaggggcggg

SEQ ID NO: 1542706 - RNA, 22 nt, Pseudomonas aeruginosa PA01
ggauguugccgccgccgaggag

SEQ ID NO: 1542707 - RNA, 13 nt, Pseudomonas aeruginosa PA01
ggauugucgccgc

SEQ ID NO: 1542708 - RNA, 14 nt, Pseudomonas aeruginosa PA01
ggauuggccgggcc

SEQ ID NO: 1542709 - RNA, 22 nt, Pseudomonas aeruginosa PA01
ggauugccgcgggucucgauca

SEQ ID NO: 1542710 - RNA, 13 nt, Pseudomonas aeruginosa PA01
cucuuggucauca

SEQ ID NO: 1542711 - RNA, 21 nt, Pseudomonas aeruginosa PA01
cucuuggucgcggucuggaug

SEQ ID NO: 1542712 - RNA, 16 nt, Pseudomonas aeruginosa PA01
cucuugggcucugccu

SEQ ID NO: 1542713 - RNA, 18 nt, Pseudomonas aeruginosa PA01
cucuugggcucugccuuc

SEQ ID NO: 1542714 - RNA, 19 nt, Pseudomonas aeruginosa PA01
cucuucuugaucacuucca

SEQ ID NO: 1542715 - RNA, 20 nt, Pseudomonas aeruginosa PA01
cucuucuuacagcuugcugg

SEQ ID NO: 1542716 - RNA, 12 nt, Pseudomonas aeruginosa PA01
cucuugaggucg

SEQ ID NO: 1542717 - RNA, 14 nt, Pseudomonas aeruginosa PA01
cucuugcccugcca

SEQ ID NO: 1542718 - RNA, 14 nt, Pseudomonas aeruginosa PA01
cucuucgucggcga

SEQ ID NO: 1542719 - RNA, 14 nt, Pseudomonas aeruginosa PA01
cucuucggcggcca

SEQ ID NO: 1542720 - RNA, 15 nt, Pseudomonas aeruginosa PA01
cucuucggcggccag

SEQ ID NO: 1542721 - RNA, 18 nt, Pseudomonas aeruginosa PA01
cucuuccgcgcugaccug

SEQ ID NO: 1542722 - RNA, 19 nt, Pseudomonas aeruginosa PA01
cucuuccgcgcugaccugg

SEQ ID NO: 1542723 - RNA, 19 nt, Pseudomonas aeruginosa PA01
cucuucccggcucggcacg

SEQ ID NO: 1542724 - RNA, 20 nt, Pseudomonas aeruginosa PA01
cucuucccggcucggcacgc

SEQ ID NO: 1542725 - RNA, 21 nt, Pseudomonas aeruginosa PA01
cucugcuucugucccugggcc

SEQ ID NO: 1542726 - RNA, 16 nt, Pseudomonas aeruginosa PA01
cucugcuggccacccu

SEQ ID NO: 1542727 - RNA, 18 nt, Pseudomonas aeruginosa PA01
cucugcuggccacccuug

SEQ ID NO: 1542728 - RNA, 23 nt, Pseudomonas aeruginosa PA01
cucuggcccagcuugauguagga

SEQ ID NO: 1542729 - RNA, 15 nt, Pseudomonas aeruginosa PA01
cucuggcugaagacc

SEQ ID NO: 1542730 - RNA, 20 nt, Pseudomonas aeruginosa PA01
cucuggguuuccguaagauc

SEQ ID NO: 1542731 - RNA, 15 nt, Pseudomonas aeruginosa PA01
cucugguagccgcag

SEQ ID NO: 1542732 - RNA, 20 nt, Pseudomonas aeruginosa PA01
cucugguagccgcaguccag

SEQ ID NO: 1542733 - RNA, 16 nt, Pseudomonas aeruginosa PA01
cucuucagcgguccgc

SEQ ID NO: 1542734 - RNA, 16 nt, Pseudomonas aeruginosa PA01
cucuguuucgggucgc

SEQ ID NO: 1542735 - RNA, 21 nt, Pseudomonas aeruginosa PA01
cucuguuucgggucgcccuug

SEQ ID NO: 1542736 - RNA, 15 nt, Pseudomonas aeruginosa PA01
cugaaauccaccagc

SEQ ID NO: 1542737 - RNA, 21 nt, Pseudomonas aeruginosa PA01
cugaacaucagguuccgugga

SEQ ID NO: 1542738 - RNA, 14 nt, Pseudomonas aeruginosa PA01
cugaacaagcccug

SEQ ID NO: 1542739 - RNA, 22 nt, Pseudomonas aeruginosa PA01
cugaacuggaucggccccaccu

SEQ ID NO: 1542740 - RNA, 14 nt, Pseudomonas aeruginosa PA01
cugaacgcgcccgg

SEQ ID NO: 1542741 - RNA, 20 nt, Pseudomonas aeruginosa PA01
cugaacgcgcccggccaggc

SEQ ID NO: 1542742 - RNA, 17 nt, Pseudomonas aeruginosa PA01
cugaagaucgccacgau

SEQ ID NO: 1542743 - RNA, 23 nt, Pseudomonas aeruginosa PA01
cugaagacccggcguucgccggg

SEQ ID NO: 1542744 - RNA, 19 nt, Pseudomonas aeruginosa PA01
cucuuuccgggucauuggc

SEQ ID NO: 1542745 - RNA, 16 nt, Pseudomonas aeruginosa PA01
cucuuuuuaagagaau

SEQ ID NO: 1542746 - RNA, 13 nt, Pseudomonas aeruginosa PA01
cugaaaaaagggg

SEQ ID NO: 1542747 - RNA, 17 nt, Pseudomonas aeruginosa PA01
cugaaaaaaggggaugc

SEQ ID NO: 1542748 - RNA, 18 nt, Pseudomonas aeruginosa PA01
cugagaccgauccagcag

SEQ ID NO: 1542749 - RNA, 19 nt, Pseudomonas aeruginosa PA01
cugagaccuuccugccagc

SEQ ID NO: 1542750 - RNA, 14 nt, Pseudomonas aeruginosa PA01
cugagcaccgggac

SEQ ID NO: 1542751 - RNA, 13 nt, Pseudomonas aeruginosa PA01
cugagcagcaggu

SEQ ID NO: 1542752 - RNA, 18 nt, Pseudomonas aeruginosa PA01
cugagcagucgccuggcc

SEQ ID NO: 1542753 - RNA, 19 nt, Pseudomonas aeruginosa PA01
cugagcagucgccuggccc

SEQ ID NO: 1542754 - RNA, 13 nt, Pseudomonas aeruginosa PA01
cugagcaggaacu

SEQ ID NO: 1542755 - RNA, 18 nt, Pseudomonas aeruginosa PA01
cugagcaggccgacggcg

SEQ ID NO: 1542756 - RNA, 23 nt, Pseudomonas aeruginosa PA01
cugagcaggccgacggcgcgcug

SEQ ID NO: 1542757 - RNA, 17 nt, Pseudomonas aeruginosa PA01
cugacgaaggcuggagc

SEQ ID NO: 1542758 - RNA, 16 nt, Pseudomonas aeruginosa PA01
cugacgaaguccuugu

SEQ ID NO: 1542759 - RNA, 13 nt, Pseudomonas aeruginosa PA01
cugacgcuggcga

SEQ ID NO: 1542760 - RNA, 21 nt, Pseudomonas aeruginosa PA01
cugacggcaaggaccugcugc

SEQ ID NO: 1542761 - RNA, 14 nt, Pseudomonas aeruginosa PA01
cugaccccggccug

SEQ ID NO: 1542762 - RNA, 16 nt, Pseudomonas aeruginosa PA01
cugacccgcugcugga

SEQ ID NO: 1542763 - RNA, 14 nt, Pseudomonas aeruginosa PA01
cugacccgcugucc

SEQ ID NO: 1542764 - RNA, 13 nt, Pseudomonas aeruginosa PA01
cugaccaccagga

SEQ ID NO: 1542765 - RNA, 16 nt, Pseudomonas aeruginosa PA01
cugaccaccagggcga

SEQ ID NO: 1542766 - RNA, 14 nt, Pseudomonas aeruginosa PA01
cugaccacgcagag

SEQ ID NO: 1542767 - RNA, 13 nt, Pseudomonas aeruginosa PA01
cugaccagcccgg

SEQ ID NO: 1542768 - RNA, 12 nt, Pseudomonas aeruginosa PA01
cugaccagcagg

SEQ ID NO: 1542769 - RNA, 14 nt, Pseudomonas aeruginosa PA01
cugaagcggccgcc

SEQ ID NO: 1542770 - RNA, 16 nt, Pseudomonas aeruginosa PA01
cugaaggugagauggu

SEQ ID NO: 1542771 - RNA, 17 nt, Pseudomonas aeruginosa PA01
cugaaggucgccgcgcu

SEQ ID NO: 1542772 - RNA, 13 nt, Pseudomonas aeruginosa PA01
cugaaggcgggcu

SEQ ID NO: 1542773 - RNA, 17 nt, Pseudomonas aeruginosa PA01
cugaagcugucgcccuc

SEQ ID NO: 1542774 - RNA, 18 nt, Pseudomonas aeruginosa PA01
cugagucgcuucacucau

SEQ ID NO: 1542775 - RNA, 19 nt, Pseudomonas aeruginosa PA01
cugaucggccgccagugca

SEQ ID NO: 1542776 - RNA, 22 nt, Pseudomonas aeruginosa PA01
cugaucgaagcccaucgacugc

SEQ ID NO: 1542777 - RNA, 14 nt, Pseudomonas aeruginosa PA01
cugaucuucugucc

SEQ ID NO: 1542778 - RNA, 17 nt, Pseudomonas aeruginosa PA01
cugcaacgccggcccgu

SEQ ID NO: 1542779 - RNA, 22 nt, Pseudomonas aeruginosa PA01
cugcaacuccgccuguccaccg

SEQ ID NO: 1542780 - RNA, 16 nt, Pseudomonas aeruginosa PA01
cugcaacucggcgccg

SEQ ID NO: 1542781 - RNA, 13 nt, Pseudomonas aeruginosa PA01
cugcaacuggaag

SEQ ID NO: 1542782 - RNA, 14 nt, Pseudomonas aeruginosa PA01
cugcaacuggccga

SEQ ID NO: 1542783 - RNA, 21 nt, Pseudomonas aeruginosa PA01
cugcaagggcacuucguccag

SEQ ID NO: 1542784 - RNA, 22 nt, Pseudomonas aeruginosa PA01
cugcaaggcggugaccagcggc

SEQ ID NO: 1542785 - RNA, 14 nt, Pseudomonas aeruginosa PA01
cugcuucaggcgcg

SEQ ID NO: 1542786 - RNA, 19 nt, Pseudomonas aeruginosa PA01
cugcuucaggcgcgcggcc

SEQ ID NO: 1542787 - RNA, 22 nt, Pseudomonas aeruginosa PA01
cugcuucaggcgcgcggccagc

SEQ ID NO: 1542788 - RNA, 14 nt, Pseudomonas aeruginosa PA01
cugcuggccgcgca

SEQ ID NO: 1542789 - RNA, 19 nt, Pseudomonas aeruginosa PA01
cugcuuaccuugccggugc

SEQ ID NO: 1542790 - RNA, 14 nt, Pseudomonas aeruginosa PA01
cugcuggccggugc

SEQ ID NO: 1542791 - RNA, 17 nt, Pseudomonas aeruginosa PA01
cugcuggccggugccgc

SEQ ID NO: 1542792 - RNA, 21 nt, Pseudomonas aeruginosa PA01
cugcuggauggggcugaucuc

SEQ ID NO: 1542793 - RNA, 13 nt, Pseudomonas aeruginosa PA01
cugcugcucagcg

SEQ ID NO: 1542794 - RNA, 17 nt, Pseudomonas aeruginosa PA01
cugcugcucagcgcgcu

SEQ ID NO: 1542795 - RNA, 23 nt, Pseudomonas aeruginosa PA01
cugcugcucagcgcgcucggccu

SEQ ID NO: 1542796 - RNA, 17 nt, Pseudomonas aeruginosa PA01
cugcuuugggagcagga

SEQ ID NO: 1542797 - RNA, 16 nt, Pseudomonas aeruginosa PA01
cuggacaggcgcaggg

SEQ ID NO: 1542798 - RNA, 17 nt, Pseudomonas aeruginosa PA01
cuggaccauggccggcg

SEQ ID NO: 1542799 - RNA, 22 nt, Pseudomonas aeruginosa PA01
cuggacaagguuugcgccgccg

SEQ ID NO: 1542800 - RNA, 17 nt, Pseudomonas aeruginosa PA01
cuggaaaggccucggcg

SEQ ID NO: 1542801 - RNA, 22 nt, Pseudomonas aeruginosa PA01
cuggaaaucggcguccuggucg

SEQ ID NO: 1542802 - RNA, 14 nt, Pseudomonas aeruginosa PA01
cuggaacaccaggc

SEQ ID NO: 1542803 - RNA, 16 nt, Pseudomonas aeruginosa PA01
cuggaacaccaggccg

SEQ ID NO: 1542804 - RNA, 19 nt, Pseudomonas aeruginosa PA01
cuggaacaccaggccgcaa

SEQ ID NO: 1542805 - RNA, 15 nt, Pseudomonas aeruginosa PA01
cuggccagcaccagu

SEQ ID NO: 1542806 - RNA, 21 nt, Pseudomonas aeruginosa PA01
cuggccagcaccagucccugg

SEQ ID NO: 1542807 - RNA, 23 nt, Pseudomonas aeruginosa PA01
cuggccagaaggucggggagagg

SEQ ID NO: 1542808 - RNA, 14 nt, Pseudomonas aeruginosa PA01
cuggccagcaauac

SEQ ID NO: 1542809 - RNA, 18 nt, Pseudomonas aeruginosa PA01
cuggccaccgccaggacc

SEQ ID NO: 1542810 - RNA, 24 nt, Pseudomonas aeruginosa PA01
cuggccaccgucggauggccgucc

SEQ ID NO: 1542811 - RNA, 21 nt, Pseudomonas aeruginosa PA01
cuggccacccuugcgcccggc

SEQ ID NO: 1542812 - RNA, 21 nt, Pseudomonas aeruginosa PA01
cuggccacccuugcguccugc

SEQ ID NO: 1542813 - RNA, 23 nt, Pseudomonas aeruginosa PA01
cuggccacccuugcguccugccu

SEQ ID NO: 1542814 - RNA, 16 nt, Pseudomonas aeruginosa PA01
cuggccagcgcuucca

SEQ ID NO: 1542815 - RNA, 12 nt, Pseudomonas aeruginosa PA01
cuggccagcagg

SEQ ID NO: 1542816 - RNA, 19 nt, Pseudomonas aeruginosa PA01
cuggccaggcgcuccucca

SEQ ID NO: 1542817 - RNA, 21 nt, Pseudomonas aeruginosa PA01
cuggccaggcgcuccuccagc

SEQ ID NO: 1542818 - RNA, 22 nt, Pseudomonas aeruginosa PA01
cuggccaggcgcuccuccagcg

SEQ ID NO: 1542819 - RNA, 17 nt, Pseudomonas aeruginosa PA01
cuggccauagaaaccgu

SEQ ID NO: 1542820 - RNA, 17 nt, Pseudomonas aeruginosa PA01
cuggccauccgcccugc

SEQ ID NO: 1542821 - RNA, 23 nt, Pseudomonas aeruginosa PA01
cuggccaucuucucgaagcgcgc

SEQ ID NO: 1542822 - RNA, 23 nt, Pseudomonas aeruginosa PA01
cuggagaaacucgcgggcgcgca

SEQ ID NO: 1542823 - RNA, 20 nt, Pseudomonas aeruginosa PA01
cuggaccuccgccaggaccu

SEQ ID NO: 1542824 - RNA, 18 nt, Pseudomonas aeruginosa PA01
cuggacgacgcuggccug

SEQ ID NO: 1542825 - RNA, 19 nt, Pseudomonas aeruginosa PA01
cuggacgacgcuggccugc

SEQ ID NO: 1542826 - RNA, 20 nt, Pseudomonas aeruginosa PA01
cuggacgacgcuggccugcc

SEQ ID NO: 1542827 - RNA, 13 nt, Pseudomonas aeruginosa PA01
cuggaccccgccc

SEQ ID NO: 1542828 - RNA, 19 nt, Pseudomonas aeruginosa PA01
cuggacccgcaccuggacc

SEQ ID NO: 1542829 - RNA, 22 nt, Pseudomonas aeruginosa PA01
cuggacccgcaccuggaccggg

SEQ ID NO: 1542830 - RNA, 13 nt, Pseudomonas aeruginosa PA01
cuggaccuggccg

SEQ ID NO: 1542831 - RNA, 14 nt, Pseudomonas aeruginosa PA01
cuggaucuccuggg

SEQ ID NO: 1542832 - RNA, 17 nt, Pseudomonas aeruginosa PA01
cuggaucuccugggucg

SEQ ID NO: 1542833 - RNA, 20 nt, Pseudomonas aeruginosa PA01
cuggaugaacgacuccagcu

SEQ ID NO: 1542834 - RNA, 18 nt, Pseudomonas aeruginosa PA01
cuggaucugcgggaacuu

SEQ ID NO: 1542835 - RNA, 17 nt, Pseudomonas aeruginosa PA01
cuggaugaaacgggcga

SEQ ID NO: 1542836 - RNA, 24 nt, Pseudomonas aeruginosa PA01
cuggaucugguggaacagcaucag

SEQ ID NO: 1542837 - RNA, 18 nt, Pseudomonas aeruginosa PA01
cuggauccgugccaggcg

SEQ ID NO: 1542838 - RNA, 21 nt, Pseudomonas aeruginosa PA01
cuggauccgugccaggcgcuc

SEQ ID NO: 1542839 - RNA, 21 nt, Pseudomonas aeruginosa PA01
cuggaucgaucucgucggcgg

SEQ ID NO: 1542840 - RNA, 14 nt, Pseudomonas aeruginosa PA01
cuggaucgccaggc

SEQ ID NO: 1542841 - RNA, 23 nt, Pseudomonas aeruginosa PA01
cuggaucaccgcggcgcugaagg

SEQ ID NO: 1542842 - RNA, 21 nt, Pseudomonas aeruginosa PA01
cuggaucaggaagguccaggc

SEQ ID NO: 1542843 - RNA, 15 nt, Pseudomonas aeruginosa PA01
cugcuccuccaggcu

SEQ ID NO: 1542844 - RNA, 19 nt, Pseudomonas aeruginosa PA01
cugcuccuccccguccugg

SEQ ID NO: 1542845 - RNA, 21 nt, Pseudomonas aeruginosa PA01
cugcuccuccccguccuggcg

SEQ ID NO: 1542846 - RNA, 14 nt, Pseudomonas aeruginosa PA01
cugcuccgggcggc

SEQ ID NO: 1542847 - RNA, 13 nt, Pseudomonas aeruginosa PA01
cugcucagggccg

SEQ ID NO: 1542848 - RNA, 14 nt, Pseudomonas aeruginosa PA01
cugcucagggccgc

SEQ ID NO: 1542849 - RNA, 17 nt, Pseudomonas aeruginosa PA01
cugcucagggccgcgcc

SEQ ID NO: 1542850 - RNA, 22 nt, Pseudomonas aeruginosa PA01
cugcucacggccgaacagacgc

SEQ ID NO: 1542851 - RNA, 21 nt, Pseudomonas aeruginosa PA01
cugcuccugcaggcccugcca

SEQ ID NO: 1542852 - RNA, 14 nt, Pseudomonas aeruginosa PA01
cugcucgaggaugg

SEQ ID NO: 1542853 - RNA, 21 nt, Pseudomonas aeruginosa PA01
cugcucgauccagccggcauc

SEQ ID NO: 1542854 - RNA, 16 nt, Pseudomonas aeruginosa PA01
cugcucgaacugcucc

SEQ ID NO: 1542855 - RNA, 23 nt, Pseudomonas aeruginosa PA01
cugcuccuuucggaacagcgccu

SEQ ID NO: 1542856 - RNA, 20 nt, Pseudomonas aeruginosa PA01
cugcucgaaagccuccagca

SEQ ID NO: 1542857 - RNA, 13 nt, Pseudomonas aeruginosa PA01
cugcugcccggca

SEQ ID NO: 1542858 - RNA, 21 nt, Pseudomonas aeruginosa PA01
cugcugccgcguuccuugugc

SEQ ID NO: 1542859 - RNA, 13 nt, Pseudomonas aeruginosa PA01
cugcugcgggcgc

SEQ ID NO: 1542860 - RNA, 14 nt, Pseudomonas aeruginosa PA01
cugcugcgggcgcu

SEQ ID NO: 1542861 - RNA, 15 nt, Pseudomonas aeruginosa PA01
cugcugcgccuggcc

SEQ ID NO: 1542862 - RNA, 21 nt, Pseudomonas aeruginosa PA01
cugcugcgccuggccgcgcag

SEQ ID NO: 1542863 - RNA, 14 nt, Pseudomonas aeruginosa PA01
cugcggcggcaggu

SEQ ID NO: 1542864 - RNA, 21 nt, Pseudomonas aeruginosa PA01
cugcggcgccuagacccuggg

SEQ ID NO: 1542865 - RNA, 14 nt, Pseudomonas aeruginosa PA01
cugcggcuugccca

SEQ ID NO: 1542866 - RNA, 16 nt, Pseudomonas aeruginosa PA01
cugcggugucccuucu

SEQ ID NO: 1542867 - RNA, 17 nt, Pseudomonas aeruginosa PA01
cugcggugucccuucuu

SEQ ID NO: 1542868 - RNA, 19 nt, Pseudomonas aeruginosa PA01
cugcggugucccuucuuuu

SEQ ID NO: 1542869 - RNA, 16 nt, Pseudomonas aeruginosa PA01
cugcgcguguaccccc

SEQ ID NO: 1542870 - RNA, 19 nt, Pseudomonas aeruginosa PA01
cugcgcguguacccccacc

SEQ ID NO: 1542871 - RNA, 20 nt, Pseudomonas aeruginosa PA01
cugcgcguugcagcgccugu

SEQ ID NO: 1542872 - RNA, 23 nt, Pseudomonas aeruginosa PA01
cugcgcguugcagcgccuguucc

SEQ ID NO: 1542873 - RNA, 15 nt, Pseudomonas aeruginosa PA01
cugcgcuccaggcgg

SEQ ID NO: 1542874 - RNA, 14 nt, Pseudomonas aeruginosa PA01
cugcgcucggcgcu

SEQ ID NO: 1542875 - RNA, 21 nt, Pseudomonas aeruginosa PA01
cugcgcucggcgcucggcucc

SEQ ID NO: 1542876 - RNA, 17 nt, Pseudomonas aeruginosa PA01
cugcgcugccagcgccg

SEQ ID NO: 1542877 - RNA, 13 nt, Pseudomonas aeruginosa PA01
cugcucaccaggu

SEQ ID NO: 1542878 - RNA, 20 nt, Pseudomonas aeruginosa PA01
cugcguggguagccauggcg

SEQ ID NO: 1542879 - RNA, 15 nt, Pseudomonas aeruginosa PA01
cugcguggguagccg

SEQ ID NO: 1542880 - RNA, 16 nt, Pseudomonas aeruginosa PA01
cugcguucugcugcuu

SEQ ID NO: 1542881 - RNA, 18 nt, Pseudomonas aeruginosa PA01
cugcgguuuuccugcccc

SEQ ID NO: 1542882 - RNA, 22 nt, Pseudomonas aeruginosa PA01
cugcaugcuuuugaacaccagc

SEQ ID NO: 1542883 - RNA, 11 nt, Pseudomonas aeruginosa PA01
cugcauggcuu

SEQ ID NO: 1542884 - RNA, 18 nt, Pseudomonas aeruginosa PA01
cugcaucucuuccucgcu

SEQ ID NO: 1542885 - RNA, 17 nt, Pseudomonas aeruginosa PA01
cugcaauggggcggccg

SEQ ID NO: 1542886 - RNA, 21 nt, Pseudomonas aeruginosa PA01
cugcaaucgcugccggucagg

SEQ ID NO: 1542887 - RNA, 22 nt, Pseudomonas aeruginosa PA01
cugcaaucgcugccggucaggc

SEQ ID NO: 1542888 - RNA, 23 nt, Pseudomonas aeruginosa PA01
cugcaaucgcugccggucaggcu

SEQ ID NO: 1542889 - RNA, 23 nt, Pseudomonas aeruginosa PA01
cugcagguggcguugcagggugc

SEQ ID NO: 1542890 - RNA, 17 nt, Pseudomonas aeruginosa PA01
cugcagguuggcgugca

SEQ ID NO: 1542891 - RNA, 23 nt, Pseudomonas aeruginosa PA01
cugcagguagcgcugcgcccgcu

SEQ ID NO: 1542892 - RNA, 20 nt, Pseudomonas aeruginosa PA01
cugcccgaccgguuccagcg

SEQ ID NO: 1542893 - RNA, 24 nt, Pseudomonas aeruginosa PA01
cugcccgaccgguuccagcggccg

SEQ ID NO: 1542894 - RNA, 18 nt, Pseudomonas aeruginosa PA01
cugcccgcucggggcauc

SEQ ID NO: 1542895 - RNA, 17 nt, Pseudomonas aeruginosa PA01
cugcccggagcggcugc

SEQ ID NO: 1542896 - RNA, 15 nt, Pseudomonas aeruginosa PA01
cugcccgcgucccau

SEQ ID NO: 1542897 - RNA, 21 nt, Pseudomonas aeruginosa PA01
cugcccgccggcgcccugggc

SEQ ID NO: 1542898 - RNA, 21 nt, Pseudomonas aeruginosa PA01
cugcccggcauaggcgccagc

SEQ ID NO: 1542899 - RNA, 17 nt, Pseudomonas aeruginosa PA01
cugccgaugggccuuca

SEQ ID NO: 1542900 - RNA, 17 nt, Pseudomonas aeruginosa PA01
cugccgauggucucucu

SEQ ID NO: 1542901 - RNA, 21 nt, Pseudomonas aeruginosa PA01
cugccccacuuccggcccggc

SEQ ID NO: 1542902 - RNA, 15 nt, Pseudomonas aeruginosa PA01
cugcccagcgccgcc

SEQ ID NO: 1542903 - RNA, 22 nt, Pseudomonas aeruginosa PA01
cugcccagcgccgccagcaggu

SEQ ID NO: 1542904 - RNA, 14 nt, Pseudomonas aeruginosa PA01
cugcccagguagcc

SEQ ID NO: 1542905 - RNA, 19 nt, Pseudomonas aeruginosa PA01
cugcccaguugcgcggcga

SEQ ID NO: 1542906 - RNA, 22 nt, Pseudomonas aeruginosa PA01
cugcccagcccgccuuccagcu

SEQ ID NO: 1542907 - RNA, 13 nt, Pseudomonas aeruginosa PA01
cugcccagauccc

SEQ ID NO: 1542908 - RNA, 14 nt, Pseudomonas aeruginosa PA01
cugccagugcucga

SEQ ID NO: 1542909 - RNA, 16 nt, Pseudomonas aeruginosa PA01
cugccagaaggccugc

SEQ ID NO: 1542910 - RNA, 14 nt, Pseudomonas aeruginosa PA01
cugccagcaggccg

SEQ ID NO: 1542911 - RNA, 15 nt, Pseudomonas aeruginosa PA01
cugccagagcgcugc

SEQ ID NO: 1542912 - RNA, 18 nt, Pseudomonas aeruginosa PA01
cugccagaggaucggcca

SEQ ID NO: 1542913 - RNA, 20 nt, Pseudomonas aeruginosa PA01
cugccagaccgagauuggcc

SEQ ID NO: 1542914 - RNA, 14 nt, Pseudomonas aeruginosa PA01
cugccagaccgugg

SEQ ID NO: 1542915 - RNA, 17 nt, Pseudomonas aeruginosa PA01
cugccagaccguggcgc

SEQ ID NO: 1542916 - RNA, 12 nt, Pseudomonas aeruginosa PA01
cugcgcagggcg

SEQ ID NO: 1542917 - RNA, 22 nt, Pseudomonas aeruginosa PA01
cugcgcaccaugcccgcugggc

SEQ ID NO: 1542918 - RNA, 17 nt, Pseudomonas aeruginosa PA01
cugcgcagaugcggggc

SEQ ID NO: 1542919 - RNA, 18 nt, Pseudomonas aeruginosa PA01
cugcgcaucgccugggcc

SEQ ID NO: 1542920 - RNA, 20 nt, Pseudomonas aeruginosa PA01
cugcgauggaacgagcgcga

SEQ ID NO: 1542921 - RNA, 13 nt, Pseudomonas aeruginosa PA01
cugcgcaacugcc

SEQ ID NO: 1542922 - RNA, 16 nt, Pseudomonas aeruginosa PA01
cugccuuccagcaggu

SEQ ID NO: 1542923 - RNA, 23 nt, Pseudomonas aeruginosa PA01
cugcgaguugaucggcguggcgg

SEQ ID NO: 1542924 - RNA, 13 nt, Pseudomonas aeruginosa PA01
cugccgcccggcc

SEQ ID NO: 1542925 - RNA, 13 nt, Pseudomonas aeruginosa PA01
cugccgggccagc

SEQ ID NO: 1542926 - RNA, 15 nt, Pseudomonas aeruginosa PA01
cugccgggccagcuc

SEQ ID NO: 1542927 - RNA, 18 nt, Pseudomonas aeruginosa PA01
cugccgcagcgccucccg

SEQ ID NO: 1542928 - RNA, 22 nt, Pseudomonas aeruginosa PA01
cugccgccagcucauggagcaa

SEQ ID NO: 1542929 - RNA, 15 nt, Pseudomonas aeruginosa PA01
cugccgcaccgccuc

SEQ ID NO: 1542930 - RNA, 18 nt, Pseudomonas aeruginosa PA01
cugccgcaccgccucgau

SEQ ID NO: 1542931 - RNA, 15 nt, Pseudomonas aeruginosa PA01
cugccggucaggcug

SEQ ID NO: 1542932 - RNA, 23 nt, Pseudomonas aeruginosa PA01
cugcgcgaagccaggaagcggcg

SEQ ID NO: 1542933 - RNA, 13 nt, Pseudomonas aeruginosa PA01
cugcgccuggccg

SEQ ID NO: 1542934 - RNA, 18 nt, Pseudomonas aeruginosa PA01
cugcgccuggccgcgcag

SEQ ID NO: 1542935 - RNA, 19 nt, Pseudomonas aeruginosa PA01
cugcgccuggccgcgcagg

SEQ ID NO: 1542936 - RNA, 13 nt, Pseudomonas aeruginosa PA01
cugcgcgcaccag

SEQ ID NO: 1542937 - RNA, 19 nt, Pseudomonas aeruginosa PA01
cugcgcgcaccaggccucc

SEQ ID NO: 1542938 - RNA, 17 nt, Pseudomonas aeruginosa PA01
cugcgccggcucgugcg

SEQ ID NO: 1542939 - RNA, 14 nt, Pseudomonas aeruginosa PA01
cugcgccuccucgg

SEQ ID NO: 1542940 - RNA, 21 nt, Pseudomonas aeruginosa PA01
cugcgccuccucggcggccuu

SEQ ID NO: 1542941 - RNA, 22 nt, Pseudomonas aeruginosa PA01
cugcgccuccucggcggccuuu

SEQ ID NO: 1542942 - RNA, 16 nt, Pseudomonas aeruginosa PA01
cugcgccucgaccugg

SEQ ID NO: 1542943 - RNA, 14 nt, Pseudomonas aeruginosa PA01
cugcgccugcagcu

SEQ ID NO: 1542944 - RNA, 16 nt, Pseudomonas aeruginosa PA01
cugcgccugcagcucg

SEQ ID NO: 1542945 - RNA, 17 nt, Pseudomonas aeruginosa PA01
cugcgcgggugucgcga

SEQ ID NO: 1542946 - RNA, 20 nt, Pseudomonas aeruginosa PA01
cugcgcggcguucgcccugc

SEQ ID NO: 1542947 - RNA, 14 nt, Pseudomonas aeruginosa PA01
cugcgcgccucuuc

SEQ ID NO: 1542948 - RNA, 15 nt, Pseudomonas aeruginosa PA01
cugcgcgccucuucc

SEQ ID NO: 1542949 - RNA, 16 nt, Pseudomonas aeruginosa PA01
cugcgcgccucuuccu

SEQ ID NO: 1542950 - RNA, 19 nt, Pseudomonas aeruginosa PA01
cugcgcgccaucuccucgc

SEQ ID NO: 1542951 - RNA, 12 nt, Pseudomonas aeruginosa PA01
cugcgcagcuag

SEQ ID NO: 1542952 - RNA, 22 nt, Pseudomonas aeruginosa PA01
cugcgccagcaucgcaucggcg

SEQ ID NO: 1542953 - RNA, 13 nt, Pseudomonas aeruginosa PA01
cugcgccaggugu

SEQ ID NO: 1542954 - RNA, 23 nt, Pseudomonas aeruginosa PA01
cugcgccgccgucuugccgcugc

SEQ ID NO: 1542955 - RNA, 16 nt, Pseudomonas aeruginosa PA01
cugcgcccagggacgc

SEQ ID NO: 1542956 - RNA, 17 nt, Pseudomonas aeruginosa PA01
cugcgcccgcucgaccc

SEQ ID NO: 1542957 - RNA, 18 nt, Pseudomonas aeruginosa PA01
cugcgcccucaagucucc

SEQ ID NO: 1542958 - RNA, 20 nt, Pseudomonas aeruginosa PA01
cugcgcccucaagucuccag

SEQ ID NO: 1542959 - RNA, 21 nt, Pseudomonas aeruginosa PA01
cugcgcccucaagucuccagc

SEQ ID NO: 1542960 - RNA, 22 nt, Pseudomonas aeruginosa PA01
cugcgcccucaagucuccagcg

SEQ ID NO: 1542961 - RNA, 19 nt, Pseudomonas aeruginosa PA01
cuacugcgcgggcaugcac

SEQ ID NO: 1542962 - RNA, 21 nt, Pseudomonas aeruginosa PA01
cuacucgacgcugcccagccc

SEQ ID NO: 1542963 - RNA, 20 nt, Pseudomonas aeruginosa PA01
cuacgccauacugggcggcg

SEQ ID NO: 1542964 - RNA, 17 nt, Pseudomonas aeruginosa PA01
cuaacaggucaacaaga

SEQ ID NO: 1542965 - RNA, 21 nt, Pseudomonas aeruginosa PA01
cuagcggguggcaacugccgc

SEQ ID NO: 1542966 - RNA, 22 nt, Pseudomonas aeruginosa PA01
cuagcggguggcaacugccgcc

SEQ ID NO: 1542967 - RNA, 17 nt, Pseudomonas aeruginosa PA01
cuaucgcuggcgcagcc

SEQ ID NO: 1542968 - RNA, 17 nt, Pseudomonas aeruginosa PA01
cuaucaggcauccccgg

SEQ ID NO: 1542969 - RNA, 17 nt, Pseudomonas aeruginosa PA01
cuaucgccaacgccacc

SEQ ID NO: 1542970 - RNA, 22 nt, Pseudomonas aeruginosa PA01
cuaucgacgguuucaggccuug

SEQ ID NO: 1542971 - RNA, 13 nt, Pseudomonas aeruginosa PA01
cuauccgccgcua

SEQ ID NO: 1542972 - RNA, 13 nt, Pseudomonas aeruginosa PA01
cuauccuccaggc

SEQ ID NO: 1542973 - RNA, 21 nt, Pseudomonas aeruginosa PA01
cucacgcaccucgucgagcag

SEQ ID NO: 1542974 - RNA, 18 nt, Pseudomonas aeruginosa PA01
cucacuccgucuccagca

SEQ ID NO: 1542975 - RNA, 13 nt, Pseudomonas aeruginosa PA01
cucaccgccaccc

SEQ ID NO: 1542976 - RNA, 14 nt, Pseudomonas aeruginosa PA01
cucaccgccacccc

SEQ ID NO: 1542977 - RNA, 21 nt, Pseudomonas aeruginosa PA01
cucaccgccaccccgccggcg

SEQ ID NO: 1542978 - RNA, 21 nt, Pseudomonas aeruginosa PA01
cucaacgaccgcccaggcugc

SEQ ID NO: 1542979 - RNA, 15 nt, Pseudomonas aeruginosa PA01
cucaagcaagcgauc

SEQ ID NO: 1542980 - RNA, 12 nt, Pseudomonas aeruginosa PA01
cucaagucucca

SEQ ID NO: 1542981 - RNA, 17 nt, Pseudomonas aeruginosa PA01
cucaagggcuggcaggu

SEQ ID NO: 1542982 - RNA, 15 nt, Pseudomonas aeruginosa PA01
cucaagacggcccgc

SEQ ID NO: 1542983 - RNA, 21 nt, Pseudomonas aeruginosa PA01
cucaacugguuggccgccugg

SEQ ID NO: 1542984 - RNA, 13 nt, Pseudomonas aeruginosa PA01
cucaacggcgugc

SEQ ID NO: 1542985 - RNA, 13 nt, Pseudomonas aeruginosa PA01
cucaucaggcugc

SEQ ID NO: 1542986 - RNA, 15 nt, Pseudomonas aeruginosa PA01
cucaucaggcugccg

SEQ ID NO: 1542987 - RNA, 20 nt, Pseudomonas aeruginosa PA01
cucaucaggcugccgagcag

SEQ ID NO: 1542988 - RNA, 19 nt, Pseudomonas aeruginosa PA01
cucauaggucagguacagg

SEQ ID NO: 1542989 - RNA, 16 nt, Pseudomonas aeruginosa PA01
cucauagcucagcugg

SEQ ID NO: 1542990 - RNA, 17 nt, Pseudomonas aeruginosa PA01
cucauagcucagcugga

SEQ ID NO: 1542991 - RNA, 21 nt, Pseudomonas aeruginosa PA01
cucaugcccagcuucaccggu

SEQ ID NO: 1542992 - RNA, 22 nt, Pseudomonas aeruginosa PA01
cucaugagauccgccagcagac

SEQ ID NO: 1542993 - RNA, 18 nt, Pseudomonas aeruginosa PA01
cucaugaccgccgcucau

SEQ ID NO: 1542994 - RNA, 23 nt, Pseudomonas aeruginosa PA01
cucaucuucucguucagcgcgaa

SEQ ID NO: 1542995 - RNA, 19 nt, Pseudomonas aeruginosa PA01
cucaucgcccaugaaaaag

SEQ ID NO: 1542996 - RNA, 16 nt, Pseudomonas aeruginosa PA01
cucaucggcgacaccc

SEQ ID NO: 1542997 - RNA, 17 nt, Pseudomonas aeruginosa PA01
cucagucgguagagcaa

SEQ ID NO: 1542998 - RNA, 17 nt, Pseudomonas aeruginosa PA01
cucagucgguagagcag

SEQ ID NO: 1542999 - RNA, 13 nt, Pseudomonas aeruginosa PA01
cucagugcgggca

SEQ ID NO: 1543000 - RNA, 20 nt, Pseudomonas aeruginosa PA01
cucaguggaucguugaacug

SEQ ID NO: 1543001 - RNA, 15 nt, Pseudomonas aeruginosa PA01
cucauagcucagcug

SEQ ID NO: 1543002 - RNA, 16 nt, Pseudomonas aeruginosa PA01
cucaggggugcagccc

SEQ ID NO: 1543003 - RNA, 21 nt, Pseudomonas aeruginosa PA01
cucagggaaaucgguugcgac

SEQ ID NO: 1543004 - RNA, 12 nt, Pseudomonas aeruginosa PA01
cucagggccgcg

SEQ ID NO: 1543005 - RNA, 15 nt, Pseudomonas aeruginosa PA01
cucagaccacgcccu

SEQ ID NO: 1543006 - RNA, 16 nt, Pseudomonas aeruginosa PA01
cucagaagucccagcg

SEQ ID NO: 1543007 - RNA, 20 nt, Pseudomonas aeruginosa PA01
cuccgccccggcaagcgccg

SEQ ID NO: 1543008 - RNA, 21 nt, Pseudomonas aeruginosa PA01
cuccgccacccguuccuugcg

SEQ ID NO: 1543009 - RNA, 13 nt, Pseudomonas aeruginosa PA01
cuccgccagccag

SEQ ID NO: 1543010 - RNA, 19 nt, Pseudomonas aeruginosa PA01
cuccgccagccccaggccg

SEQ ID NO: 1543011 - RNA, 21 nt, Pseudomonas aeruginosa PA01
cuccgccagcuuguccgccgg

SEQ ID NO: 1543012 - RNA, 20 nt, Pseudomonas aeruginosa PA01
cuccgccaggaccuccugca

SEQ ID NO: 1543013 - RNA, 14 nt, Pseudomonas aeruginosa PA01
cuccgccaggccgc

SEQ ID NO: 1543014 - RNA, 18 nt, Pseudomonas aeruginosa PA01
cuccgccaggccgcgcag

SEQ ID NO: 1543015 - RNA, 22 nt, Pseudomonas aeruginosa PA01
cuccgccaggucgauccccaac

SEQ ID NO: 1543016 - RNA, 14 nt, Pseudomonas aeruginosa PA01
cucccuucagggag

SEQ ID NO: 1543017 - RNA, 23 nt, Pseudomonas aeruginosa PA01
cucccuggcggauaucgcgccgc

SEQ ID NO: 1543018 - RNA, 15 nt, Pseudomonas aeruginosa PA01
cuccggaucgcgcaa

SEQ ID NO: 1543019 - RNA, 22 nt, Pseudomonas aeruginosa PA01
cuccgcggagaggaucagcgaa

SEQ ID NO: 1543020 - RNA, 16 nt, Pseudomonas aeruginosa PA01
cuccgcggccggcuuc

SEQ ID NO: 1543021 - RNA, 16 nt, Pseudomonas aeruginosa PA01
cuccgcgccacgcucu

SEQ ID NO: 1543022 - RNA, 15 nt, Pseudomonas aeruginosa PA01
cuccgccugaccgcu

SEQ ID NO: 1543023 - RNA, 22 nt, Pseudomonas aeruginosa PA01
cuccgcgauguccccggccagc

SEQ ID NO: 1543024 - RNA, 13 nt, Pseudomonas aeruginosa PA01
cuccgccgggggu

SEQ ID NO: 1543025 - RNA, 21 nt, Pseudomonas aeruginosa PA01
cuccgccgcgugcgcgcccuc

SEQ ID NO: 1543026 - RNA, 24 nt, Pseudomonas aeruginosa PA01
cuccgccgcuuccgccggcgccgc

SEQ ID NO: 1543027 - RNA, 15 nt, Pseudomonas aeruginosa PA01
cucccugaagggaga

SEQ ID NO: 1543028 - RNA, 17 nt, Pseudomonas aeruginosa PA01
cucccugaagggagagg

SEQ ID NO: 1543029 - RNA, 21 nt, Pseudomonas aeruginosa PA01
cucccugaagggagagggaac

SEQ ID NO: 1543030 - RNA, 23 nt, Pseudomonas aeruginosa PA01
cucccugaagggagagggaacca

SEQ ID NO: 1543031 - RNA, 16 nt, Pseudomonas aeruginosa PA01
cucccgccccuccagu

SEQ ID NO: 1543032 - RNA, 14 nt, Pseudomonas aeruginosa PA01
cucccgcaggcgcu

SEQ ID NO: 1543033 - RNA, 17 nt, Pseudomonas aeruginosa PA01
cucccgcaaccugccag

SEQ ID NO: 1543034 - RNA, 22 nt, Pseudomonas aeruginosa PA01
cucccgaggcgaucgccgcggc

SEQ ID NO: 1543035 - RNA, 21 nt, Pseudomonas aeruginosa PA01
cucccaggcaacggagcuggu

SEQ ID NO: 1543036 - RNA, 17 nt, Pseudomonas aeruginosa PA01
cuccccuggagcccccg

SEQ ID NO: 1543037 - RNA, 20 nt, Pseudomonas aeruginosa PA01
cucccagaagucgcuggccu

SEQ ID NO: 1543038 - RNA, 19 nt, Pseudomonas aeruginosa PA01
cucccacagucgaugacga

SEQ ID NO: 1543039 - RNA, 22 nt, Pseudomonas aeruginosa PA01
cucccaacagucgucgcgcagc

SEQ ID NO: 1543040 - RNA, 21 nt, Pseudomonas aeruginosa PA01
cucccaccgcuuucagcgccg

SEQ ID NO: 1543041 - RNA, 17 nt, Pseudomonas aeruginosa PA01
cuccaucucgcggcgga

SEQ ID NO: 1543042 - RNA, 17 nt, Pseudomonas aeruginosa PA01
cuccagcgucugccgcu

SEQ ID NO: 1543043 - RNA, 15 nt, Pseudomonas aeruginosa PA01
cuccagcgccgccuc

SEQ ID NO: 1543044 - RNA, 12 nt, Pseudomonas aeruginosa PA01
cuccagcggcuu

SEQ ID NO: 1543045 - RNA, 20 nt, Pseudomonas aeruginosa PA01
cuccagcggaaucgcgcccu

SEQ ID NO: 1543046 - RNA, 20 nt, Pseudomonas aeruginosa PA01
cuccagcugcgccugcagcu

SEQ ID NO: 1543047 - RNA, 17 nt, Pseudomonas aeruginosa PA01
cuccaggcccauccugg

SEQ ID NO: 1543048 - RNA, 19 nt, Pseudomonas aeruginosa PA01
cuccaggaucgccuccacc

SEQ ID NO: 1543049 - RNA, 21 nt, Pseudomonas aeruginosa PA01
cuccaggaucgccuccaccag

SEQ ID NO: 1543050 - RNA, 15 nt, Pseudomonas aeruginosa PA01
cucauguugcgggcu

SEQ ID NO: 1543051 - RNA, 16 nt, Pseudomonas aeruginosa PA01
cucauggcgucaacga

SEQ ID NO: 1543052 - RNA, 16 nt, Pseudomonas aeruginosa PA01
cuccaguucguugacc

SEQ ID NO: 1543053 - RNA, 23 nt, Pseudomonas aeruginosa PA01
cuccagggcgaauaccagugccg

SEQ ID NO: 1543054 - RNA, 17 nt, Pseudomonas aeruginosa PA01
cuccaggcucagggucu

SEQ ID NO: 1543055 - RNA, 17 nt, Pseudomonas aeruginosa PA01
cuccaggcucuucagca

SEQ ID NO: 1543056 - RNA, 13 nt, Pseudomonas aeruginosa PA01
cuccaggcugugg

SEQ ID NO: 1543057 - RNA, 16 nt, Pseudomonas aeruginosa PA01
cuccaggcuuugcggc

SEQ ID NO: 1543058 - RNA, 21 nt, Pseudomonas aeruginosa PA01
cuccagggagcgcucgcgcag

SEQ ID NO: 1543059 - RNA, 14 nt, Pseudomonas aeruginosa PA01
cuccaggccgccgg

SEQ ID NO: 1543060 - RNA, 14 nt, Pseudomonas aeruginosa PA01
cuccaggcgcgccu

SEQ ID NO: 1543061 - RNA, 19 nt, Pseudomonas aeruginosa PA01
cuccaggcgcgccuggauc

SEQ ID NO: 1543062 - RNA, 22 nt, Pseudomonas aeruginosa PA01
cuccaggucggucggcggcggu

SEQ ID NO: 1543063 - RNA, 20 nt, Pseudomonas aeruginosa PA01
cuccaggugcacggccaggc

SEQ ID NO: 1543064 - RNA, 19 nt, Pseudomonas aeruginosa PA01
cuccaggucgaacagcggc

SEQ ID NO: 1543065 - RNA, 13 nt, Pseudomonas aeruginosa PA01
cuccagguucggc

SEQ ID NO: 1543066 - RNA, 17 nt, Pseudomonas aeruginosa PA01
cuccugcacauagugga

SEQ ID NO: 1543067 - RNA, 11 nt, Pseudomonas aeruginosa PA01
cuccugccgcg

SEQ ID NO: 1543068 - RNA, 14 nt, Pseudomonas aeruginosa PA01
cuccugcgccggcu

SEQ ID NO: 1543069 - RNA, 21 nt, Pseudomonas aeruginosa PA01
cuccugggccugucgggggcu

SEQ ID NO: 1543070 - RNA, 20 nt, Pseudomonas aeruginosa PA01
cuccuggggaaucugcgcca

SEQ ID NO: 1543071 - RNA, 19 nt, Pseudomonas aeruginosa PA01
cuccugggucgacugcugg

SEQ ID NO: 1543072 - RNA, 24 nt, Pseudomonas aeruginosa PA01
cuccuggugcggcaccagccaggu

SEQ ID NO: 1543073 - RNA, 20 nt, Pseudomonas aeruginosa PA01
cuccuggaggacgcgggcuu

SEQ ID NO: 1543074 - RNA, 18 nt, Pseudomonas aeruginosa PA01
cuccuggauacgcucggc

SEQ ID NO: 1543075 - RNA, 13 nt, Pseudomonas aeruginosa PA01
cuccuggcaggcu

SEQ ID NO: 1543076 - RNA, 22 nt, Pseudomonas aeruginosa PA01
cuccuggaugcuccgcgccuca

SEQ ID NO: 1543077 - RNA, 23 nt, Pseudomonas aeruginosa PA01
cuccugcucgauccagccggcau

SEQ ID NO: 1543078 - RNA, 17 nt, Pseudomonas aeruginosa PA01
cuccucggcagcgcugg

SEQ ID NO: 1543079 - RNA, 18 nt, Pseudomonas aeruginosa PA01
cuccucgcgcugcccggc

SEQ ID NO: 1543080 - RNA, 12 nt, Pseudomonas aeruginosa PA01
cuccucgcgcag

SEQ ID NO: 1543081 - RNA, 18 nt, Pseudomonas aeruginosa PA01
cuccucgcgcagcggcuc

SEQ ID NO: 1543082 - RNA, 22 nt, Pseudomonas aeruginosa PA01
cuccucggccgacaggcuggug

SEQ ID NO: 1543083 - RNA, 16 nt, Pseudomonas aeruginosa PA01
cuccucggccugggcg

SEQ ID NO: 1543084 - RNA, 17 nt, Pseudomonas aeruginosa PA01
cuccucggcguggcuac

SEQ ID NO: 1543085 - RNA, 16 nt, Pseudomonas aeruginosa PA01
cuccucggcggcuucc

SEQ ID NO: 1543086 - RNA, 16 nt, Pseudomonas aeruginosa PA01
cuccucguaggcgucc

SEQ ID NO: 1543087 - RNA, 22 nt, Pseudomonas aeruginosa PA01
cuccucguaggcguccuggcga

SEQ ID NO: 1543088 - RNA, 19 nt, Pseudomonas aeruginosa PA01
cuccucgauaaacggcgcu

SEQ ID NO: 1543089 - RNA, 13 nt, Pseudomonas aeruginosa PA01
cuccucgucuucc

SEQ ID NO: 1543090 - RNA, 15 nt, Pseudomonas aeruginosa PA01
cuccucuaccaggcg

SEQ ID NO: 1543091 - RNA, 13 nt, Pseudomonas aeruginosa PA01
cuccucugccugc

SEQ ID NO: 1543092 - RNA, 19 nt, Pseudomonas aeruginosa PA01
cuccucugccugcgcccuc

SEQ ID NO: 1543093 - RNA, 18 nt, Pseudomonas aeruginosa PA01
cuccggcagcacccgcac

SEQ ID NO: 1543094 - RNA, 22 nt, Pseudomonas aeruginosa PA01
cuccggcaggcgcuccuggugc

SEQ ID NO: 1543095 - RNA, 22 nt, Pseudomonas aeruginosa PA01
cuccggcaguuuguucugugug

SEQ ID NO: 1543096 - RNA, 19 nt, Pseudomonas aeruginosa PA01
cuccggcauaccgcccguc

SEQ ID NO: 1543097 - RNA, 18 nt, Pseudomonas aeruginosa PA01
cuccucgauccgcugggc

SEQ ID NO: 1543098 - RNA, 12 nt, Pseudomonas aeruginosa PA01
cuccucgaugaa

SEQ ID NO: 1543099 - RNA, 14 nt, Pseudomonas aeruginosa PA01
cuccucgccgccga

SEQ ID NO: 1543100 - RNA, 21 nt, Pseudomonas aeruginosa PA01
cuccucgccgccgaccgggcg

SEQ ID NO: 1543101 - RNA, 19 nt, Pseudomonas aeruginosa PA01
cuccggcgccaggccggag

SEQ ID NO: 1543102 - RNA, 22 nt, Pseudomonas aeruginosa PA01
cuccuuggcuggccagcccugg

SEQ ID NO: 1543103 - RNA, 13 nt, Pseudomonas aeruginosa PA01
cuccuuucccagc

SEQ ID NO: 1543104 - RNA, 14 nt, Pseudomonas aeruginosa PA01
cuccuuucccagcg

SEQ ID NO: 1543105 - RNA, 15 nt, Pseudomonas aeruginosa PA01
cuccugugccuuggc

SEQ ID NO: 1543106 - RNA, 14 nt, Pseudomonas aeruginosa PA01
cuccuguugcuggc

SEQ ID NO: 1543107 - RNA, 17 nt, Pseudomonas aeruginosa PA01
cuccuucgagccuggcc

SEQ ID NO: 1543108 - RNA, 22 nt, Pseudomonas aeruginosa PA01
cuccuucgagccuggccaggcg

SEQ ID NO: 1543109 - RNA, 12 nt, Pseudomonas aeruginosa PA01
cuccuugaaggc

SEQ ID NO: 1543110 - RNA, 15 nt, Pseudomonas aeruginosa PA01
cucgagcaccaccac

SEQ ID NO: 1543111 - RNA, 18 nt, Pseudomonas aeruginosa PA01
cucgacggcgggagcggc

SEQ ID NO: 1543112 - RNA, 19 nt, Pseudomonas aeruginosa PA01
cucgacgcugcccagcccg

SEQ ID NO: 1543113 - RNA, 14 nt, Pseudomonas aeruginosa PA01
cucgaccagcgccg

SEQ ID NO: 1543114 - RNA, 17 nt, Pseudomonas aeruginosa PA01
cucgaccagcgccgcgg

SEQ ID NO: 1543115 - RNA, 13 nt, Pseudomonas aeruginosa PA01
cucgaccaccucg

SEQ ID NO: 1543116 - RNA, 19 nt, Pseudomonas aeruginosa PA01
cucgaucaaccccuggauc

SEQ ID NO: 1543117 - RNA, 23 nt, Pseudomonas aeruginosa PA01
cucgaucacccgcgaggccggcc

SEQ ID NO: 1543118 - RNA, 19 nt, Pseudomonas aeruginosa PA01
cucgagguucucgacccgc

SEQ ID NO: 1543119 - RNA, 18 nt, Pseudomonas aeruginosa PA01
cucgagccguuccaggcg

SEQ ID NO: 1543120 - RNA, 19 nt, Pseudomonas aeruginosa PA01
cucgagccguuccaggcgg

SEQ ID NO: 1543121 - RNA, 14 nt, Pseudomonas aeruginosa PA01
cucgagggcgaccg

SEQ ID NO: 1543122 - RNA, 16 nt, Pseudomonas aeruginosa PA01
cucgagggcgaccgcc

SEQ ID NO: 1543123 - RNA, 18 nt, Pseudomonas aeruginosa PA01
cucgagggcgaccgccag

SEQ ID NO: 1543124 - RNA, 19 nt, Pseudomonas aeruginosa PA01
cucgaggucggccuggcug

SEQ ID NO: 1543125 - RNA, 21 nt, Pseudomonas aeruginosa PA01
cucuccgucaaugcggccugc

SEQ ID NO: 1543126 - RNA, 14 nt, Pseudomonas aeruginosa PA01
cucuccgcgccgcg

SEQ ID NO: 1543127 - RNA, 15 nt, Pseudomonas aeruginosa PA01
cucuccccgcucccg

SEQ ID NO: 1543128 - RNA, 22 nt, Pseudomonas aeruginosa PA01
cucuccgagacgcugcaccgcg

SEQ ID NO: 1543129 - RNA, 20 nt, Pseudomonas aeruginosa PA01
cucucgaacaccaggcgcca

SEQ ID NO: 1543130 - RNA, 14 nt, Pseudomonas aeruginosa PA01
cucgucgcgccagg

SEQ ID NO: 1543131 - RNA, 16 nt, Pseudomonas aeruginosa PA01
cucgucgcgccaggcg

SEQ ID NO: 1543132 - RNA, 14 nt, Pseudomonas aeruginosa PA01
cucgucgcccuuca

SEQ ID NO: 1543133 - RNA, 18 nt, Pseudomonas aeruginosa PA01
cucgucgccgacccugca

SEQ ID NO: 1543134 - RNA, 20 nt, Pseudomonas aeruginosa PA01
cucgucgccgacccugcacc

SEQ ID NO: 1543135 - RNA, 22 nt, Pseudomonas aeruginosa PA01
cucgucgccgacccugcacccu

SEQ ID NO: 1543136 - RNA, 16 nt, Pseudomonas aeruginosa PA01
cucgucgccgcccggc

SEQ ID NO: 1543137 - RNA, 13 nt, Pseudomonas aeruginosa PA01
cucgucgccgccg

SEQ ID NO: 1543138 - RNA, 19 nt, Pseudomonas aeruginosa PA01
cucuaucagggucuucagg

SEQ ID NO: 1543139 - RNA, 18 nt, Pseudomonas aeruginosa PA01
cucugcaccgucauggug

SEQ ID NO: 1543140 - RNA, 20 nt, Pseudomonas aeruginosa PA01
cucugccggugugccgucag

SEQ ID NO: 1543141 - RNA, 13 nt, Pseudomonas aeruginosa PA01
cucugcuccagca

SEQ ID NO: 1543142 - RNA, 22 nt, Pseudomonas aeruginosa PA01
cucugcugaauucccgcuccag

SEQ ID NO: 1543143 - RNA, 15 nt, Pseudomonas aeruginosa PA01
cucugcgccaggcgg

SEQ ID NO: 1543144 - RNA, 19 nt, Pseudomonas aeruginosa PA01
cucucgacguaccgccugc

SEQ ID NO: 1543145 - RNA, 18 nt, Pseudomonas aeruginosa PA01
cucucgaggacgugcacc

SEQ ID NO: 1543146 - RNA, 13 nt, Pseudomonas aeruginosa PA01
cucucgcgcagca

SEQ ID NO: 1543147 - RNA, 20 nt, Pseudomonas aeruginosa PA01
cucucgcgcagcaggaucca

SEQ ID NO: 1543148 - RNA, 14 nt, Pseudomonas aeruginosa PA01
cucucgccgccuuc

SEQ ID NO: 1543149 - RNA, 15 nt, Pseudomonas aeruginosa PA01
cucucgccggccugg

SEQ ID NO: 1543150 - RNA, 15 nt, Pseudomonas aeruginosa PA01
cucucugcauggcac

SEQ ID NO: 1543151 - RNA, 12 nt, Pseudomonas aeruginosa PA01
cucucucugcau

SEQ ID NO: 1543152 - RNA, 20 nt, Pseudomonas aeruginosa PA01
cucucguugugggacgaagc

SEQ ID NO: 1543153 - RNA, 18 nt, Pseudomonas aeruginosa PA01
cucggcacucagccagcg

SEQ ID NO: 1543154 - RNA, 13 nt, Pseudomonas aeruginosa PA01
cucggcacgcgug

SEQ ID NO: 1543155 - RNA, 23 nt, Pseudomonas aeruginosa PA01
cucggcauccucgccccgccggg

SEQ ID NO: 1543156 - RNA, 18 nt, Pseudomonas aeruginosa PA01
cucggcaucgaccaugcc

SEQ ID NO: 1543157 - RNA, 12 nt, Pseudomonas aeruginosa PA01
cucggcagggcg

SEQ ID NO: 1543158 - RNA, 18 nt, Pseudomonas aeruginosa PA01
cucggcagggcgcccgcc

SEQ ID NO: 1543159 - RNA, 19 nt, Pseudomonas aeruginosa PA01
cucggcagggcgcccgccc

SEQ ID NO: 1543160 - RNA, 20 nt, Pseudomonas aeruginosa PA01
cucggccagccagggcagca

SEQ ID NO: 1543161 - RNA, 21 nt, Pseudomonas aeruginosa PA01
cucggccagccagggcagcag

SEQ ID NO: 1543162 - RNA, 22 nt, Pseudomonas aeruginosa PA01
cucggccaggcauuccuccagg

SEQ ID NO: 1543163 - RNA, 16 nt, Pseudomonas aeruginosa PA01
cucggccaggcgccag

SEQ ID NO: 1543164 - RNA, 18 nt, Pseudomonas aeruginosa PA01
cucggccaggcgccaggg

SEQ ID NO: 1543165 - RNA, 13 nt, Pseudomonas aeruginosa PA01
cucggccagcucg

SEQ ID NO: 1543166 - RNA, 13 nt, Pseudomonas aeruginosa PA01
cucggccagccag

SEQ ID NO: 1543167 - RNA, 12 nt, Pseudomonas aeruginosa PA01
cucggccagcca

SEQ ID NO: 1543168 - RNA, 21 nt, Pseudomonas aeruginosa PA01
cucggccgugugccugagcug

SEQ ID NO: 1543169 - RNA, 15 nt, Pseudomonas aeruginosa PA01
cucggccgccaggcg

SEQ ID NO: 1543170 - RNA, 11 nt, Pseudomonas aeruginosa PA01
cucggccaggg

SEQ ID NO: 1543171 - RNA, 14 nt, Pseudomonas aeruginosa PA01
cucggcccgggccu

SEQ ID NO: 1543172 - RNA, 23 nt, Pseudomonas aeruginosa PA01
cucgaucagugcaucggccgcca

SEQ ID NO: 1543173 - RNA, 16 nt, Pseudomonas aeruginosa PA01
cucgaucaucugcggg

SEQ ID NO: 1543174 - RNA, 14 nt, Pseudomonas aeruginosa PA01
cucgaucagcgccg

SEQ ID NO: 1543175 - RNA, 16 nt, Pseudomonas aeruginosa PA01
cucgaucagcgcggcc

SEQ ID NO: 1543176 - RNA, 20 nt, Pseudomonas aeruginosa PA01
cucgaucaggccuuccggga

SEQ ID NO: 1543177 - RNA, 16 nt, Pseudomonas aeruginosa PA01
cucgaugaacagugcg

SEQ ID NO: 1543178 - RNA, 20 nt, Pseudomonas aeruginosa PA01
cucgcgguucugcuccuggg

SEQ ID NO: 1543179 - RNA, 20 nt, Pseudomonas aeruginosa PA01
cucgcguucaucgucggcag

SEQ ID NO: 1543180 - RNA, 14 nt, Pseudomonas aeruginosa PA01
cucgcguuccagca

SEQ ID NO: 1543181 - RNA, 17 nt, Pseudomonas aeruginosa PA01
cucgcguagcugggcga

SEQ ID NO: 1543182 - RNA, 22 nt, Pseudomonas aeruginosa PA01
cucggaccagaggcugacccgc

SEQ ID NO: 1543183 - RNA, 19 nt, Pseudomonas aeruginosa PA01
cucggacugaaaccccacc

SEQ ID NO: 1543184 - RNA, 15 nt, Pseudomonas aeruginosa PA01
cucggagaacagcag

SEQ ID NO: 1543185 - RNA, 13 nt, Pseudomonas aeruginosa PA01
cucgcuccagagg

SEQ ID NO: 1543186 - RNA, 17 nt, Pseudomonas aeruginosa PA01
cucgcuccagaggaaca

SEQ ID NO: 1543187 - RNA, 16 nt, Pseudomonas aeruginosa PA01
cucgcuccgagcaggc

SEQ ID NO: 1543188 - RNA, 16 nt, Pseudomonas aeruginosa PA01
cucgcuccuccgggcg

SEQ ID NO: 1543189 - RNA, 23 nt, Pseudomonas aeruginosa PA01
cucgcuacggaaggucgccgggc

SEQ ID NO: 1543190 - RNA, 22 nt, Pseudomonas aeruginosa PA01
cucgucaucguccagcucggcc

SEQ ID NO: 1543191 - RNA, 17 nt, Pseudomonas aeruginosa PA01
cucgucacccgcgccug

SEQ ID NO: 1543192 - RNA, 21 nt, Pseudomonas aeruginosa PA01
cucguccagcaggcccagcca

SEQ ID NO: 1543193 - RNA, 14 nt, Pseudomonas aeruginosa PA01
cucgucgccaugcg

SEQ ID NO: 1543194 - RNA, 18 nt, Pseudomonas aeruginosa PA01
cucgucgccaugcggcag

SEQ ID NO: 1543195 - RNA, 21 nt, Pseudomonas aeruginosa PA01
cucgucgaugaucugcauggc

SEQ ID NO: 1543196 - RNA, 21 nt, Pseudomonas aeruginosa PA01
cucgucgacgcucagcacccu

SEQ ID NO: 1543197 - RNA, 22 nt, Pseudomonas aeruginosa PA01
cucguccuccucgaucacccgc

SEQ ID NO: 1543198 - RNA, 15 nt, Pseudomonas aeruginosa PA01
cucguccuuggugcu

SEQ ID NO: 1543199 - RNA, 22 nt, Pseudomonas aeruginosa PA01
cucguagcggucgugcagcagc

SEQ ID NO: 1543200 - RNA, 15 nt, Pseudomonas aeruginosa PA01
cucguagcagccacg

SEQ ID NO: 1543201 - RNA, 19 nt, Pseudomonas aeruginosa PA01
cucggugauaccgccggcg

SEQ ID NO: 1543202 - RNA, 21 nt, Pseudomonas aeruginosa PA01
cucguagagauauucccgcga

SEQ ID NO: 1543203 - RNA, 21 nt, Pseudomonas aeruginosa PA01
cucggcgaggaacagcaccag

SEQ ID NO: 1543204 - RNA, 15 nt, Pseudomonas aeruginosa PA01
cucggcgaggccggc

SEQ ID NO: 1543205 - RNA, 15 nt, Pseudomonas aeruginosa PA01
cucggcugccgccag

SEQ ID NO: 1543206 - RNA, 14 nt, Pseudomonas aeruginosa PA01
cucggcugcuugcc

SEQ ID NO: 1543207 - RNA, 17 nt, Pseudomonas aeruginosa PA01
cucggcuuccaucaccg

SEQ ID NO: 1543208 - RNA, 20 nt, Pseudomonas aeruginosa PA01
cucggcuucguccugcugcu

SEQ ID NO: 1543209 - RNA, 22 nt, Pseudomonas aeruginosa PA01
cucggcuugacuggcaguccag

SEQ ID NO: 1543210 - RNA, 15 nt, Pseudomonas aeruginosa PA01
cucggcgacgaggac

SEQ ID NO: 1543211 - RNA, 20 nt, Pseudomonas aeruginosa PA01
cucggccugcgucgcaucca

SEQ ID NO: 1543212 - RNA, 20 nt, Pseudomonas aeruginosa PA01
cucggccugcugcgccggca

SEQ ID NO: 1543213 - RNA, 21 nt, Pseudomonas aeruginosa PA01
cucggccuggugcaccuggcg

SEQ ID NO: 1543214 - RNA, 17 nt, Pseudomonas aeruginosa PA01
cucggcgaacgacagca

SEQ ID NO: 1543215 - RNA, 17 nt, Pseudomonas aeruginosa PA01
cucggccuugagcgccg

SEQ ID NO: 1543216 - RNA, 20 nt, Pseudomonas aeruginosa PA01
cucggccuuguccgcgcgcu

SEQ ID NO: 1543217 - RNA, 16 nt, Pseudomonas aeruginosa PA01
cucgggcaccagcacg

SEQ ID NO: 1543218 - RNA, 17 nt, Pseudomonas aeruginosa PA01
cucgggccaugagcagg

SEQ ID NO: 1543219 - RNA, 22 nt, Pseudomonas aeruginosa PA01
cucgggccaugagcagggcgga

SEQ ID NO: 1543220 - RNA, 21 nt, Pseudomonas aeruginosa PA01
cucgggcggaucgagcagcgg

SEQ ID NO: 1543221 - RNA, 18 nt, Pseudomonas aeruginosa PA01
cucggucaggcgcuggug

SEQ ID NO: 1543222 - RNA, 16 nt, Pseudomonas aeruginosa PA01
cucggucagcggcgca

SEQ ID NO: 1543223 - RNA, 22 nt, Pseudomonas aeruginosa PA01
cucggucagcggcgcagccucg

SEQ ID NO: 1543224 - RNA, 14 nt, Pseudomonas aeruginosa PA01
cucggucagcuccc

SEQ ID NO: 1543225 - RNA, 17 nt, Pseudomonas aeruginosa PA01
cucggugaccaccuuga

SEQ ID NO: 1543226 - RNA, 22 nt, Pseudomonas aeruginosa PA01
cgucgaagccggauucgcgcag

SEQ ID NO: 1543227 - RNA, 13 nt, Pseudomonas aeruginosa PA01
cgucgaccgccug

SEQ ID NO: 1543228 - RNA, 20 nt, Pseudomonas aeruginosa PA01
cgucgaccgccugccagacc

SEQ ID NO: 1543229 - RNA, 14 nt, Pseudomonas aeruginosa PA01
cgucgaccugcggg

SEQ ID NO: 1543230 - RNA, 18 nt, Pseudomonas aeruginosa PA01
cgucgaccaucaccagcg

SEQ ID NO: 1543231 - RNA, 18 nt, Pseudomonas aeruginosa PA01
cguccuggucgcugaggc

SEQ ID NO: 1543232 - RNA, 16 nt, Pseudomonas aeruginosa PA01
cgucgaaacgggcgcu

SEQ ID NO: 1543233 - RNA, 14 nt, Pseudomonas aeruginosa PA01
cguccuugcccggc

SEQ ID NO: 1543234 - RNA, 14 nt, Pseudomonas aeruginosa PA01
cgucgaacagcagc

SEQ ID NO: 1543235 - RNA, 18 nt, Pseudomonas aeruginosa PA01
cguccucguggcgcgccg

SEQ ID NO: 1543236 - RNA, 19 nt, Pseudomonas aeruginosa PA01
cguccucguggcgcgccgc

SEQ ID NO: 1543237 - RNA, 17 nt, Pseudomonas aeruginosa PA01
cguccucggagagcagc

SEQ ID NO: 1543238 - RNA, 21 nt, Pseudomonas aeruginosa PA01
cguccugccggugcucggccu

SEQ ID NO: 1543239 - RNA, 18 nt, Pseudomonas aeruginosa PA01
cguccugcggccgcaacc

SEQ ID NO: 1543240 - RNA, 13 nt, Pseudomonas aeruginosa PA01
cguccugcugcug

SEQ ID NO: 1543241 - RNA, 15 nt, Pseudomonas aeruginosa PA01
cguccugcugcuggc

SEQ ID NO: 1543242 - RNA, 15 nt, Pseudomonas aeruginosa PA01
cguccugcccuccug

SEQ ID NO: 1543243 - RNA, 11 nt, Pseudomonas aeruginosa PA01
cguccuggcgg

SEQ ID NO: 1543244 - RNA, 15 nt, Pseudomonas aeruginosa PA01
cgucgagcgggcggu

SEQ ID NO: 1543245 - RNA, 13 nt, Pseudomonas aeruginosa PA01
cgucgagcaccag

SEQ ID NO: 1543246 - RNA, 14 nt, Pseudomonas aeruginosa PA01
cgucgagcgcagcg

SEQ ID NO: 1543247 - RNA, 18 nt, Pseudomonas aeruginosa PA01
cgucgacgcucagcaccc

SEQ ID NO: 1543248 - RNA, 16 nt, Pseudomonas aeruginosa PA01
cgucgacgcagcgcgc

SEQ ID NO: 1543249 - RNA, 22 nt, Pseudomonas aeruginosa PA01
cgucgagggcaaaggcgcgcag

SEQ ID NO: 1543250 - RNA, 17 nt, Pseudomonas aeruginosa PA01
cgucgaggaucuucucc

SEQ ID NO: 1543251 - RNA, 19 nt, Pseudomonas aeruginosa PA01
cgucgaugaggucgcagcg

SEQ ID NO: 1543252 - RNA, 17 nt, Pseudomonas aeruginosa PA01
cguccaucgccaggcca

SEQ ID NO: 1543253 - RNA, 16 nt, Pseudomonas aeruginosa PA01
cguccaucgccgcggc

SEQ ID NO: 1543254 - RNA, 20 nt, Pseudomonas aeruginosa PA01
cguccaggguuggaagaaag

SEQ ID NO: 1543255 - RNA, 14 nt, Pseudomonas aeruginosa PA01
cguccaguagcgcc

SEQ ID NO: 1543256 - RNA, 18 nt, Pseudomonas aeruginosa PA01
cguccaguagcgccuggu

SEQ ID NO: 1543257 - RNA, 20 nt, Pseudomonas aeruginosa PA01
cguccaguagcgccugguuc

SEQ ID NO: 1543258 - RNA, 14 nt, Pseudomonas aeruginosa PA01
cguccagcgcgccc

SEQ ID NO: 1543259 - RNA, 21 nt, Pseudomonas aeruginosa PA01
cguccagcgcgcccggcgcca

SEQ ID NO: 1543260 - RNA, 15 nt, Pseudomonas aeruginosa PA01
cguccagcgcgccgc

SEQ ID NO: 1543261 - RNA, 14 nt, Pseudomonas aeruginosa PA01
cguccaggccgccu

SEQ ID NO: 1543262 - RNA, 15 nt, Pseudomonas aeruginosa PA01
cgucauaggccuugg

SEQ ID NO: 1543263 - RNA, 15 nt, Pseudomonas aeruginosa PA01
cguccagccggcgcu

SEQ ID NO: 1543264 - RNA, 15 nt, Pseudomonas aeruginosa PA01
cgucaucaggcucag

SEQ ID NO: 1543265 - RNA, 17 nt, Pseudomonas aeruginosa PA01
cguccagccgccgcugc

SEQ ID NO: 1543266 - RNA, 20 nt, Pseudomonas aeruginosa PA01
cguccguaaugcaacccgcc

SEQ ID NO: 1543267 - RNA, 15 nt, Pseudomonas aeruginosa PA01
cguccggucgcuuuu

SEQ ID NO: 1543268 - RNA, 15 nt, Pseudomonas aeruginosa PA01
cguccuccaggacca

SEQ ID NO: 1543269 - RNA, 20 nt, Pseudomonas aeruginosa PA01
cguccuacgcgaccggucag

SEQ ID NO: 1543270 - RNA, 21 nt, Pseudomonas aeruginosa PA01
cguccucgaugcccgccucgc

SEQ ID NO: 1543271 - RNA, 23 nt, Pseudomonas aeruginosa PA01
cguccuccuccaguuccucgcga

SEQ ID NO: 1543272 - RNA, 22 nt, Pseudomonas aeruginosa PA01
cguccuccuggaggacgcgggc

SEQ ID NO: 1543273 - RNA, 19 nt, Pseudomonas aeruginosa PA01
cguccucgaaagccgccgc

SEQ ID NO: 1543274 - RNA, 21 nt, Pseudomonas aeruginosa PA01
cguccucggcguagccggcca

SEQ ID NO: 1543275 - RNA, 17 nt, Pseudomonas aeruginosa PA01
cguccucgggaugcagu

SEQ ID NO: 1543276 - RNA, 22 nt, Pseudomonas aeruginosa PA01
cguccucggggaagcgcggcuc

SEQ ID NO: 1543277 - RNA, 18 nt, Pseudomonas aeruginosa PA01
cguccgggugccccaggc

SEQ ID NO: 1543278 - RNA, 16 nt, Pseudomonas aeruginosa PA01
cguccggcgugguggc

SEQ ID NO: 1543279 - RNA, 16 nt, Pseudomonas aeruginosa PA01
cguccggagccgggca

SEQ ID NO: 1543280 - RNA, 23 nt, Pseudomonas aeruginosa PA01
cguccggcgagaaaggcugcuuc

SEQ ID NO: 1543281 - RNA, 13 nt, Pseudomonas aeruginosa PA01
cguccggcgagca

SEQ ID NO: 1543282 - RNA, 16 nt, Pseudomonas aeruginosa PA01
cgucccacaggccggc

SEQ ID NO: 1543283 - RNA, 20 nt, Pseudomonas aeruginosa PA01
cgucccaugaccgucagcca

SEQ ID NO: 1543284 - RNA, 12 nt, Pseudomonas aeruginosa PA01
cgucccauggcg

SEQ ID NO: 1543285 - RNA, 13 nt, Pseudomonas aeruginosa PA01
cguccgcgccgcg

SEQ ID NO: 1543286 - RNA, 20 nt, Pseudomonas aeruginosa PA01
cguccgcuggccugcagcag

SEQ ID NO: 1543287 - RNA, 14 nt, Pseudomonas aeruginosa PA01
cguccgcggccugc

SEQ ID NO: 1543288 - RNA, 12 nt, Pseudomonas aeruginosa PA01
cguauuccaggg

SEQ ID NO: 1543289 - RNA, 19 nt, Pseudomonas aeruginosa PA01
cguaagucagguccuuguu

SEQ ID NO: 1543290 - RNA, 17 nt, Pseudomonas aeruginosa PA01
cguaagcggccuuuucu

SEQ ID NO: 1543291 - RNA, 12 nt, Pseudomonas aeruginosa PA01
cguagcgcagcg

SEQ ID NO: 1543292 - RNA, 15 nt, Pseudomonas aeruginosa PA01
cguagcgcagcggca

SEQ ID NO: 1543293 - RNA, 15 nt, Pseudomonas aeruginosa PA01
cguagcgcagggucg

SEQ ID NO: 1543294 - RNA, 20 nt, Pseudomonas aeruginosa PA01
cguagccgucguagcgcagc

SEQ ID NO: 1543295 - RNA, 21 nt, Pseudomonas aeruginosa PA01
cguaaucgccauuggccaggg

SEQ ID NO: 1543296 - RNA, 17 nt, Pseudomonas aeruginosa PA01
cguagcgcucgguggca

SEQ ID NO: 1543297 - RNA, 18 nt, Pseudomonas aeruginosa PA01
cguagcggucgugcagca

SEQ ID NO: 1543298 - RNA, 21 nt, Pseudomonas aeruginosa PA01
cguagcggucgugcagcagcg

SEQ ID NO: 1543299 - RNA, 22 nt, Pseudomonas aeruginosa PA01
cguagcggucgugcagcagcgc

SEQ ID NO: 1543300 - RNA, 12 nt, Pseudomonas aeruginosa PA01
cgucaccagcag

SEQ ID NO: 1543301 - RNA, 13 nt, Pseudomonas aeruginosa PA01
cgucacccgcgcc

SEQ ID NO: 1543302 - RNA, 15 nt, Pseudomonas aeruginosa PA01
cgucaagggccagga

SEQ ID NO: 1543303 - RNA, 22 nt, Pseudomonas aeruginosa PA01
cgucaagggccaggaaaucgag

SEQ ID NO: 1543304 - RNA, 12 nt, Pseudomonas aeruginosa PA01
cgucagccgcgg

SEQ ID NO: 1543305 - RNA, 23 nt, Pseudomonas aeruginosa PA01
cgucaguuccacgcggaccuugu

SEQ ID NO: 1543306 - RNA, 14 nt, Pseudomonas aeruginosa PA01
cgucagccaggcug

SEQ ID NO: 1543307 - RNA, 22 nt, Pseudomonas aeruginosa PA01
cgguggcggacugguaggacag

SEQ ID NO: 1543308 - RNA, 18 nt, Pseudomonas aeruginosa PA01
cgguggcgcccagccaga

SEQ ID NO: 1543309 - RNA, 18 nt, Pseudomonas aeruginosa PA01
cgguggcgaccaggacag

SEQ ID NO: 1543310 - RNA, 20 nt, Pseudomonas aeruginosa PA01
cgguggcgacgcgcaggccg

SEQ ID NO: 1543311 - RNA, 13 nt, Pseudomonas aeruginosa PA01
cgguggccuccug

SEQ ID NO: 1543312 - RNA, 17 nt, Pseudomonas aeruginosa PA01
cgguggcccacuccaga

SEQ ID NO: 1543313 - RNA, 12 nt, Pseudomonas aeruginosa PA01
cgguggccagga

SEQ ID NO: 1543314 - RNA, 14 nt, Pseudomonas aeruginosa PA01
cgguggccaggacg

SEQ ID NO: 1543315 - RNA, 19 nt, Pseudomonas aeruginosa PA01
cgguggcaugguguccggc

SEQ ID NO: 1543316 - RNA, 19 nt, Pseudomonas aeruginosa PA01
cgguggaccaacgggcugc

SEQ ID NO: 1543317 - RNA, 17 nt, Pseudomonas aeruginosa PA01
cgguggaggcgggcuca

SEQ ID NO: 1543318 - RNA, 19 nt, Pseudomonas aeruginosa PA01
cggugugaccuucaacggu

SEQ ID NO: 1543319 - RNA, 15 nt, Pseudomonas aeruginosa PA01
cgguguccaccacca

SEQ ID NO: 1543320 - RNA, 16 nt, Pseudomonas aeruginosa PA01
cggugucccuucuuuu

SEQ ID NO: 1543321 - RNA, 16 nt, Pseudomonas aeruginosa PA01
cgguggucuucagcac

SEQ ID NO: 1543322 - RNA, 21 nt, Pseudomonas aeruginosa PA01
cgguggucgguucgucgagga

SEQ ID NO: 1543323 - RNA, 21 nt, Pseudomonas aeruginosa PA01
cgguggugucugguuccuggu

SEQ ID NO: 1543324 - RNA, 19 nt, Pseudomonas aeruginosa PA01
cggugcgccuccaggaccu

SEQ ID NO: 1543325 - RNA, 11 nt, Pseudomonas aeruginosa PA01
cggugcucagg

SEQ ID NO: 1543326 - RNA, 19 nt, Pseudomonas aeruginosa PA01
cggugccgugggucgccuc

SEQ ID NO: 1543327 - RNA, 15 nt, Pseudomonas aeruginosa PA01
cggugccgggaagcg

SEQ ID NO: 1543328 - RNA, 21 nt, Pseudomonas aeruginosa PA01
cggugccuucccagccgaggc

SEQ ID NO: 1543329 - RNA, 18 nt, Pseudomonas aeruginosa PA01
cggugccuucggcggcgc

SEQ ID NO: 1543330 - RNA, 14 nt, Pseudomonas aeruginosa PA01
cggugccgcccggc

SEQ ID NO: 1543331 - RNA, 13 nt, Pseudomonas aeruginosa PA01
cggugccgcagac

SEQ ID NO: 1543332 - RNA, 20 nt, Pseudomonas aeruginosa PA01
cggugcagccacccagcagc

SEQ ID NO: 1543333 - RNA, 20 nt, Pseudomonas aeruginosa PA01
cggugcagaagacgcccagc

SEQ ID NO: 1543334 - RNA, 18 nt, Pseudomonas aeruginosa PA01
cggugcagaugaccagcg

SEQ ID NO: 1543335 - RNA, 17 nt, Pseudomonas aeruginosa PA01
cggugcccucgcggacg

SEQ ID NO: 1543336 - RNA, 22 nt, Pseudomonas aeruginosa PA01
cggugccauggaucaccagggu

SEQ ID NO: 1543337 - RNA, 18 nt, Pseudomonas aeruginosa PA01
cggugccauacagcgccc

SEQ ID NO: 1543338 - RNA, 18 nt, Pseudomonas aeruginosa PA01
cggugaugcgucgcacca

SEQ ID NO: 1543339 - RNA, 13 nt, Pseudomonas aeruginosa PA01
cggugaucgagcc

SEQ ID NO: 1543340 - RNA, 17 nt, Pseudomonas aeruginosa PA01
cggugaucucgcggcgc

SEQ ID NO: 1543341 - RNA, 14 nt, Pseudomonas aeruginosa PA01
cgguuucgccaccu

SEQ ID NO: 1543342 - RNA, 17 nt, Pseudomonas aeruginosa PA01
cgguuucaggccuugcu

SEQ ID NO: 1543343 - RNA, 18 nt, Pseudomonas aeruginosa PA01
cgguuucccucgagcacc

SEQ ID NO: 1543344 - RNA, 14 nt, Pseudomonas aeruginosa PA01
cgguuuccgcagcg

SEQ ID NO: 1543345 - RNA, 18 nt, Pseudomonas aeruginosa PA01
cgguuggcuacccgcagg

SEQ ID NO: 1543346 - RNA, 20 nt, Pseudomonas aeruginosa PA01
cgguuggggaggugcggcgg

SEQ ID NO: 1543347 - RNA, 17 nt, Pseudomonas aeruginosa PA01
cgguugccaggccggcg

SEQ ID NO: 1543348 - RNA, 13 nt, Pseudomonas aeruginosa PA01
cgguugccgcgcc

SEQ ID NO: 1543349 - RNA, 17 nt, Pseudomonas aeruginosa PA01
cgguuaccaggucugug

SEQ ID NO: 1543350 - RNA, 16 nt, Pseudomonas aeruginosa PA01
cgguuagccggcgauc

SEQ ID NO: 1543351 - RNA, 23 nt, Pseudomonas aeruginosa PA01
cgguuagaauaccggccugucac

SEQ ID NO: 1543352 - RNA, 16 nt, Pseudomonas aeruginosa PA01
cgguuauccgccgccg

SEQ ID NO: 1543353 - RNA, 20 nt, Pseudomonas aeruginosa PA01
cgguuauucgcccuaccccc

SEQ ID NO: 1543354 - RNA, 21 nt, Pseudomonas aeruginosa PA01
cgguuccagacauccgggucc

SEQ ID NO: 1543355 - RNA, 13 nt, Pseudomonas aeruginosa PA01
cgguucggcgucu

SEQ ID NO: 1543356 - RNA, 23 nt, Pseudomonas aeruginosa PA01
cgguucgccgagcgccgccaggc

SEQ ID NO: 1543357 - RNA, 14 nt, Pseudomonas aeruginosa PA01
cgguucgccuuccc

SEQ ID NO: 1543358 - RNA, 17 nt, Pseudomonas aeruginosa PA01
cgguucgcggcgcagcu

SEQ ID NO: 1543359 - RNA, 18 nt, Pseudomonas aeruginosa PA01
cgguucccgcagcgauca

SEQ ID NO: 1543360 - RNA, 17 nt, Pseudomonas aeruginosa PA01
cgguucgcaggccaggc

SEQ ID NO: 1543361 - RNA, 18 nt, Pseudomonas aeruginosa PA01
cgguucgcaggccaggcg

SEQ ID NO: 1543362 - RNA, 19 nt, Pseudomonas aeruginosa PA01
cgguucgcaggccaggcgc

SEQ ID NO: 1543363 - RNA, 15 nt, Pseudomonas aeruginosa PA01
cgguucugcgcacca

SEQ ID NO: 1543364 - RNA, 14 nt, Pseudomonas aeruginosa PA01
cgguugaguagaaa

SEQ ID NO: 1543365 - RNA, 17 nt, Pseudomonas aeruginosa PA01
cgucuuccggcucgccg

SEQ ID NO: 1543366 - RNA, 18 nt, Pseudomonas aeruginosa PA01
cgugaaacgccagaagcg

SEQ ID NO: 1543367 - RNA, 13 nt, Pseudomonas aeruginosa PA01
cgugacccgcgcu

SEQ ID NO: 1543368 - RNA, 23 nt, Pseudomonas aeruginosa PA01
cgucuguugcgguggugucuggu

SEQ ID NO: 1543369 - RNA, 18 nt, Pseudomonas aeruginosa PA01
cgucgcgauagacgccgg

SEQ ID NO: 1543370 - RNA, 13 nt, Pseudomonas aeruginosa PA01
cgucgcgccagca

SEQ ID NO: 1543371 - RNA, 15 nt, Pseudomonas aeruginosa PA01
cgucgcgcaccuggc

SEQ ID NO: 1543372 - RNA, 14 nt, Pseudomonas aeruginosa PA01
cgucgcacccggcc

SEQ ID NO: 1543373 - RNA, 20 nt, Pseudomonas aeruginosa PA01
cgucgcacccggcccauggc

SEQ ID NO: 1543374 - RNA, 14 nt, Pseudomonas aeruginosa PA01
cgucgccggccgcu

SEQ ID NO: 1543375 - RNA, 13 nt, Pseudomonas aeruginosa PA01
cgucgccuuccac

SEQ ID NO: 1543376 - RNA, 21 nt, Pseudomonas aeruginosa PA01
cgugcgcugguaccugccggc

SEQ ID NO: 1543377 - RNA, 17 nt, Pseudomonas aeruginosa PA01
cgugcgccgggcuugca

SEQ ID NO: 1543378 - RNA, 15 nt, Pseudomonas aeruginosa PA01
cgugcgccgcggguc

SEQ ID NO: 1543379 - RNA, 18 nt, Pseudomonas aeruginosa PA01
cgugcgccgcucgcgcac

SEQ ID NO: 1543380 - RNA, 15 nt, Pseudomonas aeruginosa PA01
cgugcgccggccucu

SEQ ID NO: 1543381 - RNA, 13 nt, Pseudomonas aeruginosa PA01
cgugcgcuccgcc

SEQ ID NO: 1543382 - RNA, 14 nt, Pseudomonas aeruginosa PA01
cgugcgcuccgcca

SEQ ID NO: 1543383 - RNA, 23 nt, Pseudomonas aeruginosa PA01
cgugcgcuccgccaggccgcgca

SEQ ID NO: 1543384 - RNA, 21 nt, Pseudomonas aeruginosa PA01
cgugcgccccagcucagcagg

SEQ ID NO: 1543385 - RNA, 17 nt, Pseudomonas aeruginosa PA01
cgugccaggagcuugcc

SEQ ID NO: 1543386 - RNA, 12 nt, Pseudomonas aeruginosa PA01
cgugccaggcga

SEQ ID NO: 1543387 - RNA, 12 nt, Pseudomonas aeruginosa PA01
cgugccaggcgg

SEQ ID NO: 1543388 - RNA, 14 nt, Pseudomonas aeruginosa PA01
cgugcauuuccugg

SEQ ID NO: 1543389 - RNA, 17 nt, Pseudomonas aeruginosa PA01
cgugcauuuccuggacg

SEQ ID NO: 1543390 - RNA, 19 nt, Pseudomonas aeruginosa PA01
cgugcaccgaggcgcgccg

SEQ ID NO: 1543391 - RNA, 21 nt, Pseudomonas aeruginosa PA01
cgugauccguggcgagcgcga

SEQ ID NO: 1543392 - RNA, 15 nt, Pseudomonas aeruginosa PA01
cguggcgggccaugc

SEQ ID NO: 1543393 - RNA, 19 nt, Pseudomonas aeruginosa PA01
cguggcgguacuccggguu

SEQ ID NO: 1543394 - RNA, 17 nt, Pseudomonas aeruginosa PA01
cguggcgggccagcagg

SEQ ID NO: 1543395 - RNA, 12 nt, Pseudomonas aeruginosa PA01
cguggcggccgc

SEQ ID NO: 1543396 - RNA, 13 nt, Pseudomonas aeruginosa PA01
cguggcggcgcgc

SEQ ID NO: 1543397 - RNA, 18 nt, Pseudomonas aeruginosa PA01
cguggcugugcuggccac

SEQ ID NO: 1543398 - RNA, 20 nt, Pseudomonas aeruginosa PA01
cgugggaaaucaccgccacc

SEQ ID NO: 1543399 - RNA, 18 nt, Pseudomonas aeruginosa PA01
cgugggaguccagguaca

SEQ ID NO: 1543400 - RNA, 17 nt, Pseudomonas aeruginosa PA01
cgugggaucgccacgcc

SEQ ID NO: 1543401 - RNA, 14 nt, Pseudomonas aeruginosa PA01
cguggcugccggag

SEQ ID NO: 1543402 - RNA, 14 nt, Pseudomonas aeruginosa PA01
cguggguagccgcc

SEQ ID NO: 1543403 - RNA, 20 nt, Pseudomonas aeruginosa PA01
cguggguagccgcccaccgc

SEQ ID NO: 1543404 - RNA, 17 nt, Pseudomonas aeruginosa PA01
cguggggcggcgcagau

SEQ ID NO: 1543405 - RNA, 18 nt, Pseudomonas aeruginosa PA01
cgugggcuucgccgccgc

SEQ ID NO: 1543406 - RNA, 16 nt, Pseudomonas aeruginosa PA01
cgugggcaacaggccg

SEQ ID NO: 1543407 - RNA, 14 nt, Pseudomonas aeruginosa PA01
cgugggccaccauc

SEQ ID NO: 1543408 - RNA, 15 nt, Pseudomonas aeruginosa PA01
cgugggccaccauca

SEQ ID NO: 1543409 - RNA, 16 nt, Pseudomonas aeruginosa PA01
cgugggccaccaucag

SEQ ID NO: 1543410 - RNA, 13 nt, Pseudomonas aeruginosa PA01
cgugggccagcag

SEQ ID NO: 1543411 - RNA, 14 nt, Pseudomonas aeruginosa PA01
cgugggccagcagg

SEQ ID NO: 1543412 - RNA, 20 nt, Pseudomonas aeruginosa PA01
cgugggccagcccagaacag

SEQ ID NO: 1543413 - RNA, 17 nt, Pseudomonas aeruginosa PA01
cgugggccggcgcgccg

SEQ ID NO: 1543414 - RNA, 21 nt, Pseudomonas aeruginosa PA01
cguggaaccgauggccagggg

SEQ ID NO: 1543415 - RNA, 17 nt, Pseudomonas aeruginosa PA01
cgugcguugcgcggcag

SEQ ID NO: 1543416 - RNA, 18 nt, Pseudomonas aeruginosa PA01
cgugcguugcgcggcagg

SEQ ID NO: 1543417 - RNA, 19 nt, Pseudomonas aeruginosa PA01
cguggaaaaagaagaaaaa

SEQ ID NO: 1543418 - RNA, 14 nt, Pseudomonas aeruginosa PA01
cguggaccaacagc

SEQ ID NO: 1543419 - RNA, 21 nt, Pseudomonas aeruginosa PA01
cguggacauacaggcgcgccu

SEQ ID NO: 1543420 - RNA, 20 nt, Pseudomonas aeruginosa PA01
cguggccagcgaacccaggc

SEQ ID NO: 1543421 - RNA, 23 nt, Pseudomonas aeruginosa PA01
cguggccauagagccgcuggguu

SEQ ID NO: 1543422 - RNA, 23 nt, Pseudomonas aeruginosa PA01
cguggaucgcccggcugcacagg

SEQ ID NO: 1543423 - RNA, 22 nt, Pseudomonas aeruginosa PA01
cguggcgaugcccuggcuuucc

SEQ ID NO: 1543424 - RNA, 12 nt, Pseudomonas aeruginosa PA01
cguggcgccgca

SEQ ID NO: 1543425 - RNA, 13 nt, Pseudomonas aeruginosa PA01
cguggcgccgcag

SEQ ID NO: 1543426 - RNA, 20 nt, Pseudomonas aeruginosa PA01
cguggcgcggacgggccgcg

SEQ ID NO: 1543427 - RNA, 22 nt, Pseudomonas aeruginosa PA01
cguggcgcggacgggccgcgcc

SEQ ID NO: 1543428 - RNA, 16 nt, Pseudomonas aeruginosa PA01
cguggugacgguccgc

SEQ ID NO: 1543429 - RNA, 14 nt, Pseudomonas aeruginosa PA01
cguggucggcggcc

SEQ ID NO: 1543430 - RNA, 16 nt, Pseudomonas aeruginosa PA01
cguggucgccguccac

SEQ ID NO: 1543431 - RNA, 20 nt, Pseudomonas aeruginosa PA01
cguggucagcaccagggcca

SEQ ID NO: 1543432 - RNA, 14 nt, Pseudomonas aeruginosa PA01
cgugguccgccagc

SEQ ID NO: 1543433 - RNA, 17 nt, Pseudomonas aeruginosa PA01
cgugguccgccagcagg

SEQ ID NO: 1543434 - RNA, 21 nt, Pseudomonas aeruginosa PA01
cgugucgacucagcgggcgcg

SEQ ID NO: 1543435 - RNA, 22 nt, Pseudomonas aeruginosa PA01
cgugucgaggaaggccagcagg

SEQ ID NO: 1543436 - RNA, 16 nt, Pseudomonas aeruginosa PA01
cgugucgccuuccggc

SEQ ID NO: 1543437 - RNA, 16 nt, Pseudomonas aeruginosa PA01
cguguugcgccgcacc

SEQ ID NO: 1543438 - RNA, 23 nt, Pseudomonas aeruginosa PA01
cguguucgcggcucuggcgcagg

SEQ ID NO: 1543439 - RNA, 14 nt, Pseudomonas aeruginosa PA01
cguguucggccagc

SEQ ID NO: 1543440 - RNA, 14 nt, Pseudomonas aeruginosa PA01
cguguucggcggcu

SEQ ID NO: 1543441 - RNA, 24 nt, Pseudomonas aeruginosa PA01
cguucgcuggacaggcgcaggggc

SEQ ID NO: 1543442 - RNA, 18 nt, Pseudomonas aeruginosa PA01
cguucucgaucaucgcca

SEQ ID NO: 1543443 - RNA, 23 nt, Pseudomonas aeruginosa PA01
cguucuguucgucccgagcaccg

SEQ ID NO: 1543444 - RNA, 19 nt, Pseudomonas aeruginosa PA01
cguucuugaccuucugcac

SEQ ID NO: 1543445 - RNA, 23 nt, Pseudomonas aeruginosa PA01
cguugaccgugaugcccagcggc

SEQ ID NO: 1543446 - RNA, 13 nt, Pseudomonas aeruginosa PA01
cguugaccagcgc

SEQ ID NO: 1543447 - RNA, 17 nt, Pseudomonas aeruginosa PA01
cguugccgaccgagcag

SEQ ID NO: 1543448 - RNA, 18 nt, Pseudomonas aeruginosa PA01
cguugccgaccgagcagc

SEQ ID NO: 1543449 - RNA, 15 nt, Pseudomonas aeruginosa PA01
cguuaaccugccugc

SEQ ID NO: 1543450 - RNA, 19 nt, Pseudomonas aeruginosa PA01
cguuccacguccuccaggc

SEQ ID NO: 1543451 - RNA, 21 nt, Pseudomonas aeruginosa PA01
cguuccaccuggcgcagguag

SEQ ID NO: 1543452 - RNA, 23 nt, Pseudomonas aeruginosa PA01
cguuccagcggcacuucccgccc

SEQ ID NO: 1543453 - RNA, 16 nt, Pseudomonas aeruginosa PA01
cguuccagggccuggu

SEQ ID NO: 1543454 - RNA, 13 nt, Pseudomonas aeruginosa PA01
cguucccagcagc

SEQ ID NO: 1543455 - RNA, 14 nt, Pseudomonas aeruginosa PA01
cguucgcgggcgcc

SEQ ID NO: 1543456 - RNA, 16 nt, Pseudomonas aeruginosa PA01
cguucgcgggcgccgu

SEQ ID NO: 1543457 - RNA, 22 nt, Pseudomonas aeruginosa PA01
cguucgcauugaaaaacccaug

SEQ ID NO: 1543458 - RNA, 23 nt, Pseudomonas aeruginosa PA01
cguucgccggccuccagcacucg

SEQ ID NO: 1543459 - RNA, 12 nt, Pseudomonas aeruginosa PA01
cguugccggcau

SEQ ID NO: 1543460 - RNA, 17 nt, Pseudomonas aeruginosa PA01
cguugccggcauugcac

SEQ ID NO: 1543461 - RNA, 16 nt, Pseudomonas aeruginosa PA01
cguugcgccgcagcaa

SEQ ID NO: 1543462 - RNA, 18 nt, Pseudomonas aeruginosa PA01
cguugcgagggcucgggc

SEQ ID NO: 1543463 - RNA, 22 nt, Pseudomonas aeruginosa PA01
cguugcgaugggugccgcgcag

SEQ ID NO: 1543464 - RNA, 16 nt, Pseudomonas aeruginosa PA01
cguugcgcgcauagca

SEQ ID NO: 1543465 - RNA, 16 nt, Pseudomonas aeruginosa PA01
cguugcgcgccagcgc

SEQ ID NO: 1543466 - RNA, 20 nt, Pseudomonas aeruginosa PA01
cguugcgcgccucgccccag

SEQ ID NO: 1543467 - RNA, 20 nt, Pseudomonas aeruginosa PA01
cguugcgcggaauccuucgc

SEQ ID NO: 1543468 - RNA, 18 nt, Pseudomonas aeruginosa PA01
cguugcgccgcuccuggc

SEQ ID NO: 1543469 - RNA, 19 nt, Pseudomonas aeruginosa PA01
cguugcgccggcccagcag

SEQ ID NO: 1543470 - RNA, 20 nt, Pseudomonas aeruginosa PA01
cguugcgccggcccagcagg

SEQ ID NO: 1543471 - RNA, 20 nt, Pseudomonas aeruginosa PA01
cguugcgccagaccagcccc

SEQ ID NO: 1543472 - RNA, 14 nt, Pseudomonas aeruginosa PA01
cguugcuuccaggc

SEQ ID NO: 1543473 - RNA, 15 nt, Pseudomonas aeruginosa PA01
cguugcgccugcuuc

SEQ ID NO: 1543474 - RNA, 19 nt, Pseudomonas aeruginosa PA01
cguugcgguagugcccggu

SEQ ID NO: 1543475 - RNA, 22 nt, Pseudomonas aeruginosa PA01
cguuggaucaccgggguguguu

SEQ ID NO: 1543476 - RNA, 22 nt, Pseudomonas aeruginosa PA01
cguuggccagcgccaccagcag

SEQ ID NO: 1543477 - RNA, 19 nt, Pseudomonas aeruginosa PA01
cguuggcgaacuucaggcc

SEQ ID NO: 1543478 - RNA, 20 nt, Pseudomonas aeruginosa PA01
cguuggcgaacuucaggccg

SEQ ID NO: 1543479 - RNA, 23 nt, Pseudomonas aeruginosa PA01
cguuggcgaacuucaggccggcg

SEQ ID NO: 1543480 - RNA, 16 nt, Pseudomonas aeruginosa PA01
cguuggcgucaacggu

SEQ ID NO: 1543481 - RNA, 19 nt, Pseudomonas aeruginosa PA01
cguuggcgugcucgcgcau

SEQ ID NO: 1543482 - RNA, 17 nt, Pseudomonas aeruginosa PA01
cguuggcuccgggccga

SEQ ID NO: 1543483 - RNA, 20 nt, Pseudomonas aeruginosa PA01
cguugguacagcucgcgcaa

SEQ ID NO: 1543484 - RNA, 16 nt, Pseudomonas aeruginosa PA01
cuaaaugccauuuuuu

SEQ ID NO: 1543485 - RNA, 21 nt, Pseudomonas aeruginosa PA01
cggcugcccaagggccugggc

SEQ ID NO: 1543486 - RNA, 20 nt, Pseudomonas aeruginosa PA01
cggcugcuugccgcucaggc

SEQ ID NO: 1543487 - RNA, 14 nt, Pseudomonas aeruginosa PA01
cggcugcuuggcca

SEQ ID NO: 1543488 - RNA, 21 nt, Pseudomonas aeruginosa PA01
cggcugcgugaggaucacgca

SEQ ID NO: 1543489 - RNA, 14 nt, Pseudomonas aeruginosa PA01
cggcugccgcgcgu

SEQ ID NO: 1543490 - RNA, 12 nt, Pseudomonas aeruginosa PA01
cggcuggcccuc

SEQ ID NO: 1543491 - RNA, 14 nt, Pseudomonas aeruginosa PA01
cggcuggcaggugc

SEQ ID NO: 1543492 - RNA, 12 nt, Pseudomonas aeruginosa PA01
cggcuggccauc

SEQ ID NO: 1543493 - RNA, 23 nt, Pseudomonas aeruginosa PA01
cggcuggacgugcaggaucaccu

SEQ ID NO: 1543494 - RNA, 21 nt, Pseudomonas aeruginosa PA01
cggcuggcggcucggcugcuu

SEQ ID NO: 1543495 - RNA, 22 nt, Pseudomonas aeruginosa PA01
cggcuggccgccucgcgccgcg

SEQ ID NO: 1543496 - RNA, 22 nt, Pseudomonas aeruginosa PA01
cggcuggcgaaccaguccagca

SEQ ID NO: 1543497 - RNA, 21 nt, Pseudomonas aeruginosa PA01
cggcugguucugguccaccag

SEQ ID NO: 1543498 - RNA, 15 nt, Pseudomonas aeruginosa PA01
cggcugguugccagc

SEQ ID NO: 1543499 - RNA, 17 nt, Pseudomonas aeruginosa PA01
cggcugguugccagcag

SEQ ID NO: 1543500 - RNA, 18 nt, Pseudomonas aeruginosa PA01
cggcugguugccagcagc

SEQ ID NO: 1543501 - RNA, 11 nt, Pseudomonas aeruginosa PA01
cggcuggucag

SEQ ID NO: 1543502 - RNA, 15 nt, Pseudomonas aeruginosa PA01
cggcuggucggcuuc

SEQ ID NO: 1543503 - RNA, 16 nt, Pseudomonas aeruginosa PA01
cggcuggucggcuucc

SEQ ID NO: 1543504 - RNA, 14 nt, Pseudomonas aeruginosa PA01
cggcuggucgucgc

SEQ ID NO: 1543505 - RNA, 18 nt, Pseudomonas aeruginosa PA01
cggcugcauguccgccag

SEQ ID NO: 1543506 - RNA, 23 nt, Pseudomonas aeruginosa PA01
cggcugcauguccgccaguuccg

SEQ ID NO: 1543507 - RNA, 17 nt, Pseudomonas aeruginosa PA01
cggcugcagggccaggg

SEQ ID NO: 1543508 - RNA, 17 nt, Pseudomonas aeruginosa PA01
cggcugcaacgccggcc

SEQ ID NO: 1543509 - RNA, 18 nt, Pseudomonas aeruginosa PA01
cggcugcaacgccggccc

SEQ ID NO: 1543510 - RNA, 23 nt, Pseudomonas aeruginosa PA01
cggcugacgaaguccuugugcug

SEQ ID NO: 1543511 - RNA, 13 nt, Pseudomonas aeruginosa PA01
cggcucugcuucu

SEQ ID NO: 1543512 - RNA, 17 nt, Pseudomonas aeruginosa PA01
cggcucugcuucugucc

SEQ ID NO: 1543513 - RNA, 20 nt, Pseudomonas aeruginosa PA01
cggcucugcuucugucccug

SEQ ID NO: 1543514 - RNA, 21 nt, Pseudomonas aeruginosa PA01
cggcucgcugaaauccaccag

SEQ ID NO: 1543515 - RNA, 22 nt, Pseudomonas aeruginosa PA01
cggcucgcugaaauccaccagc

SEQ ID NO: 1543516 - RNA, 18 nt, Pseudomonas aeruginosa PA01
cggcucggcacgcguggc

SEQ ID NO: 1543517 - RNA, 14 nt, Pseudomonas aeruginosa PA01
cggcucgcgccggc

SEQ ID NO: 1543518 - RNA, 16 nt, Pseudomonas aeruginosa PA01
cggcucgccgcgcugc

SEQ ID NO: 1543519 - RNA, 16 nt, Pseudomonas aeruginosa PA01
cggcuccuugcgccgu

SEQ ID NO: 1543520 - RNA, 17 nt, Pseudomonas aeruginosa PA01
cggcuccggcgccaggc

SEQ ID NO: 1543521 - RNA, 15 nt, Pseudomonas aeruginosa PA01
cggcucuccccgcuc

SEQ ID NO: 1543522 - RNA, 14 nt, Pseudomonas aeruginosa PA01
cggcucggccaggg

SEQ ID NO: 1543523 - RNA, 19 nt, Pseudomonas aeruginosa PA01
cggcucggccagggccgcu

SEQ ID NO: 1543524 - RNA, 22 nt, Pseudomonas aeruginosa PA01
cggcugugcagggcagcggccc

SEQ ID NO: 1543525 - RNA, 15 nt, Pseudomonas aeruginosa PA01
cggcuguuucaggcc

SEQ ID NO: 1543526 - RNA, 19 nt, Pseudomonas aeruginosa PA01
cggcuguuucaggccggcg

SEQ ID NO: 1543527 - RNA, 21 nt, Pseudomonas aeruginosa PA01
cggcuuccagguacggcccgc

SEQ ID NO: 1543528 - RNA, 14 nt, Pseudomonas aeruginosa PA01
cggcuuccgccgcc

SEQ ID NO: 1543529 - RNA, 17 nt, Pseudomonas aeruginosa PA01
cggcuucaacgcgacgg

SEQ ID NO: 1543530 - RNA, 14 nt, Pseudomonas aeruginosa PA01
cggcuucagccaga

SEQ ID NO: 1543531 - RNA, 19 nt, Pseudomonas aeruginosa PA01
cggcuucagcgccaggccg

SEQ ID NO: 1543532 - RNA, 17 nt, Pseudomonas aeruginosa PA01
cggcuguugccggaauc

SEQ ID NO: 1543533 - RNA, 21 nt, Pseudomonas aeruginosa PA01
cggcuuccaccagacgcagca

SEQ ID NO: 1543534 - RNA, 22 nt, Pseudomonas aeruginosa PA01
cggcuuccaccagacgcagcau

SEQ ID NO: 1543535 - RNA, 14 nt, Pseudomonas aeruginosa PA01
cggcuuccuccauc

SEQ ID NO: 1543536 - RNA, 16 nt, Pseudomonas aeruginosa PA01
cggcuucguccugcug

SEQ ID NO: 1543537 - RNA, 18 nt, Pseudomonas aeruginosa PA01
cggcuucgcgcuccaggc

SEQ ID NO: 1543538 - RNA, 18 nt, Pseudomonas aeruginosa PA01
cggcuucggcggcgcgcu

SEQ ID NO: 1543539 - RNA, 16 nt, Pseudomonas aeruginosa PA01
cggcuugcccaucuuc

SEQ ID NO: 1543540 - RNA, 14 nt, Pseudomonas aeruginosa PA01
cggcuugccggcgg

SEQ ID NO: 1543541 - RNA, 18 nt, Pseudomonas aeruginosa PA01
cggcuugccggcggcgcu

SEQ ID NO: 1543542 - RNA, 16 nt, Pseudomonas aeruginosa PA01
cggcuugcguucgcuc

SEQ ID NO: 1543543 - RNA, 17 nt, Pseudomonas aeruginosa PA01
cgggaacuuggcgcgca

SEQ ID NO: 1543544 - RNA, 11 nt, Pseudomonas aeruginosa PA01
cgggaagcagg

SEQ ID NO: 1543545 - RNA, 22 nt, Pseudomonas aeruginosa PA01
cgggaagcaggucucgacgcgc

SEQ ID NO: 1543546 - RNA, 17 nt, Pseudomonas aeruginosa PA01
cgggaagcgaaccaggc

SEQ ID NO: 1543547 - RNA, 16 nt, Pseudomonas aeruginosa PA01
cgggaagcgcaggccg

SEQ ID NO: 1543548 - RNA, 13 nt, Pseudomonas aeruginosa PA01
cgggaaccagcau

SEQ ID NO: 1543549 - RNA, 14 nt, Pseudomonas aeruginosa PA01
cgggaaccagcaug

SEQ ID NO: 1543550 - RNA, 23 nt, Pseudomonas aeruginosa PA01
cgggaacagcccgucgcgcgccg

SEQ ID NO: 1543551 - RNA, 21 nt, Pseudomonas aeruginosa PA01
cgggaaacagggcgacgccga

SEQ ID NO: 1543552 - RNA, 17 nt, Pseudomonas aeruginosa PA01
cgggaaacgcgagugga

SEQ ID NO: 1543553 - RNA, 22 nt, Pseudomonas aeruginosa PA01
cgggaaacgcgaguggaggauc

SEQ ID NO: 1543554 - RNA, 22 nt, Pseudomonas aeruginosa PA01
cggcuuguugcgcuccacccag

SEQ ID NO: 1543555 - RNA, 15 nt, Pseudomonas aeruginosa PA01
cggcuuuuucauuuc

SEQ ID NO: 1543556 - RNA, 19 nt, Pseudomonas aeruginosa PA01
cggcuuuuucuugcgugcg

SEQ ID NO: 1543557 - RNA, 14 nt, Pseudomonas aeruginosa PA01
cggcguagccggcg

SEQ ID NO: 1543558 - RNA, 16 nt, Pseudomonas aeruginosa PA01
cggcguaggcgcgcca

SEQ ID NO: 1543559 - RNA, 15 nt, Pseudomonas aeruginosa PA01
cggcguagugcuggu

SEQ ID NO: 1543560 - RNA, 22 nt, Pseudomonas aeruginosa PA01
cggcguaugcgccuccagguag

SEQ ID NO: 1543561 - RNA, 22 nt, Pseudomonas aeruginosa PA01
cggcguaugguggaggaagcgc

SEQ ID NO: 1543562 - RNA, 19 nt, Pseudomonas aeruginosa PA01
cggcgccgccucgggcagc

SEQ ID NO: 1543563 - RNA, 22 nt, Pseudomonas aeruginosa PA01
cggcgccgccucgggcagcccc

SEQ ID NO: 1543564 - RNA, 17 nt, Pseudomonas aeruginosa PA01
cggcguaggccucggag

SEQ ID NO: 1543565 - RNA, 21 nt, Pseudomonas aeruginosa PA01
cggcguacuucggcgcggugc

SEQ ID NO: 1543566 - RNA, 12 nt, Pseudomonas aeruginosa PA01
cggcguccccuu

SEQ ID NO: 1543567 - RNA, 20 nt, Pseudomonas aeruginosa PA01
cggcguccacuccggcagca

SEQ ID NO: 1543568 - RNA, 21 nt, Pseudomonas aeruginosa PA01
cggcguccugcucccuggcgg

SEQ ID NO: 1543569 - RNA, 21 nt, Pseudomonas aeruginosa PA01
cggcguccucggagagcagcc

SEQ ID NO: 1543570 - RNA, 22 nt, Pseudomonas aeruginosa PA01
cggcguggcgaucaggcagcgc

SEQ ID NO: 1543571 - RNA, 18 nt, Pseudomonas aeruginosa PA01
cggcguggaaggccacua

SEQ ID NO: 1543572 - RNA, 13 nt, Pseudomonas aeruginosa PA01
cggcguggcuacg

SEQ ID NO: 1543573 - RNA, 19 nt, Pseudomonas aeruginosa PA01
cggcguggucuccgugcug

SEQ ID NO: 1543574 - RNA, 14 nt, Pseudomonas aeruginosa PA01
cggcguguccaggg

SEQ ID NO: 1543575 - RNA, 18 nt, Pseudomonas aeruginosa PA01
cggcgugcccuuuuccuc

SEQ ID NO: 1543576 - RNA, 14 nt, Pseudomonas aeruginosa PA01
cggcgugccgcagg

SEQ ID NO: 1543577 - RNA, 16 nt, Pseudomonas aeruginosa PA01
cggcgugagcagggcc

SEQ ID NO: 1543578 - RNA, 19 nt, Pseudomonas aeruginosa PA01
cggcgugaagccgccgccc

SEQ ID NO: 1543579 - RNA, 21 nt, Pseudomonas aeruginosa PA01
cggcgugaagccgccgcccag

SEQ ID NO: 1543580 - RNA, 18 nt, Pseudomonas aeruginosa PA01
cggcgucuucggcggcgc

SEQ ID NO: 1543581 - RNA, 14 nt, Pseudomonas aeruginosa PA01
cggcgucgcgcagg

SEQ ID NO: 1543582 - RNA, 20 nt, Pseudomonas aeruginosa PA01
cggcgucggcugcgcugggc

SEQ ID NO: 1543583 - RNA, 24 nt, Pseudomonas aeruginosa PA01
cggcguugaacugcccgcaggggc

SEQ ID NO: 1543584 - RNA, 15 nt, Pseudomonas aeruginosa PA01
cggcguucgccgcgg

SEQ ID NO: 1543585 - RNA, 23 nt, Pseudomonas aeruginosa PA01
cggcguuauccgcccugcgcagc

SEQ ID NO: 1543586 - RNA, 15 nt, Pseudomonas aeruginosa PA01
cggcguucaccgcgc

SEQ ID NO: 1543587 - RNA, 21 nt, Pseudomonas aeruginosa PA01
cggcguuguagaucugcaccg

SEQ ID NO: 1543588 - RNA, 15 nt, Pseudomonas aeruginosa PA01
cggcguuguccaggc

SEQ ID NO: 1543589 - RNA, 20 nt, Pseudomonas aeruginosa PA01
cggcguugucggccagcagc

SEQ ID NO: 1543590 - RNA, 17 nt, Pseudomonas aeruginosa PA01
cggcguuucgccgggcc

SEQ ID NO: 1543591 - RNA, 19 nt, Pseudomonas aeruginosa PA01
cggcguuggccgaggaggc

SEQ ID NO: 1543592 - RNA, 15 nt, Pseudomonas aeruginosa PA01
cggcguugcgcgccc

SEQ ID NO: 1543593 - RNA, 13 nt, Pseudomonas aeruginosa PA01
cggcuacucgccc

SEQ ID NO: 1543594 - RNA, 15 nt, Pseudomonas aeruginosa PA01
cggcuacucgcccga

SEQ ID NO: 1543595 - RNA, 18 nt, Pseudomonas aeruginosa PA01
cggcuacucgcccgaccc

SEQ ID NO: 1543596 - RNA, 14 nt, Pseudomonas aeruginosa PA01
cggcuacccgcgcc

SEQ ID NO: 1543597 - RNA, 12 nt, Pseudomonas aeruginosa PA01
cggcuccgcgca

SEQ ID NO: 1543598 - RNA, 21 nt, Pseudomonas aeruginosa PA01
cggcuccggauggcugacccg

SEQ ID NO: 1543599 - RNA, 19 nt, Pseudomonas aeruginosa PA01
cggcuccucggccugggcg

SEQ ID NO: 1543600 - RNA, 23 nt, Pseudomonas aeruginosa PA01
cggcuccucggccugggcgcagg

SEQ ID NO: 1543601 - RNA, 21 nt, Pseudomonas aeruginosa PA01
cggcuccucugccugcgcccu

SEQ ID NO: 1543602 - RNA, 19 nt, Pseudomonas aeruginosa PA01
cggcuccggcuccgcgcac

SEQ ID NO: 1543603 - RNA, 18 nt, Pseudomonas aeruginosa PA01
cggcuccaguugcagcac

SEQ ID NO: 1543604 - RNA, 20 nt, Pseudomonas aeruginosa PA01
cggcuccaguugcagcaccc

SEQ ID NO: 1543605 - RNA, 14 nt, Pseudomonas aeruginosa PA01
cggcuccagccggg

SEQ ID NO: 1543606 - RNA, 22 nt, Pseudomonas aeruginosa PA01
cggcuccagcaccagcacgccc

SEQ ID NO: 1543607 - RNA, 17 nt, Pseudomonas aeruginosa PA01
cggcucagaaauccacc

SEQ ID NO: 1543608 - RNA, 20 nt, Pseudomonas aeruginosa PA01
cggcucagaacagcggcagc

SEQ ID NO: 1543609 - RNA, 18 nt, Pseudomonas aeruginosa PA01
cggcucaggccgccgcgu

SEQ ID NO: 1543610 - RNA, 23 nt, Pseudomonas aeruginosa PA01
cggcucaacugguuggccgccug

SEQ ID NO: 1543611 - RNA, 18 nt, Pseudomonas aeruginosa PA01
cgggcccaagccgagcgg

SEQ ID NO: 1543612 - RNA, 18 nt, Pseudomonas aeruginosa PA01
cgggcccaguucgcguag

SEQ ID NO: 1543613 - RNA, 19 nt, Pseudomonas aeruginosa PA01
cgggcccaguucgcguagc

SEQ ID NO: 1543614 - RNA, 16 nt, Pseudomonas aeruginosa PA01
cgggccaucgcggaaa

SEQ ID NO: 1543615 - RNA, 16 nt, Pseudomonas aeruginosa PA01
cgggccagcagcuccg

SEQ ID NO: 1543616 - RNA, 22 nt, Pseudomonas aeruginosa PA01
cgggccagcaggguggccaggg

SEQ ID NO: 1543617 - RNA, 22 nt, Pseudomonas aeruginosa PA01
cgggccagcuccagcaccggcg

SEQ ID NO: 1543618 - RNA, 17 nt, Pseudomonas aeruginosa PA01
cgggccagcuccgccug

SEQ ID NO: 1543619 - RNA, 19 nt, Pseudomonas aeruginosa PA01
cgggccaggccgagcgugc

SEQ ID NO: 1543620 - RNA, 23 nt, Pseudomonas aeruginosa PA01
cgggccgaucaccaccuggaugg

SEQ ID NO: 1543621 - RNA, 17 nt, Pseudomonas aeruginosa PA01
cgggccgaccugcccgc

SEQ ID NO: 1543622 - RNA, 18 nt, Pseudomonas aeruginosa PA01
cgggccgaccugcccgcu

SEQ ID NO: 1543623 - RNA, 16 nt, Pseudomonas aeruginosa PA01
cgggccgacggcccuc

SEQ ID NO: 1543624 - RNA, 13 nt, Pseudomonas aeruginosa PA01
cgggccgcagggg

SEQ ID NO: 1543625 - RNA, 17 nt, Pseudomonas aeruginosa PA01
cgggccgaucgagcggc

SEQ ID NO: 1543626 - RNA, 23 nt, Pseudomonas aeruginosa PA01
cgggccgcaucgcgggcgugcuc

SEQ ID NO: 1543627 - RNA, 13 nt, Pseudomonas aeruginosa PA01
cgggcccugggcc

SEQ ID NO: 1543628 - RNA, 18 nt, Pseudomonas aeruginosa PA01
cgggcccugggccccggc

SEQ ID NO: 1543629 - RNA, 18 nt, Pseudomonas aeruginosa PA01
cgggccuggugcacgccg

SEQ ID NO: 1543630 - RNA, 17 nt, Pseudomonas aeruginosa PA01
cgggcgaaacggcaggc

SEQ ID NO: 1543631 - RNA, 20 nt, Pseudomonas aeruginosa PA01
cgggcgaaacggcaggccag

SEQ ID NO: 1543632 - RNA, 15 nt, Pseudomonas aeruginosa PA01
cgggcgaacggcagc

SEQ ID NO: 1543633 - RNA, 14 nt, Pseudomonas aeruginosa PA01
cgggccuucgccag

SEQ ID NO: 1543634 - RNA, 18 nt, Pseudomonas aeruginosa PA01
cgggccuugaccaccgcc

SEQ ID NO: 1543635 - RNA, 14 nt, Pseudomonas aeruginosa PA01
cgggccuucaggcu

SEQ ID NO: 1543636 - RNA, 16 nt, Pseudomonas aeruginosa PA01
cgggccuucaggcugc

SEQ ID NO: 1543637 - RNA, 23 nt, Pseudomonas aeruginosa PA01
cgggccuucaggcugcgcgcauc

SEQ ID NO: 1543638 - RNA, 23 nt, Pseudomonas aeruginosa PA01
cgggccguuuuuuaugccgaggc

SEQ ID NO: 1543639 - RNA, 22 nt, Pseudomonas aeruginosa PA01
cgggccucguuuuugggggagg

SEQ ID NO: 1543640 - RNA, 15 nt, Pseudomonas aeruginosa PA01
cgggccuccuggcgg

SEQ ID NO: 1543641 - RNA, 16 nt, Pseudomonas aeruginosa PA01
cgggccuccuggcggc

SEQ ID NO: 1543642 - RNA, 13 nt, Pseudomonas aeruginosa PA01
cgggccgccggcg

SEQ ID NO: 1543643 - RNA, 16 nt, Pseudomonas aeruginosa PA01
cgggccgccggcgacg

SEQ ID NO: 1543644 - RNA, 18 nt, Pseudomonas aeruginosa PA01
cgggccgccggcgacgag

SEQ ID NO: 1543645 - RNA, 13 nt, Pseudomonas aeruginosa PA01
cgggccgcgccgc

SEQ ID NO: 1543646 - RNA, 23 nt, Pseudomonas aeruginosa PA01
cgggccgcgccuuucgcucaggc

SEQ ID NO: 1543647 - RNA, 17 nt, Pseudomonas aeruginosa PA01
cgggccgcucgcgcggc

SEQ ID NO: 1543648 - RNA, 14 nt, Pseudomonas aeruginosa PA01
cgggccggccaggg

SEQ ID NO: 1543649 - RNA, 16 nt, Pseudomonas aeruginosa PA01
cgggccggccagggcg

SEQ ID NO: 1543650 - RNA, 15 nt, Pseudomonas aeruginosa PA01
cgggccggcgauggc

SEQ ID NO: 1543651 - RNA, 20 nt, Pseudomonas aeruginosa PA01
cgggccggcguccaggaggg

SEQ ID NO: 1543652 - RNA, 14 nt, Pseudomonas aeruginosa PA01
cgggcgucuccugc

SEQ ID NO: 1543653 - RNA, 15 nt, Pseudomonas aeruginosa PA01
cgggcgucuccugcc

SEQ ID NO: 1543654 - RNA, 16 nt, Pseudomonas aeruginosa PA01
cgggcguugcgcgccu

SEQ ID NO: 1543655 - RNA, 17 nt, Pseudomonas aeruginosa PA01
cgggcguugcgcgccuc

SEQ ID NO: 1543656 - RNA, 16 nt, Pseudomonas aeruginosa PA01
cgggcguugguacagc

SEQ ID NO: 1543657 - RNA, 23 nt, Pseudomonas aeruginosa PA01
cgggcguuuucguugccgcgcuc

SEQ ID NO: 1543658 - RNA, 21 nt, Pseudomonas aeruginosa PA01
cgggcgguagcgggccagcag

SEQ ID NO: 1543659 - RNA, 15 nt, Pseudomonas aeruginosa PA01
cgggcguccggcgag

SEQ ID NO: 1543660 - RNA, 22 nt, Pseudomonas aeruginosa PA01
cgggcgggaucaggucgccagc

SEQ ID NO: 1543661 - RNA, 20 nt, Pseudomonas aeruginosa PA01
cgggcggcgucgaaaugcuc

SEQ ID NO: 1543662 - RNA, 11 nt, Pseudomonas aeruginosa PA01
cgggcgcugca

SEQ ID NO: 1543663 - RNA, 14 nt, Pseudomonas aeruginosa PA01
cgggcggaggcgag

SEQ ID NO: 1543664 - RNA, 16 nt, Pseudomonas aeruginosa PA01
cgggcggaucgagcag

SEQ ID NO: 1543665 - RNA, 17 nt, Pseudomonas aeruginosa PA01
cgggcggaucgagcagc

SEQ ID NO: 1543666 - RNA, 22 nt, Pseudomonas aeruginosa PA01
cgggcggaucgccaaccaguag

SEQ ID NO: 1543667 - RNA, 16 nt, Pseudomonas aeruginosa PA01
cgggcggacgcugggc

SEQ ID NO: 1543668 - RNA, 22 nt, Pseudomonas aeruginosa PA01
cgggcgcucaugaaaaagcccc

SEQ ID NO: 1543669 - RNA, 13 nt, Pseudomonas aeruginosa PA01
cgggcgcgggcgu

SEQ ID NO: 1543670 - RNA, 18 nt, Pseudomonas aeruginosa PA01
cgggcgcgcgccaccgcc

SEQ ID NO: 1543671 - RNA, 13 nt, Pseudomonas aeruginosa PA01
cgggcgcgcgccu

SEQ ID NO: 1543672 - RNA, 12 nt, Pseudomonas aeruginosa PA01
cgggcgcccggc

SEQ ID NO: 1543673 - RNA, 14 nt, Pseudomonas aeruginosa PA01
cgggcgccgccgcu

SEQ ID NO: 1543674 - RNA, 14 nt, Pseudomonas aeruginosa PA01
cgggcgccgcgccu

SEQ ID NO: 1543675 - RNA, 12 nt, Pseudomonas aeruginosa PA01
cgggcgcgcagc

SEQ ID NO: 1543676 - RNA, 17 nt, Pseudomonas aeruginosa PA01
cgggcgcaagcccaagg

SEQ ID NO: 1543677 - RNA, 20 nt, Pseudomonas aeruginosa PA01
cgggcgcaacccugcccagu

SEQ ID NO: 1543678 - RNA, 22 nt, Pseudomonas aeruginosa PA01
cgggcgccaccgauagcggcgc

SEQ ID NO: 1543679 - RNA, 13 nt, Pseudomonas aeruginosa PA01
cgggcgccaccgc

SEQ ID NO: 1543680 - RNA, 14 nt, Pseudomonas aeruginosa PA01
cgggcgagcgcaga

SEQ ID NO: 1543681 - RNA, 20 nt, Pseudomonas aeruginosa PA01
cgggcgagaaucgccgaggc

SEQ ID NO: 1543682 - RNA, 15 nt, Pseudomonas aeruginosa PA01
cgggcgaggcuaacg

SEQ ID NO: 1543683 - RNA, 15 nt, Pseudomonas aeruginosa PA01
cgggcgagggcggcg

SEQ ID NO: 1543684 - RNA, 20 nt, Pseudomonas aeruginosa PA01
cgggcgagggcggcgcgggc

SEQ ID NO: 1543685 - RNA, 21 nt, Pseudomonas aeruginosa PA01
cgggcgacgcguccggugacg

SEQ ID NO: 1543686 - RNA, 14 nt, Pseudomonas aeruginosa PA01
cgggcgacccaggc

SEQ ID NO: 1543687 - RNA, 16 nt, Pseudomonas aeruginosa PA01
cgggcgacccaggccg

SEQ ID NO: 1543688 - RNA, 20 nt, Pseudomonas aeruginosa PA01
cgggaugcccggccgcaggc

SEQ ID NO: 1543689 - RNA, 22 nt, Pseudomonas aeruginosa PA01
cgggaugcccggccgcaggcag

SEQ ID NO: 1543690 - RNA, 15 nt, Pseudomonas aeruginosa PA01
cgggauggucgaggg

SEQ ID NO: 1543691 - RNA, 15 nt, Pseudomonas aeruginosa PA01
cgggaucgacgccgc

SEQ ID NO: 1543692 - RNA, 20 nt, Pseudomonas aeruginosa PA01
cgggaucgaugcgcgcccug

SEQ ID NO: 1543693 - RNA, 20 nt, Pseudomonas aeruginosa PA01
cgggaucuggcccugcaaca

SEQ ID NO: 1543694 - RNA, 16 nt, Pseudomonas aeruginosa PA01
cgggaucuucuaccug

SEQ ID NO: 1543695 - RNA, 20 nt, Pseudomonas aeruginosa PA01
cgggaucuucuaccuggcgc

SEQ ID NO: 1543696 - RNA, 21 nt, Pseudomonas aeruginosa PA01
cgggaucuucuaccuggcgcu

SEQ ID NO: 1543697 - RNA, 23 nt, Pseudomonas aeruginosa PA01
cgggaucuuguagaacaggcugu

SEQ ID NO: 1543698 - RNA, 20 nt, Pseudomonas aeruginosa PA01
cgggaugaacugcagcuugu

SEQ ID NO: 1543699 - RNA, 22 nt, Pseudomonas aeruginosa PA01
cgggaugaagaucaucuggguc

SEQ ID NO: 1543700 - RNA, 15 nt, Pseudomonas aeruginosa PA01
cgggauacagcagcc

SEQ ID NO: 1543701 - RNA, 17 nt, Pseudomonas aeruginosa PA01
cgggaggcgccgcgcca

SEQ ID NO: 1543702 - RNA, 14 nt, Pseudomonas aeruginosa PA01
cgggaaucgccagc

SEQ ID NO: 1543703 - RNA, 13 nt, Pseudomonas aeruginosa PA01
cgggaagggucug

SEQ ID NO: 1543704 - RNA, 19 nt, Pseudomonas aeruginosa PA01
cgggaaggucggcagcagc

SEQ ID NO: 1543705 - RNA, 20 nt, Pseudomonas aeruginosa PA01
cgggaaggucggcagcagcu

SEQ ID NO: 1543706 - RNA, 18 nt, Pseudomonas aeruginosa PA01
cgggagagcccgggcgca

SEQ ID NO: 1543707 - RNA, 22 nt, Pseudomonas aeruginosa PA01
cgggacuuuccgaagccccgga

SEQ ID NO: 1543708 - RNA, 16 nt, Pseudomonas aeruginosa PA01
cgggacgcgcaugcag

SEQ ID NO: 1543709 - RNA, 20 nt, Pseudomonas aeruginosa PA01
cgggacgcgcaugcagggcg

SEQ ID NO: 1543710 - RNA, 23 nt, Pseudomonas aeruginosa PA01
cgggacggcgcauauccaccaug

SEQ ID NO: 1543711 - RNA, 13 nt, Pseudomonas aeruginosa PA01
cgggacaggaacg

SEQ ID NO: 1543712 - RNA, 23 nt, Pseudomonas aeruginosa PA01
cgggaccggcugcuuggccaggu

SEQ ID NO: 1543713 - RNA, 12 nt, Pseudomonas aeruginosa PA01
cgggacgccagg

SEQ ID NO: 1543714 - RNA, 13 nt, Pseudomonas aeruginosa PA01
cgggacgccaggc

SEQ ID NO: 1543715 - RNA, 15 nt, Pseudomonas aeruginosa PA01
cgggcaacgcgcaga

SEQ ID NO: 1543716 - RNA, 16 nt, Pseudomonas aeruginosa PA01
cgggcaacgcgcagag

SEQ ID NO: 1543717 - RNA, 18 nt, Pseudomonas aeruginosa PA01
cgggcaacugccgauggu

SEQ ID NO: 1543718 - RNA, 17 nt, Pseudomonas aeruginosa PA01
cgggcaacugaucagcc

SEQ ID NO: 1543719 - RNA, 16 nt, Pseudomonas aeruginosa PA01
cgggcaaccgcggcgg

SEQ ID NO: 1543720 - RNA, 17 nt, Pseudomonas aeruginosa PA01
cgggcaaccgcggcggc

SEQ ID NO: 1543721 - RNA, 15 nt, Pseudomonas aeruginosa PA01
cgggauugucgccgc

SEQ ID NO: 1543722 - RNA, 21 nt, Pseudomonas aeruginosa PA01
cgggcaacgauucgacgcagc

SEQ ID NO: 1543723 - RNA, 19 nt, Pseudomonas aeruginosa PA01
cgggcaccccgagcggcgc

SEQ ID NO: 1543724 - RNA, 16 nt, Pseudomonas aeruginosa PA01
cgggcaccgccagccc

SEQ ID NO: 1543725 - RNA, 17 nt, Pseudomonas aeruginosa PA01
cgggcaugccgugggcg

SEQ ID NO: 1543726 - RNA, 15 nt, Pseudomonas aeruginosa PA01
cgggcaguccuggcg

SEQ ID NO: 1543727 - RNA, 12 nt, Pseudomonas aeruginosa PA01
cgggcaguucca

SEQ ID NO: 1543728 - RNA, 18 nt, Pseudomonas aeruginosa PA01
cgggcaguuccgccagau

SEQ ID NO: 1543729 - RNA, 19 nt, Pseudomonas aeruginosa PA01
cgggcagauguccaggcag

SEQ ID NO: 1543730 - RNA, 12 nt, Pseudomonas aeruginosa PA01
cgggcagaccag

SEQ ID NO: 1543731 - RNA, 16 nt, Pseudomonas aeruginosa PA01
cgggcagaccagcagc

SEQ ID NO: 1543732 - RNA, 20 nt, Pseudomonas aeruginosa PA01
cgggcagacuucgccgugcu

SEQ ID NO: 1543733 - RNA, 20 nt, Pseudomonas aeruginosa PA01
cgggcaggccgaggccggcg

SEQ ID NO: 1543734 - RNA, 15 nt, Pseudomonas aeruginosa PA01
cggucgugcagcagc

SEQ ID NO: 1543735 - RNA, 20 nt, Pseudomonas aeruginosa PA01
cggucgugcagcagcgccuu

SEQ ID NO: 1543736 - RNA, 12 nt, Pseudomonas aeruginosa PA01
cggucgggcaga

SEQ ID NO: 1543737 - RNA, 13 nt, Pseudomonas aeruginosa PA01
cggucgggcagau

SEQ ID NO: 1543738 - RNA, 17 nt, Pseudomonas aeruginosa PA01
cggucggcucagccgac

SEQ ID NO: 1543739 - RNA, 23 nt, Pseudomonas aeruginosa PA01
cggucggccuguucgcccaaggc

SEQ ID NO: 1543740 - RNA, 14 nt, Pseudomonas aeruginosa PA01
cggucucgccgccg

SEQ ID NO: 1543741 - RNA, 12 nt, Pseudomonas aeruginosa PA01
cggucuuuuucg

SEQ ID NO: 1543742 - RNA, 21 nt, Pseudomonas aeruginosa PA01
cggucuucccguaaggccagg

SEQ ID NO: 1543743 - RNA, 23 nt, Pseudomonas aeruginosa PA01
cggucuucccguaaggccaggcu

SEQ ID NO: 1543744 - RNA, 19 nt, Pseudomonas aeruginosa PA01
cggugaacgagcccaggca

SEQ ID NO: 1543745 - RNA, 12 nt, Pseudomonas aeruginosa PA01
cggugaccagcg

SEQ ID NO: 1543746 - RNA, 19 nt, Pseudomonas aeruginosa PA01
cggugacauucgacagcag

SEQ ID NO: 1543747 - RNA, 13 nt, Pseudomonas aeruginosa PA01
cggugaaccaggc

SEQ ID NO: 1543748 - RNA, 17 nt, Pseudomonas aeruginosa PA01
cggugagauggcacagu

SEQ ID NO: 1543749 - RNA, 19 nt, Pseudomonas aeruginosa PA01
cggugauaccgccggcggc

SEQ ID NO: 1543750 - RNA, 18 nt, Pseudomonas aeruginosa PA01
cggugacgaacgaagcgc

SEQ ID NO: 1543751 - RNA, 20 nt, Pseudomonas aeruginosa PA01
cggucgaaccccuucccccc

SEQ ID NO: 1543752 - RNA, 18 nt, Pseudomonas aeruginosa PA01
cggucgaacugaccacca

SEQ ID NO: 1543753 - RNA, 13 nt, Pseudomonas aeruginosa PA01
cgguccuuguccg

SEQ ID NO: 1543754 - RNA, 22 nt, Pseudomonas aeruginosa PA01
cgguccguccagcgcgcccggc

SEQ ID NO: 1543755 - RNA, 13 nt, Pseudomonas aeruginosa PA01
cggucgagcccca

SEQ ID NO: 1543756 - RNA, 15 nt, Pseudomonas aeruginosa PA01
cggucgauccgaccu

SEQ ID NO: 1543757 - RNA, 13 nt, Pseudomonas aeruginosa PA01
cggucgaggcccu

SEQ ID NO: 1543758 - RNA, 13 nt, Pseudomonas aeruginosa PA01
cggucgcaccgcc

SEQ ID NO: 1543759 - RNA, 16 nt, Pseudomonas aeruginosa PA01
cggucgcaccgccagc

SEQ ID NO: 1543760 - RNA, 12 nt, Pseudomonas aeruginosa PA01
cggucgccgccg

SEQ ID NO: 1543761 - RNA, 20 nt, Pseudomonas aeruginosa PA01
cggucgcgcuggaccuggcc

SEQ ID NO: 1543762 - RNA, 23 nt, Pseudomonas aeruginosa PA01
cggucgcugaccagcccggcggc

SEQ ID NO: 1543763 - RNA, 20 nt, Pseudomonas aeruginosa PA01
cggucauggugccgagcagg

SEQ ID NO: 1543764 - RNA, 17 nt, Pseudomonas aeruginosa PA01
cgguccagcgagcgggc

SEQ ID NO: 1543765 - RNA, 15 nt, Pseudomonas aeruginosa PA01
cggucccgggaaacc

SEQ ID NO: 1543766 - RNA, 16 nt, Pseudomonas aeruginosa PA01
cggucccgggcuccgg

SEQ ID NO: 1543767 - RNA, 21 nt, Pseudomonas aeruginosa PA01
cgguccaggucaugcccuggc

SEQ ID NO: 1543768 - RNA, 15 nt, Pseudomonas aeruginosa PA01
cgguccagcuccuug

SEQ ID NO: 1543769 - RNA, 16 nt, Pseudomonas aeruginosa PA01
cggucaggcgcuggug

SEQ ID NO: 1543770 - RNA, 16 nt, Pseudomonas aeruginosa PA01
cggucaggcucagcuc

SEQ ID NO: 1543771 - RNA, 23 nt, Pseudomonas aeruginosa PA01
cggucaggcugcggcggaaggcg

SEQ ID NO: 1543772 - RNA, 12 nt, Pseudomonas aeruginosa PA01
cggucaggcugg

SEQ ID NO: 1543773 - RNA, 23 nt, Pseudomonas aeruginosa PA01
cggucaggcuggugccgcuguag

SEQ ID NO: 1543774 - RNA, 21 nt, Pseudomonas aeruginosa PA01
cggucagguauucgccggcca

SEQ ID NO: 1543775 - RNA, 22 nt, Pseudomonas aeruginosa PA01
cggucaggccgaucaccaccag

SEQ ID NO: 1543776 - RNA, 22 nt, Pseudomonas aeruginosa PA01
cggucaggacagcgugcggccc

SEQ ID NO: 1543777 - RNA, 18 nt, Pseudomonas aeruginosa PA01
cggucagcuucgccgccc

SEQ ID NO: 1543778 - RNA, 15 nt, Pseudomonas aeruginosa PA01
cggucagcuugcccu

SEQ ID NO: 1543779 - RNA, 16 nt, Pseudomonas aeruginosa PA01
cgguaacuggccaggg

SEQ ID NO: 1543780 - RNA, 19 nt, Pseudomonas aeruginosa PA01
cgguacccgccggccaugc

SEQ ID NO: 1543781 - RNA, 16 nt, Pseudomonas aeruginosa PA01
cgguacaguucaggcu

SEQ ID NO: 1543782 - RNA, 19 nt, Pseudomonas aeruginosa PA01
cgguacaguucaggcuggg

SEQ ID NO: 1543783 - RNA, 13 nt, Pseudomonas aeruginosa PA01
cgguacagccaac

SEQ ID NO: 1543784 - RNA, 16 nt, Pseudomonas aeruginosa PA01
cgguacauggccuucu

SEQ ID NO: 1543785 - RNA, 17 nt, Pseudomonas aeruginosa PA01
cgguacagcccccaggc

SEQ ID NO: 1543786 - RNA, 18 nt, Pseudomonas aeruginosa PA01
cgguacagcgccuggucg

SEQ ID NO: 1543787 - RNA, 13 nt, Pseudomonas aeruginosa PA01
cgguaccagcagc

SEQ ID NO: 1543788 - RNA, 17 nt, Pseudomonas aeruginosa PA01
cgguaccagcagcgccg

SEQ ID NO: 1543789 - RNA, 23 nt, Pseudomonas aeruginosa PA01
cgguaccagcagcgccgaacagg

SEQ ID NO: 1543790 - RNA, 15 nt, Pseudomonas aeruginosa PA01
cgguaauuggccagg

SEQ ID NO: 1543791 - RNA, 13 nt, Pseudomonas aeruginosa PA01
cgguagggccgag

SEQ ID NO: 1543792 - RNA, 17 nt, Pseudomonas aeruginosa PA01
cgguagggccgaggucg

SEQ ID NO: 1543793 - RNA, 20 nt, Pseudomonas aeruginosa PA01
cgguagguguacccagggug

SEQ ID NO: 1543794 - RNA, 23 nt, Pseudomonas aeruginosa PA01
cgguaguaccucgaagcccagcg

SEQ ID NO: 1543795 - RNA, 16 nt, Pseudomonas aeruginosa PA01
cgguagcuccaggccg

SEQ ID NO: 1543796 - RNA, 18 nt, Pseudomonas aeruginosa PA01
cgguaggcucugcuccag

SEQ ID NO: 1543797 - RNA, 12 nt, Pseudomonas aeruginosa PA01
cgguagcccgcg

SEQ ID NO: 1543798 - RNA, 21 nt, Pseudomonas aeruginosa PA01
cgguagcccgcggcgagcagc

SEQ ID NO: 1543799 - RNA, 15 nt, Pseudomonas aeruginosa PA01
cgguagcccggcagc

SEQ ID NO: 1543800 - RNA, 17 nt, Pseudomonas aeruginosa PA01
cgguagcugcgcagggc

SEQ ID NO: 1543801 - RNA, 18 nt, Pseudomonas aeruginosa PA01
cgguagcugcgcagggcg

SEQ ID NO: 1543802 - RNA, 19 nt, Pseudomonas aeruginosa PA01
cgguagcggaucagccggc

SEQ ID NO: 1543803 - RNA, 19 nt, Pseudomonas aeruginosa PA01
cgguacugcugggccuuga

SEQ ID NO: 1543804 - RNA, 16 nt, Pseudomonas aeruginosa PA01
cgguacuccuccagca

SEQ ID NO: 1543805 - RNA, 15 nt, Pseudomonas aeruginosa PA01
cgguacucgccgggc

SEQ ID NO: 1543806 - RNA, 23 nt, Pseudomonas aeruginosa PA01
cgguacucgccgggcgucugccc

SEQ ID NO: 1543807 - RNA, 17 nt, Pseudomonas aeruginosa PA01
cgguagacauucagcag

SEQ ID NO: 1543808 - RNA, 17 nt, Pseudomonas aeruginosa PA01
cgguacgcccuccagca

SEQ ID NO: 1543809 - RNA, 14 nt, Pseudomonas aeruginosa PA01
cgguacgccgcgcu

SEQ ID NO: 1543810 - RNA, 22 nt, Pseudomonas aeruginosa PA01
cgguaguguugaagccgccauc

SEQ ID NO: 1543811 - RNA, 16 nt, Pseudomonas aeruginosa PA01
cgguaguucgcugacc

SEQ ID NO: 1543812 - RNA, 24 nt, Pseudomonas aeruginosa PA01
cgguaucccggcugagcgccaggc

SEQ ID NO: 1543813 - RNA, 15 nt, Pseudomonas aeruginosa PA01
cgguauucuccagca

SEQ ID NO: 1543814 - RNA, 17 nt, Pseudomonas aeruginosa PA01
cgguauucuccagcagg

SEQ ID NO: 1543815 - RNA, 20 nt, Pseudomonas aeruginosa PA01
cgguauuguggccccagcgc

SEQ ID NO: 1543816 - RNA, 13 nt, Pseudomonas aeruginosa PA01
cggucagcucccu

SEQ ID NO: 1543817 - RNA, 14 nt, Pseudomonas aeruginosa PA01
cggucagcucccug

SEQ ID NO: 1543818 - RNA, 14 nt, Pseudomonas aeruginosa PA01
cggucacgaaggcg

SEQ ID NO: 1543819 - RNA, 21 nt, Pseudomonas aeruginosa PA01
cggucaccacccagccgcggc

SEQ ID NO: 1543820 - RNA, 16 nt, Pseudomonas aeruginosa PA01
cgggguauggccuucg

SEQ ID NO: 1543821 - RNA, 22 nt, Pseudomonas aeruginosa PA01
cggggugaucacccagagcacc

SEQ ID NO: 1543822 - RNA, 22 nt, Pseudomonas aeruginosa PA01
cgggguggccgugcagcccucg

SEQ ID NO: 1543823 - RNA, 18 nt, Pseudomonas aeruginosa PA01
cggggugcgcggcgaagg

SEQ ID NO: 1543824 - RNA, 20 nt, Pseudomonas aeruginosa PA01
cggguaccugcucgcggguc

SEQ ID NO: 1543825 - RNA, 22 nt, Pseudomonas aeruginosa PA01
cggguacagcgccacggccagc

SEQ ID NO: 1543826 - RNA, 21 nt, Pseudomonas aeruginosa PA01
cggguaacgguagcggcagga

SEQ ID NO: 1543827 - RNA, 19 nt, Pseudomonas aeruginosa PA01
cgggguagggguggccagg

SEQ ID NO: 1543828 - RNA, 20 nt, Pseudomonas aeruginosa PA01
cgggggucggaugcagcgcu

SEQ ID NO: 1543829 - RNA, 15 nt, Pseudomonas aeruginosa PA01
cggggcucugccggu

SEQ ID NO: 1543830 - RNA, 17 nt, Pseudomonas aeruginosa PA01
cggggcuuuuucauucu

SEQ ID NO: 1543831 - RNA, 21 nt, Pseudomonas aeruginosa PA01
cggggcgccuccagcgggccu

SEQ ID NO: 1543832 - RNA, 14 nt, Pseudomonas aeruginosa PA01
cggggcgcucaggg

SEQ ID NO: 1543833 - RNA, 22 nt, Pseudomonas aeruginosa PA01
cggggcgaucuugaucgccagc

SEQ ID NO: 1543834 - RNA, 20 nt, Pseudomonas aeruginosa PA01
cggggcgccgcgcggcgccc

SEQ ID NO: 1543835 - RNA, 21 nt, Pseudomonas aeruginosa PA01
cggggcgcaccgccucgaccc

SEQ ID NO: 1543836 - RNA, 18 nt, Pseudomonas aeruginosa PA01
cggggcguauagcccggg

SEQ ID NO: 1543837 - RNA, 16 nt, Pseudomonas aeruginosa PA01
cggggcgugcaggccg

SEQ ID NO: 1543838 - RNA, 22 nt, Pseudomonas aeruginosa PA01
cggggcggccaaccucucccca

SEQ ID NO: 1543839 - RNA, 12 nt, Pseudomonas aeruginosa PA01
cggggcggcgca

SEQ ID NO: 1543840 - RNA, 17 nt, Pseudomonas aeruginosa PA01
cgggcugcgugccagca

SEQ ID NO: 1543841 - RNA, 17 nt, Pseudomonas aeruginosa PA01
cgggcuggccaccagca

SEQ ID NO: 1543842 - RNA, 18 nt, Pseudomonas aeruginosa PA01
cgggcuggccaccagcac

SEQ ID NO: 1543843 - RNA, 14 nt, Pseudomonas aeruginosa PA01
cgggcuggccaccg

SEQ ID NO: 1543844 - RNA, 14 nt, Pseudomonas aeruginosa PA01
cgggcucugugcuu

SEQ ID NO: 1543845 - RNA, 13 nt, Pseudomonas aeruginosa PA01
cgggcugccgcgg

SEQ ID NO: 1543846 - RNA, 19 nt, Pseudomonas aeruginosa PA01
cgggcuauucccgccgcuc

SEQ ID NO: 1543847 - RNA, 13 nt, Pseudomonas aeruginosa PA01
cgggcuccgccgc

SEQ ID NO: 1543848 - RNA, 15 nt, Pseudomonas aeruginosa PA01
cgggcuccgccgccg

SEQ ID NO: 1543849 - RNA, 15 nt, Pseudomonas aeruginosa PA01
cgggcucgcccaucu

SEQ ID NO: 1543850 - RNA, 22 nt, Pseudomonas aeruginosa PA01
cgggcuuuuucauuuccuccga

SEQ ID NO: 1543851 - RNA, 18 nt, Pseudomonas aeruginosa PA01
cgggcuggucguagcagc

SEQ ID NO: 1543852 - RNA, 21 nt, Pseudomonas aeruginosa PA01
cgggcuguagugcuccggggc

SEQ ID NO: 1543853 - RNA, 16 nt, Pseudomonas aeruginosa PA01
cgggcuucuucaccag

SEQ ID NO: 1543854 - RNA, 18 nt, Pseudomonas aeruginosa PA01
cggggcccggcuccagcc

SEQ ID NO: 1543855 - RNA, 22 nt, Pseudomonas aeruginosa PA01
cggggccuacugcuggacggcg

SEQ ID NO: 1543856 - RNA, 14 nt, Pseudomonas aeruginosa PA01
cggggccugcugcg

SEQ ID NO: 1543857 - RNA, 23 nt, Pseudomonas aeruginosa PA01
cggggccggacgcgacugcugcu

SEQ ID NO: 1543858 - RNA, 15 nt, Pseudomonas aeruginosa PA01
cggggccggcacccg

SEQ ID NO: 1543859 - RNA, 15 nt, Pseudomonas aeruginosa PA01
cggggcgaccagcau

SEQ ID NO: 1543860 - RNA, 20 nt, Pseudomonas aeruginosa PA01
cggggccccggcaagggccu

SEQ ID NO: 1543861 - RNA, 21 nt, Pseudomonas aeruginosa PA01
cggggccccggcaagggccug

SEQ ID NO: 1543862 - RNA, 21 nt, Pseudomonas aeruginosa PA01
cggggccaucagugccugcac

SEQ ID NO: 1543863 - RNA, 16 nt, Pseudomonas aeruginosa PA01
cggggcaggcgcaggc

SEQ ID NO: 1543864 - RNA, 13 nt, Pseudomonas aeruginosa PA01
cggggcaggcaug

SEQ ID NO: 1543865 - RNA, 17 nt, Pseudomonas aeruginosa PA01
cggggaagggacgucgc

SEQ ID NO: 1543866 - RNA, 14 nt, Pseudomonas aeruginosa PA01
cggggagaggggcu

SEQ ID NO: 1543867 - RNA, 18 nt, Pseudomonas aeruginosa PA01
cggggauguccgccgccc

SEQ ID NO: 1543868 - RNA, 19 nt, Pseudomonas aeruginosa PA01
cggguggcaacugccgccc

SEQ ID NO: 1543869 - RNA, 22 nt, Pseudomonas aeruginosa PA01
cggguggcaacugccgcccgcu

SEQ ID NO: 1543870 - RNA, 16 nt, Pseudomonas aeruginosa PA01
cggguggcaugggcca

SEQ ID NO: 1543871 - RNA, 16 nt, Pseudomonas aeruginosa PA01
cggguggucgccgccc

SEQ ID NO: 1543872 - RNA, 20 nt, Pseudomonas aeruginosa PA01
cggguggucgccgcccacgc

SEQ ID NO: 1543873 - RNA, 17 nt, Pseudomonas aeruginosa PA01
cgggugcguccauccag

SEQ ID NO: 1543874 - RNA, 15 nt, Pseudomonas aeruginosa PA01
cgggugcggcuggcg

SEQ ID NO: 1543875 - RNA, 15 nt, Pseudomonas aeruginosa PA01
cggguucagcccgcc

SEQ ID NO: 1543876 - RNA, 20 nt, Pseudomonas aeruginosa PA01
cggguucagcccgccgugcg

SEQ ID NO: 1543877 - RNA, 18 nt, Pseudomonas aeruginosa PA01
cggguuccucacggcgca

SEQ ID NO: 1543878 - RNA, 16 nt, Pseudomonas aeruginosa PA01
cggguucgugccaggc

SEQ ID NO: 1543879 - RNA, 13 nt, Pseudomonas aeruginosa PA01
cggguugagcacc

SEQ ID NO: 1543880 - RNA, 15 nt, Pseudomonas aeruginosa PA01
cggguugagguagag

SEQ ID NO: 1543881 - RNA, 23 nt, Pseudomonas aeruginosa PA01
cggguugaucagguucggcagcg

SEQ ID NO: 1543882 - RNA, 12 nt, Pseudomonas aeruginosa PA01
cggguucugcuc

SEQ ID NO: 1543883 - RNA, 20 nt, Pseudomonas aeruginosa PA01
cggguuggcuuccagccagc

SEQ ID NO: 1543884 - RNA, 16 nt, Pseudomonas aeruginosa PA01
cggguuuggcgcccgc

SEQ ID NO: 1543885 - RNA, 19 nt, Pseudomonas aeruginosa PA01
cgggucgacuucgcaccag

SEQ ID NO: 1543886 - RNA, 21 nt, Pseudomonas aeruginosa PA01
cgggucgcggcuggccgccug

SEQ ID NO: 1543887 - RNA, 22 nt, Pseudomonas aeruginosa PA01
cgggucggaugccacucguccc

SEQ ID NO: 1543888 - RNA, 21 nt, Pseudomonas aeruginosa PA01
cgggucucgaucagcgccggg

SEQ ID NO: 1543889 - RNA, 16 nt, Pseudomonas aeruginosa PA01
cgggucgucggucggc

SEQ ID NO: 1543890 - RNA, 16 nt, Pseudomonas aeruginosa PA01
cgggucguccuccacc

SEQ ID NO: 1543891 - RNA, 19 nt, Pseudomonas aeruginosa PA01
cgggucgucgaagcgcagc

SEQ ID NO: 1543892 - RNA, 20 nt, Pseudomonas aeruginosa PA01
cgggucgucgaagcgcagca

SEQ ID NO: 1543893 - RNA, 16 nt, Pseudomonas aeruginosa PA01
cgggucugcucgcgcu

SEQ ID NO: 1543894 - RNA, 18 nt, Pseudomonas aeruginosa PA01
cgggucuggcggaacagc

SEQ ID NO: 1543895 - RNA, 14 nt, Pseudomonas aeruginosa PA01
cgggucuugccggu

SEQ ID NO: 1543896 - RNA, 22 nt, Pseudomonas aeruginosa PA01
cgggucuugccggucugcugcg

SEQ ID NO: 1543897 - RNA, 18 nt, Pseudomonas aeruginosa PA01
cgggugccuuccgcgccc

SEQ ID NO: 1543898 - RNA, 22 nt, Pseudomonas aeruginosa PA01
cgggugccuuccgcgcccaggc

SEQ ID NO: 1543899 - RNA, 18 nt, Pseudomonas aeruginosa PA01
cgggugcagguucaccgc

SEQ ID NO: 1543900 - RNA, 14 nt, Pseudomonas aeruginosa PA01
cgggugccccaggc

SEQ ID NO: 1543901 - RNA, 15 nt, Pseudomonas aeruginosa PA01
cggguacgcgggccu

SEQ ID NO: 1543902 - RNA, 12 nt, Pseudomonas aeruginosa PA01
cggguagagcgc

SEQ ID NO: 1543903 - RNA, 14 nt, Pseudomonas aeruginosa PA01
cggguagagcgcgg

SEQ ID NO: 1543904 - RNA, 17 nt, Pseudomonas aeruginosa PA01
cggguagagcgcggcgc

SEQ ID NO: 1543905 - RNA, 21 nt, Pseudomonas aeruginosa PA01
cggguagagcgcggcgcaggc

SEQ ID NO: 1543906 - RNA, 16 nt, Pseudomonas aeruginosa PA01
cggguagagcgggccg

SEQ ID NO: 1543907 - RNA, 17 nt, Pseudomonas aeruginosa PA01
cggguagagcgggccgu

SEQ ID NO: 1543908 - RNA, 19 nt, Pseudomonas aeruginosa PA01
cggguauucagugaaaggg

SEQ ID NO: 1543909 - RNA, 13 nt, Pseudomonas aeruginosa PA01
cggguauccgccg

SEQ ID NO: 1543910 - RNA, 16 nt, Pseudomonas aeruginosa PA01
cggguauccgccgggc

SEQ ID NO: 1543911 - RNA, 19 nt, Pseudomonas aeruginosa PA01
cgggucacgccgagggcgc

SEQ ID NO: 1543912 - RNA, 13 nt, Pseudomonas aeruginosa PA01
cgggucaccagcg

SEQ ID NO: 1543913 - RNA, 16 nt, Pseudomonas aeruginosa PA01
cgggucaccagcgccg

SEQ ID NO: 1543914 - RNA, 15 nt, Pseudomonas aeruginosa PA01
cgggucagcagcacc

SEQ ID NO: 1543915 - RNA, 14 nt, Pseudomonas aeruginosa PA01
cgggucaguccuug

SEQ ID NO: 1543916 - RNA, 19 nt, Pseudomonas aeruginosa PA01
cgggucaucaccggcagga

SEQ ID NO: 1543917 - RNA, 21 nt, Pseudomonas aeruginosa PA01
cuucugcagggcggcuuccag

SEQ ID NO: 1543918 - RNA, 14 nt, Pseudomonas aeruginosa PA01
cuucugcaccuugg

SEQ ID NO: 1543919 - RNA, 17 nt, Pseudomonas aeruginosa PA01
cuucugcaccuuggcca

SEQ ID NO: 1543920 - RNA, 15 nt, Pseudomonas aeruginosa PA01
cuucugcgccuccuc

SEQ ID NO: 1543921 - RNA, 13 nt, Pseudomonas aeruginosa PA01
cuucugcgagccg

SEQ ID NO: 1543922 - RNA, 14 nt, Pseudomonas aeruginosa PA01
cuucugcgagccgc

SEQ ID NO: 1543923 - RNA, 21 nt, Pseudomonas aeruginosa PA01
cuucuggaaaucggcguccug

SEQ ID NO: 1543924 - RNA, 22 nt, Pseudomonas aeruginosa PA01
cuucuggaaaucggcguccugg

SEQ ID NO: 1543925 - RNA, 23 nt, Pseudomonas aeruginosa PA01
cuucugcuggauccucgccucgc

SEQ ID NO: 1543926 - RNA, 23 nt, Pseudomonas aeruginosa PA01
cuucuccagcagggucgccuggg

SEQ ID NO: 1543927 - RNA, 16 nt, Pseudomonas aeruginosa PA01
cuucuccccagaugcc

SEQ ID NO: 1543928 - RNA, 14 nt, Pseudomonas aeruginosa PA01
cuucuccggggccc

SEQ ID NO: 1543929 - RNA, 16 nt, Pseudomonas aeruginosa PA01
cuucuccgauuccugc

SEQ ID NO: 1543930 - RNA, 17 nt, Pseudomonas aeruginosa PA01
cuucuccgauuccugcg

SEQ ID NO: 1543931 - RNA, 20 nt, Pseudomonas aeruginosa PA01
cuucuccgccgcgugcgcgc

SEQ ID NO: 1543932 - RNA, 23 nt, Pseudomonas aeruginosa PA01
cuucucgucgaaggugaagcugc

SEQ ID NO: 1543933 - RNA, 17 nt, Pseudomonas aeruginosa PA01
cuucucgucgccgcccg

SEQ ID NO: 1543934 - RNA, 15 nt, Pseudomonas aeruginosa PA01
cuucucguagcgcuc

SEQ ID NO: 1543935 - RNA, 18 nt, Pseudomonas aeruginosa PA01
cuucucgaacagcuccuc

SEQ ID NO: 1543936 - RNA, 21 nt, Pseudomonas aeruginosa PA01
cuucucgacgaaggcgcgcuc

SEQ ID NO: 1543937 - RNA, 22 nt, Pseudomonas aeruginosa PA01
cuucguuuucaggcgacgccgc

SEQ ID NO: 1543938 - RNA, 22 nt, Pseudomonas aeruginosa PA01
cuucguugaugcgcguggcacg

SEQ ID NO: 1543939 - RNA, 18 nt, Pseudomonas aeruginosa PA01
cuucgugggccugcucgg

SEQ ID NO: 1543940 - RNA, 18 nt, Pseudomonas aeruginosa PA01
cuucgguguaucggcgga

SEQ ID NO: 1543941 - RNA, 21 nt, Pseudomonas aeruginosa PA01
cuucggugucguauuccaggg

SEQ ID NO: 1543942 - RNA, 15 nt, Pseudomonas aeruginosa PA01
cuucguccugcugcu

SEQ ID NO: 1543943 - RNA, 18 nt, Pseudomonas aeruginosa PA01
cuucguccugcugcuggc

SEQ ID NO: 1543944 - RNA, 21 nt, Pseudomonas aeruginosa PA01
cuucgucgaagaccagggugg

SEQ ID NO: 1543945 - RNA, 22 nt, Pseudomonas aeruginosa PA01
cuucgucgaagaccaggguggg

SEQ ID NO: 1543946 - RNA, 18 nt, Pseudomonas aeruginosa PA01
cuucguccggccgcccga

SEQ ID NO: 1543947 - RNA, 21 nt, Pseudomonas aeruginosa PA01
cuucuacgccuugcggcgccg

SEQ ID NO: 1543948 - RNA, 20 nt, Pseudomonas aeruginosa PA01
cuucuucugcagcucggccu

SEQ ID NO: 1543949 - RNA, 18 nt, Pseudomonas aeruginosa PA01
cuucuucgcuggaccagg

SEQ ID NO: 1543950 - RNA, 22 nt, Pseudomonas aeruginosa PA01
cuucuuccccgccacuuccagc

SEQ ID NO: 1543951 - RNA, 19 nt, Pseudomonas aeruginosa PA01
cuucugguaggccagcagg

SEQ ID NO: 1543952 - RNA, 18 nt, Pseudomonas aeruginosa PA01
cuugaaaacugucggcgg

SEQ ID NO: 1543953 - RNA, 21 nt, Pseudomonas aeruginosa PA01
cuugacccucugguuggccga

SEQ ID NO: 1543954 - RNA, 17 nt, Pseudomonas aeruginosa PA01
cuugaccagcggcccgg

SEQ ID NO: 1543955 - RNA, 18 nt, Pseudomonas aeruginosa PA01
cuugaccagcggcccggc

SEQ ID NO: 1543956 - RNA, 18 nt, Pseudomonas aeruginosa PA01
cuugaccaucuuuuccug

SEQ ID NO: 1543957 - RNA, 16 nt, Pseudomonas aeruginosa PA01
cuugacccgacugcag

SEQ ID NO: 1543958 - RNA, 17 nt, Pseudomonas aeruginosa PA01
cuugaccacggcgagga

SEQ ID NO: 1543959 - RNA, 23 nt, Pseudomonas aeruginosa PA01
cuugaacaccucuucgccauccu

SEQ ID NO: 1543960 - RNA, 20 nt, Pseudomonas aeruginosa PA01
cuugaacucgcccggcucgg

SEQ ID NO: 1543961 - RNA, 15 nt, Pseudomonas aeruginosa PA01
cuugaaggugcccag

SEQ ID NO: 1543962 - RNA, 16 nt, Pseudomonas aeruginosa PA01
cuugaaggugcccagg

SEQ ID NO: 1543963 - RNA, 15 nt, Pseudomonas aeruginosa PA01
cuugaucacguccag

SEQ ID NO: 1543964 - RNA, 20 nt, Pseudomonas aeruginosa PA01
cuugauccgcuccagcgccu

SEQ ID NO: 1543965 - RNA, 19 nt, Pseudomonas aeruginosa PA01
cuugaggucguccaccucc

SEQ ID NO: 1543966 - RNA, 18 nt, Pseudomonas aeruginosa PA01
cuugaggucgugcagcac

SEQ ID NO: 1543967 - RNA, 21 nt, Pseudomonas aeruginosa PA01
cuugaggaaguagugcagcug

SEQ ID NO: 1543968 - RNA, 21 nt, Pseudomonas aeruginosa PA01
cuugaggaaguugcgcagcaa

SEQ ID NO: 1543969 - RNA, 23 nt, Pseudomonas aeruginosa PA01
cuugaggaaguugcgcagcaacu

SEQ ID NO: 1543970 - RNA, 16 nt, Pseudomonas aeruginosa PA01
cuugaggccuuucuuc

SEQ ID NO: 1543971 - RNA, 20 nt, Pseudomonas aeruginosa PA01
cuugagguaggccagcccca

SEQ ID NO: 1543972 - RNA, 22 nt, Pseudomonas aeruginosa PA01
cuugagguaggccagccccaga

SEQ ID NO: 1543973 - RNA, 14 nt, Pseudomonas aeruginosa PA01
cuugagcagccagg

SEQ ID NO: 1543974 - RNA, 18 nt, Pseudomonas aeruginosa PA01
cuugagcagccaggcgaa

SEQ ID NO: 1543975 - RNA, 15 nt, Pseudomonas aeruginosa PA01
cuugagcgccagcag

SEQ ID NO: 1543976 - RNA, 17 nt, Pseudomonas aeruginosa PA01
cuugacgaucuucugca

SEQ ID NO: 1543977 - RNA, 19 nt, Pseudomonas aeruginosa PA01
cuugaccgccgccugggug

SEQ ID NO: 1543978 - RNA, 18 nt, Pseudomonas aeruginosa PA01
cuugaccucgacgccgag

SEQ ID NO: 1543979 - RNA, 19 nt, Pseudomonas aeruginosa PA01
cuugaccuugucggccgac

SEQ ID NO: 1543980 - RNA, 17 nt, Pseudomonas aeruginosa PA01
cuugacgaaaaagccgg

SEQ ID NO: 1543981 - RNA, 19 nt, Pseudomonas aeruginosa PA01
cuugacgaaggcggcagcg

SEQ ID NO: 1543982 - RNA, 16 nt, Pseudomonas aeruginosa PA01
cuugaucgucucggug

SEQ ID NO: 1543983 - RNA, 18 nt, Pseudomonas aeruginosa PA01
cuugccacugcgcgccag

SEQ ID NO: 1543984 - RNA, 13 nt, Pseudomonas aeruginosa PA01
cuugcagggccgc

SEQ ID NO: 1543985 - RNA, 14 nt, Pseudomonas aeruginosa PA01
cuugcagggccgcc

SEQ ID NO: 1543986 - RNA, 15 nt, Pseudomonas aeruginosa PA01
cuugcacauccagcc

SEQ ID NO: 1543987 - RNA, 18 nt, Pseudomonas aeruginosa PA01
cuugcacauccagcccug

SEQ ID NO: 1543988 - RNA, 22 nt, Pseudomonas aeruginosa PA01
cuugccgccgguucgcaggcca

SEQ ID NO: 1543989 - RNA, 13 nt, Pseudomonas aeruginosa PA01
cuugccgccgccg

SEQ ID NO: 1543990 - RNA, 15 nt, Pseudomonas aeruginosa PA01
cuugccgagcugggc

SEQ ID NO: 1543991 - RNA, 21 nt, Pseudomonas aeruginosa PA01
cuugccgaugucgccggcaug

SEQ ID NO: 1543992 - RNA, 23 nt, Pseudomonas aeruginosa PA01
cuugccgcucaggcugugcagga

SEQ ID NO: 1543993 - RNA, 15 nt, Pseudomonas aeruginosa PA01
cuugccgcgcccggc

SEQ ID NO: 1543994 - RNA, 16 nt, Pseudomonas aeruginosa PA01
cuugccgcgcccggcc

SEQ ID NO: 1543995 - RNA, 13 nt, Pseudomonas aeruginosa PA01
cuugccggcgcgc

SEQ ID NO: 1543996 - RNA, 14 nt, Pseudomonas aeruginosa PA01
cuugccggcugcgc

SEQ ID NO: 1543997 - RNA, 16 nt, Pseudomonas aeruginosa PA01
cuugccggcugcgccg

SEQ ID NO: 1543998 - RNA, 14 nt, Pseudomonas aeruginosa PA01
cuugccuuccaggc

SEQ ID NO: 1543999 - RNA, 15 nt, Pseudomonas aeruginosa PA01
cuugccuuccaggcu

SEQ ID NO: 1544000 - RNA, 16 nt, Pseudomonas aeruginosa PA01
cuugccuuccugggcg

SEQ ID NO: 1544001 - RNA, 17 nt, Pseudomonas aeruginosa PA01
cuugcgaaaagcccgcc

SEQ ID NO: 1544002 - RNA, 17 nt, Pseudomonas aeruginosa PA01
cuugccggucugcugcg

SEQ ID NO: 1544003 - RNA, 14 nt, Pseudomonas aeruginosa PA01
cuugccguccagcc

SEQ ID NO: 1544004 - RNA, 14 nt, Pseudomonas aeruginosa PA01
cuugccguggcucc

SEQ ID NO: 1544005 - RNA, 18 nt, Pseudomonas aeruginosa PA01
cuugccguggcuccugga

SEQ ID NO: 1544006 - RNA, 19 nt, Pseudomonas aeruginosa PA01
cuugccguggcuccuggag

SEQ ID NO: 1544007 - RNA, 20 nt, Pseudomonas aeruginosa PA01
cuugccguggcuccuggagg

SEQ ID NO: 1544008 - RNA, 14 nt, Pseudomonas aeruginosa PA01
cuugccguugcuca

SEQ ID NO: 1544009 - RNA, 21 nt, Pseudomonas aeruginosa PA01
cuugccgacaagccuccagcg

SEQ ID NO: 1544010 - RNA, 23 nt, Pseudomonas aeruginosa PA01
cuugccgacaagccuccagcgcc

SEQ ID NO: 1544011 - RNA, 22 nt, Pseudomonas aeruginosa PA01
cuugccgaagauacccagcggg

SEQ ID NO: 1544012 - RNA, 14 nt, Pseudomonas aeruginosa PA01
cuugcccaugugca

SEQ ID NO: 1544013 - RNA, 20 nt, Pseudomonas aeruginosa PA01
cuugcccucggcgcccgccu

SEQ ID NO: 1544014 - RNA, 13 nt, Pseudomonas aeruginosa PA01
cuugcccugggcg

SEQ ID NO: 1544015 - RNA, 23 nt, Pseudomonas aeruginosa PA01
cuugcucgcggcguaggccucgg

SEQ ID NO: 1544016 - RNA, 15 nt, Pseudomonas aeruginosa PA01
cuugcugaagcccca

SEQ ID NO: 1544017 - RNA, 17 nt, Pseudomonas aeruginosa PA01
cuugcuacgggucaguc

SEQ ID NO: 1544018 - RNA, 23 nt, Pseudomonas aeruginosa PA01
cuugcuacgggucaguccuuguc

SEQ ID NO: 1544019 - RNA, 15 nt, Pseudomonas aeruginosa PA01
cuugcuccagaucgc

SEQ ID NO: 1544020 - RNA, 17 nt, Pseudomonas aeruginosa PA01
cuugcuggcgcgauccg

SEQ ID NO: 1544021 - RNA, 18 nt, Pseudomonas aeruginosa PA01
cuugcgccggcugccgcg

SEQ ID NO: 1544022 - RNA, 13 nt, Pseudomonas aeruginosa PA01
cuugcgcccggcu

SEQ ID NO: 1544023 - RNA, 15 nt, Pseudomonas aeruginosa PA01
cuugcgcgccaccag

SEQ ID NO: 1544024 - RNA, 14 nt, Pseudomonas aeruginosa PA01
cuugcgcgccgccg

SEQ ID NO: 1544025 - RNA, 11 nt, Pseudomonas aeruginosa PA01
cuugcgcggca

SEQ ID NO: 1544026 - RNA, 16 nt, Pseudomonas aeruginosa PA01
cuugcgcggcaggccg

SEQ ID NO: 1544027 - RNA, 15 nt, Pseudomonas aeruginosa PA01
cuugcgccaggccuu

SEQ ID NO: 1544028 - RNA, 13 nt, Pseudomonas aeruginosa PA01
cuugcgcaccgcc

SEQ ID NO: 1544029 - RNA, 13 nt, Pseudomonas aeruginosa PA01
cuugcgcaggcgg

SEQ ID NO: 1544030 - RNA, 15 nt, Pseudomonas aeruginosa PA01
cuugcgcagggcggc

SEQ ID NO: 1544031 - RNA, 15 nt, Pseudomonas aeruginosa PA01
cuugcgcuccuuggc

SEQ ID NO: 1544032 - RNA, 19 nt, Pseudomonas aeruginosa PA01
cuugcgcuccuuggcuggc

SEQ ID NO: 1544033 - RNA, 19 nt, Pseudomonas aeruginosa PA01
cuugcggcgccgaggcccu

SEQ ID NO: 1544034 - RNA, 14 nt, Pseudomonas aeruginosa PA01
cuugcggcgcggcc

SEQ ID NO: 1544035 - RNA, 17 nt, Pseudomonas aeruginosa PA01
cuugcggcgcggcccgu

SEQ ID NO: 1544036 - RNA, 15 nt, Pseudomonas aeruginosa PA01
cuugcguuccuccuc

SEQ ID NO: 1544037 - RNA, 23 nt, Pseudomonas aeruginosa PA01
cuugcgucccugggccugcaggu

SEQ ID NO: 1544038 - RNA, 14 nt, Pseudomonas aeruginosa PA01
cuugcguccugccu

SEQ ID NO: 1544039 - RNA, 16 nt, Pseudomonas aeruginosa PA01
cuugcggguggucuug

SEQ ID NO: 1544040 - RNA, 14 nt, Pseudomonas aeruginosa PA01
cuugcggccguucu

SEQ ID NO: 1544041 - RNA, 13 nt, Pseudomonas aeruginosa PA01
cuguuucaggccg

SEQ ID NO: 1544042 - RNA, 21 nt, Pseudomonas aeruginosa PA01
cuguuucaacucccaggacac

SEQ ID NO: 1544043 - RNA, 15 nt, Pseudomonas aeruginosa PA01
cuguucggcaggggg

SEQ ID NO: 1544044 - RNA, 19 nt, Pseudomonas aeruginosa PA01
cuguucgucccgagcaccg

SEQ ID NO: 1544045 - RNA, 21 nt, Pseudomonas aeruginosa PA01
cuguuguugccggucuugccg

SEQ ID NO: 1544046 - RNA, 13 nt, Pseudomonas aeruginosa PA01
cuguucggccagg

SEQ ID NO: 1544047 - RNA, 16 nt, Pseudomonas aeruginosa PA01
cuguucggccagggag

SEQ ID NO: 1544048 - RNA, 14 nt, Pseudomonas aeruginosa PA01
cuguucggccuugc

SEQ ID NO: 1544049 - RNA, 17 nt, Pseudomonas aeruginosa PA01
cuguucggccuugcucu

SEQ ID NO: 1544050 - RNA, 19 nt, Pseudomonas aeruginosa PA01
cuguuccgggcccaguucg

SEQ ID NO: 1544051 - RNA, 13 nt, Pseudomonas aeruginosa PA01
cuguucgaccagu

SEQ ID NO: 1544052 - RNA, 21 nt, Pseudomonas aeruginosa PA01
cuguuccgcgaucaacgguag

SEQ ID NO: 1544053 - RNA, 22 nt, Pseudomonas aeruginosa PA01
cuggccgagcgccgccugggcc

SEQ ID NO: 1544054 - RNA, 17 nt, Pseudomonas aeruginosa PA01
cuggcccuggcgcaggc

SEQ ID NO: 1544055 - RNA, 22 nt, Pseudomonas aeruginosa PA01
cuggcccuggcgcaggcggcgc

SEQ ID NO: 1544056 - RNA, 21 nt, Pseudomonas aeruginosa PA01
cuggcccgggguauggccuuc

SEQ ID NO: 1544057 - RNA, 14 nt, Pseudomonas aeruginosa PA01
cuggcccuccaucc

SEQ ID NO: 1544058 - RNA, 22 nt, Pseudomonas aeruginosa PA01
cuggcccuggauaucugggcca

SEQ ID NO: 1544059 - RNA, 22 nt, Pseudomonas aeruginosa PA01
cuggcccucucucgccucggcg

SEQ ID NO: 1544060 - RNA, 18 nt, Pseudomonas aeruginosa PA01
cuggcccaguugcccggc

SEQ ID NO: 1544061 - RNA, 17 nt, Pseudomonas aeruginosa PA01
cuggcccagcuugaugu

SEQ ID NO: 1544062 - RNA, 16 nt, Pseudomonas aeruginosa PA01
cuguuucggguccagg

SEQ ID NO: 1544063 - RNA, 21 nt, Pseudomonas aeruginosa PA01
cuuaggcggauaacgccagga

SEQ ID NO: 1544064 - RNA, 15 nt, Pseudomonas aeruginosa PA01
cuuccagcuuggcac

SEQ ID NO: 1544065 - RNA, 13 nt, Pseudomonas aeruginosa PA01
cuuccagcugcca

SEQ ID NO: 1544066 - RNA, 23 nt, Pseudomonas aeruginosa PA01
cuuccagggugggcggugcggca

SEQ ID NO: 1544067 - RNA, 17 nt, Pseudomonas aeruginosa PA01
cuuccccguugccgagg

SEQ ID NO: 1544068 - RNA, 18 nt, Pseudomonas aeruginosa PA01
cuuccccugcaugccggc

SEQ ID NO: 1544069 - RNA, 17 nt, Pseudomonas aeruginosa PA01
cuucccguaaggccagg

SEQ ID NO: 1544070 - RNA, 16 nt, Pseudomonas aeruginosa PA01
cuucccgcggcuccag

SEQ ID NO: 1544071 - RNA, 18 nt, Pseudomonas aeruginosa PA01
cuucccgcggcuccagcc

SEQ ID NO: 1544072 - RNA, 23 nt, Pseudomonas aeruginosa PA01
cuucccgcccaucaacgagccga

SEQ ID NO: 1544073 - RNA, 23 nt, Pseudomonas aeruginosa PA01
cuuccggcgcuccacagcugcca

SEQ ID NO: 1544074 - RNA, 13 nt, Pseudomonas aeruginosa PA01
cuuccggcuccag

SEQ ID NO: 1544075 - RNA, 20 nt, Pseudomonas aeruginosa PA01
cuuccagaccucgagcaggc

SEQ ID NO: 1544076 - RNA, 22 nt, Pseudomonas aeruginosa PA01
cuuccagaacgccgcgcaccuc

SEQ ID NO: 1544077 - RNA, 17 nt, Pseudomonas aeruginosa PA01
cuuccacuugcgccggc

SEQ ID NO: 1544078 - RNA, 14 nt, Pseudomonas aeruginosa PA01
cuuccacuccaggc

SEQ ID NO: 1544079 - RNA, 14 nt, Pseudomonas aeruginosa PA01
cuuccaccgccugc

SEQ ID NO: 1544080 - RNA, 20 nt, Pseudomonas aeruginosa PA01
cuuccaccgggaagcagguc

SEQ ID NO: 1544081 - RNA, 19 nt, Pseudomonas aeruginosa PA01
cuucggucgcgccccgcca

SEQ ID NO: 1544082 - RNA, 23 nt, Pseudomonas aeruginosa PA01
cuucggcgugcauggccgggccg

SEQ ID NO: 1544083 - RNA, 16 nt, Pseudomonas aeruginosa PA01
cuucggcuccagcacc

SEQ ID NO: 1544084 - RNA, 22 nt, Pseudomonas aeruginosa PA01
cuucgcgcuccaggcccggcag

SEQ ID NO: 1544085 - RNA, 18 nt, Pseudomonas aeruginosa PA01
cuucgcggaucaacgccg

SEQ ID NO: 1544086 - RNA, 22 nt, Pseudomonas aeruginosa PA01
cuucgcgacccucagucgcccc

SEQ ID NO: 1544087 - RNA, 16 nt, Pseudomonas aeruginosa PA01
cuucgccgucgagcca

SEQ ID NO: 1544088 - RNA, 22 nt, Pseudomonas aeruginosa PA01
cuucgccuucggcgugcauggc

SEQ ID NO: 1544089 - RNA, 13 nt, Pseudomonas aeruginosa PA01
cuucgccuugccc

SEQ ID NO: 1544090 - RNA, 19 nt, Pseudomonas aeruginosa PA01
cuucgccuugcccuggccg

SEQ ID NO: 1544091 - RNA, 17 nt, Pseudomonas aeruginosa PA01
cuucgccggagccuucu

SEQ ID NO: 1544092 - RNA, 14 nt, Pseudomonas aeruginosa PA01
cuucgacgacaccu

SEQ ID NO: 1544093 - RNA, 22 nt, Pseudomonas aeruginosa PA01
cuucgacgacaccugcaacgcc

SEQ ID NO: 1544094 - RNA, 16 nt, Pseudomonas aeruginosa PA01
cuucgagcacuuccca

SEQ ID NO: 1544095 - RNA, 19 nt, Pseudomonas aeruginosa PA01
cuuccugggaauugcgcac

SEQ ID NO: 1544096 - RNA, 19 nt, Pseudomonas aeruginosa PA01
cuuccugggcgugcuuggc

SEQ ID NO: 1544097 - RNA, 15 nt, Pseudomonas aeruginosa PA01
cuuccuggaagcgau

SEQ ID NO: 1544098 - RNA, 21 nt, Pseudomonas aeruginosa PA01
cuuccuggaagcgaugggcga

SEQ ID NO: 1544099 - RNA, 21 nt, Pseudomonas aeruginosa PA01
cuuccugcacgcugcgccggc

SEQ ID NO: 1544100 - RNA, 15 nt, Pseudomonas aeruginosa PA01
cuuccugccagcgcg

SEQ ID NO: 1544101 - RNA, 17 nt, Pseudomonas aeruginosa PA01
cuucgacauaggacugc

SEQ ID NO: 1544102 - RNA, 13 nt, Pseudomonas aeruginosa PA01
cuuccuacaucuu

SEQ ID NO: 1544103 - RNA, 19 nt, Pseudomonas aeruginosa PA01
cuuccggguugaaggcgcg

SEQ ID NO: 1544104 - RNA, 23 nt, Pseudomonas aeruginosa PA01
cuucaguaggccagcggcuccuc

SEQ ID NO: 1544105 - RNA, 19 nt, Pseudomonas aeruginosa PA01
cuucagauacuccagcagc

SEQ ID NO: 1544106 - RNA, 13 nt, Pseudomonas aeruginosa PA01
cuucagagcugga

SEQ ID NO: 1544107 - RNA, 14 nt, Pseudomonas aeruginosa PA01
cuucagagcuggac

SEQ ID NO: 1544108 - RNA, 19 nt, Pseudomonas aeruginosa PA01
cuucagagcuggacgacgc

SEQ ID NO: 1544109 - RNA, 22 nt, Pseudomonas aeruginosa PA01
cuucagagcagggugaagcugc

SEQ ID NO: 1544110 - RNA, 16 nt, Pseudomonas aeruginosa PA01
cuucagcaacucuucc

SEQ ID NO: 1544111 - RNA, 11 nt, Pseudomonas aeruginosa PA01
cuucagcucca

SEQ ID NO: 1544112 - RNA, 14 nt, Pseudomonas aeruginosa PA01
cuucagcuccagca

SEQ ID NO: 1544113 - RNA, 16 nt, Pseudomonas aeruginosa PA01
cuucagcuccagcagu

SEQ ID NO: 1544114 - RNA, 21 nt, Pseudomonas aeruginosa PA01
cuucaggagggaacgucuggc

SEQ ID NO: 1544115 - RNA, 21 nt, Pseudomonas aeruginosa PA01
cuucagcuccgagccacggau

SEQ ID NO: 1544116 - RNA, 16 nt, Pseudomonas aeruginosa PA01
cuucaggcgcuccugg

SEQ ID NO: 1544117 - RNA, 23 nt, Pseudomonas aeruginosa PA01
cuucaggcugucggccaucgccg

SEQ ID NO: 1544118 - RNA, 17 nt, Pseudomonas aeruginosa PA01
cuucaggcucggccugu

SEQ ID NO: 1544119 - RNA, 16 nt, Pseudomonas aeruginosa PA01
cuucagggagaggaag

SEQ ID NO: 1544120 - RNA, 23 nt, Pseudomonas aeruginosa PA01
cuucaggguggcgcugccuucga

SEQ ID NO: 1544121 - RNA, 14 nt, Pseudomonas aeruginosa PA01
cuucaaccacucca

SEQ ID NO: 1544122 - RNA, 17 nt, Pseudomonas aeruginosa PA01
cuucaaccacuccagcg

SEQ ID NO: 1544123 - RNA, 15 nt, Pseudomonas aeruginosa PA01
cuucaaaaaccaugc

SEQ ID NO: 1544124 - RNA, 19 nt, Pseudomonas aeruginosa PA01
cuucaagcggccauuuuuc

SEQ ID NO: 1544125 - RNA, 18 nt, Pseudomonas aeruginosa PA01
cuucaccaccagcgagga

SEQ ID NO: 1544126 - RNA, 22 nt, Pseudomonas aeruginosa PA01
cuucacauggugggcgccgcug

SEQ ID NO: 1544127 - RNA, 19 nt, Pseudomonas aeruginosa PA01
cuuguucggcuggaccucc

SEQ ID NO: 1544128 - RNA, 15 nt, Pseudomonas aeruginosa PA01
cuuguuggccagcag

SEQ ID NO: 1544129 - RNA, 13 nt, Pseudomonas aeruginosa PA01
cuuguccuggaua

SEQ ID NO: 1544130 - RNA, 13 nt, Pseudomonas aeruginosa PA01
cuuguccggcccg

SEQ ID NO: 1544131 - RNA, 14 nt, Pseudomonas aeruginosa PA01
cuuguccggcccgg

SEQ ID NO: 1544132 - RNA, 17 nt, Pseudomonas aeruginosa PA01
cuuguccuuggccuccg

SEQ ID NO: 1544133 - RNA, 22 nt, Pseudomonas aeruginosa PA01
cuugucgagguagguccaggcg

SEQ ID NO: 1544134 - RNA, 14 nt, Pseudomonas aeruginosa PA01
cuugucgaccagcg

SEQ ID NO: 1544135 - RNA, 15 nt, Pseudomonas aeruginosa PA01
cuugucgccgcuggg

SEQ ID NO: 1544136 - RNA, 16 nt, Pseudomonas aeruginosa PA01
cuugucgcaccagccu

SEQ ID NO: 1544137 - RNA, 16 nt, Pseudomonas aeruginosa PA01
cuugucgauggucagg

SEQ ID NO: 1544138 - RNA, 19 nt, Pseudomonas aeruginosa PA01
cuugucgauggucaggauc

SEQ ID NO: 1544139 - RNA, 11 nt, Pseudomonas aeruginosa PA01
cuugugaaagg

SEQ ID NO: 1544140 - RNA, 18 nt, Pseudomonas aeruginosa PA01
cuugugaaagggcggcag

SEQ ID NO: 1544141 - RNA, 16 nt, Pseudomonas aeruginosa PA01
cuugucuuucugcgac

SEQ ID NO: 1544142 - RNA, 20 nt, Pseudomonas aeruginosa PA01
cuuguggccgaucuccuggu

SEQ ID NO: 1544143 - RNA, 22 nt, Pseudomonas aeruginosa PA01
cuuguggccgaucuccugguag

SEQ ID NO: 1544144 - RNA, 14 nt, Pseudomonas aeruginosa PA01
cuuguucagggugg

SEQ ID NO: 1544145 - RNA, 19 nt, Pseudomonas aeruginosa PA01
cuugguauccaccucgccc

SEQ ID NO: 1544146 - RNA, 19 nt, Pseudomonas aeruginosa PA01
cuuggucacgccguucagg

SEQ ID NO: 1544147 - RNA, 21 nt, Pseudomonas aeruginosa PA01
cuuggucacgccguucagggu

SEQ ID NO: 1544148 - RNA, 14 nt, Pseudomonas aeruginosa PA01
cuuggucaucaccu

SEQ ID NO: 1544149 - RNA, 16 nt, Pseudomonas aeruginosa PA01
cuuggugucggccgcc

SEQ ID NO: 1544150 - RNA, 19 nt, Pseudomonas aeruginosa PA01
cuuggucgggcgccgcgcc

SEQ ID NO: 1544151 - RNA, 14 nt, Pseudomonas aeruginosa PA01
cuuguccgagaccg

SEQ ID NO: 1544152 - RNA, 18 nt, Pseudomonas aeruginosa PA01
cuuguccgcgcgcuucca

SEQ ID NO: 1544153 - RNA, 18 nt, Pseudomonas aeruginosa PA01
cuuguccaggcgcugcuc

SEQ ID NO: 1544154 - RNA, 16 nt, Pseudomonas aeruginosa PA01
cuuguccaccaccgac

SEQ ID NO: 1544155 - RNA, 16 nt, Pseudomonas aeruginosa PA01
cuuguagcagccgcag

SEQ ID NO: 1544156 - RNA, 21 nt, Pseudomonas aeruginosa PA01
cuuguacagcuucaggcgcac

SEQ ID NO: 1544157 - RNA, 19 nt, Pseudomonas aeruginosa PA01
cuuggcgggcucgcccauc

SEQ ID NO: 1544158 - RNA, 21 nt, Pseudomonas aeruginosa PA01
cuuggccuccggacgcugcau

SEQ ID NO: 1544159 - RNA, 20 nt, Pseudomonas aeruginosa PA01
cuuggcgcagguagucgcuc

SEQ ID NO: 1544160 - RNA, 18 nt, Pseudomonas aeruginosa PA01
cuuggcgcgcgacagaua

SEQ ID NO: 1544161 - RNA, 16 nt, Pseudomonas aeruginosa PA01
cuuggcuucagcuucu

SEQ ID NO: 1544162 - RNA, 16 nt, Pseudomonas aeruginosa PA01
cuuggcgucgcggcuu

SEQ ID NO: 1544163 - RNA, 22 nt, Pseudomonas aeruginosa PA01
cuugggccaggcauccagcacc

SEQ ID NO: 1544164 - RNA, 12 nt, Pseudomonas aeruginosa PA01
cuugggcaucga

SEQ ID NO: 1544165 - RNA, 21 nt, Pseudomonas aeruginosa PA01
cuugggcgccucgccgcggca

SEQ ID NO: 1544166 - RNA, 16 nt, Pseudomonas aeruginosa PA01
cuuggccacuccgggc

SEQ ID NO: 1544167 - RNA, 13 nt, Pseudomonas aeruginosa PA01
cuuggccagccgc

SEQ ID NO: 1544168 - RNA, 15 nt, Pseudomonas aeruginosa PA01
cuuggccagccgcgc

SEQ ID NO: 1544169 - RNA, 21 nt, Pseudomonas aeruginosa PA01
cuuggccagcgcggugcgcgc

SEQ ID NO: 1544170 - RNA, 20 nt, Pseudomonas aeruginosa PA01
cuuugcgcagccacccgcuc

SEQ ID NO: 1544171 - RNA, 13 nt, Pseudomonas aeruginosa PA01
cuuugccuggaaa

SEQ ID NO: 1544172 - RNA, 18 nt, Pseudomonas aeruginosa PA01
cuuugccuggaaaaagac

SEQ ID NO: 1544173 - RNA, 21 nt, Pseudomonas aeruginosa PA01
cuuugagggucagaccagccc

SEQ ID NO: 1544174 - RNA, 14 nt, Pseudomonas aeruginosa PA01
cuuuccugcuccag

SEQ ID NO: 1544175 - RNA, 14 nt, Pseudomonas aeruginosa PA01
cuuuccucaucucc

SEQ ID NO: 1544176 - RNA, 20 nt, Pseudomonas aeruginosa PA01
cuuuccggcgcggccugcag

SEQ ID NO: 1544177 - RNA, 16 nt, Pseudomonas aeruginosa PA01
cuuuccaggcgccgcu

SEQ ID NO: 1544178 - RNA, 22 nt, Pseudomonas aeruginosa PA01
cuuucgcgucugguagauggac

SEQ ID NO: 1544179 - RNA, 17 nt, Pseudomonas aeruginosa PA01
cuuucggugaacuucuc

SEQ ID NO: 1544180 - RNA, 17 nt, Pseudomonas aeruginosa PA01
cuuucggaacagcgccu

SEQ ID NO: 1544181 - RNA, 12 nt, Pseudomonas aeruginosa PA01
cuuucaccuggu

SEQ ID NO: 1544182 - RNA, 15 nt, Pseudomonas aeruginosa PA01
cuuuccaccgccagc

SEQ ID NO: 1544183 - RNA, 19 nt, Pseudomonas aeruginosa PA01
cuuuccaccgccagcaccc

SEQ ID NO: 1544184 - RNA, 21 nt, Pseudomonas aeruginosa PA01
gaaacaguuggacugcgaggc

SEQ ID NO: 1544185 - RNA, 13 nt, Pseudomonas aeruginosa PA01
gaaacaccaggcc

SEQ ID NO: 1544186 - RNA, 14 nt, Pseudomonas aeruginosa PA01
gaaaccaccaggaa

SEQ ID NO: 1544187 - RNA, 21 nt, Pseudomonas aeruginosa PA01
gaaaccaccuggaacuugcug

SEQ ID NO: 1544188 - RNA, 13 nt, Pseudomonas aeruginosa PA01
gaaaccucgccga

SEQ ID NO: 1544189 - RNA, 17 nt, Pseudomonas aeruginosa PA01
gaaaccgcggccggcuu

SEQ ID NO: 1544190 - RNA, 17 nt, Pseudomonas aeruginosa PA01
gaaaccguggucgccgc

SEQ ID NO: 1544191 - RNA, 18 nt, Pseudomonas aeruginosa PA01
gaaacccuuccagccgcc

SEQ ID NO: 1544192 - RNA, 23 nt, Pseudomonas aeruginosa PA01
gaaacccgugguccgccagcagg

SEQ ID NO: 1544193 - RNA, 16 nt, Pseudomonas aeruginosa PA01
gaaaccgaucagcacc

SEQ ID NO: 1544194 - RNA, 22 nt, Pseudomonas aeruginosa PA01
gaaaccgccaucgauggucagg

SEQ ID NO: 1544195 - RNA, 14 nt, Pseudomonas aeruginosa PA01
gaaaccggccagcg

SEQ ID NO: 1544196 - RNA, 16 nt, Pseudomonas aeruginosa PA01
gaaaccggccagcgca

SEQ ID NO: 1544197 - RNA, 17 nt, Pseudomonas aeruginosa PA01
gaaaccggcgaaccagu

SEQ ID NO: 1544198 - RNA, 22 nt, Pseudomonas aeruginosa PA01
cuuuuugcgccagguagccugg

SEQ ID NO: 1544199 - RNA, 19 nt, Pseudomonas aeruginosa PA01
cuuuuuucauggcggucag

SEQ ID NO: 1544200 - RNA, 21 nt, Pseudomonas aeruginosa PA01
cuuuuucauggccuggcgcuc

SEQ ID NO: 1544201 - RNA, 16 nt, Pseudomonas aeruginosa PA01
gaaaaaaggggaugcc

SEQ ID NO: 1544202 - RNA, 19 nt, Pseudomonas aeruginosa PA01
gaaaaagacaaaauucucc

SEQ ID NO: 1544203 - RNA, 21 nt, Pseudomonas aeruginosa PA01
cuuuugcaaucggcgagccgc

SEQ ID NO: 1544204 - RNA, 18 nt, Pseudomonas aeruginosa PA01
gaaaugcucgugcaggua

SEQ ID NO: 1544205 - RNA, 22 nt, Pseudomonas aeruginosa PA01
gaaaugcucgugcagguagccg

SEQ ID NO: 1544206 - RNA, 14 nt, Pseudomonas aeruginosa PA01
gaaaugcugcaggc

SEQ ID NO: 1544207 - RNA, 20 nt, Pseudomonas aeruginosa PA01
gaaauggguucccagcagca

SEQ ID NO: 1544208 - RNA, 19 nt, Pseudomonas aeruginosa PA01
gaaauggucaccaugauca

SEQ ID NO: 1544209 - RNA, 14 nt, Pseudomonas aeruginosa PA01
aaagagccgcgccu

SEQ ID NO: 1544210 - RNA, 20 nt, Pseudomonas aeruginosa PA01
gaacacacgcuucugcuggc

SEQ ID NO: 1544211 - RNA, 15 nt, Pseudomonas aeruginosa PA01
gaacaagccgccuuc

SEQ ID NO: 1544212 - RNA, 16 nt, Pseudomonas aeruginosa PA01
gaacaacccgccagca

SEQ ID NO: 1544213 - RNA, 17 nt, Pseudomonas aeruginosa PA01
gaacaacccgccagcaa

SEQ ID NO: 1544214 - RNA, 16 nt, Pseudomonas aeruginosa PA01
gaacagacgcaggcag

SEQ ID NO: 1544215 - RNA, 19 nt, Pseudomonas aeruginosa PA01
gaacaccaggcgccaggga

SEQ ID NO: 1544216 - RNA, 15 nt, Pseudomonas aeruginosa PA01
gaacacccagaagcc

SEQ ID NO: 1544217 - RNA, 22 nt, Pseudomonas aeruginosa PA01
gaacaggugcugguggcccugg

SEQ ID NO: 1544218 - RNA, 18 nt, Pseudomonas aeruginosa PA01
gaacagguucggcaggcc

SEQ ID NO: 1544219 - RNA, 17 nt, Pseudomonas aeruginosa PA01
gaacagcggaaugcuuc

SEQ ID NO: 1544220 - RNA, 18 nt, Pseudomonas aeruginosa PA01
gaacagcgccgcggcugg

SEQ ID NO: 1544221 - RNA, 19 nt, Pseudomonas aeruginosa PA01
gaacagcgccgcggcuggc

SEQ ID NO: 1544222 - RNA, 13 nt, Pseudomonas aeruginosa PA01
gaacagguagccc

SEQ ID NO: 1544223 - RNA, 22 nt, Pseudomonas aeruginosa PA01
gaacagguagcuggaaagcucg

SEQ ID NO: 1544224 - RNA, 19 nt, Pseudomonas aeruginosa PA01
gaacagggccaucagggcg

SEQ ID NO: 1544225 - RNA, 19 nt, Pseudomonas aeruginosa PA01
gaacagggcgaaggucugc

SEQ ID NO: 1544226 - RNA, 15 nt, Pseudomonas aeruginosa PA01
gaacagggcgagcag

SEQ ID NO: 1544227 - RNA, 18 nt, Pseudomonas aeruginosa PA01
gaacagcgagacccggua

SEQ ID NO: 1544228 - RNA, 21 nt, Pseudomonas aeruginosa PA01
gaacagcgccagcggcagcgg

SEQ ID NO: 1544229 - RNA, 14 nt, Pseudomonas aeruginosa PA01
gaacagcgccacca

SEQ ID NO: 1544230 - RNA, 18 nt, Pseudomonas aeruginosa PA01
gaacagcgccaccagcau

SEQ ID NO: 1544231 - RNA, 21 nt, Pseudomonas aeruginosa PA01
gaacagcgccaccagcaugcc

SEQ ID NO: 1544232 - RNA, 20 nt, Pseudomonas aeruginosa PA01
gaacagcccgucgcgcgccg

SEQ ID NO: 1544233 - RNA, 20 nt, Pseudomonas aeruginosa PA01
gaacagccgccccaccacca

SEQ ID NO: 1544234 - RNA, 11 nt, Pseudomonas aeruginosa PA01
gaacagcacca

SEQ ID NO: 1544235 - RNA, 13 nt, Pseudomonas aeruginosa PA01
gaacagcaaagcg

SEQ ID NO: 1544236 - RNA, 17 nt, Pseudomonas aeruginosa PA01
gaacagcaaagcgcagg

SEQ ID NO: 1544237 - RNA, 22 nt, Pseudomonas aeruginosa PA01
gaaagagccccucucguagagg

SEQ ID NO: 1544238 - RNA, 14 nt, Pseudomonas aeruginosa PA01
gaaagagcccggca

SEQ ID NO: 1544239 - RNA, 22 nt, Pseudomonas aeruginosa PA01
gaaagaccggcgccccugcggc

SEQ ID NO: 1544240 - RNA, 23 nt, Pseudomonas aeruginosa PA01
gaaagacgcugcgaccuggcgcc

SEQ ID NO: 1544241 - RNA, 19 nt, Pseudomonas aeruginosa PA01
gaaagaaggggagccgagg

SEQ ID NO: 1544242 - RNA, 20 nt, Pseudomonas aeruginosa PA01
gaaagaagccgcacuuccag

SEQ ID NO: 1544243 - RNA, 14 nt, Pseudomonas aeruginosa PA01
gaaagccaugccca

SEQ ID NO: 1544244 - RNA, 16 nt, Pseudomonas aeruginosa PA01
gaaagccagcaaaccc

SEQ ID NO: 1544245 - RNA, 16 nt, Pseudomonas aeruginosa PA01
gaaagccccugccgcg

SEQ ID NO: 1544246 - RNA, 14 nt, Pseudomonas aeruginosa PA01
gaaagcgauagccg

SEQ ID NO: 1544247 - RNA, 16 nt, Pseudomonas aeruginosa PA01
gaaagccugccgggca

SEQ ID NO: 1544248 - RNA, 16 nt, Pseudomonas aeruginosa PA01
gaaagccuggccggcg

SEQ ID NO: 1544249 - RNA, 23 nt, Pseudomonas aeruginosa PA01
gaaacgcauguucaugcgcuggu

SEQ ID NO: 1544250 - RNA, 19 nt, Pseudomonas aeruginosa PA01
gaaacgcagggccggaugc

SEQ ID NO: 1544251 - RNA, 14 nt, Pseudomonas aeruginosa PA01
gaaacgacaggcug

SEQ ID NO: 1544252 - RNA, 22 nt, Pseudomonas aeruginosa PA01
gaaacgcgcgcucucgccggcc

SEQ ID NO: 1544253 - RNA, 20 nt, Pseudomonas aeruginosa PA01
gaaacgcuugagcuggcgcu

SEQ ID NO: 1544254 - RNA, 18 nt, Pseudomonas aeruginosa PA01
gaaacggcgcgucuccau

SEQ ID NO: 1544255 - RNA, 19 nt, Pseudomonas aeruginosa PA01
gaaacggcaggccagcagg

SEQ ID NO: 1544256 - RNA, 21 nt, Pseudomonas aeruginosa PA01
gaaacgguuggccucggcccg

SEQ ID NO: 1544257 - RNA, 22 nt, Pseudomonas aeruginosa PA01
gaaacggugacgggcauugucc

SEQ ID NO: 1544258 - RNA, 19 nt, Pseudomonas aeruginosa PA01
gaaauagucgcgggccugg

SEQ ID NO: 1544259 - RNA, 20 nt, Pseudomonas aeruginosa PA01
gaaauagucgcgggccuggg

SEQ ID NO: 1544260 - RNA, 14 nt, Pseudomonas aeruginosa PA01
gaaauccaccagca

SEQ ID NO: 1544261 - RNA, 13 nt, Pseudomonas aeruginosa PA01
gaaagucugcacc

SEQ ID NO: 1544262 - RNA, 19 nt, Pseudomonas aeruginosa PA01
gaaagucugugaucaggcu

SEQ ID NO: 1544263 - RNA, 13 nt, Pseudomonas aeruginosa PA01
gaaagggaaaucc

SEQ ID NO: 1544264 - RNA, 19 nt, Pseudomonas aeruginosa PA01
gaaaggggcucgaaacgaa

SEQ ID NO: 1544265 - RNA, 23 nt, Pseudomonas aeruginosa PA01
gaagagcucccugccgcccuucg

SEQ ID NO: 1544266 - RNA, 20 nt, Pseudomonas aeruginosa PA01
gaagagcgccgcggcggcgu

SEQ ID NO: 1544267 - RNA, 20 nt, Pseudomonas aeruginosa PA01
gaagaggaucgcgaagcgca

SEQ ID NO: 1544268 - RNA, 22 nt, Pseudomonas aeruginosa PA01
gaagauccuguaguacaugacg

SEQ ID NO: 1544269 - RNA, 16 nt, Pseudomonas aeruginosa PA01
gaagaucuccgggucc

SEQ ID NO: 1544270 - RNA, 17 nt, Pseudomonas aeruginosa PA01
gaagaucuuuucgaugg

SEQ ID NO: 1544271 - RNA, 16 nt, Pseudomonas aeruginosa PA01
gaagaaggcgaucauc

SEQ ID NO: 1544272 - RNA, 16 nt, Pseudomonas aeruginosa PA01
gaagaagcugccggca

SEQ ID NO: 1544273 - RNA, 14 nt, Pseudomonas aeruginosa PA01
gaagaagccauugc

SEQ ID NO: 1544274 - RNA, 16 nt, Pseudomonas aeruginosa PA01
gaacaucgccagcgcc

SEQ ID NO: 1544275 - RNA, 16 nt, Pseudomonas aeruginosa PA01
gaagccgccgcccagc

SEQ ID NO: 1544276 - RNA, 11 nt, Pseudomonas aeruginosa PA01
gaagccgagcu

SEQ ID NO: 1544277 - RNA, 18 nt, Pseudomonas aeruginosa PA01
gaagccgaggcuuuccag

SEQ ID NO: 1544278 - RNA, 21 nt, Pseudomonas aeruginosa PA01
gaagccgaucaccaccagcau

SEQ ID NO: 1544279 - RNA, 16 nt, Pseudomonas aeruginosa PA01
gaagccgcgccccagc

SEQ ID NO: 1544280 - RNA, 22 nt, Pseudomonas aeruginosa PA01
gaagccgcgccccagcggcagg

SEQ ID NO: 1544281 - RNA, 19 nt, Pseudomonas aeruginosa PA01
gaagccgccgccgagaacc

SEQ ID NO: 1544282 - RNA, 16 nt, Pseudomonas aeruginosa PA01
gaagccgacgccgagc

SEQ ID NO: 1544283 - RNA, 22 nt, Pseudomonas aeruginosa PA01
gaagccgacgccgagcagcacc

SEQ ID NO: 1544284 - RNA, 14 nt, Pseudomonas aeruginosa PA01
gaagccgcacuucc

SEQ ID NO: 1544285 - RNA, 15 nt, Pseudomonas aeruginosa PA01
gaagccgcacuucca

SEQ ID NO: 1544286 - RNA, 16 nt, Pseudomonas aeruginosa PA01
gaagccgcacuuccag

SEQ ID NO: 1544287 - RNA, 20 nt, Pseudomonas aeruginosa PA01
gaagccgcacuuccaggcgc

SEQ ID NO: 1544288 - RNA, 20 nt, Pseudomonas aeruginosa PA01
gaagccgcacuuccaggugc

SEQ ID NO: 1544289 - RNA, 17 nt, Pseudomonas aeruginosa PA01
gaagccgcgcaaggcag

SEQ ID NO: 1544290 - RNA, 16 nt, Pseudomonas aeruginosa PA01
gaagccggggcaggca

SEQ ID NO: 1544291 - RNA, 19 nt, Pseudomonas aeruginosa PA01
gaagccggggcaggcaugc

SEQ ID NO: 1544292 - RNA, 15 nt, Pseudomonas aeruginosa PA01
gaagccggccccugg

SEQ ID NO: 1544293 - RNA, 15 nt, Pseudomonas aeruginosa PA01
gaagccugccagacc

SEQ ID NO: 1544294 - RNA, 14 nt, Pseudomonas aeruginosa PA01
gaagcgacggcgca

SEQ ID NO: 1544295 - RNA, 22 nt, Pseudomonas aeruginosa PA01
gaagcgacugcgcuggccgagc

SEQ ID NO: 1544296 - RNA, 13 nt, Pseudomonas aeruginosa PA01
gaagcgaaccagg

SEQ ID NO: 1544297 - RNA, 18 nt, Pseudomonas aeruginosa PA01
gaagccgaccggcgccgg

SEQ ID NO: 1544298 - RNA, 20 nt, Pseudomonas aeruginosa PA01
gaagccgaccggcgccggga

SEQ ID NO: 1544299 - RNA, 19 nt, Pseudomonas aeruginosa PA01
gaagauggcuaaacaagcc

SEQ ID NO: 1544300 - RNA, 13 nt, Pseudomonas aeruginosa PA01
gaagauuccgcug

SEQ ID NO: 1544301 - RNA, 22 nt, Pseudomonas aeruginosa PA01
gaaggcguagaaacgcgccucc

SEQ ID NO: 1544302 - RNA, 19 nt, Pseudomonas aeruginosa PA01
gaaggcgucgaaggccucg

SEQ ID NO: 1544303 - RNA, 15 nt, Pseudomonas aeruginosa PA01
gaaggcgugccgcug

SEQ ID NO: 1544304 - RNA, 23 nt, Pseudomonas aeruginosa PA01
gaaggcgugccgcuggccgacca

SEQ ID NO: 1544305 - RNA, 15 nt, Pseudomonas aeruginosa PA01
gaaggcuccgcugcu

SEQ ID NO: 1544306 - RNA, 21 nt, Pseudomonas aeruginosa PA01
gaaggcucguucguagauccc

SEQ ID NO: 1544307 - RNA, 17 nt, Pseudomonas aeruginosa PA01
gaaggcuuccuggaagc

SEQ ID NO: 1544308 - RNA, 20 nt, Pseudomonas aeruginosa PA01
gaaggcugccgggcucuggu

SEQ ID NO: 1544309 - RNA, 15 nt, Pseudomonas aeruginosa PA01
gaagggaaaaaaggg

SEQ ID NO: 1544310 - RNA, 17 nt, Pseudomonas aeruginosa PA01
gaagggaaacaccaggc

SEQ ID NO: 1544311 - RNA, 22 nt, Pseudomonas aeruginosa PA01
gaagcuggggcuguugcugggc

SEQ ID NO: 1544312 - RNA, 16 nt, Pseudomonas aeruginosa PA01
gaagcugccuuccagc

SEQ ID NO: 1544313 - RNA, 15 nt, Pseudomonas aeruginosa PA01
gaagcucggcagcac

SEQ ID NO: 1544314 - RNA, 21 nt, Pseudomonas aeruginosa PA01
gaagcucgggguuuuuuuugc

SEQ ID NO: 1544315 - RNA, 18 nt, Pseudomonas aeruginosa PA01
gaagucagccagguucuu

SEQ ID NO: 1544316 - RNA, 18 nt, Pseudomonas aeruginosa PA01
gaaguggcagcgccguug

SEQ ID NO: 1544317 - RNA, 20 nt, Pseudomonas aeruginosa PA01
gaagugcgcugcuugaacac

SEQ ID NO: 1544318 - RNA, 21 nt, Pseudomonas aeruginosa PA01
gaaggucuugcccaacuccag

SEQ ID NO: 1544319 - RNA, 17 nt, Pseudomonas aeruginosa PA01
gaagguucaggugaaaa

SEQ ID NO: 1544320 - RNA, 22 nt, Pseudomonas aeruginosa PA01
gaagguucaggugaaaagcgcu

SEQ ID NO: 1544321 - RNA, 21 nt, Pseudomonas aeruginosa PA01
gaaguaguagaugcggcugug

SEQ ID NO: 1544322 - RNA, 18 nt, Pseudomonas aeruginosa PA01
gaaguaggcggcggaguc

SEQ ID NO: 1544323 - RNA, 21 nt, Pseudomonas aeruginosa PA01
gaagguucucggccaccacca

SEQ ID NO: 1544324 - RNA, 11 nt, Pseudomonas aeruginosa PA01
gaauaaccauu

SEQ ID NO: 1544325 - RNA, 16 nt, Pseudomonas aeruginosa PA01
gaauacgugggggauu

SEQ ID NO: 1544326 - RNA, 16 nt, Pseudomonas aeruginosa PA01
gaaguguuacagcagg

SEQ ID NO: 1544327 - RNA, 17 nt, Pseudomonas aeruginosa PA01
gaaguguuacagcagga

SEQ ID NO: 1544328 - RNA, 21 nt, Pseudomonas aeruginosa PA01
gaaguugauggucaggcuggu

SEQ ID NO: 1544329 - RNA, 18 nt, Pseudomonas aeruginosa PA01
gaaguugcaggccagcgc

SEQ ID NO: 1544330 - RNA, 15 nt, Pseudomonas aeruginosa PA01
gaaguugccgccgcu

SEQ ID NO: 1544331 - RNA, 15 nt, Pseudomonas aeruginosa PA01
gaauccgcucggugc

SEQ ID NO: 1544332 - RNA, 13 nt, Pseudomonas aeruginosa PA01
gaauccuccagcc

SEQ ID NO: 1544333 - RNA, 14 nt, Pseudomonas aeruginosa PA01
gaaucgccucccug

SEQ ID NO: 1544334 - RNA, 22 nt, Pseudomonas aeruginosa PA01
gaaucgucgaugaggucgcagc

SEQ ID NO: 1544335 - RNA, 18 nt, Pseudomonas aeruginosa PA01
gaaucaccacucgccagc

SEQ ID NO: 1544336 - RNA, 11 nt, Pseudomonas aeruginosa PA01
gaaucacgcug

SEQ ID NO: 1544337 - RNA, 15 nt, Pseudomonas aeruginosa PA01
gaaucacgcugcucg

SEQ ID NO: 1544338 - RNA, 17 nt, Pseudomonas aeruginosa PA01
gaauaguggaucgcccg

SEQ ID NO: 1544339 - RNA, 18 nt, Pseudomonas aeruginosa PA01
gaauaguggaucgcccga

SEQ ID NO: 1544340 - RNA, 18 nt, Pseudomonas aeruginosa PA01
gacaagcauucagcgcgc

SEQ ID NO: 1544341 - RNA, 15 nt, Pseudomonas aeruginosa PA01
gacaagccuccagcg

SEQ ID NO: 1544342 - RNA, 20 nt, Pseudomonas aeruginosa PA01
gacaagcgucgccggccgcu

SEQ ID NO: 1544343 - RNA, 15 nt, Pseudomonas aeruginosa PA01
gaauggcguggcuug

SEQ ID NO: 1544344 - RNA, 13 nt, Pseudomonas aeruginosa PA01
gaauggagaugcc

SEQ ID NO: 1544345 - RNA, 14 nt, Pseudomonas aeruginosa PA01
gaauggcagcaggc

SEQ ID NO: 1544346 - RNA, 23 nt, Pseudomonas aeruginosa PA01
gaauggaguuuccgcgaggauca

SEQ ID NO: 1544347 - RNA, 21 nt, Pseudomonas aeruginosa PA01
gaauuccagcuuguccacgcc

SEQ ID NO: 1544348 - RNA, 15 nt, Pseudomonas aeruginosa PA01
gaauucaggcuuccu

SEQ ID NO: 1544349 - RNA, 11 nt, Pseudomonas aeruginosa PA01
gaauuuccugc

SEQ ID NO: 1544350 - RNA, 17 nt, Pseudomonas aeruginosa PA01
gaauucgucgccgccga

SEQ ID NO: 1544351 - RNA, 14 nt, Pseudomonas aeruginosa PA01
gaauuuccugcugg

SEQ ID NO: 1544352 - RNA, 22 nt, Pseudomonas aeruginosa PA01
gaccaguuucuucgcgugggcc

SEQ ID NO: 1544353 - RNA, 17 nt, Pseudomonas aeruginosa PA01
gaccaguucagcgcgcu

SEQ ID NO: 1544354 - RNA, 22 nt, Pseudomonas aeruginosa PA01
gaccaguucagcgcgcucgcug

SEQ ID NO: 1544355 - RNA, 23 nt, Pseudomonas aeruginosa PA01
gaccagucguugaagacgcucac

SEQ ID NO: 1544356 - RNA, 15 nt, Pseudomonas aeruginosa PA01
gaccaguaccagcaa

SEQ ID NO: 1544357 - RNA, 13 nt, Pseudomonas aeruginosa PA01
gaccaguacgucg

SEQ ID NO: 1544358 - RNA, 14 nt, Pseudomonas aeruginosa PA01
gaccagguccggca

SEQ ID NO: 1544359 - RNA, 16 nt, Pseudomonas aeruginosa PA01
gaccaggucgcuggca

SEQ ID NO: 1544360 - RNA, 17 nt, Pseudomonas aeruginosa PA01
gaccaggcguuccacca

SEQ ID NO: 1544361 - RNA, 12 nt, Pseudomonas aeruginosa PA01
gaccagggcgcc

SEQ ID NO: 1544362 - RNA, 18 nt, Pseudomonas aeruginosa PA01
gaccagggcgggccgcuc

SEQ ID NO: 1544363 - RNA, 17 nt, Pseudomonas aeruginosa PA01
gaccagguagagcagcc

SEQ ID NO: 1544364 - RNA, 19 nt, Pseudomonas aeruginosa PA01
gaccagguagagcagcccg

SEQ ID NO: 1544365 - RNA, 18 nt, Pseudomonas aeruginosa PA01
gaccaggguggcggcggc

SEQ ID NO: 1544366 - RNA, 15 nt, Pseudomonas aeruginosa PA01
gacccgcaguuccuu

SEQ ID NO: 1544367 - RNA, 18 nt, Pseudomonas aeruginosa PA01
gacccagaccugccgccc

SEQ ID NO: 1544368 - RNA, 19 nt, Pseudomonas aeruginosa PA01
gacccaaauuaacggccau

SEQ ID NO: 1544369 - RNA, 17 nt, Pseudomonas aeruginosa PA01
gacccacugaagacccg

SEQ ID NO: 1544370 - RNA, 18 nt, Pseudomonas aeruginosa PA01
gacccgcgccggcagcuc

SEQ ID NO: 1544371 - RNA, 14 nt, Pseudomonas aeruginosa PA01
gacccgcucggccu

SEQ ID NO: 1544372 - RNA, 14 nt, Pseudomonas aeruginosa PA01
gacccgcugcacca

SEQ ID NO: 1544373 - RNA, 13 nt, Pseudomonas aeruginosa PA01
gacccgcucgccg

SEQ ID NO: 1544374 - RNA, 19 nt, Pseudomonas aeruginosa PA01
gacccgcuguccgccggcc

SEQ ID NO: 1544375 - RNA, 13 nt, Pseudomonas aeruginosa PA01
gacccgggccucc

SEQ ID NO: 1544376 - RNA, 17 nt, Pseudomonas aeruginosa PA01
gacccgggccuccuggc

SEQ ID NO: 1544377 - RNA, 15 nt, Pseudomonas aeruginosa PA01
gacccgguacuccuc

SEQ ID NO: 1544378 - RNA, 11 nt, Pseudomonas aeruginosa PA01
gacccuggccg

SEQ ID NO: 1544379 - RNA, 14 nt, Pseudomonas aeruginosa PA01
gacccugcuggccg

SEQ ID NO: 1544380 - RNA, 17 nt, Pseudomonas aeruginosa PA01
gacccuggggucgccgu

SEQ ID NO: 1544381 - RNA, 16 nt, Pseudomonas aeruginosa PA01
gacccuggcgccgacc

SEQ ID NO: 1544382 - RNA, 14 nt, Pseudomonas aeruginosa PA01
gacccuggccgcgc

SEQ ID NO: 1544383 - RNA, 22 nt, Pseudomonas aeruginosa PA01
gacccugcacccuuggcgcagg

SEQ ID NO: 1544384 - RNA, 16 nt, Pseudomonas aeruginosa PA01
gacccucugguuggcc

SEQ ID NO: 1544385 - RNA, 17 nt, Pseudomonas aeruginosa PA01
gacccuagggucggcgu

SEQ ID NO: 1544386 - RNA, 22 nt, Pseudomonas aeruginosa PA01
gacccguugcgccucgccgccc

SEQ ID NO: 1544387 - RNA, 18 nt, Pseudomonas aeruginosa PA01
gacccggucgcugaccag

SEQ ID NO: 1544388 - RNA, 19 nt, Pseudomonas aeruginosa PA01
gacccggucgcugaccagc

SEQ ID NO: 1544389 - RNA, 14 nt, Pseudomonas aeruginosa PA01
gacccgugcgccgc

SEQ ID NO: 1544390 - RNA, 19 nt, Pseudomonas aeruginosa PA01
gaccagcccuggcgcggca

SEQ ID NO: 1544391 - RNA, 11 nt, Pseudomonas aeruginosa PA01
gaccagcgccg

SEQ ID NO: 1544392 - RNA, 14 nt, Pseudomonas aeruginosa PA01
gaccagcgccaggc

SEQ ID NO: 1544393 - RNA, 15 nt, Pseudomonas aeruginosa PA01
gaccagcgccaggcg

SEQ ID NO: 1544394 - RNA, 16 nt, Pseudomonas aeruginosa PA01
gaccagcgccaggcgc

SEQ ID NO: 1544395 - RNA, 18 nt, Pseudomonas aeruginosa PA01
gaccagcgcaucggcgcc

SEQ ID NO: 1544396 - RNA, 16 nt, Pseudomonas aeruginosa PA01
gaccaggccgagcagg

SEQ ID NO: 1544397 - RNA, 17 nt, Pseudomonas aeruginosa PA01
gaccaggccgagcagga

SEQ ID NO: 1544398 - RNA, 22 nt, Pseudomonas aeruginosa PA01
gaccaggcggccgucggccugg

SEQ ID NO: 1544399 - RNA, 16 nt, Pseudomonas aeruginosa PA01
gaccagcagggccagc

SEQ ID NO: 1544400 - RNA, 17 nt, Pseudomonas aeruginosa PA01
gaccagcagggccagca

SEQ ID NO: 1544401 - RNA, 10 nt, Pseudomonas aeruginosa PA01
gaccagcagg

SEQ ID NO: 1544402 - RNA, 19 nt, Pseudomonas aeruginosa PA01
gaccagcccgcgcgacagc

SEQ ID NO: 1544403 - RNA, 20 nt, Pseudomonas aeruginosa PA01
gaccagcccggcggcggcac

SEQ ID NO: 1544404 - RNA, 14 nt, Pseudomonas aeruginosa PA01
gaccagcauggcgg

SEQ ID NO: 1544405 - RNA, 13 nt, Pseudomonas aeruginosa PA01
gaccaacagggcg

SEQ ID NO: 1544406 - RNA, 15 nt, Pseudomonas aeruginosa PA01
gaccaacagccggcg

SEQ ID NO: 1544407 - RNA, 23 nt, Pseudomonas aeruginosa PA01
gaccagaacgaaaaaggcgcgcc

SEQ ID NO: 1544408 - RNA, 15 nt, Pseudomonas aeruginosa PA01
gaccagagccgccga

SEQ ID NO: 1544409 - RNA, 18 nt, Pseudomonas aeruginosa PA01
gaccacucgcgagauggc

SEQ ID NO: 1544410 - RNA, 15 nt, Pseudomonas aeruginosa PA01
gacagcaggcugccg

SEQ ID NO: 1544411 - RNA, 17 nt, Pseudomonas aeruginosa PA01
gacagcagguggcuggu

SEQ ID NO: 1544412 - RNA, 22 nt, Pseudomonas aeruginosa PA01
gacagccucaagccucgcccuu

SEQ ID NO: 1544413 - RNA, 16 nt, Pseudomonas aeruginosa PA01
gacagccugggcggcu

SEQ ID NO: 1544414 - RNA, 22 nt, Pseudomonas aeruginosa PA01
gacagccugggcggcuuccugc

SEQ ID NO: 1544415 - RNA, 18 nt, Pseudomonas aeruginosa PA01
gacagcacgauggcgagg

SEQ ID NO: 1544416 - RNA, 16 nt, Pseudomonas aeruginosa PA01
gacagcacgcucaggc

SEQ ID NO: 1544417 - RNA, 17 nt, Pseudomonas aeruginosa PA01
gacagcaccacgccgcu

SEQ ID NO: 1544418 - RNA, 14 nt, Pseudomonas aeruginosa PA01
gacagcaccaugcc

SEQ ID NO: 1544419 - RNA, 20 nt, Pseudomonas aeruginosa PA01
gacaccuggcaacaaggcau

SEQ ID NO: 1544420 - RNA, 18 nt, Pseudomonas aeruginosa PA01
gacacgcacucauagcuc

SEQ ID NO: 1544421 - RNA, 14 nt, Pseudomonas aeruginosa PA01
gacacgcaggcgcc

SEQ ID NO: 1544422 - RNA, 20 nt, Pseudomonas aeruginosa PA01
gacacgagccgcugcggcuc

SEQ ID NO: 1544423 - RNA, 22 nt, Pseudomonas aeruginosa PA01
gacacgugugucgacaccuggc

SEQ ID NO: 1544424 - RNA, 21 nt, Pseudomonas aeruginosa PA01
gacaucggcgauggccaucag

SEQ ID NO: 1544425 - RNA, 20 nt, Pseudomonas aeruginosa PA01
gacauagcgcagcaccggcu

SEQ ID NO: 1544426 - RNA, 16 nt, Pseudomonas aeruginosa PA01
gacauucgacagcagg

SEQ ID NO: 1544427 - RNA, 14 nt, Pseudomonas aeruginosa PA01
gacaucuccaggcc

SEQ ID NO: 1544428 - RNA, 20 nt, Pseudomonas aeruginosa PA01
gacaugaaaaagccggaggc

SEQ ID NO: 1544429 - RNA, 15 nt, Pseudomonas aeruginosa PA01
gacaggaagagcagg

SEQ ID NO: 1544430 - RNA, 18 nt, Pseudomonas aeruginosa PA01
gacagcuugccguccagc

SEQ ID NO: 1544431 - RNA, 20 nt, Pseudomonas aeruginosa PA01
gacagcucgcgggacagcuu

SEQ ID NO: 1544432 - RNA, 16 nt, Pseudomonas aeruginosa PA01
gacagcggcuggcgcu

SEQ ID NO: 1544433 - RNA, 17 nt, Pseudomonas aeruginosa PA01
gacaggauggacagcuu

SEQ ID NO: 1544434 - RNA, 20 nt, Pseudomonas aeruginosa PA01
gacggggaucacucgccgcc

SEQ ID NO: 1544435 - RNA, 20 nt, Pseudomonas aeruginosa PA01
gacgggcauugucccugcgg

SEQ ID NO: 1544436 - RNA, 22 nt, Pseudomonas aeruginosa PA01
gacgggagcgcgaggcgcaggc

SEQ ID NO: 1544437 - RNA, 12 nt, Pseudomonas aeruginosa PA01
gacgggccgcgc

SEQ ID NO: 1544438 - RNA, 15 nt, Pseudomonas aeruginosa PA01
gacgggccgcgccgc

SEQ ID NO: 1544439 - RNA, 17 nt, Pseudomonas aeruginosa PA01
gacgggccgcgccgcaa

SEQ ID NO: 1544440 - RNA, 21 nt, Pseudomonas aeruginosa PA01
gacggcagggucagccgaugc

SEQ ID NO: 1544441 - RNA, 12 nt, Pseudomonas aeruginosa PA01
gacggcacgggg

SEQ ID NO: 1544442 - RNA, 21 nt, Pseudomonas aeruginosa PA01
gacgguuucaggccuugcuga

SEQ ID NO: 1544443 - RNA, 13 nt, Pseudomonas aeruginosa PA01
gacgugaagcccc

SEQ ID NO: 1544444 - RNA, 15 nt, Pseudomonas aeruginosa PA01
gacgugaagccccug

SEQ ID NO: 1544445 - RNA, 22 nt, Pseudomonas aeruginosa PA01
gacgucgaggucgacggcggcc

SEQ ID NO: 1544446 - RNA, 13 nt, Pseudomonas aeruginosa PA01
gacgucgccccag

SEQ ID NO: 1544447 - RNA, 15 nt, Pseudomonas aeruginosa PA01
gacgucgccccagcc

SEQ ID NO: 1544448 - RNA, 12 nt, Pseudomonas aeruginosa PA01
gacgucccuucc

SEQ ID NO: 1544449 - RNA, 14 nt, Pseudomonas aeruginosa PA01
gacguccuccaccg

SEQ ID NO: 1544450 - RNA, 16 nt, Pseudomonas aeruginosa PA01
gacgcggacagccugg

SEQ ID NO: 1544451 - RNA, 15 nt, Pseudomonas aeruginosa PA01
gacgcgcuuguccuc

SEQ ID NO: 1544452 - RNA, 23 nt, Pseudomonas aeruginosa PA01
gacgcgcuuguccuccagcugcg

SEQ ID NO: 1544453 - RNA, 18 nt, Pseudomonas aeruginosa PA01
gacgcacucauagcucag

SEQ ID NO: 1544454 - RNA, 22 nt, Pseudomonas aeruginosa PA01
gacgcagagcgccaugacccgc

SEQ ID NO: 1544455 - RNA, 17 nt, Pseudomonas aeruginosa PA01
gacgcagcacggcggcu

SEQ ID NO: 1544456 - RNA, 14 nt, Pseudomonas aeruginosa PA01
gacgcgaucccgcu

SEQ ID NO: 1544457 - RNA, 22 nt, Pseudomonas aeruginosa PA01
gacgcacaccgucgaaccagcc

SEQ ID NO: 1544458 - RNA, 17 nt, Pseudomonas aeruginosa PA01
gacgcucagcacccugg

SEQ ID NO: 1544459 - RNA, 12 nt, Pseudomonas aeruginosa PA01
gacgcucggcca

SEQ ID NO: 1544460 - RNA, 21 nt, Pseudomonas aeruginosa PA01
gacgcucugcucggccagcgc

SEQ ID NO: 1544461 - RNA, 14 nt, Pseudomonas aeruginosa PA01
gacgcugcccagcc

SEQ ID NO: 1544462 - RNA, 14 nt, Pseudomonas aeruginosa PA01
gacgacgaaagaag

SEQ ID NO: 1544463 - RNA, 18 nt, Pseudomonas aeruginosa PA01
gacgacgaaaggccgcgc

SEQ ID NO: 1544464 - RNA, 13 nt, Pseudomonas aeruginosa PA01
gacgagacgccga

SEQ ID NO: 1544465 - RNA, 20 nt, Pseudomonas aeruginosa PA01
gacgagauugaugaagcgcu

SEQ ID NO: 1544466 - RNA, 19 nt, Pseudomonas aeruginosa PA01
gacgagccggacggcggcg

SEQ ID NO: 1544467 - RNA, 16 nt, Pseudomonas aeruginosa PA01
gacgagcuuuccugcu

SEQ ID NO: 1544468 - RNA, 18 nt, Pseudomonas aeruginosa PA01
gacgaggaaggcgcgcac

SEQ ID NO: 1544469 - RNA, 12 nt, Pseudomonas aeruginosa PA01
gacgaggacgcc

SEQ ID NO: 1544470 - RNA, 15 nt, Pseudomonas aeruginosa PA01
gacgaggacgccgcc

SEQ ID NO: 1544471 - RNA, 15 nt, Pseudomonas aeruginosa PA01
gacgaugccgccgcc

SEQ ID NO: 1544472 - RNA, 12 nt, Pseudomonas aeruginosa PA01
gacgaugcaggg

SEQ ID NO: 1544473 - RNA, 15 nt, Pseudomonas aeruginosa PA01
gacgaugaagcccca

SEQ ID NO: 1544474 - RNA, 24 nt, Pseudomonas aeruginosa PA01
gacgaggcccgcccaguugcgggc

SEQ ID NO: 1544475 - RNA, 17 nt, Pseudomonas aeruginosa PA01
gacgagcguccgccgcc

SEQ ID NO: 1544476 - RNA, 18 nt, Pseudomonas aeruginosa PA01
gacgagcguccgccgccg

SEQ ID NO: 1544477 - RNA, 12 nt, Pseudomonas aeruginosa PA01
gacgagggcacg

SEQ ID NO: 1544478 - RNA, 19 nt, Pseudomonas aeruginosa PA01
gacgauggcgacguucugc

SEQ ID NO: 1544479 - RNA, 14 nt, Pseudomonas aeruginosa PA01
gacgauggccagcc

SEQ ID NO: 1544480 - RNA, 19 nt, Pseudomonas aeruginosa PA01
gacgaugcggcccgccggc

SEQ ID NO: 1544481 - RNA, 14 nt, Pseudomonas aeruginosa PA01
gacgaugccguucu

SEQ ID NO: 1544482 - RNA, 17 nt, Pseudomonas aeruginosa PA01
gaccucggccgcaucga

SEQ ID NO: 1544483 - RNA, 14 nt, Pseudomonas aeruginosa PA01
gaccucggccgcca

SEQ ID NO: 1544484 - RNA, 21 nt, Pseudomonas aeruginosa PA01
gaccucgacgccgagccagcc

SEQ ID NO: 1544485 - RNA, 15 nt, Pseudomonas aeruginosa PA01
gaccucgagcaggcc

SEQ ID NO: 1544486 - RNA, 13 nt, Pseudomonas aeruginosa PA01
gaccucgggcagc

SEQ ID NO: 1544487 - RNA, 23 nt, Pseudomonas aeruginosa PA01
gaccucgggcgagaaucgccgag

SEQ ID NO: 1544488 - RNA, 13 nt, Pseudomonas aeruginosa PA01
gaccucggcgguc

SEQ ID NO: 1544489 - RNA, 18 nt, Pseudomonas aeruginosa PA01
gacgaagugaccgcgcgc

SEQ ID NO: 1544490 - RNA, 18 nt, Pseudomonas aeruginosa PA01
gacgaaguugcaggccag

SEQ ID NO: 1544491 - RNA, 11 nt, Pseudomonas aeruginosa PA01
gaccuucagau

SEQ ID NO: 1544492 - RNA, 16 nt, Pseudomonas aeruginosa PA01
gaccuucaucaggcgg

SEQ ID NO: 1544493 - RNA, 14 nt, Pseudomonas aeruginosa PA01
gaccuuccagccgc

SEQ ID NO: 1544494 - RNA, 13 nt, Pseudomonas aeruginosa PA01
gaccuuccgccag

SEQ ID NO: 1544495 - RNA, 15 nt, Pseudomonas aeruginosa PA01
gaccuuccgccagca

SEQ ID NO: 1544496 - RNA, 19 nt, Pseudomonas aeruginosa PA01
gaccuuccgccagcaggcg

SEQ ID NO: 1544497 - RNA, 21 nt, Pseudomonas aeruginosa PA01
gaccuuccgccagcaggcgcg

SEQ ID NO: 1544498 - RNA, 18 nt, Pseudomonas aeruginosa PA01
gaccuuccugccagcgcg

SEQ ID NO: 1544499 - RNA, 19 nt, Pseudomonas aeruginosa PA01
gacgacaucucguccucgg

SEQ ID NO: 1544500 - RNA, 22 nt, Pseudomonas aeruginosa PA01
gaccguggcgcuacgcucgccg

SEQ ID NO: 1544501 - RNA, 15 nt, Pseudomonas aeruginosa PA01
gaccguccuggcccu

SEQ ID NO: 1544502 - RNA, 15 nt, Pseudomonas aeruginosa PA01
gaccgucgaaccagg

SEQ ID NO: 1544503 - RNA, 16 nt, Pseudomonas aeruginosa PA01
gaccucccgcgccagc

SEQ ID NO: 1544504 - RNA, 20 nt, Pseudomonas aeruginosa PA01
gaccucccgcgccagcucga

SEQ ID NO: 1544505 - RNA, 16 nt, Pseudomonas aeruginosa PA01
gaccucgaagcuggcc

SEQ ID NO: 1544506 - RNA, 17 nt, Pseudomonas aeruginosa PA01
gaccucgaagcuggcca

SEQ ID NO: 1544507 - RNA, 11 nt, Pseudomonas aeruginosa PA01
gaccuccgcca

SEQ ID NO: 1544508 - RNA, 14 nt, Pseudomonas aeruginosa PA01
gaccuccgccaggu

SEQ ID NO: 1544509 - RNA, 17 nt, Pseudomonas aeruginosa PA01
gaccuccagggccagcu

SEQ ID NO: 1544510 - RNA, 18 nt, Pseudomonas aeruginosa PA01
gaccuccggcgccaggcc

SEQ ID NO: 1544511 - RNA, 15 nt, Pseudomonas aeruginosa PA01
gaccgguagccauga

SEQ ID NO: 1544512 - RNA, 15 nt, Pseudomonas aeruginosa PA01
gaccggcuccagggc

SEQ ID NO: 1544513 - RNA, 15 nt, Pseudomonas aeruginosa PA01
gaccgggcggcaggc

SEQ ID NO: 1544514 - RNA, 20 nt, Pseudomonas aeruginosa PA01
gaccgggcgggucuggcgga

SEQ ID NO: 1544515 - RNA, 13 nt, Pseudomonas aeruginosa PA01
gaccgggcgccuc

SEQ ID NO: 1544516 - RNA, 14 nt, Pseudomonas aeruginosa PA01
gaccgcagcccagu

SEQ ID NO: 1544517 - RNA, 16 nt, Pseudomonas aeruginosa PA01
gaccgcagcccaguuc

SEQ ID NO: 1544518 - RNA, 23 nt, Pseudomonas aeruginosa PA01
gaccgauccagcagucgcggccc

SEQ ID NO: 1544519 - RNA, 15 nt, Pseudomonas aeruginosa PA01
gacugucgugccucc

SEQ ID NO: 1544520 - RNA, 17 nt, Pseudomonas aeruginosa PA01
gacugucgugccuccag

SEQ ID NO: 1544521 - RNA, 18 nt, Pseudomonas aeruginosa PA01
gacugucgugccuccagc

SEQ ID NO: 1544522 - RNA, 21 nt, Pseudomonas aeruginosa PA01
gacugucgugccuccagccuc

SEQ ID NO: 1544523 - RNA, 23 nt, Pseudomonas aeruginosa PA01
gacugguugaccugcagcgccuc

SEQ ID NO: 1544524 - RNA, 17 nt, Pseudomonas aeruginosa PA01
gacuggaaacgcaucca

SEQ ID NO: 1544525 - RNA, 19 nt, Pseudomonas aeruginosa PA01
gacugcugcugcggggccu

SEQ ID NO: 1544526 - RNA, 13 nt, Pseudomonas aeruginosa PA01
gacuggcccuggu

SEQ ID NO: 1544527 - RNA, 19 nt, Pseudomonas aeruginosa PA01
gacuggaugaacagcgaga

SEQ ID NO: 1544528 - RNA, 14 nt, Pseudomonas aeruginosa PA01
gacugacgaaggcu

SEQ ID NO: 1544529 - RNA, 15 nt, Pseudomonas aeruginosa PA01
gacugagccgcuggu

SEQ ID NO: 1544530 - RNA, 21 nt, Pseudomonas aeruginosa PA01
gacugcccagcgccgccagca

SEQ ID NO: 1544531 - RNA, 14 nt, Pseudomonas aeruginosa PA01
gacugccugcaggu

SEQ ID NO: 1544532 - RNA, 21 nt, Pseudomonas aeruginosa PA01
gacugcgagccgacuuccagc

SEQ ID NO: 1544533 - RNA, 17 nt, Pseudomonas aeruginosa PA01
gacguugcugcccuggc

SEQ ID NO: 1544534 - RNA, 20 nt, Pseudomonas aeruginosa PA01
gacguugcugcccuggcgcg

SEQ ID NO: 1544535 - RNA, 12 nt, Pseudomonas aeruginosa PA01
gacguugcgccg

SEQ ID NO: 1544536 - RNA, 14 nt, Pseudomonas aeruginosa PA01
gacgugcacccgcu

SEQ ID NO: 1544537 - RNA, 22 nt, Pseudomonas aeruginosa PA01
gacuccggccggcggccugagc

SEQ ID NO: 1544538 - RNA, 17 nt, Pseudomonas aeruginosa PA01
gacuccgggaacagccc

SEQ ID NO: 1544539 - RNA, 16 nt, Pseudomonas aeruginosa PA01
gacuccgcccaguucu

SEQ ID NO: 1544540 - RNA, 17 nt, Pseudomonas aeruginosa PA01
gacuccggaggcgcaca

SEQ ID NO: 1544541 - RNA, 17 nt, Pseudomonas aeruginosa PA01
gacucgaugcgcagcuu

SEQ ID NO: 1544542 - RNA, 15 nt, Pseudomonas aeruginosa PA01
gacucgccaucggcc

SEQ ID NO: 1544543 - RNA, 21 nt, Pseudomonas aeruginosa PA01
gacuucgacgaacucgacgcg

SEQ ID NO: 1544544 - RNA, 20 nt, Pseudomonas aeruginosa PA01
gacuucgucgaagaccaggg

SEQ ID NO: 1544545 - RNA, 21 nt, Pseudomonas aeruginosa PA01
gacuucgucgaagaccagggu

SEQ ID NO: 1544546 - RNA, 14 nt, Pseudomonas aeruginosa PA01
gacuuccaucagcu

SEQ ID NO: 1544547 - RNA, 18 nt, Pseudomonas aeruginosa PA01
gacuucgcaccagccggc

SEQ ID NO: 1544548 - RNA, 20 nt, Pseudomonas aeruginosa PA01
gagaaaacccugggaauggc

SEQ ID NO: 1544549 - RNA, 9 nt, Pseudomonas aeruginosa PA01
gagaaaaac

SEQ ID NO: 1544550 - RNA, 21 nt, Pseudomonas aeruginosa PA01
gagaaaaaccacgggaauggc

SEQ ID NO: 1544551 - RNA, 16 nt, Pseudomonas aeruginosa PA01
gagaaaccgaaguagu

SEQ ID NO: 1544552 - RNA, 22 nt, Pseudomonas aeruginosa PA01
gagaacgcuucgaagcucucgc

SEQ ID NO: 1544553 - RNA, 21 nt, Pseudomonas aeruginosa PA01
gagaacgcggcgaagggcgcu

SEQ ID NO: 1544554 - RNA, 13 nt, Pseudomonas aeruginosa PA01
gagaaccaguacu

SEQ ID NO: 1544555 - RNA, 14 nt, Pseudomonas aeruginosa PA01
gagaaccaguacuu

SEQ ID NO: 1544556 - RNA, 16 nt, Pseudomonas aeruginosa PA01
gagaaccaguacuuga

SEQ ID NO: 1544557 - RNA, 18 nt, Pseudomonas aeruginosa PA01
gagaacccggccaggccc

SEQ ID NO: 1544558 - RNA, 21 nt, Pseudomonas aeruginosa PA01
gagaacccggccaggcccuca

SEQ ID NO: 1544559 - RNA, 12 nt, Pseudomonas aeruginosa PA01
gagaacagcagc

SEQ ID NO: 1544560 - RNA, 22 nt, Pseudomonas aeruginosa PA01
gagaacagcagcggcaccagca

SEQ ID NO: 1544561 - RNA, 13 nt, Pseudomonas aeruginosa PA01
gagaacagcaggg

SEQ ID NO: 1544562 - RNA, 22 nt, Pseudomonas aeruginosa PA01
gagacagguacucggcccgggc

SEQ ID NO: 1544563 - RNA, 17 nt, Pseudomonas aeruginosa PA01
gagaccuuccugccagc

SEQ ID NO: 1544564 - RNA, 18 nt, Pseudomonas aeruginosa PA01
gagaccuuccugccagcg

SEQ ID NO: 1544565 - RNA, 13 nt, Pseudomonas aeruginosa PA01
gagacgcugccgu

SEQ ID NO: 1544566 - RNA, 21 nt, Pseudomonas aeruginosa PA01
gagacgcugccguucgcccgc

SEQ ID NO: 1544567 - RNA, 15 nt, Pseudomonas aeruginosa PA01
gagacgccagccgcc

SEQ ID NO: 1544568 - RNA, 18 nt, Pseudomonas aeruginosa PA01
gagacgcccuggaugauc

SEQ ID NO: 1544569 - RNA, 16 nt, Pseudomonas aeruginosa PA01
gagaccgugccgccgg

SEQ ID NO: 1544570 - RNA, 18 nt, Pseudomonas aeruginosa PA01
gagaccgugccgccgggg

SEQ ID NO: 1544571 - RNA, 13 nt, Pseudomonas aeruginosa PA01
gagaccggcagcc

SEQ ID NO: 1544572 - RNA, 17 nt, Pseudomonas aeruginosa PA01
gagaccggcagccgggu

SEQ ID NO: 1544573 - RNA, 13 nt, Pseudomonas aeruginosa PA01
gagacccgccagc

SEQ ID NO: 1544574 - RNA, 22 nt, Pseudomonas aeruginosa PA01
gagacccgguacuccuccagca

SEQ ID NO: 1544575 - RNA, 18 nt, Pseudomonas aeruginosa PA01
gagaccgacgcucgcggc

SEQ ID NO: 1544576 - RNA, 13 nt, Pseudomonas aeruginosa PA01
gagacccccggga

SEQ ID NO: 1544577 - RNA, 15 nt, Pseudomonas aeruginosa PA01
gagaaugaaaaaggg

SEQ ID NO: 1544578 - RNA, 21 nt, Pseudomonas aeruginosa PA01
gagaagaucgccguguugaug

SEQ ID NO: 1544579 - RNA, 12 nt, Pseudomonas aeruginosa PA01
gagaaggcugcc

SEQ ID NO: 1544580 - RNA, 15 nt, Pseudomonas aeruginosa PA01
gagaagggcgcgccc

SEQ ID NO: 1544581 - RNA, 21 nt, Pseudomonas aeruginosa PA01
gagaaggcguagaaacgcgcc

SEQ ID NO: 1544582 - RNA, 13 nt, Pseudomonas aeruginosa PA01
gagacucagcgcg

SEQ ID NO: 1544583 - RNA, 15 nt, Pseudomonas aeruginosa PA01
gagagcgcugccgca

SEQ ID NO: 1544584 - RNA, 19 nt, Pseudomonas aeruginosa PA01
gagagcguccggcagggcc

SEQ ID NO: 1544585 - RNA, 23 nt, Pseudomonas aeruginosa PA01
gagagcuucucgguagggccgag

SEQ ID NO: 1544586 - RNA, 17 nt, Pseudomonas aeruginosa PA01
gagagcggcgccaggcg

SEQ ID NO: 1544587 - RNA, 19 nt, Pseudomonas aeruginosa PA01
gagagcggguagcgccggu

SEQ ID NO: 1544588 - RNA, 19 nt, Pseudomonas aeruginosa PA01
gagaugcugcgggcgccgc

SEQ ID NO: 1544589 - RNA, 17 nt, Pseudomonas aeruginosa PA01
gagaugcagagaaaagg

SEQ ID NO: 1544590 - RNA, 15 nt, Pseudomonas aeruginosa PA01
gagcaccgcgccuuc

SEQ ID NO: 1544591 - RNA, 17 nt, Pseudomonas aeruginosa PA01
gagcaccgcgccuucca

SEQ ID NO: 1544592 - RNA, 22 nt, Pseudomonas aeruginosa PA01
gagcaccggcaggacgaugauc

SEQ ID NO: 1544593 - RNA, 13 nt, Pseudomonas aeruginosa PA01
gagcaccaugcag

SEQ ID NO: 1544594 - RNA, 13 nt, Pseudomonas aeruginosa PA01
gagcaccaugccg

SEQ ID NO: 1544595 - RNA, 15 nt, Pseudomonas aeruginosa PA01
gagcaccaugccgau

SEQ ID NO: 1544596 - RNA, 16 nt, Pseudomonas aeruginosa PA01
gagcaccaugccgaug

SEQ ID NO: 1544597 - RNA, 19 nt, Pseudomonas aeruginosa PA01
gagcaccccgagcccggcc

SEQ ID NO: 1544598 - RNA, 21 nt, Pseudomonas aeruginosa PA01
gagcaccccgagcccggccgg

SEQ ID NO: 1544599 - RNA, 20 nt, Pseudomonas aeruginosa PA01
gagcaccaccacucgcgagc

SEQ ID NO: 1544600 - RNA, 17 nt, Pseudomonas aeruginosa PA01
gagcagacacaaaaaac

SEQ ID NO: 1544601 - RNA, 13 nt, Pseudomonas aeruginosa PA01
gagcacuucccag

SEQ ID NO: 1544602 - RNA, 17 nt, Pseudomonas aeruginosa PA01
gagcacgccgcgaccga

SEQ ID NO: 1544603 - RNA, 19 nt, Pseudomonas aeruginosa PA01
gagcagaaccgccagcagu

SEQ ID NO: 1544604 - RNA, 21 nt, Pseudomonas aeruginosa PA01
gagcagggugaagcugcggcu

SEQ ID NO: 1544605 - RNA, 14 nt, Pseudomonas aeruginosa PA01
gagcagggcacagc

SEQ ID NO: 1544606 - RNA, 19 nt, Pseudomonas aeruginosa PA01
gagcagggcgaugccgaug

SEQ ID NO: 1544607 - RNA, 12 nt, Pseudomonas aeruginosa PA01
gagcagggcgcc

SEQ ID NO: 1544608 - RNA, 13 nt, Pseudomonas aeruginosa PA01
gagcaggcgcgcc

SEQ ID NO: 1544609 - RNA, 13 nt, Pseudomonas aeruginosa PA01
gagcaggcugcua

SEQ ID NO: 1544610 - RNA, 15 nt, Pseudomonas aeruginosa PA01
gagcaggcugcuagg

SEQ ID NO: 1544611 - RNA, 23 nt, Pseudomonas aeruginosa PA01
gagcaggcugcuagguucuaucg

SEQ ID NO: 1544612 - RNA, 16 nt, Pseudomonas aeruginosa PA01
gagcaggcggaucgcc

SEQ ID NO: 1544613 - RNA, 17 nt, Pseudomonas aeruginosa PA01
gagcaggcggaucgccg

SEQ ID NO: 1544614 - RNA, 10 nt, Pseudomonas aeruginosa PA01
gagccaggcg

SEQ ID NO: 1544615 - RNA, 11 nt, Pseudomonas aeruginosa PA01
gagccaggcgg

SEQ ID NO: 1544616 - RNA, 20 nt, Pseudomonas aeruginosa PA01
gagccagguacggaugccgc

SEQ ID NO: 1544617 - RNA, 22 nt, Pseudomonas aeruginosa PA01
gagccagguuuccggcagcacg

SEQ ID NO: 1544618 - RNA, 14 nt, Pseudomonas aeruginosa PA01
gagccaugggccgg

SEQ ID NO: 1544619 - RNA, 20 nt, Pseudomonas aeruginosa PA01
gagcaugauggugccgccgg

SEQ ID NO: 1544620 - RNA, 23 nt, Pseudomonas aeruginosa PA01
gagcaugccugcuuucccugcug

SEQ ID NO: 1544621 - RNA, 17 nt, Pseudomonas aeruginosa PA01
gagcaugcgcggcagga

SEQ ID NO: 1544622 - RNA, 23 nt, Pseudomonas aeruginosa PA01
gagcauggugucgcucccuacga

SEQ ID NO: 1544623 - RNA, 20 nt, Pseudomonas aeruginosa PA01
gagcaugucggcgguuucca

SEQ ID NO: 1544624 - RNA, 17 nt, Pseudomonas aeruginosa PA01
gagcauuccucagcgcc

SEQ ID NO: 1544625 - RNA, 12 nt, Pseudomonas aeruginosa PA01
gagccagccgca

SEQ ID NO: 1544626 - RNA, 15 nt, Pseudomonas aeruginosa PA01
gagccagccgcagcc

SEQ ID NO: 1544627 - RNA, 17 nt, Pseudomonas aeruginosa PA01
gagccagccgcagcccg

SEQ ID NO: 1544628 - RNA, 23 nt, Pseudomonas aeruginosa PA01
gagccagccugcagccagcuuca

SEQ ID NO: 1544629 - RNA, 14 nt, Pseudomonas aeruginosa PA01
gagccagcgcucga

SEQ ID NO: 1544630 - RNA, 18 nt, Pseudomonas aeruginosa PA01
gagcaguucccccagcac

SEQ ID NO: 1544631 - RNA, 16 nt, Pseudomonas aeruginosa PA01
gagcaucggcgcggcc

SEQ ID NO: 1544632 - RNA, 20 nt, Pseudomonas aeruginosa PA01
gagcaucucggccaggcccu

SEQ ID NO: 1544633 - RNA, 15 nt, Pseudomonas aeruginosa PA01
gagcaugaugcaggc

SEQ ID NO: 1544634 - RNA, 16 nt, Pseudomonas aeruginosa PA01
gagcaugaugcaggca

SEQ ID NO: 1544635 - RNA, 19 nt, Pseudomonas aeruginosa PA01
gagccgcuggguuuccugc

SEQ ID NO: 1544636 - RNA, 19 nt, Pseudomonas aeruginosa PA01
gagccgcugguccagcugg

SEQ ID NO: 1544637 - RNA, 20 nt, Pseudomonas aeruginosa PA01
gagccggcauccuguggcug

SEQ ID NO: 1544638 - RNA, 13 nt, Pseudomonas aeruginosa PA01
gagccggcugccg

SEQ ID NO: 1544639 - RNA, 22 nt, Pseudomonas aeruginosa PA01
gagccuucagcacggcgcgggu

SEQ ID NO: 1544640 - RNA, 18 nt, Pseudomonas aeruginosa PA01
gagcccgccgaacagcaa

SEQ ID NO: 1544641 - RNA, 19 nt, Pseudomonas aeruginosa PA01
gagcccgagugcgcccagc

SEQ ID NO: 1544642 - RNA, 22 nt, Pseudomonas aeruginosa PA01
gagcccgagugcgcccagcagc

SEQ ID NO: 1544643 - RNA, 15 nt, Pseudomonas aeruginosa PA01
gagcccuugcgcggc

SEQ ID NO: 1544644 - RNA, 20 nt, Pseudomonas aeruginosa PA01
gagccgccggggaagcugcc

SEQ ID NO: 1544645 - RNA, 20 nt, Pseudomonas aeruginosa PA01
gagcccaugaaaaagccccg

SEQ ID NO: 1544646 - RNA, 13 nt, Pseudomonas aeruginosa PA01
gagcccccggcgc

SEQ ID NO: 1544647 - RNA, 14 nt, Pseudomonas aeruginosa PA01
gagcccccggcgcc

SEQ ID NO: 1544648 - RNA, 19 nt, Pseudomonas aeruginosa PA01
gagccccagguaggcgaag

SEQ ID NO: 1544649 - RNA, 17 nt, Pseudomonas aeruginosa PA01
gagccccaugccguuca

SEQ ID NO: 1544650 - RNA, 22 nt, Pseudomonas aeruginosa PA01
gauacaccgcauccucguucca

SEQ ID NO: 1544651 - RNA, 12 nt, Pseudomonas aeruginosa PA01
gauacagcagcc

SEQ ID NO: 1544652 - RNA, 18 nt, Pseudomonas aeruginosa PA01
gauacaggcgcagcagca

SEQ ID NO: 1544653 - RNA, 15 nt, Pseudomonas aeruginosa PA01
gauaccgccggcggc

SEQ ID NO: 1544654 - RNA, 18 nt, Pseudomonas aeruginosa PA01
gauaccgcacggccguca

SEQ ID NO: 1544655 - RNA, 16 nt, Pseudomonas aeruginosa PA01
gauacccuucaucccu

SEQ ID NO: 1544656 - RNA, 15 nt, Pseudomonas aeruginosa PA01
gauacccagcgggca

SEQ ID NO: 1544657 - RNA, 12 nt, Pseudomonas aeruginosa PA01
gauacccaggcc

SEQ ID NO: 1544658 - RNA, 22 nt, Pseudomonas aeruginosa PA01
gauaacaccaggagcgccagca

SEQ ID NO: 1544659 - RNA, 19 nt, Pseudomonas aeruginosa PA01
gauaccggccaucagcacc

SEQ ID NO: 1544660 - RNA, 16 nt, Pseudomonas aeruginosa PA01
gauagccgaccaggcc

SEQ ID NO: 1544661 - RNA, 20 nt, Pseudomonas aeruginosa PA01
gauagccggcgcguucacuc

SEQ ID NO: 1544662 - RNA, 19 nt, Pseudomonas aeruginosa PA01
gauagcguccaggugcggc

SEQ ID NO: 1544663 - RNA, 17 nt, Pseudomonas aeruginosa PA01
gauagccgugcagcagc

SEQ ID NO: 1544664 - RNA, 17 nt, Pseudomonas aeruginosa PA01
gauagcggcgcgaggcc

SEQ ID NO: 1544665 - RNA, 12 nt, Pseudomonas aeruginosa PA01
gauauugaacac

SEQ ID NO: 1544666 - RNA, 19 nt, Pseudomonas aeruginosa PA01
gauaucgcccagggccagc

SEQ ID NO: 1544667 - RNA, 15 nt, Pseudomonas aeruginosa PA01
gauauccgccaggcg

SEQ ID NO: 1544668 - RNA, 17 nt, Pseudomonas aeruginosa PA01
gauauccgccagggagc

SEQ ID NO: 1544669 - RNA, 15 nt, Pseudomonas aeruginosa PA01
gauauccagcggcag

SEQ ID NO: 1544670 - RNA, 18 nt, Pseudomonas aeruginosa PA01
gauauccagggccaggau

SEQ ID NO: 1544671 - RNA, 15 nt, Pseudomonas aeruginosa PA01
gagucguagcgcaug

SEQ ID NO: 1544672 - RNA, 15 nt, Pseudomonas aeruginosa PA01
gagugcgcagcagcg

SEQ ID NO: 1544673 - RNA, 17 nt, Pseudomonas aeruginosa PA01
gagugcgcccagcagca

SEQ ID NO: 1544674 - RNA, 20 nt, Pseudomonas aeruginosa PA01
gagugcgcccagcagcaggc

SEQ ID NO: 1544675 - RNA, 21 nt, Pseudomonas aeruginosa PA01
gagugccgcggaauggcgcgc

SEQ ID NO: 1544676 - RNA, 17 nt, Pseudomonas aeruginosa PA01
gaguccaggcgggccag

SEQ ID NO: 1544677 - RNA, 10 nt, Pseudomonas aeruginosa PA01
gaguccaggu

SEQ ID NO: 1544678 - RNA, 15 nt, Pseudomonas aeruginosa PA01
gaguccgccagccgg

SEQ ID NO: 1544679 - RNA, 21 nt, Pseudomonas aeruginosa PA01
gaguccgcgcgcgcgcuccuc

SEQ ID NO: 1544680 - RNA, 17 nt, Pseudomonas aeruginosa PA01
gagguucuccacuucca

SEQ ID NO: 1544681 - RNA, 17 nt, Pseudomonas aeruginosa PA01
gaguagcuggcgcaggg

SEQ ID NO: 1544682 - RNA, 22 nt, Pseudomonas aeruginosa PA01
gaguagguccaggcgucggcgc

SEQ ID NO: 1544683 - RNA, 16 nt, Pseudomonas aeruginosa PA01
gagguuggucugcucg

SEQ ID NO: 1544684 - RNA, 14 nt, Pseudomonas aeruginosa PA01
gagguugcgcggca

SEQ ID NO: 1544685 - RNA, 18 nt, Pseudomonas aeruginosa PA01
gagguugcuguagaaugc

SEQ ID NO: 1544686 - RNA, 19 nt, Pseudomonas aeruginosa PA01
gaggugucgccgcggacgg

SEQ ID NO: 1544687 - RNA, 18 nt, Pseudomonas aeruginosa PA01
gagguucgaauccuccug

SEQ ID NO: 1544688 - RNA, 17 nt, Pseudomonas aeruginosa PA01
gagguucaggccgggca

SEQ ID NO: 1544689 - RNA, 16 nt, Pseudomonas aeruginosa PA01
gagugcuucugggugu

SEQ ID NO: 1544690 - RNA, 14 nt, Pseudomonas aeruginosa PA01
gaguggaggaucuc

SEQ ID NO: 1544691 - RNA, 19 nt, Pseudomonas aeruginosa PA01
gaguugaucggcguggcgg

SEQ ID NO: 1544692 - RNA, 14 nt, Pseudomonas aeruginosa PA01
gaguugaccagcau

SEQ ID NO: 1544693 - RNA, 20 nt, Pseudomonas aeruginosa PA01
gagggcguagugcaucagcc

SEQ ID NO: 1544694 - RNA, 23 nt, Pseudomonas aeruginosa PA01
gagggcguccugcuuccagaccu

SEQ ID NO: 1544695 - RNA, 18 nt, Pseudomonas aeruginosa PA01
gaggucaccugcaguucg

SEQ ID NO: 1544696 - RNA, 20 nt, Pseudomonas aeruginosa PA01
gagggcgcggcgccagcgcc

SEQ ID NO: 1544697 - RNA, 13 nt, Pseudomonas aeruginosa PA01
gagggcgcggcgc

SEQ ID NO: 1544698 - RNA, 19 nt, Pseudomonas aeruginosa PA01
gagggcgaacagcagcggu

SEQ ID NO: 1544699 - RNA, 17 nt, Pseudomonas aeruginosa PA01
gagggccgcgccgaccc

SEQ ID NO: 1544700 - RNA, 23 nt, Pseudomonas aeruginosa PA01
gagggccacgaacugcauggccu

SEQ ID NO: 1544701 - RNA, 18 nt, Pseudomonas aeruginosa PA01
gagggauguuccaggccc

SEQ ID NO: 1544702 - RNA, 21 nt, Pseudomonas aeruginosa PA01
gagggcauguuggcgccuucg

SEQ ID NO: 1544703 - RNA, 17 nt, Pseudomonas aeruginosa PA01
gagggcauuuccugggu

SEQ ID NO: 1544704 - RNA, 20 nt, Pseudomonas aeruginosa PA01
gagggcaaaggcgcgcaggg

SEQ ID NO: 1544705 - RNA, 22 nt, Pseudomonas aeruginosa PA01
gagggcaaaggcgcgcagggcc

SEQ ID NO: 1544706 - RNA, 23 nt, Pseudomonas aeruginosa PA01
gagggcaaaggcgcgcagggccg

SEQ ID NO: 1544707 - RNA, 13 nt, Pseudomonas aeruginosa PA01
gaggucggccucg

SEQ ID NO: 1544708 - RNA, 14 nt, Pseudomonas aeruginosa PA01
gaggucggccuggc

SEQ ID NO: 1544709 - RNA, 14 nt, Pseudomonas aeruginosa PA01
gaggucggcggcgg

SEQ ID NO: 1544710 - RNA, 16 nt, Pseudomonas aeruginosa PA01
gaggucgacggcggcc

SEQ ID NO: 1544711 - RNA, 15 nt, Pseudomonas aeruginosa PA01
gaggucguccaccuc

SEQ ID NO: 1544712 - RNA, 14 nt, Pseudomonas aeruginosa PA01
gaggucggcaaagc

SEQ ID NO: 1544713 - RNA, 16 nt, Pseudomonas aeruginosa PA01
gaggucuuggccagcc

SEQ ID NO: 1544714 - RNA, 18 nt, Pseudomonas aeruginosa PA01
gaggucuuggccagccgc

SEQ ID NO: 1544715 - RNA, 15 nt, Pseudomonas aeruginosa PA01
gaggugcggcgguga

SEQ ID NO: 1544716 - RNA, 15 nt, Pseudomonas aeruginosa PA01
gaggcggugcagcgg

SEQ ID NO: 1544717 - RNA, 20 nt, Pseudomonas aeruginosa PA01
gaggcggugcagcggaagcc

SEQ ID NO: 1544718 - RNA, 17 nt, Pseudomonas aeruginosa PA01
gaggcgucgaaacgggc

SEQ ID NO: 1544719 - RNA, 21 nt, Pseudomonas aeruginosa PA01
gaggcgucggcccuugugaaa

SEQ ID NO: 1544720 - RNA, 19 nt, Pseudomonas aeruginosa PA01
gaggcuaacgccgaggaua

SEQ ID NO: 1544721 - RNA, 21 nt, Pseudomonas aeruginosa PA01
gaggcguuccaggugguggcg

SEQ ID NO: 1544722 - RNA, 13 nt, Pseudomonas aeruginosa PA01
gaggcagccgucg

SEQ ID NO: 1544723 - RNA, 19 nt, Pseudomonas aeruginosa PA01
gaggcugccgaagccuucg

SEQ ID NO: 1544724 - RNA, 12 nt, Pseudomonas aeruginosa PA01
gaggcuggcgcu

SEQ ID NO: 1544725 - RNA, 14 nt, Pseudomonas aeruginosa PA01
gaggcucggcggcc

SEQ ID NO: 1544726 - RNA, 17 nt, Pseudomonas aeruginosa PA01
gaggcuguccagcaggc

SEQ ID NO: 1544727 - RNA, 23 nt, Pseudomonas aeruginosa PA01
gaggcugucgucgaggguggcgc

SEQ ID NO: 1544728 - RNA, 22 nt, Pseudomonas aeruginosa PA01
gaggcugugccccaggcacggc

SEQ ID NO: 1544729 - RNA, 17 nt, Pseudomonas aeruginosa PA01
gaggcuuuccagcaggc

SEQ ID NO: 1544730 - RNA, 20 nt, Pseudomonas aeruginosa PA01
gaggcuuuccagcaggcgcu

SEQ ID NO: 1544731 - RNA, 18 nt, Pseudomonas aeruginosa PA01
gagggaucgcgcggcugg

SEQ ID NO: 1544732 - RNA, 15 nt, Pseudomonas aeruginosa PA01
gagggaggaggcgcc

SEQ ID NO: 1544733 - RNA, 13 nt, Pseudomonas aeruginosa PA01
gaggauggucagg

SEQ ID NO: 1544734 - RNA, 20 nt, Pseudomonas aeruginosa PA01
gaggauggucaggccggcgc

SEQ ID NO: 1544735 - RNA, 14 nt, Pseudomonas aeruginosa PA01
gaggauguacaggg

SEQ ID NO: 1544736 - RNA, 15 nt, Pseudomonas aeruginosa PA01
gaggauucagcagga

SEQ ID NO: 1544737 - RNA, 23 nt, Pseudomonas aeruginosa PA01
gaggauuuccggcuugccgaugu

SEQ ID NO: 1544738 - RNA, 15 nt, Pseudomonas aeruginosa PA01
gaggauggccguccu

SEQ ID NO: 1544739 - RNA, 17 nt, Pseudomonas aeruginosa PA01
gaggaugcggauguagu

SEQ ID NO: 1544740 - RNA, 19 nt, Pseudomonas aeruginosa PA01
gaggaugccgaucaccgcc

SEQ ID NO: 1544741 - RNA, 21 nt, Pseudomonas aeruginosa PA01
gaggaugaucagggcaccgcc

SEQ ID NO: 1544742 - RNA, 14 nt, Pseudomonas aeruginosa PA01
gaggaucgcggccu

SEQ ID NO: 1544743 - RNA, 14 nt, Pseudomonas aeruginosa PA01
gaggaucacgcagc

SEQ ID NO: 1544744 - RNA, 21 nt, Pseudomonas aeruginosa PA01
gaggaucacgcagcaggcgac

SEQ ID NO: 1544745 - RNA, 18 nt, Pseudomonas aeruginosa PA01
gaggaucagccagccggc

SEQ ID NO: 1544746 - RNA, 18 nt, Pseudomonas aeruginosa PA01
gaggauacgcucaggaag

SEQ ID NO: 1544747 - RNA, 16 nt, Pseudomonas aeruginosa PA01
gaggauacggcgcagc

SEQ ID NO: 1544748 - RNA, 12 nt, Pseudomonas aeruginosa PA01
gaggacgccgcc

SEQ ID NO: 1544749 - RNA, 17 nt, Pseudomonas aeruginosa PA01
gaggacgauggaacgcg

SEQ ID NO: 1544750 - RNA, 17 nt, Pseudomonas aeruginosa PA01
gaggaaggccagcaggg

SEQ ID NO: 1544751 - RNA, 20 nt, Pseudomonas aeruginosa PA01
gaggaaggccagcagggucg

SEQ ID NO: 1544752 - RNA, 16 nt, Pseudomonas aeruginosa PA01
gaggaagucggcggcc

SEQ ID NO: 1544753 - RNA, 21 nt, Pseudomonas aeruginosa PA01
gaggaauaaagaaaaggccgc

SEQ ID NO: 1544754 - RNA, 20 nt, Pseudomonas aeruginosa PA01
gaggaaucgaacccccgacc

SEQ ID NO: 1544755 - RNA, 20 nt, Pseudomonas aeruginosa PA01
gagcuugaugaagcccgcgg

SEQ ID NO: 1544756 - RNA, 18 nt, Pseudomonas aeruginosa PA01
gagcuugcugaagcccca

SEQ ID NO: 1544757 - RNA, 14 nt, Pseudomonas aeruginosa PA01
gagcuuggcccugg

SEQ ID NO: 1544758 - RNA, 11 nt, Pseudomonas aeruginosa PA01
gagcuuccagc

SEQ ID NO: 1544759 - RNA, 22 nt, Pseudomonas aeruginosa PA01
gagcuguccaucucgccgcgca

SEQ ID NO: 1544760 - RNA, 13 nt, Pseudomonas aeruginosa PA01
gagcugugguugu

SEQ ID NO: 1544761 - RNA, 21 nt, Pseudomonas aeruginosa PA01
gagcugggucacuccgcuggu

SEQ ID NO: 1544762 - RNA, 21 nt, Pseudomonas aeruginosa PA01
gagcuggacgacgcuggccug

SEQ ID NO: 1544763 - RNA, 22 nt, Pseudomonas aeruginosa PA01
gagcuggcccaguugcccggcc

SEQ ID NO: 1544764 - RNA, 17 nt, Pseudomonas aeruginosa PA01
gagcuggaaauggcggu

SEQ ID NO: 1544765 - RNA, 20 nt, Pseudomonas aeruginosa PA01
gagcgacccaacggggccuu

SEQ ID NO: 1544766 - RNA, 21 nt, Pseudomonas aeruginosa PA01
gagcgacaccaugcuccgccu

SEQ ID NO: 1544767 - RNA, 20 nt, Pseudomonas aeruginosa PA01
gagcugcucgauggcggccu

SEQ ID NO: 1544768 - RNA, 22 nt, Pseudomonas aeruginosa PA01
gagcgaagugggggcaaaugcc

SEQ ID NO: 1544769 - RNA, 22 nt, Pseudomonas aeruginosa PA01
gagcgaauacaccgagcgcagu

SEQ ID NO: 1544770 - RNA, 16 nt, Pseudomonas aeruginosa PA01
ggccggcgccagcagg

SEQ ID NO: 1544771 - RNA, 14 nt, Pseudomonas aeruginosa PA01
ggccggcgagccag

SEQ ID NO: 1544772 - RNA, 17 nt, Pseudomonas aeruginosa PA01
ggccggcgagggcggcg

SEQ ID NO: 1544773 - RNA, 15 nt, Pseudomonas aeruginosa PA01
ggccggccugggccc

SEQ ID NO: 1544774 - RNA, 14 nt, Pseudomonas aeruginosa PA01
ggccggcgaccagc

SEQ ID NO: 1544775 - RNA, 16 nt, Pseudomonas aeruginosa PA01
ggccggcgaccagcgu

SEQ ID NO: 1544776 - RNA, 15 nt, Pseudomonas aeruginosa PA01
ggccggcgaccagcu

SEQ ID NO: 1544777 - RNA, 21 nt, Pseudomonas aeruginosa PA01
ggccggcgaccuuguccaggc

SEQ ID NO: 1544778 - RNA, 17 nt, Pseudomonas aeruginosa PA01
ggccggccucggcggcg

SEQ ID NO: 1544779 - RNA, 16 nt, Pseudomonas aeruginosa PA01
ggccggcgcggacggc

SEQ ID NO: 1544780 - RNA, 13 nt, Pseudomonas aeruginosa PA01
ggccggcgcgccg

SEQ ID NO: 1544781 - RNA, 14 nt, Pseudomonas aeruginosa PA01
ggccggcgccgccg

SEQ ID NO: 1544782 - RNA, 15 nt, Pseudomonas aeruginosa PA01
ggccggcgccgaugc

SEQ ID NO: 1544783 - RNA, 13 nt, Pseudomonas aeruginosa PA01
ggccggcggccug

SEQ ID NO: 1544784 - RNA, 11 nt, Pseudomonas aeruginosa PA01
ggccggcggcg

SEQ ID NO: 1544785 - RNA, 16 nt, Pseudomonas aeruginosa PA01
ggccgggcccugggcc

SEQ ID NO: 1544786 - RNA, 15 nt, Pseudomonas aeruginosa PA01
ggccgggccgaucac

SEQ ID NO: 1544787 - RNA, 15 nt, Pseudomonas aeruginosa PA01
ggccgggccgaugcg

SEQ ID NO: 1544788 - RNA, 12 nt, Pseudomonas aeruginosa PA01
ggccgggcggcg

SEQ ID NO: 1544789 - RNA, 15 nt, Pseudomonas aeruginosa PA01
ggccgggcggcggcg

SEQ ID NO: 1544790 - RNA, 17 nt, Pseudomonas aeruginosa PA01
ggccgggcggacgcugg

SEQ ID NO: 1544791 - RNA, 17 nt, Pseudomonas aeruginosa PA01
ggccgggauacagcagc

SEQ ID NO: 1544792 - RNA, 17 nt, Pseudomonas aeruginosa PA01
ggccgggaaccagcaug

SEQ ID NO: 1544793 - RNA, 21 nt, Pseudomonas aeruginosa PA01
ggccgggaaccagcauguccu

SEQ ID NO: 1544794 - RNA, 22 nt, Pseudomonas aeruginosa PA01
ggccggcuucuacgccuugcgg

SEQ ID NO: 1544795 - RNA, 16 nt, Pseudomonas aeruginosa PA01
ggccgcuuccggcccg

SEQ ID NO: 1544796 - RNA, 18 nt, Pseudomonas aeruginosa PA01
ggccgcuuccggcccggc

SEQ ID NO: 1544797 - RNA, 17 nt, Pseudomonas aeruginosa PA01
ggccgcuugaagcggcc

SEQ ID NO: 1544798 - RNA, 16 nt, Pseudomonas aeruginosa PA01
ggccgcuuacgcggcc

SEQ ID NO: 1544799 - RNA, 18 nt, Pseudomonas aeruginosa PA01
ggccgcuucaagcggcca

SEQ ID NO: 1544800 - RNA, 23 nt, Pseudomonas aeruginosa PA01
ggccgcugucgucuucggccagu

SEQ ID NO: 1544801 - RNA, 14 nt, Pseudomonas aeruginosa PA01
ggccgcuggcggcg

SEQ ID NO: 1544802 - RNA, 15 nt, Pseudomonas aeruginosa PA01
ggccgcugcgcaggc

SEQ ID NO: 1544803 - RNA, 21 nt, Pseudomonas aeruginosa PA01
ggccgcugccgccgcgcaggc

SEQ ID NO: 1544804 - RNA, 16 nt, Pseudomonas aeruginosa PA01
ggccgcugagcagcag

SEQ ID NO: 1544805 - RNA, 20 nt, Pseudomonas aeruginosa PA01
ggccgcugagcagcaggugg

SEQ ID NO: 1544806 - RNA, 17 nt, Pseudomonas aeruginosa PA01
ggccggccagggagcgc

SEQ ID NO: 1544807 - RNA, 16 nt, Pseudomonas aeruginosa PA01
ggccggccagccaggc

SEQ ID NO: 1544808 - RNA, 13 nt, Pseudomonas aeruginosa PA01
ggccggcagcagc

SEQ ID NO: 1544809 - RNA, 14 nt, Pseudomonas aeruginosa PA01
ggccggcagcagcg

SEQ ID NO: 1544810 - RNA, 15 nt, Pseudomonas aeruginosa PA01
ggccggcagcgagcg

SEQ ID NO: 1544811 - RNA, 16 nt, Pseudomonas aeruginosa PA01
ggccggcagcgagcgg

SEQ ID NO: 1544812 - RNA, 15 nt, Pseudomonas aeruginosa PA01
ggccggcagcuccgg

SEQ ID NO: 1544813 - RNA, 15 nt, Pseudomonas aeruginosa PA01
ggccggcaggccgau

SEQ ID NO: 1544814 - RNA, 16 nt, Pseudomonas aeruginosa PA01
ggccggcaccagcagu

SEQ ID NO: 1544815 - RNA, 16 nt, Pseudomonas aeruginosa PA01
ggccggauggccgccg

SEQ ID NO: 1544816 - RNA, 19 nt, Pseudomonas aeruginosa PA01
ggccgcgagguccggcucc

SEQ ID NO: 1544817 - RNA, 22 nt, Pseudomonas aeruginosa PA01
ggccgcgagguccggcuccggc

SEQ ID NO: 1544818 - RNA, 22 nt, Pseudomonas aeruginosa PA01
ggccgcgcacaaaaaagcccgc

SEQ ID NO: 1544819 - RNA, 21 nt, Pseudomonas aeruginosa PA01
ggccgcgccgagccggcugcc

SEQ ID NO: 1544820 - RNA, 14 nt, Pseudomonas aeruginosa PA01
ggccgcgccgcccu

SEQ ID NO: 1544821 - RNA, 12 nt, Pseudomonas aeruginosa PA01
ggccgcgccggc

SEQ ID NO: 1544822 - RNA, 23 nt, Pseudomonas aeruginosa PA01
ggccgcgcagucccgcgcggccc

SEQ ID NO: 1544823 - RNA, 14 nt, Pseudomonas aeruginosa PA01
ggccgcgcucgacg

SEQ ID NO: 1544824 - RNA, 20 nt, Pseudomonas aeruginosa PA01
ggccgcgcugucggccucga

SEQ ID NO: 1544825 - RNA, 15 nt, Pseudomonas aeruginosa PA01
ggccgcggcccugcg

SEQ ID NO: 1544826 - RNA, 23 nt, Pseudomonas aeruginosa PA01
ggccgcggcguugucggccagca

SEQ ID NO: 1544827 - RNA, 22 nt, Pseudomonas aeruginosa PA01
ggccgcgggucuugcgcagggc

SEQ ID NO: 1544828 - RNA, 22 nt, Pseudomonas aeruginosa PA01
ggccgcggugggcuccagcggg

SEQ ID NO: 1544829 - RNA, 16 nt, Pseudomonas aeruginosa PA01
ggccgcguaagcggcc

SEQ ID NO: 1544830 - RNA, 14 nt, Pseudomonas aeruginosa PA01
ggccgcguucgccg

SEQ ID NO: 1544831 - RNA, 17 nt, Pseudomonas aeruginosa PA01
ggccgcguucgccgagg

SEQ ID NO: 1544832 - RNA, 23 nt, Pseudomonas aeruginosa PA01
ggccgcucaccgccaccccgccg

SEQ ID NO: 1544833 - RNA, 15 nt, Pseudomonas aeruginosa PA01
ggccgcuacgcggcg

SEQ ID NO: 1544834 - RNA, 15 nt, Pseudomonas aeruginosa PA01
ggccgcucgcgcggc

SEQ ID NO: 1544835 - RNA, 22 nt, Pseudomonas aeruginosa PA01
ggccgcucggccuugagcgccg

SEQ ID NO: 1544836 - RNA, 19 nt, Pseudomonas aeruginosa PA01
ggccgcucuuuccucaucu

SEQ ID NO: 1544837 - RNA, 22 nt, Pseudomonas aeruginosa PA01
ggccgaugaucuccgcgccggg

SEQ ID NO: 1544838 - RNA, 19 nt, Pseudomonas aeruginosa PA01
ggccgaucgagcggcccgc

SEQ ID NO: 1544839 - RNA, 14 nt, Pseudomonas aeruginosa PA01
ggccgaucuccugg

SEQ ID NO: 1544840 - RNA, 16 nt, Pseudomonas aeruginosa PA01
ggccgaucaucggcug

SEQ ID NO: 1544841 - RNA, 13 nt, Pseudomonas aeruginosa PA01
ggccgagggugau

SEQ ID NO: 1544842 - RNA, 16 nt, Pseudomonas aeruginosa PA01
ggccgaggucggcggc

SEQ ID NO: 1544843 - RNA, 14 nt, Pseudomonas aeruginosa PA01
ggccgaggcuuccu

SEQ ID NO: 1544844 - RNA, 17 nt, Pseudomonas aeruginosa PA01
ggccgaggcuuccucga

SEQ ID NO: 1544845 - RNA, 13 nt, Pseudomonas aeruginosa PA01
ggccgagggcagc

SEQ ID NO: 1544846 - RNA, 15 nt, Pseudomonas aeruginosa PA01
ggccgaucagcggcg

SEQ ID NO: 1544847 - RNA, 21 nt, Pseudomonas aeruginosa PA01
ggccgaucaccagcgccaggc

SEQ ID NO: 1544848 - RNA, 23 nt, Pseudomonas aeruginosa PA01
ggccgaucaccagcgccaggccg

SEQ ID NO: 1544849 - RNA, 16 nt, Pseudomonas aeruginosa PA01
ggccgaguccgcgcgc

SEQ ID NO: 1544850 - RNA, 18 nt, Pseudomonas aeruginosa PA01
ggccgaucaccaccagcg

SEQ ID NO: 1544851 - RNA, 14 nt, Pseudomonas aeruginosa PA01
ggccgagccccggu

SEQ ID NO: 1544852 - RNA, 23 nt, Pseudomonas aeruginosa PA01
ggccgagcgcgagugcagcgagu

SEQ ID NO: 1544853 - RNA, 22 nt, Pseudomonas aeruginosa PA01
ggccgagccggcauccuguggc

SEQ ID NO: 1544854 - RNA, 15 nt, Pseudomonas aeruginosa PA01
ggccgagcgccgccu

SEQ ID NO: 1544855 - RNA, 18 nt, Pseudomonas aeruginosa PA01
ggccgagcgccgccuggg

SEQ ID NO: 1544856 - RNA, 19 nt, Pseudomonas aeruginosa PA01
ggccgagcugccgcaccgc

SEQ ID NO: 1544857 - RNA, 22 nt, Pseudomonas aeruginosa PA01
ggccgagcgugcgcaugcccgc

SEQ ID NO: 1544858 - RNA, 18 nt, Pseudomonas aeruginosa PA01
ggccgaggaaggcgcugg

SEQ ID NO: 1544859 - RNA, 19 nt, Pseudomonas aeruginosa PA01
ggccgaggaaggcgcuggc

SEQ ID NO: 1544860 - RNA, 18 nt, Pseudomonas aeruginosa PA01
ggccgaggaugcucgccu

SEQ ID NO: 1544861 - RNA, 15 nt, Pseudomonas aeruginosa PA01
ggcccaauccgcgcc

SEQ ID NO: 1544862 - RNA, 22 nt, Pseudomonas aeruginosa PA01
ggccauuguucuuuggccaauu

SEQ ID NO: 1544863 - RNA, 18 nt, Pseudomonas aeruginosa PA01
ggccauugcccgguggcc

SEQ ID NO: 1544864 - RNA, 13 nt, Pseudomonas aeruginosa PA01
ggccgauguccuc

SEQ ID NO: 1544865 - RNA, 16 nt, Pseudomonas aeruginosa PA01
ggccgaugccgaccuu

SEQ ID NO: 1544866 - RNA, 22 nt, Pseudomonas aeruginosa PA01
ggccgaugcgcaacgggcggcg

SEQ ID NO: 1544867 - RNA, 16 nt, Pseudomonas aeruginosa PA01
ggccgauggccccggc

SEQ ID NO: 1544868 - RNA, 13 nt, Pseudomonas aeruginosa PA01
ggccgcaggcagc

SEQ ID NO: 1544869 - RNA, 14 nt, Pseudomonas aeruginosa PA01
ggccgcaggcagca

SEQ ID NO: 1544870 - RNA, 16 nt, Pseudomonas aeruginosa PA01
ggccgcagcgcagccg

SEQ ID NO: 1544871 - RNA, 14 nt, Pseudomonas aeruginosa PA01
ggccgcagcagcgg

SEQ ID NO: 1544872 - RNA, 19 nt, Pseudomonas aeruginosa PA01
ggccgcaaccagcccuggc

SEQ ID NO: 1544873 - RNA, 13 nt, Pseudomonas aeruginosa PA01
ggccgcccagcgg

SEQ ID NO: 1544874 - RNA, 14 nt, Pseudomonas aeruginosa PA01
ggccgcccagcgca

SEQ ID NO: 1544875 - RNA, 18 nt, Pseudomonas aeruginosa PA01
ggccgccaugcucggcca

SEQ ID NO: 1544876 - RNA, 20 nt, Pseudomonas aeruginosa PA01
ggccgccgaaaugcugcagg

SEQ ID NO: 1544877 - RNA, 14 nt, Pseudomonas aeruginosa PA01
ggccgccgaagaac

SEQ ID NO: 1544878 - RNA, 14 nt, Pseudomonas aeruginosa PA01
ggccgcccuggccg

SEQ ID NO: 1544879 - RNA, 16 nt, Pseudomonas aeruginosa PA01
ggccgcccuugcggcc

SEQ ID NO: 1544880 - RNA, 17 nt, Pseudomonas aeruginosa PA01
ggccgcccuugcggccc

SEQ ID NO: 1544881 - RNA, 12 nt, Pseudomonas aeruginosa PA01
ggccgccgccug

SEQ ID NO: 1544882 - RNA, 13 nt, Pseudomonas aeruginosa PA01
ggccgccggcgcc

SEQ ID NO: 1544883 - RNA, 17 nt, Pseudomonas aeruginosa PA01
ggccgccggcgcccugc

SEQ ID NO: 1544884 - RNA, 14 nt, Pseudomonas aeruginosa PA01
ggccgccggcgacc

SEQ ID NO: 1544885 - RNA, 13 nt, Pseudomonas aeruginosa PA01
ggccgccggcggc

SEQ ID NO: 1544886 - RNA, 14 nt, Pseudomonas aeruginosa PA01
ggccgccggcggcc

SEQ ID NO: 1544887 - RNA, 21 nt, Pseudomonas aeruginosa PA01
ggccgccggcggccagggcgu

SEQ ID NO: 1544888 - RNA, 20 nt, Pseudomonas aeruginosa PA01
ggccgccuugaccugcuggg

SEQ ID NO: 1544889 - RNA, 22 nt, Pseudomonas aeruginosa PA01
ggccgccuugaccugcugggcc

SEQ ID NO: 1544890 - RNA, 12 nt, Pseudomonas aeruginosa PA01
ggccgccaggcu

SEQ ID NO: 1544891 - RNA, 14 nt, Pseudomonas aeruginosa PA01
ggccgccaggcugg

SEQ ID NO: 1544892 - RNA, 11 nt, Pseudomonas aeruginosa PA01
ggccgccaggg

SEQ ID NO: 1544893 - RNA, 14 nt, Pseudomonas aeruginosa PA01
ggccgccaggccuc

SEQ ID NO: 1544894 - RNA, 14 nt, Pseudomonas aeruginosa PA01
ggccgcaggugaag

SEQ ID NO: 1544895 - RNA, 18 nt, Pseudomonas aeruginosa PA01
ggccgcaggugaagcuuu

SEQ ID NO: 1544896 - RNA, 13 nt, Pseudomonas aeruginosa PA01
ggccgccagccgc

SEQ ID NO: 1544897 - RNA, 13 nt, Pseudomonas aeruginosa PA01
ggccgccagcagg

SEQ ID NO: 1544898 - RNA, 16 nt, Pseudomonas aeruginosa PA01
ggccgccagcaggccg

SEQ ID NO: 1544899 - RNA, 14 nt, Pseudomonas aeruginosa PA01
ggccgccagcaggu

SEQ ID NO: 1544900 - RNA, 20 nt, Pseudomonas aeruginosa PA01
ggccgucuuccagggcggcg

SEQ ID NO: 1544901 - RNA, 21 nt, Pseudomonas aeruginosa PA01
ggccgucguuuuguccggcgg

SEQ ID NO: 1544902 - RNA, 23 nt, Pseudomonas aeruginosa PA01
ggccgucguuuuguccggcggcu

SEQ ID NO: 1544903 - RNA, 17 nt, Pseudomonas aeruginosa PA01
ggccgucuccaggcgcg

SEQ ID NO: 1544904 - RNA, 20 nt, Pseudomonas aeruginosa PA01
ggccgucuccaggcgcgccg

SEQ ID NO: 1544905 - RNA, 23 nt, Pseudomonas aeruginosa PA01
ggccgugcaugccgacgagcagc

SEQ ID NO: 1544906 - RNA, 14 nt, Pseudomonas aeruginosa PA01
ggccgugcagcccu

SEQ ID NO: 1544907 - RNA, 20 nt, Pseudomonas aeruginosa PA01
ggccgucccugaccagcagg

SEQ ID NO: 1544908 - RNA, 14 nt, Pseudomonas aeruginosa PA01
ggccgucgaagggc

SEQ ID NO: 1544909 - RNA, 14 nt, Pseudomonas aeruginosa PA01
ggccgucgacccgc

SEQ ID NO: 1544910 - RNA, 17 nt, Pseudomonas aeruginosa PA01
ggccgucgacccgccuc

SEQ ID NO: 1544911 - RNA, 15 nt, Pseudomonas aeruginosa PA01
ggccgucggccuggc

SEQ ID NO: 1544912 - RNA, 16 nt, Pseudomonas aeruginosa PA01
ggccguccaggcugcc

SEQ ID NO: 1544913 - RNA, 18 nt, Pseudomonas aeruginosa PA01
ggccgucgaggucggcga

SEQ ID NO: 1544914 - RNA, 19 nt, Pseudomonas aeruginosa PA01
ggccguagaccaccagcag

SEQ ID NO: 1544915 - RNA, 18 nt, Pseudomonas aeruginosa PA01
ggccguagcugcgcgccu

SEQ ID NO: 1544916 - RNA, 15 nt, Pseudomonas aeruginosa PA01
ggccgguugcggcgc

SEQ ID NO: 1544917 - RNA, 17 nt, Pseudomonas aeruginosa PA01
ggccgguugcggcgccg

SEQ ID NO: 1544918 - RNA, 14 nt, Pseudomonas aeruginosa PA01
ggccggugccgccg

SEQ ID NO: 1544919 - RNA, 16 nt, Pseudomonas aeruginosa PA01
ggccggugccgccggc

SEQ ID NO: 1544920 - RNA, 17 nt, Pseudomonas aeruginosa PA01
ggccggugccgccggcc

SEQ ID NO: 1544921 - RNA, 19 nt, Pseudomonas aeruginosa PA01
ggccggugccuucggcggc

SEQ ID NO: 1544922 - RNA, 16 nt, Pseudomonas aeruginosa PA01
ggccgucacggccucc

SEQ ID NO: 1544923 - RNA, 19 nt, Pseudomonas aeruginosa PA01
ggccggugaucucgcggcg

SEQ ID NO: 1544924 - RNA, 21 nt, Pseudomonas aeruginosa PA01
ggccggugacauucgacagca

SEQ ID NO: 1544925 - RNA, 22 nt, Pseudomonas aeruginosa PA01
ggccggugacgaacgaagcgcc

SEQ ID NO: 1544926 - RNA, 16 nt, Pseudomonas aeruginosa PA01
ggccgggucgcagccg

SEQ ID NO: 1544927 - RNA, 17 nt, Pseudomonas aeruginosa PA01
ggccgggggucgcggcg

SEQ ID NO: 1544928 - RNA, 16 nt, Pseudomonas aeruginosa PA01
ggccgggggcggcgcc

SEQ ID NO: 1544929 - RNA, 14 nt, Pseudomonas aeruginosa PA01
ggccguuguagaga

SEQ ID NO: 1544930 - RNA, 17 nt, Pseudomonas aeruginosa PA01
ggccguugcgcaggcgg

SEQ ID NO: 1544931 - RNA, 20 nt, Pseudomonas aeruginosa PA01
ggccguggcgccccaggcgg

SEQ ID NO: 1544932 - RNA, 22 nt, Pseudomonas aeruginosa PA01
ggccguggcgccccaggcgggc

SEQ ID NO: 1544933 - RNA, 15 nt, Pseudomonas aeruginosa PA01
ggccgugggccgccg

SEQ ID NO: 1544934 - RNA, 19 nt, Pseudomonas aeruginosa PA01
ggccguucucgaagagcug

SEQ ID NO: 1544935 - RNA, 16 nt, Pseudomonas aeruginosa PA01
ggccguugaccagcgc

SEQ ID NO: 1544936 - RNA, 15 nt, Pseudomonas aeruginosa PA01
ggccucagggcgcga

SEQ ID NO: 1544937 - RNA, 21 nt, Pseudomonas aeruginosa PA01
ggccucaacgaccgcccaggc

SEQ ID NO: 1544938 - RNA, 14 nt, Pseudomonas aeruginosa PA01
ggccuccagcgccu

SEQ ID NO: 1544939 - RNA, 22 nt, Pseudomonas aeruginosa PA01
ggccuccagcgccucgccgagc

SEQ ID NO: 1544940 - RNA, 22 nt, Pseudomonas aeruginosa PA01
ggccuccagcaacgccgccccc

SEQ ID NO: 1544941 - RNA, 21 nt, Pseudomonas aeruginosa PA01
ggccuccagcacucgcuccuc

SEQ ID NO: 1544942 - RNA, 24 nt, Pseudomonas aeruginosa PA01
ggccuacuugaucagccgcaggca

SEQ ID NO: 1544943 - RNA, 17 nt, Pseudomonas aeruginosa PA01
ggccucggcgaucgcca

SEQ ID NO: 1544944 - RNA, 14 nt, Pseudomonas aeruginosa PA01
ggccucggcggcgc

SEQ ID NO: 1544945 - RNA, 14 nt, Pseudomonas aeruginosa PA01
ggccucggccuggu

SEQ ID NO: 1544946 - RNA, 23 nt, Pseudomonas aeruginosa PA01
ggccucggccagcgccgccgcug

SEQ ID NO: 1544947 - RNA, 15 nt, Pseudomonas aeruginosa PA01
ggccucggcauccuc

SEQ ID NO: 1544948 - RNA, 15 nt, Pseudomonas aeruginosa PA01
ggccucgcgcaacug

SEQ ID NO: 1544949 - RNA, 20 nt, Pseudomonas aeruginosa PA01
ggccucgcugccgccgcaga

SEQ ID NO: 1544950 - RNA, 18 nt, Pseudomonas aeruginosa PA01
ggccucgcugcgcagaug

SEQ ID NO: 1544951 - RNA, 22 nt, Pseudomonas aeruginosa PA01
ggccucgcggguaucgauccag

SEQ ID NO: 1544952 - RNA, 19 nt, Pseudomonas aeruginosa PA01
ggccucgaggucggccugg

SEQ ID NO: 1544953 - RNA, 20 nt, Pseudomonas aeruginosa PA01
ggccuccggacgcugcaugc

SEQ ID NO: 1544954 - RNA, 23 nt, Pseudomonas aeruginosa PA01
ggccuccggacgcugcaugcgga

SEQ ID NO: 1544955 - RNA, 11 nt, Pseudomonas aeruginosa PA01
ggccuccucgu

SEQ ID NO: 1544956 - RNA, 14 nt, Pseudomonas aeruginosa PA01
ggccucuugaaaac

SEQ ID NO: 1544957 - RNA, 21 nt, Pseudomonas aeruginosa PA01
ggccugacgcaagcgcucggc

SEQ ID NO: 1544958 - RNA, 23 nt, Pseudomonas aeruginosa PA01
ggccugacgcaagcgcucggccu

SEQ ID NO: 1544959 - RNA, 21 nt, Pseudomonas aeruginosa PA01
ggccucggucagguauucgcc

SEQ ID NO: 1544960 - RNA, 14 nt, Pseudomonas aeruginosa PA01
ggccugggccgggu

SEQ ID NO: 1544961 - RNA, 14 nt, Pseudomonas aeruginosa PA01
ggccugggcgcagg

SEQ ID NO: 1544962 - RNA, 17 nt, Pseudomonas aeruginosa PA01
ggccugggcgcaggccg

SEQ ID NO: 1544963 - RNA, 13 nt, Pseudomonas aeruginosa PA01
ggccuggccaccc

SEQ ID NO: 1544964 - RNA, 20 nt, Pseudomonas aeruginosa PA01
ggccuggcccggcgcacugc

SEQ ID NO: 1544965 - RNA, 21 nt, Pseudomonas aeruginosa PA01
ggccugggcaagcugcacggc

SEQ ID NO: 1544966 - RNA, 17 nt, Pseudomonas aeruginosa PA01
ggccuggcugccgagca

SEQ ID NO: 1544967 - RNA, 15 nt, Pseudomonas aeruginosa PA01
ggccuggcgcacggc

SEQ ID NO: 1544968 - RNA, 16 nt, Pseudomonas aeruginosa PA01
ggccuggcgucccggg

SEQ ID NO: 1544969 - RNA, 14 nt, Pseudomonas aeruginosa PA01
ggccuggagcgccu

SEQ ID NO: 1544970 - RNA, 23 nt, Pseudomonas aeruginosa PA01
ggccuggaucgccuugcgcgugc

SEQ ID NO: 1544971 - RNA, 17 nt, Pseudomonas aeruginosa PA01
ggccuggaacaccaggc

SEQ ID NO: 1544972 - RNA, 22 nt, Pseudomonas aeruginosa PA01
ggccuggaacaccaggccgcaa

SEQ ID NO: 1544973 - RNA, 17 nt, Pseudomonas aeruginosa PA01
ggccuggaacuggucgg

SEQ ID NO: 1544974 - RNA, 21 nt, Pseudomonas aeruginosa PA01
ggccuggagaaacucgcgggc

SEQ ID NO: 1544975 - RNA, 21 nt, Pseudomonas aeruginosa PA01
ggccugcucgcgcagccaggc

SEQ ID NO: 1544976 - RNA, 13 nt, Pseudomonas aeruginosa PA01
ggccugcucggag

SEQ ID NO: 1544977 - RNA, 16 nt, Pseudomonas aeruginosa PA01
ggccugcugcgccggc

SEQ ID NO: 1544978 - RNA, 11 nt, Pseudomonas aeruginosa PA01
ggccugcucag

SEQ ID NO: 1544979 - RNA, 15 nt, Pseudomonas aeruginosa PA01
ggccugcuccucggc

SEQ ID NO: 1544980 - RNA, 19 nt, Pseudomonas aeruginosa PA01
ggccugcuccucggcagcg

SEQ ID NO: 1544981 - RNA, 16 nt, Pseudomonas aeruginosa PA01
ggccugcucgaacggc

SEQ ID NO: 1544982 - RNA, 19 nt, Pseudomonas aeruginosa PA01
ggccugcgcgcaccaggcc

SEQ ID NO: 1544983 - RNA, 23 nt, Pseudomonas aeruginosa PA01
ggccugcgcgcaccaggccuccc

SEQ ID NO: 1544984 - RNA, 19 nt, Pseudomonas aeruginosa PA01
ggccugcgcuuccggcagc

SEQ ID NO: 1544985 - RNA, 20 nt, Pseudomonas aeruginosa PA01
ggccugcgcuuccggcagcc

SEQ ID NO: 1544986 - RNA, 16 nt, Pseudomonas aeruginosa PA01
ggccugcgguucgccu

SEQ ID NO: 1544987 - RNA, 17 nt, Pseudomonas aeruginosa PA01
ggccugaucaucugggc

SEQ ID NO: 1544988 - RNA, 19 nt, Pseudomonas aeruginosa PA01
ggccugaucaucugggcca

SEQ ID NO: 1544989 - RNA, 12 nt, Pseudomonas aeruginosa PA01
ggccugagccgg

SEQ ID NO: 1544990 - RNA, 15 nt, Pseudomonas aeruginosa PA01
ggccugcagccuggc

SEQ ID NO: 1544991 - RNA, 19 nt, Pseudomonas aeruginosa PA01
ggccugcagcgacuccagc

SEQ ID NO: 1544992 - RNA, 14 nt, Pseudomonas aeruginosa PA01
ggccugcagcaggu

SEQ ID NO: 1544993 - RNA, 11 nt, Pseudomonas aeruginosa PA01
ggccugcaggu

SEQ ID NO: 1544994 - RNA, 16 nt, Pseudomonas aeruginosa PA01
ggccugccccgccggc

SEQ ID NO: 1544995 - RNA, 15 nt, Pseudomonas aeruginosa PA01
ggccuuaaggugacg

SEQ ID NO: 1544996 - RNA, 15 nt, Pseudomonas aeruginosa PA01
ggccuucaggcugcg

SEQ ID NO: 1544997 - RNA, 14 nt, Pseudomonas aeruginosa PA01
ggccuguggauaga

SEQ ID NO: 1544998 - RNA, 14 nt, Pseudomonas aeruginosa PA01
ggccuguucggccu

SEQ ID NO: 1544999 - RNA, 14 nt, Pseudomonas aeruginosa PA01
ggccugguccggca

SEQ ID NO: 1545000 - RNA, 20 nt, Pseudomonas aeruginosa PA01
ggccugguaggcgucgucga

SEQ ID NO: 1545001 - RNA, 16 nt, Pseudomonas aeruginosa PA01
ggccugguagucgccg

SEQ ID NO: 1545002 - RNA, 20 nt, Pseudomonas aeruginosa PA01
ggccugggugaacagcggcc

SEQ ID NO: 1545003 - RNA, 20 nt, Pseudomonas aeruginosa PA01
ggccugggugauuucuucag

SEQ ID NO: 1545004 - RNA, 15 nt, Pseudomonas aeruginosa PA01
ggccuggucggcgcg

SEQ ID NO: 1545005 - RNA, 15 nt, Pseudomonas aeruginosa PA01
ggccuggugcaccug

SEQ ID NO: 1545006 - RNA, 16 nt, Pseudomonas aeruginosa PA01
ggccuguaccgcuucc

SEQ ID NO: 1545007 - RNA, 20 nt, Pseudomonas aeruginosa PA01
ggccuguaccgcuuccuggg

SEQ ID NO: 1545008 - RNA, 18 nt, Pseudomonas aeruginosa PA01
ggcgaagguggcgaccug

SEQ ID NO: 1545009 - RNA, 18 nt, Pseudomonas aeruginosa PA01
ggcgaagucgccgucguc

SEQ ID NO: 1545010 - RNA, 14 nt, Pseudomonas aeruginosa PA01
ggcgaagucggcgc

SEQ ID NO: 1545011 - RNA, 16 nt, Pseudomonas aeruginosa PA01
ggcgaaguugccgccg

SEQ ID NO: 1545012 - RNA, 17 nt, Pseudomonas aeruginosa PA01
ggcgaaguugccgccgc

SEQ ID NO: 1545013 - RNA, 18 nt, Pseudomonas aeruginosa PA01
ggcgaauaaccgcucgcg

SEQ ID NO: 1545014 - RNA, 16 nt, Pseudomonas aeruginosa PA01
ggcgaauaacgccaca

SEQ ID NO: 1545015 - RNA, 20 nt, Pseudomonas aeruginosa PA01
ggcgaauaacgccacaggcg

SEQ ID NO: 1545016 - RNA, 14 nt, Pseudomonas aeruginosa PA01
ggcgaagcccagcg

SEQ ID NO: 1545017 - RNA, 17 nt, Pseudomonas aeruginosa PA01
ggcgaagcggaagcgca

SEQ ID NO: 1545018 - RNA, 13 nt, Pseudomonas aeruginosa PA01
ggcgaagcggccc

SEQ ID NO: 1545019 - RNA, 19 nt, Pseudomonas aeruginosa PA01
ggcgaagcggcucggccag

SEQ ID NO: 1545020 - RNA, 20 nt, Pseudomonas aeruginosa PA01
ggcgaagcggcucggccagg

SEQ ID NO: 1545021 - RNA, 22 nt, Pseudomonas aeruginosa PA01
ggcgaagcggcucggccagggc

SEQ ID NO: 1545022 - RNA, 16 nt, Pseudomonas aeruginosa PA01
ggcgaagcggcuggcc

SEQ ID NO: 1545023 - RNA, 19 nt, Pseudomonas aeruginosa PA01
ggcgaaggcaaugccgccc

SEQ ID NO: 1545024 - RNA, 22 nt, Pseudomonas aeruginosa PA01
ggcgaaggccaccaucgcggcg

SEQ ID NO: 1545025 - RNA, 14 nt, Pseudomonas aeruginosa PA01
ggcgaagggcaggc

SEQ ID NO: 1545026 - RNA, 15 nt, Pseudomonas aeruginosa PA01
ggcgaagcucggccg

SEQ ID NO: 1545027 - RNA, 13 nt, Pseudomonas aeruginosa PA01
ggcgaagccggcg

SEQ ID NO: 1545028 - RNA, 14 nt, Pseudomonas aeruginosa PA01
ggcgaagccugcgg

SEQ ID NO: 1545029 - RNA, 17 nt, Pseudomonas aeruginosa PA01
ggcgaacuucaggccgg

SEQ ID NO: 1545030 - RNA, 20 nt, Pseudomonas aeruginosa PA01
ggcgaacgcuugagccccgg

SEQ ID NO: 1545031 - RNA, 22 nt, Pseudomonas aeruginosa PA01
ggcgaacggcuggucggcuucc

SEQ ID NO: 1545032 - RNA, 13 nt, Pseudomonas aeruginosa PA01
ggccuuggccucc

SEQ ID NO: 1545033 - RNA, 14 nt, Pseudomonas aeruginosa PA01
ggccuugagcaggc

SEQ ID NO: 1545034 - RNA, 21 nt, Pseudomonas aeruginosa PA01
ggccuugcgaccagguccgga

SEQ ID NO: 1545035 - RNA, 15 nt, Pseudomonas aeruginosa PA01
ggccuugcgcggcgc

SEQ ID NO: 1545036 - RNA, 21 nt, Pseudomonas aeruginosa PA01
ggccuugaccaccgccaggcu

SEQ ID NO: 1545037 - RNA, 16 nt, Pseudomonas aeruginosa PA01
ggccuucggcaggaag

SEQ ID NO: 1545038 - RNA, 20 nt, Pseudomonas aeruginosa PA01
ggccuucccacuccguccag

SEQ ID NO: 1545039 - RNA, 21 nt, Pseudomonas aeruginosa PA01
ggccuucggcgccggagcugg

SEQ ID NO: 1545040 - RNA, 15 nt, Pseudomonas aeruginosa PA01
ggcgcgcggccagcg

SEQ ID NO: 1545041 - RNA, 18 nt, Pseudomonas aeruginosa PA01
ggcgcgcggccagcgcgg

SEQ ID NO: 1545042 - RNA, 15 nt, Pseudomonas aeruginosa PA01
ggcgcgcgcgcugcc

SEQ ID NO: 1545043 - RNA, 23 nt, Pseudomonas aeruginosa PA01
ggcgcgcgccucagcggcuggcg

SEQ ID NO: 1545044 - RNA, 13 nt, Pseudomonas aeruginosa PA01
ggcgcgcgccccc

SEQ ID NO: 1545045 - RNA, 11 nt, Pseudomonas aeruginosa PA01
ggcgcgcgccc

SEQ ID NO: 1545046 - RNA, 13 nt, Pseudomonas aeruginosa PA01
ggcgcgggccuuc

SEQ ID NO: 1545047 - RNA, 18 nt, Pseudomonas aeruginosa PA01
ggcgcgggucugcucgcg

SEQ ID NO: 1545048 - RNA, 16 nt, Pseudomonas aeruginosa PA01
ggcgcgggcggccucg

SEQ ID NO: 1545049 - RNA, 13 nt, Pseudomonas aeruginosa PA01
ggcgcgggcggcg

SEQ ID NO: 1545050 - RNA, 15 nt, Pseudomonas aeruginosa PA01
ggcgcugaagcggcc

SEQ ID NO: 1545051 - RNA, 12 nt, Pseudomonas aeruginosa PA01
ggcgcucuggcc

SEQ ID NO: 1545052 - RNA, 18 nt, Pseudomonas aeruginosa PA01
ggcgcucggcgacgcgga

SEQ ID NO: 1545053 - RNA, 20 nt, Pseudomonas aeruginosa PA01
ggcgcugaggaucagccagc

SEQ ID NO: 1545054 - RNA, 21 nt, Pseudomonas aeruginosa PA01
ggcgcugaggaucagccagcc

SEQ ID NO: 1545055 - RNA, 13 nt, Pseudomonas aeruginosa PA01
ggcgcugcuucuu

SEQ ID NO: 1545056 - RNA, 14 nt, Pseudomonas aeruginosa PA01
ggcgcuccaggcgg

SEQ ID NO: 1545057 - RNA, 15 nt, Pseudomonas aeruginosa PA01
ggcgcuccuccagcg

SEQ ID NO: 1545058 - RNA, 23 nt, Pseudomonas aeruginosa PA01
ggcgcuccuccagcgccgccagg

SEQ ID NO: 1545059 - RNA, 21 nt, Pseudomonas aeruginosa PA01
ggcgcucgaagcuccagcgug

SEQ ID NO: 1545060 - RNA, 21 nt, Pseudomonas aeruginosa PA01
ggcgcuccuggugcggcacca

SEQ ID NO: 1545061 - RNA, 24 nt, Pseudomonas aeruginosa PA01
ggcgcuccuggugcggcaccagcc

SEQ ID NO: 1545062 - RNA, 14 nt, Pseudomonas aeruginosa PA01
ggcgcucgcgcugc

SEQ ID NO: 1545063 - RNA, 14 nt, Pseudomonas aeruginosa PA01
ggcgcucgcgggcc

SEQ ID NO: 1545064 - RNA, 22 nt, Pseudomonas aeruginosa PA01
ggcgcuagcccuuccuacaucu

SEQ ID NO: 1545065 - RNA, 16 nt, Pseudomonas aeruginosa PA01
ggcgcucacccacaug

SEQ ID NO: 1545066 - RNA, 23 nt, Pseudomonas aeruginosa PA01
ggcgcucagcaucagcgacagca

SEQ ID NO: 1545067 - RNA, 20 nt, Pseudomonas aeruginosa PA01
ggcgcuccaacagcagguag

SEQ ID NO: 1545068 - RNA, 16 nt, Pseudomonas aeruginosa PA01
ggcgcgucuccagcuc

SEQ ID NO: 1545069 - RNA, 19 nt, Pseudomonas aeruginosa PA01
ggcgcguugcuuccaggca

SEQ ID NO: 1545070 - RNA, 14 nt, Pseudomonas aeruginosa PA01
ggcgccggagcugg

SEQ ID NO: 1545071 - RNA, 15 nt, Pseudomonas aeruginosa PA01
ggcgccggaccagcc

SEQ ID NO: 1545072 - RNA, 17 nt, Pseudomonas aeruginosa PA01
ggcgccggaccagccgg

SEQ ID NO: 1545073 - RNA, 16 nt, Pseudomonas aeruginosa PA01
ggcgccggcgcgcggc

SEQ ID NO: 1545074 - RNA, 19 nt, Pseudomonas aeruginosa PA01
ggcgccggcgcgcuugccg

SEQ ID NO: 1545075 - RNA, 21 nt, Pseudomonas aeruginosa PA01
ggcgccggcggaucagcccgc

SEQ ID NO: 1545076 - RNA, 12 nt, Pseudomonas aeruginosa PA01
ggcgccggcgcg

SEQ ID NO: 1545077 - RNA, 13 nt, Pseudomonas aeruginosa PA01
ggcgccggccaga

SEQ ID NO: 1545078 - RNA, 15 nt, Pseudomonas aeruginosa PA01
ggcgccggccagagc

SEQ ID NO: 1545079 - RNA, 11 nt, Pseudomonas aeruginosa PA01
ggcgcccuggc

SEQ ID NO: 1545080 - RNA, 16 nt, Pseudomonas aeruginosa PA01
ggcgcccuucagcgcc

SEQ ID NO: 1545081 - RNA, 22 nt, Pseudomonas aeruginosa PA01
ggcgccgaaaaaaaggggcccg

SEQ ID NO: 1545082 - RNA, 13 nt, Pseudomonas aeruginosa PA01
ggcgccgaccagc

SEQ ID NO: 1545083 - RNA, 14 nt, Pseudomonas aeruginosa PA01
ggcgccgaccagcu

SEQ ID NO: 1545084 - RNA, 13 nt, Pseudomonas aeruginosa PA01
ggcgccgcagggc

SEQ ID NO: 1545085 - RNA, 14 nt, Pseudomonas aeruginosa PA01
ggcgccgcagggcc

SEQ ID NO: 1545086 - RNA, 16 nt, Pseudomonas aeruginosa PA01
ggcgccgaugcccagg

SEQ ID NO: 1545087 - RNA, 22 nt, Pseudomonas aeruginosa PA01
ggcgccgaugccggccggcagc

SEQ ID NO: 1545088 - RNA, 18 nt, Pseudomonas aeruginosa PA01
ggcgccgagcagcggcgc

SEQ ID NO: 1545089 - RNA, 13 nt, Pseudomonas aeruginosa PA01
ggcgccgagcagc

SEQ ID NO: 1545090 - RNA, 15 nt, Pseudomonas aeruginosa PA01
ggcgcgccggcccgg

SEQ ID NO: 1545091 - RNA, 18 nt, Pseudomonas aeruginosa PA01
ggcgcgcagcgaacgggc

SEQ ID NO: 1545092 - RNA, 18 nt, Pseudomonas aeruginosa PA01
ggcgcgcacggaggcgcu

SEQ ID NO: 1545093 - RNA, 18 nt, Pseudomonas aeruginosa PA01
ggcgcgccucugagacgc

SEQ ID NO: 1545094 - RNA, 19 nt, Pseudomonas aeruginosa PA01
ggcgcgccuucagcgccuc

SEQ ID NO: 1545095 - RNA, 20 nt, Pseudomonas aeruginosa PA01
ggcgcgcagcagguagugcg

SEQ ID NO: 1545096 - RNA, 15 nt, Pseudomonas aeruginosa PA01
ggcgcgaugcucccg

SEQ ID NO: 1545097 - RNA, 20 nt, Pseudomonas aeruginosa PA01
ggcgcgauauccgccaggga

SEQ ID NO: 1545098 - RNA, 17 nt, Pseudomonas aeruginosa PA01
ggcgcgauccgcgcggc

SEQ ID NO: 1545099 - RNA, 17 nt, Pseudomonas aeruginosa PA01
ggcgccugagcagcgcu

SEQ ID NO: 1545100 - RNA, 14 nt, Pseudomonas aeruginosa PA01
ggcgccuggccugg

SEQ ID NO: 1545101 - RNA, 18 nt, Pseudomonas aeruginosa PA01
ggcgccggcgcgcagggu

SEQ ID NO: 1545102 - RNA, 16 nt, Pseudomonas aeruginosa PA01
ggcgccgucgggggcg

SEQ ID NO: 1545103 - RNA, 17 nt, Pseudomonas aeruginosa PA01
ggcgccuccagcgggcc

SEQ ID NO: 1545104 - RNA, 23 nt, Pseudomonas aeruginosa PA01
ggcgccucgaugauccacuugcc

SEQ ID NO: 1545105 - RNA, 15 nt, Pseudomonas aeruginosa PA01
ggcgccuagacccug

SEQ ID NO: 1545106 - RNA, 16 nt, Pseudomonas aeruginosa PA01
ggcgccuagacccugg

SEQ ID NO: 1545107 - RNA, 20 nt, Pseudomonas aeruginosa PA01
ggcgcagacgucuuccggga

SEQ ID NO: 1545108 - RNA, 22 nt, Pseudomonas aeruginosa PA01
ggcgcagaacugccgggccagc

SEQ ID NO: 1545109 - RNA, 20 nt, Pseudomonas aeruginosa PA01
ggcgcagacaggccuccagc

SEQ ID NO: 1545110 - RNA, 21 nt, Pseudomonas aeruginosa PA01
ggcgcagacaggccuccagca

SEQ ID NO: 1545111 - RNA, 14 nt, Pseudomonas aeruginosa PA01
ggcgcacugccagg

SEQ ID NO: 1545112 - RNA, 15 nt, Pseudomonas aeruginosa PA01
ggcgcacugcguggg

SEQ ID NO: 1545113 - RNA, 22 nt, Pseudomonas aeruginosa PA01
ggcgcagcagcgacucgcuggg

SEQ ID NO: 1545114 - RNA, 13 nt, Pseudomonas aeruginosa PA01
ggcgcagcaggau

SEQ ID NO: 1545115 - RNA, 20 nt, Pseudomonas aeruginosa PA01
ggcgcagccgcaaggccagg

SEQ ID NO: 1545116 - RNA, 16 nt, Pseudomonas aeruginosa PA01
ggcgcagccgcugggc

SEQ ID NO: 1545117 - RNA, 15 nt, Pseudomonas aeruginosa PA01
ggcgcagcaucaucu

SEQ ID NO: 1545118 - RNA, 19 nt, Pseudomonas aeruginosa PA01
ggcgcagcccuugcaaccg

SEQ ID NO: 1545119 - RNA, 21 nt, Pseudomonas aeruginosa PA01
ggcgcagcccuugcaaccgcc

SEQ ID NO: 1545120 - RNA, 17 nt, Pseudomonas aeruginosa PA01
ggcgcaggggcgcgccg

SEQ ID NO: 1545121 - RNA, 16 nt, Pseudomonas aeruginosa PA01
ggcgcaugcccagggc

SEQ ID NO: 1545122 - RNA, 16 nt, Pseudomonas aeruginosa PA01
ggcgcaugcgccggcu

SEQ ID NO: 1545123 - RNA, 21 nt, Pseudomonas aeruginosa PA01
ggcgcaucgucgaaacgcugg

SEQ ID NO: 1545124 - RNA, 11 nt, Pseudomonas aeruginosa PA01
ggcgcccaggg

SEQ ID NO: 1545125 - RNA, 20 nt, Pseudomonas aeruginosa PA01
ggcgccccaggcgcccaggc

SEQ ID NO: 1545126 - RNA, 14 nt, Pseudomonas aeruginosa PA01
ggcgccccaggcgg

SEQ ID NO: 1545127 - RNA, 16 nt, Pseudomonas aeruginosa PA01
ggcgccccggcccagc

SEQ ID NO: 1545128 - RNA, 15 nt, Pseudomonas aeruginosa PA01
ggcgccccugcggcg

SEQ ID NO: 1545129 - RNA, 19 nt, Pseudomonas aeruginosa PA01
ggcgccccugcggcgccgg

SEQ ID NO: 1545130 - RNA, 22 nt, Pseudomonas aeruginosa PA01
ggcgcccgccuuguucgccagc

SEQ ID NO: 1545131 - RNA, 13 nt, Pseudomonas aeruginosa PA01
ggcgcccgcgggc

SEQ ID NO: 1545132 - RNA, 17 nt, Pseudomonas aeruginosa PA01
ggcgcccgagggcgccg

SEQ ID NO: 1545133 - RNA, 20 nt, Pseudomonas aeruginosa PA01
ggcgccaccgauagcggcgc

SEQ ID NO: 1545134 - RNA, 22 nt, Pseudomonas aeruginosa PA01
ggcgccaauccgggcguagggc

SEQ ID NO: 1545135 - RNA, 15 nt, Pseudomonas aeruginosa PA01
ggcgccaccccgccg

SEQ ID NO: 1545136 - RNA, 14 nt, Pseudomonas aeruginosa PA01
ggcgccaaccaugg

SEQ ID NO: 1545137 - RNA, 17 nt, Pseudomonas aeruginosa PA01
ggcgccaaccgggcagc

SEQ ID NO: 1545138 - RNA, 18 nt, Pseudomonas aeruginosa PA01
ggcgccaacucggccugg

SEQ ID NO: 1545139 - RNA, 21 nt, Pseudomonas aeruginosa PA01
ggcgcccaaugcaucggccgg

SEQ ID NO: 1545140 - RNA, 20 nt, Pseudomonas aeruginosa PA01
ggcgaggaucacgcagcagg

SEQ ID NO: 1545141 - RNA, 16 nt, Pseudomonas aeruginosa PA01
ggcgaggaucgcgcug

SEQ ID NO: 1545142 - RNA, 20 nt, Pseudomonas aeruginosa PA01
ggcgaggaaaaggaucgccg

SEQ ID NO: 1545143 - RNA, 15 nt, Pseudomonas aeruginosa PA01
ggcgagggcgcgcac

SEQ ID NO: 1545144 - RNA, 17 nt, Pseudomonas aeruginosa PA01
ggcgagggcggcgcggg

SEQ ID NO: 1545145 - RNA, 19 nt, Pseudomonas aeruginosa PA01
ggcgaggcuaacgccgagg

SEQ ID NO: 1545146 - RNA, 13 nt, Pseudomonas aeruginosa PA01
ggcgaggccggcg

SEQ ID NO: 1545147 - RNA, 13 nt, Pseudomonas aeruginosa PA01
ggcgaggcgcgcc

SEQ ID NO: 1545148 - RNA, 14 nt, Pseudomonas aeruginosa PA01
ggcgaaugccuucg

SEQ ID NO: 1545149 - RNA, 17 nt, Pseudomonas aeruginosa PA01
ggcgaauucgucgccgc

SEQ ID NO: 1545150 - RNA, 15 nt, Pseudomonas aeruginosa PA01
ggcgaucagcucgcg

SEQ ID NO: 1545151 - RNA, 13 nt, Pseudomonas aeruginosa PA01
ggcgaucaggcag

SEQ ID NO: 1545152 - RNA, 21 nt, Pseudomonas aeruginosa PA01
ggcgaucaggcagcgcgcggc

SEQ ID NO: 1545153 - RNA, 17 nt, Pseudomonas aeruginosa PA01
ggcgauccacagcaggu

SEQ ID NO: 1545154 - RNA, 18 nt, Pseudomonas aeruginosa PA01
ggcgaucauccagccccc

SEQ ID NO: 1545155 - RNA, 16 nt, Pseudomonas aeruginosa PA01
ggcgaggucggccugc

SEQ ID NO: 1545156 - RNA, 18 nt, Pseudomonas aeruginosa PA01
ggcgaggugaucgagggc

SEQ ID NO: 1545157 - RNA, 21 nt, Pseudomonas aeruginosa PA01
ggcgaggugaucgagggccac

SEQ ID NO: 1545158 - RNA, 23 nt, Pseudomonas aeruginosa PA01
ggcgaguaccaccgugcccgccg

SEQ ID NO: 1545159 - RNA, 15 nt, Pseudomonas aeruginosa PA01
ggcgagucguuacga

SEQ ID NO: 1545160 - RNA, 15 nt, Pseudomonas aeruginosa PA01
ggcgcaacugcgcca

SEQ ID NO: 1545161 - RNA, 17 nt, Pseudomonas aeruginosa PA01
ggcgcaacugcgccagc

SEQ ID NO: 1545162 - RNA, 18 nt, Pseudomonas aeruginosa PA01
ggcgcaacugcgccagcc

SEQ ID NO: 1545163 - RNA, 16 nt, Pseudomonas aeruginosa PA01
ggcgcaaccagaccag

SEQ ID NO: 1545164 - RNA, 19 nt, Pseudomonas aeruginosa PA01
ggcgcaaccagaccagcag

SEQ ID NO: 1545165 - RNA, 21 nt, Pseudomonas aeruginosa PA01
ggcgcaacccugcccaguggg

SEQ ID NO: 1545166 - RNA, 23 nt, Pseudomonas aeruginosa PA01
ggcgcaacaccuugcgcaccgcc

SEQ ID NO: 1545167 - RNA, 19 nt, Pseudomonas aeruginosa PA01
ggcgauguagcugccggcg

SEQ ID NO: 1545168 - RNA, 23 nt, Pseudomonas aeruginosa PA01
ggcgauguccuggaucggcagcu

SEQ ID NO: 1545169 - RNA, 18 nt, Pseudomonas aeruginosa PA01
ggcgauggugcgcucgcg

SEQ ID NO: 1545170 - RNA, 23 nt, Pseudomonas aeruginosa PA01
ggcgcaagcgguugaguagaaaa

SEQ ID NO: 1545171 - RNA, 20 nt, Pseudomonas aeruginosa PA01
ggcgcaaggccagcggcauc

SEQ ID NO: 1545172 - RNA, 18 nt, Pseudomonas aeruginosa PA01
ggcgcaaucagggcuggg

SEQ ID NO: 1545173 - RNA, 17 nt, Pseudomonas aeruginosa PA01
ggcgcaaggugccgagg

SEQ ID NO: 1545174 - RNA, 18 nt, Pseudomonas aeruginosa PA01
ggcgauggccgccagcag

SEQ ID NO: 1545175 - RNA, 19 nt, Pseudomonas aeruginosa PA01
ggcgauggccgccagcagg

SEQ ID NO: 1545176 - RNA, 20 nt, Pseudomonas aeruginosa PA01
ggcgauggccgccagcaggc

SEQ ID NO: 1545177 - RNA, 16 nt, Pseudomonas aeruginosa PA01
ggcgauggccgccugc

SEQ ID NO: 1545178 - RNA, 20 nt, Pseudomonas aeruginosa PA01
ggcgauggccuggucggcgc

SEQ ID NO: 1545179 - RNA, 13 nt, Pseudomonas aeruginosa PA01
ggcgaugcucagc

SEQ ID NO: 1545180 - RNA, 15 nt, Pseudomonas aeruginosa PA01
ggcgaugcugaccca

SEQ ID NO: 1545181 - RNA, 19 nt, Pseudomonas aeruginosa PA01
ggcgaugcugcugaucagg

SEQ ID NO: 1545182 - RNA, 22 nt, Pseudomonas aeruginosa PA01
ggcgaugcugcugaucaggagg

SEQ ID NO: 1545183 - RNA, 18 nt, Pseudomonas aeruginosa PA01
ggcgaucucggcgcgggc

SEQ ID NO: 1545184 - RNA, 13 nt, Pseudomonas aeruginosa PA01
ggcgaucccggcg

SEQ ID NO: 1545185 - RNA, 20 nt, Pseudomonas aeruginosa PA01
ggcgaucccguagaccggcu

SEQ ID NO: 1545186 - RNA, 14 nt, Pseudomonas aeruginosa PA01
ggcgauccgcugca

SEQ ID NO: 1545187 - RNA, 15 nt, Pseudomonas aeruginosa PA01
ggcgaucgccaggcg

SEQ ID NO: 1545188 - RNA, 17 nt, Pseudomonas aeruginosa PA01
ggcgugccgccaggccu

SEQ ID NO: 1545189 - RNA, 13 nt, Pseudomonas aeruginosa PA01
ggcgugcugcacg

SEQ ID NO: 1545190 - RNA, 18 nt, Pseudomonas aeruginosa PA01
ggcgugcauggccgggcc

SEQ ID NO: 1545191 - RNA, 12 nt, Pseudomonas aeruginosa PA01
ggcgugcagggu

SEQ ID NO: 1545192 - RNA, 19 nt, Pseudomonas aeruginosa PA01
ggcguggucuccgugcugg

SEQ ID NO: 1545193 - RNA, 20 nt, Pseudomonas aeruginosa PA01
ggcguggucuccgugcuggc

SEQ ID NO: 1545194 - RNA, 22 nt, Pseudomonas aeruginosa PA01
ggcguggucuccgugcuggccg

SEQ ID NO: 1545195 - RNA, 19 nt, Pseudomonas aeruginosa PA01
ggcguggcggccgccggcg

SEQ ID NO: 1545196 - RNA, 18 nt, Pseudomonas aeruginosa PA01
ggcguggucggcggccuc

SEQ ID NO: 1545197 - RNA, 11 nt, Pseudomonas aeruginosa PA01
ggcgugguggc

SEQ ID NO: 1545198 - RNA, 16 nt, Pseudomonas aeruginosa PA01
ggcgugggcgccggcg

SEQ ID NO: 1545199 - RNA, 17 nt, Pseudomonas aeruginosa PA01
ggcgugggcggucggcg

SEQ ID NO: 1545200 - RNA, 15 nt, Pseudomonas aeruginosa PA01
ggcguucaccgcgca

SEQ ID NO: 1545201 - RNA, 14 nt, Pseudomonas aeruginosa PA01
ggcguuagccgccu

SEQ ID NO: 1545202 - RNA, 14 nt, Pseudomonas aeruginosa PA01
ggcguuauccgccg

SEQ ID NO: 1545203 - RNA, 23 nt, Pseudomonas aeruginosa PA01
ggcguuauccgccgcucacccug

SEQ ID NO: 1545204 - RNA, 18 nt, Pseudomonas aeruginosa PA01
ggcguucgaucuccucgc

SEQ ID NO: 1545205 - RNA, 13 nt, Pseudomonas aeruginosa PA01
ggcguucgcccug

SEQ ID NO: 1545206 - RNA, 15 nt, Pseudomonas aeruginosa PA01
ggcguucgccgagca

SEQ ID NO: 1545207 - RNA, 17 nt, Pseudomonas aeruginosa PA01
ggcguucgccgcgggcg

SEQ ID NO: 1545208 - RNA, 15 nt, Pseudomonas aeruginosa PA01
ggcguucggggcccu

SEQ ID NO: 1545209 - RNA, 20 nt, Pseudomonas aeruginosa PA01
ggcguuacaguaucgcuuag

SEQ ID NO: 1545210 - RNA, 18 nt, Pseudomonas aeruginosa PA01
ggcgucgggcaguacuca

SEQ ID NO: 1545211 - RNA, 23 nt, Pseudomonas aeruginosa PA01
ggcgucgggcgaaacggcaggcc

SEQ ID NO: 1545212 - RNA, 18 nt, Pseudomonas aeruginosa PA01
ggcgucggcugcgcuggg

SEQ ID NO: 1545213 - RNA, 17 nt, Pseudomonas aeruginosa PA01
ggcgucggcgagcaggc

SEQ ID NO: 1545214 - RNA, 16 nt, Pseudomonas aeruginosa PA01
ggcgucgcacugcugc

SEQ ID NO: 1545215 - RNA, 22 nt, Pseudomonas aeruginosa PA01
ggcgucgaucccgaucgccaau

SEQ ID NO: 1545216 - RNA, 20 nt, Pseudomonas aeruginosa PA01
ggcgucgcccucggcgcugg

SEQ ID NO: 1545217 - RNA, 23 nt, Pseudomonas aeruginosa PA01
ggcgucgccgacuucggcaagca

SEQ ID NO: 1545218 - RNA, 23 nt, Pseudomonas aeruginosa PA01
ggcgucgaugcgccucagcggcc

SEQ ID NO: 1545219 - RNA, 14 nt, Pseudomonas aeruginosa PA01
ggcgucgaccgccu

SEQ ID NO: 1545220 - RNA, 16 nt, Pseudomonas aeruginosa PA01
ggcgucgaccgccugc

SEQ ID NO: 1545221 - RNA, 20 nt, Pseudomonas aeruginosa PA01
ggcgugagcagggccgagcg

SEQ ID NO: 1545222 - RNA, 16 nt, Pseudomonas aeruginosa PA01
ggcgugaagccgccgc

SEQ ID NO: 1545223 - RNA, 18 nt, Pseudomonas aeruginosa PA01
ggcgugaaguagccgccg

SEQ ID NO: 1545224 - RNA, 22 nt, Pseudomonas aeruginosa PA01
ggcgucugcucauucggccagc

SEQ ID NO: 1545225 - RNA, 19 nt, Pseudomonas aeruginosa PA01
ggcgucugggacggcagcc

SEQ ID NO: 1545226 - RNA, 14 nt, Pseudomonas aeruginosa PA01
ggcguuggccagcg

SEQ ID NO: 1545227 - RNA, 21 nt, Pseudomonas aeruginosa PA01
ggcguuggcuccgggccgagg

SEQ ID NO: 1545228 - RNA, 17 nt, Pseudomonas aeruginosa PA01
ggcguugucggccagca

SEQ ID NO: 1545229 - RNA, 20 nt, Pseudomonas aeruginosa PA01
ggcguugucggccagcagca

SEQ ID NO: 1545230 - RNA, 16 nt, Pseudomonas aeruginosa PA01
ggcguucucggccagg

SEQ ID NO: 1545231 - RNA, 19 nt, Pseudomonas aeruginosa PA01
ggcguugccgugccggucg

SEQ ID NO: 1545232 - RNA, 19 nt, Pseudomonas aeruginosa PA01
ggcguuuucguuggcggcc

SEQ ID NO: 1545233 - RNA, 22 nt, Pseudomonas aeruginosa PA01
ggcguuuuucauugggcagcca

SEQ ID NO: 1545234 - RNA, 18 nt, Pseudomonas aeruginosa PA01
ggcuacgcuccguagggc

SEQ ID NO: 1545235 - RNA, 16 nt, Pseudomonas aeruginosa PA01
ggcuacccgcagggcu

SEQ ID NO: 1545236 - RNA, 17 nt, Pseudomonas aeruginosa PA01
ggcuacccgcagggcuc

SEQ ID NO: 1545237 - RNA, 23 nt, Pseudomonas aeruginosa PA01
ggcuacccgcagggcucgugcca

SEQ ID NO: 1545238 - RNA, 23 nt, Pseudomonas aeruginosa PA01
ggcuaccaggaagcucggcagca

SEQ ID NO: 1545239 - RNA, 19 nt, Pseudomonas aeruginosa PA01
ggcuagucgcgcagcgccu

SEQ ID NO: 1545240 - RNA, 19 nt, Pseudomonas aeruginosa PA01
ggcuauguauucggcgguc

SEQ ID NO: 1545241 - RNA, 19 nt, Pseudomonas aeruginosa PA01
ggcucagcgcggcggcggc

SEQ ID NO: 1545242 - RNA, 17 nt, Pseudomonas aeruginosa PA01
ggcucagaaauccaccu

SEQ ID NO: 1545243 - RNA, 19 nt, Pseudomonas aeruginosa PA01
ggcucagaacagcggcagc

SEQ ID NO: 1545244 - RNA, 21 nt, Pseudomonas aeruginosa PA01
ggcucagaagucccagcgagu

SEQ ID NO: 1545245 - RNA, 13 nt, Pseudomonas aeruginosa PA01
ggcggaacggcuc

SEQ ID NO: 1545246 - RNA, 16 nt, Pseudomonas aeruginosa PA01
ggcggaacggcucgcg

SEQ ID NO: 1545247 - RNA, 15 nt, Pseudomonas aeruginosa PA01
ggcggaacagcucgg

SEQ ID NO: 1545248 - RNA, 16 nt, Pseudomonas aeruginosa PA01
ggcgcuugccgcgccc

SEQ ID NO: 1545249 - RNA, 19 nt, Pseudomonas aeruginosa PA01
ggcgcuuucaucaggcgcu

SEQ ID NO: 1545250 - RNA, 18 nt, Pseudomonas aeruginosa PA01
ggcgcuuucgcucugguc

SEQ ID NO: 1545251 - RNA, 14 nt, Pseudomonas aeruginosa PA01
ggcggccgagggcg

SEQ ID NO: 1545252 - RNA, 23 nt, Pseudomonas aeruginosa PA01
ggcggccgaauccuccagccggc

SEQ ID NO: 1545253 - RNA, 21 nt, Pseudomonas aeruginosa PA01
ggcggccgacgugcacccgcu

SEQ ID NO: 1545254 - RNA, 19 nt, Pseudomonas aeruginosa PA01
ggcggccccuucagcucca

SEQ ID NO: 1545255 - RNA, 13 nt, Pseudomonas aeruginosa PA01
ggcggcccgcaca

SEQ ID NO: 1545256 - RNA, 18 nt, Pseudomonas aeruginosa PA01
ggcgcuggucucuuccag

SEQ ID NO: 1545257 - RNA, 17 nt, Pseudomonas aeruginosa PA01
ggcgcugggucaugcuc

SEQ ID NO: 1545258 - RNA, 20 nt, Pseudomonas aeruginosa PA01
ggcgcugggucaugcucggg

SEQ ID NO: 1545259 - RNA, 21 nt, Pseudomonas aeruginosa PA01
ggcgcugguccagcacgcugg

SEQ ID NO: 1545260 - RNA, 18 nt, Pseudomonas aeruginosa PA01
ggcgcugggcggcuggcc

SEQ ID NO: 1545261 - RNA, 19 nt, Pseudomonas aeruginosa PA01
ggcgcuguaggcgagcagc

SEQ ID NO: 1545262 - RNA, 14 nt, Pseudomonas aeruginosa PA01
ggcgcuugcgcagc

SEQ ID NO: 1545263 - RNA, 15 nt, Pseudomonas aeruginosa PA01
ggcgcuugcgcagca

SEQ ID NO: 1545264 - RNA, 18 nt, Pseudomonas aeruginosa PA01
ggcgcuuguagcccaggg

SEQ ID NO: 1545265 - RNA, 18 nt, Pseudomonas aeruginosa PA01
ggcgcuucugcgagccgc

SEQ ID NO: 1545266 - RNA, 20 nt, Pseudomonas aeruginosa PA01
ggcgcuucugcucggccugg

SEQ ID NO: 1545267 - RNA, 17 nt, Pseudomonas aeruginosa PA01
ggcgcugucgcccgggc

SEQ ID NO: 1545268 - RNA, 13 nt, Pseudomonas aeruginosa PA01
ggcgcugucgccg

SEQ ID NO: 1545269 - RNA, 23 nt, Pseudomonas aeruginosa PA01
ggcgcugucucgccagcccggca

SEQ ID NO: 1545270 - RNA, 16 nt, Pseudomonas aeruginosa PA01
ggcggcucaggccgcc

SEQ ID NO: 1545271 - RNA, 15 nt, Pseudomonas aeruginosa PA01
ggcggcucggcugcu

SEQ ID NO: 1545272 - RNA, 16 nt, Pseudomonas aeruginosa PA01
ggcggcgugcaggccg

SEQ ID NO: 1545273 - RNA, 15 nt, Pseudomonas aeruginosa PA01
ggcggcgguucgccg

SEQ ID NO: 1545274 - RNA, 15 nt, Pseudomonas aeruginosa PA01
ggcggcgagcgccgc

SEQ ID NO: 1545275 - RNA, 18 nt, Pseudomonas aeruginosa PA01
ggcggcgguagccgaggc

SEQ ID NO: 1545276 - RNA, 20 nt, Pseudomonas aeruginosa PA01
ggcggcgacgaagcccaggc

SEQ ID NO: 1545277 - RNA, 20 nt, Pseudomonas aeruginosa PA01
ggcggcgacccagaccugcc

SEQ ID NO: 1545278 - RNA, 20 nt, Pseudomonas aeruginosa PA01
ggcggccgcaugccggggug

SEQ ID NO: 1545279 - RNA, 22 nt, Pseudomonas aeruginosa PA01
ggcggccgccuugaccugcugg

SEQ ID NO: 1545280 - RNA, 16 nt, Pseudomonas aeruginosa PA01
ggcggcgaagucugcc

SEQ ID NO: 1545281 - RNA, 15 nt, Pseudomonas aeruginosa PA01
ggcggcgagcggguc

SEQ ID NO: 1545282 - RNA, 16 nt, Pseudomonas aeruginosa PA01
ggcggcgagcuggauc

SEQ ID NO: 1545283 - RNA, 16 nt, Pseudomonas aeruginosa PA01
ggcggcgccaggccgg

SEQ ID NO: 1545284 - RNA, 23 nt, Pseudomonas aeruginosa PA01
ggcggcgccgaacagggcgagca

SEQ ID NO: 1545285 - RNA, 19 nt, Pseudomonas aeruginosa PA01
ggcggcgccuucgccggaa

SEQ ID NO: 1545286 - RNA, 22 nt, Pseudomonas aeruginosa PA01
ggcggcgccggugaggcgcagc

SEQ ID NO: 1545287 - RNA, 23 nt, Pseudomonas aeruginosa PA01
ggcggcugguucugguccaccag

SEQ ID NO: 1545288 - RNA, 15 nt, Pseudomonas aeruginosa PA01
ggcggcuggccgagg

SEQ ID NO: 1545289 - RNA, 16 nt, Pseudomonas aeruginosa PA01
ggcggcuggccgagga

SEQ ID NO: 1545290 - RNA, 15 nt, Pseudomonas aeruginosa PA01
ggcggcuuccuccau

SEQ ID NO: 1545291 - RNA, 11 nt, Pseudomonas aeruginosa PA01
ggcggucaggu

SEQ ID NO: 1545292 - RNA, 19 nt, Pseudomonas aeruginosa PA01
ggcggucaucgcgccgccg

SEQ ID NO: 1545293 - RNA, 19 nt, Pseudomonas aeruginosa PA01
ggcggucccaucagcaguc

SEQ ID NO: 1545294 - RNA, 16 nt, Pseudomonas aeruginosa PA01
ggcggucagcgacugg

SEQ ID NO: 1545295 - RNA, 11 nt, Pseudomonas aeruginosa PA01
ggcggucaggc

SEQ ID NO: 1545296 - RNA, 13 nt, Pseudomonas aeruginosa PA01
ggcggugcggaag

SEQ ID NO: 1545297 - RNA, 23 nt, Pseudomonas aeruginosa PA01
ggcggucucgaacgccaggcagg

SEQ ID NO: 1545298 - RNA, 24 nt, Pseudomonas aeruginosa PA01
ggcggucucgaacgccaggcaggc

SEQ ID NO: 1545299 - RNA, 17 nt, Pseudomonas aeruginosa PA01
ggcggucggcucagccg

SEQ ID NO: 1545300 - RNA, 17 nt, Pseudomonas aeruginosa PA01
ggcggucggccaggcgg

SEQ ID NO: 1545301 - RNA, 22 nt, Pseudomonas aeruginosa PA01
ggcggucggccaucuggcugcc

SEQ ID NO: 1545302 - RNA, 19 nt, Pseudomonas aeruginosa PA01
ggcggucgcgaucugcugg

SEQ ID NO: 1545303 - RNA, 16 nt, Pseudomonas aeruginosa PA01
ggcggugcggucggcg

SEQ ID NO: 1545304 - RNA, 15 nt, Pseudomonas aeruginosa PA01
ggcguaccagccgcg

SEQ ID NO: 1545305 - RNA, 19 nt, Pseudomonas aeruginosa PA01
ggcguagaccuugcggccg

SEQ ID NO: 1545306 - RNA, 13 nt, Pseudomonas aeruginosa PA01
ggcguccagcagg

SEQ ID NO: 1545307 - RNA, 14 nt, Pseudomonas aeruginosa PA01
ggcguccagcaggu

SEQ ID NO: 1545308 - RNA, 21 nt, Pseudomonas aeruginosa PA01
ggcguccccaugcccggccug

SEQ ID NO: 1545309 - RNA, 15 nt, Pseudomonas aeruginosa PA01
ggcguccccuuccuc

SEQ ID NO: 1545310 - RNA, 23 nt, Pseudomonas aeruginosa PA01
ggcguccccuuccuccucgccgc

SEQ ID NO: 1545311 - RNA, 14 nt, Pseudomonas aeruginosa PA01
ggcgucccgcagua

SEQ ID NO: 1545312 - RNA, 15 nt, Pseudomonas aeruginosa PA01
ggcguccgcggccug

SEQ ID NO: 1545313 - RNA, 17 nt, Pseudomonas aeruginosa PA01
ggcguccgcggccugcu

SEQ ID NO: 1545314 - RNA, 14 nt, Pseudomonas aeruginosa PA01
ggcguccgcuggcc

SEQ ID NO: 1545315 - RNA, 15 nt, Pseudomonas aeruginosa PA01
ggcguccgcuggccu

SEQ ID NO: 1545316 - RNA, 15 nt, Pseudomonas aeruginosa PA01
ggcgucgaccacggc

SEQ ID NO: 1545317 - RNA, 17 nt, Pseudomonas aeruginosa PA01
ggcgucgaccacggccu

SEQ ID NO: 1545318 - RNA, 23 nt, Pseudomonas aeruginosa PA01
ggccauucgcuucggccaccagc

SEQ ID NO: 1545319 - RNA, 18 nt, Pseudomonas aeruginosa PA01
ggccaucgucaacauccu

SEQ ID NO: 1545320 - RNA, 22 nt, Pseudomonas aeruginosa PA01
ggccauguacguaucccagcgc

SEQ ID NO: 1545321 - RNA, 16 nt, Pseudomonas aeruginosa PA01
ggccaugggcacgccg

SEQ ID NO: 1545322 - RNA, 17 nt, Pseudomonas aeruginosa PA01
ggccaugggcacgccgg

SEQ ID NO: 1545323 - RNA, 18 nt, Pseudomonas aeruginosa PA01
ggccaugggugucggcga

SEQ ID NO: 1545324 - RNA, 21 nt, Pseudomonas aeruginosa PA01
ggccaucgaaaucgcccacca

SEQ ID NO: 1545325 - RNA, 14 nt, Pseudomonas aeruginosa PA01
ggccaucgccggcc

SEQ ID NO: 1545326 - RNA, 20 nt, Pseudomonas aeruginosa PA01
ggccauccauaucggccacc

SEQ ID NO: 1545327 - RNA, 17 nt, Pseudomonas aeruginosa PA01
ggccaucagcaccagga

SEQ ID NO: 1545328 - RNA, 14 nt, Pseudomonas aeruginosa PA01
ggccaucagcacgu

SEQ ID NO: 1545329 - RNA, 23 nt, Pseudomonas aeruginosa PA01
ggccaguuccaugucgcuggccu

SEQ ID NO: 1545330 - RNA, 18 nt, Pseudomonas aeruginosa PA01
ggccaucagcgccagggc

SEQ ID NO: 1545331 - RNA, 18 nt, Pseudomonas aeruginosa PA01
ggccaucagcgccgccuc

SEQ ID NO: 1545332 - RNA, 23 nt, Pseudomonas aeruginosa PA01
ggccaucagggcgaaagccuuca

SEQ ID NO: 1545333 - RNA, 15 nt, Pseudomonas aeruginosa PA01
ggccaucagguccac

SEQ ID NO: 1545334 - RNA, 16 nt, Pseudomonas aeruginosa PA01
ggccagguugaccagu

SEQ ID NO: 1545335 - RNA, 20 nt, Pseudomonas aeruginosa PA01
ggccaguccggucagcagca

SEQ ID NO: 1545336 - RNA, 13 nt, Pseudomonas aeruginosa PA01
ggccagcgcggcg

SEQ ID NO: 1545337 - RNA, 18 nt, Pseudomonas aeruginosa PA01
ggccagcgcggccgccgc

SEQ ID NO: 1545338 - RNA, 12 nt, Pseudomonas aeruginosa PA01
ggccagcgcgua

SEQ ID NO: 1545339 - RNA, 16 nt, Pseudomonas aeruginosa PA01
ggccagcgcggcggac

SEQ ID NO: 1545340 - RNA, 14 nt, Pseudomonas aeruginosa PA01
ggccagcuccagca

SEQ ID NO: 1545341 - RNA, 21 nt, Pseudomonas aeruginosa PA01
ggccagcuccagcaccggcgg

SEQ ID NO: 1545342 - RNA, 23 nt, Pseudomonas aeruginosa PA01
ggccagcuccagcaccggcggcg

SEQ ID NO: 1545343 - RNA, 20 nt, Pseudomonas aeruginosa PA01
ggccagcgugaagaccuggu

SEQ ID NO: 1545344 - RNA, 17 nt, Pseudomonas aeruginosa PA01
ggccagcggcuccucgg

SEQ ID NO: 1545345 - RNA, 17 nt, Pseudomonas aeruginosa PA01
ggccaggaucgucggcc

SEQ ID NO: 1545346 - RNA, 19 nt, Pseudomonas aeruginosa PA01
ggccaggagcaucggcgcg

SEQ ID NO: 1545347 - RNA, 21 nt, Pseudomonas aeruginosa PA01
ggccaggagcaucggcgcggc

SEQ ID NO: 1545348 - RNA, 22 nt, Pseudomonas aeruginosa PA01
ggccaggagcaucggcgcggcc

SEQ ID NO: 1545349 - RNA, 13 nt, Pseudomonas aeruginosa PA01
ggccaggaggccc

SEQ ID NO: 1545350 - RNA, 14 nt, Pseudomonas aeruginosa PA01
ggccaggaccaggg

SEQ ID NO: 1545351 - RNA, 18 nt, Pseudomonas aeruginosa PA01
ggccaggcagaccagcgc

SEQ ID NO: 1545352 - RNA, 15 nt, Pseudomonas aeruginosa PA01
ggccaggcaaugucg

SEQ ID NO: 1545353 - RNA, 14 nt, Pseudomonas aeruginosa PA01
ggccaggcauccag

SEQ ID NO: 1545354 - RNA, 17 nt, Pseudomonas aeruginosa PA01
ggccaggcauccagcac

SEQ ID NO: 1545355 - RNA, 14 nt, Pseudomonas aeruginosa PA01
ggccaggcauuccu

SEQ ID NO: 1545356 - RNA, 21 nt, Pseudomonas aeruginosa PA01
ggccaggcauuccuccagggu

SEQ ID NO: 1545357 - RNA, 23 nt, Pseudomonas aeruginosa PA01
ggccaggucgguccgccgaugcg

SEQ ID NO: 1545358 - RNA, 11 nt, Pseudomonas aeruginosa PA01
ggccaggcgcg

SEQ ID NO: 1545359 - RNA, 18 nt, Pseudomonas aeruginosa PA01
ggccaggucgcgcagggc

SEQ ID NO: 1545360 - RNA, 16 nt, Pseudomonas aeruginosa PA01
ggccaggcgccagggc

SEQ ID NO: 1545361 - RNA, 15 nt, Pseudomonas aeruginosa PA01
ggccaggcgccaggu

SEQ ID NO: 1545362 - RNA, 15 nt, Pseudomonas aeruginosa PA01
ggccaggccggcgcc

SEQ ID NO: 1545363 - RNA, 13 nt, Pseudomonas aeruginosa PA01
ggccaggccggcg

SEQ ID NO: 1545364 - RNA, 15 nt, Pseudomonas aeruginosa PA01
ggccaggccgcccag

SEQ ID NO: 1545365 - RNA, 14 nt, Pseudomonas aeruginosa PA01
ggccaggccgagcg

SEQ ID NO: 1545366 - RNA, 18 nt, Pseudomonas aeruginosa PA01
ggccaggccgagcgccag

SEQ ID NO: 1545367 - RNA, 19 nt, Pseudomonas aeruginosa PA01
ggccaggccgagcgcgccg

SEQ ID NO: 1545368 - RNA, 23 nt, Pseudomonas aeruginosa PA01
ggccaggccgagcgcgccgccga

SEQ ID NO: 1545369 - RNA, 12 nt, Pseudomonas aeruginosa PA01
ggccaggcccuu

SEQ ID NO: 1545370 - RNA, 21 nt, Pseudomonas aeruginosa PA01
ggccaggccccaggccgccgc

SEQ ID NO: 1545371 - RNA, 13 nt, Pseudomonas aeruginosa PA01
ggccaggcccacg

SEQ ID NO: 1545372 - RNA, 11 nt, Pseudomonas aeruginosa PA01
ggccaggccac

SEQ ID NO: 1545373 - RNA, 19 nt, Pseudomonas aeruginosa PA01
ggccaggccacggccggcg

SEQ ID NO: 1545374 - RNA, 16 nt, Pseudomonas aeruginosa PA01
ggccacucgcagccgc

SEQ ID NO: 1545375 - RNA, 17 nt, Pseudomonas aeruginosa PA01
ggccacucgcagccgcg

SEQ ID NO: 1545376 - RNA, 18 nt, Pseudomonas aeruginosa PA01
ggccagcagcgccuccuc

SEQ ID NO: 1545377 - RNA, 22 nt, Pseudomonas aeruginosa PA01
ggccagcagcgccuccucuacc

SEQ ID NO: 1545378 - RNA, 23 nt, Pseudomonas aeruginosa PA01
ggccagcagcgccuccucuacca

SEQ ID NO: 1545379 - RNA, 22 nt, Pseudomonas aeruginosa PA01
ggccagcaggaugcugcacagc

SEQ ID NO: 1545380 - RNA, 13 nt, Pseudomonas aeruginosa PA01
ggccagcaggccg

SEQ ID NO: 1545381 - RNA, 16 nt, Pseudomonas aeruginosa PA01
ggccagcaggccgagc

SEQ ID NO: 1545382 - RNA, 18 nt, Pseudomonas aeruginosa PA01
ggccagcaggccgaucag

SEQ ID NO: 1545383 - RNA, 14 nt, Pseudomonas aeruginosa PA01
ggccagcaggcgcc

SEQ ID NO: 1545384 - RNA, 14 nt, Pseudomonas aeruginosa PA01
ggccagcaggcgcu

SEQ ID NO: 1545385 - RNA, 19 nt, Pseudomonas aeruginosa PA01
ggccagcaggcgcucggcg

SEQ ID NO: 1545386 - RNA, 14 nt, Pseudomonas aeruginosa PA01
ggccagcaggcugg

SEQ ID NO: 1545387 - RNA, 11 nt, Pseudomonas aeruginosa PA01
ggccagcagcu

SEQ ID NO: 1545388 - RNA, 13 nt, Pseudomonas aeruginosa PA01
ggccagcagcucc

SEQ ID NO: 1545389 - RNA, 15 nt, Pseudomonas aeruginosa PA01
ggccagcagcuccgg

SEQ ID NO: 1545390 - RNA, 18 nt, Pseudomonas aeruginosa PA01
ggccagcagcuccgggcu

SEQ ID NO: 1545391 - RNA, 20 nt, Pseudomonas aeruginosa PA01
ggccagcagcuccgggcugg

SEQ ID NO: 1545392 - RNA, 14 nt, Pseudomonas aeruginosa PA01
ggccagcagcggcg

SEQ ID NO: 1545393 - RNA, 16 nt, Pseudomonas aeruginosa PA01
ggccagcagcggcggc

SEQ ID NO: 1545394 - RNA, 13 nt, Pseudomonas aeruginosa PA01
ggccagcagcgcu

SEQ ID NO: 1545395 - RNA, 14 nt, Pseudomonas aeruginosa PA01
ggccagcagggugg

SEQ ID NO: 1545396 - RNA, 17 nt, Pseudomonas aeruginosa PA01
ggccagcagggccgccg

SEQ ID NO: 1545397 - RNA, 16 nt, Pseudomonas aeruginosa PA01
ggccacccuugcgccc

SEQ ID NO: 1545398 - RNA, 20 nt, Pseudomonas aeruginosa PA01
ggccacccgccucgucgcca

SEQ ID NO: 1545399 - RNA, 23 nt, Pseudomonas aeruginosa PA01
ggccaccgaaucggacagguugg

SEQ ID NO: 1545400 - RNA, 18 nt, Pseudomonas aeruginosa PA01
ggccaccgccaggaccuc

SEQ ID NO: 1545401 - RNA, 13 nt, Pseudomonas aeruginosa PA01
ggccacggccgcu

SEQ ID NO: 1545402 - RNA, 16 nt, Pseudomonas aeruginosa PA01
ggccacggccgcugcg

SEQ ID NO: 1545403 - RNA, 13 nt, Pseudomonas aeruginosa PA01
ggccacuccagcc

SEQ ID NO: 1545404 - RNA, 17 nt, Pseudomonas aeruginosa PA01
ggccacguucugcagga

SEQ ID NO: 1545405 - RNA, 14 nt, Pseudomonas aeruginosa PA01
ggccacuccgggcu

SEQ ID NO: 1545406 - RNA, 16 nt, Pseudomonas aeruginosa PA01
ggccacuccgggcugg

SEQ ID NO: 1545407 - RNA, 16 nt, Pseudomonas aeruginosa PA01
ggccacgucgccccag

SEQ ID NO: 1545408 - RNA, 18 nt, Pseudomonas aeruginosa PA01
ggccagccgcgccagugc

SEQ ID NO: 1545409 - RNA, 14 nt, Pseudomonas aeruginosa PA01
ggccagccggcgcc

SEQ ID NO: 1545410 - RNA, 15 nt, Pseudomonas aeruginosa PA01
ggccagccggcgccg

SEQ ID NO: 1545411 - RNA, 16 nt, Pseudomonas aeruginosa PA01
ggccagccccugcgga

SEQ ID NO: 1545412 - RNA, 21 nt, Pseudomonas aeruginosa PA01
ggccagccccugcggaccgca

SEQ ID NO: 1545413 - RNA, 17 nt, Pseudomonas aeruginosa PA01
ggccagcccugguaggu

SEQ ID NO: 1545414 - RNA, 22 nt, Pseudomonas aeruginosa PA01
ggccagcccuuucagcggcugc

SEQ ID NO: 1545415 - RNA, 23 nt, Pseudomonas aeruginosa PA01
ggccagcccuuucagcggcugcc

SEQ ID NO: 1545416 - RNA, 17 nt, Pseudomonas aeruginosa PA01
ggccagccccagauggg

SEQ ID NO: 1545417 - RNA, 13 nt, Pseudomonas aeruginosa PA01
ggccagccagggc

SEQ ID NO: 1545418 - RNA, 12 nt, Pseudomonas aeruginosa PA01
ggccagcccaga

SEQ ID NO: 1545419 - RNA, 18 nt, Pseudomonas aeruginosa PA01
ggccagcccagaacagca

SEQ ID NO: 1545420 - RNA, 13 nt, Pseudomonas aeruginosa PA01
ggccagccagagc

SEQ ID NO: 1545421 - RNA, 16 nt, Pseudomonas aeruginosa PA01
ggccagccagagccag

SEQ ID NO: 1545422 - RNA, 19 nt, Pseudomonas aeruginosa PA01
ggccagccuggccagcgcu

SEQ ID NO: 1545423 - RNA, 16 nt, Pseudomonas aeruginosa PA01
ggccagccuucccggc

SEQ ID NO: 1545424 - RNA, 17 nt, Pseudomonas aeruginosa PA01
ggccagccuucccggcg

SEQ ID NO: 1545425 - RNA, 17 nt, Pseudomonas aeruginosa PA01
ggccagcgaacccaggc

SEQ ID NO: 1545426 - RNA, 16 nt, Pseudomonas aeruginosa PA01
ggccagcgccaggagc

SEQ ID NO: 1545427 - RNA, 14 nt, Pseudomonas aeruginosa PA01
ggccagcgccaggu

SEQ ID NO: 1545428 - RNA, 23 nt, Pseudomonas aeruginosa PA01
ggccagcgccagguuggccuggc

SEQ ID NO: 1545429 - RNA, 21 nt, Pseudomonas aeruginosa PA01
ggcaugcacgcccuggagcgg

SEQ ID NO: 1545430 - RNA, 21 nt, Pseudomonas aeruginosa PA01
ggcaugaugcgcccguccucc

SEQ ID NO: 1545431 - RNA, 16 nt, Pseudomonas aeruginosa PA01
ggcaugcccaggcucg

SEQ ID NO: 1545432 - RNA, 18 nt, Pseudomonas aeruginosa PA01
ggcaugcccugccggcgc

SEQ ID NO: 1545433 - RNA, 13 nt, Pseudomonas aeruginosa PA01
ggcauggcuguag

SEQ ID NO: 1545434 - RNA, 24 nt, Pseudomonas aeruginosa PA01
ggcauggcuuuccaggcgccgcuu

SEQ ID NO: 1545435 - RNA, 21 nt, Pseudomonas aeruginosa PA01
ggcaugguugguguccacgcu

SEQ ID NO: 1545436 - RNA, 15 nt, Pseudomonas aeruginosa PA01
ggcauguuccuccag

SEQ ID NO: 1545437 - RNA, 16 nt, Pseudomonas aeruginosa PA01
ggccaaccucucccca

SEQ ID NO: 1545438 - RNA, 22 nt, Pseudomonas aeruginosa PA01
ggccaaccucuccccagacccu

SEQ ID NO: 1545439 - RNA, 12 nt, Pseudomonas aeruginosa PA01
ggccaccagcac

SEQ ID NO: 1545440 - RNA, 12 nt, Pseudomonas aeruginosa PA01
ggccaccagagc

SEQ ID NO: 1545441 - RNA, 19 nt, Pseudomonas aeruginosa PA01
ggccaccaccgugaccagc

SEQ ID NO: 1545442 - RNA, 13 nt, Pseudomonas aeruginosa PA01
ggcaguuccaggc

SEQ ID NO: 1545443 - RNA, 14 nt, Pseudomonas aeruginosa PA01
ggcaguuccgccag

SEQ ID NO: 1545444 - RNA, 20 nt, Pseudomonas aeruginosa PA01
ggcagucgguagaaauccuc

SEQ ID NO: 1545445 - RNA, 21 nt, Pseudomonas aeruginosa PA01
ggcagugcgccggcaucgcca

SEQ ID NO: 1545446 - RNA, 16 nt, Pseudomonas aeruginosa PA01
ggcagugcucgaucag

SEQ ID NO: 1545447 - RNA, 20 nt, Pseudomonas aeruginosa PA01
ggcagugcucgaucaggcug

SEQ ID NO: 1545448 - RNA, 14 nt, Pseudomonas aeruginosa PA01
ggcagugccgggcg

SEQ ID NO: 1545449 - RNA, 19 nt, Pseudomonas aeruginosa PA01
ggcagucccugccaggggc

SEQ ID NO: 1545450 - RNA, 22 nt, Pseudomonas aeruginosa PA01
ggcaguccuggcgguagcccgg

SEQ ID NO: 1545451 - RNA, 21 nt, Pseudomonas aeruginosa PA01
ggcaguccuugagcgccagca

SEQ ID NO: 1545452 - RNA, 23 nt, Pseudomonas aeruginosa PA01
ggcaguccuugagcgccagcagg

SEQ ID NO: 1545453 - RNA, 16 nt, Pseudomonas aeruginosa PA01
ggcagucccagaaggc

SEQ ID NO: 1545454 - RNA, 20 nt, Pseudomonas aeruginosa PA01
ggcagucccagaaggccagg

SEQ ID NO: 1545455 - RNA, 22 nt, Pseudomonas aeruginosa PA01
ggcagucccagaaggccagggc

SEQ ID NO: 1545456 - RNA, 15 nt, Pseudomonas aeruginosa PA01
ggcaguacguggcgc

SEQ ID NO: 1545457 - RNA, 19 nt, Pseudomonas aeruginosa PA01
ggcagcgucucggcugccg

SEQ ID NO: 1545458 - RNA, 20 nt, Pseudomonas aeruginosa PA01
ggcagcgugcaccagcaggc

SEQ ID NO: 1545459 - RNA, 23 nt, Pseudomonas aeruginosa PA01
ggcagcgucgagcuggcgcaggc

SEQ ID NO: 1545460 - RNA, 14 nt, Pseudomonas aeruginosa PA01
ggcagcgggccagg

SEQ ID NO: 1545461 - RNA, 17 nt, Pseudomonas aeruginosa PA01
ggcagcgggccaggcgg

SEQ ID NO: 1545462 - RNA, 14 nt, Pseudomonas aeruginosa PA01
ggcaucgauccgca

SEQ ID NO: 1545463 - RNA, 16 nt, Pseudomonas aeruginosa PA01
ggcaucgaccagcagc

SEQ ID NO: 1545464 - RNA, 21 nt, Pseudomonas aeruginosa PA01
ggcaucgaccagcagcggcuc

SEQ ID NO: 1545465 - RNA, 15 nt, Pseudomonas aeruginosa PA01
ggcaucgacgccagc

SEQ ID NO: 1545466 - RNA, 22 nt, Pseudomonas aeruginosa PA01
ggcauccuguggcugcagguag

SEQ ID NO: 1545467 - RNA, 13 nt, Pseudomonas aeruginosa PA01
ggcaucgccgccc

SEQ ID NO: 1545468 - RNA, 16 nt, Pseudomonas aeruginosa PA01
ggcaucucggccaccu

SEQ ID NO: 1545469 - RNA, 21 nt, Pseudomonas aeruginosa PA01
ggcaugaacgaaaacgccgcu

SEQ ID NO: 1545470 - RNA, 22 nt, Pseudomonas aeruginosa PA01
ggcaugaacgaaaacgccgcuu

SEQ ID NO: 1545471 - RNA, 19 nt, Pseudomonas aeruginosa PA01
ggcauagaugccgcccugc

SEQ ID NO: 1545472 - RNA, 17 nt, Pseudomonas aeruginosa PA01
ggcauccccuuuuuuca

SEQ ID NO: 1545473 - RNA, 22 nt, Pseudomonas aeruginosa PA01
ggcauccccuuuuuucagccug

SEQ ID NO: 1545474 - RNA, 13 nt, Pseudomonas aeruginosa PA01
ggcaucccgcccg

SEQ ID NO: 1545475 - RNA, 22 nt, Pseudomonas aeruginosa PA01
ggcauagccgaacuccgccagc

SEQ ID NO: 1545476 - RNA, 19 nt, Pseudomonas aeruginosa PA01
ggcauaggcccggcgugcc

SEQ ID NO: 1545477 - RNA, 19 nt, Pseudomonas aeruginosa PA01
ggcacguacguccagggca

SEQ ID NO: 1545478 - RNA, 23 nt, Pseudomonas aeruginosa PA01
ggcacguacguccagggcaccac

SEQ ID NO: 1545479 - RNA, 19 nt, Pseudomonas aeruginosa PA01
ggcacggggcgccuguccg

SEQ ID NO: 1545480 - RNA, 19 nt, Pseudomonas aeruginosa PA01
ggcacggucauggccagcu

SEQ ID NO: 1545481 - RNA, 23 nt, Pseudomonas aeruginosa PA01
ggcacgccccauccgggcggcgg

SEQ ID NO: 1545482 - RNA, 17 nt, Pseudomonas aeruginosa PA01
ggcacgcugccagcagg

SEQ ID NO: 1545483 - RNA, 18 nt, Pseudomonas aeruginosa PA01
ggcacgccgguggccagg

SEQ ID NO: 1545484 - RNA, 20 nt, Pseudomonas aeruginosa PA01
ggcacgccgguggccaggcu

SEQ ID NO: 1545485 - RNA, 14 nt, Pseudomonas aeruginosa PA01
ggcacgcagcagcu

SEQ ID NO: 1545486 - RNA, 19 nt, Pseudomonas aeruginosa PA01
ggcacgacgcucggacagc

SEQ ID NO: 1545487 - RNA, 19 nt, Pseudomonas aeruginosa PA01
ggcaccuugcgaaaagccc

SEQ ID NO: 1545488 - RNA, 22 nt, Pseudomonas aeruginosa PA01
ggcaccuugcgaaaagcccgcc

SEQ ID NO: 1545489 - RNA, 16 nt, Pseudomonas aeruginosa PA01
ggcaccguaggccagg

SEQ ID NO: 1545490 - RNA, 18 nt, Pseudomonas aeruginosa PA01
ggcaccguaggccaggca

SEQ ID NO: 1545491 - RNA, 19 nt, Pseudomonas aeruginosa PA01
ggcaccguaggccaggcag

SEQ ID NO: 1545492 - RNA, 12 nt, Pseudomonas aeruginosa PA01
ggcaccugcaga

SEQ ID NO: 1545493 - RNA, 13 nt, Pseudomonas aeruginosa PA01
ggcaccugcagac

SEQ ID NO: 1545494 - RNA, 14 nt, Pseudomonas aeruginosa PA01
ggcaccgcgccggc

SEQ ID NO: 1545495 - RNA, 17 nt, Pseudomonas aeruginosa PA01
ggcaccguggugcccgg

SEQ ID NO: 1545496 - RNA, 20 nt, Pseudomonas aeruginosa PA01
ggcaccgagagcugcaaggc

SEQ ID NO: 1545497 - RNA, 23 nt, Pseudomonas aeruginosa PA01
ggcaccgagccguugugcaggua

SEQ ID NO: 1545498 - RNA, 23 nt, Pseudomonas aeruginosa PA01
ggcaccgaucgcccgcgccucga

SEQ ID NO: 1545499 - RNA, 13 nt, Pseudomonas aeruginosa PA01
ggcacccggcugg

SEQ ID NO: 1545500 - RNA, 20 nt, Pseudomonas aeruginosa PA01
ggcacccucuuccgcgcuga

SEQ ID NO: 1545501 - RNA, 21 nt, Pseudomonas aeruginosa PA01
ggcaccccuucgagcaacaca

SEQ ID NO: 1545502 - RNA, 20 nt, Pseudomonas aeruginosa PA01
ggcaccccuugcagccagcc

SEQ ID NO: 1545503 - RNA, 12 nt, Pseudomonas aeruginosa PA01
ggcagcaccagg

SEQ ID NO: 1545504 - RNA, 13 nt, Pseudomonas aeruginosa PA01
ggcagcaccaggc

SEQ ID NO: 1545505 - RNA, 21 nt, Pseudomonas aeruginosa PA01
ggcagcacgcuggcgucgggc

SEQ ID NO: 1545506 - RNA, 20 nt, Pseudomonas aeruginosa PA01
ggcacuucucgaacagcucc

SEQ ID NO: 1545507 - RNA, 21 nt, Pseudomonas aeruginosa PA01
ggcacuucguccaggccgccu

SEQ ID NO: 1545508 - RNA, 15 nt, Pseudomonas aeruginosa PA01
ggcacucggcgacca

SEQ ID NO: 1545509 - RNA, 14 nt, Pseudomonas aeruginosa PA01
ggcacucagccagc

SEQ ID NO: 1545510 - RNA, 19 nt, Pseudomonas aeruginosa PA01
ggcacuccguugaccuggu

SEQ ID NO: 1545511 - RNA, 20 nt, Pseudomonas aeruginosa PA01
ggcacucgaugaacagcgcg

SEQ ID NO: 1545512 - RNA, 15 nt, Pseudomonas aeruginosa PA01
ggcacucgccgggcg

SEQ ID NO: 1545513 - RNA, 20 nt, Pseudomonas aeruginosa PA01
ggcagcgcgauaucgcaggc

SEQ ID NO: 1545514 - RNA, 19 nt, Pseudomonas aeruginosa PA01
ggcagccacucggccaggc

SEQ ID NO: 1545515 - RNA, 21 nt, Pseudomonas aeruginosa PA01
ggcagccacucggccaggcgc

SEQ ID NO: 1545516 - RNA, 19 nt, Pseudomonas aeruginosa PA01
ggcagcgccgccagcagga

SEQ ID NO: 1545517 - RNA, 15 nt, Pseudomonas aeruginosa PA01
ggcagcgccgcccac

SEQ ID NO: 1545518 - RNA, 14 nt, Pseudomonas aeruginosa PA01
ggcagcgccgggca

SEQ ID NO: 1545519 - RNA, 20 nt, Pseudomonas aeruginosa PA01
ggcagcgccucggcggcguu

SEQ ID NO: 1545520 - RNA, 12 nt, Pseudomonas aeruginosa PA01
ggcagcgcuggc

SEQ ID NO: 1545521 - RNA, 17 nt, Pseudomonas aeruginosa PA01
ggcagcgcuacgcaggc

SEQ ID NO: 1545522 - RNA, 20 nt, Pseudomonas aeruginosa PA01
ggcagcgcuacgcaggcccu

SEQ ID NO: 1545523 - RNA, 17 nt, Pseudomonas aeruginosa PA01
ggcagcgcgcggccagu

SEQ ID NO: 1545524 - RNA, 23 nt, Pseudomonas aeruginosa PA01
ggcagcggcucgucaucguccag

SEQ ID NO: 1545525 - RNA, 12 nt, Pseudomonas aeruginosa PA01
ggcagcggcugg

SEQ ID NO: 1545526 - RNA, 14 nt, Pseudomonas aeruginosa PA01
ggcagcagcggauc

SEQ ID NO: 1545527 - RNA, 20 nt, Pseudomonas aeruginosa PA01
ggcagcaucucggugcgccc

SEQ ID NO: 1545528 - RNA, 13 nt, Pseudomonas aeruginosa PA01
ggcagccaccagg

SEQ ID NO: 1545529 - RNA, 15 nt, Pseudomonas aeruginosa PA01
ggcagcagcuugccg

SEQ ID NO: 1545530 - RNA, 19 nt, Pseudomonas aeruginosa PA01
ggcagcagucgcagcucgg

SEQ ID NO: 1545531 - RNA, 13 nt, Pseudomonas aeruginosa PA01
ggcagcagggcgu

SEQ ID NO: 1545532 - RNA, 18 nt, Pseudomonas aeruginosa PA01
ggcagcaggucgcgcagu

SEQ ID NO: 1545533 - RNA, 22 nt, Pseudomonas aeruginosa PA01
ggcacacgcccggcacucgccg

SEQ ID NO: 1545534 - RNA, 18 nt, Pseudomonas aeruginosa PA01
ggcaccaccagcgcgcgc

SEQ ID NO: 1545535 - RNA, 18 nt, Pseudomonas aeruginosa PA01
ggcaccaccgccgccagc

SEQ ID NO: 1545536 - RNA, 20 nt, Pseudomonas aeruginosa PA01
ggcaccaccgccgccagcaa

SEQ ID NO: 1545537 - RNA, 21 nt, Pseudomonas aeruginosa PA01
ggcaccaccgccgccagcaac

SEQ ID NO: 1545538 - RNA, 23 nt, Pseudomonas aeruginosa PA01
ggcaccagcacguugccauccag

SEQ ID NO: 1545539 - RNA, 12 nt, Pseudomonas aeruginosa PA01
ggcaaucgcggg

SEQ ID NO: 1545540 - RNA, 19 nt, Pseudomonas aeruginosa PA01
ggcaauguccgagcagguc

SEQ ID NO: 1545541 - RNA, 15 nt, Pseudomonas aeruginosa PA01
ggcaauagccgggcu

SEQ ID NO: 1545542 - RNA, 20 nt, Pseudomonas aeruginosa PA01
ggcaaucaucgcgucgccga

SEQ ID NO: 1545543 - RNA, 23 nt, Pseudomonas aeruginosa PA01
ggauugguggucaccagcguggg

SEQ ID NO: 1545544 - RNA, 13 nt, Pseudomonas aeruginosa PA01
ggaucgcccuggc

SEQ ID NO: 1545545 - RNA, 17 nt, Pseudomonas aeruginosa PA01
ggaucgccuccggcacg

SEQ ID NO: 1545546 - RNA, 13 nt, Pseudomonas aeruginosa PA01
ggaucgccgggcu

SEQ ID NO: 1545547 - RNA, 12 nt, Pseudomonas aeruginosa PA01
ggaucgccagga

SEQ ID NO: 1545548 - RNA, 13 nt, Pseudomonas aeruginosa PA01
ggaucgccaggac

SEQ ID NO: 1545549 - RNA, 16 nt, Pseudomonas aeruginosa PA01
ggaucgaccccgccgg

SEQ ID NO: 1545550 - RNA, 15 nt, Pseudomonas aeruginosa PA01
ggaucgacagcagcg

SEQ ID NO: 1545551 - RNA, 17 nt, Pseudomonas aeruginosa PA01
ggaucgacagcagcgcc

SEQ ID NO: 1545552 - RNA, 15 nt, Pseudomonas aeruginosa PA01
ggaucgcucccaggc

SEQ ID NO: 1545553 - RNA, 19 nt, Pseudomonas aeruginosa PA01
ggcaacggcugggucacgu

SEQ ID NO: 1545554 - RNA, 17 nt, Pseudomonas aeruginosa PA01
ggcaacgucaggcugua

SEQ ID NO: 1545555 - RNA, 17 nt, Pseudomonas aeruginosa PA01
ggcaacgccaggccgcu

SEQ ID NO: 1545556 - RNA, 15 nt, Pseudomonas aeruginosa PA01
ggaccucgggcagcu

SEQ ID NO: 1545557 - RNA, 23 nt, Pseudomonas aeruginosa PA01
ggaccucgggcgagaaucgccga

SEQ ID NO: 1545558 - RNA, 19 nt, Pseudomonas aeruginosa PA01
ggaccucucucgcugcgcg

SEQ ID NO: 1545559 - RNA, 18 nt, Pseudomonas aeruginosa PA01
ggaccucgaagcuggcca

SEQ ID NO: 1545560 - RNA, 20 nt, Pseudomonas aeruginosa PA01
ggaccucgaagcuggccagu

SEQ ID NO: 1545561 - RNA, 18 nt, Pseudomonas aeruginosa PA01
ggacccgcgccggcagcu

SEQ ID NO: 1545562 - RNA, 15 nt, Pseudomonas aeruginosa PA01
ggacccgcucggccu

SEQ ID NO: 1545563 - RNA, 17 nt, Pseudomonas aeruginosa PA01
ggaccagcgccugcugc

SEQ ID NO: 1545564 - RNA, 18 nt, Pseudomonas aeruginosa PA01
ggaccagcgccugcugcg

SEQ ID NO: 1545565 - RNA, 15 nt, Pseudomonas aeruginosa PA01
ggaccagccgguccc

SEQ ID NO: 1545566 - RNA, 20 nt, Pseudomonas aeruginosa PA01
ggaccagccggucccgggcu

SEQ ID NO: 1545567 - RNA, 22 nt, Pseudomonas aeruginosa PA01
ggaccagccggucccgggcucc

SEQ ID NO: 1545568 - RNA, 19 nt, Pseudomonas aeruginosa PA01
ggaccaccguggcgccggc

SEQ ID NO: 1545569 - RNA, 19 nt, Pseudomonas aeruginosa PA01
ggaccaggaucgaccccgc

SEQ ID NO: 1545570 - RNA, 11 nt, Pseudomonas aeruginosa PA01
ggaccagcgcc

SEQ ID NO: 1545571 - RNA, 21 nt, Pseudomonas aeruginosa PA01
ggaccaguucgccgccgcgcu

SEQ ID NO: 1545572 - RNA, 16 nt, Pseudomonas aeruginosa PA01
ggacccagacaggccu

SEQ ID NO: 1545573 - RNA, 15 nt, Pseudomonas aeruginosa PA01
ggaccauggccggcg

SEQ ID NO: 1545574 - RNA, 14 nt, Pseudomonas aeruginosa PA01
ggaauccagggccg

SEQ ID NO: 1545575 - RNA, 19 nt, Pseudomonas aeruginosa PA01
ggaauccuucgcggcggcg

SEQ ID NO: 1545576 - RNA, 16 nt, Pseudomonas aeruginosa PA01
ggaaugacgagccgca

SEQ ID NO: 1545577 - RNA, 16 nt, Pseudomonas aeruginosa PA01
ggaaucuuuccuccag

SEQ ID NO: 1545578 - RNA, 22 nt, Pseudomonas aeruginosa PA01
ggacagguccuggaacaggaag

SEQ ID NO: 1545579 - RNA, 21 nt, Pseudomonas aeruginosa PA01
ggacaggucgcggaagugcgg

SEQ ID NO: 1545580 - RNA, 22 nt, Pseudomonas aeruginosa PA01
ggacauggagaccuggcugaau

SEQ ID NO: 1545581 - RNA, 20 nt, Pseudomonas aeruginosa PA01
ggacaugucgagggccgggu

SEQ ID NO: 1545582 - RNA, 19 nt, Pseudomonas aeruginosa PA01
ggacggcucgcgcagcggc

SEQ ID NO: 1545583 - RNA, 13 nt, Pseudomonas aeruginosa PA01
ggacggcugaggc

SEQ ID NO: 1545584 - RNA, 13 nt, Pseudomonas aeruginosa PA01
ggacggugcaggc

SEQ ID NO: 1545585 - RNA, 14 nt, Pseudomonas aeruginosa PA01
ggacgguucccaga

SEQ ID NO: 1545586 - RNA, 20 nt, Pseudomonas aeruginosa PA01
ggacggcggacugcucgccg

SEQ ID NO: 1545587 - RNA, 16 nt, Pseudomonas aeruginosa PA01
ggacguuccaccuggc

SEQ ID NO: 1545588 - RNA, 16 nt, Pseudomonas aeruginosa PA01
ggacgcaccagcaggc

SEQ ID NO: 1545589 - RNA, 16 nt, Pseudomonas aeruginosa PA01
ggacgcaggccgaccu

SEQ ID NO: 1545590 - RNA, 19 nt, Pseudomonas aeruginosa PA01
ggaccugagaucagcgccc

SEQ ID NO: 1545591 - RNA, 14 nt, Pseudomonas aeruginosa PA01
ggaccuccugcaca

SEQ ID NO: 1545592 - RNA, 21 nt, Pseudomonas aeruginosa PA01
ggacgaucacucccugcucgc

SEQ ID NO: 1545593 - RNA, 23 nt, Pseudomonas aeruginosa PA01
ggacgaugaucaccaggacccag

SEQ ID NO: 1545594 - RNA, 15 nt, Pseudomonas aeruginosa PA01
ggacgccaccaggcc

SEQ ID NO: 1545595 - RNA, 16 nt, Pseudomonas aeruginosa PA01
ggacgccaccaggccg

SEQ ID NO: 1545596 - RNA, 17 nt, Pseudomonas aeruginosa PA01
ggagaacuuuucccagc

SEQ ID NO: 1545597 - RNA, 22 nt, Pseudomonas aeruginosa PA01
ggacucgcuaucaggcaucccc

SEQ ID NO: 1545598 - RNA, 13 nt, Pseudomonas aeruginosa PA01
ggacucccgcaga

SEQ ID NO: 1545599 - RNA, 16 nt, Pseudomonas aeruginosa PA01
ggacuccggaggcgca

SEQ ID NO: 1545600 - RNA, 12 nt, Pseudomonas aeruginosa PA01
ggaggggcggcc

SEQ ID NO: 1545601 - RNA, 18 nt, Pseudomonas aeruginosa PA01
ggaggcgcuuucccgcuu

SEQ ID NO: 1545602 - RNA, 23 nt, Pseudomonas aeruginosa PA01
ggaggcacgaaccguccgcagcg

SEQ ID NO: 1545603 - RNA, 15 nt, Pseudomonas aeruginosa PA01
ggaggaucgccagga

SEQ ID NO: 1545604 - RNA, 16 nt, Pseudomonas aeruginosa PA01
ggaggaucuccaacug

SEQ ID NO: 1545605 - RNA, 17 nt, Pseudomonas aeruginosa PA01
ggaggauucgccagccu

SEQ ID NO: 1545606 - RNA, 19 nt, Pseudomonas aeruginosa PA01
ggagcguccaccagcgccc

SEQ ID NO: 1545607 - RNA, 13 nt, Pseudomonas aeruginosa PA01
ggagcgggcgccg

SEQ ID NO: 1545608 - RNA, 18 nt, Pseudomonas aeruginosa PA01
ggaggaaauacagcaccc

SEQ ID NO: 1545609 - RNA, 16 nt, Pseudomonas aeruginosa PA01
ggagcuuugcagggcg

SEQ ID NO: 1545610 - RNA, 21 nt, Pseudomonas aeruginosa PA01
ggaggaaacccaugcccgccc

SEQ ID NO: 1545611 - RNA, 12 nt, Pseudomonas aeruginosa PA01
ggagcgccagca

SEQ ID NO: 1545612 - RNA, 15 nt, Pseudomonas aeruginosa PA01
ggagcgccagcacca

SEQ ID NO: 1545613 - RNA, 21 nt, Pseudomonas aeruginosa PA01
ggagcgccgcgcagcgcggcg

SEQ ID NO: 1545614 - RNA, 23 nt, Pseudomonas aeruginosa PA01
ggagcgccgcgcagcgcggcgcu

SEQ ID NO: 1545615 - RNA, 12 nt, Pseudomonas aeruginosa PA01
ggagcgccggcg

SEQ ID NO: 1545616 - RNA, 13 nt, Pseudomonas aeruginosa PA01
ggagcgccuggcg

SEQ ID NO: 1545617 - RNA, 17 nt, Pseudomonas aeruginosa PA01
ggagcgcucgcgcagcc

SEQ ID NO: 1545618 - RNA, 13 nt, Pseudomonas aeruginosa PA01
ggagcggcugccg

SEQ ID NO: 1545619 - RNA, 13 nt, Pseudomonas aeruginosa PA01
ggagaugcucagg

SEQ ID NO: 1545620 - RNA, 14 nt, Pseudomonas aeruginosa PA01
ggagaucagcggac

SEQ ID NO: 1545621 - RNA, 18 nt, Pseudomonas aeruginosa PA01
ggagaacgacaugcucau

SEQ ID NO: 1545622 - RNA, 16 nt, Pseudomonas aeruginosa PA01
ggagauagccuccucc

SEQ ID NO: 1545623 - RNA, 21 nt, Pseudomonas aeruginosa PA01
ggaucagccacgggcgccagc

SEQ ID NO: 1545624 - RNA, 24 nt, Pseudomonas aeruginosa PA01
ggaucagccacgggcgccagcggu

SEQ ID NO: 1545625 - RNA, 12 nt, Pseudomonas aeruginosa PA01
ggauccggacug

SEQ ID NO: 1545626 - RNA, 19 nt, Pseudomonas aeruginosa PA01
ggaucccguguaccacgcc

SEQ ID NO: 1545627 - RNA, 15 nt, Pseudomonas aeruginosa PA01
ggauccgugccaggc

SEQ ID NO: 1545628 - RNA, 18 nt, Pseudomonas aeruginosa PA01
ggauccgugccaggcgcu

SEQ ID NO: 1545629 - RNA, 17 nt, Pseudomonas aeruginosa PA01
ggaucgaacuggccagc

SEQ ID NO: 1545630 - RNA, 23 nt, Pseudomonas aeruginosa PA01
ggauccucgccucgcgccagaga

SEQ ID NO: 1545631 - RNA, 18 nt, Pseudomonas aeruginosa PA01
ggaucacgauggccggca

SEQ ID NO: 1545632 - RNA, 22 nt, Pseudomonas aeruginosa PA01
ggaucaccagggucggcaccug

SEQ ID NO: 1545633 - RNA, 15 nt, Pseudomonas aeruginosa PA01
ggaucacaucgcccg

SEQ ID NO: 1545634 - RNA, 17 nt, Pseudomonas aeruginosa PA01
ggauaucgcccagggcc

SEQ ID NO: 1545635 - RNA, 18 nt, Pseudomonas aeruginosa PA01
ggagggucaggccgaggg

SEQ ID NO: 1545636 - RNA, 17 nt, Pseudomonas aeruginosa PA01
ggagguuggucugcucg

SEQ ID NO: 1545637 - RNA, 13 nt, Pseudomonas aeruginosa PA01
ggaguaccaggcc

SEQ ID NO: 1545638 - RNA, 16 nt, Pseudomonas aeruginosa PA01
ggaguacuacccccuc

SEQ ID NO: 1545639 - RNA, 13 nt, Pseudomonas aeruginosa PA01
ggauaggcggcgg

SEQ ID NO: 1545640 - RNA, 14 nt, Pseudomonas aeruginosa PA01
ggauaggcggcgga

SEQ ID NO: 1545641 - RNA, 23 nt, Pseudomonas aeruginosa PA01
ggauagcaccgauuuccccaagg

SEQ ID NO: 1545642 - RNA, 16 nt, Pseudomonas aeruginosa PA01
ggauagcguccagcuc

SEQ ID NO: 1545643 - RNA, 22 nt, Pseudomonas aeruginosa PA01
ggagugcucgaucagguaggcg

SEQ ID NO: 1545644 - RNA, 17 nt, Pseudomonas aeruginosa PA01
ggaaacacagcacgagc

SEQ ID NO: 1545645 - RNA, 15 nt, Pseudomonas aeruginosa PA01
ggaaacaccaggccg

SEQ ID NO: 1545646 - RNA, 13 nt, Pseudomonas aeruginosa PA01
ggaaaagccccgc

SEQ ID NO: 1545647 - RNA, 18 nt, Pseudomonas aeruginosa PA01
ggaaagaccggcgccccu

SEQ ID NO: 1545648 - RNA, 22 nt, Pseudomonas aeruginosa PA01
ggaaacgcauccauucggugga

SEQ ID NO: 1545649 - RNA, 13 nt, Pseudomonas aeruginosa PA01
ggaaacgccgaga

SEQ ID NO: 1545650 - RNA, 20 nt, Pseudomonas aeruginosa PA01
ggaaaccucgccggucaggu

SEQ ID NO: 1545651 - RNA, 21 nt, Pseudomonas aeruginosa PA01
ggaaaccgggaugaagaucau

SEQ ID NO: 1545652 - RNA, 21 nt, Pseudomonas aeruginosa PA01
ggaaacccgugguccgccagc

SEQ ID NO: 1545653 - RNA, 22 nt, Pseudomonas aeruginosa PA01
ggaaacccgugguccgccagca

SEQ ID NO: 1545654 - RNA, 18 nt, Pseudomonas aeruginosa PA01
ggaaaucgagcgccagga

SEQ ID NO: 1545655 - RNA, 20 nt, Pseudomonas aeruginosa PA01
ggaaaucggccacuccagcc

SEQ ID NO: 1545656 - RNA, 18 nt, Pseudomonas aeruginosa PA01
ggaaucaccacucgccag

SEQ ID NO: 1545657 - RNA, 12 nt, Pseudomonas aeruginosa PA01
ggaaggccugga

SEQ ID NO: 1545658 - RNA, 13 nt, Pseudomonas aeruginosa PA01
ggaaggcgcuggg

SEQ ID NO: 1545659 - RNA, 23 nt, Pseudomonas aeruginosa PA01
ggaagggaaaaaagggagccagg

SEQ ID NO: 1545660 - RNA, 22 nt, Pseudomonas aeruginosa PA01
ggaagggacgucgccagggagg

SEQ ID NO: 1545661 - RNA, 14 nt, Pseudomonas aeruginosa PA01
ggaaggccgggccc

SEQ ID NO: 1545662 - RNA, 15 nt, Pseudomonas aeruginosa PA01
ggaagcuuccagcuu

SEQ ID NO: 1545663 - RNA, 19 nt, Pseudomonas aeruginosa PA01
ggaacgaaagaaggggagc

SEQ ID NO: 1545664 - RNA, 19 nt, Pseudomonas aeruginosa PA01
ggaacgaagaaccccggcc

SEQ ID NO: 1545665 - RNA, 14 nt, Pseudomonas aeruginosa PA01
ggaaccggccggca

SEQ ID NO: 1545666 - RNA, 13 nt, Pseudomonas aeruginosa PA01
ggaacgaggcgac

SEQ ID NO: 1545667 - RNA, 20 nt, Pseudomonas aeruginosa PA01
ggaaccuguccgaacagggc

SEQ ID NO: 1545668 - RNA, 19 nt, Pseudomonas aeruginosa PA01
ggaacgcggguugcccggc

SEQ ID NO: 1545669 - RNA, 15 nt, Pseudomonas aeruginosa PA01
ggaagaagccgauca

SEQ ID NO: 1545670 - RNA, 17 nt, Pseudomonas aeruginosa PA01
ggaagaauaccgccagc

SEQ ID NO: 1545671 - RNA, 12 nt, Pseudomonas aeruginosa PA01
ggaagaacaucg

SEQ ID NO: 1545672 - RNA, 19 nt, Pseudomonas aeruginosa PA01
ggaagaaucgcagccauga

SEQ ID NO: 1545673 - RNA, 20 nt, Pseudomonas aeruginosa PA01
gcuuugcgcagccacccgcu

SEQ ID NO: 1545674 - RNA, 21 nt, Pseudomonas aeruginosa PA01
gcuuugcgcagccacccgcuc

SEQ ID NO: 1545675 - RNA, 14 nt, Pseudomonas aeruginosa PA01
gcuuugcauggccu

SEQ ID NO: 1545676 - RNA, 21 nt, Pseudomonas aeruginosa PA01
gcuuugcccgucuagcgcagg

SEQ ID NO: 1545677 - RNA, 14 nt, Pseudomonas aeruginosa PA01
gcuuugcagggcga

SEQ ID NO: 1545678 - RNA, 22 nt, Pseudomonas aeruginosa PA01
gcuuucguaggcaggcgcggca

SEQ ID NO: 1545679 - RNA, 23 nt, Pseudomonas aeruginosa PA01
gcuuucguaggcaggcgcggcau

SEQ ID NO: 1545680 - RNA, 18 nt, Pseudomonas aeruginosa PA01
gcugugcugcaccagcag

SEQ ID NO: 1545681 - RNA, 20 nt, Pseudomonas aeruginosa PA01
gcugugcugcaccagcaggu

SEQ ID NO: 1545682 - RNA, 13 nt, Pseudomonas aeruginosa PA01
gcugugcagggca

SEQ ID NO: 1545683 - RNA, 23 nt, Pseudomonas aeruginosa PA01
gcugugcacccagaccuuccagc

SEQ ID NO: 1545684 - RNA, 19 nt, Pseudomonas aeruginosa PA01
gcugugcggcagcaggcug

SEQ ID NO: 1545685 - RNA, 21 nt, Pseudomonas aeruginosa PA01
ggaaaaacccggcccaggccg

SEQ ID NO: 1545686 - RNA, 9 nt, Pseudomonas aeruginosa PA01
ggaaaaaga

SEQ ID NO: 1545687 - RNA, 21 nt, Pseudomonas aeruginosa PA01
ggaaaacgcucaggccaagca

SEQ ID NO: 1545688 - RNA, 22 nt, Pseudomonas aeruginosa PA01
gcuuuucccuauucgcugucag

SEQ ID NO: 1545689 - RNA, 16 nt, Pseudomonas aeruginosa PA01
gcuacccagguggucg

SEQ ID NO: 1545690 - RNA, 23 nt, Pseudomonas aeruginosa PA01
gcuacccucaggggugcagcccu

SEQ ID NO: 1545691 - RNA, 15 nt, Pseudomonas aeruginosa PA01
gcuacccucucccca

SEQ ID NO: 1545692 - RNA, 13 nt, Pseudomonas aeruginosa PA01
gcuacccugcccc

SEQ ID NO: 1545693 - RNA, 22 nt, Pseudomonas aeruginosa PA01
gcuacgaaggcgugccgcuggc

SEQ ID NO: 1545694 - RNA, 13 nt, Pseudomonas aeruginosa PA01
gcuacgcggcggg

SEQ ID NO: 1545695 - RNA, 14 nt, Pseudomonas aeruginosa PA01
gcuacgcggcggga

SEQ ID NO: 1545696 - RNA, 13 nt, Pseudomonas aeruginosa PA01
gcuacgcaggccc

SEQ ID NO: 1545697 - RNA, 20 nt, Pseudomonas aeruginosa PA01
gcuacggaugcugucccaac

SEQ ID NO: 1545698 - RNA, 14 nt, Pseudomonas aeruginosa PA01
gcuacagcaauuac

SEQ ID NO: 1545699 - RNA, 15 nt, Pseudomonas aeruginosa PA01
gcuacagcaauuaca

SEQ ID NO: 1545700 - RNA, 22 nt, Pseudomonas aeruginosa PA01
gcuaccaggaagcucggcagca

SEQ ID NO: 1545701 - RNA, 13 nt, Pseudomonas aeruginosa PA01
gcuaccagcaauu

SEQ ID NO: 1545702 - RNA, 14 nt, Pseudomonas aeruginosa PA01
gcuaccagcaauuc

SEQ ID NO: 1545703 - RNA, 23 nt, Pseudomonas aeruginosa PA01
gcguugcgcgccucgccccagac

SEQ ID NO: 1545704 - RNA, 17 nt, Pseudomonas aeruginosa PA01
gcguuggaucaccgggg

SEQ ID NO: 1545705 - RNA, 13 nt, Pseudomonas aeruginosa PA01
gcguugcgggcag

SEQ ID NO: 1545706 - RNA, 21 nt, Pseudomonas aeruginosa PA01
gcguugucggcaaccgggcgg

SEQ ID NO: 1545707 - RNA, 18 nt, Pseudomonas aeruginosa PA01
gcguugucggccagcagc

SEQ ID NO: 1545708 - RNA, 21 nt, Pseudomonas aeruginosa PA01
gcguugucccugucccgccgc

SEQ ID NO: 1545709 - RNA, 16 nt, Pseudomonas aeruginosa PA01
gcguugcugaucacgu

SEQ ID NO: 1545710 - RNA, 13 nt, Pseudomonas aeruginosa PA01
gcguuggccugga

SEQ ID NO: 1545711 - RNA, 15 nt, Pseudomonas aeruginosa PA01
gcguucucccugagc

SEQ ID NO: 1545712 - RNA, 17 nt, Pseudomonas aeruginosa PA01
gcguucucccugagccu

SEQ ID NO: 1545713 - RNA, 13 nt, Pseudomonas aeruginosa PA01
gcguucucugucg

SEQ ID NO: 1545714 - RNA, 22 nt, Pseudomonas aeruginosa PA01
gcguucuucacccgcagcggca

SEQ ID NO: 1545715 - RNA, 19 nt, Pseudomonas aeruginosa PA01
gcguuugcgucauccgccu

SEQ ID NO: 1545716 - RNA, 18 nt, Pseudomonas aeruginosa PA01
gcguugugccgccaccuc

SEQ ID NO: 1545717 - RNA, 15 nt, Pseudomonas aeruginosa PA01
gcguggugcauccgc

SEQ ID NO: 1545718 - RNA, 13 nt, Pseudomonas aeruginosa PA01
gcguguucccugu

SEQ ID NO: 1545719 - RNA, 17 nt, Pseudomonas aeruginosa PA01
gcguguucgcggcucug

SEQ ID NO: 1545720 - RNA, 18 nt, Pseudomonas aeruginosa PA01
gcguguucggcggcucug

SEQ ID NO: 1545721 - RNA, 14 nt, Pseudomonas aeruginosa PA01
gcguggcgaugccc

SEQ ID NO: 1545722 - RNA, 12 nt, Pseudomonas aeruginosa PA01
gcguggcggccg

SEQ ID NO: 1545723 - RNA, 16 nt, Pseudomonas aeruginosa PA01
gcguggcuuggcccug

SEQ ID NO: 1545724 - RNA, 23 nt, Pseudomonas aeruginosa PA01
gcguggcuuggcccugcgcgcgc

SEQ ID NO: 1545725 - RNA, 20 nt, Pseudomonas aeruginosa PA01
gcguggguccacgccgggca

SEQ ID NO: 1545726 - RNA, 14 nt, Pseudomonas aeruginosa PA01
gcgugggcugacau

SEQ ID NO: 1545727 - RNA, 13 nt, Pseudomonas aeruginosa PA01
gcgugggcggccg

SEQ ID NO: 1545728 - RNA, 17 nt, Pseudomonas aeruginosa PA01
gcguggucggcggccuc

SEQ ID NO: 1545729 - RNA, 20 nt, Pseudomonas aeruginosa PA01
gcguucaccguggcgcuggc

SEQ ID NO: 1545730 - RNA, 20 nt, Pseudomonas aeruginosa PA01
gcguucagccacggacgcgc

SEQ ID NO: 1545731 - RNA, 14 nt, Pseudomonas aeruginosa PA01
gcguuccaacuggc

SEQ ID NO: 1545732 - RNA, 23 nt, Pseudomonas aeruginosa PA01
gcguuccacgaaaaagcccggca

SEQ ID NO: 1545733 - RNA, 19 nt, Pseudomonas aeruginosa PA01
gcguucggaucggcccggc

SEQ ID NO: 1545734 - RNA, 19 nt, Pseudomonas aeruginosa PA01
gcguucgccuugcggggcg

SEQ ID NO: 1545735 - RNA, 15 nt, Pseudomonas aeruginosa PA01
gcguucgccgagggc

SEQ ID NO: 1545736 - RNA, 16 nt, Pseudomonas aeruginosa PA01
gcguucgcgggcgccg

SEQ ID NO: 1545737 - RNA, 23 nt, Pseudomonas aeruginosa PA01
gcguucgaggguacuccuggcau

SEQ ID NO: 1545738 - RNA, 16 nt, Pseudomonas aeruginosa PA01
gcguucgaucuccucg

SEQ ID NO: 1545739 - RNA, 19 nt, Pseudomonas aeruginosa PA01
gcguuccuguucgcugccu

SEQ ID NO: 1545740 - RNA, 15 nt, Pseudomonas aeruginosa PA01
gcguuccagcaccuc

SEQ ID NO: 1545741 - RNA, 15 nt, Pseudomonas aeruginosa PA01
gcguuccagcuccgu

SEQ ID NO: 1545742 - RNA, 17 nt, Pseudomonas aeruginosa PA01
gcguuccaggcggcgga

SEQ ID NO: 1545743 - RNA, 12 nt, Pseudomonas aeruginosa PA01
gcguuccagggc

SEQ ID NO: 1545744 - RNA, 19 nt, Pseudomonas aeruginosa PA01
gcguuccaggucgcugcug

SEQ ID NO: 1545745 - RNA, 12 nt, Pseudomonas aeruginosa PA01
gcguuccaggug

SEQ ID NO: 1545746 - RNA, 18 nt, Pseudomonas aeruginosa PA01
gcucagccgaggucgccg

SEQ ID NO: 1545747 - RNA, 20 nt, Pseudomonas aeruginosa PA01
gcucagcccaggcgccgcuc

SEQ ID NO: 1545748 - RNA, 19 nt, Pseudomonas aeruginosa PA01
gcucagcacccuggccacg

SEQ ID NO: 1545749 - RNA, 22 nt, Pseudomonas aeruginosa PA01
gcucagcaccuugugcugccug

SEQ ID NO: 1545750 - RNA, 17 nt, Pseudomonas aeruginosa PA01
gcucacucccguccagc

SEQ ID NO: 1545751 - RNA, 20 nt, Pseudomonas aeruginosa PA01
gcucagaagucccagcgagu

SEQ ID NO: 1545752 - RNA, 19 nt, Pseudomonas aeruginosa PA01
gcucaggacguccuggccg

SEQ ID NO: 1545753 - RNA, 23 nt, Pseudomonas aeruginosa PA01
gcucaggacguccuggccgagcc

SEQ ID NO: 1545754 - RNA, 19 nt, Pseudomonas aeruginosa PA01
gcucagcuggauagaguac

SEQ ID NO: 1545755 - RNA, 16 nt, Pseudomonas aeruginosa PA01
gcucagcuggauagag

SEQ ID NO: 1545756 - RNA, 17 nt, Pseudomonas aeruginosa PA01
gcucaggcgcagcgucc

SEQ ID NO: 1545757 - RNA, 16 nt, Pseudomonas aeruginosa PA01
gcucaggccuuggcuu

SEQ ID NO: 1545758 - RNA, 18 nt, Pseudomonas aeruginosa PA01
gcucaggcgaaccuggag

SEQ ID NO: 1545759 - RNA, 16 nt, Pseudomonas aeruginosa PA01
gcucaggccgccgcgu

SEQ ID NO: 1545760 - RNA, 15 nt, Pseudomonas aeruginosa PA01
gcucagcuccaggcc

SEQ ID NO: 1545761 - RNA, 18 nt, Pseudomonas aeruginosa PA01
gcucagcucucccgaggc

SEQ ID NO: 1545762 - RNA, 20 nt, Pseudomonas aeruginosa PA01
gcucagcucucccgaggcga

SEQ ID NO: 1545763 - RNA, 17 nt, Pseudomonas aeruginosa PA01
gcucagcguccucagcc

SEQ ID NO: 1545764 - RNA, 23 nt, Pseudomonas aeruginosa PA01
gcucagcgggccgauccgcgaau

SEQ ID NO: 1545765 - RNA, 13 nt, Pseudomonas aeruginosa PA01
gcucagcgcgcgu

SEQ ID NO: 1545766 - RNA, 17 nt, Pseudomonas aeruginosa PA01
gcucagcgcgcucggcc

SEQ ID NO: 1545767 - RNA, 21 nt, Pseudomonas aeruginosa PA01
gcucagcgccgcuucuucccg

SEQ ID NO: 1545768 - RNA, 14 nt, Pseudomonas aeruginosa PA01
gcucagcgccggcc

SEQ ID NO: 1545769 - RNA, 21 nt, Pseudomonas aeruginosa PA01
gcucagcggaacauuuccuug

SEQ ID NO: 1545770 - RNA, 17 nt, Pseudomonas aeruginosa PA01
gcucagcggcccagcgc

SEQ ID NO: 1545771 - RNA, 20 nt, Pseudomonas aeruginosa PA01
gcucagcggcccagcgcccc

SEQ ID NO: 1545772 - RNA, 23 nt, Pseudomonas aeruginosa PA01
gcucacauuaauugcgagcgagc

SEQ ID NO: 1545773 - RNA, 13 nt, Pseudomonas aeruginosa PA01
gcucaccaaugcc

SEQ ID NO: 1545774 - RNA, 19 nt, Pseudomonas aeruginosa PA01
gcucaccaaugccagugcc

SEQ ID NO: 1545775 - RNA, 19 nt, Pseudomonas aeruginosa PA01
gcucaccggucgagaggga

SEQ ID NO: 1545776 - RNA, 17 nt, Pseudomonas aeruginosa PA01
gcucacguagcccccgc

SEQ ID NO: 1545777 - RNA, 23 nt, Pseudomonas aeruginosa PA01
gcucacgugaccguccagcgcgc

SEQ ID NO: 1545778 - RNA, 17 nt, Pseudomonas aeruginosa PA01
gcucaccgguagagggg

SEQ ID NO: 1545779 - RNA, 20 nt, Pseudomonas aeruginosa PA01
gcucaccgccaccccgccgg

SEQ ID NO: 1545780 - RNA, 18 nt, Pseudomonas aeruginosa PA01
gcuccacugcuuggccag

SEQ ID NO: 1545781 - RNA, 21 nt, Pseudomonas aeruginosa PA01
gcuccaccucggaccagaggc

SEQ ID NO: 1545782 - RNA, 22 nt, Pseudomonas aeruginosa PA01
gcuccaccucggaccagaggcu

SEQ ID NO: 1545783 - RNA, 21 nt, Pseudomonas aeruginosa PA01
gcuccagaccuccagguaggc

SEQ ID NO: 1545784 - RNA, 16 nt, Pseudomonas aeruginosa PA01
gcuccagggagcgcuc

SEQ ID NO: 1545785 - RNA, 23 nt, Pseudomonas aeruginosa PA01
gcuccagggagcgcucgcgcagc

SEQ ID NO: 1545786 - RNA, 16 nt, Pseudomonas aeruginosa PA01
gcuccaggaccggcag

SEQ ID NO: 1545787 - RNA, 20 nt, Pseudomonas aeruginosa PA01
gcuccagcuccuccagcagg

SEQ ID NO: 1545788 - RNA, 17 nt, Pseudomonas aeruginosa PA01
gcuccagaugcuggagc

SEQ ID NO: 1545789 - RNA, 13 nt, Pseudomonas aeruginosa PA01
gcucccagccgac

SEQ ID NO: 1545790 - RNA, 16 nt, Pseudomonas aeruginosa PA01
gcuccagucggggcag

SEQ ID NO: 1545791 - RNA, 21 nt, Pseudomonas aeruginosa PA01
gcuccagucggggcaggcgca

SEQ ID NO: 1545792 - RNA, 22 nt, Pseudomonas aeruginosa PA01
gcuccaggugcacggccaggcc

SEQ ID NO: 1545793 - RNA, 17 nt, Pseudomonas aeruginosa PA01
gcuccaggggagccccg

SEQ ID NO: 1545794 - RNA, 13 nt, Pseudomonas aeruginosa PA01
gcuccagggcggc

SEQ ID NO: 1545795 - RNA, 12 nt, Pseudomonas aeruginosa PA01
gcuccccgccgc

SEQ ID NO: 1545796 - RNA, 16 nt, Pseudomonas aeruginosa PA01
gcuccccugccgaacc

SEQ ID NO: 1545797 - RNA, 21 nt, Pseudomonas aeruginosa PA01
gcuccccugccgaaccgccuc

SEQ ID NO: 1545798 - RNA, 14 nt, Pseudomonas aeruginosa PA01
gcuccacccgcagc

SEQ ID NO: 1545799 - RNA, 17 nt, Pseudomonas aeruginosa PA01
gcuccacccgcagccgc

SEQ ID NO: 1545800 - RNA, 16 nt, Pseudomonas aeruginosa PA01
gcucauggagcaacag

SEQ ID NO: 1545801 - RNA, 17 nt, Pseudomonas aeruginosa PA01
gcucauggagcaacagc

SEQ ID NO: 1545802 - RNA, 19 nt, Pseudomonas aeruginosa PA01
gcucauguugcgggcuucg

SEQ ID NO: 1545803 - RNA, 14 nt, Pseudomonas aeruginosa PA01
gcucaugucgugga

SEQ ID NO: 1545804 - RNA, 13 nt, Pseudomonas aeruginosa PA01
gcucauggccggg

SEQ ID NO: 1545805 - RNA, 14 nt, Pseudomonas aeruginosa PA01
gcucauggccgggg

SEQ ID NO: 1545806 - RNA, 16 nt, Pseudomonas aeruginosa PA01
gcucauggcgccgcca

SEQ ID NO: 1545807 - RNA, 16 nt, Pseudomonas aeruginosa PA01
gcucaggcugugcagg

SEQ ID NO: 1545808 - RNA, 23 nt, Pseudomonas aeruginosa PA01
gcucagggaauggaugcgcggca

SEQ ID NO: 1545809 - RNA, 22 nt, Pseudomonas aeruginosa PA01
gcucaggguggcguuuucccag

SEQ ID NO: 1545810 - RNA, 13 nt, Pseudomonas aeruginosa PA01
gcucaggcggccg

SEQ ID NO: 1545811 - RNA, 21 nt, Pseudomonas aeruginosa PA01
gcucaggcgucccgcuccagc

SEQ ID NO: 1545812 - RNA, 22 nt, Pseudomonas aeruginosa PA01
gcucaggcgucccgcuccagcc

SEQ ID NO: 1545813 - RNA, 19 nt, Pseudomonas aeruginosa PA01
gcucaguucggccagcggc

SEQ ID NO: 1545814 - RNA, 15 nt, Pseudomonas aeruginosa PA01
gcucaguugcaccug

SEQ ID NO: 1545815 - RNA, 18 nt, Pseudomonas aeruginosa PA01
gcucagucgguagagcag

SEQ ID NO: 1545816 - RNA, 19 nt, Pseudomonas aeruginosa PA01
gcucagucgguagagcagu

SEQ ID NO: 1545817 - RNA, 15 nt, Pseudomonas aeruginosa PA01
gcuaugcgccgggcc

SEQ ID NO: 1545818 - RNA, 21 nt, Pseudomonas aeruginosa PA01
gcuaugcaaaagugcccccgg

SEQ ID NO: 1545819 - RNA, 14 nt, Pseudomonas aeruginosa PA01
gcuauucccgccgc

SEQ ID NO: 1545820 - RNA, 20 nt, Pseudomonas aeruginosa PA01
gcucaaaccuguucggcagg

SEQ ID NO: 1545821 - RNA, 22 nt, Pseudomonas aeruginosa PA01
gcucaaaccuguucggcagggg

SEQ ID NO: 1545822 - RNA, 19 nt, Pseudomonas aeruginosa PA01
gcucaaccgaacaggcgac

SEQ ID NO: 1545823 - RNA, 14 nt, Pseudomonas aeruginosa PA01
gcucaagggcuggc

SEQ ID NO: 1545824 - RNA, 18 nt, Pseudomonas aeruginosa PA01
gcucaacgccucgcggcu

SEQ ID NO: 1545825 - RNA, 23 nt, Pseudomonas aeruginosa PA01
gcucaacugguuggccgccuggc

SEQ ID NO: 1545826 - RNA, 13 nt, Pseudomonas aeruginosa PA01
gcucaagacggcc

SEQ ID NO: 1545827 - RNA, 19 nt, Pseudomonas aeruginosa PA01
gcuagucgcgcagcgccuc

SEQ ID NO: 1545828 - RNA, 24 nt, Pseudomonas aeruginosa PA01
gcuagucuuccugcacgcugcgcc

SEQ ID NO: 1545829 - RNA, 16 nt, Pseudomonas aeruginosa PA01
gcuaguuauugaagug

SEQ ID NO: 1545830 - RNA, 15 nt, Pseudomonas aeruginosa PA01
gcuauccuccaggcc

SEQ ID NO: 1545831 - RNA, 13 nt, Pseudomonas aeruginosa PA01
gcuaucgccgccg

SEQ ID NO: 1545832 - RNA, 24 nt, Pseudomonas aeruginosa PA01
gcuaucgccgccgcagccguggcg

SEQ ID NO: 1545833 - RNA, 18 nt, Pseudomonas aeruginosa PA01
gcuaucggcccggggcuc

SEQ ID NO: 1545834 - RNA, 12 nt, Pseudomonas aeruginosa PA01
gcuaucagguga

SEQ ID NO: 1545835 - RNA, 21 nt, Pseudomonas aeruginosa PA01
gcucggacaagggccagagca

SEQ ID NO: 1545836 - RNA, 15 nt, Pseudomonas aeruginosa PA01
gcucggacagcuucu

SEQ ID NO: 1545837 - RNA, 16 nt, Pseudomonas aeruginosa PA01
gcucggacagcuucug

SEQ ID NO: 1545838 - RNA, 17 nt, Pseudomonas aeruginosa PA01
gcucgcgggucaccagc

SEQ ID NO: 1545839 - RNA, 20 nt, Pseudomonas aeruginosa PA01
gcucggccaucagcgccagg

SEQ ID NO: 1545840 - RNA, 13 nt, Pseudomonas aeruginosa PA01
gcucggccacauu

SEQ ID NO: 1545841 - RNA, 15 nt, Pseudomonas aeruginosa PA01
gcucggccagcgucc

SEQ ID NO: 1545842 - RNA, 13 nt, Pseudomonas aeruginosa PA01
gcucggccaggca

SEQ ID NO: 1545843 - RNA, 15 nt, Pseudomonas aeruginosa PA01
gcucggccaggcaca

SEQ ID NO: 1545844 - RNA, 13 nt, Pseudomonas aeruginosa PA01
gcucggcgcccug

SEQ ID NO: 1545845 - RNA, 19 nt, Pseudomonas aeruginosa PA01
gcucggcgcccuggguggu

SEQ ID NO: 1545846 - RNA, 15 nt, Pseudomonas aeruginosa PA01
gcucggcgauggcgc

SEQ ID NO: 1545847 - RNA, 17 nt, Pseudomonas aeruginosa PA01
gcucggcgauggcgcgc

SEQ ID NO: 1545848 - RNA, 14 nt, Pseudomonas aeruginosa PA01
gcucggcgagccgc

SEQ ID NO: 1545849 - RNA, 12 nt, Pseudomonas aeruginosa PA01
gcucggccuggu

SEQ ID NO: 1545850 - RNA, 15 nt, Pseudomonas aeruginosa PA01
gcucggccuggugca

SEQ ID NO: 1545851 - RNA, 22 nt, Pseudomonas aeruginosa PA01
gcucggccuguaccgcuuccug

SEQ ID NO: 1545852 - RNA, 12 nt, Pseudomonas aeruginosa PA01
gcucggccuuga

SEQ ID NO: 1545853 - RNA, 17 nt, Pseudomonas aeruginosa PA01
gcucggccuugagcgcc

SEQ ID NO: 1545854 - RNA, 19 nt, Pseudomonas aeruginosa PA01
gcucgcgaugcugugcagg

SEQ ID NO: 1545855 - RNA, 13 nt, Pseudomonas aeruginosa PA01
gcucccgcggccc

SEQ ID NO: 1545856 - RNA, 16 nt, Pseudomonas aeruginosa PA01
gcucgcgcagcgacuc

SEQ ID NO: 1545857 - RNA, 15 nt, Pseudomonas aeruginosa PA01
gcucgcgcagcggcg

SEQ ID NO: 1545858 - RNA, 15 nt, Pseudomonas aeruginosa PA01
gcucgcgccagcccc

SEQ ID NO: 1545859 - RNA, 13 nt, Pseudomonas aeruginosa PA01
gcucgcgcugcaa

SEQ ID NO: 1545860 - RNA, 13 nt, Pseudomonas aeruginosa PA01
gcucgcggcuggc

SEQ ID NO: 1545861 - RNA, 14 nt, Pseudomonas aeruginosa PA01
gcucgcggcuggcc

SEQ ID NO: 1545862 - RNA, 19 nt, Pseudomonas aeruginosa PA01
gcucgcggcuggccgccuc

SEQ ID NO: 1545863 - RNA, 16 nt, Pseudomonas aeruginosa PA01
gcucgcggcaucccgc

SEQ ID NO: 1545864 - RNA, 14 nt, Pseudomonas aeruginosa PA01
gcucguccaguucc

SEQ ID NO: 1545865 - RNA, 13 nt, Pseudomonas aeruginosa PA01
gcucguccaggcc

SEQ ID NO: 1545866 - RNA, 16 nt, Pseudomonas aeruginosa PA01
gcucguuggcggccag

SEQ ID NO: 1545867 - RNA, 14 nt, Pseudomonas aeruginosa PA01
gcucguucguucug

SEQ ID NO: 1545868 - RNA, 14 nt, Pseudomonas aeruginosa PA01
gcucguugcacagc

SEQ ID NO: 1545869 - RNA, 17 nt, Pseudomonas aeruginosa PA01
gcucguugcacagcgcc

SEQ ID NO: 1545870 - RNA, 22 nt, Pseudomonas aeruginosa PA01
gcucguugcgccgcuccuggca

SEQ ID NO: 1545871 - RNA, 18 nt, Pseudomonas aeruginosa PA01
gcucggcuugacuggcag

SEQ ID NO: 1545872 - RNA, 12 nt, Pseudomonas aeruginosa PA01
gcucggcuucca

SEQ ID NO: 1545873 - RNA, 16 nt, Pseudomonas aeruginosa PA01
gcucggcuuccaucac

SEQ ID NO: 1545874 - RNA, 18 nt, Pseudomonas aeruginosa PA01
gcucggcggcaggcugcg

SEQ ID NO: 1545875 - RNA, 18 nt, Pseudomonas aeruginosa PA01
gcucggcgggacggcgca

SEQ ID NO: 1545876 - RNA, 13 nt, Pseudomonas aeruginosa PA01
gcucggcgggcug

SEQ ID NO: 1545877 - RNA, 14 nt, Pseudomonas aeruginosa PA01
gcucggcggcgcgc

SEQ ID NO: 1545878 - RNA, 15 nt, Pseudomonas aeruginosa PA01
gcucgguuccagcuc

SEQ ID NO: 1545879 - RNA, 18 nt, Pseudomonas aeruginosa PA01
gcucugcuggccacccuu

SEQ ID NO: 1545880 - RNA, 14 nt, Pseudomonas aeruginosa PA01
gcucugcuggccgc

SEQ ID NO: 1545881 - RNA, 22 nt, Pseudomonas aeruginosa PA01
gcucugcuggccgcccuugcgg

SEQ ID NO: 1545882 - RNA, 14 nt, Pseudomonas aeruginosa PA01
gcucugcgccgcgg

SEQ ID NO: 1545883 - RNA, 14 nt, Pseudomonas aeruginosa PA01
gcucugcuccagca

SEQ ID NO: 1545884 - RNA, 19 nt, Pseudomonas aeruginosa PA01
gcucugcugaauucccgcu

SEQ ID NO: 1545885 - RNA, 19 nt, Pseudomonas aeruginosa PA01
gcucugccagaaggccugc

SEQ ID NO: 1545886 - RNA, 20 nt, Pseudomonas aeruginosa PA01
gcucugcaccgucauggugc

SEQ ID NO: 1545887 - RNA, 20 nt, Pseudomonas aeruginosa PA01
gcucuccacuaccgccgagg

SEQ ID NO: 1545888 - RNA, 21 nt, Pseudomonas aeruginosa PA01
gcucuccccgcucccgcggcc

SEQ ID NO: 1545889 - RNA, 18 nt, Pseudomonas aeruginosa PA01
gcucuuggucgcggucug

SEQ ID NO: 1545890 - RNA, 19 nt, Pseudomonas aeruginosa PA01
gcucuuggucgcggucugg

SEQ ID NO: 1545891 - RNA, 20 nt, Pseudomonas aeruginosa PA01
gcucuugaucgucucggugc

SEQ ID NO: 1545892 - RNA, 23 nt, Pseudomonas aeruginosa PA01
gcucuugccgacaagccuccagc

SEQ ID NO: 1545893 - RNA, 22 nt, Pseudomonas aeruginosa PA01
gcucuugccgcgagcuuggccc

SEQ ID NO: 1545894 - RNA, 12 nt, Pseudomonas aeruginosa PA01
gcucuuccuugu

SEQ ID NO: 1545895 - RNA, 21 nt, Pseudomonas aeruginosa PA01
gcucuucggcggccagcggau

SEQ ID NO: 1545896 - RNA, 19 nt, Pseudomonas aeruginosa PA01
gcucuguagggucgcagca

SEQ ID NO: 1545897 - RNA, 18 nt, Pseudomonas aeruginosa PA01
gcucugucuccugugccu

SEQ ID NO: 1545898 - RNA, 20 nt, Pseudomonas aeruginosa PA01
gcucuguuccucggcggcgg

SEQ ID NO: 1545899 - RNA, 21 nt, Pseudomonas aeruginosa PA01
gcucuguuccucggcggcggu

SEQ ID NO: 1545900 - RNA, 14 nt, Pseudomonas aeruginosa PA01
gcucuggaagaagu

SEQ ID NO: 1545901 - RNA, 17 nt, Pseudomonas aeruginosa PA01
gcucugcuucugucccu

SEQ ID NO: 1545902 - RNA, 11 nt, Pseudomonas aeruginosa PA01
gcucuggcugc

SEQ ID NO: 1545903 - RNA, 13 nt, Pseudomonas aeruginosa PA01
gcucuggccgcgc

SEQ ID NO: 1545904 - RNA, 12 nt, Pseudomonas aeruginosa PA01
gcugagcggcug

SEQ ID NO: 1545905 - RNA, 15 nt, Pseudomonas aeruginosa PA01
gcugagcggcuggug

SEQ ID NO: 1545906 - RNA, 19 nt, Pseudomonas aeruginosa PA01
gcugagcgccaggcgcaag

SEQ ID NO: 1545907 - RNA, 15 nt, Pseudomonas aeruginosa PA01
gcugaggaagagcag

SEQ ID NO: 1545908 - RNA, 23 nt, Pseudomonas aeruginosa PA01
gcugaggccgcccuggccgagcg

SEQ ID NO: 1545909 - RNA, 17 nt, Pseudomonas aeruginosa PA01
gcugaggcucagcgcgc

SEQ ID NO: 1545910 - RNA, 20 nt, Pseudomonas aeruginosa PA01
gcucuuucauugcgcacggu

SEQ ID NO: 1545911 - RNA, 19 nt, Pseudomonas aeruginosa PA01
gcucuuugcgacugacgcu

SEQ ID NO: 1545912 - RNA, 18 nt, Pseudomonas aeruginosa PA01
gcugaaaaacgccugggc

SEQ ID NO: 1545913 - RNA, 13 nt, Pseudomonas aeruginosa PA01
gcugacccaggcu

SEQ ID NO: 1545914 - RNA, 22 nt, Pseudomonas aeruginosa PA01
gcugacccaggcuucggcgcgc

SEQ ID NO: 1545915 - RNA, 20 nt, Pseudomonas aeruginosa PA01
gcugaccaggucguggaagg

SEQ ID NO: 1545916 - RNA, 19 nt, Pseudomonas aeruginosa PA01
gcugaccggcaucgaccag

SEQ ID NO: 1545917 - RNA, 19 nt, Pseudomonas aeruginosa PA01
gcugacggcguggcggaua

SEQ ID NO: 1545918 - RNA, 21 nt, Pseudomonas aeruginosa PA01
gcugacggcaaggaccugcug

SEQ ID NO: 1545919 - RNA, 19 nt, Pseudomonas aeruginosa PA01
gcugcaauucgucggccug

SEQ ID NO: 1545920 - RNA, 20 nt, Pseudomonas aeruginosa PA01
gcugcaauucgucggccugc

SEQ ID NO: 1545921 - RNA, 14 nt, Pseudomonas aeruginosa PA01
gcugaugcgcuggu

SEQ ID NO: 1545922 - RNA, 13 nt, Pseudomonas aeruginosa PA01
gcugaugcccggg

SEQ ID NO: 1545923 - RNA, 19 nt, Pseudomonas aeruginosa PA01
gcugauaagcucggcuuga

SEQ ID NO: 1545924 - RNA, 19 nt, Pseudomonas aeruginosa PA01
gcugaucuugccgcuggug

SEQ ID NO: 1545925 - RNA, 15 nt, Pseudomonas aeruginosa PA01
gcugcacggcgaccc

SEQ ID NO: 1545926 - RNA, 21 nt, Pseudomonas aeruginosa PA01
gcugcacggcgacccgcacgu

SEQ ID NO: 1545927 - RNA, 16 nt, Pseudomonas aeruginosa PA01
gcugcaccagcuucuu

SEQ ID NO: 1545928 - RNA, 14 nt, Pseudomonas aeruginosa PA01
gcugcaccagcagg

SEQ ID NO: 1545929 - RNA, 16 nt, Pseudomonas aeruginosa PA01
gcugcaucggcgcgcc

SEQ ID NO: 1545930 - RNA, 21 nt, Pseudomonas aeruginosa PA01
gcugcaugugccaggccuggg

SEQ ID NO: 1545931 - RNA, 21 nt, Pseudomonas aeruginosa PA01
gcugccccucacaccaccagc

SEQ ID NO: 1545932 - RNA, 17 nt, Pseudomonas aeruginosa PA01
gcugcccggagcggcug

SEQ ID NO: 1545933 - RNA, 18 nt, Pseudomonas aeruginosa PA01
gcugcccggagcggcugc

SEQ ID NO: 1545934 - RNA, 23 nt, Pseudomonas aeruginosa PA01
gcugcccgggguuggcgcugacc

SEQ ID NO: 1545935 - RNA, 16 nt, Pseudomonas aeruginosa PA01
gcugcccaagggccug

SEQ ID NO: 1545936 - RNA, 23 nt, Pseudomonas aeruginosa PA01
gcugcccaagggccugggcgccg

SEQ ID NO: 1545937 - RNA, 15 nt, Pseudomonas aeruginosa PA01
gcugccccacaggcc

SEQ ID NO: 1545938 - RNA, 15 nt, Pseudomonas aeruginosa PA01
gcugccauggcggcg

SEQ ID NO: 1545939 - RNA, 20 nt, Pseudomonas aeruginosa PA01
gcugcccaucgccuccacgg

SEQ ID NO: 1545940 - RNA, 18 nt, Pseudomonas aeruginosa PA01
gcugcccaguugcgcggc

SEQ ID NO: 1545941 - RNA, 12 nt, Pseudomonas aeruginosa PA01
gcugcccaggcu

SEQ ID NO: 1545942 - RNA, 19 nt, Pseudomonas aeruginosa PA01
gcugcccagggcccagagc

SEQ ID NO: 1545943 - RNA, 20 nt, Pseudomonas aeruginosa PA01
gcugcccagggcccagagca

SEQ ID NO: 1545944 - RNA, 14 nt, Pseudomonas aeruginosa PA01
gcugucguccuggg

SEQ ID NO: 1545945 - RNA, 22 nt, Pseudomonas aeruginosa PA01
gcugucuaucccgugccgggcc

SEQ ID NO: 1545946 - RNA, 19 nt, Pseudomonas aeruginosa PA01
gcugucucgccagcccggc

SEQ ID NO: 1545947 - RNA, 23 nt, Pseudomonas aeruginosa PA01
gcugucgcucagcgggccgaucc

SEQ ID NO: 1545948 - RNA, 18 nt, Pseudomonas aeruginosa PA01
gcugucggccagccccug

SEQ ID NO: 1545949 - RNA, 15 nt, Pseudomonas aeruginosa PA01
gcugucggccucgac

SEQ ID NO: 1545950 - RNA, 23 nt, Pseudomonas aeruginosa PA01
gcugucgucgaggguggcgccga

SEQ ID NO: 1545951 - RNA, 19 nt, Pseudomonas aeruginosa PA01
gcugucgucggcgcggccg

SEQ ID NO: 1545952 - RNA, 13 nt, Pseudomonas aeruginosa PA01
gcugucguccagc

SEQ ID NO: 1545953 - RNA, 14 nt, Pseudomonas aeruginosa PA01
gcuguacagcagga

SEQ ID NO: 1545954 - RNA, 19 nt, Pseudomonas aeruginosa PA01
gcugucgagggucugcucg

SEQ ID NO: 1545955 - RNA, 21 nt, Pseudomonas aeruginosa PA01
gcugucgacgcagccgggccg

SEQ ID NO: 1545956 - RNA, 14 nt, Pseudomonas aeruginosa PA01
gcugucgccgagca

SEQ ID NO: 1545957 - RNA, 18 nt, Pseudomonas aeruginosa PA01
gcugguagugcuggcgca

SEQ ID NO: 1545958 - RNA, 13 nt, Pseudomonas aeruginosa PA01
gcugguggcccug

SEQ ID NO: 1545959 - RNA, 12 nt, Pseudomonas aeruginosa PA01
gcugguggccgu

SEQ ID NO: 1545960 - RNA, 12 nt, Pseudomonas aeruginosa PA01
gcugguuggcga

SEQ ID NO: 1545961 - RNA, 15 nt, Pseudomonas aeruginosa PA01
gcugguugccagcag

SEQ ID NO: 1545962 - RNA, 17 nt, Pseudomonas aeruginosa PA01
gcugguugcccagggug

SEQ ID NO: 1545963 - RNA, 14 nt, Pseudomonas aeruginosa PA01
gcugguugaagccg

SEQ ID NO: 1545964 - RNA, 20 nt, Pseudomonas aeruginosa PA01
gcugguucugguccaccagc

SEQ ID NO: 1545965 - RNA, 22 nt, Pseudomonas aeruginosa PA01
gcugguucugguccaccagccc

SEQ ID NO: 1545966 - RNA, 23 nt, Pseudomonas aeruginosa PA01
gcugguucugguccaccagcccg

SEQ ID NO: 1545967 - RNA, 16 nt, Pseudomonas aeruginosa PA01
gcugggcagcgccgcc

SEQ ID NO: 1545968 - RNA, 12 nt, Pseudomonas aeruginosa PA01
gcugggcagcac

SEQ ID NO: 1545969 - RNA, 17 nt, Pseudomonas aeruginosa PA01
gcugggcagcacgcugg

SEQ ID NO: 1545970 - RNA, 15 nt, Pseudomonas aeruginosa PA01
gcugggacgccuugu

SEQ ID NO: 1545971 - RNA, 16 nt, Pseudomonas aeruginosa PA01
gcugggacggcggcug

SEQ ID NO: 1545972 - RNA, 19 nt, Pseudomonas aeruginosa PA01
gcuggcugguaacgggcga

SEQ ID NO: 1545973 - RNA, 22 nt, Pseudomonas aeruginosa PA01
gcuggcugacagcuugucggug

SEQ ID NO: 1545974 - RNA, 15 nt, Pseudomonas aeruginosa PA01
gcuggcuaucuuuua

SEQ ID NO: 1545975 - RNA, 21 nt, Pseudomonas aeruginosa PA01
gcuggcuaucuuuuaaccaga

SEQ ID NO: 1545976 - RNA, 21 nt, Pseudomonas aeruginosa PA01
gcuggcguucuccagguagau

SEQ ID NO: 1545977 - RNA, 21 nt, Pseudomonas aeruginosa PA01
gcuggcguugacugccugcag

SEQ ID NO: 1545978 - RNA, 18 nt, Pseudomonas aeruginosa PA01
gcuggcggggucgcgccg

SEQ ID NO: 1545979 - RNA, 21 nt, Pseudomonas aeruginosa PA01
gcuggcggggucgcgccggug

SEQ ID NO: 1545980 - RNA, 23 nt, Pseudomonas aeruginosa PA01
gcuggcguacuugggcaucagcu

SEQ ID NO: 1545981 - RNA, 21 nt, Pseudomonas aeruginosa PA01
gcuggcguagaagucguccuc

SEQ ID NO: 1545982 - RNA, 20 nt, Pseudomonas aeruginosa PA01
gcuggcgucgaccgccugcc

SEQ ID NO: 1545983 - RNA, 16 nt, Pseudomonas aeruginosa PA01
gcugggugcggugggc

SEQ ID NO: 1545984 - RNA, 16 nt, Pseudomonas aeruginosa PA01
gcuggguggaggccca

SEQ ID NO: 1545985 - RNA, 13 nt, Pseudomonas aeruginosa PA01
gcuggguuuccug

SEQ ID NO: 1545986 - RNA, 23 nt, Pseudomonas aeruginosa PA01
gcugguaacgggcgaacccgaau

SEQ ID NO: 1545987 - RNA, 14 nt, Pseudomonas aeruginosa PA01
gcugguagcccagg

SEQ ID NO: 1545988 - RNA, 17 nt, Pseudomonas aeruginosa PA01
gcugguaauccagggag

SEQ ID NO: 1545989 - RNA, 13 nt, Pseudomonas aeruginosa PA01
gcugggcggcugg

SEQ ID NO: 1545990 - RNA, 14 nt, Pseudomonas aeruginosa PA01
gcugggcggcuggc

SEQ ID NO: 1545991 - RNA, 17 nt, Pseudomonas aeruginosa PA01
gcugggcgcccuucagc

SEQ ID NO: 1545992 - RNA, 15 nt, Pseudomonas aeruginosa PA01
gcugggcgccggcag

SEQ ID NO: 1545993 - RNA, 13 nt, Pseudomonas aeruginosa PA01
gcugggcgcagcc

SEQ ID NO: 1545994 - RNA, 16 nt, Pseudomonas aeruginosa PA01
gcugggccgaaccggg

SEQ ID NO: 1545995 - RNA, 17 nt, Pseudomonas aeruginosa PA01
gcugggccuugagcagg

SEQ ID NO: 1545996 - RNA, 19 nt, Pseudomonas aeruginosa PA01
gcugggccuuguucagggu

SEQ ID NO: 1545997 - RNA, 20 nt, Pseudomonas aeruginosa PA01
gcugggguugcggcgcccgc

SEQ ID NO: 1545998 - RNA, 17 nt, Pseudomonas aeruginosa PA01
gcugggucggcuggcag

SEQ ID NO: 1545999 - RNA, 19 nt, Pseudomonas aeruginosa PA01
gcugggucaucgaggccau

SEQ ID NO: 1546000 - RNA, 23 nt, Pseudomonas aeruginosa PA01
gcugggucaucgaggccaucccc

SEQ ID NO: 1546001 - RNA, 16 nt, Pseudomonas aeruginosa PA01
gcugggcugggucggc

SEQ ID NO: 1546002 - RNA, 17 nt, Pseudomonas aeruginosa PA01
gcuggggaccgcaccug

SEQ ID NO: 1546003 - RNA, 14 nt, Pseudomonas aeruginosa PA01
gcugcgggcgccgc

SEQ ID NO: 1546004 - RNA, 17 nt, Pseudomonas aeruginosa PA01
gcugcgggcgccgccgc

SEQ ID NO: 1546005 - RNA, 14 nt, Pseudomonas aeruginosa PA01
gcugcggggccugc

SEQ ID NO: 1546006 - RNA, 21 nt, Pseudomonas aeruginosa PA01
gcugcguaguugagccccagg

SEQ ID NO: 1546007 - RNA, 17 nt, Pseudomonas aeruginosa PA01
gcugcguagggcgagua

SEQ ID NO: 1546008 - RNA, 16 nt, Pseudomonas aeruginosa PA01
gcugcucgccucgggc

SEQ ID NO: 1546009 - RNA, 14 nt, Pseudomonas aeruginosa PA01
gcugcucgauggcc

SEQ ID NO: 1546010 - RNA, 19 nt, Pseudomonas aeruginosa PA01
gcugcucgauggcggccug

SEQ ID NO: 1546011 - RNA, 21 nt, Pseudomonas aeruginosa PA01
gcugcucgauggcggccuggu

SEQ ID NO: 1546012 - RNA, 22 nt, Pseudomonas aeruginosa PA01
gcugcucgauggcggccuggua

SEQ ID NO: 1546013 - RNA, 16 nt, Pseudomonas aeruginosa PA01
gcugcucgccaugggc

SEQ ID NO: 1546014 - RNA, 19 nt, Pseudomonas aeruginosa PA01
gcugcgucguuggccggcu

SEQ ID NO: 1546015 - RNA, 21 nt, Pseudomonas aeruginosa PA01
gcugcgucgucgcggcgccug

SEQ ID NO: 1546016 - RNA, 21 nt, Pseudomonas aeruginosa PA01
gcugcggcgguuggagcgagc

SEQ ID NO: 1546017 - RNA, 13 nt, Pseudomonas aeruginosa PA01
gcugcggccggcg

SEQ ID NO: 1546018 - RNA, 15 nt, Pseudomonas aeruginosa PA01
gcugcggccggcgcg

SEQ ID NO: 1546019 - RNA, 14 nt, Pseudomonas aeruginosa PA01
gcugcggccgagca

SEQ ID NO: 1546020 - RNA, 14 nt, Pseudomonas aeruginosa PA01
gcugcggcggaagg

SEQ ID NO: 1546021 - RNA, 17 nt, Pseudomonas aeruginosa PA01
gcugcggcggcaccacg

SEQ ID NO: 1546022 - RNA, 20 nt, Pseudomonas aeruginosa PA01
gcugccgaacagacgggaca

SEQ ID NO: 1546023 - RNA, 14 nt, Pseudomonas aeruginosa PA01
gcugccgaacagca

SEQ ID NO: 1546024 - RNA, 15 nt, Pseudomonas aeruginosa PA01
gcugccgaacagcag

SEQ ID NO: 1546025 - RNA, 18 nt, Pseudomonas aeruginosa PA01
gcugccgaacagcaggga

SEQ ID NO: 1546026 - RNA, 18 nt, Pseudomonas aeruginosa PA01
gcugcccuggcgcgcgcc

SEQ ID NO: 1546027 - RNA, 19 nt, Pseudomonas aeruginosa PA01
gcugcccuggcgcgcgccc

SEQ ID NO: 1546028 - RNA, 15 nt, Pseudomonas aeruginosa PA01
gcugcggcagggugg

SEQ ID NO: 1546029 - RNA, 14 nt, Pseudomonas aeruginosa PA01
gcuggaccaggcgg

SEQ ID NO: 1546030 - RNA, 20 nt, Pseudomonas aeruginosa PA01
gcuggaccaguucagcgcgc

SEQ ID NO: 1546031 - RNA, 22 nt, Pseudomonas aeruginosa PA01
gcuggaccaguucagcgcgcuc

SEQ ID NO: 1546032 - RNA, 17 nt, Pseudomonas aeruginosa PA01
gcuggaccauggccggc

SEQ ID NO: 1546033 - RNA, 17 nt, Pseudomonas aeruginosa PA01
gcugcuuucgcgucugg

SEQ ID NO: 1546034 - RNA, 12 nt, Pseudomonas aeruginosa PA01
gcugcuuggcca

SEQ ID NO: 1546035 - RNA, 14 nt, Pseudomonas aeruginosa PA01
gcugcuugaacacc

SEQ ID NO: 1546036 - RNA, 13 nt, Pseudomonas aeruginosa PA01
gcugcuugcgccg

SEQ ID NO: 1546037 - RNA, 12 nt, Pseudomonas aeruginosa PA01
gcuggagcagca

SEQ ID NO: 1546038 - RNA, 14 nt, Pseudomonas aeruginosa PA01
gcuggagcagcagc

SEQ ID NO: 1546039 - RNA, 21 nt, Pseudomonas aeruginosa PA01
gcuggagcagcagcgccgcga

SEQ ID NO: 1546040 - RNA, 17 nt, Pseudomonas aeruginosa PA01
gcuggagcugcgcgcga

SEQ ID NO: 1546041 - RNA, 12 nt, Pseudomonas aeruginosa PA01
gcuggacuuccc

SEQ ID NO: 1546042 - RNA, 17 nt, Pseudomonas aeruginosa PA01
gcuggacuucccggcgu

SEQ ID NO: 1546043 - RNA, 16 nt, Pseudomonas aeruginosa PA01
gcuggaccuggccggc

SEQ ID NO: 1546044 - RNA, 18 nt, Pseudomonas aeruginosa PA01
gcuggaccuccuggcgcg

SEQ ID NO: 1546045 - RNA, 18 nt, Pseudomonas aeruginosa PA01
gcuggcagguugugcggg

SEQ ID NO: 1546046 - RNA, 20 nt, Pseudomonas aeruginosa PA01
gcuggcagguugugcggggu

SEQ ID NO: 1546047 - RNA, 16 nt, Pseudomonas aeruginosa PA01
gcuggcagggcgcguc

SEQ ID NO: 1546048 - RNA, 14 nt, Pseudomonas aeruginosa PA01
gcuggcauaaccgg

SEQ ID NO: 1546049 - RNA, 23 nt, Pseudomonas aeruginosa PA01
gcuggcauacacaugcaggcucg

SEQ ID NO: 1546050 - RNA, 12 nt, Pseudomonas aeruginosa PA01
gcuggccagcag

SEQ ID NO: 1546051 - RNA, 18 nt, Pseudomonas aeruginosa PA01
gcuggccagcaggcuggc

SEQ ID NO: 1546052 - RNA, 12 nt, Pseudomonas aeruginosa PA01
gcuggccagccc

SEQ ID NO: 1546053 - RNA, 13 nt, Pseudomonas aeruginosa PA01
gcuggccaccagc

SEQ ID NO: 1546054 - RNA, 13 nt, Pseudomonas aeruginosa PA01
gcuggccauccgc

SEQ ID NO: 1546055 - RNA, 15 nt, Pseudomonas aeruginosa PA01
gcuggcccuccaucc

SEQ ID NO: 1546056 - RNA, 15 nt, Pseudomonas aeruginosa PA01
gcuggcccucggcgu

SEQ ID NO: 1546057 - RNA, 15 nt, Pseudomonas aeruginosa PA01
gcuggccgagcgccg

SEQ ID NO: 1546058 - RNA, 16 nt, Pseudomonas aeruginosa PA01
gcuggccgcggugggc

SEQ ID NO: 1546059 - RNA, 22 nt, Pseudomonas aeruginosa PA01
gcuggccgcggugggcuccagc

SEQ ID NO: 1546060 - RNA, 16 nt, Pseudomonas aeruginosa PA01
gcuggccgccuggccg

SEQ ID NO: 1546061 - RNA, 17 nt, Pseudomonas aeruginosa PA01
gcuggcgaagcuggggc

SEQ ID NO: 1546062 - RNA, 15 nt, Pseudomonas aeruginosa PA01
gcuggcgacggcucu

SEQ ID NO: 1546063 - RNA, 19 nt, Pseudomonas aeruginosa PA01
gcuggcgaaccaguccagc

SEQ ID NO: 1546064 - RNA, 22 nt, Pseudomonas aeruginosa PA01
gcuggcgaucaccagggugcgc

SEQ ID NO: 1546065 - RNA, 21 nt, Pseudomonas aeruginosa PA01
gcuggcgcaacagaucuuccu

SEQ ID NO: 1546066 - RNA, 17 nt, Pseudomonas aeruginosa PA01
gcuggcgcacacggucg

SEQ ID NO: 1546067 - RNA, 15 nt, Pseudomonas aeruginosa PA01
gcuggccggucugcu

SEQ ID NO: 1546068 - RNA, 14 nt, Pseudomonas aeruginosa PA01
gcuggccggcagca

SEQ ID NO: 1546069 - RNA, 16 nt, Pseudomonas aeruginosa PA01
gcuggccgagggcgcg

SEQ ID NO: 1546070 - RNA, 19 nt, Pseudomonas aeruginosa PA01
gcuggccgagggcgcgcag

SEQ ID NO: 1546071 - RNA, 20 nt, Pseudomonas aeruginosa PA01
gcuggccuuguacagggcgc

SEQ ID NO: 1546072 - RNA, 21 nt, Pseudomonas aeruginosa PA01
gcuggccuuguacagggcgcg

SEQ ID NO: 1546073 - RNA, 17 nt, Pseudomonas aeruginosa PA01
gcuggccucagggcgcg

SEQ ID NO: 1546074 - RNA, 17 nt, Pseudomonas aeruginosa PA01
gcuggccugcagcaggu

SEQ ID NO: 1546075 - RNA, 22 nt, Pseudomonas aeruginosa PA01
gcuggccugcagcaggucgagc

SEQ ID NO: 1546076 - RNA, 17 nt, Pseudomonas aeruginosa PA01
gcuggcgccggugcaug

SEQ ID NO: 1546077 - RNA, 19 nt, Pseudomonas aeruginosa PA01
gcuggcgcggaugucgggc

SEQ ID NO: 1546078 - RNA, 20 nt, Pseudomonas aeruginosa PA01
gcuggcgcgaucggggcaga

SEQ ID NO: 1546079 - RNA, 23 nt, Pseudomonas aeruginosa PA01
gcuggcgcagccaggcgauggug

SEQ ID NO: 1546080 - RNA, 21 nt, Pseudomonas aeruginosa PA01
gcuggcgcuugccgcgcccgg

SEQ ID NO: 1546081 - RNA, 19 nt, Pseudomonas aeruginosa PA01
gcuggcgcuguaggcgagc

SEQ ID NO: 1546082 - RNA, 14 nt, Pseudomonas aeruginosa PA01
gcuggcgcuggucc

SEQ ID NO: 1546083 - RNA, 20 nt, Pseudomonas aeruginosa PA01
gcuggcggaaggugccuucg

SEQ ID NO: 1546084 - RNA, 21 nt, Pseudomonas aeruginosa PA01
gcuggcggauguaguccagcg

SEQ ID NO: 1546085 - RNA, 23 nt, Pseudomonas aeruginosa PA01
gcuggcggauguaguccagcgcc

SEQ ID NO: 1546086 - RNA, 16 nt, Pseudomonas aeruginosa PA01
gcuggcggccagggca

SEQ ID NO: 1546087 - RNA, 16 nt, Pseudomonas aeruginosa PA01
gcuggcggcucggcug

SEQ ID NO: 1546088 - RNA, 18 nt, Pseudomonas aeruginosa PA01
gcuggcggcgcucaccca

SEQ ID NO: 1546089 - RNA, 12 nt, Pseudomonas aeruginosa PA01
gcuggcggccgc

SEQ ID NO: 1546090 - RNA, 14 nt, Pseudomonas aeruginosa PA01
gcuggcggccuucg

SEQ ID NO: 1546091 - RNA, 16 nt, Pseudomonas aeruginosa PA01
gcgucccgcuccagcc

SEQ ID NO: 1546092 - RNA, 20 nt, Pseudomonas aeruginosa PA01
gcguccgagguggcugaagc

SEQ ID NO: 1546093 - RNA, 13 nt, Pseudomonas aeruginosa PA01
gcguccgccgccg

SEQ ID NO: 1546094 - RNA, 14 nt, Pseudomonas aeruginosa PA01
gcguccgccgccgu

SEQ ID NO: 1546095 - RNA, 13 nt, Pseudomonas aeruginosa PA01
gcguccgcgcagg

SEQ ID NO: 1546096 - RNA, 17 nt, Pseudomonas aeruginosa PA01
gcgucccuggagcaggg

SEQ ID NO: 1546097 - RNA, 14 nt, Pseudomonas aeruginosa PA01
gcguccgaacgcgc

SEQ ID NO: 1546098 - RNA, 13 nt, Pseudomonas aeruginosa PA01
gcguccagccggu

SEQ ID NO: 1546099 - RNA, 16 nt, Pseudomonas aeruginosa PA01
gcguccagggcuucga

SEQ ID NO: 1546100 - RNA, 20 nt, Pseudomonas aeruginosa PA01
gcguccagcuccaccaggcc

SEQ ID NO: 1546101 - RNA, 13 nt, Pseudomonas aeruginosa PA01
gcguccauccagg

SEQ ID NO: 1546102 - RNA, 16 nt, Pseudomonas aeruginosa PA01
gcguccauccccgccu

SEQ ID NO: 1546103 - RNA, 14 nt, Pseudomonas aeruginosa PA01
gcguccacuccggc

SEQ ID NO: 1546104 - RNA, 13 nt, Pseudomonas aeruginosa PA01
gcguccagcaggu

SEQ ID NO: 1546105 - RNA, 23 nt, Pseudomonas aeruginosa PA01
gcgucgacgccgaagccgcuggc

SEQ ID NO: 1546106 - RNA, 16 nt, Pseudomonas aeruginosa PA01
gcgucgagcuggcgca

SEQ ID NO: 1546107 - RNA, 18 nt, Pseudomonas aeruginosa PA01
gcgucgagcuggcgcagg

SEQ ID NO: 1546108 - RNA, 20 nt, Pseudomonas aeruginosa PA01
gcgucgaguaccgcugcggc

SEQ ID NO: 1546109 - RNA, 14 nt, Pseudomonas aeruginosa PA01
gcgucgagucgcgc

SEQ ID NO: 1546110 - RNA, 18 nt, Pseudomonas aeruginosa PA01
gcgucgaucaggcgggcg

SEQ ID NO: 1546111 - RNA, 21 nt, Pseudomonas aeruginosa PA01
gcgucgcacccggcccauggc

SEQ ID NO: 1546112 - RNA, 17 nt, Pseudomonas aeruginosa PA01
gcgucgcauccaccagc

SEQ ID NO: 1546113 - RNA, 13 nt, Pseudomonas aeruginosa PA01
gcgucgccaggcc

SEQ ID NO: 1546114 - RNA, 17 nt, Pseudomonas aeruginosa PA01
gcgucgccgccgcgggc

SEQ ID NO: 1546115 - RNA, 20 nt, Pseudomonas aeruginosa PA01
gcgucgaccaccgcguggug

SEQ ID NO: 1546116 - RNA, 22 nt, Pseudomonas aeruginosa PA01
gcgucgaaaugcucgugcaggu

SEQ ID NO: 1546117 - RNA, 23 nt, Pseudomonas aeruginosa PA01
gcguccguaaugcaacccgccgc

SEQ ID NO: 1546118 - RNA, 18 nt, Pseudomonas aeruginosa PA01
gcguccgggugccccagg

SEQ ID NO: 1546119 - RNA, 17 nt, Pseudomonas aeruginosa PA01
gcguccugcucccuggc

SEQ ID NO: 1546120 - RNA, 14 nt, Pseudomonas aeruginosa PA01
gcguccugcuucca

SEQ ID NO: 1546121 - RNA, 17 nt, Pseudomonas aeruginosa PA01
gcguccugcccuccugc

SEQ ID NO: 1546122 - RNA, 18 nt, Pseudomonas aeruginosa PA01
gcguagccggccagggcg

SEQ ID NO: 1546123 - RNA, 19 nt, Pseudomonas aeruginosa PA01
gcguagcgccccuuggcca

SEQ ID NO: 1546124 - RNA, 20 nt, Pseudomonas aeruginosa PA01
gcguagcgcggcagcgccau

SEQ ID NO: 1546125 - RNA, 21 nt, Pseudomonas aeruginosa PA01
gcguagcgcuucccgcggcuc

SEQ ID NO: 1546126 - RNA, 19 nt, Pseudomonas aeruginosa PA01
gcguagaccaucgccggcg

SEQ ID NO: 1546127 - RNA, 12 nt, Pseudomonas aeruginosa PA01
gcguaggcgcgc

SEQ ID NO: 1546128 - RNA, 13 nt, Pseudomonas aeruginosa PA01
gcguaggcgcgcc

SEQ ID NO: 1546129 - RNA, 14 nt, Pseudomonas aeruginosa PA01
gcguaggcgcgcca

SEQ ID NO: 1546130 - RNA, 21 nt, Pseudomonas aeruginosa PA01
gcguaggcgcgccaaggccgc

SEQ ID NO: 1546131 - RNA, 18 nt, Pseudomonas aeruginosa PA01
gcguaggccucggaguca

SEQ ID NO: 1546132 - RNA, 16 nt, Pseudomonas aeruginosa PA01
gcguaugcgccuccag

SEQ ID NO: 1546133 - RNA, 22 nt, Pseudomonas aeruginosa PA01
gcguaucgaugcgcgcggcgag

SEQ ID NO: 1546134 - RNA, 14 nt, Pseudomonas aeruginosa PA01
gcguaguggugcca

SEQ ID NO: 1546135 - RNA, 18 nt, Pseudomonas aeruginosa PA01
gcguaguugagccccagg

SEQ ID NO: 1546136 - RNA, 19 nt, Pseudomonas aeruginosa PA01
gcguagguggcgccgccgg

SEQ ID NO: 1546137 - RNA, 15 nt, Pseudomonas aeruginosa PA01
gcguagugcaucagc

SEQ ID NO: 1546138 - RNA, 21 nt, Pseudomonas aeruginosa PA01
gcgucacgccgaucccggcgg

SEQ ID NO: 1546139 - RNA, 18 nt, Pseudomonas aeruginosa PA01
gcgucagcgcgccagcac

SEQ ID NO: 1546140 - RNA, 13 nt, Pseudomonas aeruginosa PA01
gcgucagccgcgg

SEQ ID NO: 1546141 - RNA, 20 nt, Pseudomonas aeruginosa PA01
gcguggcaaaaaugcccuug

SEQ ID NO: 1546142 - RNA, 15 nt, Pseudomonas aeruginosa PA01
gcguggaaggccacu

SEQ ID NO: 1546143 - RNA, 16 nt, Pseudomonas aeruginosa PA01
gcguggaaccgcggcg

SEQ ID NO: 1546144 - RNA, 17 nt, Pseudomonas aeruginosa PA01
gcguggaaccgcggcgc

SEQ ID NO: 1546145 - RNA, 15 nt, Pseudomonas aeruginosa PA01
gcguggccggcgacc

SEQ ID NO: 1546146 - RNA, 12 nt, Pseudomonas aeruginosa PA01
gcguggcccggc

SEQ ID NO: 1546147 - RNA, 15 nt, Pseudomonas aeruginosa PA01
gcguggcccggcgcg

SEQ ID NO: 1546148 - RNA, 18 nt, Pseudomonas aeruginosa PA01
gcgugcuuggcgaggcgc

SEQ ID NO: 1546149 - RNA, 23 nt, Pseudomonas aeruginosa PA01
gcgugcucuuuucccgcaccggc

SEQ ID NO: 1546150 - RNA, 15 nt, Pseudomonas aeruginosa PA01
gcgugcuccagcacc

SEQ ID NO: 1546151 - RNA, 22 nt, Pseudomonas aeruginosa PA01
gcgugcuccgugucggcggcgc

SEQ ID NO: 1546152 - RNA, 16 nt, Pseudomonas aeruginosa PA01
gcgugcgagggcggcg

SEQ ID NO: 1546153 - RNA, 16 nt, Pseudomonas aeruginosa PA01
gcgugccgccaggccu

SEQ ID NO: 1546154 - RNA, 16 nt, Pseudomonas aeruginosa PA01
gcgugccgcaggccgc

SEQ ID NO: 1546155 - RNA, 15 nt, Pseudomonas aeruginosa PA01
gcgugcgccguagca

SEQ ID NO: 1546156 - RNA, 16 nt, Pseudomonas aeruginosa PA01
gcgugcgcgccgccgg

SEQ ID NO: 1546157 - RNA, 19 nt, Pseudomonas aeruginosa PA01
gcgugcgcgccgccgggcg

SEQ ID NO: 1546158 - RNA, 13 nt, Pseudomonas aeruginosa PA01
gcgugacccgcgc

SEQ ID NO: 1546159 - RNA, 13 nt, Pseudomonas aeruginosa PA01
gcgugaagcugga

SEQ ID NO: 1546160 - RNA, 13 nt, Pseudomonas aeruginosa PA01
gcgugcaggccgc

SEQ ID NO: 1546161 - RNA, 12 nt, Pseudomonas aeruginosa PA01
gcgugcaggccg

SEQ ID NO: 1546162 - RNA, 15 nt, Pseudomonas aeruginosa PA01
gcgugcaggcgcccu

SEQ ID NO: 1546163 - RNA, 18 nt, Pseudomonas aeruginosa PA01
gcgugcaggcgcccuggc

SEQ ID NO: 1546164 - RNA, 11 nt, Pseudomonas aeruginosa PA01
gcgugcagggu

SEQ ID NO: 1546165 - RNA, 20 nt, Pseudomonas aeruginosa PA01
gcgugcagguagcagccguc

SEQ ID NO: 1546166 - RNA, 18 nt, Pseudomonas aeruginosa PA01
gcgugcccuuuuccucca

SEQ ID NO: 1546167 - RNA, 22 nt, Pseudomonas aeruginosa PA01
gcgugccccguggcgggccagc

SEQ ID NO: 1546168 - RNA, 13 nt, Pseudomonas aeruginosa PA01
gcgugccaggagc

SEQ ID NO: 1546169 - RNA, 16 nt, Pseudomonas aeruginosa PA01
gcgugcaccagcaggc

SEQ ID NO: 1546170 - RNA, 15 nt, Pseudomonas aeruginosa PA01
gcgucucggcugccg

SEQ ID NO: 1546171 - RNA, 17 nt, Pseudomonas aeruginosa PA01
gcgucucggagugaggc

SEQ ID NO: 1546172 - RNA, 13 nt, Pseudomonas aeruginosa PA01
gcgucuccugccg

SEQ ID NO: 1546173 - RNA, 16 nt, Pseudomonas aeruginosa PA01
gcgucuggggugaggc

SEQ ID NO: 1546174 - RNA, 20 nt, Pseudomonas aeruginosa PA01
gcgucugggugaccagcagg

SEQ ID NO: 1546175 - RNA, 16 nt, Pseudomonas aeruginosa PA01
gcgucggccuggcgca

SEQ ID NO: 1546176 - RNA, 18 nt, Pseudomonas aeruginosa PA01
gcgucggccuggcgcagc

SEQ ID NO: 1546177 - RNA, 13 nt, Pseudomonas aeruginosa PA01
gcgucggcauggc

SEQ ID NO: 1546178 - RNA, 24 nt, Pseudomonas aeruginosa PA01
gcgucgcggagaauccgcucggug

SEQ ID NO: 1546179 - RNA, 16 nt, Pseudomonas aeruginosa PA01
gcgucgcggccucuuc

SEQ ID NO: 1546180 - RNA, 15 nt, Pseudomonas aeruginosa PA01
gcgucgcgcacgagg

SEQ ID NO: 1546181 - RNA, 15 nt, Pseudomonas aeruginosa PA01
gcgucgcgcgugccc

SEQ ID NO: 1546182 - RNA, 13 nt, Pseudomonas aeruginosa PA01
gcgucgcgcaggc

SEQ ID NO: 1546183 - RNA, 21 nt, Pseudomonas aeruginosa PA01
gcgucgucggggugccgccag

SEQ ID NO: 1546184 - RNA, 20 nt, Pseudomonas aeruginosa PA01
gcgucgucgcugcgcggguc

SEQ ID NO: 1546185 - RNA, 20 nt, Pseudomonas aeruginosa PA01
gcgucgucgcggcgccuggc

SEQ ID NO: 1546186 - RNA, 18 nt, Pseudomonas aeruginosa PA01
gcgucguccugcgcggcg

SEQ ID NO: 1546187 - RNA, 20 nt, Pseudomonas aeruginosa PA01
gcgucguaguggcgcaacac

SEQ ID NO: 1546188 - RNA, 20 nt, Pseudomonas aeruginosa PA01
gcgucguauaggcgcuggug

SEQ ID NO: 1546189 - RNA, 16 nt, Pseudomonas aeruginosa PA01
gcgucggugccgacgg

SEQ ID NO: 1546190 - RNA, 14 nt, Pseudomonas aeruginosa PA01
gcgucguaacggau

SEQ ID NO: 1546191 - RNA, 16 nt, Pseudomonas aeruginosa PA01
gcgucgguccagcucc

SEQ ID NO: 1546192 - RNA, 23 nt, Pseudomonas aeruginosa PA01
gcgucggcugcgcugggcgccga

SEQ ID NO: 1546193 - RNA, 18 nt, Pseudomonas aeruginosa PA01
gcgucggcgucggcugcg

SEQ ID NO: 1546194 - RNA, 15 nt, Pseudomonas aeruginosa PA01
gcgucggcgcgggcg

SEQ ID NO: 1546195 - RNA, 13 nt, Pseudomonas aeruginosa PA01
gcgggcagcaguc

SEQ ID NO: 1546196 - RNA, 17 nt, Pseudomonas aeruginosa PA01
gcgggauugucgccgcc

SEQ ID NO: 1546197 - RNA, 22 nt, Pseudomonas aeruginosa PA01
gcgggcgcuaugcgccguuacg

SEQ ID NO: 1546198 - RNA, 13 nt, Pseudomonas aeruginosa PA01
gcgggcgcgggcg

SEQ ID NO: 1546199 - RNA, 19 nt, Pseudomonas aeruginosa PA01
gcgggcgcgcgccaccgcc

SEQ ID NO: 1546200 - RNA, 17 nt, Pseudomonas aeruginosa PA01
gcgggccuucaggcugc

SEQ ID NO: 1546201 - RNA, 20 nt, Pseudomonas aeruginosa PA01
gcgggcgcgccugagcuggc

SEQ ID NO: 1546202 - RNA, 11 nt, Pseudomonas aeruginosa PA01
gcgggccuggg

SEQ ID NO: 1546203 - RNA, 16 nt, Pseudomonas aeruginosa PA01
gcgggccugggcaucg

SEQ ID NO: 1546204 - RNA, 20 nt, Pseudomonas aeruginosa PA01
gcgggccucggcgggugugg

SEQ ID NO: 1546205 - RNA, 19 nt, Pseudomonas aeruginosa PA01
gcgggccgccuggucgggg

SEQ ID NO: 1546206 - RNA, 13 nt, Pseudomonas aeruginosa PA01
gcgggccgcggcg

SEQ ID NO: 1546207 - RNA, 19 nt, Pseudomonas aeruginosa PA01
gcgggccgcucgcgcggca

SEQ ID NO: 1546208 - RNA, 13 nt, Pseudomonas aeruginosa PA01
gcgggccgagguc

SEQ ID NO: 1546209 - RNA, 17 nt, Pseudomonas aeruginosa PA01
gcggcuuccugcugguu

SEQ ID NO: 1546210 - RNA, 14 nt, Pseudomonas aeruginosa PA01
gcgggaucaggucg

SEQ ID NO: 1546211 - RNA, 21 nt, Pseudomonas aeruginosa PA01
gcgggaucaggucgccagcgc

SEQ ID NO: 1546212 - RNA, 22 nt, Pseudomonas aeruginosa PA01
gcgggaucaggucgccagcgcc

SEQ ID NO: 1546213 - RNA, 22 nt, Pseudomonas aeruginosa PA01
gcgggaucuucuaccuggcgcu

SEQ ID NO: 1546214 - RNA, 21 nt, Pseudomonas aeruginosa PA01
gcgggauguacgccagggugc

SEQ ID NO: 1546215 - RNA, 16 nt, Pseudomonas aeruginosa PA01
gcggcuucagagcugg

SEQ ID NO: 1546216 - RNA, 17 nt, Pseudomonas aeruginosa PA01
gcggcuucagagcugga

SEQ ID NO: 1546217 - RNA, 16 nt, Pseudomonas aeruginosa PA01
gcggcgccgaggcccu

SEQ ID NO: 1546218 - RNA, 20 nt, Pseudomonas aeruginosa PA01
gcggcgcccucugccggucg

SEQ ID NO: 1546219 - RNA, 22 nt, Pseudomonas aeruginosa PA01
gcggcgccgguugcgucucagc

SEQ ID NO: 1546220 - RNA, 22 nt, Pseudomonas aeruginosa PA01
gcggcgcgagaugaagcgccgc

SEQ ID NO: 1546221 - RNA, 13 nt, Pseudomonas aeruginosa PA01
gcggcgccuugcg

SEQ ID NO: 1546222 - RNA, 13 nt, Pseudomonas aeruginosa PA01
gcggcuggguguc

SEQ ID NO: 1546223 - RNA, 21 nt, Pseudomonas aeruginosa PA01
gcggcuggcugaagccgggca

SEQ ID NO: 1546224 - RNA, 16 nt, Pseudomonas aeruginosa PA01
gcggguggucgccgcc

SEQ ID NO: 1546225 - RNA, 16 nt, Pseudomonas aeruginosa PA01
gcgggugucgcgacgg

SEQ ID NO: 1546226 - RNA, 20 nt, Pseudomonas aeruginosa PA01
gcggguugaccccgaggucg

SEQ ID NO: 1546227 - RNA, 22 nt, Pseudomonas aeruginosa PA01
gcggguugaccccgaggucggc

SEQ ID NO: 1546228 - RNA, 14 nt, Pseudomonas aeruginosa PA01
gcggguguggggaa

SEQ ID NO: 1546229 - RNA, 21 nt, Pseudomonas aeruginosa PA01
gcggguucagcccgccgugcg

SEQ ID NO: 1546230 - RNA, 15 nt, Pseudomonas aeruginosa PA01
gcggguuggcuucca

SEQ ID NO: 1546231 - RNA, 21 nt, Pseudomonas aeruginosa PA01
gcggguuggcuuccagccagc

SEQ ID NO: 1546232 - RNA, 16 nt, Pseudomonas aeruginosa PA01
gcggguucccugcgcc

SEQ ID NO: 1546233 - RNA, 16 nt, Pseudomonas aeruginosa PA01
gcgguacguagcgcgg

SEQ ID NO: 1546234 - RNA, 16 nt, Pseudomonas aeruginosa PA01
gcgguagacgcagggu

SEQ ID NO: 1546235 - RNA, 19 nt, Pseudomonas aeruginosa PA01
gcgguagcgggccagcagc

SEQ ID NO: 1546236 - RNA, 18 nt, Pseudomonas aeruginosa PA01
gcgguagcgccgcgccaa

SEQ ID NO: 1546237 - RNA, 14 nt, Pseudomonas aeruginosa PA01
gcgguaggccagcu

SEQ ID NO: 1546238 - RNA, 16 nt, Pseudomonas aeruginosa PA01
gcgguagucgcugcug

SEQ ID NO: 1546239 - RNA, 21 nt, Pseudomonas aeruginosa PA01
gcgguagucgcugcuggcgcc

SEQ ID NO: 1546240 - RNA, 19 nt, Pseudomonas aeruginosa PA01
gcggggccugcugcgggcg

SEQ ID NO: 1546241 - RNA, 17 nt, Pseudomonas aeruginosa PA01
gcggggcgaccagcauc

SEQ ID NO: 1546242 - RNA, 13 nt, Pseudomonas aeruginosa PA01
gcggggccggacg

SEQ ID NO: 1546243 - RNA, 18 nt, Pseudomonas aeruginosa PA01
gcgggcggucgaggcccu

SEQ ID NO: 1546244 - RNA, 12 nt, Pseudomonas aeruginosa PA01
gcgggcggauca

SEQ ID NO: 1546245 - RNA, 17 nt, Pseudomonas aeruginosa PA01
gcgggcgguagaucucc

SEQ ID NO: 1546246 - RNA, 14 nt, Pseudomonas aeruginosa PA01
gcggggccaucagu

SEQ ID NO: 1546247 - RNA, 13 nt, Pseudomonas aeruginosa PA01
gcggggcgcaccg

SEQ ID NO: 1546248 - RNA, 14 nt, Pseudomonas aeruginosa PA01
gcggggcgcaccgc

SEQ ID NO: 1546249 - RNA, 12 nt, Pseudomonas aeruginosa PA01
gcggggcgcagc

SEQ ID NO: 1546250 - RNA, 14 nt, Pseudomonas aeruginosa PA01
gcggggcgaggucg

SEQ ID NO: 1546251 - RNA, 13 nt, Pseudomonas aeruginosa PA01
gcggggcggauga

SEQ ID NO: 1546252 - RNA, 20 nt, Pseudomonas aeruginosa PA01
gcgggcgcuugaagccggcg

SEQ ID NO: 1546253 - RNA, 16 nt, Pseudomonas aeruginosa PA01
gcgggguucgacgcgc

SEQ ID NO: 1546254 - RNA, 18 nt, Pseudomonas aeruginosa PA01
gcgggguucgacgcgcca

SEQ ID NO: 1546255 - RNA, 21 nt, Pseudomonas aeruginosa PA01
gcgggguucgacgcgccacgc

SEQ ID NO: 1546256 - RNA, 17 nt, Pseudomonas aeruginosa PA01
gcggguaaagcgcccgc

SEQ ID NO: 1546257 - RNA, 16 nt, Pseudomonas aeruginosa PA01
gcggggcuugcgcccc

SEQ ID NO: 1546258 - RNA, 15 nt, Pseudomonas aeruginosa PA01
gcggggcguucugcu

SEQ ID NO: 1546259 - RNA, 22 nt, Pseudomonas aeruginosa PA01
gcgggguaauaccccgccccuu

SEQ ID NO: 1546260 - RNA, 22 nt, Pseudomonas aeruginosa PA01
gcgguccucgggcaccagcacg

SEQ ID NO: 1546261 - RNA, 19 nt, Pseudomonas aeruginosa PA01
gcgguccaggucaugcccu

SEQ ID NO: 1546262 - RNA, 20 nt, Pseudomonas aeruginosa PA01
gcggucccagaccagcagcg

SEQ ID NO: 1546263 - RNA, 14 nt, Pseudomonas aeruginosa PA01
gcgguccgccgcgg

SEQ ID NO: 1546264 - RNA, 20 nt, Pseudomonas aeruginosa PA01
gcggucuuucacgguaaaac

SEQ ID NO: 1546265 - RNA, 23 nt, Pseudomonas aeruginosa PA01
gcggucuucccguaaggccaggc

SEQ ID NO: 1546266 - RNA, 17 nt, Pseudomonas aeruginosa PA01
gcggucggguccgggcc

SEQ ID NO: 1546267 - RNA, 22 nt, Pseudomonas aeruginosa PA01
gcggucggugagcacgccgcga

SEQ ID NO: 1546268 - RNA, 16 nt, Pseudomonas aeruginosa PA01
gcggucguagcccaug

SEQ ID NO: 1546269 - RNA, 18 nt, Pseudomonas aeruginosa PA01
gcggucgccgacccagag

SEQ ID NO: 1546270 - RNA, 14 nt, Pseudomonas aeruginosa PA01
gcggucgccggucg

SEQ ID NO: 1546271 - RNA, 22 nt, Pseudomonas aeruginosa PA01
gcggucgcggaccuccagccgg

SEQ ID NO: 1546272 - RNA, 14 nt, Pseudomonas aeruginosa PA01
gcggucgcgcccgc

SEQ ID NO: 1546273 - RNA, 22 nt, Pseudomonas aeruginosa PA01
gcggugcgcaugucguccaggc

SEQ ID NO: 1546274 - RNA, 21 nt, Pseudomonas aeruginosa PA01
gcggugccauucggugcgcuc

SEQ ID NO: 1546275 - RNA, 13 nt, Pseudomonas aeruginosa PA01
gcggugccgcaga

SEQ ID NO: 1546276 - RNA, 16 nt, Pseudomonas aeruginosa PA01
gcggugcggucggcgc

SEQ ID NO: 1546277 - RNA, 22 nt, Pseudomonas aeruginosa PA01
gcgguggccacgucgccccagg

SEQ ID NO: 1546278 - RNA, 22 nt, Pseudomonas aeruginosa PA01
gcggugaccguuucgccgccgg

SEQ ID NO: 1546279 - RNA, 23 nt, Pseudomonas aeruginosa PA01
gcggugaagguccgcgccaugcc

SEQ ID NO: 1546280 - RNA, 17 nt, Pseudomonas aeruginosa PA01
gcggugagggcgacggc

SEQ ID NO: 1546281 - RNA, 20 nt, Pseudomonas aeruginosa PA01
gcggugcaguucgccguuca

SEQ ID NO: 1546282 - RNA, 18 nt, Pseudomonas aeruginosa PA01
gcgguuaccaggucugug

SEQ ID NO: 1546283 - RNA, 14 nt, Pseudomonas aeruginosa PA01
gcgguuauccgccg

SEQ ID NO: 1546284 - RNA, 14 nt, Pseudomonas aeruginosa PA01
gcgguuccuggcug

SEQ ID NO: 1546285 - RNA, 14 nt, Pseudomonas aeruginosa PA01
gcgguucgaggacu

SEQ ID NO: 1546286 - RNA, 20 nt, Pseudomonas aeruginosa PA01
gcgguuauucgccccagcgg

SEQ ID NO: 1546287 - RNA, 23 nt, Pseudomonas aeruginosa PA01
gcgguuuccaguucaucgagcag

SEQ ID NO: 1546288 - RNA, 21 nt, Pseudomonas aeruginosa PA01
gcguaacuguaccgcucugca

SEQ ID NO: 1546289 - RNA, 18 nt, Pseudomonas aeruginosa PA01
gcguaaucgcgccaggcc

SEQ ID NO: 1546290 - RNA, 19 nt, Pseudomonas aeruginosa PA01
gcguaccucgccaggcugg

SEQ ID NO: 1546291 - RNA, 16 nt, Pseudomonas aeruginosa PA01
gcguacgcccagcagc

SEQ ID NO: 1546292 - RNA, 17 nt, Pseudomonas aeruginosa PA01
gcggcgaggccgaccuu

SEQ ID NO: 1546293 - RNA, 14 nt, Pseudomonas aeruginosa PA01
gcggcgacgcuggc

SEQ ID NO: 1546294 - RNA, 18 nt, Pseudomonas aeruginosa PA01
gcggcgacgcuggcggug

SEQ ID NO: 1546295 - RNA, 17 nt, Pseudomonas aeruginosa PA01
gcggcgacgaucacccc

SEQ ID NO: 1546296 - RNA, 17 nt, Pseudomonas aeruginosa PA01
gcggcgacgccacccgc

SEQ ID NO: 1546297 - RNA, 18 nt, Pseudomonas aeruginosa PA01
gcggcgacgaaggucggc

SEQ ID NO: 1546298 - RNA, 15 nt, Pseudomonas aeruginosa PA01
gcggcgacaccgcca

SEQ ID NO: 1546299 - RNA, 14 nt, Pseudomonas aeruginosa PA01
gcggcgaagcgcuc

SEQ ID NO: 1546300 - RNA, 19 nt, Pseudomonas aeruginosa PA01
gcggcgaagguggcgaccu

SEQ ID NO: 1546301 - RNA, 22 nt, Pseudomonas aeruginosa PA01
gcggcgcaaucagggcugggcg

SEQ ID NO: 1546302 - RNA, 21 nt, Pseudomonas aeruginosa PA01
gcggcgaugcgcaugcgcagc

SEQ ID NO: 1546303 - RNA, 18 nt, Pseudomonas aeruginosa PA01
gcggcgaucgccuggucg

SEQ ID NO: 1546304 - RNA, 17 nt, Pseudomonas aeruginosa PA01
gcggcgaucuucuccgc

SEQ ID NO: 1546305 - RNA, 17 nt, Pseudomonas aeruginosa PA01
gcggcgagcgccgcggc

SEQ ID NO: 1546306 - RNA, 15 nt, Pseudomonas aeruginosa PA01
gcggccgucggccug

SEQ ID NO: 1546307 - RNA, 16 nt, Pseudomonas aeruginosa PA01
gcggccgucggccugg

SEQ ID NO: 1546308 - RNA, 13 nt, Pseudomonas aeruginosa PA01
gcggccguucgcc

SEQ ID NO: 1546309 - RNA, 22 nt, Pseudomonas aeruginosa PA01
gcggccuacgguacaguucagg

SEQ ID NO: 1546310 - RNA, 13 nt, Pseudomonas aeruginosa PA01
gcggccucaggcc

SEQ ID NO: 1546311 - RNA, 21 nt, Pseudomonas aeruginosa PA01
gcggccucgaggucggccugg

SEQ ID NO: 1546312 - RNA, 14 nt, Pseudomonas aeruginosa PA01
gcggccucggccuc

SEQ ID NO: 1546313 - RNA, 14 nt, Pseudomonas aeruginosa PA01
gcggccugagccgg

SEQ ID NO: 1546314 - RNA, 17 nt, Pseudomonas aeruginosa PA01
gcggccugagccggccg

SEQ ID NO: 1546315 - RNA, 21 nt, Pseudomonas aeruginosa PA01
gcggccugagcugccgcuucg

SEQ ID NO: 1546316 - RNA, 17 nt, Pseudomonas aeruginosa PA01
gcggcgaacaucaucca

SEQ ID NO: 1546317 - RNA, 21 nt, Pseudomonas aeruginosa PA01
gcggcgaacaucauccacagc

SEQ ID NO: 1546318 - RNA, 22 nt, Pseudomonas aeruginosa PA01
gcggcgaaauggguucccagca

SEQ ID NO: 1546319 - RNA, 22 nt, Pseudomonas aeruginosa PA01
gcggccuuuucggcggccaggc

SEQ ID NO: 1546320 - RNA, 17 nt, Pseudomonas aeruginosa PA01
gcggccuuuucucugca

SEQ ID NO: 1546321 - RNA, 22 nt, Pseudomonas aeruginosa PA01
gcggccuuuucuuuauuccucc

SEQ ID NO: 1546322 - RNA, 15 nt, Pseudomonas aeruginosa PA01
gcggccuucuugcug

SEQ ID NO: 1546323 - RNA, 20 nt, Pseudomonas aeruginosa PA01
gcggccuucuugcugccggc

SEQ ID NO: 1546324 - RNA, 21 nt, Pseudomonas aeruginosa PA01
gcggccuucuugcugccggcg

SEQ ID NO: 1546325 - RNA, 21 nt, Pseudomonas aeruginosa PA01
gcggccuucucgucgccgccc

SEQ ID NO: 1546326 - RNA, 19 nt, Pseudomonas aeruginosa PA01
gcggccuguucggccuugc

SEQ ID NO: 1546327 - RNA, 19 nt, Pseudomonas aeruginosa PA01
gcggccugguagucgccgg

SEQ ID NO: 1546328 - RNA, 21 nt, Pseudomonas aeruginosa PA01
gcggccugcucgcgcagccag

SEQ ID NO: 1546329 - RNA, 22 nt, Pseudomonas aeruginosa PA01
gcggccugcucgcgcagccagg

SEQ ID NO: 1546330 - RNA, 12 nt, Pseudomonas aeruginosa PA01
gcggcagguccu

SEQ ID NO: 1546331 - RNA, 16 nt, Pseudomonas aeruginosa PA01
gcggcauagcgcagcc

SEQ ID NO: 1546332 - RNA, 18 nt, Pseudomonas aeruginosa PA01
gcggcauagcgcagccgc

SEQ ID NO: 1546333 - RNA, 15 nt, Pseudomonas aeruginosa PA01
gcggccagcccccuc

SEQ ID NO: 1546334 - RNA, 14 nt, Pseudomonas aeruginosa PA01
gcggccagcgccag

SEQ ID NO: 1546335 - RNA, 16 nt, Pseudomonas aeruginosa PA01
gcggccagcgccagga

SEQ ID NO: 1546336 - RNA, 19 nt, Pseudomonas aeruginosa PA01
gcggccagcgugaagaccu

SEQ ID NO: 1546337 - RNA, 15 nt, Pseudomonas aeruginosa PA01
gcggccagcgcggcc

SEQ ID NO: 1546338 - RNA, 14 nt, Pseudomonas aeruginosa PA01
gcggccagcuucuc

SEQ ID NO: 1546339 - RNA, 18 nt, Pseudomonas aeruginosa PA01
gcggccaguucggggucg

SEQ ID NO: 1546340 - RNA, 20 nt, Pseudomonas aeruginosa PA01
gcggccaguucggggucggc

SEQ ID NO: 1546341 - RNA, 22 nt, Pseudomonas aeruginosa PA01
gcggccaguucggggucggccu

SEQ ID NO: 1546342 - RNA, 20 nt, Pseudomonas aeruginosa PA01
gcggccagggaaaagcccag

SEQ ID NO: 1546343 - RNA, 13 nt, Pseudomonas aeruginosa PA01
gcggccaucggcg

SEQ ID NO: 1546344 - RNA, 22 nt, Pseudomonas aeruginosa PA01
gcggccaucggcgaagcggaag

SEQ ID NO: 1546345 - RNA, 16 nt, Pseudomonas aeruginosa PA01
gcggccgcgagcgcgg

SEQ ID NO: 1546346 - RNA, 20 nt, Pseudomonas aeruginosa PA01
gcggccgcgagcgcggccgg

SEQ ID NO: 1546347 - RNA, 22 nt, Pseudomonas aeruginosa PA01
gcggccggcgcggacggccugc

SEQ ID NO: 1546348 - RNA, 15 nt, Pseudomonas aeruginosa PA01
gcggccggcgcggcg

SEQ ID NO: 1546349 - RNA, 16 nt, Pseudomonas aeruginosa PA01
gcggccguagccgucg

SEQ ID NO: 1546350 - RNA, 11 nt, Pseudomonas aeruginosa PA01
gcggcagaagc

SEQ ID NO: 1546351 - RNA, 11 nt, Pseudomonas aeruginosa PA01
gcggcagcagg

SEQ ID NO: 1546352 - RNA, 12 nt, Pseudomonas aeruginosa PA01
gcggcagcaggc

SEQ ID NO: 1546353 - RNA, 23 nt, Pseudomonas aeruginosa PA01
gcggcaauucuugauccaguagc

SEQ ID NO: 1546354 - RNA, 19 nt, Pseudomonas aeruginosa PA01
gcggcaauguccgagcagg

SEQ ID NO: 1546355 - RNA, 22 nt, Pseudomonas aeruginosa PA01
gcggcacagcguggccagcgcc

SEQ ID NO: 1546356 - RNA, 21 nt, Pseudomonas aeruginosa PA01
gcggaugcaguugagucgcgc

SEQ ID NO: 1546357 - RNA, 18 nt, Pseudomonas aeruginosa PA01
gcggaugcccuggucggc

SEQ ID NO: 1546358 - RNA, 17 nt, Pseudomonas aeruginosa PA01
gcggauuacuccgccgg

SEQ ID NO: 1546359 - RNA, 18 nt, Pseudomonas aeruginosa PA01
gcggauucaucggcggca

SEQ ID NO: 1546360 - RNA, 17 nt, Pseudomonas aeruginosa PA01
gcggauguucgccacgc

SEQ ID NO: 1546361 - RNA, 15 nt, Pseudomonas aeruginosa PA01
gcggauguucuucac

SEQ ID NO: 1546362 - RNA, 17 nt, Pseudomonas aeruginosa PA01
gcggcaaggccaagucg

SEQ ID NO: 1546363 - RNA, 14 nt, Pseudomonas aeruginosa PA01
gcggcaagggcacg

SEQ ID NO: 1546364 - RNA, 23 nt, Pseudomonas aeruginosa PA01
gcggcaagggcacgugcagcggc

SEQ ID NO: 1546365 - RNA, 16 nt, Pseudomonas aeruginosa PA01
gcggcaagggcgucug

SEQ ID NO: 1546366 - RNA, 23 nt, Pseudomonas aeruginosa PA01
gcggaucaacuccgccaggcgcu

SEQ ID NO: 1546367 - RNA, 14 nt, Pseudomonas aeruginosa PA01
gcggaucaggcugg

SEQ ID NO: 1546368 - RNA, 13 nt, Pseudomonas aeruginosa PA01
gcggaucagccgg

SEQ ID NO: 1546369 - RNA, 14 nt, Pseudomonas aeruginosa PA01
gcggaucagccggc

SEQ ID NO: 1546370 - RNA, 13 nt, Pseudomonas aeruginosa PA01
gcggaucacaggc

SEQ ID NO: 1546371 - RNA, 19 nt, Pseudomonas aeruginosa PA01
gcggaucacaggcucuucu

SEQ ID NO: 1546372 - RNA, 15 nt, Pseudomonas aeruginosa PA01
gcggauacaggcgca

SEQ ID NO: 1546373 - RNA, 18 nt, Pseudomonas aeruginosa PA01
gcggauacaggcgcagca

SEQ ID NO: 1546374 - RNA, 20 nt, Pseudomonas aeruginosa PA01
gcggauacaggcgcagcagc

SEQ ID NO: 1546375 - RNA, 17 nt, Pseudomonas aeruginosa PA01
gcggauauucgacgcgc

SEQ ID NO: 1546376 - RNA, 21 nt, Pseudomonas aeruginosa PA01
gcggaguagccggcggcgaac

SEQ ID NO: 1546377 - RNA, 19 nt, Pseudomonas aeruginosa PA01
gcggauaacgccuguggcg

SEQ ID NO: 1546378 - RNA, 19 nt, Pseudomonas aeruginosa PA01
gcggagauccccuccucca

SEQ ID NO: 1546379 - RNA, 12 nt, Pseudomonas aeruginosa PA01
gcggagagucgg

SEQ ID NO: 1546380 - RNA, 17 nt, Pseudomonas aeruginosa PA01
gcggagcgucggaagcg

SEQ ID NO: 1546381 - RNA, 16 nt, Pseudomonas aeruginosa PA01
gcggagcagccucagu

SEQ ID NO: 1546382 - RNA, 17 nt, Pseudomonas aeruginosa PA01
gcggaggcgaggucgcc

SEQ ID NO: 1546383 - RNA, 15 nt, Pseudomonas aeruginosa PA01
gcggacaccgcggug

SEQ ID NO: 1546384 - RNA, 23 nt, Pseudomonas aeruginosa PA01
gcggacaccgcggugucggugcc

SEQ ID NO: 1546385 - RNA, 15 nt, Pseudomonas aeruginosa PA01
gcggacaagcccagc

SEQ ID NO: 1546386 - RNA, 20 nt, Pseudomonas aeruginosa PA01
gcggacauguugcagggucg

SEQ ID NO: 1546387 - RNA, 16 nt, Pseudomonas aeruginosa PA01
gcggacuccggaggcg

SEQ ID NO: 1546388 - RNA, 18 nt, Pseudomonas aeruginosa PA01
gcggacuccggaggcgca

SEQ ID NO: 1546389 - RNA, 18 nt, Pseudomonas aeruginosa PA01
gcggagaauccgcucggu

SEQ ID NO: 1546390 - RNA, 19 nt, Pseudomonas aeruginosa PA01
gcgcuugcugccauggcgg

SEQ ID NO: 1546391 - RNA, 21 nt, Pseudomonas aeruginosa PA01
gcgcuuggacagcucgcggga

SEQ ID NO: 1546392 - RNA, 21 nt, Pseudomonas aeruginosa PA01
gcgcuuguagcagccgcagga

SEQ ID NO: 1546393 - RNA, 16 nt, Pseudomonas aeruginosa PA01
gcgcuuguagcccagg

SEQ ID NO: 1546394 - RNA, 20 nt, Pseudomonas aeruginosa PA01
gcgcuuuccggcgcggccug

SEQ ID NO: 1546395 - RNA, 15 nt, Pseudomonas aeruginosa PA01
gcgcuuucccgcuuc

SEQ ID NO: 1546396 - RNA, 17 nt, Pseudomonas aeruginosa PA01
gcggacaaccaccaugc

SEQ ID NO: 1546397 - RNA, 17 nt, Pseudomonas aeruginosa PA01
gcgcuuuucaggauguu

SEQ ID NO: 1546398 - RNA, 13 nt, Pseudomonas aeruginosa PA01
gcgcuugcccagg

SEQ ID NO: 1546399 - RNA, 19 nt, Pseudomonas aeruginosa PA01
gcgcuucugcucggccugg

SEQ ID NO: 1546400 - RNA, 23 nt, Pseudomonas aeruginosa PA01
gcgcuucuugucgucggacuuga

SEQ ID NO: 1546401 - RNA, 19 nt, Pseudomonas aeruginosa PA01
gcgcuugaacgcgcgccug

SEQ ID NO: 1546402 - RNA, 19 nt, Pseudomonas aeruginosa PA01
gcgcuugagcagccaggcg

SEQ ID NO: 1546403 - RNA, 20 nt, Pseudomonas aeruginosa PA01
gcgcuugagcagccaggcga

SEQ ID NO: 1546404 - RNA, 14 nt, Pseudomonas aeruginosa PA01
gcgcuuccaggcac

SEQ ID NO: 1546405 - RNA, 21 nt, Pseudomonas aeruginosa PA01
gcgcuucauccugcgcgccuc

SEQ ID NO: 1546406 - RNA, 16 nt, Pseudomonas aeruginosa PA01
gcgcuuccaccgccug

SEQ ID NO: 1546407 - RNA, 17 nt, Pseudomonas aeruginosa PA01
gcgcuuccaccgccugc

SEQ ID NO: 1546408 - RNA, 19 nt, Pseudomonas aeruginosa PA01
gcgcuucgcgcagcucggc

SEQ ID NO: 1546409 - RNA, 15 nt, Pseudomonas aeruginosa PA01
gcgcugaccuggucg

SEQ ID NO: 1546410 - RNA, 16 nt, Pseudomonas aeruginosa PA01
gcgcugaccaggucgu

SEQ ID NO: 1546411 - RNA, 18 nt, Pseudomonas aeruginosa PA01
gcgcugaccgcucccagg

SEQ ID NO: 1546412 - RNA, 23 nt, Pseudomonas aeruginosa PA01
gcgcugaccgcucccaggcaacg

SEQ ID NO: 1546413 - RNA, 20 nt, Pseudomonas aeruginosa PA01
gcgcugaggaucagccagcc

SEQ ID NO: 1546414 - RNA, 21 nt, Pseudomonas aeruginosa PA01
gcgcugaggaucagccagccg

SEQ ID NO: 1546415 - RNA, 15 nt, Pseudomonas aeruginosa PA01
gcgcuccgccaggcc

SEQ ID NO: 1546416 - RNA, 17 nt, Pseudomonas aeruginosa PA01
gcgcuccucgcgcugcc

SEQ ID NO: 1546417 - RNA, 16 nt, Pseudomonas aeruginosa PA01
gcgcuccgacuccugc

SEQ ID NO: 1546418 - RNA, 23 nt, Pseudomonas aeruginosa PA01
gcgcuccuucuccggggcccggc

SEQ ID NO: 1546419 - RNA, 13 nt, Pseudomonas aeruginosa PA01
gcgcuccuugagc

SEQ ID NO: 1546420 - RNA, 23 nt, Pseudomonas aeruginosa PA01
gcgcuccuugcgccaggcccggc

SEQ ID NO: 1546421 - RNA, 16 nt, Pseudomonas aeruginosa PA01
gcgcuccuuggcuggc

SEQ ID NO: 1546422 - RNA, 18 nt, Pseudomonas aeruginosa PA01
gcgcugaacaagcccugg

SEQ ID NO: 1546423 - RNA, 22 nt, Pseudomonas aeruginosa PA01
gcgcugaacaagcccugguggu

SEQ ID NO: 1546424 - RNA, 19 nt, Pseudomonas aeruginosa PA01
gcgcggaucagucaggauc

SEQ ID NO: 1546425 - RNA, 18 nt, Pseudomonas aeruginosa PA01
gcgcggauccccucccgc

SEQ ID NO: 1546426 - RNA, 16 nt, Pseudomonas aeruginosa PA01
gcgcggaccgcaaccg

SEQ ID NO: 1546427 - RNA, 21 nt, Pseudomonas aeruginosa PA01
gcgcggaccgcaaccgguccu

SEQ ID NO: 1546428 - RNA, 22 nt, Pseudomonas aeruginosa PA01
gcgcggaccuucgacggcaggu

SEQ ID NO: 1546429 - RNA, 12 nt, Pseudomonas aeruginosa PA01
gcgcggagaucc

SEQ ID NO: 1546430 - RNA, 22 nt, Pseudomonas aeruginosa PA01
gcgcggagcguccaccagcgcc

SEQ ID NO: 1546431 - RNA, 23 nt, Pseudomonas aeruginosa PA01
gcgcggaauccuucgcggcggcg

SEQ ID NO: 1546432 - RNA, 22 nt, Pseudomonas aeruginosa PA01
gcgcgcguuccaggucgcugcu

SEQ ID NO: 1546433 - RNA, 19 nt, Pseudomonas aeruginosa PA01
gcgcggaacaucgcccggc

SEQ ID NO: 1546434 - RNA, 20 nt, Pseudomonas aeruginosa PA01
gcgcggaacaucgcccggcg

SEQ ID NO: 1546435 - RNA, 17 nt, Pseudomonas aeruginosa PA01
gcgcgcuccggcgcgcc

SEQ ID NO: 1546436 - RNA, 22 nt, Pseudomonas aeruginosa PA01
gcgcggccacuucguccggccg

SEQ ID NO: 1546437 - RNA, 12 nt, Pseudomonas aeruginosa PA01
gcgcggccagcg

SEQ ID NO: 1546438 - RNA, 14 nt, Pseudomonas aeruginosa PA01
gcgcggccagcuuc

SEQ ID NO: 1546439 - RNA, 13 nt, Pseudomonas aeruginosa PA01
gcgcggccagcgc

SEQ ID NO: 1546440 - RNA, 17 nt, Pseudomonas aeruginosa PA01
gcgcggccagcgcggcc

SEQ ID NO: 1546441 - RNA, 12 nt, Pseudomonas aeruginosa PA01
gcgcggccggcg

SEQ ID NO: 1546442 - RNA, 15 nt, Pseudomonas aeruginosa PA01
gcgcggccggcgccg

SEQ ID NO: 1546443 - RNA, 16 nt, Pseudomonas aeruginosa PA01
gcgcggccggcgccgc

SEQ ID NO: 1546444 - RNA, 11 nt, Pseudomonas aeruginosa PA01
gcgcggcggcg

SEQ ID NO: 1546445 - RNA, 14 nt, Pseudomonas aeruginosa PA01
gcgcggcggcggcc

SEQ ID NO: 1546446 - RNA, 22 nt, Pseudomonas aeruginosa PA01
gcgcgccggguugcgccgcaag

SEQ ID NO: 1546447 - RNA, 16 nt, Pseudomonas aeruginosa PA01
gcgcgcccuugagcac

SEQ ID NO: 1546448 - RNA, 12 nt, Pseudomonas aeruginosa PA01
gcgcgccgagcc

SEQ ID NO: 1546449 - RNA, 23 nt, Pseudomonas aeruginosa PA01
gcgcgccgaacucgaacgcguga

SEQ ID NO: 1546450 - RNA, 16 nt, Pseudomonas aeruginosa PA01
gcgcgcccaggcaggc

SEQ ID NO: 1546451 - RNA, 15 nt, Pseudomonas aeruginosa PA01
gcgcgccauggcggu

SEQ ID NO: 1546452 - RNA, 13 nt, Pseudomonas aeruginosa PA01
gcgcgcccgccag

SEQ ID NO: 1546453 - RNA, 22 nt, Pseudomonas aeruginosa PA01
gcgcgcggucgagcagcgccgc

SEQ ID NO: 1546454 - RNA, 15 nt, Pseudomonas aeruginosa PA01
gcgcgcgggccuucg

SEQ ID NO: 1546455 - RNA, 16 nt, Pseudomonas aeruginosa PA01
gcgcgcggccuguucg

SEQ ID NO: 1546456 - RNA, 19 nt, Pseudomonas aeruginosa PA01
gcgcgccucagcggcuggc

SEQ ID NO: 1546457 - RNA, 21 nt, Pseudomonas aeruginosa PA01
gcgcgccucuuccuggaccuc

SEQ ID NO: 1546458 - RNA, 16 nt, Pseudomonas aeruginosa PA01
gcgcgccucgccccag

SEQ ID NO: 1546459 - RNA, 17 nt, Pseudomonas aeruginosa PA01
gcgcgccucgccccaga

SEQ ID NO: 1546460 - RNA, 23 nt, Pseudomonas aeruginosa PA01
gcgcgccucgccccagacccagg

SEQ ID NO: 1546461 - RNA, 13 nt, Pseudomonas aeruginosa PA01
gcgcgccuggccc

SEQ ID NO: 1546462 - RNA, 17 nt, Pseudomonas aeruginosa PA01
gcgcgccuggcccuggc

SEQ ID NO: 1546463 - RNA, 20 nt, Pseudomonas aeruginosa PA01
gcgcgccuucagccccagca

SEQ ID NO: 1546464 - RNA, 16 nt, Pseudomonas aeruginosa PA01
gcgcgacacauggucg

SEQ ID NO: 1546465 - RNA, 13 nt, Pseudomonas aeruginosa PA01
gcgcgagcguucc

SEQ ID NO: 1546466 - RNA, 21 nt, Pseudomonas aeruginosa PA01
gcgcgacagcucguggcuggc

SEQ ID NO: 1546467 - RNA, 14 nt, Pseudomonas aeruginosa PA01
gcgcgacagcucug

SEQ ID NO: 1546468 - RNA, 16 nt, Pseudomonas aeruginosa PA01
gcgcgagggggccucg

SEQ ID NO: 1546469 - RNA, 17 nt, Pseudomonas aeruginosa PA01
gcgcgagggggccucgg

SEQ ID NO: 1546470 - RNA, 16 nt, Pseudomonas aeruginosa PA01
gcgcgauaucgcaggc

SEQ ID NO: 1546471 - RNA, 20 nt, Pseudomonas aeruginosa PA01
gcgcgauaucgcaggccagg

SEQ ID NO: 1546472 - RNA, 16 nt, Pseudomonas aeruginosa PA01
gcgcgauccgcgcggc

SEQ ID NO: 1546473 - RNA, 17 nt, Pseudomonas aeruginosa PA01
gcgcgauccuccgccag

SEQ ID NO: 1546474 - RNA, 23 nt, Pseudomonas aeruginosa PA01
gcgcgauccuccgccagccccag

SEQ ID NO: 1546475 - RNA, 17 nt, Pseudomonas aeruginosa PA01
gcgcgauccuggcggca

SEQ ID NO: 1546476 - RNA, 17 nt, Pseudomonas aeruginosa PA01
gcgcgcaccaggccucc

SEQ ID NO: 1546477 - RNA, 22 nt, Pseudomonas aeruginosa PA01
gcgcgcagcgguacaggcggau

SEQ ID NO: 1546478 - RNA, 13 nt, Pseudomonas aeruginosa PA01
gcgcgcaggcgcu

SEQ ID NO: 1546479 - RNA, 13 nt, Pseudomonas aeruginosa PA01
gcgcgcagggcau

SEQ ID NO: 1546480 - RNA, 13 nt, Pseudomonas aeruginosa PA01
gcgcgcagggccg

SEQ ID NO: 1546481 - RNA, 16 nt, Pseudomonas aeruginosa PA01
gcgcgcagggccgcgg

SEQ ID NO: 1546482 - RNA, 18 nt, Pseudomonas aeruginosa PA01
gcgcgcagggccgcggcg

SEQ ID NO: 1546483 - RNA, 22 nt, Pseudomonas aeruginosa PA01
gcgcgcagggugagcauggcgu

SEQ ID NO: 1546484 - RNA, 13 nt, Pseudomonas aeruginosa PA01
gcgaucgccggcg

SEQ ID NO: 1546485 - RNA, 18 nt, Pseudomonas aeruginosa PA01
gcgaucgaucggcugguc

SEQ ID NO: 1546486 - RNA, 14 nt, Pseudomonas aeruginosa PA01
gcgaucgccaggcg

SEQ ID NO: 1546487 - RNA, 13 nt, Pseudomonas aeruginosa PA01
gcgaucgccaggu

SEQ ID NO: 1546488 - RNA, 18 nt, Pseudomonas aeruginosa PA01
gcgaucgccccguuggug

SEQ ID NO: 1546489 - RNA, 20 nt, Pseudomonas aeruginosa PA01
gcgauccugaccguccuggc

SEQ ID NO: 1546490 - RNA, 21 nt, Pseudomonas aeruginosa PA01
gcgauccugaccguccuggcc

SEQ ID NO: 1546491 - RNA, 19 nt, Pseudomonas aeruginosa PA01
gcgauccuucggaggucga

SEQ ID NO: 1546492 - RNA, 15 nt, Pseudomonas aeruginosa PA01
gcgcgaaggcgccuu

SEQ ID NO: 1546493 - RNA, 14 nt, Pseudomonas aeruginosa PA01
gcgcgaagccagga

SEQ ID NO: 1546494 - RNA, 23 nt, Pseudomonas aeruginosa PA01
gcgcgaagccaggaagcggcggu

SEQ ID NO: 1546495 - RNA, 19 nt, Pseudomonas aeruginosa PA01
gcgcgaauaccgcgcgcgc

SEQ ID NO: 1546496 - RNA, 16 nt, Pseudomonas aeruginosa PA01
gcgaucgagcugucca

SEQ ID NO: 1546497 - RNA, 19 nt, Pseudomonas aeruginosa PA01
gcgauccaccgccagggcg

SEQ ID NO: 1546498 - RNA, 22 nt, Pseudomonas aeruginosa PA01
gcgauccaccgccagggcgcuc

SEQ ID NO: 1546499 - RNA, 16 nt, Pseudomonas aeruginosa PA01
gcgaucaggccgaugc

SEQ ID NO: 1546500 - RNA, 16 nt, Pseudomonas aeruginosa PA01
gcgauccacagcaggu

SEQ ID NO: 1546501 - RNA, 12 nt, Pseudomonas aeruginosa PA01
gcgaucauccag

SEQ ID NO: 1546502 - RNA, 15 nt, Pseudomonas aeruginosa PA01
gcgaucaucgccacc

SEQ ID NO: 1546503 - RNA, 16 nt, Pseudomonas aeruginosa PA01
gcgaucagggccucgc

SEQ ID NO: 1546504 - RNA, 20 nt, Pseudomonas aeruginosa PA01
gcgcguagcuuuccgcggcg

SEQ ID NO: 1546505 - RNA, 18 nt, Pseudomonas aeruginosa PA01
gcgcguacgcccgcagcc

SEQ ID NO: 1546506 - RNA, 20 nt, Pseudomonas aeruginosa PA01
gcgcguacucaggccgggcg

SEQ ID NO: 1546507 - RNA, 21 nt, Pseudomonas aeruginosa PA01
gcgcgguuauccgccggugcg

SEQ ID NO: 1546508 - RNA, 17 nt, Pseudomonas aeruginosa PA01
gcgcgguuucgcagcgc

SEQ ID NO: 1546509 - RNA, 15 nt, Pseudomonas aeruginosa PA01
gcgcguccggaguga

SEQ ID NO: 1546510 - RNA, 14 nt, Pseudomonas aeruginosa PA01
gcgcguccagccgg

SEQ ID NO: 1546511 - RNA, 13 nt, Pseudomonas aeruginosa PA01
gcgcggugcgcgc

SEQ ID NO: 1546512 - RNA, 13 nt, Pseudomonas aeruginosa PA01
gcgcggugggccu

SEQ ID NO: 1546513 - RNA, 12 nt, Pseudomonas aeruginosa PA01
gcgcggucgggu

SEQ ID NO: 1546514 - RNA, 13 nt, Pseudomonas aeruginosa PA01
gcgcggucggguc

SEQ ID NO: 1546515 - RNA, 20 nt, Pseudomonas aeruginosa PA01
gcgcggucggguccgggccc

SEQ ID NO: 1546516 - RNA, 16 nt, Pseudomonas aeruginosa PA01
gcgcggucgagcagcg

SEQ ID NO: 1546517 - RNA, 20 nt, Pseudomonas aeruginosa PA01
gcgcggucgagcagcgccgc

SEQ ID NO: 1546518 - RNA, 14 nt, Pseudomonas aeruginosa PA01
gcgcggucgagcuc

SEQ ID NO: 1546519 - RNA, 16 nt, Pseudomonas aeruginosa PA01
gcgcggucauccgccc

SEQ ID NO: 1546520 - RNA, 22 nt, Pseudomonas aeruginosa PA01
gcgcgguccgcguggugagcac

SEQ ID NO: 1546521 - RNA, 17 nt, Pseudomonas aeruginosa PA01
gcgcgggaauucuuccg

SEQ ID NO: 1546522 - RNA, 22 nt, Pseudomonas aeruginosa PA01
gcgcgggccgacggcccuccgg

SEQ ID NO: 1546523 - RNA, 13 nt, Pseudomonas aeruginosa PA01
gcgcgggccggcg

SEQ ID NO: 1546524 - RNA, 20 nt, Pseudomonas aeruginosa PA01
gcgcgggccuucaggcugcg

SEQ ID NO: 1546525 - RNA, 12 nt, Pseudomonas aeruginosa PA01
gcgcggcugcuu

SEQ ID NO: 1546526 - RNA, 16 nt, Pseudomonas aeruginosa PA01
gcgcggcugcuugccg

SEQ ID NO: 1546527 - RNA, 19 nt, Pseudomonas aeruginosa PA01
gcgcggcuugccggcgcgc

SEQ ID NO: 1546528 - RNA, 15 nt, Pseudomonas aeruginosa PA01
gcgcggcucggcggg

SEQ ID NO: 1546529 - RNA, 14 nt, Pseudomonas aeruginosa PA01
gcgcgggcuggcca

SEQ ID NO: 1546530 - RNA, 13 nt, Pseudomonas aeruginosa PA01
gcgcggggccccg

SEQ ID NO: 1546531 - RNA, 23 nt, Pseudomonas aeruginosa PA01
gcgcgggucguacaccgcgcggc

SEQ ID NO: 1546532 - RNA, 15 nt, Pseudomonas aeruginosa PA01
gcgcgggucuugccg

SEQ ID NO: 1546533 - RNA, 20 nt, Pseudomonas aeruginosa PA01
gcgcggguucgugccaggcg

SEQ ID NO: 1546534 - RNA, 14 nt, Pseudomonas aeruginosa PA01
gcgcgucgcggccu

SEQ ID NO: 1546535 - RNA, 15 nt, Pseudomonas aeruginosa PA01
gcgcgucgcggccuc

SEQ ID NO: 1546536 - RNA, 22 nt, Pseudomonas aeruginosa PA01
gcgcgucgaugcuuucgagcaa

SEQ ID NO: 1546537 - RNA, 16 nt, Pseudomonas aeruginosa PA01
gcgcgucggcacgccg

SEQ ID NO: 1546538 - RNA, 15 nt, Pseudomonas aeruginosa PA01
gcgcgucgcugccgc

SEQ ID NO: 1546539 - RNA, 18 nt, Pseudomonas aeruginosa PA01
gcgcguucacuccacgag

SEQ ID NO: 1546540 - RNA, 20 nt, Pseudomonas aeruginosa PA01
gcgcguucacuccacgagga

SEQ ID NO: 1546541 - RNA, 16 nt, Pseudomonas aeruginosa PA01
gcgcguugcccagccc

SEQ ID NO: 1546542 - RNA, 14 nt, Pseudomonas aeruginosa PA01
gcgcguuggcuggc

SEQ ID NO: 1546543 - RNA, 14 nt, Pseudomonas aeruginosa PA01
gcgcucagggacac

SEQ ID NO: 1546544 - RNA, 16 nt, Pseudomonas aeruginosa PA01
gcgcuccaggcccggc

SEQ ID NO: 1546545 - RNA, 17 nt, Pseudomonas aeruginosa PA01
gcgcuccaggcccggca

SEQ ID NO: 1546546 - RNA, 18 nt, Pseudomonas aeruginosa PA01
gcgcuccaggcgggugaa

SEQ ID NO: 1546547 - RNA, 18 nt, Pseudomonas aeruginosa PA01
gcgcuccaccagggccuc

SEQ ID NO: 1546548 - RNA, 19 nt, Pseudomonas aeruginosa PA01
gcgcuccaccgcccccggc

SEQ ID NO: 1546549 - RNA, 18 nt, Pseudomonas aeruginosa PA01
gcgcuccacagcugccag

SEQ ID NO: 1546550 - RNA, 19 nt, Pseudomonas aeruginosa PA01
gcgcuccacagcugccagc

SEQ ID NO: 1546551 - RNA, 17 nt, Pseudomonas aeruginosa PA01
gcgcuagcgcauggcga

SEQ ID NO: 1546552 - RNA, 18 nt, Pseudomonas aeruginosa PA01
gcgcuaucggcccggggc

SEQ ID NO: 1546553 - RNA, 12 nt, Pseudomonas aeruginosa PA01
gcaacuggaagg

SEQ ID NO: 1546554 - RNA, 16 nt, Pseudomonas aeruginosa PA01
gcaacuggucgcggcu

SEQ ID NO: 1546555 - RNA, 17 nt, Pseudomonas aeruginosa PA01
gcaacuggucgcggcug

SEQ ID NO: 1546556 - RNA, 15 nt, Pseudomonas aeruginosa PA01
gcaacuggcuggccu

SEQ ID NO: 1546557 - RNA, 22 nt, Pseudomonas aeruginosa PA01
gcaacuggccgagaucggucac

SEQ ID NO: 1546558 - RNA, 22 nt, Pseudomonas aeruginosa PA01
gcaacucggcgucgcgcuugcc

SEQ ID NO: 1546559 - RNA, 21 nt, Pseudomonas aeruginosa PA01
gcaacucgaaaaugucggugc

SEQ ID NO: 1546560 - RNA, 22 nt, Pseudomonas aeruginosa PA01
aaagcgccuucugcgugggcaa

SEQ ID NO: 1546561 - RNA, 19 nt, Pseudomonas aeruginosa PA01
gcaacugaucagccgggcg

SEQ ID NO: 1546562 - RNA, 15 nt, Pseudomonas aeruginosa PA01
gcaacgcuuccagca

SEQ ID NO: 1546563 - RNA, 21 nt, Pseudomonas aeruginosa PA01
gcaacgcuuccagcaccuccc

SEQ ID NO: 1546564 - RNA, 12 nt, Pseudomonas aeruginosa PA01
gcaacgccaggc

SEQ ID NO: 1546565 - RNA, 15 nt, Pseudomonas aeruginosa PA01
gcaacgcccgcgagc

SEQ ID NO: 1546566 - RNA, 12 nt, Pseudomonas aeruginosa PA01
gcaacggcuggg

SEQ ID NO: 1546567 - RNA, 18 nt, Pseudomonas aeruginosa PA01
gcaacgggacgccaggcg

SEQ ID NO: 1546568 - RNA, 23 nt, Pseudomonas aeruginosa PA01
gcaaccgucgaacagguggcuuu

SEQ ID NO: 1546569 - RNA, 14 nt, Pseudomonas aeruginosa PA01
gcaaccgcggcggc

SEQ ID NO: 1546570 - RNA, 17 nt, Pseudomonas aeruginosa PA01
gcaaccgcugccgccgu

SEQ ID NO: 1546571 - RNA, 20 nt, Pseudomonas aeruginosa PA01
gcaacgcaggucaugaagga

SEQ ID NO: 1546572 - RNA, 19 nt, Pseudomonas aeruginosa PA01
gcaacgaaaaagggcggcc

SEQ ID NO: 1546573 - RNA, 22 nt, Pseudomonas aeruginosa PA01
gcaacgaaaaagggcggccacc

SEQ ID NO: 1546574 - RNA, 18 nt, Pseudomonas aeruginosa PA01
gcaaccugccagaaaacc

SEQ ID NO: 1546575 - RNA, 15 nt, Pseudomonas aeruginosa PA01
gcaaguggcggcuga

SEQ ID NO: 1546576 - RNA, 19 nt, Pseudomonas aeruginosa PA01
gcaaggcgcugaagcggcc

SEQ ID NO: 1546577 - RNA, 15 nt, Pseudomonas aeruginosa PA01
gcaaggccaagucgg

SEQ ID NO: 1546578 - RNA, 18 nt, Pseudomonas aeruginosa PA01
gcaaggcggugaccagcg

SEQ ID NO: 1546579 - RNA, 20 nt, Pseudomonas aeruginosa PA01
gcaaggcggugaccagcggc

SEQ ID NO: 1546580 - RNA, 18 nt, Pseudomonas aeruginosa PA01
gcaagggcacgugcagcg

SEQ ID NO: 1546581 - RNA, 16 nt, Pseudomonas aeruginosa PA01
gcaagggcgccgccga

SEQ ID NO: 1546582 - RNA, 15 nt, Pseudomonas aeruginosa PA01
gcaagggugcucagg

SEQ ID NO: 1546583 - RNA, 17 nt, Pseudomonas aeruginosa PA01
gcaagggugcucaggac

SEQ ID NO: 1546584 - RNA, 22 nt, Pseudomonas aeruginosa PA01
gcaagcgguuauucgcccuacc

SEQ ID NO: 1546585 - RNA, 15 nt, Pseudomonas aeruginosa PA01
gcaagcuccccgccg

SEQ ID NO: 1546586 - RNA, 22 nt, Pseudomonas aeruginosa PA01
gcaagcuccccgccgccaggcg

SEQ ID NO: 1546587 - RNA, 13 nt, Pseudomonas aeruginosa PA01
gcaaggagcccuu

SEQ ID NO: 1546588 - RNA, 15 nt, Pseudomonas aeruginosa PA01
gcaaggaccugcugc

SEQ ID NO: 1546589 - RNA, 17 nt, Pseudomonas aeruginosa PA01
gcaaggccgaagaggcc

SEQ ID NO: 1546590 - RNA, 19 nt, Pseudomonas aeruginosa PA01
gcaaggccgaagaggcccu

SEQ ID NO: 1546591 - RNA, 20 nt, Pseudomonas aeruginosa PA01
gcaagaguguucccucagga

SEQ ID NO: 1546592 - RNA, 20 nt, Pseudomonas aeruginosa PA01
gcaagcaccuugagggccuu

SEQ ID NO: 1546593 - RNA, 12 nt, Pseudomonas aeruginosa PA01
gcaagcaggccg

SEQ ID NO: 1546594 - RNA, 15 nt, Pseudomonas aeruginosa PA01
gcaagcaggccgcgg

SEQ ID NO: 1546595 - RNA, 19 nt, Pseudomonas aeruginosa PA01
gcaagcgccggcaacagca

SEQ ID NO: 1546596 - RNA, 14 nt, Pseudomonas aeruginosa PA01
gcaagcgcccggcg

SEQ ID NO: 1546597 - RNA, 21 nt, Pseudomonas aeruginosa PA01
gcaagccguagaacgccagga

SEQ ID NO: 1546598 - RNA, 23 nt, Pseudomonas aeruginosa PA01
gcaagcccgugggaucgccacgc

SEQ ID NO: 1546599 - RNA, 18 nt, Pseudomonas aeruginosa PA01
gcaagcccaagggcuccg

SEQ ID NO: 1546600 - RNA, 20 nt, Pseudomonas aeruginosa PA01
gcaauccguuaccgcgggcu

SEQ ID NO: 1546601 - RNA, 14 nt, Pseudomonas aeruginosa PA01
gcaaucucccccuc

SEQ ID NO: 1546602 - RNA, 15 nt, Pseudomonas aeruginosa PA01
gcaaucugcccggca

SEQ ID NO: 1546603 - RNA, 23 nt, Pseudomonas aeruginosa PA01
gcaaucgacuucccacaaacccc

SEQ ID NO: 1546604 - RNA, 14 nt, Pseudomonas aeruginosa PA01
gcaauccucggugc

SEQ ID NO: 1546605 - RNA, 15 nt, Pseudomonas aeruginosa PA01
gcaauugcuugcgcu

SEQ ID NO: 1546606 - RNA, 21 nt, Pseudomonas aeruginosa PA01
gcaauucgugugggugcuugu

SEQ ID NO: 1546607 - RNA, 17 nt, Pseudomonas aeruginosa PA01
gcaauuccgcagccuug

SEQ ID NO: 1546608 - RNA, 20 nt, Pseudomonas aeruginosa PA01
gcacaggcggaaggccucgg

SEQ ID NO: 1546609 - RNA, 15 nt, Pseudomonas aeruginosa PA01
gcacaggcuggccag

SEQ ID NO: 1546610 - RNA, 16 nt, Pseudomonas aeruginosa PA01
gcacaggcuggccaga

SEQ ID NO: 1546611 - RNA, 22 nt, Pseudomonas aeruginosa PA01
gcacagguugacgaugcggccc

SEQ ID NO: 1546612 - RNA, 19 nt, Pseudomonas aeruginosa PA01
gcacaguacgccuugcagg

SEQ ID NO: 1546613 - RNA, 19 nt, Pseudomonas aeruginosa PA01
gcacagcguggccagcgcc

SEQ ID NO: 1546614 - RNA, 20 nt, Pseudomonas aeruginosa PA01
gcacagccauagcgccggca

SEQ ID NO: 1546615 - RNA, 19 nt, Pseudomonas aeruginosa PA01
gcacagccauagugcuggg

SEQ ID NO: 1546616 - RNA, 23 nt, Pseudomonas aeruginosa PA01
gcacaucaccuucgcccucagca

SEQ ID NO: 1546617 - RNA, 15 nt, Pseudomonas aeruginosa PA01
gcacaacgccuuccu

SEQ ID NO: 1546618 - RNA, 19 nt, Pseudomonas aeruginosa PA01
gcacacggucgagacccgc

SEQ ID NO: 1546619 - RNA, 22 nt, Pseudomonas aeruginosa PA01
gcacacggucgagacccgcaac

SEQ ID NO: 1546620 - RNA, 22 nt, Pseudomonas aeruginosa PA01
gcacacgcccggcacucgccgg

SEQ ID NO: 1546621 - RNA, 17 nt, Pseudomonas aeruginosa PA01
gcacaccgcgcgcgccu

SEQ ID NO: 1546622 - RNA, 15 nt, Pseudomonas aeruginosa PA01
gcaccgccucgugca

SEQ ID NO: 1546623 - RNA, 22 nt, Pseudomonas aeruginosa PA01
gcaccgccucgugcagcaagcc

SEQ ID NO: 1546624 - RNA, 14 nt, Pseudomonas aeruginosa PA01
gcaccgccagcagu

SEQ ID NO: 1546625 - RNA, 14 nt, Pseudomonas aeruginosa PA01
gcaccgcggccagu

SEQ ID NO: 1546626 - RNA, 18 nt, Pseudomonas aeruginosa PA01
gcaccgcgccuuccagcc

SEQ ID NO: 1546627 - RNA, 15 nt, Pseudomonas aeruginosa PA01
gcaccgccugcaacu

SEQ ID NO: 1546628 - RNA, 17 nt, Pseudomonas aeruginosa PA01
gcaccgccugcaacucg

SEQ ID NO: 1546629 - RNA, 15 nt, Pseudomonas aeruginosa PA01
gcaccgccugcagca

SEQ ID NO: 1546630 - RNA, 22 nt, Pseudomonas aeruginosa PA01
gcaccgccugcagcaccaccuc

SEQ ID NO: 1546631 - RNA, 23 nt, Pseudomonas aeruginosa PA01
gcaccgcggcgagccgguagugc

SEQ ID NO: 1546632 - RNA, 16 nt, Pseudomonas aeruginosa PA01
gcaccgcggcgcggau

SEQ ID NO: 1546633 - RNA, 18 nt, Pseudomonas aeruginosa PA01
gcaccgcggcgcggaugu

SEQ ID NO: 1546634 - RNA, 22 nt, Pseudomonas aeruginosa PA01
gcacccggucgaaccccuuccc

SEQ ID NO: 1546635 - RNA, 21 nt, Pseudomonas aeruginosa PA01
gcacccucuuccgcgcugacc

SEQ ID NO: 1546636 - RNA, 22 nt, Pseudomonas aeruginosa PA01
gcacccucuuccgcgcugaccu

SEQ ID NO: 1546637 - RNA, 17 nt, Pseudomonas aeruginosa PA01
gcaccgacacgcacuca

SEQ ID NO: 1546638 - RNA, 17 nt, Pseudomonas aeruginosa PA01
gcaccgagacgcccugg

SEQ ID NO: 1546639 - RNA, 15 nt, Pseudomonas aeruginosa PA01
gcaccgacgccgccu

SEQ ID NO: 1546640 - RNA, 23 nt, Pseudomonas aeruginosa PA01
gcaccgagguagucccagaccac

SEQ ID NO: 1546641 - RNA, 16 nt, Pseudomonas aeruginosa PA01
gcaccgaguugaccag

SEQ ID NO: 1546642 - RNA, 17 nt, Pseudomonas aeruginosa PA01
gcaccgaguugaccagc

SEQ ID NO: 1546643 - RNA, 17 nt, Pseudomonas aeruginosa PA01
gcaccgggaggcgccgc

SEQ ID NO: 1546644 - RNA, 18 nt, Pseudomonas aeruginosa PA01
gcaccggggugauccagc

SEQ ID NO: 1546645 - RNA, 19 nt, Pseudomonas aeruginosa PA01
gcaccggggugauccagcu

SEQ ID NO: 1546646 - RNA, 18 nt, Pseudomonas aeruginosa PA01
gcaccgguucgacacgcu

SEQ ID NO: 1546647 - RNA, 20 nt, Pseudomonas aeruginosa PA01
gcaccgcuucugugggcagc

SEQ ID NO: 1546648 - RNA, 18 nt, Pseudomonas aeruginosa PA01
gcaccgcuugccagccgc

SEQ ID NO: 1546649 - RNA, 16 nt, Pseudomonas aeruginosa PA01
gcaccgcuuucaccag

SEQ ID NO: 1546650 - RNA, 14 nt, Pseudomonas aeruginosa PA01
gcaccggccaggcg

SEQ ID NO: 1546651 - RNA, 16 nt, Pseudomonas aeruginosa PA01
gcaccggcaggacgau

SEQ ID NO: 1546652 - RNA, 21 nt, Pseudomonas aeruginosa PA01
gcaccggccucaagcaagcga

SEQ ID NO: 1546653 - RNA, 16 nt, Pseudomonas aeruginosa PA01
gcaccggcgcgccgga

SEQ ID NO: 1546654 - RNA, 15 nt, Pseudomonas aeruginosa PA01
gcaccggcgauggcc

SEQ ID NO: 1546655 - RNA, 22 nt, Pseudomonas aeruginosa PA01
gcaccggcgauggccggcacca

SEQ ID NO: 1546656 - RNA, 14 nt, Pseudomonas aeruginosa PA01
gcaccggcuucugg

SEQ ID NO: 1546657 - RNA, 21 nt, Pseudomonas aeruginosa PA01
gcaccggcgacgaaagacgcu

SEQ ID NO: 1546658 - RNA, 16 nt, Pseudomonas aeruginosa PA01
gcaccucguccagcag

SEQ ID NO: 1546659 - RNA, 15 nt, Pseudomonas aeruginosa PA01
gcaccugcucggggc

SEQ ID NO: 1546660 - RNA, 18 nt, Pseudomonas aeruginosa PA01
gcaccuggcggucgccgc

SEQ ID NO: 1546661 - RNA, 20 nt, Pseudomonas aeruginosa PA01
gcaccuggcggucgccgccg

SEQ ID NO: 1546662 - RNA, 17 nt, Pseudomonas aeruginosa PA01
gcaccugggcguuggcc

SEQ ID NO: 1546663 - RNA, 19 nt, Pseudomonas aeruginosa PA01
gcaccugggcguuggccag

SEQ ID NO: 1546664 - RNA, 21 nt, Pseudomonas aeruginosa PA01
gcaccugggcguuggccagcg

SEQ ID NO: 1546665 - RNA, 22 nt, Pseudomonas aeruginosa PA01
gcaccugggcguuggccagcgc

SEQ ID NO: 1546666 - RNA, 19 nt, Pseudomonas aeruginosa PA01
gcaccuggcgaugcccugg

SEQ ID NO: 1546667 - RNA, 20 nt, Pseudomonas aeruginosa PA01
gcaccuggcgaugcccuggc

SEQ ID NO: 1546668 - RNA, 21 nt, Pseudomonas aeruginosa PA01
gcaccuggcgaugcccuggcc

SEQ ID NO: 1546669 - RNA, 23 nt, Pseudomonas aeruginosa PA01
gcaccuggcgaugcccuggccgc

SEQ ID NO: 1546670 - RNA, 21 nt, Pseudomonas aeruginosa PA01
gcaccuacuaccgcugggacg

SEQ ID NO: 1546671 - RNA, 19 nt, Pseudomonas aeruginosa PA01
gcaccucgaccgcgccggc

SEQ ID NO: 1546672 - RNA, 22 nt, Pseudomonas aeruginosa PA01
gcaccucgcccuugcugcccag

SEQ ID NO: 1546673 - RNA, 20 nt, Pseudomonas aeruginosa PA01
gcaccacguagccggcgucc

SEQ ID NO: 1546674 - RNA, 15 nt, Pseudomonas aeruginosa PA01
gcaccacgugcagca

SEQ ID NO: 1546675 - RNA, 22 nt, Pseudomonas aeruginosa PA01
gcaccacugcaacacuuccuuc

SEQ ID NO: 1546676 - RNA, 14 nt, Pseudomonas aeruginosa PA01
gcaccagcaggccg

SEQ ID NO: 1546677 - RNA, 22 nt, Pseudomonas aeruginosa PA01
gcaccagcaggccgaucaccag

SEQ ID NO: 1546678 - RNA, 16 nt, Pseudomonas aeruginosa PA01
gcaccagcaggcgaca

SEQ ID NO: 1546679 - RNA, 24 nt, Pseudomonas aeruginosa PA01
gcaccagcaggucggcgcgacggc

SEQ ID NO: 1546680 - RNA, 12 nt, Pseudomonas aeruginosa PA01
gcaccagccuuc

SEQ ID NO: 1546681 - RNA, 23 nt, Pseudomonas aeruginosa PA01
gcaccagccaguccggcagcacg

SEQ ID NO: 1546682 - RNA, 16 nt, Pseudomonas aeruginosa PA01
gcaccaggccgccaug

SEQ ID NO: 1546683 - RNA, 16 nt, Pseudomonas aeruginosa PA01
gcaccaggaagcccca

SEQ ID NO: 1546684 - RNA, 12 nt, Pseudomonas aeruginosa PA01
gcaccaggccag

SEQ ID NO: 1546685 - RNA, 14 nt, Pseudomonas aeruginosa PA01
gcaccaggccaggc

SEQ ID NO: 1546686 - RNA, 14 nt, Pseudomonas aeruginosa PA01
gcaccaggccaggu

SEQ ID NO: 1546687 - RNA, 14 nt, Pseudomonas aeruginosa PA01
gcaccaggccuccc

SEQ ID NO: 1546688 - RNA, 16 nt, Pseudomonas aeruginosa PA01
gcaccaggccucccag

SEQ ID NO: 1546689 - RNA, 17 nt, Pseudomonas aeruginosa PA01
gcaccacccggccgcgc

SEQ ID NO: 1546690 - RNA, 19 nt, Pseudomonas aeruginosa PA01
gcaccacccaucugccggc

SEQ ID NO: 1546691 - RNA, 14 nt, Pseudomonas aeruginosa PA01
gcaccaccagcgcg

SEQ ID NO: 1546692 - RNA, 18 nt, Pseudomonas aeruginosa PA01
gcaccaccagcgcgcgcu

SEQ ID NO: 1546693 - RNA, 21 nt, Pseudomonas aeruginosa PA01
gcaccaccagcgcgcgcuggc

SEQ ID NO: 1546694 - RNA, 18 nt, Pseudomonas aeruginosa PA01
gcaccaccgccgccagca

SEQ ID NO: 1546695 - RNA, 12 nt, Pseudomonas aeruginosa PA01
gcaccaccuggc

SEQ ID NO: 1546696 - RNA, 16 nt, Pseudomonas aeruginosa PA01
gcaccaccucgccaag

SEQ ID NO: 1546697 - RNA, 17 nt, Pseudomonas aeruginosa PA01
gcaccaccucgccaagc

SEQ ID NO: 1546698 - RNA, 20 nt, Pseudomonas aeruginosa PA01
gcaccacgcgcaagccagcc

SEQ ID NO: 1546699 - RNA, 16 nt, Pseudomonas aeruginosa PA01
gcaccacgccgcuggc

SEQ ID NO: 1546700 - RNA, 16 nt, Pseudomonas aeruginosa PA01
gcaccaguggcgccgc

SEQ ID NO: 1546701 - RNA, 16 nt, Pseudomonas aeruginosa PA01
gcaccagucccuggcc

SEQ ID NO: 1546702 - RNA, 15 nt, Pseudomonas aeruginosa PA01
gcaccagcgggaugu

SEQ ID NO: 1546703 - RNA, 17 nt, Pseudomonas aeruginosa PA01
gcaccaggcuggccagu

SEQ ID NO: 1546704 - RNA, 22 nt, Pseudomonas aeruginosa PA01
gcaccaggcucgccccggcggc

SEQ ID NO: 1546705 - RNA, 14 nt, Pseudomonas aeruginosa PA01
gcaccaucagccag

SEQ ID NO: 1546706 - RNA, 23 nt, Pseudomonas aeruginosa PA01
gcacccagaccuuccagccgcgc

SEQ ID NO: 1546707 - RNA, 22 nt, Pseudomonas aeruginosa PA01
gcacccaggauuuguccgcgcc

SEQ ID NO: 1546708 - RNA, 21 nt, Pseudomonas aeruginosa PA01
gcaccaugcccuuguccggcc

SEQ ID NO: 1546709 - RNA, 14 nt, Pseudomonas aeruginosa PA01
gcacccggcccaug

SEQ ID NO: 1546710 - RNA, 13 nt, Pseudomonas aeruginosa PA01
gcacccggcuggg

SEQ ID NO: 1546711 - RNA, 19 nt, Pseudomonas aeruginosa PA01
gcacccgggcgaccugcuc

SEQ ID NO: 1546712 - RNA, 15 nt, Pseudomonas aeruginosa PA01
gcacccgcaccagcc

SEQ ID NO: 1546713 - RNA, 18 nt, Pseudomonas aeruginosa PA01
gcacccgcaccagccggc

SEQ ID NO: 1546714 - RNA, 20 nt, Pseudomonas aeruginosa PA01
gcacccgcaccagccggcgc

SEQ ID NO: 1546715 - RNA, 11 nt, Pseudomonas aeruginosa PA01
gcaccccuucg

SEQ ID NO: 1546716 - RNA, 19 nt, Pseudomonas aeruginosa PA01
gcaccccuugcagccagcc

SEQ ID NO: 1546717 - RNA, 18 nt, Pseudomonas aeruginosa PA01
gcacgccgaaguccugca

SEQ ID NO: 1546718 - RNA, 20 nt, Pseudomonas aeruginosa PA01
gcacgccgagcaacggcagc

SEQ ID NO: 1546719 - RNA, 21 nt, Pseudomonas aeruginosa PA01
gcacgccccauccgggcggcg

SEQ ID NO: 1546720 - RNA, 12 nt, Pseudomonas aeruginosa PA01
gcacgcccaggc

SEQ ID NO: 1546721 - RNA, 14 nt, Pseudomonas aeruginosa PA01
gcacgcauagcgcg

SEQ ID NO: 1546722 - RNA, 18 nt, Pseudomonas aeruginosa PA01
gcacgcaggccgcugccu

SEQ ID NO: 1546723 - RNA, 21 nt, Pseudomonas aeruginosa PA01
gcacgcaauggcgcagccgcu

SEQ ID NO: 1546724 - RNA, 15 nt, Pseudomonas aeruginosa PA01
gcacgaugcacaggc

SEQ ID NO: 1546725 - RNA, 20 nt, Pseudomonas aeruginosa PA01
gcacgagcuuggccacuccg

SEQ ID NO: 1546726 - RNA, 19 nt, Pseudomonas aeruginosa PA01
gcaccuucaucaccagguc

SEQ ID NO: 1546727 - RNA, 17 nt, Pseudomonas aeruginosa PA01
gcaccuguuccagcaac

SEQ ID NO: 1546728 - RNA, 22 nt, Pseudomonas aeruginosa PA01
gcaccugguggacacccugcug

SEQ ID NO: 1546729 - RNA, 20 nt, Pseudomonas aeruginosa PA01
gcaccugggugcuuuccugc

SEQ ID NO: 1546730 - RNA, 13 nt, Pseudomonas aeruginosa PA01
gcacgaaagccau

SEQ ID NO: 1546731 - RNA, 14 nt, Pseudomonas aeruginosa PA01
gcaccuugcccugc

SEQ ID NO: 1546732 - RNA, 18 nt, Pseudomonas aeruginosa PA01
gcaccuugcgaaaagccc

SEQ ID NO: 1546733 - RNA, 21 nt, Pseudomonas aeruginosa PA01
gcaccuugcgaaaagcccgcc

SEQ ID NO: 1546734 - RNA, 19 nt, Pseudomonas aeruginosa PA01
gcacgaauuuccuggcgcg

SEQ ID NO: 1546735 - RNA, 15 nt, Pseudomonas aeruginosa PA01
gcacgaacagggucu

SEQ ID NO: 1546736 - RNA, 22 nt, Pseudomonas aeruginosa PA01
gcacgaacaggugcugguggcc

SEQ ID NO: 1546737 - RNA, 20 nt, Pseudomonas aeruginosa PA01
gcacgacgccggugccagga

SEQ ID NO: 1546738 - RNA, 15 nt, Pseudomonas aeruginosa PA01
gcacgguagccgccc

SEQ ID NO: 1546739 - RNA, 19 nt, Pseudomonas aeruginosa PA01
gcacgguccgcgaaccgcu

SEQ ID NO: 1546740 - RNA, 17 nt, Pseudomonas aeruginosa PA01
gcacggucauggccagc

SEQ ID NO: 1546741 - RNA, 24 nt, Pseudomonas aeruginosa PA01
gcacggucauggccagcucgaccu

SEQ ID NO: 1546742 - RNA, 22 nt, Pseudomonas aeruginosa PA01
gcacgguguuguggcuggccuc

SEQ ID NO: 1546743 - RNA, 23 nt, Pseudomonas aeruginosa PA01
gcacgggauuuccgauccuccug

SEQ ID NO: 1546744 - RNA, 19 nt, Pseudomonas aeruginosa PA01
gcacggcgaacaccgggcc

SEQ ID NO: 1546745 - RNA, 22 nt, Pseudomonas aeruginosa PA01
gcacggccucgcgugcgcuggu

SEQ ID NO: 1546746 - RNA, 15 nt, Pseudomonas aeruginosa PA01
gcacggccugcaccu

SEQ ID NO: 1546747 - RNA, 13 nt, Pseudomonas aeruginosa PA01
gcacggccaggcc

SEQ ID NO: 1546748 - RNA, 15 nt, Pseudomonas aeruginosa PA01
gcacggaucgcgcug

SEQ ID NO: 1546749 - RNA, 23 nt, Pseudomonas aeruginosa PA01
gcacggaucgcgcugggcgcagc

SEQ ID NO: 1546750 - RNA, 18 nt, Pseudomonas aeruginosa PA01
gcacgccgguggccaggc

SEQ ID NO: 1546751 - RNA, 20 nt, Pseudomonas aeruginosa PA01
gcacgccgugcagggucagg

SEQ ID NO: 1546752 - RNA, 15 nt, Pseudomonas aeruginosa PA01
gcacgcgccgggucg

SEQ ID NO: 1546753 - RNA, 13 nt, Pseudomonas aeruginosa PA01
gcacgcucaggca

SEQ ID NO: 1546754 - RNA, 15 nt, Pseudomonas aeruginosa PA01
gcacgcucaggcagc

SEQ ID NO: 1546755 - RNA, 18 nt, Pseudomonas aeruginosa PA01
gcacgcuccagggcggcc

SEQ ID NO: 1546756 - RNA, 19 nt, Pseudomonas aeruginosa PA01
gcacgcuccagggcggccc

SEQ ID NO: 1546757 - RNA, 17 nt, Pseudomonas aeruginosa PA01
gcacgcugccagcaggc

SEQ ID NO: 1546758 - RNA, 16 nt, Pseudomonas aeruginosa PA01
gcacgcugccgccgau

SEQ ID NO: 1546759 - RNA, 20 nt, Pseudomonas aeruginosa PA01
gcacgcugcuugcgcaccuc

SEQ ID NO: 1546760 - RNA, 22 nt, Pseudomonas aeruginosa PA01
gcacggauaccacccgcagccc

SEQ ID NO: 1546761 - RNA, 22 nt, Pseudomonas aeruginosa PA01
gcacgcuggugaugucgcggca

SEQ ID NO: 1546762 - RNA, 23 nt, Pseudomonas aeruginosa PA01
gcacgcuggugaugucgcggcag

SEQ ID NO: 1546763 - RNA, 21 nt, Pseudomonas aeruginosa PA01
gcacugagggucagccgcagg

SEQ ID NO: 1546764 - RNA, 23 nt, Pseudomonas aeruginosa PA01
gcacugagggucagccgcaggcc

SEQ ID NO: 1546765 - RNA, 18 nt, Pseudomonas aeruginosa PA01
gcacucgcuccuccgggc

SEQ ID NO: 1546766 - RNA, 12 nt, Pseudomonas aeruginosa PA01
gcacucuuccug

SEQ ID NO: 1546767 - RNA, 14 nt, Pseudomonas aeruginosa PA01
gcacucauagcuca

SEQ ID NO: 1546768 - RNA, 19 nt, Pseudomonas aeruginosa PA01
gcacucauagcucagcugg

SEQ ID NO: 1546769 - RNA, 20 nt, Pseudomonas aeruginosa PA01
gcacucauagcucagcugga

SEQ ID NO: 1546770 - RNA, 15 nt, Pseudomonas aeruginosa PA01
gcacucagccagcgg

SEQ ID NO: 1546771 - RNA, 16 nt, Pseudomonas aeruginosa PA01
gcacucagccagcggc

SEQ ID NO: 1546772 - RNA, 22 nt, Pseudomonas aeruginosa PA01
gcacucaggaaaaaacgccggu

SEQ ID NO: 1546773 - RNA, 14 nt, Pseudomonas aeruginosa PA01
gcacucgccgggcg

SEQ ID NO: 1546774 - RNA, 19 nt, Pseudomonas aeruginosa PA01
gcacucgaugaacagcgcg

SEQ ID NO: 1546775 - RNA, 22 nt, Pseudomonas aeruginosa PA01
gcacgucgagguagaacaggcu

SEQ ID NO: 1546776 - RNA, 21 nt, Pseudomonas aeruginosa PA01
gcacgucgauauccagcggca

SEQ ID NO: 1546777 - RNA, 13 nt, Pseudomonas aeruginosa PA01
gcacgugcagcgg

SEQ ID NO: 1546778 - RNA, 17 nt, Pseudomonas aeruginosa PA01
gcacguacguccagggc

SEQ ID NO: 1546779 - RNA, 23 nt, Pseudomonas aeruginosa PA01
gcacguugcugugcugcaccagc

SEQ ID NO: 1546780 - RNA, 20 nt, Pseudomonas aeruginosa PA01
gcacuuccacuccaggcggc

SEQ ID NO: 1546781 - RNA, 23 nt, Pseudomonas aeruginosa PA01
gcacuuccacuccaggcggcggu

SEQ ID NO: 1546782 - RNA, 23 nt, Pseudomonas aeruginosa PA01
gcacuuccggacugcccagcgcc

SEQ ID NO: 1546783 - RNA, 13 nt, Pseudomonas aeruginosa PA01
gcacuucgaccag

SEQ ID NO: 1546784 - RNA, 19 nt, Pseudomonas aeruginosa PA01
gcacuucggcgcgcggcag

SEQ ID NO: 1546785 - RNA, 23 nt, Pseudomonas aeruginosa PA01
gcacugcguggguagccauggcg

SEQ ID NO: 1546786 - RNA, 20 nt, Pseudomonas aeruginosa PA01
gcacugguggcgaacagcac

SEQ ID NO: 1546787 - RNA, 20 nt, Pseudomonas aeruginosa PA01
gcacuggucggccaguuccu

SEQ ID NO: 1546788 - RNA, 21 nt, Pseudomonas aeruginosa PA01
gcacuggucggccaguuccuu

SEQ ID NO: 1546789 - RNA, 22 nt, Pseudomonas aeruginosa PA01
gcagaguuucucggucgccgcc

SEQ ID NO: 1546790 - RNA, 14 nt, Pseudomonas aeruginosa PA01
gcagagcaucaccc

SEQ ID NO: 1546791 - RNA, 16 nt, Pseudomonas aeruginosa PA01
gcagagaucggcggcg

SEQ ID NO: 1546792 - RNA, 14 nt, Pseudomonas aeruginosa PA01
gcagagcgccagcc

SEQ ID NO: 1546793 - RNA, 23 nt, Pseudomonas aeruginosa PA01
gcagagcgccagccagcgcggcu

SEQ ID NO: 1546794 - RNA, 14 nt, Pseudomonas aeruginosa PA01
gcagagcgccauga

SEQ ID NO: 1546795 - RNA, 22 nt, Pseudomonas aeruginosa PA01
gcagagcuggaagucguccagc

SEQ ID NO: 1546796 - RNA, 17 nt, Pseudomonas aeruginosa PA01
gcagagggucgccagcg

SEQ ID NO: 1546797 - RNA, 18 nt, Pseudomonas aeruginosa PA01
gcagagggcguccugcuu

SEQ ID NO: 1546798 - RNA, 16 nt, Pseudomonas aeruginosa PA01
gcagaugaucgccacc

SEQ ID NO: 1546799 - RNA, 13 nt, Pseudomonas aeruginosa PA01
gcagauguccagg

SEQ ID NO: 1546800 - RNA, 15 nt, Pseudomonas aeruginosa PA01
gcagauguccaggca

SEQ ID NO: 1546801 - RNA, 14 nt, Pseudomonas aeruginosa PA01
gcagaucgccgcgu

SEQ ID NO: 1546802 - RNA, 21 nt, Pseudomonas aeruginosa PA01
gcagaucgcgccgagcuggcg

SEQ ID NO: 1546803 - RNA, 15 nt, Pseudomonas aeruginosa PA01
gcagaucgcguccag

SEQ ID NO: 1546804 - RNA, 18 nt, Pseudomonas aeruginosa PA01
gcagaucgcguccagggu

SEQ ID NO: 1546805 - RNA, 18 nt, Pseudomonas aeruginosa PA01
gcagaucgcggcgcaggc

SEQ ID NO: 1546806 - RNA, 21 nt, Pseudomonas aeruginosa PA01
gcagaucggugcgggcagaca

SEQ ID NO: 1546807 - RNA, 16 nt, Pseudomonas aeruginosa PA01
gcagaccuggugggcg

SEQ ID NO: 1546808 - RNA, 16 nt, Pseudomonas aeruginosa PA01
gcagaccugcagcagg

SEQ ID NO: 1546809 - RNA, 17 nt, Pseudomonas aeruginosa PA01
gcagaccugcagcagga

SEQ ID NO: 1546810 - RNA, 18 nt, Pseudomonas aeruginosa PA01
gcagacaggccuccagca

SEQ ID NO: 1546811 - RNA, 24 nt, Pseudomonas aeruginosa PA01
gcagaccagcagcgcaccauccuc

SEQ ID NO: 1546812 - RNA, 22 nt, Pseudomonas aeruginosa PA01
gcagaccagcgcaagcggcggc

SEQ ID NO: 1546813 - RNA, 19 nt, Pseudomonas aeruginosa PA01
gcagaccaggccgagcagg

SEQ ID NO: 1546814 - RNA, 21 nt, Pseudomonas aeruginosa PA01
gcagaccaggccgagcaggaa

SEQ ID NO: 1546815 - RNA, 21 nt, Pseudomonas aeruginosa PA01
gcagacgguucagcagcggca

SEQ ID NO: 1546816 - RNA, 17 nt, Pseudomonas aeruginosa PA01
gcagacgggugcugaag

SEQ ID NO: 1546817 - RNA, 18 nt, Pseudomonas aeruginosa PA01
gcagacgggugcugaaga

SEQ ID NO: 1546818 - RNA, 20 nt, Pseudomonas aeruginosa PA01
gcagaagcuuucccauuguu

SEQ ID NO: 1546819 - RNA, 20 nt, Pseudomonas aeruginosa PA01
gcagaagacgcccagcaggg

SEQ ID NO: 1546820 - RNA, 19 nt, Pseudomonas aeruginosa PA01
gcagaacugccgggccagc

SEQ ID NO: 1546821 - RNA, 15 nt, Pseudomonas aeruginosa PA01
gcagaaccgccagca

SEQ ID NO: 1546822 - RNA, 23 nt, Pseudomonas aeruginosa PA01
gcagcaucucggugcgccccagg

SEQ ID NO: 1546823 - RNA, 19 nt, Pseudomonas aeruginosa PA01
gcagcaugaugccgaggcg

SEQ ID NO: 1546824 - RNA, 21 nt, Pseudomonas aeruginosa PA01
gcagcaugaugccgaggcggc

SEQ ID NO: 1546825 - RNA, 20 nt, Pseudomonas aeruginosa PA01
gcagcaggucgagcaguucc

SEQ ID NO: 1546826 - RNA, 18 nt, Pseudomonas aeruginosa PA01
gcagcagguuccuccugg

SEQ ID NO: 1546827 - RNA, 21 nt, Pseudomonas aeruginosa PA01
gcagcagguagugcucggcca

SEQ ID NO: 1546828 - RNA, 22 nt, Pseudomonas aeruginosa PA01
gcagcagguagugcucggccag

SEQ ID NO: 1546829 - RNA, 23 nt, Pseudomonas aeruginosa PA01
gcagcagguagugcucggccagu

SEQ ID NO: 1546830 - RNA, 19 nt, Pseudomonas aeruginosa PA01
gcagcagcgccuucaccgu

SEQ ID NO: 1546831 - RNA, 13 nt, Pseudomonas aeruginosa PA01
gcagcagcgaccu

SEQ ID NO: 1546832 - RNA, 21 nt, Pseudomonas aeruginosa PA01
gcagcagcggauauucgacgc

SEQ ID NO: 1546833 - RNA, 12 nt, Pseudomonas aeruginosa PA01
gcagcagcggca

SEQ ID NO: 1546834 - RNA, 20 nt, Pseudomonas aeruginosa PA01
gcagcaggcuguacagcagg

SEQ ID NO: 1546835 - RNA, 23 nt, Pseudomonas aeruginosa PA01
gcagcaggcuguacagcaggagc

SEQ ID NO: 1546836 - RNA, 20 nt, Pseudomonas aeruginosa PA01
gcagcaggccggcgaccagc

SEQ ID NO: 1546837 - RNA, 18 nt, Pseudomonas aeruginosa PA01
gcagcaggaucagcgcau

SEQ ID NO: 1546838 - RNA, 16 nt, Pseudomonas aeruginosa PA01
gcagcaggcacagggc

SEQ ID NO: 1546839 - RNA, 17 nt, Pseudomonas aeruginosa PA01
gcagccagccucaggua

SEQ ID NO: 1546840 - RNA, 14 nt, Pseudomonas aeruginosa PA01
gcagccauggcugg

SEQ ID NO: 1546841 - RNA, 16 nt, Pseudomonas aeruginosa PA01
gcagccacccagcagc

SEQ ID NO: 1546842 - RNA, 15 nt, Pseudomonas aeruginosa PA01
gcagccagcacaugc

SEQ ID NO: 1546843 - RNA, 22 nt, Pseudomonas aeruginosa PA01
gcagccaggcgaagcggcuggc

SEQ ID NO: 1546844 - RNA, 22 nt, Pseudomonas aeruginosa PA01
gcagccaggcgauggugcgcuc

SEQ ID NO: 1546845 - RNA, 18 nt, Pseudomonas aeruginosa PA01
gcagccacucggccaggc

SEQ ID NO: 1546846 - RNA, 19 nt, Pseudomonas aeruginosa PA01
gcagccacucggccaggcg

SEQ ID NO: 1546847 - RNA, 18 nt, Pseudomonas aeruginosa PA01
gcagcaugccgcucugcc

SEQ ID NO: 1546848 - RNA, 17 nt, Pseudomonas aeruginosa PA01
gcagcaugucgccgggg

SEQ ID NO: 1546849 - RNA, 20 nt, Pseudomonas aeruginosa PA01
gcagcaugggauggcgcggu

SEQ ID NO: 1546850 - RNA, 15 nt, Pseudomonas aeruginosa PA01
gcagcagagcgccac

SEQ ID NO: 1546851 - RNA, 14 nt, Pseudomonas aeruginosa PA01
gcagcaccgcgagc

SEQ ID NO: 1546852 - RNA, 17 nt, Pseudomonas aeruginosa PA01
gcagcaccaucagccag

SEQ ID NO: 1546853 - RNA, 21 nt, Pseudomonas aeruginosa PA01
gcagcacccgcaccagccggc

SEQ ID NO: 1546854 - RNA, 22 nt, Pseudomonas aeruginosa PA01
gcagcacccgcaccagccggcg

SEQ ID NO: 1546855 - RNA, 15 nt, Pseudomonas aeruginosa PA01
gcagcacgaugaggc

SEQ ID NO: 1546856 - RNA, 14 nt, Pseudomonas aeruginosa PA01
gcagcacgcuggcg

SEQ ID NO: 1546857 - RNA, 21 nt, Pseudomonas aeruginosa PA01
gcagcacgcccugggacaggc

SEQ ID NO: 1546858 - RNA, 13 nt, Pseudomonas aeruginosa PA01
gcagcaccaccuc

SEQ ID NO: 1546859 - RNA, 15 nt, Pseudomonas aeruginosa PA01
gcagcaccaggccau

SEQ ID NO: 1546860 - RNA, 13 nt, Pseudomonas aeruginosa PA01
gcagcaccaggcu

SEQ ID NO: 1546861 - RNA, 16 nt, Pseudomonas aeruginosa PA01
gcagcaccaggcuggc

SEQ ID NO: 1546862 - RNA, 18 nt, Pseudomonas aeruginosa PA01
gcagcacccccagcaggc

SEQ ID NO: 1546863 - RNA, 19 nt, Pseudomonas aeruginosa PA01
gcagcaacagcgccgcgcg

SEQ ID NO: 1546864 - RNA, 15 nt, Pseudomonas aeruginosa PA01
gcagcaacuggucgc

SEQ ID NO: 1546865 - RNA, 14 nt, Pseudomonas aeruginosa PA01
gcagcaagccgaug

SEQ ID NO: 1546866 - RNA, 15 nt, Pseudomonas aeruginosa PA01
gcagcaagccgcagc

SEQ ID NO: 1546867 - RNA, 16 nt, Pseudomonas aeruginosa PA01
gcagcaagccgcagcg

SEQ ID NO: 1546868 - RNA, 14 nt, Pseudomonas aeruginosa PA01
gcagcaacccggcc

SEQ ID NO: 1546869 - RNA, 20 nt, Pseudomonas aeruginosa PA01
gcagcccggucacgccggga

SEQ ID NO: 1546870 - RNA, 18 nt, Pseudomonas aeruginosa PA01
gcagcccgguccguccag

SEQ ID NO: 1546871 - RNA, 21 nt, Pseudomonas aeruginosa PA01
gcagcccuggcguggccggcg

SEQ ID NO: 1546872 - RNA, 16 nt, Pseudomonas aeruginosa PA01
gcagcccagcgcuucc

SEQ ID NO: 1546873 - RNA, 14 nt, Pseudomonas aeruginosa PA01
gcagccgcaaggcc

SEQ ID NO: 1546874 - RNA, 20 nt, Pseudomonas aeruginosa PA01
gcagccgcaaggccagggcg

SEQ ID NO: 1546875 - RNA, 14 nt, Pseudomonas aeruginosa PA01
gcagccgccgcggc

SEQ ID NO: 1546876 - RNA, 14 nt, Pseudomonas aeruginosa PA01
gcagccgcucggcc

SEQ ID NO: 1546877 - RNA, 17 nt, Pseudomonas aeruginosa PA01
gcagccgcucggccgcc

SEQ ID NO: 1546878 - RNA, 21 nt, Pseudomonas aeruginosa PA01
gcagccgcucggccgccagca

SEQ ID NO: 1546879 - RNA, 19 nt, Pseudomonas aeruginosa PA01
gcagcgaccaccaccaggu

SEQ ID NO: 1546880 - RNA, 19 nt, Pseudomonas aeruginosa PA01
gcagcgacacaacgcugca

SEQ ID NO: 1546881 - RNA, 15 nt, Pseudomonas aeruginosa PA01
gcagcgaucagcacc

SEQ ID NO: 1546882 - RNA, 17 nt, Pseudomonas aeruginosa PA01
gcagcgaucgccgccau

SEQ ID NO: 1546883 - RNA, 18 nt, Pseudomonas aeruginosa PA01
gcagcgaucgccgccauu

SEQ ID NO: 1546884 - RNA, 18 nt, Pseudomonas aeruginosa PA01
gcagcgcaagucggccug

SEQ ID NO: 1546885 - RNA, 15 nt, Pseudomonas aeruginosa PA01
gcagccucagcgaca

SEQ ID NO: 1546886 - RNA, 20 nt, Pseudomonas aeruginosa PA01
gcagccuggcgucgcacugc

SEQ ID NO: 1546887 - RNA, 21 nt, Pseudomonas aeruginosa PA01
gcagccuuuuuugugcccgcc

SEQ ID NO: 1546888 - RNA, 12 nt, Pseudomonas aeruginosa PA01
gcagccggggcu

SEQ ID NO: 1546889 - RNA, 18 nt, Pseudomonas aeruginosa PA01
gcagccggggcucaggcc

SEQ ID NO: 1546890 - RNA, 16 nt, Pseudomonas aeruginosa PA01
gcagccgggccgcagc

SEQ ID NO: 1546891 - RNA, 23 nt, Pseudomonas aeruginosa PA01
gcagccgguggucuucagcacau

SEQ ID NO: 1546892 - RNA, 17 nt, Pseudomonas aeruginosa PA01
gcagccguugccccaga

SEQ ID NO: 1546893 - RNA, 16 nt, Pseudomonas aeruginosa PA01
gcagccguuggccagc

SEQ ID NO: 1546894 - RNA, 17 nt, Pseudomonas aeruginosa PA01
gcagccguuggccagca

SEQ ID NO: 1546895 - RNA, 16 nt, Pseudomonas aeruginosa PA01
gcagccguuggcguca

SEQ ID NO: 1546896 - RNA, 13 nt, Pseudomonas aeruginosa PA01
gcagcgccgcgcg

SEQ ID NO: 1546897 - RNA, 15 nt, Pseudomonas aeruginosa PA01
gcagcgccgcgcggc

SEQ ID NO: 1546898 - RNA, 12 nt, Pseudomonas aeruginosa PA01
gcagcgccgcga

SEQ ID NO: 1546899 - RNA, 14 nt, Pseudomonas aeruginosa PA01
gcagcgccgagguc

SEQ ID NO: 1546900 - RNA, 13 nt, Pseudomonas aeruginosa PA01
gcagcgccgcccu

SEQ ID NO: 1546901 - RNA, 14 nt, Pseudomonas aeruginosa PA01
gcagcgccgcccug

SEQ ID NO: 1546902 - RNA, 16 nt, Pseudomonas aeruginosa PA01
gcagcgccgccgggcg

SEQ ID NO: 1546903 - RNA, 15 nt, Pseudomonas aeruginosa PA01
gcagcgccccuccca

SEQ ID NO: 1546904 - RNA, 15 nt, Pseudomonas aeruginosa PA01
gcagcgccgccagca

SEQ ID NO: 1546905 - RNA, 17 nt, Pseudomonas aeruginosa PA01
gcagcgccgccagcagg

SEQ ID NO: 1546906 - RNA, 18 nt, Pseudomonas aeruginosa PA01
gcagcgccgccagcagga

SEQ ID NO: 1546907 - RNA, 19 nt, Pseudomonas aeruginosa PA01
gcagcgccgccagcaggau

SEQ ID NO: 1546908 - RNA, 16 nt, Pseudomonas aeruginosa PA01
gcagcgccccagcacc

SEQ ID NO: 1546909 - RNA, 15 nt, Pseudomonas aeruginosa PA01
gcagcgccaccagga

SEQ ID NO: 1546910 - RNA, 13 nt, Pseudomonas aeruginosa PA01
gcagcgccgggca

SEQ ID NO: 1546911 - RNA, 23 nt, Pseudomonas aeruginosa PA01
gcagcgcgauaucgcaggccagg

SEQ ID NO: 1546912 - RNA, 16 nt, Pseudomonas aeruginosa PA01
gcagcgcuagcgcaug

SEQ ID NO: 1546913 - RNA, 14 nt, Pseudomonas aeruginosa PA01
gcagcgcgggggcu

SEQ ID NO: 1546914 - RNA, 23 nt, Pseudomonas aeruginosa PA01
gcagcgcggucauccgcccugcg

SEQ ID NO: 1546915 - RNA, 13 nt, Pseudomonas aeruginosa PA01
gcagcgcgcggcc

SEQ ID NO: 1546916 - RNA, 14 nt, Pseudomonas aeruginosa PA01
gcagcgcgcggcca

SEQ ID NO: 1546917 - RNA, 15 nt, Pseudomonas aeruginosa PA01
gcagcgcgcggccag

SEQ ID NO: 1546918 - RNA, 16 nt, Pseudomonas aeruginosa PA01
gcagcgcgcggccagu

SEQ ID NO: 1546919 - RNA, 14 nt, Pseudomonas aeruginosa PA01
gcagcgcgcggcuc

SEQ ID NO: 1546920 - RNA, 15 nt, Pseudomonas aeruginosa PA01
gcagcgcgcgcuggu

SEQ ID NO: 1546921 - RNA, 13 nt, Pseudomonas aeruginosa PA01
gcagcgcggcggc

SEQ ID NO: 1546922 - RNA, 21 nt, Pseudomonas aeruginosa PA01
gcagcgcggcggcggccagca

SEQ ID NO: 1546923 - RNA, 14 nt, Pseudomonas aeruginosa PA01
gcagcggccaggga

SEQ ID NO: 1546924 - RNA, 19 nt, Pseudomonas aeruginosa PA01
gcagcggcaugcccugccg

SEQ ID NO: 1546925 - RNA, 14 nt, Pseudomonas aeruginosa PA01
gcagcggcagcggc

SEQ ID NO: 1546926 - RNA, 19 nt, Pseudomonas aeruginosa PA01
gcagcggcaggccacggcc

SEQ ID NO: 1546927 - RNA, 19 nt, Pseudomonas aeruginosa PA01
gcagcggcacgcucuggcc

SEQ ID NO: 1546928 - RNA, 15 nt, Pseudomonas aeruginosa PA01
gcagcggaagcccug

SEQ ID NO: 1546929 - RNA, 17 nt, Pseudomonas aeruginosa PA01
gcagcggaagcccugcu

SEQ ID NO: 1546930 - RNA, 20 nt, Pseudomonas aeruginosa PA01
gcagcgcuuguagcagccgc

SEQ ID NO: 1546931 - RNA, 23 nt, Pseudomonas aeruginosa PA01
gcagcgcuuguagcagccgcagg

SEQ ID NO: 1546932 - RNA, 17 nt, Pseudomonas aeruginosa PA01
gcagcggaucggcggug

SEQ ID NO: 1546933 - RNA, 20 nt, Pseudomonas aeruginosa PA01
gcagcggcaaaggcccggcg

SEQ ID NO: 1546934 - RNA, 15 nt, Pseudomonas aeruginosa PA01
gcagcggcccuugcc

SEQ ID NO: 1546935 - RNA, 17 nt, Pseudomonas aeruginosa PA01
gcagcggcgcgccaugc

SEQ ID NO: 1546936 - RNA, 18 nt, Pseudomonas aeruginosa PA01
gcagcggcgucugccgcu

SEQ ID NO: 1546937 - RNA, 22 nt, Pseudomonas aeruginosa PA01
gcagcggcgugaagccgccgcc

SEQ ID NO: 1546938 - RNA, 14 nt, Pseudomonas aeruginosa PA01
gcagcgucucagcc

SEQ ID NO: 1546939 - RNA, 22 nt, Pseudomonas aeruginosa PA01
gcagcgucucggcugccgccag

SEQ ID NO: 1546940 - RNA, 19 nt, Pseudomonas aeruginosa PA01
gcagcgucgagcuggcgca

SEQ ID NO: 1546941 - RNA, 16 nt, Pseudomonas aeruginosa PA01
gcagcgucgcgcgucc

SEQ ID NO: 1546942 - RNA, 22 nt, Pseudomonas aeruginosa PA01
gcagcucggugagcaggcgccg

SEQ ID NO: 1546943 - RNA, 21 nt, Pseudomonas aeruginosa PA01
gcagcucggcacgcagcagcu

SEQ ID NO: 1546944 - RNA, 21 nt, Pseudomonas aeruginosa PA01
gcagcucgcuaugcagcaggu

SEQ ID NO: 1546945 - RNA, 18 nt, Pseudomonas aeruginosa PA01
gcagcucggccgagggca

SEQ ID NO: 1546946 - RNA, 15 nt, Pseudomonas aeruginosa PA01
gcagcucggccuggu

SEQ ID NO: 1546947 - RNA, 14 nt, Pseudomonas aeruginosa PA01
gcagcuccuggucg

SEQ ID NO: 1546948 - RNA, 14 nt, Pseudomonas aeruginosa PA01
gcagcucgccggcg

SEQ ID NO: 1546949 - RNA, 17 nt, Pseudomonas aeruginosa PA01
gcagcucgccggcgucc

SEQ ID NO: 1546950 - RNA, 13 nt, Pseudomonas aeruginosa PA01
gcaggcacccgcg

SEQ ID NO: 1546951 - RNA, 16 nt, Pseudomonas aeruginosa PA01
gcaggcacgcugccag

SEQ ID NO: 1546952 - RNA, 20 nt, Pseudomonas aeruginosa PA01
gcaggcacgcugccagcagg

SEQ ID NO: 1546953 - RNA, 21 nt, Pseudomonas aeruginosa PA01
gcaggcacgcugccagcaggc

SEQ ID NO: 1546954 - RNA, 21 nt, Pseudomonas aeruginosa PA01
gcaggcaguggcgccagccag

SEQ ID NO: 1546955 - RNA, 22 nt, Pseudomonas aeruginosa PA01
gcaggcaguggcgccagccagc

SEQ ID NO: 1546956 - RNA, 19 nt, Pseudomonas aeruginosa PA01
gcaggcagucccagaaggc

SEQ ID NO: 1546957 - RNA, 21 nt, Pseudomonas aeruginosa PA01
gcaggcaaaaagaaaccccgc

SEQ ID NO: 1546958 - RNA, 14 nt, Pseudomonas aeruginosa PA01
gcaggcggcuggcg

SEQ ID NO: 1546959 - RNA, 24 nt, Pseudomonas aeruginosa PA01
gcaggcgguaggugagcgacccgc

SEQ ID NO: 1546960 - RNA, 22 nt, Pseudomonas aeruginosa PA01
gcaggcggucggaaagcagggc

SEQ ID NO: 1546961 - RNA, 18 nt, Pseudomonas aeruginosa PA01
gcaggccgaagcgugggc

SEQ ID NO: 1546962 - RNA, 22 nt, Pseudomonas aeruginosa PA01
gcaggccgaagcgugggcggcc

SEQ ID NO: 1546963 - RNA, 14 nt, Pseudomonas aeruginosa PA01
gcaggccgaaggcc

SEQ ID NO: 1546964 - RNA, 16 nt, Pseudomonas aeruginosa PA01
gcaggccgaaggccag

SEQ ID NO: 1546965 - RNA, 17 nt, Pseudomonas aeruginosa PA01
gcaggccgaaggccagg

SEQ ID NO: 1546966 - RNA, 22 nt, Pseudomonas aeruginosa PA01
gcaggccccuugcgcuguuccg

SEQ ID NO: 1546967 - RNA, 18 nt, Pseudomonas aeruginosa PA01
gcaggcgcggcauagaug

SEQ ID NO: 1546968 - RNA, 15 nt, Pseudomonas aeruginosa PA01
gcaggcgcucgcugc

SEQ ID NO: 1546969 - RNA, 14 nt, Pseudomonas aeruginosa PA01
gcaggcggcccaug

SEQ ID NO: 1546970 - RNA, 19 nt, Pseudomonas aeruginosa PA01
gcaggcgcuucagcgccuc

SEQ ID NO: 1546971 - RNA, 14 nt, Pseudomonas aeruginosa PA01
gcaggcggaguagc

SEQ ID NO: 1546972 - RNA, 19 nt, Pseudomonas aeruginosa PA01
gcaggcggaucgcccggcg

SEQ ID NO: 1546973 - RNA, 17 nt, Pseudomonas aeruginosa PA01
gcaggcggaucgccgcc

SEQ ID NO: 1546974 - RNA, 18 nt, Pseudomonas aeruginosa PA01
gcaggcggaucgccgccu

SEQ ID NO: 1546975 - RNA, 18 nt, Pseudomonas aeruginosa PA01
gcaggcaugcggccccgg

SEQ ID NO: 1546976 - RNA, 19 nt, Pseudomonas aeruginosa PA01
gcaggcaugcggccccggc

SEQ ID NO: 1546977 - RNA, 22 nt, Pseudomonas aeruginosa PA01
gcaggccagccaacugcuucag

SEQ ID NO: 1546978 - RNA, 12 nt, Pseudomonas aeruginosa PA01
gcaggccaggcc

SEQ ID NO: 1546979 - RNA, 20 nt, Pseudomonas aeruginosa PA01
gcaggccaggccccagggcc

SEQ ID NO: 1546980 - RNA, 17 nt, Pseudomonas aeruginosa PA01
gcaggccagcgccaggu

SEQ ID NO: 1546981 - RNA, 12 nt, Pseudomonas aeruginosa PA01
gcaggcccagcc

SEQ ID NO: 1546982 - RNA, 23 nt, Pseudomonas aeruginosa PA01
gcaggcccagcuucuuggcccgg

SEQ ID NO: 1546983 - RNA, 15 nt, Pseudomonas aeruginosa PA01
gcagggucgccuggg

SEQ ID NO: 1546984 - RNA, 20 nt, Pseudomonas aeruginosa PA01
gcagggucgcgagcagggcg

SEQ ID NO: 1546985 - RNA, 20 nt, Pseudomonas aeruginosa PA01
gcagggaggcgcacaucacc

SEQ ID NO: 1546986 - RNA, 22 nt, Pseudomonas aeruginosa PA01
gcagggaggcgcacaucacccg

SEQ ID NO: 1546987 - RNA, 21 nt, Pseudomonas aeruginosa PA01
gcagggaguccgccagccggc

SEQ ID NO: 1546988 - RNA, 22 nt, Pseudomonas aeruginosa PA01
gcagggaguccgccagccggcu

SEQ ID NO: 1546989 - RNA, 16 nt, Pseudomonas aeruginosa PA01
gcaggguggccagggu

SEQ ID NO: 1546990 - RNA, 13 nt, Pseudomonas aeruginosa PA01
gcaggguggcgca

SEQ ID NO: 1546991 - RNA, 15 nt, Pseudomonas aeruginosa PA01
gcagggugaagcugc

SEQ ID NO: 1546992 - RNA, 15 nt, Pseudomonas aeruginosa PA01
gcaggcuuggucagg

SEQ ID NO: 1546993 - RNA, 17 nt, Pseudomonas aeruginosa PA01
gcaggcugugccauucc

SEQ ID NO: 1546994 - RNA, 20 nt, Pseudomonas aeruginosa PA01
gcaggcuuuccagcccggcg

SEQ ID NO: 1546995 - RNA, 17 nt, Pseudomonas aeruginosa PA01
gcagguagcugagcagg

SEQ ID NO: 1546996 - RNA, 22 nt, Pseudomonas aeruginosa PA01
gcagguagcugcuccagcccgg

SEQ ID NO: 1546997 - RNA, 13 nt, Pseudomonas aeruginosa PA01
gcagguagcagcc

SEQ ID NO: 1546998 - RNA, 13 nt, Pseudomonas aeruginosa PA01
gcagguagccagg

SEQ ID NO: 1546999 - RNA, 20 nt, Pseudomonas aeruginosa PA01
gcagguagccgcgccggccg

SEQ ID NO: 1547000 - RNA, 16 nt, Pseudomonas aeruginosa PA01
gcagguagcgcugcgc

SEQ ID NO: 1547001 - RNA, 19 nt, Pseudomonas aeruginosa PA01
gcaggucaucaggaucagg

SEQ ID NO: 1547002 - RNA, 11 nt, Pseudomonas aeruginosa PA01
gcagguagugc

SEQ ID NO: 1547003 - RNA, 17 nt, Pseudomonas aeruginosa PA01
gcagguagugcggcggg

SEQ ID NO: 1547004 - RNA, 15 nt, Pseudomonas aeruginosa PA01
gcagguagugcucgg

SEQ ID NO: 1547005 - RNA, 16 nt, Pseudomonas aeruginosa PA01
gcagguaucgcugggc

SEQ ID NO: 1547006 - RNA, 16 nt, Pseudomonas aeruginosa PA01
gcaggguguugaucac

SEQ ID NO: 1547007 - RNA, 16 nt, Pseudomonas aeruginosa PA01
gcagguaacccgcggc

SEQ ID NO: 1547008 - RNA, 18 nt, Pseudomonas aeruginosa PA01
gcagguaacccgcggcga

SEQ ID NO: 1547009 - RNA, 19 nt, Pseudomonas aeruginosa PA01
gcagguaacccgcggcgag

SEQ ID NO: 1547010 - RNA, 14 nt, Pseudomonas aeruginosa PA01
gcagguacagcagc

SEQ ID NO: 1547011 - RNA, 19 nt, Pseudomonas aeruginosa PA01
gcagguagaccacgcaggc

SEQ ID NO: 1547012 - RNA, 22 nt, Pseudomonas aeruginosa PA01
gcagguagaccacgcaggccag

SEQ ID NO: 1547013 - RNA, 18 nt, Pseudomonas aeruginosa PA01
gcagguagaccgccucgg

SEQ ID NO: 1547014 - RNA, 17 nt, Pseudomonas aeruginosa PA01
gcagguacucgccggcg

SEQ ID NO: 1547015 - RNA, 16 nt, Pseudomonas aeruginosa PA01
gcaguacccggccgcc

SEQ ID NO: 1547016 - RNA, 21 nt, Pseudomonas aeruginosa PA01
gcaguacccggccgccuuccu

SEQ ID NO: 1547017 - RNA, 16 nt, Pseudomonas aeruginosa PA01
gcagguugcucgccuu

SEQ ID NO: 1547018 - RNA, 18 nt, Pseudomonas aeruginosa PA01
gcagguugcucgccuugg

SEQ ID NO: 1547019 - RNA, 18 nt, Pseudomonas aeruginosa PA01
gcagguugcuggcgagga

SEQ ID NO: 1547020 - RNA, 21 nt, Pseudomonas aeruginosa PA01
gcagguucgaaugcugcccgg

SEQ ID NO: 1547021 - RNA, 22 nt, Pseudomonas aeruginosa PA01
gcagguguucgcaaagcucgcg

SEQ ID NO: 1547022 - RNA, 17 nt, Pseudomonas aeruginosa PA01
gcagguguucggcggcg

SEQ ID NO: 1547023 - RNA, 19 nt, Pseudomonas aeruginosa PA01
gcagguguucggcggcgug

SEQ ID NO: 1547024 - RNA, 14 nt, Pseudomonas aeruginosa PA01
gcagguggccggaa

SEQ ID NO: 1547025 - RNA, 17 nt, Pseudomonas aeruginosa PA01
gcagguggcgcacugcc

SEQ ID NO: 1547026 - RNA, 20 nt, Pseudomonas aeruginosa PA01
gcagguggcgcacugccagg

SEQ ID NO: 1547027 - RNA, 21 nt, Pseudomonas aeruginosa PA01
gcagguggcgcacugccagga

SEQ ID NO: 1547028 - RNA, 24 nt, Pseudomonas aeruginosa PA01
gcagguggcgcacugccaggagca

SEQ ID NO: 1547029 - RNA, 16 nt, Pseudomonas aeruginosa PA01
gcagguggcuggccau

SEQ ID NO: 1547030 - RNA, 23 nt, Pseudomonas aeruginosa PA01
gcagguggucguugcgcgccagc

SEQ ID NO: 1547031 - RNA, 13 nt, Pseudomonas aeruginosa PA01
gcaggucggccug

SEQ ID NO: 1547032 - RNA, 16 nt, Pseudomonas aeruginosa PA01
gcaggucucgacgcgc

SEQ ID NO: 1547033 - RNA, 17 nt, Pseudomonas aeruginosa PA01
gcaggugcuuggcaccg

SEQ ID NO: 1547034 - RNA, 20 nt, Pseudomonas aeruginosa PA01
gcaggugcuuggcaccgcgc

SEQ ID NO: 1547035 - RNA, 17 nt, Pseudomonas aeruginosa PA01
gcagguggacggcauug

SEQ ID NO: 1547036 - RNA, 18 nt, Pseudomonas aeruginosa PA01
gcaggucgagcaguuccg

SEQ ID NO: 1547037 - RNA, 20 nt, Pseudomonas aeruginosa PA01
gcagguccgcgccucgcgca

SEQ ID NO: 1547038 - RNA, 14 nt, Pseudomonas aeruginosa PA01
gcagguccuguccc

SEQ ID NO: 1547039 - RNA, 18 nt, Pseudomonas aeruginosa PA01
gcaggucgcggccccagc

SEQ ID NO: 1547040 - RNA, 14 nt, Pseudomonas aeruginosa PA01
gcaggucgcggugc

SEQ ID NO: 1547041 - RNA, 15 nt, Pseudomonas aeruginosa PA01
gcaggucggcagcgu

SEQ ID NO: 1547042 - RNA, 17 nt, Pseudomonas aeruginosa PA01
gcaugccugcuuucccu

SEQ ID NO: 1547043 - RNA, 21 nt, Pseudomonas aeruginosa PA01
gcaugccguugggccagggcc

SEQ ID NO: 1547044 - RNA, 14 nt, Pseudomonas aeruginosa PA01
gcauggcuggcgcu

SEQ ID NO: 1547045 - RNA, 17 nt, Pseudomonas aeruginosa PA01
gcauggcuuuccaggcg

SEQ ID NO: 1547046 - RNA, 14 nt, Pseudomonas aeruginosa PA01
gcauggcguucugc

SEQ ID NO: 1547047 - RNA, 13 nt, Pseudomonas aeruginosa PA01
gcaugcucagccg

SEQ ID NO: 1547048 - RNA, 22 nt, Pseudomonas aeruginosa PA01
gcaugcguucgccgaaauagcg

SEQ ID NO: 1547049 - RNA, 14 nt, Pseudomonas aeruginosa PA01
gcauggggcggcac

SEQ ID NO: 1547050 - RNA, 13 nt, Pseudomonas aeruginosa PA01
gcaugggucagcg

SEQ ID NO: 1547051 - RNA, 15 nt, Pseudomonas aeruginosa PA01
gcaugggucagcgcc

SEQ ID NO: 1547052 - RNA, 19 nt, Pseudomonas aeruginosa PA01
gcaucgucgaaacgcuggc

SEQ ID NO: 1547053 - RNA, 20 nt, Pseudomonas aeruginosa PA01
gcaucgucgaaacgcuggcg

SEQ ID NO: 1547054 - RNA, 19 nt, Pseudomonas aeruginosa PA01
gcaucgucgaagcugaggu

SEQ ID NO: 1547055 - RNA, 16 nt, Pseudomonas aeruginosa PA01
gcaucggugccggcag

SEQ ID NO: 1547056 - RNA, 20 nt, Pseudomonas aeruginosa PA01
gcaugaccuccagggccagc

SEQ ID NO: 1547057 - RNA, 17 nt, Pseudomonas aeruginosa PA01
gcaugaccgauggcgcc

SEQ ID NO: 1547058 - RNA, 23 nt, Pseudomonas aeruginosa PA01
gcaugaccgauggcgccgcgaug

SEQ ID NO: 1547059 - RNA, 20 nt, Pseudomonas aeruginosa PA01
gcauucuggaugcagccggg

SEQ ID NO: 1547060 - RNA, 15 nt, Pseudomonas aeruginosa PA01
gcauuggugcugccg

SEQ ID NO: 1547061 - RNA, 15 nt, Pseudomonas aeruginosa PA01
gccaaaaagcaggac

SEQ ID NO: 1547062 - RNA, 22 nt, Pseudomonas aeruginosa PA01
gcauucucgcgacccuggccgc

SEQ ID NO: 1547063 - RNA, 19 nt, Pseudomonas aeruginosa PA01
gcauguucaugcgcuggua

SEQ ID NO: 1547064 - RNA, 15 nt, Pseudomonas aeruginosa PA01
gcauguuggcgccuu

SEQ ID NO: 1547065 - RNA, 15 nt, Pseudomonas aeruginosa PA01
gcauguugugcuuga

SEQ ID NO: 1547066 - RNA, 16 nt, Pseudomonas aeruginosa PA01
gcaucggccgccaggc

SEQ ID NO: 1547067 - RNA, 15 nt, Pseudomonas aeruginosa PA01
gcaucggcgccgcgc

SEQ ID NO: 1547068 - RNA, 14 nt, Pseudomonas aeruginosa PA01
gcaucggcgaccuu

SEQ ID NO: 1547069 - RNA, 12 nt, Pseudomonas aeruginosa PA01
gcaucggcgccu

SEQ ID NO: 1547070 - RNA, 16 nt, Pseudomonas aeruginosa PA01
gcaucggcgcggccuu

SEQ ID NO: 1547071 - RNA, 17 nt, Pseudomonas aeruginosa PA01
gcaucgccggcagcgcc

SEQ ID NO: 1547072 - RNA, 14 nt, Pseudomonas aeruginosa PA01
gcaucgccggggcu

SEQ ID NO: 1547073 - RNA, 15 nt, Pseudomonas aeruginosa PA01
gcaucgccgcccagu

SEQ ID NO: 1547074 - RNA, 23 nt, Pseudomonas aeruginosa PA01
gcauccguaaaauggcgcgccuc

SEQ ID NO: 1547075 - RNA, 12 nt, Pseudomonas aeruginosa PA01
gcaucgcgggcg

SEQ ID NO: 1547076 - RNA, 21 nt, Pseudomonas aeruginosa PA01
gcaucgcgcacaugccgagcg

SEQ ID NO: 1547077 - RNA, 15 nt, Pseudomonas aeruginosa PA01
gcauccaucgccagu

SEQ ID NO: 1547078 - RNA, 14 nt, Pseudomonas aeruginosa PA01
gcaucagcaggaag

SEQ ID NO: 1547079 - RNA, 20 nt, Pseudomonas aeruginosa PA01
gcauccccggaccagggcgc

SEQ ID NO: 1547080 - RNA, 15 nt, Pseudomonas aeruginosa PA01
gcaguaggcgcugcc

SEQ ID NO: 1547081 - RNA, 16 nt, Pseudomonas aeruginosa PA01
gcauacacaugcaggc

SEQ ID NO: 1547082 - RNA, 21 nt, Pseudomonas aeruginosa PA01
gcaguacguggcgcuugagca

SEQ ID NO: 1547083 - RNA, 18 nt, Pseudomonas aeruginosa PA01
gcaguagcucgccgaggu

SEQ ID NO: 1547084 - RNA, 18 nt, Pseudomonas aeruginosa PA01
gcauaggucaugcccagg

SEQ ID NO: 1547085 - RNA, 19 nt, Pseudomonas aeruginosa PA01
gcauaggcggccagccuuc

SEQ ID NO: 1547086 - RNA, 21 nt, Pseudomonas aeruginosa PA01
gcauauccccucucaacaccc

SEQ ID NO: 1547087 - RNA, 17 nt, Pseudomonas aeruginosa PA01
gcaucaccggcagcagc

SEQ ID NO: 1547088 - RNA, 15 nt, Pseudomonas aeruginosa PA01
gcaucaccggcggga

SEQ ID NO: 1547089 - RNA, 20 nt, Pseudomonas aeruginosa PA01
gcaucaccccgcaaccgcag

SEQ ID NO: 1547090 - RNA, 12 nt, Pseudomonas aeruginosa PA01
gccaaccaggaa

SEQ ID NO: 1547091 - RNA, 14 nt, Pseudomonas aeruginosa PA01
gccaaccacuccgc

SEQ ID NO: 1547092 - RNA, 16 nt, Pseudomonas aeruginosa PA01
gccaaccacuccgcca

SEQ ID NO: 1547093 - RNA, 15 nt, Pseudomonas aeruginosa PA01
gccaaccagauccgg

SEQ ID NO: 1547094 - RNA, 21 nt, Pseudomonas aeruginosa PA01
gccaaccgucgcccuggugca

SEQ ID NO: 1547095 - RNA, 19 nt, Pseudomonas aeruginosa PA01
gccaacgcccgggccgggg

SEQ ID NO: 1547096 - RNA, 18 nt, Pseudomonas aeruginosa PA01
gccaacugagcggcggca

SEQ ID NO: 1547097 - RNA, 22 nt, Pseudomonas aeruginosa PA01
gccaacuggcguccccaugccc

SEQ ID NO: 1547098 - RNA, 17 nt, Pseudomonas aeruginosa PA01
gccaauccacaaacacu

SEQ ID NO: 1547099 - RNA, 21 nt, Pseudomonas aeruginosa PA01
gccaauggccgggcuucuuca

SEQ ID NO: 1547100 - RNA, 15 nt, Pseudomonas aeruginosa PA01
gccaauugcuccggu

SEQ ID NO: 1547101 - RNA, 20 nt, Pseudomonas aeruginosa PA01
gccaagucggccgcccagcg

SEQ ID NO: 1547102 - RNA, 14 nt, Pseudomonas aeruginosa PA01
gccaagccaccagc

SEQ ID NO: 1547103 - RNA, 13 nt, Pseudomonas aeruginosa PA01
gccaagcuggcga

SEQ ID NO: 1547104 - RNA, 14 nt, Pseudomonas aeruginosa PA01
gccaaggcccugcu

SEQ ID NO: 1547105 - RNA, 17 nt, Pseudomonas aeruginosa PA01
gccaaggccgccaggcc

SEQ ID NO: 1547106 - RNA, 23 nt, Pseudomonas aeruginosa PA01
gccaaggucggucucgccacccc

SEQ ID NO: 1547107 - RNA, 21 nt, Pseudomonas aeruginosa PA01
gccaagggcgccgccgaggau

SEQ ID NO: 1547108 - RNA, 23 nt, Pseudomonas aeruginosa PA01
gccaagguguggccgagccccgg

SEQ ID NO: 1547109 - RNA, 21 nt, Pseudomonas aeruginosa PA01
gccaagguuccagccccgccg

SEQ ID NO: 1547110 - RNA, 13 nt, Pseudomonas aeruginosa PA01
gccacggccgcug

SEQ ID NO: 1547111 - RNA, 14 nt, Pseudomonas aeruginosa PA01
gccacggccgcugc

SEQ ID NO: 1547112 - RNA, 16 nt, Pseudomonas aeruginosa PA01
gccacggccgcugcgc

SEQ ID NO: 1547113 - RNA, 20 nt, Pseudomonas aeruginosa PA01
gccacggccgcugcgcaggc

SEQ ID NO: 1547114 - RNA, 21 nt, Pseudomonas aeruginosa PA01
gccacggccgcugcgcaggcc

SEQ ID NO: 1547115 - RNA, 13 nt, Pseudomonas aeruginosa PA01
gccacggccggcg

SEQ ID NO: 1547116 - RNA, 15 nt, Pseudomonas aeruginosa PA01
gccacggccggcgag

SEQ ID NO: 1547117 - RNA, 16 nt, Pseudomonas aeruginosa PA01
gccacggccagcagga

SEQ ID NO: 1547118 - RNA, 22 nt, Pseudomonas aeruginosa PA01
gccacggcgcgcuccggcgcgc

SEQ ID NO: 1547119 - RNA, 16 nt, Pseudomonas aeruginosa PA01
gccacgacccugcugg

SEQ ID NO: 1547120 - RNA, 22 nt, Pseudomonas aeruginosa PA01
gccacgaacugcauggccuugu

SEQ ID NO: 1547121 - RNA, 15 nt, Pseudomonas aeruginosa PA01
gccacuggcggaccg

SEQ ID NO: 1547122 - RNA, 19 nt, Pseudomonas aeruginosa PA01
gccacuggcggaccgccuc

SEQ ID NO: 1547123 - RNA, 14 nt, Pseudomonas aeruginosa PA01
gccacugccgccuc

SEQ ID NO: 1547124 - RNA, 15 nt, Pseudomonas aeruginosa PA01
gccacucggccaggc

SEQ ID NO: 1547125 - RNA, 21 nt, Pseudomonas aeruginosa PA01
gccacucggcgugccgggccg

SEQ ID NO: 1547126 - RNA, 16 nt, Pseudomonas aeruginosa PA01
gccacugacgcgcagc

SEQ ID NO: 1547127 - RNA, 15 nt, Pseudomonas aeruginosa PA01
gccacguucugcagg

SEQ ID NO: 1547128 - RNA, 16 nt, Pseudomonas aeruginosa PA01
gccacguucugcagga

SEQ ID NO: 1547129 - RNA, 20 nt, Pseudomonas aeruginosa PA01
gccacucccggcccuugagc

SEQ ID NO: 1547130 - RNA, 14 nt, Pseudomonas aeruginosa PA01
gccacuccagcccc

SEQ ID NO: 1547131 - RNA, 18 nt, Pseudomonas aeruginosa PA01
gccaccccgcuccgcuca

SEQ ID NO: 1547132 - RNA, 22 nt, Pseudomonas aeruginosa PA01
gccaccccgcuccgcucagucg

SEQ ID NO: 1547133 - RNA, 13 nt, Pseudomonas aeruginosa PA01
gccacccgcgggc

SEQ ID NO: 1547134 - RNA, 16 nt, Pseudomonas aeruginosa PA01
gccacccgcgggcagc

SEQ ID NO: 1547135 - RNA, 22 nt, Pseudomonas aeruginosa PA01
gccacccgcaucgaggccgccc

SEQ ID NO: 1547136 - RNA, 13 nt, Pseudomonas aeruginosa PA01
gccaccccgccgc

SEQ ID NO: 1547137 - RNA, 21 nt, Pseudomonas aeruginosa PA01
gccaccccgccgcuggcggca

SEQ ID NO: 1547138 - RNA, 12 nt, Pseudomonas aeruginosa PA01
gccacccggcgc

SEQ ID NO: 1547139 - RNA, 20 nt, Pseudomonas aeruginosa PA01
gccaccgguggacugguuga

SEQ ID NO: 1547140 - RNA, 21 nt, Pseudomonas aeruginosa PA01
gccaccggcugcauguccgcc

SEQ ID NO: 1547141 - RNA, 23 nt, Pseudomonas aeruginosa PA01
gccaccgauagcggcgcgaggcc

SEQ ID NO: 1547142 - RNA, 19 nt, Pseudomonas aeruginosa PA01
gccaccgacgcgcgcgcau

SEQ ID NO: 1547143 - RNA, 12 nt, Pseudomonas aeruginosa PA01
gccaccgccagg

SEQ ID NO: 1547144 - RNA, 13 nt, Pseudomonas aeruginosa PA01
gccaccgccagga

SEQ ID NO: 1547145 - RNA, 14 nt, Pseudomonas aeruginosa PA01
gccaccgccaggac

SEQ ID NO: 1547146 - RNA, 12 nt, Pseudomonas aeruginosa PA01
gccacccuugcg

SEQ ID NO: 1547147 - RNA, 23 nt, Pseudomonas aeruginosa PA01
gccacccuugcguccugccucgg

SEQ ID NO: 1547148 - RNA, 19 nt, Pseudomonas aeruginosa PA01
gccacccuuggagccgccc

SEQ ID NO: 1547149 - RNA, 19 nt, Pseudomonas aeruginosa PA01
gccaccgacccucggcgag

SEQ ID NO: 1547150 - RNA, 15 nt, Pseudomonas aeruginosa PA01
gccccuggcgcuggg

SEQ ID NO: 1547151 - RNA, 18 nt, Pseudomonas aeruginosa PA01
gccccuggcucaggcacu

SEQ ID NO: 1547152 - RNA, 14 nt, Pseudomonas aeruginosa PA01
gccccugggccggc

SEQ ID NO: 1547153 - RNA, 23 nt, Pseudomonas aeruginosa PA01
gcccgaauguuccaaggugcugc

SEQ ID NO: 1547154 - RNA, 12 nt, Pseudomonas aeruginosa PA01
gccccuccaccu

SEQ ID NO: 1547155 - RNA, 18 nt, Pseudomonas aeruginosa PA01
gccccugcggaccgcaga

SEQ ID NO: 1547156 - RNA, 12 nt, Pseudomonas aeruginosa PA01
gccccugccgcg

SEQ ID NO: 1547157 - RNA, 21 nt, Pseudomonas aeruginosa PA01
gccccugccguauccgcggca

SEQ ID NO: 1547158 - RNA, 14 nt, Pseudomonas aeruginosa PA01
gccccuccaguucc

SEQ ID NO: 1547159 - RNA, 15 nt, Pseudomonas aeruginosa PA01
gccccuccaguuccu

SEQ ID NO: 1547160 - RNA, 16 nt, Pseudomonas aeruginosa PA01
gccccuccaguuccug

SEQ ID NO: 1547161 - RNA, 23 nt, Pseudomonas aeruginosa PA01
gccccuccuucgagccuggccag

SEQ ID NO: 1547162 - RNA, 14 nt, Pseudomonas aeruginosa PA01
gccccucgcgcauc

SEQ ID NO: 1547163 - RNA, 19 nt, Pseudomonas aeruginosa PA01
gccccucgcgcaucuggcu

SEQ ID NO: 1547164 - RNA, 15 nt, Pseudomonas aeruginosa PA01
gccccggcagccacc

SEQ ID NO: 1547165 - RNA, 16 nt, Pseudomonas aeruginosa PA01
gccccggcagccacca

SEQ ID NO: 1547166 - RNA, 21 nt, Pseudomonas aeruginosa PA01
gccccggcaggcaggccuggg

SEQ ID NO: 1547167 - RNA, 13 nt, Pseudomonas aeruginosa PA01
gccccucagaagu

SEQ ID NO: 1547168 - RNA, 22 nt, Pseudomonas aeruginosa PA01
gcccgacgaaguugcaggccag

SEQ ID NO: 1547169 - RNA, 17 nt, Pseudomonas aeruginosa PA01
gcccgcaaucagcgggc

SEQ ID NO: 1547170 - RNA, 19 nt, Pseudomonas aeruginosa PA01
gcccgcaauccgaccgggg

SEQ ID NO: 1547171 - RNA, 23 nt, Pseudomonas aeruginosa PA01
gcccgaccgguuccagcggccgc

SEQ ID NO: 1547172 - RNA, 20 nt, Pseudomonas aeruginosa PA01
gcccgaccccacgccggccg

SEQ ID NO: 1547173 - RNA, 17 nt, Pseudomonas aeruginosa PA01
gcccgccaaggcccugc

SEQ ID NO: 1547174 - RNA, 18 nt, Pseudomonas aeruginosa PA01
gcccgccaagggcgccgc

SEQ ID NO: 1547175 - RNA, 16 nt, Pseudomonas aeruginosa PA01
gcccgcagccacaggc

SEQ ID NO: 1547176 - RNA, 20 nt, Pseudomonas aeruginosa PA01
gcccgcagccacaggcgcca

SEQ ID NO: 1547177 - RNA, 15 nt, Pseudomonas aeruginosa PA01
gcccgcagccacggc

SEQ ID NO: 1547178 - RNA, 14 nt, Pseudomonas aeruginosa PA01
gcccgcagccagcc

SEQ ID NO: 1547179 - RNA, 16 nt, Pseudomonas aeruginosa PA01
gcccgcagccagccuc

SEQ ID NO: 1547180 - RNA, 21 nt, Pseudomonas aeruginosa PA01
gccccgacugucgugccucca

SEQ ID NO: 1547181 - RNA, 23 nt, Pseudomonas aeruginosa PA01
gccccgacugucgugccuccagc

SEQ ID NO: 1547182 - RNA, 23 nt, Pseudomonas aeruginosa PA01
gcccccaggcaccguaggccagg

SEQ ID NO: 1547183 - RNA, 20 nt, Pseudomonas aeruginosa PA01
gcccccaugaaaaaggcgcc

SEQ ID NO: 1547184 - RNA, 23 nt, Pseudomonas aeruginosa PA01
gccccgcgauugcagcuccuggu

SEQ ID NO: 1547185 - RNA, 23 nt, Pseudomonas aeruginosa PA01
gccccgcauugcggggcguucuu

SEQ ID NO: 1547186 - RNA, 17 nt, Pseudomonas aeruginosa PA01
gccccgaggccagcagg

SEQ ID NO: 1547187 - RNA, 19 nt, Pseudomonas aeruginosa PA01
gccccgagaaaacccuggg

SEQ ID NO: 1547188 - RNA, 13 nt, Pseudomonas aeruginosa PA01
gccccgcagccgc

SEQ ID NO: 1547189 - RNA, 18 nt, Pseudomonas aeruginosa PA01
gccccgcagccgcggggc

SEQ ID NO: 1547190 - RNA, 20 nt, Pseudomonas aeruginosa PA01
gccccgcaaggugcgggccg

SEQ ID NO: 1547191 - RNA, 19 nt, Pseudomonas aeruginosa PA01
gccccgcaccagccagccc

SEQ ID NO: 1547192 - RNA, 21 nt, Pseudomonas aeruginosa PA01
gccccgcucgucauggcgcac

SEQ ID NO: 1547193 - RNA, 22 nt, Pseudomonas aeruginosa PA01
gccccgcgguacccggcagggc

SEQ ID NO: 1547194 - RNA, 18 nt, Pseudomonas aeruginosa PA01
gccccgcuucggcggggc

SEQ ID NO: 1547195 - RNA, 12 nt, Pseudomonas aeruginosa PA01
gccccgcuggcc

SEQ ID NO: 1547196 - RNA, 19 nt, Pseudomonas aeruginosa PA01
gccccgcuggcccaacagc

SEQ ID NO: 1547197 - RNA, 22 nt, Pseudomonas aeruginosa PA01
gccccgcuggcccaacagcggu

SEQ ID NO: 1547198 - RNA, 15 nt, Pseudomonas aeruginosa PA01
gccccagcggcaggc

SEQ ID NO: 1547199 - RNA, 23 nt, Pseudomonas aeruginosa PA01
gccccagccucggcagggcgccc

SEQ ID NO: 1547200 - RNA, 16 nt, Pseudomonas aeruginosa PA01
gccccagccuugcugg

SEQ ID NO: 1547201 - RNA, 23 nt, Pseudomonas aeruginosa PA01
gccccagcgcgagcguuccauga

SEQ ID NO: 1547202 - RNA, 14 nt, Pseudomonas aeruginosa PA01
gccccagcccaggg

SEQ ID NO: 1547203 - RNA, 17 nt, Pseudomonas aeruginosa PA01
gccccagcaucgccggc

SEQ ID NO: 1547204 - RNA, 20 nt, Pseudomonas aeruginosa PA01
gccccagcaucgccggcagc

SEQ ID NO: 1547205 - RNA, 13 nt, Pseudomonas aeruginosa PA01
gccccagcaccuc

SEQ ID NO: 1547206 - RNA, 17 nt, Pseudomonas aeruginosa PA01
gccccagcaccucgccg

SEQ ID NO: 1547207 - RNA, 22 nt, Pseudomonas aeruginosa PA01
gccccagguaggcgaaggcgau

SEQ ID NO: 1547208 - RNA, 14 nt, Pseudomonas aeruginosa PA01
gccccaggugcagc

SEQ ID NO: 1547209 - RNA, 17 nt, Pseudomonas aeruginosa PA01
gccccaggugcagcgag

SEQ ID NO: 1547210 - RNA, 18 nt, Pseudomonas aeruginosa PA01
gccccaggugcagcgagg

SEQ ID NO: 1547211 - RNA, 19 nt, Pseudomonas aeruginosa PA01
gccccaggcgauccacagc

SEQ ID NO: 1547212 - RNA, 19 nt, Pseudomonas aeruginosa PA01
gccccaggcgcccaggcag

SEQ ID NO: 1547213 - RNA, 20 nt, Pseudomonas aeruginosa PA01
gccccaggcgcccaggcagc

SEQ ID NO: 1547214 - RNA, 14 nt, Pseudomonas aeruginosa PA01
gccccaggcgcggc

SEQ ID NO: 1547215 - RNA, 15 nt, Pseudomonas aeruginosa PA01
gccccaggcgcggcg

SEQ ID NO: 1547216 - RNA, 14 nt, Pseudomonas aeruginosa PA01
gccccaggccgccg

SEQ ID NO: 1547217 - RNA, 17 nt, Pseudomonas aeruginosa PA01
gccccaggccgccgccu

SEQ ID NO: 1547218 - RNA, 12 nt, Pseudomonas aeruginosa PA01
gcccccagcgcc

SEQ ID NO: 1547219 - RNA, 21 nt, Pseudomonas aeruginosa PA01
gccccagggaaucgucacggc

SEQ ID NO: 1547220 - RNA, 16 nt, Pseudomonas aeruginosa PA01
gcccaauacccacagg

SEQ ID NO: 1547221 - RNA, 21 nt, Pseudomonas aeruginosa PA01
gcccaagggccugggcgccgc

SEQ ID NO: 1547222 - RNA, 20 nt, Pseudomonas aeruginosa PA01
gcccaagggcuccgcaagga

SEQ ID NO: 1547223 - RNA, 20 nt, Pseudomonas aeruginosa PA01
gcccaauccgcgccgguggc

SEQ ID NO: 1547224 - RNA, 15 nt, Pseudomonas aeruginosa PA01
gcccagacgccgcuc

SEQ ID NO: 1547225 - RNA, 22 nt, Pseudomonas aeruginosa PA01
gcccagauauccagggccagga

SEQ ID NO: 1547226 - RNA, 16 nt, Pseudomonas aeruginosa PA01
gcccagcagcaccauc

SEQ ID NO: 1547227 - RNA, 13 nt, Pseudomonas aeruginosa PA01
gcccagcagcggc

SEQ ID NO: 1547228 - RNA, 14 nt, Pseudomonas aeruginosa PA01
gcccagcagcaggc

SEQ ID NO: 1547229 - RNA, 17 nt, Pseudomonas aeruginosa PA01
gcccagcagcaggccgg

SEQ ID NO: 1547230 - RNA, 19 nt, Pseudomonas aeruginosa PA01
gcccagcagcaggccggcg

SEQ ID NO: 1547231 - RNA, 22 nt, Pseudomonas aeruginosa PA01
gcccagcagcaggccggcgacc

SEQ ID NO: 1547232 - RNA, 14 nt, Pseudomonas aeruginosa PA01
gcccagcaccgagc

SEQ ID NO: 1547233 - RNA, 15 nt, Pseudomonas aeruginosa PA01
gcccagcaccacagc

SEQ ID NO: 1547234 - RNA, 23 nt, Pseudomonas aeruginosa PA01
gcccagaucauguagagcaggcu

SEQ ID NO: 1547235 - RNA, 22 nt, Pseudomonas aeruginosa PA01
gcccagaugaucaggccgagca

SEQ ID NO: 1547236 - RNA, 21 nt, Pseudomonas aeruginosa PA01
gcccagcgagccgaucaccag

SEQ ID NO: 1547237 - RNA, 15 nt, Pseudomonas aeruginosa PA01
gcccagcgcagccug

SEQ ID NO: 1547238 - RNA, 13 nt, Pseudomonas aeruginosa PA01
gcccagcgcaggc

SEQ ID NO: 1547239 - RNA, 14 nt, Pseudomonas aeruginosa PA01
gcccagcgcaggcc

SEQ ID NO: 1547240 - RNA, 14 nt, Pseudomonas aeruginosa PA01
gcccagcgccgcca

SEQ ID NO: 1547241 - RNA, 21 nt, Pseudomonas aeruginosa PA01
gcccagcgccgccagcagguc

SEQ ID NO: 1547242 - RNA, 13 nt, Pseudomonas aeruginosa PA01
gcccagcaggccg

SEQ ID NO: 1547243 - RNA, 19 nt, Pseudomonas aeruginosa PA01
gcccagcaggccggccagc

SEQ ID NO: 1547244 - RNA, 10 nt, Pseudomonas aeruginosa PA01
gcccagcagg

SEQ ID NO: 1547245 - RNA, 12 nt, Pseudomonas aeruginosa PA01
gcccagcaggcc

SEQ ID NO: 1547246 - RNA, 15 nt, Pseudomonas aeruginosa PA01
gcccagccgcggcgc

SEQ ID NO: 1547247 - RNA, 16 nt, Pseudomonas aeruginosa PA01
gcccaggcccagcgcg

SEQ ID NO: 1547248 - RNA, 12 nt, Pseudomonas aeruginosa PA01
gcccaggcaggc

SEQ ID NO: 1547249 - RNA, 12 nt, Pseudomonas aeruginosa PA01
gcccagcggcgc

SEQ ID NO: 1547250 - RNA, 15 nt, Pseudomonas aeruginosa PA01
gcccagcggcgcggc

SEQ ID NO: 1547251 - RNA, 16 nt, Pseudomonas aeruginosa PA01
gcccagcggcgcggcg

SEQ ID NO: 1547252 - RNA, 24 nt, Pseudomonas aeruginosa PA01
gcccagcggcgcggcguaccagcc

SEQ ID NO: 1547253 - RNA, 21 nt, Pseudomonas aeruginosa PA01
gcccagcggcuggcgggcgac

SEQ ID NO: 1547254 - RNA, 14 nt, Pseudomonas aeruginosa PA01
gcccaggccgaagu

SEQ ID NO: 1547255 - RNA, 13 nt, Pseudomonas aeruginosa PA01
gcccaggccgcug

SEQ ID NO: 1547256 - RNA, 23 nt, Pseudomonas aeruginosa PA01
gcccagcgccgccugcuggcugc

SEQ ID NO: 1547257 - RNA, 18 nt, Pseudomonas aeruginosa PA01
gcccagcgcuuccucggg

SEQ ID NO: 1547258 - RNA, 19 nt, Pseudomonas aeruginosa PA01
gcccagcggcagggcggcg

SEQ ID NO: 1547259 - RNA, 22 nt, Pseudomonas aeruginosa PA01
gcccaugaaaaagccccgccga

SEQ ID NO: 1547260 - RNA, 21 nt, Pseudomonas aeruginosa PA01
gcccaugaaaaagcccggccu

SEQ ID NO: 1547261 - RNA, 18 nt, Pseudomonas aeruginosa PA01
gcccaguucuucgccgcc

SEQ ID NO: 1547262 - RNA, 19 nt, Pseudomonas aeruginosa PA01
gcccaguucuucgccgccc

SEQ ID NO: 1547263 - RNA, 16 nt, Pseudomonas aeruginosa PA01
gcccaguucgccggcc

SEQ ID NO: 1547264 - RNA, 20 nt, Pseudomonas aeruginosa PA01
gcccaguucgcugccgccgc

SEQ ID NO: 1547265 - RNA, 18 nt, Pseudomonas aeruginosa PA01
gcccauggcacgcagggc

SEQ ID NO: 1547266 - RNA, 19 nt, Pseudomonas aeruginosa PA01
gcccaggccgggucgcagc

SEQ ID NO: 1547267 - RNA, 23 nt, Pseudomonas aeruginosa PA01
gcccaggccgggucgcagccggg

SEQ ID NO: 1547268 - RNA, 15 nt, Pseudomonas aeruginosa PA01
gcccaggcgcucggc

SEQ ID NO: 1547269 - RNA, 16 nt, Pseudomonas aeruginosa PA01
gcccaggcgcucggcg

SEQ ID NO: 1547270 - RNA, 22 nt, Pseudomonas aeruginosa PA01
gcccaggcgcucggcgaccuug

SEQ ID NO: 1547271 - RNA, 18 nt, Pseudomonas aeruginosa PA01
gcccaggcgcucggcggc

SEQ ID NO: 1547272 - RNA, 22 nt, Pseudomonas aeruginosa PA01
gcccaggcgcucggcggcgcgc

SEQ ID NO: 1547273 - RNA, 15 nt, Pseudomonas aeruginosa PA01
gcccaggcgcuggcg

SEQ ID NO: 1547274 - RNA, 15 nt, Pseudomonas aeruginosa PA01
gcccaggcgccgcuc

SEQ ID NO: 1547275 - RNA, 19 nt, Pseudomonas aeruginosa PA01
gccccacaggcccugcagc

SEQ ID NO: 1547276 - RNA, 22 nt, Pseudomonas aeruginosa PA01
gcccauuucguagcccaggcgg

SEQ ID NO: 1547277 - RNA, 21 nt, Pseudomonas aeruginosa PA01
gccccaccgaauaccagggcu

SEQ ID NO: 1547278 - RNA, 14 nt, Pseudomonas aeruginosa PA01
gccccaccccaggg

SEQ ID NO: 1547279 - RNA, 20 nt, Pseudomonas aeruginosa PA01
gccccaccccaggguuggcg

SEQ ID NO: 1547280 - RNA, 14 nt, Pseudomonas aeruginosa PA01
gccccaccgccagg

SEQ ID NO: 1547281 - RNA, 22 nt, Pseudomonas aeruginosa PA01
gccccagaucgccagcgccagc

SEQ ID NO: 1547282 - RNA, 22 nt, Pseudomonas aeruginosa PA01
gccccagauggguaagguugcc

SEQ ID NO: 1547283 - RNA, 14 nt, Pseudomonas aeruginosa PA01
gccccagacccagg

SEQ ID NO: 1547284 - RNA, 19 nt, Pseudomonas aeruginosa PA01
gccccacuuccggcccggc

SEQ ID NO: 1547285 - RNA, 14 nt, Pseudomonas aeruginosa PA01
gccccagaagcccc

SEQ ID NO: 1547286 - RNA, 19 nt, Pseudomonas aeruginosa PA01
gccccagaagccccagagc

SEQ ID NO: 1547287 - RNA, 15 nt, Pseudomonas aeruginosa PA01
gccccacggcgcggc

SEQ ID NO: 1547288 - RNA, 15 nt, Pseudomonas aeruginosa PA01
gccagucgagagcgg

SEQ ID NO: 1547289 - RNA, 23 nt, Pseudomonas aeruginosa PA01
gccaguccacgacgaacggcgcu

SEQ ID NO: 1547290 - RNA, 17 nt, Pseudomonas aeruginosa PA01
gccaguaguccuccgcg

SEQ ID NO: 1547291 - RNA, 18 nt, Pseudomonas aeruginosa PA01
gccaguuccggcaacagu

SEQ ID NO: 1547292 - RNA, 20 nt, Pseudomonas aeruginosa PA01
gccaguucggccaucagcac

SEQ ID NO: 1547293 - RNA, 22 nt, Pseudomonas aeruginosa PA01
gccaguucgccggugacgcugc

SEQ ID NO: 1547294 - RNA, 19 nt, Pseudomonas aeruginosa PA01
gccaguucucgcagcaggc

SEQ ID NO: 1547295 - RNA, 22 nt, Pseudomonas aeruginosa PA01
gccaguucgucgagcaugccga

SEQ ID NO: 1547296 - RNA, 17 nt, Pseudomonas aeruginosa PA01
gccaguuggacgcggcc

SEQ ID NO: 1547297 - RNA, 13 nt, Pseudomonas aeruginosa PA01
gccaguuggcccu

SEQ ID NO: 1547298 - RNA, 14 nt, Pseudomonas aeruginosa PA01
gccaguuggcccuu

SEQ ID NO: 1547299 - RNA, 17 nt, Pseudomonas aeruginosa PA01
gccaguuggcccuugac

SEQ ID NO: 1547300 - RNA, 13 nt, Pseudomonas aeruginosa PA01
gccaguggcuggc

SEQ ID NO: 1547301 - RNA, 17 nt, Pseudomonas aeruginosa PA01
gccagugcaugcgugca

SEQ ID NO: 1547302 - RNA, 14 nt, Pseudomonas aeruginosa PA01
gccagggaggcgcu

SEQ ID NO: 1547303 - RNA, 20 nt, Pseudomonas aeruginosa PA01
gccagggaggcgcuggccag

SEQ ID NO: 1547304 - RNA, 21 nt, Pseudomonas aeruginosa PA01
gccagggauacucaugcaggc

SEQ ID NO: 1547305 - RNA, 14 nt, Pseudomonas aeruginosa PA01
gccagggcagcagg

SEQ ID NO: 1547306 - RNA, 16 nt, Pseudomonas aeruginosa PA01
gccagggcagcagguc

SEQ ID NO: 1547307 - RNA, 14 nt, Pseudomonas aeruginosa PA01
gccagggaaaagcc

SEQ ID NO: 1547308 - RNA, 19 nt, Pseudomonas aeruginosa PA01
gccagggacgcgcagcggc

SEQ ID NO: 1547309 - RNA, 13 nt, Pseudomonas aeruginosa PA01
gccaggcuggcca

SEQ ID NO: 1547310 - RNA, 20 nt, Pseudomonas aeruginosa PA01
gccaggcuuuccgccgagcg

SEQ ID NO: 1547311 - RNA, 22 nt, Pseudomonas aeruginosa PA01
gccaggcuggcugguaacgggc

SEQ ID NO: 1547312 - RNA, 22 nt, Pseudomonas aeruginosa PA01
gccaggcuggguuggcgcgaga

SEQ ID NO: 1547313 - RNA, 14 nt, Pseudomonas aeruginosa PA01
gccaggcugucagg

SEQ ID NO: 1547314 - RNA, 19 nt, Pseudomonas aeruginosa PA01
gccaggcugucagggcgca

SEQ ID NO: 1547315 - RNA, 12 nt, Pseudomonas aeruginosa PA01
gccacuguccau

SEQ ID NO: 1547316 - RNA, 19 nt, Pseudomonas aeruginosa PA01
gccacuucaagcuggcgca

SEQ ID NO: 1547317 - RNA, 20 nt, Pseudomonas aeruginosa PA01
gccacuucguccggccgccc

SEQ ID NO: 1547318 - RNA, 19 nt, Pseudomonas aeruginosa PA01
gccagggagucgcuggcca

SEQ ID NO: 1547319 - RNA, 15 nt, Pseudomonas aeruginosa PA01
gccagggcccacagu

SEQ ID NO: 1547320 - RNA, 13 nt, Pseudomonas aeruginosa PA01
gccagggccgcga

SEQ ID NO: 1547321 - RNA, 21 nt, Pseudomonas aeruginosa PA01
gccagggccgcgagagguuca

SEQ ID NO: 1547322 - RNA, 20 nt, Pseudomonas aeruginosa PA01
gccagggcgaacagcgccgc

SEQ ID NO: 1547323 - RNA, 22 nt, Pseudomonas aeruginosa PA01
gccagggcgaacagcgccgcgg

SEQ ID NO: 1547324 - RNA, 13 nt, Pseudomonas aeruginosa PA01
gccagggcggcgc

SEQ ID NO: 1547325 - RNA, 16 nt, Pseudomonas aeruginosa PA01
gccagggcggucggcc

SEQ ID NO: 1547326 - RNA, 15 nt, Pseudomonas aeruginosa PA01
gccagggcuucccag

SEQ ID NO: 1547327 - RNA, 18 nt, Pseudomonas aeruginosa PA01
gccagggcuucccaggcc

SEQ ID NO: 1547328 - RNA, 21 nt, Pseudomonas aeruginosa PA01
gccagggcuucccaggccagc

SEQ ID NO: 1547329 - RNA, 13 nt, Pseudomonas aeruginosa PA01
gccagggcgcggu

SEQ ID NO: 1547330 - RNA, 16 nt, Pseudomonas aeruginosa PA01
gccagggcgcucaccg

SEQ ID NO: 1547331 - RNA, 22 nt, Pseudomonas aeruginosa PA01
gccaggggcuagucgcgcagcg

SEQ ID NO: 1547332 - RNA, 21 nt, Pseudomonas aeruginosa PA01
gccaggguaccguugcgcagg

SEQ ID NO: 1547333 - RNA, 23 nt, Pseudomonas aeruginosa PA01
gccaggguacuucgugccacagg

SEQ ID NO: 1547334 - RNA, 19 nt, Pseudomonas aeruginosa PA01
gccagguccgaacagagga

SEQ ID NO: 1547335 - RNA, 16 nt, Pseudomonas aeruginosa PA01
gccagguccaggcuca

SEQ ID NO: 1547336 - RNA, 13 nt, Pseudomonas aeruginosa PA01
gccaggucagcca

SEQ ID NO: 1547337 - RNA, 18 nt, Pseudomonas aeruginosa PA01
gccaggucgguccgccga

SEQ ID NO: 1547338 - RNA, 19 nt, Pseudomonas aeruginosa PA01
gccaggucgcgacugacca

SEQ ID NO: 1547339 - RNA, 19 nt, Pseudomonas aeruginosa PA01
gccagggucuugccgaccu

SEQ ID NO: 1547340 - RNA, 19 nt, Pseudomonas aeruginosa PA01
gccagggucgccagcaggu

SEQ ID NO: 1547341 - RNA, 20 nt, Pseudomonas aeruginosa PA01
gccagguacggaugccgcga

SEQ ID NO: 1547342 - RNA, 18 nt, Pseudomonas aeruginosa PA01
gccagguaguccagcggu

SEQ ID NO: 1547343 - RNA, 19 nt, Pseudomonas aeruginosa PA01
gccagguugcgcaaccagc

SEQ ID NO: 1547344 - RNA, 22 nt, Pseudomonas aeruginosa PA01
gccagguugcgcaaccagcgcu

SEQ ID NO: 1547345 - RNA, 18 nt, Pseudomonas aeruginosa PA01
gccagguuggccuggccc

SEQ ID NO: 1547346 - RNA, 20 nt, Pseudomonas aeruginosa PA01
gccaggucuucuggaaaucg

SEQ ID NO: 1547347 - RNA, 23 nt, Pseudomonas aeruginosa PA01
gccaggugcaggaagcgccgggc

SEQ ID NO: 1547348 - RNA, 16 nt, Pseudomonas aeruginosa PA01
gccauccagccaggcg

SEQ ID NO: 1547349 - RNA, 19 nt, Pseudomonas aeruginosa PA01
gccauccagccaggcgcuc

SEQ ID NO: 1547350 - RNA, 21 nt, Pseudomonas aeruginosa PA01
gccauccccgaggcgacgccc

SEQ ID NO: 1547351 - RNA, 21 nt, Pseudomonas aeruginosa PA01
gccaucccucuaucacacugu

SEQ ID NO: 1547352 - RNA, 18 nt, Pseudomonas aeruginosa PA01
gccauccgcagucuucuc

SEQ ID NO: 1547353 - RNA, 14 nt, Pseudomonas aeruginosa PA01
gccauccgcccugc

SEQ ID NO: 1547354 - RNA, 23 nt, Pseudomonas aeruginosa PA01
gccauccgccuucuuuucuuccg

SEQ ID NO: 1547355 - RNA, 22 nt, Pseudomonas aeruginosa PA01
gccauccgcgccgaccagccgc

SEQ ID NO: 1547356 - RNA, 20 nt, Pseudomonas aeruginosa PA01
gccaucgccggcccgcgcgg

SEQ ID NO: 1547357 - RNA, 23 nt, Pseudomonas aeruginosa PA01
gccaucgcggaaacccuuccagc

SEQ ID NO: 1547358 - RNA, 13 nt, Pseudomonas aeruginosa PA01
gccaucagcacca

SEQ ID NO: 1547359 - RNA, 20 nt, Pseudomonas aeruginosa PA01
gccaucagcaccaggaagcc

SEQ ID NO: 1547360 - RNA, 18 nt, Pseudomonas aeruginosa PA01
gccauaccuccagccagc

SEQ ID NO: 1547361 - RNA, 14 nt, Pseudomonas aeruginosa PA01
gccauaggcggcgc

SEQ ID NO: 1547362 - RNA, 17 nt, Pseudomonas aeruginosa PA01
gccauaggcggcgcaga

SEQ ID NO: 1547363 - RNA, 15 nt, Pseudomonas aeruginosa PA01
gccauagcgcgccgg

SEQ ID NO: 1547364 - RNA, 18 nt, Pseudomonas aeruginosa PA01
gccauagcgcgccggguu

SEQ ID NO: 1547365 - RNA, 18 nt, Pseudomonas aeruginosa PA01
gccaguuggugcacgcgc

SEQ ID NO: 1547366 - RNA, 13 nt, Pseudomonas aeruginosa PA01
gccaguuguuccg

SEQ ID NO: 1547367 - RNA, 14 nt, Pseudomonas aeruginosa PA01
gccauuccgcggca

SEQ ID NO: 1547368 - RNA, 15 nt, Pseudomonas aeruginosa PA01
gccaugggccggccg

SEQ ID NO: 1547369 - RNA, 14 nt, Pseudomonas aeruginosa PA01
gccauuucugcugu

SEQ ID NO: 1547370 - RNA, 12 nt, Pseudomonas aeruginosa PA01
gccauuccuggg

SEQ ID NO: 1547371 - RNA, 20 nt, Pseudomonas aeruginosa PA01
gccauucgaauggcgccggc

SEQ ID NO: 1547372 - RNA, 21 nt, Pseudomonas aeruginosa PA01
gccauucgaauggcgccggcc

SEQ ID NO: 1547373 - RNA, 21 nt, Pseudomonas aeruginosa PA01
gccauucgcugucgagcaggg

SEQ ID NO: 1547374 - RNA, 22 nt, Pseudomonas aeruginosa PA01
gccauucgcugucgagcaggga

SEQ ID NO: 1547375 - RNA, 15 nt, Pseudomonas aeruginosa PA01
gcccaagccgagcgg

SEQ ID NO: 1547376 - RNA, 20 nt, Pseudomonas aeruginosa PA01
gcccaacuggcggaugcguu

SEQ ID NO: 1547377 - RNA, 19 nt, Pseudomonas aeruginosa PA01
gccaugaucaucgccugcu

SEQ ID NO: 1547378 - RNA, 18 nt, Pseudomonas aeruginosa PA01
gccaugaccucggccagc

SEQ ID NO: 1547379 - RNA, 19 nt, Pseudomonas aeruginosa PA01
gccaugaaaaagccgggau

SEQ ID NO: 1547380 - RNA, 16 nt, Pseudomonas aeruginosa PA01
gccaucgccucgccgg

SEQ ID NO: 1547381 - RNA, 19 nt, Pseudomonas aeruginosa PA01
gccaucgcuuuccuggccg

SEQ ID NO: 1547382 - RNA, 18 nt, Pseudomonas aeruginosa PA01
gccaucggccuggggcuc

SEQ ID NO: 1547383 - RNA, 14 nt, Pseudomonas aeruginosa PA01
gccauggcggcgga

SEQ ID NO: 1547384 - RNA, 17 nt, Pseudomonas aeruginosa PA01
gccauggcgcuugcgca

SEQ ID NO: 1547385 - RNA, 18 nt, Pseudomonas aeruginosa PA01
gccauggguggaacccgc

SEQ ID NO: 1547386 - RNA, 20 nt, Pseudomonas aeruginosa PA01
gccauggguggaacccgcuu

SEQ ID NO: 1547387 - RNA, 15 nt, Pseudomonas aeruginosa PA01
gccaugcaggccagg

SEQ ID NO: 1547388 - RNA, 17 nt, Pseudomonas aeruginosa PA01
gccaugcaggccagggc

SEQ ID NO: 1547389 - RNA, 15 nt, Pseudomonas aeruginosa PA01
gccaugcaggcugcc

SEQ ID NO: 1547390 - RNA, 18 nt, Pseudomonas aeruginosa PA01
gccaugaugugcgcaggc

SEQ ID NO: 1547391 - RNA, 20 nt, Pseudomonas aeruginosa PA01
gcccguauggcgggccuugc

SEQ ID NO: 1547392 - RNA, 22 nt, Pseudomonas aeruginosa PA01
gcccguagucguucagcgccuc

SEQ ID NO: 1547393 - RNA, 15 nt, Pseudomonas aeruginosa PA01
gcccguccgcgccac

SEQ ID NO: 1547394 - RNA, 24 nt, Pseudomonas aeruginosa PA01
gcccgucaggccuugcgcggcgcc

SEQ ID NO: 1547395 - RNA, 21 nt, Pseudomonas aeruginosa PA01
gcccgguggggcgggcgaagc

SEQ ID NO: 1547396 - RNA, 16 nt, Pseudomonas aeruginosa PA01
gcccgguccguccagc

SEQ ID NO: 1547397 - RNA, 22 nt, Pseudomonas aeruginosa PA01
gcccgguccguccagcgcgccc

SEQ ID NO: 1547398 - RNA, 14 nt, Pseudomonas aeruginosa PA01
gcccggucucagcc

SEQ ID NO: 1547399 - RNA, 19 nt, Pseudomonas aeruginosa PA01
gcccggucucagccggcgc

SEQ ID NO: 1547400 - RNA, 23 nt, Pseudomonas aeruginosa PA01
gcccggucuagcgccccggccgc

SEQ ID NO: 1547401 - RNA, 13 nt, Pseudomonas aeruginosa PA01
gcccgguccaacc

SEQ ID NO: 1547402 - RNA, 20 nt, Pseudomonas aeruginosa PA01
gcccggucagcuucgccgcc

SEQ ID NO: 1547403 - RNA, 21 nt, Pseudomonas aeruginosa PA01
gcccggucagcuucgccgccc

SEQ ID NO: 1547404 - RNA, 20 nt, Pseudomonas aeruginosa PA01
gcccgguauucagccagagc

SEQ ID NO: 1547405 - RNA, 21 nt, Pseudomonas aeruginosa PA01
gcccgguauucagccagagcc

SEQ ID NO: 1547406 - RNA, 21 nt, Pseudomonas aeruginosa PA01
gcccgguucagcgggacagcu

SEQ ID NO: 1547407 - RNA, 14 nt, Pseudomonas aeruginosa PA01
gcccgccagcaggc

SEQ ID NO: 1547408 - RNA, 18 nt, Pseudomonas aeruginosa PA01
gcccgccagguggcgggc

SEQ ID NO: 1547409 - RNA, 21 nt, Pseudomonas aeruginosa PA01
gcccgccggcgcgcccaggcc

SEQ ID NO: 1547410 - RNA, 22 nt, Pseudomonas aeruginosa PA01
gcccgccggcgcgcccaggccc

SEQ ID NO: 1547411 - RNA, 17 nt, Pseudomonas aeruginosa PA01
gcccgccguccuccagc

SEQ ID NO: 1547412 - RNA, 18 nt, Pseudomonas aeruginosa PA01
gcccgccguccuccagca

SEQ ID NO: 1547413 - RNA, 20 nt, Pseudomonas aeruginosa PA01
gcccgccgugcgcuccgcca

SEQ ID NO: 1547414 - RNA, 17 nt, Pseudomonas aeruginosa PA01
gcccgccgucauggcgg

SEQ ID NO: 1547415 - RNA, 16 nt, Pseudomonas aeruginosa PA01
gcccgccucggcggcu

SEQ ID NO: 1547416 - RNA, 16 nt, Pseudomonas aeruginosa PA01
gcccgccugauggcga

SEQ ID NO: 1547417 - RNA, 17 nt, Pseudomonas aeruginosa PA01
gcccucagcagcgccgc

SEQ ID NO: 1547418 - RNA, 12 nt, Pseudomonas aeruginosa PA01
gcccucagcggc

SEQ ID NO: 1547419 - RNA, 13 nt, Pseudomonas aeruginosa PA01
gcccuccauccag

SEQ ID NO: 1547420 - RNA, 14 nt, Pseudomonas aeruginosa PA01
gcccuccagcaccc

SEQ ID NO: 1547421 - RNA, 17 nt, Pseudomonas aeruginosa PA01
gcccuccagcacccagg

SEQ ID NO: 1547422 - RNA, 17 nt, Pseudomonas aeruginosa PA01
gcccuacaaugauggcc

SEQ ID NO: 1547423 - RNA, 18 nt, Pseudomonas aeruginosa PA01
gcccuacccgacaggcag

SEQ ID NO: 1547424 - RNA, 23 nt, Pseudomonas aeruginosa PA01
gcccuaccugucccggacgacga

SEQ ID NO: 1547425 - RNA, 15 nt, Pseudomonas aeruginosa PA01
gcccuacgaaagcgg

SEQ ID NO: 1547426 - RNA, 22 nt, Pseudomonas aeruginosa PA01
gcccuacggggacaugucgagg

SEQ ID NO: 1547427 - RNA, 22 nt, Pseudomonas aeruginosa PA01
gcccuacgggggcgugucgagg

SEQ ID NO: 1547428 - RNA, 17 nt, Pseudomonas aeruginosa PA01
gcccuacuccagggguc

SEQ ID NO: 1547429 - RNA, 21 nt, Pseudomonas aeruginosa PA01
gcccucgauguaggccucggc

SEQ ID NO: 1547430 - RNA, 14 nt, Pseudomonas aeruginosa PA01
gcccucgcccaggu

SEQ ID NO: 1547431 - RNA, 14 nt, Pseudomonas aeruginosa PA01
gcccucgcgacggc

SEQ ID NO: 1547432 - RNA, 21 nt, Pseudomonas aeruginosa PA01
gcccucgcaguacagcucggc

SEQ ID NO: 1547433 - RNA, 15 nt, Pseudomonas aeruginosa PA01
gcccucgcggacgcu

SEQ ID NO: 1547434 - RNA, 18 nt, Pseudomonas aeruginosa PA01
gcccucgcggacgcuggc

SEQ ID NO: 1547435 - RNA, 20 nt, Pseudomonas aeruginosa PA01
gcccucgcggacgcuggcga

SEQ ID NO: 1547436 - RNA, 23 nt, Pseudomonas aeruginosa PA01
gcccucgcggaucugcuccugca

SEQ ID NO: 1547437 - RNA, 23 nt, Pseudomonas aeruginosa PA01
gcccucgcggcggcaggccagcu

SEQ ID NO: 1547438 - RNA, 18 nt, Pseudomonas aeruginosa PA01
gcccucgcuccaacgcag

SEQ ID NO: 1547439 - RNA, 22 nt, Pseudomonas aeruginosa PA01
gcccucgcucguuccgcggagu

SEQ ID NO: 1547440 - RNA, 17 nt, Pseudomonas aeruginosa PA01
gcccucgcugagcagga

SEQ ID NO: 1547441 - RNA, 16 nt, Pseudomonas aeruginosa PA01
gcccucgaagcccugc

SEQ ID NO: 1547442 - RNA, 14 nt, Pseudomonas aeruginosa PA01
gcccuccugggccu

SEQ ID NO: 1547443 - RNA, 14 nt, Pseudomonas aeruginosa PA01
gcccucgaccaggu

SEQ ID NO: 1547444 - RNA, 14 nt, Pseudomonas aeruginosa PA01
gcccuccccuggcc

SEQ ID NO: 1547445 - RNA, 17 nt, Pseudomonas aeruginosa PA01
gcccgucuagcgcaggc

SEQ ID NO: 1547446 - RNA, 17 nt, Pseudomonas aeruginosa PA01
gcccgucgucguggcga

SEQ ID NO: 1547447 - RNA, 13 nt, Pseudomonas aeruginosa PA01
gcccgucggccuc

SEQ ID NO: 1547448 - RNA, 15 nt, Pseudomonas aeruginosa PA01
gcccgucgcgccggc

SEQ ID NO: 1547449 - RNA, 15 nt, Pseudomonas aeruginosa PA01
gcccgucgcgcgccg

SEQ ID NO: 1547450 - RNA, 20 nt, Pseudomonas aeruginosa PA01
gcccguccgucccacaggcc

SEQ ID NO: 1547451 - RNA, 23 nt, Pseudomonas aeruginosa PA01
gcccguccgucccacaggccggc

SEQ ID NO: 1547452 - RNA, 14 nt, Pseudomonas aeruginosa PA01
gcccguccuaggcc

SEQ ID NO: 1547453 - RNA, 22 nt, Pseudomonas aeruginosa PA01
gcccgucgaccaucaccagcgc

SEQ ID NO: 1547454 - RNA, 23 nt, Pseudomonas aeruginosa PA01
gcccgucgaccaucaccagcgcc

SEQ ID NO: 1547455 - RNA, 16 nt, Pseudomonas aeruginosa PA01
gcccgugcggcacgcu

SEQ ID NO: 1547456 - RNA, 17 nt, Pseudomonas aeruginosa PA01
gcccguugcgguagugc

SEQ ID NO: 1547457 - RNA, 22 nt, Pseudomonas aeruginosa PA01
gcccguuccaccgccuggacca

SEQ ID NO: 1547458 - RNA, 23 nt, Pseudomonas aeruginosa PA01
gcccgugggguauuccaggcgaa

SEQ ID NO: 1547459 - RNA, 17 nt, Pseudomonas aeruginosa PA01
gcccguguucggccagc

SEQ ID NO: 1547460 - RNA, 18 nt, Pseudomonas aeruginosa PA01
gcccguguucggccagcc

SEQ ID NO: 1547461 - RNA, 16 nt, Pseudomonas aeruginosa PA01
gcccuggcucugggcc

SEQ ID NO: 1547462 - RNA, 20 nt, Pseudomonas aeruginosa PA01
gcccuguuucggguccaggc

SEQ ID NO: 1547463 - RNA, 15 nt, Pseudomonas aeruginosa PA01
gcccugggcggccuc

SEQ ID NO: 1547464 - RNA, 18 nt, Pseudomonas aeruginosa PA01
gcccugggcggcgaccug

SEQ ID NO: 1547465 - RNA, 16 nt, Pseudomonas aeruginosa PA01
gcccuguucggcggga

SEQ ID NO: 1547466 - RNA, 15 nt, Pseudomonas aeruginosa PA01
gcccuguucgucugg

SEQ ID NO: 1547467 - RNA, 21 nt, Pseudomonas aeruginosa PA01
gcccuguucgucuggcgccug

SEQ ID NO: 1547468 - RNA, 14 nt, Pseudomonas aeruginosa PA01
gcccuggccgcugc

SEQ ID NO: 1547469 - RNA, 20 nt, Pseudomonas aeruginosa PA01
gcccuggccgucggccugcu

SEQ ID NO: 1547470 - RNA, 14 nt, Pseudomonas aeruginosa PA01
gcccuggcgcggca

SEQ ID NO: 1547471 - RNA, 23 nt, Pseudomonas aeruginosa PA01
gcccuggcgcggcaaagugcggu

SEQ ID NO: 1547472 - RNA, 16 nt, Pseudomonas aeruginosa PA01
gcccuggcgcaggcgg

SEQ ID NO: 1547473 - RNA, 15 nt, Pseudomonas aeruginosa PA01
gcccugggccccggc

SEQ ID NO: 1547474 - RNA, 21 nt, Pseudomonas aeruginosa PA01
gcccugggccccggccggcag

SEQ ID NO: 1547475 - RNA, 15 nt, Pseudomonas aeruginosa PA01
gcccugggcgccgcc

SEQ ID NO: 1547476 - RNA, 22 nt, Pseudomonas aeruginosa PA01
gcccuggcgguuuuccgguugc

SEQ ID NO: 1547477 - RNA, 20 nt, Pseudomonas aeruginosa PA01
gcccuggcguggccggcgag

SEQ ID NO: 1547478 - RNA, 19 nt, Pseudomonas aeruginosa PA01
gcccuucgagaaacugcag

SEQ ID NO: 1547479 - RNA, 16 nt, Pseudomonas aeruginosa PA01
gcccuugucgcccuuc

SEQ ID NO: 1547480 - RNA, 15 nt, Pseudomonas aeruginosa PA01
gcccuugucgccgcu

SEQ ID NO: 1547481 - RNA, 14 nt, Pseudomonas aeruginosa PA01
gcccuuggcggcgc

SEQ ID NO: 1547482 - RNA, 13 nt, Pseudomonas aeruginosa PA01
gcccuucgcgcuc

SEQ ID NO: 1547483 - RNA, 20 nt, Pseudomonas aeruginosa PA01
gcccuuuucaauuccgccgc

SEQ ID NO: 1547484 - RNA, 22 nt, Pseudomonas aeruginosa PA01
gcccuuuucaauuccgccgcgg

SEQ ID NO: 1547485 - RNA, 19 nt, Pseudomonas aeruginosa PA01
gcccuuuuccaccggccgc

SEQ ID NO: 1547486 - RNA, 19 nt, Pseudomonas aeruginosa PA01
gcccuuuuucgucgccagc

SEQ ID NO: 1547487 - RNA, 13 nt, Pseudomonas aeruginosa PA01
gcccugccccuuc

SEQ ID NO: 1547488 - RNA, 20 nt, Pseudomonas aeruginosa PA01
gcccugccccuucggcugca

SEQ ID NO: 1547489 - RNA, 23 nt, Pseudomonas aeruginosa PA01
gcccugcaggccgaauccgccgg

SEQ ID NO: 1547490 - RNA, 14 nt, Pseudomonas aeruginosa PA01
gcccuggccgacgc

SEQ ID NO: 1547491 - RNA, 17 nt, Pseudomonas aeruginosa PA01
gcccugcaccuugggau

SEQ ID NO: 1547492 - RNA, 23 nt, Pseudomonas aeruginosa PA01
gcccugaggcuuuccugcgccuc

SEQ ID NO: 1547493 - RNA, 18 nt, Pseudomonas aeruginosa PA01
gcccugacccgcaccggc

SEQ ID NO: 1547494 - RNA, 14 nt, Pseudomonas aeruginosa PA01
gcccucgggccgca

SEQ ID NO: 1547495 - RNA, 18 nt, Pseudomonas aeruginosa PA01
gcccucgggccgcagggg

SEQ ID NO: 1547496 - RNA, 15 nt, Pseudomonas aeruginosa PA01
gcccucggcgcccgc

SEQ ID NO: 1547497 - RNA, 22 nt, Pseudomonas aeruginosa PA01
gcccucggcgcccgccugcagg

SEQ ID NO: 1547498 - RNA, 23 nt, Pseudomonas aeruginosa PA01
gcccucggcgcccgccugcagga

SEQ ID NO: 1547499 - RNA, 16 nt, Pseudomonas aeruginosa PA01
gcccucggcgccgagc

SEQ ID NO: 1547500 - RNA, 16 nt, Pseudomonas aeruginosa PA01
gcccucggcgcuggcc

SEQ ID NO: 1547501 - RNA, 22 nt, Pseudomonas aeruginosa PA01
gcccucgucgcaccuguuccag

SEQ ID NO: 1547502 - RNA, 17 nt, Pseudomonas aeruginosa PA01
gccgaccugcccgcugu

SEQ ID NO: 1547503 - RNA, 20 nt, Pseudomonas aeruginosa PA01
gccgaccacaugggcgaccg

SEQ ID NO: 1547504 - RNA, 21 nt, Pseudomonas aeruginosa PA01
gccgacgagcagcucgccggc

SEQ ID NO: 1547505 - RNA, 15 nt, Pseudomonas aeruginosa PA01
gccgacgaagaccuu

SEQ ID NO: 1547506 - RNA, 12 nt, Pseudomonas aeruginosa PA01
gccgaccuucac

SEQ ID NO: 1547507 - RNA, 21 nt, Pseudomonas aeruginosa PA01
gccgaccuguaccgcucccca

SEQ ID NO: 1547508 - RNA, 22 nt, Pseudomonas aeruginosa PA01
gccgaccuguaccgcuccccac

SEQ ID NO: 1547509 - RNA, 16 nt, Pseudomonas aeruginosa PA01
gccgaauccuccagcc

SEQ ID NO: 1547510 - RNA, 23 nt, Pseudomonas aeruginosa PA01
gccgacaggucgcuuucgcgcag

SEQ ID NO: 1547511 - RNA, 19 nt, Pseudomonas aeruginosa PA01
gccgacaggucggccggca

SEQ ID NO: 1547512 - RNA, 15 nt, Pseudomonas aeruginosa PA01
gccgacagcggcugg

SEQ ID NO: 1547513 - RNA, 16 nt, Pseudomonas aeruginosa PA01
gccgacagcggcuggc

SEQ ID NO: 1547514 - RNA, 14 nt, Pseudomonas aeruginosa PA01
gccgaagggccgca

SEQ ID NO: 1547515 - RNA, 18 nt, Pseudomonas aeruginosa PA01
gccgaagggccgcagguu

SEQ ID NO: 1547516 - RNA, 13 nt, Pseudomonas aeruginosa PA01
gccgaaguccugc

SEQ ID NO: 1547517 - RNA, 18 nt, Pseudomonas aeruginosa PA01
gccgaaguccugcaacag

SEQ ID NO: 1547518 - RNA, 21 nt, Pseudomonas aeruginosa PA01
gccgaaguccugcaacagggc

SEQ ID NO: 1547519 - RNA, 19 nt, Pseudomonas aeruginosa PA01
gccgaaguucuucagcagc

SEQ ID NO: 1547520 - RNA, 16 nt, Pseudomonas aeruginosa PA01
gccgaaguuguagaug

SEQ ID NO: 1547521 - RNA, 22 nt, Pseudomonas aeruginosa PA01
aaagcggugccgcguagggcga

SEQ ID NO: 1547522 - RNA, 22 nt, Pseudomonas aeruginosa PA01
aaagcgguaccgggccaggcaa

SEQ ID NO: 1547523 - RNA, 22 nt, Pseudomonas aeruginosa PA01
gccgaagcccuuggaguugaug

SEQ ID NO: 1547524 - RNA, 14 nt, Pseudomonas aeruginosa PA01
gccgaagccgccgg

SEQ ID NO: 1547525 - RNA, 18 nt, Pseudomonas aeruginosa PA01
gccgaagaggcccucggc

SEQ ID NO: 1547526 - RNA, 15 nt, Pseudomonas aeruginosa PA01
gccgaaggccaggcc

SEQ ID NO: 1547527 - RNA, 15 nt, Pseudomonas aeruginosa PA01
gccgaaggaaucacc

SEQ ID NO: 1547528 - RNA, 20 nt, Pseudomonas aeruginosa PA01
gccgaagauacccagcgggc

SEQ ID NO: 1547529 - RNA, 13 nt, Pseudomonas aeruginosa PA01
gccgaagauccgc

SEQ ID NO: 1547530 - RNA, 17 nt, Pseudomonas aeruginosa PA01
gccgaugaucuccgcgc

SEQ ID NO: 1547531 - RNA, 15 nt, Pseudomonas aeruginosa PA01
gccgaucaggcguag

SEQ ID NO: 1547532 - RNA, 18 nt, Pseudomonas aeruginosa PA01
gccgaucaucggcugguc

SEQ ID NO: 1547533 - RNA, 16 nt, Pseudomonas aeruginosa PA01
gccgaucaucuucugg

SEQ ID NO: 1547534 - RNA, 17 nt, Pseudomonas aeruginosa PA01
gccgaucaccaccagca

SEQ ID NO: 1547535 - RNA, 14 nt, Pseudomonas aeruginosa PA01
gccgaugccgaccu

SEQ ID NO: 1547536 - RNA, 22 nt, Pseudomonas aeruginosa PA01
gccgaugcgcaacgggcggcgg

SEQ ID NO: 1547537 - RNA, 17 nt, Pseudomonas aeruginosa PA01
gccgaugccggccggca

SEQ ID NO: 1547538 - RNA, 22 nt, Pseudomonas aeruginosa PA01
gccgaugccggccggcagcgag

SEQ ID NO: 1547539 - RNA, 14 nt, Pseudomonas aeruginosa PA01
gccgaugccgggca

SEQ ID NO: 1547540 - RNA, 16 nt, Pseudomonas aeruginosa PA01
gccgaugcgccgacgc

SEQ ID NO: 1547541 - RNA, 13 nt, Pseudomonas aeruginosa PA01
gccgaugcucggu

SEQ ID NO: 1547542 - RNA, 14 nt, Pseudomonas aeruginosa PA01
gccgaugcgcgacu

SEQ ID NO: 1547543 - RNA, 20 nt, Pseudomonas aeruginosa PA01
gccgaugcuguucagcagga

SEQ ID NO: 1547544 - RNA, 22 nt, Pseudomonas aeruginosa PA01
gccgaugcuguucagcaggagc

SEQ ID NO: 1547545 - RNA, 17 nt, Pseudomonas aeruginosa PA01
gccgauggagauguagu

SEQ ID NO: 1547546 - RNA, 21 nt, Pseudomonas aeruginosa PA01
gccgauggcgccgccgagguu

SEQ ID NO: 1547547 - RNA, 14 nt, Pseudomonas aeruginosa PA01
gccgaugucgccgg

SEQ ID NO: 1547548 - RNA, 16 nt, Pseudomonas aeruginosa PA01
gccgauugugcagggc

SEQ ID NO: 1547549 - RNA, 15 nt, Pseudomonas aeruginosa PA01
gccgaucaaugcguu

SEQ ID NO: 1547550 - RNA, 23 nt, Pseudomonas aeruginosa PA01
gccgagugugccggccaugcagg

SEQ ID NO: 1547551 - RNA, 13 nt, Pseudomonas aeruginosa PA01
gccgaucaccccg

SEQ ID NO: 1547552 - RNA, 19 nt, Pseudomonas aeruginosa PA01
gccgaucaccccgcccagu

SEQ ID NO: 1547553 - RNA, 14 nt, Pseudomonas aeruginosa PA01
gccgaucagcgccu

SEQ ID NO: 1547554 - RNA, 22 nt, Pseudomonas aeruginosa PA01
gccgagggcgaguucggcgagc

SEQ ID NO: 1547555 - RNA, 21 nt, Pseudomonas aeruginosa PA01
gccgagggcgccaggugcagg

SEQ ID NO: 1547556 - RNA, 15 nt, Pseudomonas aeruginosa PA01
gccgagggcgcggcg

SEQ ID NO: 1547557 - RNA, 17 nt, Pseudomonas aeruginosa PA01
gccgagggguacagggc

SEQ ID NO: 1547558 - RNA, 16 nt, Pseudomonas aeruginosa PA01
gccgaggucgccgcca

SEQ ID NO: 1547559 - RNA, 20 nt, Pseudomonas aeruginosa PA01
gccgaggucgucgcugagca

SEQ ID NO: 1547560 - RNA, 23 nt, Pseudomonas aeruginosa PA01
gccgaggucuuggccagccgcgc

SEQ ID NO: 1547561 - RNA, 19 nt, Pseudomonas aeruginosa PA01
gccgaggugcugcaccggg

SEQ ID NO: 1547562 - RNA, 17 nt, Pseudomonas aeruginosa PA01
gccgaguccgcgcgcgc

SEQ ID NO: 1547563 - RNA, 15 nt, Pseudomonas aeruginosa PA01
gccgagguuuccagu

SEQ ID NO: 1547564 - RNA, 22 nt, Pseudomonas aeruginosa PA01
gccgagguucuugcccagcaac

SEQ ID NO: 1547565 - RNA, 17 nt, Pseudomonas aeruginosa PA01
gccgacgccaccagcca

SEQ ID NO: 1547566 - RNA, 17 nt, Pseudomonas aeruginosa PA01
gccgacgccgagcagca

SEQ ID NO: 1547567 - RNA, 20 nt, Pseudomonas aeruginosa PA01
gccgacggacguccuccugg

SEQ ID NO: 1547568 - RNA, 12 nt, Pseudomonas aeruginosa PA01
gccgacggcccu

SEQ ID NO: 1547569 - RNA, 20 nt, Pseudomonas aeruginosa PA01
gccgacggcccuccggcgcg

SEQ ID NO: 1547570 - RNA, 14 nt, Pseudomonas aeruginosa PA01
gccgacggcgcgcu

SEQ ID NO: 1547571 - RNA, 19 nt, Pseudomonas aeruginosa PA01
gccgaggcuuuccagcagg

SEQ ID NO: 1547572 - RNA, 15 nt, Pseudomonas aeruginosa PA01
gccgccaucaccagc

SEQ ID NO: 1547573 - RNA, 16 nt, Pseudomonas aeruginosa PA01
gccgccagugcaugcg

SEQ ID NO: 1547574 - RNA, 18 nt, Pseudomonas aeruginosa PA01
gccgccaucgaccaggaa

SEQ ID NO: 1547575 - RNA, 20 nt, Pseudomonas aeruginosa PA01
gccgccaucgacguagagga

SEQ ID NO: 1547576 - RNA, 16 nt, Pseudomonas aeruginosa PA01
gccgccaugcucggcc

SEQ ID NO: 1547577 - RNA, 19 nt, Pseudomonas aeruginosa PA01
gccgccaucgccucgccgg

SEQ ID NO: 1547578 - RNA, 21 nt, Pseudomonas aeruginosa PA01
gccgccagcaggucggccugc

SEQ ID NO: 1547579 - RNA, 19 nt, Pseudomonas aeruginosa PA01
gccgccaggacggcagggu

SEQ ID NO: 1547580 - RNA, 23 nt, Pseudomonas aeruginosa PA01
gccgccaggcaggccgggcuggc

SEQ ID NO: 1547581 - RNA, 23 nt, Pseudomonas aeruginosa PA01
gccgccaggccucggcgcgggcc

SEQ ID NO: 1547582 - RNA, 11 nt, Pseudomonas aeruginosa PA01
gccgccaggcg

SEQ ID NO: 1547583 - RNA, 14 nt, Pseudomonas aeruginosa PA01
gccgccaggcgcug

SEQ ID NO: 1547584 - RNA, 16 nt, Pseudomonas aeruginosa PA01
gccgccaggcgcuggc

SEQ ID NO: 1547585 - RNA, 23 nt, Pseudomonas aeruginosa PA01
gccgccaggcggcaagggcgucu

SEQ ID NO: 1547586 - RNA, 13 nt, Pseudomonas aeruginosa PA01
gccgccaagcccu

SEQ ID NO: 1547587 - RNA, 12 nt, Pseudomonas aeruginosa PA01
gccgccaacugg

SEQ ID NO: 1547588 - RNA, 21 nt, Pseudomonas aeruginosa PA01
gccgcagguuggccccgccga

SEQ ID NO: 1547589 - RNA, 24 nt, Pseudomonas aeruginosa PA01
gccgcagguuggccccgccgagga

SEQ ID NO: 1547590 - RNA, 19 nt, Pseudomonas aeruginosa PA01
gccgcaguacgaggggccg

SEQ ID NO: 1547591 - RNA, 13 nt, Pseudomonas aeruginosa PA01
gccgcagggugaa

SEQ ID NO: 1547592 - RNA, 17 nt, Pseudomonas aeruginosa PA01
gccgcagggugcggcug

SEQ ID NO: 1547593 - RNA, 17 nt, Pseudomonas aeruginosa PA01
gccgcaggcgggcgcca

SEQ ID NO: 1547594 - RNA, 12 nt, Pseudomonas aeruginosa PA01
gccgcaggcugc

SEQ ID NO: 1547595 - RNA, 14 nt, Pseudomonas aeruginosa PA01
gccgcaggcugccg

SEQ ID NO: 1547596 - RNA, 23 nt, Pseudomonas aeruginosa PA01
gccgcaggcugccguccaggcgc

SEQ ID NO: 1547597 - RNA, 19 nt, Pseudomonas aeruginosa PA01
gccgcaggaugccgccugc

SEQ ID NO: 1547598 - RNA, 12 nt, Pseudomonas aeruginosa PA01
gccgcaggcaga

SEQ ID NO: 1547599 - RNA, 24 nt, Pseudomonas aeruginosa PA01
gccgcaggcagcacaugccacgca

SEQ ID NO: 1547600 - RNA, 16 nt, Pseudomonas aeruginosa PA01
gccgcaggccgcggcc

SEQ ID NO: 1547601 - RNA, 17 nt, Pseudomonas aeruginosa PA01
gccgcaggccgcggccg

SEQ ID NO: 1547602 - RNA, 13 nt, Pseudomonas aeruginosa PA01
gccgcacaggcug

SEQ ID NO: 1547603 - RNA, 14 nt, Pseudomonas aeruginosa PA01
gccgcaaggccagg

SEQ ID NO: 1547604 - RNA, 19 nt, Pseudomonas aeruginosa PA01
gccgcaggaaccgacgcgc

SEQ ID NO: 1547605 - RNA, 21 nt, Pseudomonas aeruginosa PA01
gccgccgaucagcgcgccuuc

SEQ ID NO: 1547606 - RNA, 15 nt, Pseudomonas aeruginosa PA01
gccgccgaucugcug

SEQ ID NO: 1547607 - RNA, 15 nt, Pseudomonas aeruginosa PA01
gccgccgaggcgcgc

SEQ ID NO: 1547608 - RNA, 22 nt, Pseudomonas aeruginosa PA01
gccgccgaacaugccgaagagc

SEQ ID NO: 1547609 - RNA, 15 nt, Pseudomonas aeruginosa PA01
gccgccgagcgccug

SEQ ID NO: 1547610 - RNA, 17 nt, Pseudomonas aeruginosa PA01
gccgccgagcgccuggc

SEQ ID NO: 1547611 - RNA, 22 nt, Pseudomonas aeruginosa PA01
gccgccgaggauagcguccagc

SEQ ID NO: 1547612 - RNA, 13 nt, Pseudomonas aeruginosa PA01
gccgccggaggga

SEQ ID NO: 1547613 - RNA, 13 nt, Pseudomonas aeruginosa PA01
gccgccgcuggcg

SEQ ID NO: 1547614 - RNA, 12 nt, Pseudomonas aeruginosa PA01
gccgccgaugcc

SEQ ID NO: 1547615 - RNA, 12 nt, Pseudomonas aeruginosa PA01
gccgcccuugcg

SEQ ID NO: 1547616 - RNA, 23 nt, Pseudomonas aeruginosa PA01
gccgcccuugcggcccgccucgg

SEQ ID NO: 1547617 - RNA, 14 nt, Pseudomonas aeruginosa PA01
gccgcccuggccga

SEQ ID NO: 1547618 - RNA, 14 nt, Pseudomonas aeruginosa PA01
gccgccgacacccg

SEQ ID NO: 1547619 - RNA, 20 nt, Pseudomonas aeruginosa PA01
gccgccgacacccgcgccgc

SEQ ID NO: 1547620 - RNA, 22 nt, Pseudomonas aeruginosa PA01
gccgccgacacccgcgccgccg

SEQ ID NO: 1547621 - RNA, 15 nt, Pseudomonas aeruginosa PA01
gccgccgacgccgga

SEQ ID NO: 1547622 - RNA, 23 nt, Pseudomonas aeruginosa PA01
gccgccgaccgggcgggucuggc

SEQ ID NO: 1547623 - RNA, 20 nt, Pseudomonas aeruginosa PA01
gccgcccggucuagcgcccc

SEQ ID NO: 1547624 - RNA, 11 nt, Pseudomonas aeruginosa PA01
gccgccccagc

SEQ ID NO: 1547625 - RNA, 15 nt, Pseudomonas aeruginosa PA01
gccgcccucggggcc

SEQ ID NO: 1547626 - RNA, 16 nt, Pseudomonas aeruginosa PA01
gccgcccuccaucagc

SEQ ID NO: 1547627 - RNA, 24 nt, Pseudomonas aeruginosa PA01
gccgcccugcucuugccgacaagc

SEQ ID NO: 1547628 - RNA, 18 nt, Pseudomonas aeruginosa PA01
gccgccccaccaccaucg

SEQ ID NO: 1547629 - RNA, 18 nt, Pseudomonas aeruginosa PA01
gccgcccagguugaugcc

SEQ ID NO: 1547630 - RNA, 13 nt, Pseudomonas aeruginosa PA01
gccgcccaguccu

SEQ ID NO: 1547631 - RNA, 20 nt, Pseudomonas aeruginosa PA01
gccgcccagcggaugcgcga

SEQ ID NO: 1547632 - RNA, 13 nt, Pseudomonas aeruginosa PA01
gccgcccagcagc

SEQ ID NO: 1547633 - RNA, 14 nt, Pseudomonas aeruginosa PA01
gccgccauugacga

SEQ ID NO: 1547634 - RNA, 21 nt, Pseudomonas aeruginosa PA01
gccgcgccuucugcaccuugg

SEQ ID NO: 1547635 - RNA, 23 nt, Pseudomonas aeruginosa PA01
gccgcgcgcgcggucgagcagcg

SEQ ID NO: 1547636 - RNA, 15 nt, Pseudomonas aeruginosa PA01
gccgcgccccacggc

SEQ ID NO: 1547637 - RNA, 16 nt, Pseudomonas aeruginosa PA01
gccgcgccggggcagc

SEQ ID NO: 1547638 - RNA, 13 nt, Pseudomonas aeruginosa PA01
gccgcgccccagc

SEQ ID NO: 1547639 - RNA, 16 nt, Pseudomonas aeruginosa PA01
gccgcgccccagcggc

SEQ ID NO: 1547640 - RNA, 21 nt, Pseudomonas aeruginosa PA01
gccgcgccccagcggcaggca

SEQ ID NO: 1547641 - RNA, 12 nt, Pseudomonas aeruginosa PA01
gccgcgcagcuu

SEQ ID NO: 1547642 - RNA, 18 nt, Pseudomonas aeruginosa PA01
gccgcgcaucaccccgca

SEQ ID NO: 1547643 - RNA, 21 nt, Pseudomonas aeruginosa PA01
gccgcgcagcgcggcgcuggg

SEQ ID NO: 1547644 - RNA, 22 nt, Pseudomonas aeruginosa PA01
gccgcgcaugaaaaagccgccc

SEQ ID NO: 1547645 - RNA, 15 nt, Pseudomonas aeruginosa PA01
gccgcgccagcaggc

SEQ ID NO: 1547646 - RNA, 13 nt, Pseudomonas aeruginosa PA01
gccgcgccagcca

SEQ ID NO: 1547647 - RNA, 17 nt, Pseudomonas aeruginosa PA01
gccgcgccaggcgcagu

SEQ ID NO: 1547648 - RNA, 13 nt, Pseudomonas aeruginosa PA01
gccgcgagcgcgg

SEQ ID NO: 1547649 - RNA, 15 nt, Pseudomonas aeruginosa PA01
gccgcgagcgcggcc

SEQ ID NO: 1547650 - RNA, 16 nt, Pseudomonas aeruginosa PA01
gccgcgagcgcggccg

SEQ ID NO: 1547651 - RNA, 18 nt, Pseudomonas aeruginosa PA01
gccgcgagcuuggcccug

SEQ ID NO: 1547652 - RNA, 16 nt, Pseudomonas aeruginosa PA01
gccgcgacgcuccagc

SEQ ID NO: 1547653 - RNA, 17 nt, Pseudomonas aeruginosa PA01
gccgccucgggcagccc

SEQ ID NO: 1547654 - RNA, 18 nt, Pseudomonas aeruginosa PA01
gccgccugcgccucggcc

SEQ ID NO: 1547655 - RNA, 18 nt, Pseudomonas aeruginosa PA01
gccgccugcggcuugccc

SEQ ID NO: 1547656 - RNA, 20 nt, Pseudomonas aeruginosa PA01
gccgccugcggcuugcccug

SEQ ID NO: 1547657 - RNA, 23 nt, Pseudomonas aeruginosa PA01
gccgccugcggcuugcccugcuc

SEQ ID NO: 1547658 - RNA, 22 nt, Pseudomonas aeruginosa PA01
gccgcgaccgaagccgcgcagc

SEQ ID NO: 1547659 - RNA, 20 nt, Pseudomonas aeruginosa PA01
gccgccggggaucagcgaga

SEQ ID NO: 1547660 - RNA, 16 nt, Pseudomonas aeruginosa PA01
gccgccggugaacagg

SEQ ID NO: 1547661 - RNA, 14 nt, Pseudomonas aeruginosa PA01
gccgccggccagcc

SEQ ID NO: 1547662 - RNA, 18 nt, Pseudomonas aeruginosa PA01
gccgccgggcgcccggcc

SEQ ID NO: 1547663 - RNA, 19 nt, Pseudomonas aeruginosa PA01
gccgccgggcgcccggccg

SEQ ID NO: 1547664 - RNA, 20 nt, Pseudomonas aeruginosa PA01
gccgccggggcgggccgcgc

SEQ ID NO: 1547665 - RNA, 14 nt, Pseudomonas aeruginosa PA01
gccgccgggcggcg

SEQ ID NO: 1547666 - RNA, 17 nt, Pseudomonas aeruginosa PA01
gccgccgggcgcgcgcc

SEQ ID NO: 1547667 - RNA, 22 nt, Pseudomonas aeruginosa PA01
gcgacagcucguggcuggcgcc

SEQ ID NO: 1547668 - RNA, 20 nt, Pseudomonas aeruginosa PA01
gcgacagcucuggggucagu

SEQ ID NO: 1547669 - RNA, 15 nt, Pseudomonas aeruginosa PA01
gcgacauccuccacc

SEQ ID NO: 1547670 - RNA, 18 nt, Pseudomonas aeruginosa PA01
gcgacauagcggcugcug

SEQ ID NO: 1547671 - RNA, 19 nt, Pseudomonas aeruginosa PA01
gcgacacauggucggccag

SEQ ID NO: 1547672 - RNA, 22 nt, Pseudomonas aeruginosa PA01
gcgacacauggucggccagguc

SEQ ID NO: 1547673 - RNA, 13 nt, Pseudomonas aeruginosa PA01
gcgacaccgccag

SEQ ID NO: 1547674 - RNA, 22 nt, Pseudomonas aeruginosa PA01
gcgacacucugguagcugcggc

SEQ ID NO: 1547675 - RNA, 17 nt, Pseudomonas aeruginosa PA01
gcgacagauagcagguc

SEQ ID NO: 1547676 - RNA, 23 nt, Pseudomonas aeruginosa PA01
gcgaauaccgcgcgcgcaaggcc

SEQ ID NO: 1547677 - RNA, 20 nt, Pseudomonas aeruginosa PA01
gcgaaaccggccagcgcggc

SEQ ID NO: 1547678 - RNA, 15 nt, Pseudomonas aeruginosa PA01
gcgaauagacgccgc

SEQ ID NO: 1547679 - RNA, 20 nt, Pseudomonas aeruginosa PA01
gcgaaugcuccggggucagu

SEQ ID NO: 1547680 - RNA, 15 nt, Pseudomonas aeruginosa PA01
gcgaaugcccggcag

SEQ ID NO: 1547681 - RNA, 15 nt, Pseudomonas aeruginosa PA01
gcgaaucugcagggc

SEQ ID NO: 1547682 - RNA, 20 nt, Pseudomonas aeruginosa PA01
gcgaaucuucggcgcgccgg

SEQ ID NO: 1547683 - RNA, 19 nt, Pseudomonas aeruginosa PA01
gcgaccgaacagcgcgcca

SEQ ID NO: 1547684 - RNA, 18 nt, Pseudomonas aeruginosa PA01
gcgacccuggggucgccg

SEQ ID NO: 1547685 - RNA, 18 nt, Pseudomonas aeruginosa PA01
gcgacccuucaacggcga

SEQ ID NO: 1547686 - RNA, 16 nt, Pseudomonas aeruginosa PA01
gcgacccgggucaggc

SEQ ID NO: 1547687 - RNA, 21 nt, Pseudomonas aeruginosa PA01
gcgacccaucgccgaagacgc

SEQ ID NO: 1547688 - RNA, 15 nt, Pseudomonas aeruginosa PA01
gcgacccagaccugc

SEQ ID NO: 1547689 - RNA, 18 nt, Pseudomonas aeruginosa PA01
gcgacccgaaggucgccg

SEQ ID NO: 1547690 - RNA, 14 nt, Pseudomonas aeruginosa PA01
gcgaccagccgggg

SEQ ID NO: 1547691 - RNA, 17 nt, Pseudomonas aeruginosa PA01
gcgaccagcgccaggcg

SEQ ID NO: 1547692 - RNA, 20 nt, Pseudomonas aeruginosa PA01
gcgaccagcgucgcgcgugc

SEQ ID NO: 1547693 - RNA, 20 nt, Pseudomonas aeruginosa PA01
gcgaccagguccggagggcc

SEQ ID NO: 1547694 - RNA, 22 nt, Pseudomonas aeruginosa PA01
gcgaccagguccggagggcccg

SEQ ID NO: 1547695 - RNA, 20 nt, Pseudomonas aeruginosa PA01
gcgaccauguucaccagcgc

SEQ ID NO: 1547696 - RNA, 18 nt, Pseudomonas aeruginosa PA01
gcgaccaguugcucgcuc

SEQ ID NO: 1547697 - RNA, 20 nt, Pseudomonas aeruginosa PA01
gcgaccaccaccaggucggc

SEQ ID NO: 1547698 - RNA, 22 nt, Pseudomonas aeruginosa PA01
gcgacaugccgguucccgcagc

SEQ ID NO: 1547699 - RNA, 18 nt, Pseudomonas aeruginosa PA01
gcgacaucggcgauggcc

SEQ ID NO: 1547700 - RNA, 13 nt, Pseudomonas aeruginosa PA01
gcgacaucuccag

SEQ ID NO: 1547701 - RNA, 16 nt, Pseudomonas aeruginosa PA01
gcgacaucuccaggcc

SEQ ID NO: 1547702 - RNA, 17 nt, Pseudomonas aeruginosa PA01
gcgacaucuccaggccg

SEQ ID NO: 1547703 - RNA, 21 nt, Pseudomonas aeruginosa PA01
gcgacgaagcccucgcgacgg

SEQ ID NO: 1547704 - RNA, 22 nt, Pseudomonas aeruginosa PA01
gcgacgaagcccucgcgacggc

SEQ ID NO: 1547705 - RNA, 22 nt, Pseudomonas aeruginosa PA01
gcgaccuugcgcaccagggcca

SEQ ID NO: 1547706 - RNA, 15 nt, Pseudomonas aeruginosa PA01
gcgaccuuggccagc

SEQ ID NO: 1547707 - RNA, 15 nt, Pseudomonas aeruginosa PA01
gcgaccuugucgaug

SEQ ID NO: 1547708 - RNA, 19 nt, Pseudomonas aeruginosa PA01
gcgaccugguggcgccggc

SEQ ID NO: 1547709 - RNA, 13 nt, Pseudomonas aeruginosa PA01
gcgaccugcucgu

SEQ ID NO: 1547710 - RNA, 16 nt, Pseudomonas aeruginosa PA01
gcgacgagccggacgg

SEQ ID NO: 1547711 - RNA, 17 nt, Pseudomonas aeruginosa PA01
gcgacgagccggacggc

SEQ ID NO: 1547712 - RNA, 20 nt, Pseudomonas aeruginosa PA01
gcgacgagccggacggcggc

SEQ ID NO: 1547713 - RNA, 17 nt, Pseudomonas aeruginosa PA01
gcgacgacugcggcagc

SEQ ID NO: 1547714 - RNA, 20 nt, Pseudomonas aeruginosa PA01
gcgacgacgaagaguaaaug

SEQ ID NO: 1547715 - RNA, 16 nt, Pseudomonas aeruginosa PA01
gcgacgaagcuggcga

SEQ ID NO: 1547716 - RNA, 18 nt, Pseudomonas aeruginosa PA01
gcgacgaaggucggcggc

SEQ ID NO: 1547717 - RNA, 19 nt, Pseudomonas aeruginosa PA01
gcgaccggaugcuccaggu

SEQ ID NO: 1547718 - RNA, 20 nt, Pseudomonas aeruginosa PA01
gcgaccuccggcgccaggcc

SEQ ID NO: 1547719 - RNA, 16 nt, Pseudomonas aeruginosa PA01
gcgaccgugaggcgca

SEQ ID NO: 1547720 - RNA, 15 nt, Pseudomonas aeruginosa PA01
gcgaccgcccgccuc

SEQ ID NO: 1547721 - RNA, 14 nt, Pseudomonas aeruginosa PA01
gcgaccgccaggcg

SEQ ID NO: 1547722 - RNA, 19 nt, Pseudomonas aeruginosa PA01
gcgaccgccaggcggccgc

SEQ ID NO: 1547723 - RNA, 20 nt, Pseudomonas aeruginosa PA01
gcgaccgccaggcggccgcu

SEQ ID NO: 1547724 - RNA, 15 nt, Pseudomonas aeruginosa PA01
gcgaccgcuggacca

SEQ ID NO: 1547725 - RNA, 12 nt, Pseudomonas aeruginosa PA01
gcgagcaccaug

SEQ ID NO: 1547726 - RNA, 19 nt, Pseudomonas aeruginosa PA01
gcgagcaccaugccgauga

SEQ ID NO: 1547727 - RNA, 20 nt, Pseudomonas aeruginosa PA01
gcgagcagcggcgcuuucca

SEQ ID NO: 1547728 - RNA, 14 nt, Pseudomonas aeruginosa PA01
gcgagcagggcgcu

SEQ ID NO: 1547729 - RNA, 14 nt, Pseudomonas aeruginosa PA01
gcgagcaccgcgca

SEQ ID NO: 1547730 - RNA, 13 nt, Pseudomonas aeruginosa PA01
gcgagcacggcga

SEQ ID NO: 1547731 - RNA, 13 nt, Pseudomonas aeruginosa PA01
gcgacugcugcug

SEQ ID NO: 1547732 - RNA, 16 nt, Pseudomonas aeruginosa PA01
gcgacuguucucuacg

SEQ ID NO: 1547733 - RNA, 19 nt, Pseudomonas aeruginosa PA01
gcgacgugggccugcuccu

SEQ ID NO: 1547734 - RNA, 22 nt, Pseudomonas aeruginosa PA01
gcgacgucgccccagccuugcu

SEQ ID NO: 1547735 - RNA, 20 nt, Pseudomonas aeruginosa PA01
gcgacgaucacccccagcga

SEQ ID NO: 1547736 - RNA, 20 nt, Pseudomonas aeruginosa PA01
gcgacgaucagcccgccggc

SEQ ID NO: 1547737 - RNA, 22 nt, Pseudomonas aeruginosa PA01
gcgacgagaaaaagcccggcau

SEQ ID NO: 1547738 - RNA, 16 nt, Pseudomonas aeruginosa PA01
gcgacgaugccgccgc

SEQ ID NO: 1547739 - RNA, 12 nt, Pseudomonas aeruginosa PA01
gcgacgaggacg

SEQ ID NO: 1547740 - RNA, 17 nt, Pseudomonas aeruginosa PA01
gcgacgaggcgcggcgg

SEQ ID NO: 1547741 - RNA, 19 nt, Pseudomonas aeruginosa PA01
gcgacgaguaaaacggcag

SEQ ID NO: 1547742 - RNA, 12 nt, Pseudomonas aeruginosa PA01
gcgacgccgcga

SEQ ID NO: 1547743 - RNA, 12 nt, Pseudomonas aeruginosa PA01
gcgacgccgcgc

SEQ ID NO: 1547744 - RNA, 15 nt, Pseudomonas aeruginosa PA01
gcgacgcagcacggc

SEQ ID NO: 1547745 - RNA, 15 nt, Pseudomonas aeruginosa PA01
gcgacgaugcgcccc

SEQ ID NO: 1547746 - RNA, 14 nt, Pseudomonas aeruginosa PA01
gcgacgcuccagcg

SEQ ID NO: 1547747 - RNA, 16 nt, Pseudomonas aeruginosa PA01
gcgacgcuccagcggc

SEQ ID NO: 1547748 - RNA, 18 nt, Pseudomonas aeruginosa PA01
gcgacgcuccagcggcag

SEQ ID NO: 1547749 - RNA, 15 nt, Pseudomonas aeruginosa PA01
gcgacgcuccaggug

SEQ ID NO: 1547750 - RNA, 16 nt, Pseudomonas aeruginosa PA01
gcgacgcuccaggugc

SEQ ID NO: 1547751 - RNA, 23 nt, Pseudomonas aeruginosa PA01
gcgacgcugaugaugccgcggcg

SEQ ID NO: 1547752 - RNA, 22 nt, Pseudomonas aeruginosa PA01
gcgacgcgcuggaccauggccg

SEQ ID NO: 1547753 - RNA, 13 nt, Pseudomonas aeruginosa PA01
gcgacgcgcaggc

SEQ ID NO: 1547754 - RNA, 15 nt, Pseudomonas aeruginosa PA01
gcgacgcgcaggccg

SEQ ID NO: 1547755 - RNA, 21 nt, Pseudomonas aeruginosa PA01
gcgacgcgaccuccggcgcca

SEQ ID NO: 1547756 - RNA, 22 nt, Pseudomonas aeruginosa PA01
gcgacggugauagagcacgccc

SEQ ID NO: 1547757 - RNA, 22 nt, Pseudomonas aeruginosa PA01
gcgacgggugcguccauccagg

SEQ ID NO: 1547758 - RNA, 19 nt, Pseudomonas aeruginosa PA01
gcgacggaaacgacaggcu

SEQ ID NO: 1547759 - RNA, 15 nt, Pseudomonas aeruginosa PA01
gcgacggaagcccuc

SEQ ID NO: 1547760 - RNA, 18 nt, Pseudomonas aeruginosa PA01
gcgaggcgucgaucaucu

SEQ ID NO: 1547761 - RNA, 17 nt, Pseudomonas aeruginosa PA01
gcgaggcgggcgcggau

SEQ ID NO: 1547762 - RNA, 12 nt, Pseudomonas aeruginosa PA01
gcgaggccggcg

SEQ ID NO: 1547763 - RNA, 23 nt, Pseudomonas aeruginosa PA01
gcgaggccguaccagucgcccgc

SEQ ID NO: 1547764 - RNA, 13 nt, Pseudomonas aeruginosa PA01
gcgaggcccgcgc

SEQ ID NO: 1547765 - RNA, 19 nt, Pseudomonas aeruginosa PA01
gcgaggcccgcgccgccgg

SEQ ID NO: 1547766 - RNA, 23 nt, Pseudomonas aeruginosa PA01
gcgaggcgcucuucacuuccagc

SEQ ID NO: 1547767 - RNA, 16 nt, Pseudomonas aeruginosa PA01
gcgaggcgcccgccgg

SEQ ID NO: 1547768 - RNA, 17 nt, Pseudomonas aeruginosa PA01
gcgaggcgcccgccggc

SEQ ID NO: 1547769 - RNA, 19 nt, Pseudomonas aeruginosa PA01
gcgaggcgcccgccggccg

SEQ ID NO: 1547770 - RNA, 11 nt, Pseudomonas aeruginosa PA01
gcgaggcgcgc

SEQ ID NO: 1547771 - RNA, 13 nt, Pseudomonas aeruginosa PA01
gcgaggcgcgccu

SEQ ID NO: 1547772 - RNA, 19 nt, Pseudomonas aeruginosa PA01
gcgagggauguuccaggcc

SEQ ID NO: 1547773 - RNA, 15 nt, Pseudomonas aeruginosa PA01
gcgagggcucgggcg

SEQ ID NO: 1547774 - RNA, 14 nt, Pseudomonas aeruginosa PA01
gcgagggcgcgcac

SEQ ID NO: 1547775 - RNA, 15 nt, Pseudomonas aeruginosa PA01
gcgagggcggcggcu

SEQ ID NO: 1547776 - RNA, 16 nt, Pseudomonas aeruginosa PA01
gcgagggcggcggcuc

SEQ ID NO: 1547777 - RNA, 15 nt, Pseudomonas aeruginosa PA01
gcgaggguggcgccc

SEQ ID NO: 1547778 - RNA, 16 nt, Pseudomonas aeruginosa PA01
gcgaggguggcgccca

SEQ ID NO: 1547779 - RNA, 17 nt, Pseudomonas aeruginosa PA01
gcgagggugaacuggcc

SEQ ID NO: 1547780 - RNA, 15 nt, Pseudomonas aeruginosa PA01
gcgagccuucagcac

SEQ ID NO: 1547781 - RNA, 19 nt, Pseudomonas aeruginosa PA01
gcgagcgauccgcugcaug

SEQ ID NO: 1547782 - RNA, 12 nt, Pseudomonas aeruginosa PA01
gcgagcgccgcc

SEQ ID NO: 1547783 - RNA, 16 nt, Pseudomonas aeruginosa PA01
gcgagcgccgccuuga

SEQ ID NO: 1547784 - RNA, 14 nt, Pseudomonas aeruginosa PA01
gcgagcgccgcggc

SEQ ID NO: 1547785 - RNA, 15 nt, Pseudomonas aeruginosa PA01
gcgaggcauucucgc

SEQ ID NO: 1547786 - RNA, 23 nt, Pseudomonas aeruginosa PA01
gcgaggaucagucgcugcucggc

SEQ ID NO: 1547787 - RNA, 20 nt, Pseudomonas aeruginosa PA01
gcgagcgggcgagggcggcg

SEQ ID NO: 1547788 - RNA, 23 nt, Pseudomonas aeruginosa PA01
gcgagcgucgagucgcgcagcca

SEQ ID NO: 1547789 - RNA, 16 nt, Pseudomonas aeruginosa PA01
gcgagcguuccaugaa

SEQ ID NO: 1547790 - RNA, 23 nt, Pseudomonas aeruginosa PA01
gcgagucgacccaggcccagccg

SEQ ID NO: 1547791 - RNA, 17 nt, Pseudomonas aeruginosa PA01
gcgagucgaucaggucg

SEQ ID NO: 1547792 - RNA, 22 nt, Pseudomonas aeruginosa PA01
gcgagucgaucaggucgccgcc

SEQ ID NO: 1547793 - RNA, 13 nt, Pseudomonas aeruginosa PA01
gcgagguccggcu

SEQ ID NO: 1547794 - RNA, 15 nt, Pseudomonas aeruginosa PA01
gcgaggucgccacgc

SEQ ID NO: 1547795 - RNA, 15 nt, Pseudomonas aeruginosa PA01
gcgaggucgccgggg

SEQ ID NO: 1547796 - RNA, 20 nt, Pseudomonas aeruginosa PA01
gcgagguggaugaacagcgg

SEQ ID NO: 1547797 - RNA, 15 nt, Pseudomonas aeruginosa PA01
gcgaguaaccaccgc

SEQ ID NO: 1547798 - RNA, 17 nt, Pseudomonas aeruginosa PA01
gcgagguuccgcggcga

SEQ ID NO: 1547799 - RNA, 19 nt, Pseudomonas aeruginosa PA01
gcgagugcugaacaucagg

SEQ ID NO: 1547800 - RNA, 12 nt, Pseudomonas aeruginosa PA01
gcgauagcucag

SEQ ID NO: 1547801 - RNA, 14 nt, Pseudomonas aeruginosa PA01
gcgauagccgacca

SEQ ID NO: 1547802 - RNA, 23 nt, Pseudomonas aeruginosa PA01
gcgauagaccaggaaggccgggc

SEQ ID NO: 1547803 - RNA, 17 nt, Pseudomonas aeruginosa PA01
gcgauacccuggccggc

SEQ ID NO: 1547804 - RNA, 16 nt, Pseudomonas aeruginosa PA01
gccugagcuggcccag

SEQ ID NO: 1547805 - RNA, 17 nt, Pseudomonas aeruginosa PA01
gccugagcuggcccagu

SEQ ID NO: 1547806 - RNA, 19 nt, Pseudomonas aeruginosa PA01
gccugagcuggcccaguug

SEQ ID NO: 1547807 - RNA, 20 nt, Pseudomonas aeruginosa PA01
gccugcaacacccaggccug

SEQ ID NO: 1547808 - RNA, 16 nt, Pseudomonas aeruginosa PA01
gccugcaaagaggcgc

SEQ ID NO: 1547809 - RNA, 19 nt, Pseudomonas aeruginosa PA01
gccugaugcaggagaugca

SEQ ID NO: 1547810 - RNA, 21 nt, Pseudomonas aeruginosa PA01
gccugcagccagcuucagccg

SEQ ID NO: 1547811 - RNA, 16 nt, Pseudomonas aeruginosa PA01
gccugcagcucgguga

SEQ ID NO: 1547812 - RNA, 17 nt, Pseudomonas aeruginosa PA01
gccugcagcaccaccuc

SEQ ID NO: 1547813 - RNA, 18 nt, Pseudomonas aeruginosa PA01
gccugcagcaccaccucg

SEQ ID NO: 1547814 - RNA, 16 nt, Pseudomonas aeruginosa PA01
gccugcaccgggccga

SEQ ID NO: 1547815 - RNA, 21 nt, Pseudomonas aeruginosa PA01
gccugcaccugcucggggccg

SEQ ID NO: 1547816 - RNA, 21 nt, Pseudomonas aeruginosa PA01
gccugcaacucgucguccagc

SEQ ID NO: 1547817 - RNA, 13 nt, Pseudomonas aeruginosa PA01
gccugcaccagcc

SEQ ID NO: 1547818 - RNA, 21 nt, Pseudomonas aeruginosa PA01
gccugcaccagccaguccggc

SEQ ID NO: 1547819 - RNA, 12 nt, Pseudomonas aeruginosa PA01
gccugcagguug

SEQ ID NO: 1547820 - RNA, 21 nt, Pseudomonas aeruginosa PA01
gccugcagguuguccagggca

SEQ ID NO: 1547821 - RNA, 23 nt, Pseudomonas aeruginosa PA01
gccugcagcgacuccagccaggc

SEQ ID NO: 1547822 - RNA, 18 nt, Pseudomonas aeruginosa PA01
gccugcagguagcgcugc

SEQ ID NO: 1547823 - RNA, 12 nt, Pseudomonas aeruginosa PA01
gccugccaggcg

SEQ ID NO: 1547824 - RNA, 20 nt, Pseudomonas aeruginosa PA01
gccugcgcagggcuuccuug

SEQ ID NO: 1547825 - RNA, 16 nt, Pseudomonas aeruginosa PA01
gccugccccacuuccg

SEQ ID NO: 1547826 - RNA, 11 nt, Pseudomonas aeruginosa PA01
gccugcucagc

SEQ ID NO: 1547827 - RNA, 12 nt, Pseudomonas aeruginosa PA01
gccugcuccagc

SEQ ID NO: 1547828 - RNA, 16 nt, Pseudomonas aeruginosa PA01
gccugcucgccgcuga

SEQ ID NO: 1547829 - RNA, 16 nt, Pseudomonas aeruginosa PA01
gccugcgucagcgagg

SEQ ID NO: 1547830 - RNA, 17 nt, Pseudomonas aeruginosa PA01
gccugcgucgcauccac

SEQ ID NO: 1547831 - RNA, 20 nt, Pseudomonas aeruginosa PA01
gccugcgucgcauccaccag

SEQ ID NO: 1547832 - RNA, 13 nt, Pseudomonas aeruginosa PA01
gccuuccgggaag

SEQ ID NO: 1547833 - RNA, 16 nt, Pseudomonas aeruginosa PA01
gccuuccgcgcccagg

SEQ ID NO: 1547834 - RNA, 22 nt, Pseudomonas aeruginosa PA01
gccuuccgcgcccaggcugccg

SEQ ID NO: 1547835 - RNA, 21 nt, Pseudomonas aeruginosa PA01
gccuuccaggcuguagccggc

SEQ ID NO: 1547836 - RNA, 19 nt, Pseudomonas aeruginosa PA01
gccuuccagguaguccagc

SEQ ID NO: 1547837 - RNA, 20 nt, Pseudomonas aeruginosa PA01
gccuuccagguaguccagcu

SEQ ID NO: 1547838 - RNA, 22 nt, Pseudomonas aeruginosa PA01
gccuucccagacguccagcgcc

SEQ ID NO: 1547839 - RNA, 15 nt, Pseudomonas aeruginosa PA01
gccuucccagccgag

SEQ ID NO: 1547840 - RNA, 19 nt, Pseudomonas aeruginosa PA01
gccuuccggcaccaccacc

SEQ ID NO: 1547841 - RNA, 18 nt, Pseudomonas aeruginosa PA01
gccuuccucggccgccag

SEQ ID NO: 1547842 - RNA, 19 nt, Pseudomonas aeruginosa PA01
gccuuccucggccgccagg

SEQ ID NO: 1547843 - RNA, 23 nt, Pseudomonas aeruginosa PA01
gccuuccucggcgaacuccgcca

SEQ ID NO: 1547844 - RNA, 15 nt, Pseudomonas aeruginosa PA01
gccuucuugcugccg

SEQ ID NO: 1547845 - RNA, 17 nt, Pseudomonas aeruginosa PA01
gccuucuugcugccggc

SEQ ID NO: 1547846 - RNA, 20 nt, Pseudomonas aeruginosa PA01
gccuugcgccaggccuugca

SEQ ID NO: 1547847 - RNA, 19 nt, Pseudomonas aeruginosa PA01
gccuugguguagccgagca

SEQ ID NO: 1547848 - RNA, 13 nt, Pseudomonas aeruginosa PA01
gccuuguccggca

SEQ ID NO: 1547849 - RNA, 17 nt, Pseudomonas aeruginosa PA01
gccuugccguccagccg

SEQ ID NO: 1547850 - RNA, 18 nt, Pseudomonas aeruginosa PA01
gccuugccguccagccgg

SEQ ID NO: 1547851 - RNA, 21 nt, Pseudomonas aeruginosa PA01
gccuugcgaccagguccggag

SEQ ID NO: 1547852 - RNA, 15 nt, Pseudomonas aeruginosa PA01
gccuugcucgacccg

SEQ ID NO: 1547853 - RNA, 22 nt, Pseudomonas aeruginosa PA01
gccuugcucgacccgguacagc

SEQ ID NO: 1547854 - RNA, 23 nt, Pseudomonas aeruginosa PA01
gccuugcucgacccgguacagcc

SEQ ID NO: 1547855 - RNA, 23 nt, Pseudomonas aeruginosa PA01
gccuugcggggcggcgcaucggc

SEQ ID NO: 1547856 - RNA, 19 nt, Pseudomonas aeruginosa PA01
gccuugcgguccagcgagc

SEQ ID NO: 1547857 - RNA, 16 nt, Pseudomonas aeruginosa PA01
gccuuguucagggugg

SEQ ID NO: 1547858 - RNA, 23 nt, Pseudomonas aeruginosa PA01
gccuuuuuugugcccgccccuuu

SEQ ID NO: 1547859 - RNA, 19 nt, Pseudomonas aeruginosa PA01
gccuuuuuucauuucguug

SEQ ID NO: 1547860 - RNA, 13 nt, Pseudomonas aeruginosa PA01
gccuuccaccggc

SEQ ID NO: 1547861 - RNA, 23 nt, Pseudomonas aeruginosa PA01
gccuuccaccgggaagcaggucu

SEQ ID NO: 1547862 - RNA, 18 nt, Pseudomonas aeruginosa PA01
gccuuccagcaggucgag

SEQ ID NO: 1547863 - RNA, 15 nt, Pseudomonas aeruginosa PA01
gccuuccagcccuuc

SEQ ID NO: 1547864 - RNA, 23 nt, Pseudomonas aeruginosa PA01
gccuuaccagaagccggccgggu

SEQ ID NO: 1547865 - RNA, 21 nt, Pseudomonas aeruginosa PA01
gccuggugcccgaugccgcgc

SEQ ID NO: 1547866 - RNA, 15 nt, Pseudomonas aeruginosa PA01
gccugguucugcucc

SEQ ID NO: 1547867 - RNA, 23 nt, Pseudomonas aeruginosa PA01
gccugcuccucggcagcgcuggc

SEQ ID NO: 1547868 - RNA, 17 nt, Pseudomonas aeruginosa PA01
gccugcucgcggcuggc

SEQ ID NO: 1547869 - RNA, 19 nt, Pseudomonas aeruginosa PA01
gccugcucgcggcuggccg

SEQ ID NO: 1547870 - RNA, 11 nt, Pseudomonas aeruginosa PA01
gccugcucggc

SEQ ID NO: 1547871 - RNA, 18 nt, Pseudomonas aeruginosa PA01
gccugcucggccugcugc

SEQ ID NO: 1547872 - RNA, 21 nt, Pseudomonas aeruginosa PA01
gccuggaauaccccgcggacg

SEQ ID NO: 1547873 - RNA, 22 nt, Pseudomonas aeruginosa PA01
gccuggaaggcgcugggcggcu

SEQ ID NO: 1547874 - RNA, 16 nt, Pseudomonas aeruginosa PA01
gccuggccacccuugu

SEQ ID NO: 1547875 - RNA, 18 nt, Pseudomonas aeruginosa PA01
gccuggccacccuugugg

SEQ ID NO: 1547876 - RNA, 16 nt, Pseudomonas aeruginosa PA01
gccuggucggcgcggc

SEQ ID NO: 1547877 - RNA, 17 nt, Pseudomonas aeruginosa PA01
gccuggucggcgcggcg

SEQ ID NO: 1547878 - RNA, 18 nt, Pseudomonas aeruginosa PA01
gccuggucggcgcggcgc

SEQ ID NO: 1547879 - RNA, 18 nt, Pseudomonas aeruginosa PA01
gccuggugagcggaacgg

SEQ ID NO: 1547880 - RNA, 15 nt, Pseudomonas aeruginosa PA01
gccuggaccaggucg

SEQ ID NO: 1547881 - RNA, 16 nt, Pseudomonas aeruginosa PA01
gccggcggccugcccc

SEQ ID NO: 1547882 - RNA, 18 nt, Pseudomonas aeruginosa PA01
gccggcggccugccccgc

SEQ ID NO: 1547883 - RNA, 21 nt, Pseudomonas aeruginosa PA01
gccggcggcggacgcaggccg

SEQ ID NO: 1547884 - RNA, 15 nt, Pseudomonas aeruginosa PA01
gccggcggcgcugag

SEQ ID NO: 1547885 - RNA, 14 nt, Pseudomonas aeruginosa PA01
gccggcggcgcggc

SEQ ID NO: 1547886 - RNA, 15 nt, Pseudomonas aeruginosa PA01
gccggcggcgcggca

SEQ ID NO: 1547887 - RNA, 16 nt, Pseudomonas aeruginosa PA01
gccggcggcgcggcag

SEQ ID NO: 1547888 - RNA, 14 nt, Pseudomonas aeruginosa PA01
gccggcggcgcguc

SEQ ID NO: 1547889 - RNA, 15 nt, Pseudomonas aeruginosa PA01
gccggcggcgcgucc

SEQ ID NO: 1547890 - RNA, 21 nt, Pseudomonas aeruginosa PA01
gccggcggccugagccggccg

SEQ ID NO: 1547891 - RNA, 15 nt, Pseudomonas aeruginosa PA01
gccggcgcuccuccu

SEQ ID NO: 1547892 - RNA, 18 nt, Pseudomonas aeruginosa PA01
gccggcgcgucgcugcgc

SEQ ID NO: 1547893 - RNA, 19 nt, Pseudomonas aeruginosa PA01
gccggcgcgucgcugcgca

SEQ ID NO: 1547894 - RNA, 21 nt, Pseudomonas aeruginosa PA01
gccggcgcggucucgcguuca

SEQ ID NO: 1547895 - RNA, 18 nt, Pseudomonas aeruginosa PA01
gccggcggaucacaggcu

SEQ ID NO: 1547896 - RNA, 13 nt, Pseudomonas aeruginosa PA01
gccggcgcugguu

SEQ ID NO: 1547897 - RNA, 14 nt, Pseudomonas aeruginosa PA01
gccggcgcugguug

SEQ ID NO: 1547898 - RNA, 18 nt, Pseudomonas aeruginosa PA01
gccggcgcugucucgcca

SEQ ID NO: 1547899 - RNA, 21 nt, Pseudomonas aeruginosa PA01
gccggcgcugucucgccagcc

SEQ ID NO: 1547900 - RNA, 19 nt, Pseudomonas aeruginosa PA01
gccggcgcuucugcgagcc

SEQ ID NO: 1547901 - RNA, 22 nt, Pseudomonas aeruginosa PA01
gccggcguacuucggcgcggug

SEQ ID NO: 1547902 - RNA, 13 nt, Pseudomonas aeruginosa PA01
gccggcguccagg

SEQ ID NO: 1547903 - RNA, 19 nt, Pseudomonas aeruginosa PA01
gccggcguccuugccgagg

SEQ ID NO: 1547904 - RNA, 14 nt, Pseudomonas aeruginosa PA01
gccggcgggcgcga

SEQ ID NO: 1547905 - RNA, 18 nt, Pseudomonas aeruginosa PA01
gccggcggguguggggaa

SEQ ID NO: 1547906 - RNA, 23 nt, Pseudomonas aeruginosa PA01
gccgggaaucgccagcaggcugu

SEQ ID NO: 1547907 - RNA, 17 nt, Pseudomonas aeruginosa PA01
gccgggauacagcagcc

SEQ ID NO: 1547908 - RNA, 22 nt, Pseudomonas aeruginosa PA01
gccgggcaacgccaggccgcuu

SEQ ID NO: 1547909 - RNA, 17 nt, Pseudomonas aeruginosa PA01
gccgggcaacgcgcaga

SEQ ID NO: 1547910 - RNA, 23 nt, Pseudomonas aeruginosa PA01
gccgggaucuccucgacggcggg

SEQ ID NO: 1547911 - RNA, 14 nt, Pseudomonas aeruginosa PA01
gccgggaaucccca

SEQ ID NO: 1547912 - RNA, 17 nt, Pseudomonas aeruginosa PA01
gccgggaauccccagua

SEQ ID NO: 1547913 - RNA, 15 nt, Pseudomonas aeruginosa PA01
gccggcugugcaggg

SEQ ID NO: 1547914 - RNA, 20 nt, Pseudomonas aeruginosa PA01
gccggcuuccaccagacgca

SEQ ID NO: 1547915 - RNA, 18 nt, Pseudomonas aeruginosa PA01
gccggcguucgacgccuu

SEQ ID NO: 1547916 - RNA, 23 nt, Pseudomonas aeruginosa PA01
gccggcguuggcgucgcugccgc

SEQ ID NO: 1547917 - RNA, 22 nt, Pseudomonas aeruginosa PA01
gccggcgucguccugcgcggcg

SEQ ID NO: 1547918 - RNA, 20 nt, Pseudomonas aeruginosa PA01
gccggcucagaaauccaccu

SEQ ID NO: 1547919 - RNA, 14 nt, Pseudomonas aeruginosa PA01
gccggcugccgcgc

SEQ ID NO: 1547920 - RNA, 17 nt, Pseudomonas aeruginosa PA01
gccggcuccuugcgccg

SEQ ID NO: 1547921 - RNA, 18 nt, Pseudomonas aeruginosa PA01
gccggcugacgcuggcga

SEQ ID NO: 1547922 - RNA, 22 nt, Pseudomonas aeruginosa PA01
gccggcugaugcccgggucguc

SEQ ID NO: 1547923 - RNA, 23 nt, Pseudomonas aeruginosa PA01
gccggccuugcuuugcgccucgc

SEQ ID NO: 1547924 - RNA, 16 nt, Pseudomonas aeruginosa PA01
gccggccugcgcgcac

SEQ ID NO: 1547925 - RNA, 16 nt, Pseudomonas aeruginosa PA01
gccggcgaacagccag

SEQ ID NO: 1547926 - RNA, 20 nt, Pseudomonas aeruginosa PA01
gccggcgaaccaggcggccg

SEQ ID NO: 1547927 - RNA, 19 nt, Pseudomonas aeruginosa PA01
gccggcgaagggcaggccg

SEQ ID NO: 1547928 - RNA, 13 nt, Pseudomonas aeruginosa PA01
gccggccggggcc

SEQ ID NO: 1547929 - RNA, 17 nt, Pseudomonas aeruginosa PA01
gccggccggcagcgagc

SEQ ID NO: 1547930 - RNA, 11 nt, Pseudomonas aeruginosa PA01
gccggccggga

SEQ ID NO: 1547931 - RNA, 23 nt, Pseudomonas aeruginosa PA01
gccggccucgcugccgccgcaga

SEQ ID NO: 1547932 - RNA, 14 nt, Pseudomonas aeruginosa PA01
gccggccgucgcgc

SEQ ID NO: 1547933 - RNA, 16 nt, Pseudomonas aeruginosa PA01
gccggccgucgcgcac

SEQ ID NO: 1547934 - RNA, 13 nt, Pseudomonas aeruginosa PA01
gccggccuccagc

SEQ ID NO: 1547935 - RNA, 23 nt, Pseudomonas aeruginosa PA01
gccggccuccagcacucgcuccu

SEQ ID NO: 1547936 - RNA, 16 nt, Pseudomonas aeruginosa PA01
gccggccuccagcgcc

SEQ ID NO: 1547937 - RNA, 16 nt, Pseudomonas aeruginosa PA01
gccggccucgacgcag

SEQ ID NO: 1547938 - RNA, 16 nt, Pseudomonas aeruginosa PA01
gccggccucggcggcg

SEQ ID NO: 1547939 - RNA, 11 nt, Pseudomonas aeruginosa PA01
gccggccccug

SEQ ID NO: 1547940 - RNA, 12 nt, Pseudomonas aeruginosa PA01
gccggcccgcgc

SEQ ID NO: 1547941 - RNA, 16 nt, Pseudomonas aeruginosa PA01
gccggccgcgucgccc

SEQ ID NO: 1547942 - RNA, 18 nt, Pseudomonas aeruginosa PA01
gccggcgaccuuguccug

SEQ ID NO: 1547943 - RNA, 14 nt, Pseudomonas aeruginosa PA01
gccggcgacgaggu

SEQ ID NO: 1547944 - RNA, 17 nt, Pseudomonas aeruginosa PA01
gccggcgaccgcgcgca

SEQ ID NO: 1547945 - RNA, 21 nt, Pseudomonas aeruginosa PA01
gccggcgaccgcgcgcauggu

SEQ ID NO: 1547946 - RNA, 17 nt, Pseudomonas aeruginosa PA01
gccggcgagcgccugga

SEQ ID NO: 1547947 - RNA, 16 nt, Pseudomonas aeruginosa PA01
gccggcgagggcggcg

SEQ ID NO: 1547948 - RNA, 17 nt, Pseudomonas aeruginosa PA01
gccggcgaucauccagc

SEQ ID NO: 1547949 - RNA, 18 nt, Pseudomonas aeruginosa PA01
gccggcgcaugcgccggc

SEQ ID NO: 1547950 - RNA, 21 nt, Pseudomonas aeruginosa PA01
gccggcgccaucgaucagcag

SEQ ID NO: 1547951 - RNA, 23 nt, Pseudomonas aeruginosa PA01
gccggcgccaucgaucagcagcg

SEQ ID NO: 1547952 - RNA, 14 nt, Pseudomonas aeruginosa PA01
gccggcgcaucagc

SEQ ID NO: 1547953 - RNA, 21 nt, Pseudomonas aeruginosa PA01
gccggcgauguucgcccccuu

SEQ ID NO: 1547954 - RNA, 23 nt, Pseudomonas aeruginosa PA01
gccggcgaugcccaggccgccga

SEQ ID NO: 1547955 - RNA, 16 nt, Pseudomonas aeruginosa PA01
gccggcgaugccgccc

SEQ ID NO: 1547956 - RNA, 22 nt, Pseudomonas aeruginosa PA01
gccggcgaugccgcccagcacc

SEQ ID NO: 1547957 - RNA, 16 nt, Pseudomonas aeruginosa PA01
gccggcgaugcgcagg

SEQ ID NO: 1547958 - RNA, 14 nt, Pseudomonas aeruginosa PA01
gccggcgauggccc

SEQ ID NO: 1547959 - RNA, 18 nt, Pseudomonas aeruginosa PA01
gccggcgauggccgccug

SEQ ID NO: 1547960 - RNA, 19 nt, Pseudomonas aeruginosa PA01
gccggcgauggccgccugc

SEQ ID NO: 1547961 - RNA, 16 nt, Pseudomonas aeruginosa PA01
gccggcgccagcaggc

SEQ ID NO: 1547962 - RNA, 21 nt, Pseudomonas aeruginosa PA01
gccggcgccgcagggugcggc

SEQ ID NO: 1547963 - RNA, 21 nt, Pseudomonas aeruginosa PA01
gccggcgccgauauugaacga

SEQ ID NO: 1547964 - RNA, 13 nt, Pseudomonas aeruginosa PA01
gccggcgcccugg

SEQ ID NO: 1547965 - RNA, 14 nt, Pseudomonas aeruginosa PA01
gccggcgccgccga

SEQ ID NO: 1547966 - RNA, 13 nt, Pseudomonas aeruginosa PA01
gccggcgcggcgc

SEQ ID NO: 1547967 - RNA, 12 nt, Pseudomonas aeruginosa PA01
gccggcgcgccg

SEQ ID NO: 1547968 - RNA, 13 nt, Pseudomonas aeruginosa PA01
gccggcgcgcuug

SEQ ID NO: 1547969 - RNA, 14 nt, Pseudomonas aeruginosa PA01
gccggcgcgcggcg

SEQ ID NO: 1547970 - RNA, 21 nt, Pseudomonas aeruginosa PA01
gccggcgcgauccuggcggca

SEQ ID NO: 1547971 - RNA, 22 nt, Pseudomonas aeruginosa PA01
gccggaagacggaaacgcgcgc

SEQ ID NO: 1547972 - RNA, 18 nt, Pseudomonas aeruginosa PA01
gccgcggcccugcgccgc

SEQ ID NO: 1547973 - RNA, 21 nt, Pseudomonas aeruginosa PA01
gccgcggcccugcgccgcagc

SEQ ID NO: 1547974 - RNA, 14 nt, Pseudomonas aeruginosa PA01
gccgcggcccggcg

SEQ ID NO: 1547975 - RNA, 13 nt, Pseudomonas aeruginosa PA01
gccgcggccagcc

SEQ ID NO: 1547976 - RNA, 15 nt, Pseudomonas aeruginosa PA01
gccgcggccagcccc

SEQ ID NO: 1547977 - RNA, 19 nt, Pseudomonas aeruginosa PA01
gccgcggauacggcagggg

SEQ ID NO: 1547978 - RNA, 19 nt, Pseudomonas aeruginosa PA01
gccgcggagcaccgcgccu

SEQ ID NO: 1547979 - RNA, 17 nt, Pseudomonas aeruginosa PA01
gccgcggaugacgggcg

SEQ ID NO: 1547980 - RNA, 20 nt, Pseudomonas aeruginosa PA01
gccgcggaaggcccgcgagc

SEQ ID NO: 1547981 - RNA, 21 nt, Pseudomonas aeruginosa PA01
gccggacaggaaaaagcccgc

SEQ ID NO: 1547982 - RNA, 14 nt, Pseudomonas aeruginosa PA01
gccggacaggccac

SEQ ID NO: 1547983 - RNA, 18 nt, Pseudomonas aeruginosa PA01
gccggaaucacgcugcuc

SEQ ID NO: 1547984 - RNA, 17 nt, Pseudomonas aeruginosa PA01
gccggacgcaccagcag

SEQ ID NO: 1547985 - RNA, 19 nt, Pseudomonas aeruginosa PA01
gccggacguuuccagcggc

SEQ ID NO: 1547986 - RNA, 21 nt, Pseudomonas aeruginosa PA01
gccggacguuuccagcggcuc

SEQ ID NO: 1547987 - RNA, 15 nt, Pseudomonas aeruginosa PA01
gccggaccagccggu

SEQ ID NO: 1547988 - RNA, 14 nt, Pseudomonas aeruginosa PA01
gccggaugccaccg

SEQ ID NO: 1547989 - RNA, 16 nt, Pseudomonas aeruginosa PA01
gccggaucggccuugg

SEQ ID NO: 1547990 - RNA, 17 nt, Pseudomonas aeruginosa PA01
gccggaggcagcgaugc

SEQ ID NO: 1547991 - RNA, 15 nt, Pseudomonas aeruginosa PA01
gccggaggggcggcc

SEQ ID NO: 1547992 - RNA, 22 nt, Pseudomonas aeruginosa PA01
gccggagucguagcgcgcggcg

SEQ ID NO: 1547993 - RNA, 18 nt, Pseudomonas aeruginosa PA01
gccggagaugugcgcggu

SEQ ID NO: 1547994 - RNA, 21 nt, Pseudomonas aeruginosa PA01
gccggagagcagcacggccuc

SEQ ID NO: 1547995 - RNA, 13 nt, Pseudomonas aeruginosa PA01
gccggagccaccg

SEQ ID NO: 1547996 - RNA, 16 nt, Pseudomonas aeruginosa PA01
gccggcaagcgugccc

SEQ ID NO: 1547997 - RNA, 16 nt, Pseudomonas aeruginosa PA01
gccggcaaacgccgcc

SEQ ID NO: 1547998 - RNA, 22 nt, Pseudomonas aeruginosa PA01
gccggauuguaucggcuccucu

SEQ ID NO: 1547999 - RNA, 17 nt, Pseudomonas aeruginosa PA01
gccggcacuguuccuca

SEQ ID NO: 1548000 - RNA, 15 nt, Pseudomonas aeruginosa PA01
gccggcagcagcgcc

SEQ ID NO: 1548001 - RNA, 22 nt, Pseudomonas aeruginosa PA01
gccggcagguugugguugggca

SEQ ID NO: 1548002 - RNA, 18 nt, Pseudomonas aeruginosa PA01
gccggcaggaacgcccgc

SEQ ID NO: 1548003 - RNA, 13 nt, Pseudomonas aeruginosa PA01
gccggcagcuccg

SEQ ID NO: 1548004 - RNA, 15 nt, Pseudomonas aeruginosa PA01
gccggcauugcccaa

SEQ ID NO: 1548005 - RNA, 17 nt, Pseudomonas aeruginosa PA01
gccggcauugcccaaua

SEQ ID NO: 1548006 - RNA, 22 nt, Pseudomonas aeruginosa PA01
gccggcauugccgacuuccucg

SEQ ID NO: 1548007 - RNA, 21 nt, Pseudomonas aeruginosa PA01
gccggccaaccaccggcgcac

SEQ ID NO: 1548008 - RNA, 16 nt, Pseudomonas aeruginosa PA01
gccggccaccagcagc

SEQ ID NO: 1548009 - RNA, 20 nt, Pseudomonas aeruginosa PA01
gccggcaugcucagccgcgc

SEQ ID NO: 1548010 - RNA, 19 nt, Pseudomonas aeruginosa PA01
gccggcauccuguggcugc

SEQ ID NO: 1548011 - RNA, 21 nt, Pseudomonas aeruginosa PA01
gccggcauccuguggcugcag

SEQ ID NO: 1548012 - RNA, 21 nt, Pseudomonas aeruginosa PA01
gccggcaucguggccaugggu

SEQ ID NO: 1548013 - RNA, 21 nt, Pseudomonas aeruginosa PA01
gccggcaucgccauggcgcug

SEQ ID NO: 1548014 - RNA, 13 nt, Pseudomonas aeruginosa PA01
gccggcauccagc

SEQ ID NO: 1548015 - RNA, 23 nt, Pseudomonas aeruginosa PA01
gccggcauagccgaacuccgcca

SEQ ID NO: 1548016 - RNA, 19 nt, Pseudomonas aeruginosa PA01
gccggcagugugccgcccu

SEQ ID NO: 1548017 - RNA, 14 nt, Pseudomonas aeruginosa PA01
gccggccaugcagg

SEQ ID NO: 1548018 - RNA, 19 nt, Pseudomonas aeruginosa PA01
gccggccaugcaggccagg

SEQ ID NO: 1548019 - RNA, 13 nt, Pseudomonas aeruginosa PA01
gccggccagcacc

SEQ ID NO: 1548020 - RNA, 14 nt, Pseudomonas aeruginosa PA01
gccggccagccgcg

SEQ ID NO: 1548021 - RNA, 15 nt, Pseudomonas aeruginosa PA01
gccggccagccgcgc

SEQ ID NO: 1548022 - RNA, 22 nt, Pseudomonas aeruginosa PA01
gccggccagccuucccggcgcu

SEQ ID NO: 1548023 - RNA, 15 nt, Pseudomonas aeruginosa PA01
gccggcccagcaggc

SEQ ID NO: 1548024 - RNA, 16 nt, Pseudomonas aeruginosa PA01
gccggcccagcaggcc

SEQ ID NO: 1548025 - RNA, 16 nt, Pseudomonas aeruginosa PA01
gccggccaggaaggcc

SEQ ID NO: 1548026 - RNA, 13 nt, Pseudomonas aeruginosa PA01
gccgugccgugga

SEQ ID NO: 1548027 - RNA, 16 nt, Pseudomonas aeruginosa PA01
gccgugcaucaccggc

SEQ ID NO: 1548028 - RNA, 20 nt, Pseudomonas aeruginosa PA01
gccgugcaucaccggcagca

SEQ ID NO: 1548029 - RNA, 14 nt, Pseudomonas aeruginosa PA01
gccgugcaggguca

SEQ ID NO: 1548030 - RNA, 14 nt, Pseudomonas aeruginosa PA01
gccgugcagcccuc

SEQ ID NO: 1548031 - RNA, 19 nt, Pseudomonas aeruginosa PA01
gccgucuccaggcgcgccg

SEQ ID NO: 1548032 - RNA, 16 nt, Pseudomonas aeruginosa PA01
gccguggcgccccagg

SEQ ID NO: 1548033 - RNA, 14 nt, Pseudomonas aeruginosa PA01
gccguggcggcgcg

SEQ ID NO: 1548034 - RNA, 15 nt, Pseudomonas aeruginosa PA01
gccguggcggcgcgc

SEQ ID NO: 1548035 - RNA, 23 nt, Pseudomonas aeruginosa PA01
gccguggcugugcuggccacccu

SEQ ID NO: 1548036 - RNA, 14 nt, Pseudomonas aeruginosa PA01
gccguggcuccugg

SEQ ID NO: 1548037 - RNA, 17 nt, Pseudomonas aeruginosa PA01
gccguggcucggcggca

SEQ ID NO: 1548038 - RNA, 15 nt, Pseudomonas aeruginosa PA01
gccgugggccgccga

SEQ ID NO: 1548039 - RNA, 14 nt, Pseudomonas aeruginosa PA01
gccgugggcgccgc

SEQ ID NO: 1548040 - RNA, 22 nt, Pseudomonas aeruginosa PA01
gccgugggcguagagccuggag

SEQ ID NO: 1548041 - RNA, 21 nt, Pseudomonas aeruginosa PA01
gccguucgcccgcggcggcga

SEQ ID NO: 1548042 - RNA, 13 nt, Pseudomonas aeruginosa PA01
gccguucgcccuu

SEQ ID NO: 1548043 - RNA, 22 nt, Pseudomonas aeruginosa PA01
gccgugguggccguggcgcccc

SEQ ID NO: 1548044 - RNA, 17 nt, Pseudomonas aeruginosa PA01
gccguguaaguuaaugc

SEQ ID NO: 1548045 - RNA, 20 nt, Pseudomonas aeruginosa PA01
gccguugcccucgcgcugga

SEQ ID NO: 1548046 - RNA, 12 nt, Pseudomonas aeruginosa PA01
gccuacccgcgc

SEQ ID NO: 1548047 - RNA, 20 nt, Pseudomonas aeruginosa PA01
gccuaccggcgccgccccgu

SEQ ID NO: 1548048 - RNA, 20 nt, Pseudomonas aeruginosa PA01
gccguagaccaccagcagca

SEQ ID NO: 1548049 - RNA, 21 nt, Pseudomonas aeruginosa PA01
gccguagaccaccagcagcag

SEQ ID NO: 1548050 - RNA, 15 nt, Pseudomonas aeruginosa PA01
gccguacuucagggu

SEQ ID NO: 1548051 - RNA, 21 nt, Pseudomonas aeruginosa PA01
gccguagccgucgaacagcag

SEQ ID NO: 1548052 - RNA, 22 nt, Pseudomonas aeruginosa PA01
gccguagccgucgaacagcagc

SEQ ID NO: 1548053 - RNA, 23 nt, Pseudomonas aeruginosa PA01
gccguagcgcaguucgccgccga

SEQ ID NO: 1548054 - RNA, 17 nt, Pseudomonas aeruginosa PA01
gccguagcugcgcgccu

SEQ ID NO: 1548055 - RNA, 14 nt, Pseudomonas aeruginosa PA01
gccguacagcaggc

SEQ ID NO: 1548056 - RNA, 15 nt, Pseudomonas aeruginosa PA01
gccguacagcaggca

SEQ ID NO: 1548057 - RNA, 20 nt, Pseudomonas aeruginosa PA01
gccguacaggccaccgcgca

SEQ ID NO: 1548058 - RNA, 19 nt, Pseudomonas aeruginosa PA01
gccguacaggucggcgccg

SEQ ID NO: 1548059 - RNA, 24 nt, Pseudomonas aeruginosa PA01
gccgguugcugcuugcgcgcggcg

SEQ ID NO: 1548060 - RNA, 19 nt, Pseudomonas aeruginosa PA01
gccgguucgcaggccaggc

SEQ ID NO: 1548061 - RNA, 16 nt, Pseudomonas aeruginosa PA01
gccgguucccgcagcg

SEQ ID NO: 1548062 - RNA, 20 nt, Pseudomonas aeruginosa PA01
gccgguuucgaccggcgcgc

SEQ ID NO: 1548063 - RNA, 17 nt, Pseudomonas aeruginosa PA01
gccguccaccagccagc

SEQ ID NO: 1548064 - RNA, 23 nt, Pseudomonas aeruginosa PA01
gccgucgaacagcagcucgccgc

SEQ ID NO: 1548065 - RNA, 20 nt, Pseudomonas aeruginosa PA01
gccguccuugucgcagcggc

SEQ ID NO: 1548066 - RNA, 13 nt, Pseudomonas aeruginosa PA01
gccguccagcgag

SEQ ID NO: 1548067 - RNA, 20 nt, Pseudomonas aeruginosa PA01
gccguaggugaccgcccagg

SEQ ID NO: 1548068 - RNA, 18 nt, Pseudomonas aeruginosa PA01
gccguaggcgauggccug

SEQ ID NO: 1548069 - RNA, 20 nt, Pseudomonas aeruginosa PA01
gccgucaucgagcaguucca

SEQ ID NO: 1548070 - RNA, 14 nt, Pseudomonas aeruginosa PA01
gccgucgacccgcc

SEQ ID NO: 1548071 - RNA, 18 nt, Pseudomonas aeruginosa PA01
gccgucgagcaccagcag

SEQ ID NO: 1548072 - RNA, 13 nt, Pseudomonas aeruginosa PA01
gccgucgagccag

SEQ ID NO: 1548073 - RNA, 14 nt, Pseudomonas aeruginosa PA01
gccgucgagccagc

SEQ ID NO: 1548074 - RNA, 19 nt, Pseudomonas aeruginosa PA01
gccgucguagcgcagcggc

SEQ ID NO: 1548075 - RNA, 21 nt, Pseudomonas aeruginosa PA01
gccgucgguguccgcggugcc

SEQ ID NO: 1548076 - RNA, 18 nt, Pseudomonas aeruginosa PA01
gccggucugcugcgcgca

SEQ ID NO: 1548077 - RNA, 23 nt, Pseudomonas aeruginosa PA01
gccggugacauucgacagcaggu

SEQ ID NO: 1548078 - RNA, 20 nt, Pseudomonas aeruginosa PA01
gccggugacccacuccggca

SEQ ID NO: 1548079 - RNA, 24 nt, Pseudomonas aeruginosa PA01
gccggugacccacuccggcaggcg

SEQ ID NO: 1548080 - RNA, 13 nt, Pseudomonas aeruginosa PA01
gccggucgcgcag

SEQ ID NO: 1548081 - RNA, 14 nt, Pseudomonas aeruginosa PA01
gccggugaacaggu

SEQ ID NO: 1548082 - RNA, 23 nt, Pseudomonas aeruginosa PA01
gccggugaacagguagcuggaaa

SEQ ID NO: 1548083 - RNA, 17 nt, Pseudomonas aeruginosa PA01
gccggugccgcccuggg

SEQ ID NO: 1548084 - RNA, 16 nt, Pseudomonas aeruginosa PA01
gccgguggcgcccagc

SEQ ID NO: 1548085 - RNA, 14 nt, Pseudomonas aeruginosa PA01
gccgguggccagga

SEQ ID NO: 1548086 - RNA, 14 nt, Pseudomonas aeruginosa PA01
gccggugcuggcga

SEQ ID NO: 1548087 - RNA, 17 nt, Pseudomonas aeruginosa PA01
gccggugccgccggcca

SEQ ID NO: 1548088 - RNA, 16 nt, Pseudomonas aeruginosa PA01
gccggugccggcggcg

SEQ ID NO: 1548089 - RNA, 14 nt, Pseudomonas aeruginosa PA01
gccgguagucgggg

SEQ ID NO: 1548090 - RNA, 12 nt, Pseudomonas aeruginosa PA01
gccgguagugcu

SEQ ID NO: 1548091 - RNA, 17 nt, Pseudomonas aeruginosa PA01
gccgguagugcuucagg

SEQ ID NO: 1548092 - RNA, 18 nt, Pseudomonas aeruginosa PA01
gccggucaaccgcgggcg

SEQ ID NO: 1548093 - RNA, 20 nt, Pseudomonas aeruginosa PA01
gccggucaaccgcgggcgag

SEQ ID NO: 1548094 - RNA, 15 nt, Pseudomonas aeruginosa PA01
gccggucgcaaccgg

SEQ ID NO: 1548095 - RNA, 21 nt, Pseudomonas aeruginosa PA01
gccggucccgggcuccggguu

SEQ ID NO: 1548096 - RNA, 14 nt, Pseudomonas aeruginosa PA01
gccggucaggcugg

SEQ ID NO: 1548097 - RNA, 16 nt, Pseudomonas aeruginosa PA01
gccggucaggcuggug

SEQ ID NO: 1548098 - RNA, 20 nt, Pseudomonas aeruginosa PA01
gccgggugcuaugcgccggg

SEQ ID NO: 1548099 - RNA, 16 nt, Pseudomonas aeruginosa PA01
gccggguucccaguug

SEQ ID NO: 1548100 - RNA, 15 nt, Pseudomonas aeruginosa PA01
gccggguugcgccgc

SEQ ID NO: 1548101 - RNA, 21 nt, Pseudomonas aeruginosa PA01
gccggguugcgccuccgggcg

SEQ ID NO: 1548102 - RNA, 23 nt, Pseudomonas aeruginosa PA01
gccggguuucgucggucaucacg

SEQ ID NO: 1548103 - RNA, 14 nt, Pseudomonas aeruginosa PA01
gccgguagcuggcc

SEQ ID NO: 1548104 - RNA, 17 nt, Pseudomonas aeruginosa PA01
gccgguacucgccgggc

SEQ ID NO: 1548105 - RNA, 21 nt, Pseudomonas aeruginosa PA01
gccgguaaugaaaagccccgc

SEQ ID NO: 1548106 - RNA, 14 nt, Pseudomonas aeruginosa PA01
gccgguaauaggcu

SEQ ID NO: 1548107 - RNA, 22 nt, Pseudomonas aeruginosa PA01
gccggggaucaggucgccgcug

SEQ ID NO: 1548108 - RNA, 17 nt, Pseudomonas aeruginosa PA01
gccgggcuucuucaggc

SEQ ID NO: 1548109 - RNA, 21 nt, Pseudomonas aeruginosa PA01
gccgggcuuccuggccggggg

SEQ ID NO: 1548110 - RNA, 22 nt, Pseudomonas aeruginosa PA01
gccgggcuuuuucaugggcgcg

SEQ ID NO: 1548111 - RNA, 22 nt, Pseudomonas aeruginosa PA01
gccgggcuuuuucucgucgcgc

SEQ ID NO: 1548112 - RNA, 17 nt, Pseudomonas aeruginosa PA01
gccgggcuuuuuugggu

SEQ ID NO: 1548113 - RNA, 22 nt, Pseudomonas aeruginosa PA01
gccggggaagauguucgccgcc

SEQ ID NO: 1548114 - RNA, 13 nt, Pseudomonas aeruginosa PA01
gccggggcgcgcc

SEQ ID NO: 1548115 - RNA, 16 nt, Pseudomonas aeruginosa PA01
gccggggcgcgcccgc

SEQ ID NO: 1548116 - RNA, 22 nt, Pseudomonas aeruginosa PA01
gccggggcggauucaggcgcgc

SEQ ID NO: 1548117 - RNA, 17 nt, Pseudomonas aeruginosa PA01
gccggggcgggccgcgc

SEQ ID NO: 1548118 - RNA, 22 nt, Pseudomonas aeruginosa PA01
gccggggcgugcaggccgccga

SEQ ID NO: 1548119 - RNA, 16 nt, Pseudomonas aeruginosa PA01
gccggggcugagcgca

SEQ ID NO: 1548120 - RNA, 22 nt, Pseudomonas aeruginosa PA01
gccgggguugaguugcaggccg

SEQ ID NO: 1548121 - RNA, 20 nt, Pseudomonas aeruginosa PA01
gccggguauccagcacccgc

SEQ ID NO: 1548122 - RNA, 15 nt, Pseudomonas aeruginosa PA01
gccggguacagcgcc

SEQ ID NO: 1548123 - RNA, 16 nt, Pseudomonas aeruginosa PA01
gccggggguguugaaa

SEQ ID NO: 1548124 - RNA, 19 nt, Pseudomonas aeruginosa PA01
gccggggguguugaaagcc

SEQ ID NO: 1548125 - RNA, 19 nt, Pseudomonas aeruginosa PA01
gccgggucgacaugcaggc

SEQ ID NO: 1548126 - RNA, 21 nt, Pseudomonas aeruginosa PA01
gccgggucgaccuugccgacg

SEQ ID NO: 1548127 - RNA, 23 nt, Pseudomonas aeruginosa PA01
gccgggucgacuucgcaccagcc

SEQ ID NO: 1548128 - RNA, 16 nt, Pseudomonas aeruginosa PA01
gccgggucgccgcagc

SEQ ID NO: 1548129 - RNA, 14 nt, Pseudomonas aeruginosa PA01
gccgggccagcucc

SEQ ID NO: 1548130 - RNA, 20 nt, Pseudomonas aeruginosa PA01
gccgggcccugggccccggc

SEQ ID NO: 1548131 - RNA, 15 nt, Pseudomonas aeruginosa PA01
gccgggccgcagcgc

SEQ ID NO: 1548132 - RNA, 20 nt, Pseudomonas aeruginosa PA01
gccgggccgccuugcgcagc

SEQ ID NO: 1548133 - RNA, 13 nt, Pseudomonas aeruginosa PA01
gccgggcagccgu

SEQ ID NO: 1548134 - RNA, 17 nt, Pseudomonas aeruginosa PA01
gccgggcauucgcagcg

SEQ ID NO: 1548135 - RNA, 21 nt, Pseudomonas aeruginosa PA01
gccgggcagacuucgccgugc

SEQ ID NO: 1548136 - RNA, 17 nt, Pseudomonas aeruginosa PA01
gccgggcggacgcuggg

SEQ ID NO: 1548137 - RNA, 13 nt, Pseudomonas aeruginosa PA01
gccgggcgcgcgc

SEQ ID NO: 1548138 - RNA, 23 nt, Pseudomonas aeruginosa PA01
gccgggcguuuucguugccgcgc

SEQ ID NO: 1548139 - RNA, 20 nt, Pseudomonas aeruginosa PA01
gccgggcuccgccgcgagcg

SEQ ID NO: 1548140 - RNA, 16 nt, Pseudomonas aeruginosa PA01
gccgggcuggccgucg

SEQ ID NO: 1548141 - RNA, 21 nt, Pseudomonas aeruginosa PA01
gguucggcgaggaucgccagc

SEQ ID NO: 1548142 - RNA, 20 nt, Pseudomonas aeruginosa PA01
gguucggcgucuucggcggc

SEQ ID NO: 1548143 - RNA, 18 nt, Pseudomonas aeruginosa PA01
gguucuccacuuccacuu

SEQ ID NO: 1548144 - RNA, 20 nt, Pseudomonas aeruginosa PA01
gguucguagaguucgcugag

SEQ ID NO: 1548145 - RNA, 15 nt, Pseudomonas aeruginosa PA01
gguucgauuccucua

SEQ ID NO: 1548146 - RNA, 13 nt, Pseudomonas aeruginosa PA01
gguucgcaggcca

SEQ ID NO: 1548147 - RNA, 14 nt, Pseudomonas aeruginosa PA01
gguucgaaugcugc

SEQ ID NO: 1548148 - RNA, 21 nt, Pseudomonas aeruginosa PA01
gguucgacacgcucagccccg

SEQ ID NO: 1548149 - RNA, 14 nt, Pseudomonas aeruginosa PA01
gguuccuggcugga

SEQ ID NO: 1548150 - RNA, 16 nt, Pseudomonas aeruginosa PA01
gguuccuggugucggg

SEQ ID NO: 1548151 - RNA, 19 nt, Pseudomonas aeruginosa PA01
gguucaggucgaugcccag

SEQ ID NO: 1548152 - RNA, 21 nt, Pseudomonas aeruginosa PA01
gguucaggucgaugcccagcc

SEQ ID NO: 1548153 - RNA, 16 nt, Pseudomonas aeruginosa PA01
gguucagucggccagg

SEQ ID NO: 1548154 - RNA, 18 nt, Pseudomonas aeruginosa PA01
gguucaucgagcggcggc

SEQ ID NO: 1548155 - RNA, 18 nt, Pseudomonas aeruginosa PA01
gguucaggacgcuccugc

SEQ ID NO: 1548156 - RNA, 13 nt, Pseudomonas aeruginosa PA01
gguuccagccccg

SEQ ID NO: 1548157 - RNA, 22 nt, Pseudomonas aeruginosa PA01
gguucagcagcggcacccggcu

SEQ ID NO: 1548158 - RNA, 18 nt, Pseudomonas aeruginosa PA01
gguuauccgccggcugug

SEQ ID NO: 1548159 - RNA, 16 nt, Pseudomonas aeruginosa PA01
ggugugccgucaggca

SEQ ID NO: 1548160 - RNA, 14 nt, Pseudomonas aeruginosa PA01
ggugugcagcagca

SEQ ID NO: 1548161 - RNA, 20 nt, Pseudomonas aeruginosa PA01
ggugugcaacggaaacacag

SEQ ID NO: 1548162 - RNA, 23 nt, Pseudomonas aeruginosa PA01
ggugugcaacggaaacacagcac

SEQ ID NO: 1548163 - RNA, 17 nt, Pseudomonas aeruginosa PA01
ggugucguagaggcugu

SEQ ID NO: 1548164 - RNA, 14 nt, Pseudomonas aeruginosa PA01
gguguuguggcugg

SEQ ID NO: 1548165 - RNA, 17 nt, Pseudomonas aeruginosa PA01
gguguuguucgccagca

SEQ ID NO: 1548166 - RNA, 14 nt, Pseudomonas aeruginosa PA01
gguguuggucaggc

SEQ ID NO: 1548167 - RNA, 13 nt, Pseudomonas aeruginosa PA01
gguguugaugguc

SEQ ID NO: 1548168 - RNA, 18 nt, Pseudomonas aeruginosa PA01
gguguucguccagaugcu

SEQ ID NO: 1548169 - RNA, 14 nt, Pseudomonas aeruginosa PA01
gguguagccgagca

SEQ ID NO: 1548170 - RNA, 13 nt, Pseudomonas aeruginosa PA01
gguguagcugcag

SEQ ID NO: 1548171 - RNA, 18 nt, Pseudomonas aeruginosa PA01
gguguccaccaccagcag

SEQ ID NO: 1548172 - RNA, 11 nt, Pseudomonas aeruginosa PA01
ggugucgccgc

SEQ ID NO: 1548173 - RNA, 22 nt, Pseudomonas aeruginosa PA01
gguggugaucagcggccgagca

SEQ ID NO: 1548174 - RNA, 18 nt, Pseudomonas aeruginosa PA01
gguggugucugguuccug

SEQ ID NO: 1548175 - RNA, 22 nt, Pseudomonas aeruginosa PA01
gguggucgaggguggucagcca

SEQ ID NO: 1548176 - RNA, 21 nt, Pseudomonas aeruginosa PA01
gguggucgaucuccuccucgg

SEQ ID NO: 1548177 - RNA, 16 nt, Pseudomonas aeruginosa PA01
gguggucaccagcgug

SEQ ID NO: 1548178 - RNA, 23 nt, Pseudomonas aeruginosa PA01
gguggucaccagcgugggcaaca

SEQ ID NO: 1548179 - RNA, 19 nt, Pseudomonas aeruginosa PA01
gguugcgcaaccagcgcuc

SEQ ID NO: 1548180 - RNA, 18 nt, Pseudomonas aeruginosa PA01
gguugcgggagcacuggg

SEQ ID NO: 1548181 - RNA, 15 nt, Pseudomonas aeruginosa PA01
gguugcuguagaaug

SEQ ID NO: 1548182 - RNA, 16 nt, Pseudomonas aeruginosa PA01
gguuggcgcaggccgg

SEQ ID NO: 1548183 - RNA, 17 nt, Pseudomonas aeruginosa PA01
gguuggccaguuggccc

SEQ ID NO: 1548184 - RNA, 14 nt, Pseudomonas aeruginosa PA01
gguuggccgcagca

SEQ ID NO: 1548185 - RNA, 22 nt, Pseudomonas aeruginosa PA01
gguuggccgaaagcacugcggc

SEQ ID NO: 1548186 - RNA, 17 nt, Pseudomonas aeruginosa PA01
gguuggucggcaccagg

SEQ ID NO: 1548187 - RNA, 15 nt, Pseudomonas aeruginosa PA01
gguugaugucgucga

SEQ ID NO: 1548188 - RNA, 17 nt, Pseudomonas aeruginosa PA01
gguugaguugcaggccg

SEQ ID NO: 1548189 - RNA, 18 nt, Pseudomonas aeruginosa PA01
gguugaguugcaggccgg

SEQ ID NO: 1548190 - RNA, 16 nt, Pseudomonas aeruginosa PA01
gguugcccaggguggc

SEQ ID NO: 1548191 - RNA, 16 nt, Pseudomonas aeruginosa PA01
gguugccgaagcgcuc

SEQ ID NO: 1548192 - RNA, 15 nt, Pseudomonas aeruginosa PA01
gguugccgcuggccu

SEQ ID NO: 1548193 - RNA, 17 nt, Pseudomonas aeruginosa PA01
gguugacccagagccgc

SEQ ID NO: 1548194 - RNA, 19 nt, Pseudomonas aeruginosa PA01
gguugaccccgcggguggc

SEQ ID NO: 1548195 - RNA, 18 nt, Pseudomonas aeruginosa PA01
gguugaacugcgguccgg

SEQ ID NO: 1548196 - RNA, 16 nt, Pseudomonas aeruginosa PA01
gguucucggccaccac

SEQ ID NO: 1548197 - RNA, 16 nt, Pseudomonas aeruginosa PA01
gguucugccagagcgc

SEQ ID NO: 1548198 - RNA, 14 nt, Pseudomonas aeruginosa PA01
gguucugcuccugg

SEQ ID NO: 1548199 - RNA, 13 nt, Pseudomonas aeruginosa PA01
gguucugcgagua

SEQ ID NO: 1548200 - RNA, 17 nt, Pseudomonas aeruginosa PA01
gguuuccgugugcagca

SEQ ID NO: 1548201 - RNA, 13 nt, Pseudomonas aeruginosa PA01
gguuuccaguuca

SEQ ID NO: 1548202 - RNA, 20 nt, Pseudomonas aeruginosa PA01
gguuuccgccggacccugcc

SEQ ID NO: 1548203 - RNA, 16 nt, Pseudomonas aeruginosa PA01
gguuuccggccaggcg

SEQ ID NO: 1548204 - RNA, 18 nt, Pseudomonas aeruginosa PA01
gguuucuucgccuugccc

SEQ ID NO: 1548205 - RNA, 22 nt, Pseudomonas aeruginosa PA01
gguuucuucgccuugcccuggc

SEQ ID NO: 1548206 - RNA, 23 nt, Pseudomonas aeruginosa PA01
gguuucuucgccuugcccuggcc

SEQ ID NO: 1548207 - RNA, 22 nt, Pseudomonas aeruginosa PA01
ggugauuuacaggacugugcuu

SEQ ID NO: 1548208 - RNA, 13 nt, Pseudomonas aeruginosa PA01
ggugauccagcug

SEQ ID NO: 1548209 - RNA, 13 nt, Pseudomonas aeruginosa PA01
ggugaugaagaag

SEQ ID NO: 1548210 - RNA, 15 nt, Pseudomonas aeruginosa PA01
ggugaucacccagag

SEQ ID NO: 1548211 - RNA, 15 nt, Pseudomonas aeruginosa PA01
ggugaucagcggccg

SEQ ID NO: 1548212 - RNA, 14 nt, Pseudomonas aeruginosa PA01
ggugaucgagccgc

SEQ ID NO: 1548213 - RNA, 16 nt, Pseudomonas aeruginosa PA01
ggugagguugccgccg

SEQ ID NO: 1548214 - RNA, 15 nt, Pseudomonas aeruginosa PA01
ggugauagagcacgc

SEQ ID NO: 1548215 - RNA, 16 nt, Pseudomonas aeruginosa PA01
ggugcauguagcgcuc

SEQ ID NO: 1548216 - RNA, 23 nt, Pseudomonas aeruginosa PA01
ggugccauccgcagucuucucgg

SEQ ID NO: 1548217 - RNA, 17 nt, Pseudomonas aeruginosa PA01
ggugcccuggaagccgg

SEQ ID NO: 1548218 - RNA, 18 nt, Pseudomonas aeruginosa PA01
ggugccagggcggucggc

SEQ ID NO: 1548219 - RNA, 17 nt, Pseudomonas aeruginosa PA01
ggugcauccgccgcaga

SEQ ID NO: 1548220 - RNA, 21 nt, Pseudomonas aeruginosa PA01
ggugcauccgccgcagaccag

SEQ ID NO: 1548221 - RNA, 17 nt, Pseudomonas aeruginosa PA01
ggugcagauggucgccg

SEQ ID NO: 1548222 - RNA, 14 nt, Pseudomonas aeruginosa PA01
ggugcaggccgacg

SEQ ID NO: 1548223 - RNA, 15 nt, Pseudomonas aeruginosa PA01
ggugcaggccgcgcg

SEQ ID NO: 1548224 - RNA, 16 nt, Pseudomonas aeruginosa PA01
ggugcagcggaagccc

SEQ ID NO: 1548225 - RNA, 17 nt, Pseudomonas aeruginosa PA01
ggugcaggaagcgccgg

SEQ ID NO: 1548226 - RNA, 13 nt, Pseudomonas aeruginosa PA01
ggugaggaccugg

SEQ ID NO: 1548227 - RNA, 14 nt, Pseudomonas aeruginosa PA01
ggugaggccgagcc

SEQ ID NO: 1548228 - RNA, 23 nt, Pseudomonas aeruginosa PA01
ggugagcauggcguugagguugc

SEQ ID NO: 1548229 - RNA, 19 nt, Pseudomonas aeruginosa PA01
ggugaccugguagucgcgg

SEQ ID NO: 1548230 - RNA, 21 nt, Pseudomonas aeruginosa PA01
ggugacgacgugcccauuuuc

SEQ ID NO: 1548231 - RNA, 20 nt, Pseudomonas aeruginosa PA01
ggugaccaccuugauccgcg

SEQ ID NO: 1548232 - RNA, 19 nt, Pseudomonas aeruginosa PA01
ggugacccacuccggcagg

SEQ ID NO: 1548233 - RNA, 12 nt, Pseudomonas aeruginosa PA01
ggcuccggcgcc

SEQ ID NO: 1548234 - RNA, 17 nt, Pseudomonas aeruginosa PA01
ggcuccggcgccaggcc

SEQ ID NO: 1548235 - RNA, 19 nt, Pseudomonas aeruginosa PA01
ggcuccggcgccaggccgg

SEQ ID NO: 1548236 - RNA, 22 nt, Pseudomonas aeruginosa PA01
ggcuccgggccgagggcugaga

SEQ ID NO: 1548237 - RNA, 15 nt, Pseudomonas aeruginosa PA01
ggcucaggccuuggc

SEQ ID NO: 1548238 - RNA, 17 nt, Pseudomonas aeruginosa PA01
ggcucaguucggccagc

SEQ ID NO: 1548239 - RNA, 18 nt, Pseudomonas aeruginosa PA01
ggcucaguucggccagcg

SEQ ID NO: 1548240 - RNA, 14 nt, Pseudomonas aeruginosa PA01
ggcucccccgcgcc

SEQ ID NO: 1548241 - RNA, 22 nt, Pseudomonas aeruginosa PA01
ggcucccugcaauggggcggcc

SEQ ID NO: 1548242 - RNA, 18 nt, Pseudomonas aeruginosa PA01
ggugcuuuccugcuccag

SEQ ID NO: 1548243 - RNA, 21 nt, Pseudomonas aeruginosa PA01
ggugcuuuccugcuccagcag

SEQ ID NO: 1548244 - RNA, 23 nt, Pseudomonas aeruginosa PA01
ggugcuuugcauggccuguacca

SEQ ID NO: 1548245 - RNA, 16 nt, Pseudomonas aeruginosa PA01
ggugcuuggcaccgcg

SEQ ID NO: 1548246 - RNA, 19 nt, Pseudomonas aeruginosa PA01
ggugcuuggcuucgagcug

SEQ ID NO: 1548247 - RNA, 22 nt, Pseudomonas aeruginosa PA01
ggugcuguucagcgggugccga

SEQ ID NO: 1548248 - RNA, 21 nt, Pseudomonas aeruginosa PA01
gguggaauccagggccgagca

SEQ ID NO: 1548249 - RNA, 13 nt, Pseudomonas aeruginosa PA01
gguggaagcgcgc

SEQ ID NO: 1548250 - RNA, 20 nt, Pseudomonas aeruginosa PA01
gguggacgucgucggcgacc

SEQ ID NO: 1548251 - RNA, 16 nt, Pseudomonas aeruginosa PA01
gguggauaucgucggg

SEQ ID NO: 1548252 - RNA, 20 nt, Pseudomonas aeruginosa PA01
gguggauguucgccgccacc

SEQ ID NO: 1548253 - RNA, 11 nt, Pseudomonas aeruginosa PA01
gguggaggcgu

SEQ ID NO: 1548254 - RNA, 21 nt, Pseudomonas aeruginosa PA01
gguggccaggcgcaccagcag

SEQ ID NO: 1548255 - RNA, 12 nt, Pseudomonas aeruginosa PA01
gguggccaggcu

SEQ ID NO: 1548256 - RNA, 15 nt, Pseudomonas aeruginosa PA01
gguggccgugcagcc

SEQ ID NO: 1548257 - RNA, 20 nt, Pseudomonas aeruginosa PA01
gguggcgacgcgcaggccgg

SEQ ID NO: 1548258 - RNA, 16 nt, Pseudomonas aeruginosa PA01
gguggcguacccgccc

SEQ ID NO: 1548259 - RNA, 15 nt, Pseudomonas aeruginosa PA01
gguggcguugcaggg

SEQ ID NO: 1548260 - RNA, 13 nt, Pseudomonas aeruginosa PA01
gguggcgguugcg

SEQ ID NO: 1548261 - RNA, 14 nt, Pseudomonas aeruginosa PA01
gguggcgcuggcca

SEQ ID NO: 1548262 - RNA, 11 nt, Pseudomonas aeruginosa PA01
gguggcggcga

SEQ ID NO: 1548263 - RNA, 17 nt, Pseudomonas aeruginosa PA01
ggugggucacgucggcg

SEQ ID NO: 1548264 - RNA, 12 nt, Pseudomonas aeruginosa PA01
ggugggcggcgg

SEQ ID NO: 1548265 - RNA, 13 nt, Pseudomonas aeruginosa PA01
ggugggcagcagc

SEQ ID NO: 1548266 - RNA, 20 nt, Pseudomonas aeruginosa PA01
ggugcgcucguugauccgcg

SEQ ID NO: 1548267 - RNA, 13 nt, Pseudomonas aeruginosa PA01
ggugcggcugccg

SEQ ID NO: 1548268 - RNA, 15 nt, Pseudomonas aeruginosa PA01
ggugcggcugcucau

SEQ ID NO: 1548269 - RNA, 21 nt, Pseudomonas aeruginosa PA01
ggugcgcggcaggacccagaa

SEQ ID NO: 1548270 - RNA, 16 nt, Pseudomonas aeruginosa PA01
ggugcgccgagcgcuc

SEQ ID NO: 1548271 - RNA, 19 nt, Pseudomonas aeruginosa PA01
ggugcgccgagcgcucgcc

SEQ ID NO: 1548272 - RNA, 23 nt, Pseudomonas aeruginosa PA01
ggugcucggccugaucaucuggg

SEQ ID NO: 1548273 - RNA, 20 nt, Pseudomonas aeruginosa PA01
ggugcuaugcgccgggccuc

SEQ ID NO: 1548274 - RNA, 22 nt, Pseudomonas aeruginosa PA01
ggugcguuaccgaaagaaacaa

SEQ ID NO: 1548275 - RNA, 14 nt, Pseudomonas aeruginosa PA01
ggugcggcaccagc

SEQ ID NO: 1548276 - RNA, 12 nt, Pseudomonas aeruginosa PA01
ggugcgggcgcg

SEQ ID NO: 1548277 - RNA, 20 nt, Pseudomonas aeruginosa PA01
ggugccuuccgcgcccaggc

SEQ ID NO: 1548278 - RNA, 23 nt, Pseudomonas aeruginosa PA01
ggugccuuccgcgcccaggcugc

SEQ ID NO: 1548279 - RNA, 17 nt, Pseudomonas aeruginosa PA01
ggugccuucggcggcgc

SEQ ID NO: 1548280 - RNA, 13 nt, Pseudomonas aeruginosa PA01
ggugccgcgcagc

SEQ ID NO: 1548281 - RNA, 23 nt, Pseudomonas aeruginosa PA01
ggugccgccggccaccagcagca

SEQ ID NO: 1548282 - RNA, 15 nt, Pseudomonas aeruginosa PA01
ggugccgccggcgcc

SEQ ID NO: 1548283 - RNA, 13 nt, Pseudomonas aeruginosa PA01
ggugccggcggcg

SEQ ID NO: 1548284 - RNA, 15 nt, Pseudomonas aeruginosa PA01
ggugccggcggcgga

SEQ ID NO: 1548285 - RNA, 15 nt, Pseudomonas aeruginosa PA01
ggugccgcguagggc

SEQ ID NO: 1548286 - RNA, 19 nt, Pseudomonas aeruginosa PA01
ggugccgcgcagcuugccu

SEQ ID NO: 1548287 - RNA, 21 nt, Pseudomonas aeruginosa PA01
ggugccgcuguaggacagguu

SEQ ID NO: 1548288 - RNA, 13 nt, Pseudomonas aeruginosa PA01
ggugccgggggcg

SEQ ID NO: 1548289 - RNA, 16 nt, Pseudomonas aeruginosa PA01
ggugccgcccggcgcc

SEQ ID NO: 1548290 - RNA, 13 nt, Pseudomonas aeruginosa PA01
guacggaugccgc

SEQ ID NO: 1548291 - RNA, 22 nt, Pseudomonas aeruginosa PA01
guacggcugagaccuuccugcc

SEQ ID NO: 1548292 - RNA, 12 nt, Pseudomonas aeruginosa PA01
guacgcugcaug

SEQ ID NO: 1548293 - RNA, 21 nt, Pseudomonas aeruginosa PA01
guacgccgcgcugcgccaggc

SEQ ID NO: 1548294 - RNA, 22 nt, Pseudomonas aeruginosa PA01
guacgccgcgcugcgccaggcc

SEQ ID NO: 1548295 - RNA, 21 nt, Pseudomonas aeruginosa PA01
guaccuuucuccccucaggcg

SEQ ID NO: 1548296 - RNA, 15 nt, Pseudomonas aeruginosa PA01
guaccugcucacggc

SEQ ID NO: 1548297 - RNA, 23 nt, Pseudomonas aeruginosa PA01
guaccugcucgcgggucaccacc

SEQ ID NO: 1548298 - RNA, 15 nt, Pseudomonas aeruginosa PA01
guacccggccgccuu

SEQ ID NO: 1548299 - RNA, 16 nt, Pseudomonas aeruginosa PA01
guacccguacgcugcc

SEQ ID NO: 1548300 - RNA, 17 nt, Pseudomonas aeruginosa PA01
guaccgaaacagggcga

SEQ ID NO: 1548301 - RNA, 15 nt, Pseudomonas aeruginosa PA01
guaccgggccaggca

SEQ ID NO: 1548302 - RNA, 13 nt, Pseudomonas aeruginosa PA01
guaccggccaggc

SEQ ID NO: 1548303 - RNA, 14 nt, Pseudomonas aeruginosa PA01
guaccggccaggcg

SEQ ID NO: 1548304 - RNA, 13 nt, Pseudomonas aeruginosa PA01
guaccgcugcggc

SEQ ID NO: 1548305 - RNA, 18 nt, Pseudomonas aeruginosa PA01
guaccgcugcgugccagg

SEQ ID NO: 1548306 - RNA, 16 nt, Pseudomonas aeruginosa PA01
guaccucgccaggcug

SEQ ID NO: 1548307 - RNA, 12 nt, Pseudomonas aeruginosa PA01
guaccucuggcu

SEQ ID NO: 1548308 - RNA, 14 nt, Pseudomonas aeruginosa PA01
guaccucuggcuga

SEQ ID NO: 1548309 - RNA, 14 nt, Pseudomonas aeruginosa PA01
guaccugcaaggcg

SEQ ID NO: 1548310 - RNA, 20 nt, Pseudomonas aeruginosa PA01
guaccucgaagcccagcgcc

SEQ ID NO: 1548311 - RNA, 20 nt, Pseudomonas aeruginosa PA01
guaccagcaaugcccagcgc

SEQ ID NO: 1548312 - RNA, 16 nt, Pseudomonas aeruginosa PA01
guaccacgcagccacc

SEQ ID NO: 1548313 - RNA, 23 nt, Pseudomonas aeruginosa PA01
guaccacgcccgcgguauucucc

SEQ ID NO: 1548314 - RNA, 22 nt, Pseudomonas aeruginosa PA01
guaccagcgcgauacccuggcc

SEQ ID NO: 1548315 - RNA, 15 nt, Pseudomonas aeruginosa PA01
guaccaggccaccgg

SEQ ID NO: 1548316 - RNA, 15 nt, Pseudomonas aeruginosa PA01
guaccagucgcccgc

SEQ ID NO: 1548317 - RNA, 19 nt, Pseudomonas aeruginosa PA01
guacagcucaccccaggaa

SEQ ID NO: 1548318 - RNA, 15 nt, Pseudomonas aeruginosa PA01
guacagcgggccggg

SEQ ID NO: 1548319 - RNA, 12 nt, Pseudomonas aeruginosa PA01
guacagcaggca

SEQ ID NO: 1548320 - RNA, 15 nt, Pseudomonas aeruginosa PA01
guacagcaggcaggc

SEQ ID NO: 1548321 - RNA, 16 nt, Pseudomonas aeruginosa PA01
guacagcaggcaggca

SEQ ID NO: 1548322 - RNA, 20 nt, Pseudomonas aeruginosa PA01
guacagcaggcaggcauggu

SEQ ID NO: 1548323 - RNA, 22 nt, Pseudomonas aeruginosa PA01
guacagguuguucggcgaguug

SEQ ID NO: 1548324 - RNA, 17 nt, Pseudomonas aeruginosa PA01
guaaugcaacccgccgc

SEQ ID NO: 1548325 - RNA, 14 nt, Pseudomonas aeruginosa PA01
guaaugagaagguc

SEQ ID NO: 1548326 - RNA, 16 nt, Pseudomonas aeruginosa PA01
guaauguucuccuccc

SEQ ID NO: 1548327 - RNA, 21 nt, Pseudomonas aeruginosa PA01
guaauucgcugacgaggacgc

SEQ ID NO: 1548328 - RNA, 17 nt, Pseudomonas aeruginosa PA01
guacaccgcgcggcaca

SEQ ID NO: 1548329 - RNA, 21 nt, Pseudomonas aeruginosa PA01
guacaccagauggcuggucag

SEQ ID NO: 1548330 - RNA, 18 nt, Pseudomonas aeruginosa PA01
guaacgguagcggcagga

SEQ ID NO: 1548331 - RNA, 16 nt, Pseudomonas aeruginosa PA01
guaacuggccagggca

SEQ ID NO: 1548332 - RNA, 13 nt, Pseudomonas aeruginosa PA01
guaagaucgauga

SEQ ID NO: 1548333 - RNA, 14 nt, Pseudomonas aeruginosa PA01
guaagugccgacca

SEQ ID NO: 1548334 - RNA, 20 nt, Pseudomonas aeruginosa PA01
guaagguugccgaucaggcu

SEQ ID NO: 1548335 - RNA, 16 nt, Pseudomonas aeruginosa PA01
guaagcauuaacuuac

SEQ ID NO: 1548336 - RNA, 21 nt, Pseudomonas aeruginosa PA01
guaauaggcgaagcggcucgg

SEQ ID NO: 1548337 - RNA, 23 nt, Pseudomonas aeruginosa PA01
guaaacgcgaaugcccggcagcg

SEQ ID NO: 1548338 - RNA, 20 nt, Pseudomonas aeruginosa PA01
guacugggcgauguccugga

SEQ ID NO: 1548339 - RNA, 19 nt, Pseudomonas aeruginosa PA01
guacucgaucugucgcagc

SEQ ID NO: 1548340 - RNA, 20 nt, Pseudomonas aeruginosa PA01
guacucgaucugucgcagcg

SEQ ID NO: 1548341 - RNA, 20 nt, Pseudomonas aeruginosa PA01
guacucgauggucagguagg

SEQ ID NO: 1548342 - RNA, 20 nt, Pseudomonas aeruginosa PA01
guacucguguuccggcagga

SEQ ID NO: 1548343 - RNA, 21 nt, Pseudomonas aeruginosa PA01
guacucaggccgggcggauga

SEQ ID NO: 1548344 - RNA, 23 nt, Pseudomonas aeruginosa PA01
guacuccggguugaccgccagac

SEQ ID NO: 1548345 - RNA, 23 nt, Pseudomonas aeruginosa PA01
guacuccagcaacggcaucgcuc

SEQ ID NO: 1548346 - RNA, 14 nt, Pseudomonas aeruginosa PA01
guacguccagggca

SEQ ID NO: 1548347 - RNA, 20 nt, Pseudomonas aeruginosa PA01
guagaaaccgauguuggugu

SEQ ID NO: 1548348 - RNA, 23 nt, Pseudomonas aeruginosa PA01
guagaaacgcgccuccggcagcg

SEQ ID NO: 1548349 - RNA, 14 nt, Pseudomonas aeruginosa PA01
guagaacaccaccc

SEQ ID NO: 1548350 - RNA, 15 nt, Pseudomonas aeruginosa PA01
guagaagcgcgcggu

SEQ ID NO: 1548351 - RNA, 15 nt, Pseudomonas aeruginosa PA01
guagaacaggcugcc

SEQ ID NO: 1548352 - RNA, 14 nt, Pseudomonas aeruginosa PA01
guacuuggccacgc

SEQ ID NO: 1548353 - RNA, 22 nt, Pseudomonas aeruginosa PA01
guacuuggccacgccuucgggc

SEQ ID NO: 1548354 - RNA, 17 nt, Pseudomonas aeruginosa PA01
guagcagggugcgggcg

SEQ ID NO: 1548355 - RNA, 20 nt, Pseudomonas aeruginosa PA01
guagcaauacaccuuggugu

SEQ ID NO: 1548356 - RNA, 20 nt, Pseudomonas aeruginosa PA01
guagaugccggugcuggugc

SEQ ID NO: 1548357 - RNA, 12 nt, Pseudomonas aeruginosa PA01
guagaucgaugc

SEQ ID NO: 1548358 - RNA, 14 nt, Pseudomonas aeruginosa PA01
guagaucggcagca

SEQ ID NO: 1548359 - RNA, 21 nt, Pseudomonas aeruginosa PA01
guagaucggcagcaucagccg

SEQ ID NO: 1548360 - RNA, 19 nt, Pseudomonas aeruginosa PA01
guagaggucgccguccuug

SEQ ID NO: 1548361 - RNA, 17 nt, Pseudomonas aeruginosa PA01
guagaggcuguagcgcu

SEQ ID NO: 1548362 - RNA, 20 nt, Pseudomonas aeruginosa PA01
guagagauuggguucaggcu

SEQ ID NO: 1548363 - RNA, 14 nt, Pseudomonas aeruginosa PA01
guagagcaggcugc

SEQ ID NO: 1548364 - RNA, 16 nt, Pseudomonas aeruginosa PA01
guagaccaccagcagg

SEQ ID NO: 1548365 - RNA, 23 nt, Pseudomonas aeruginosa PA01
guagaccagauagaccaaggcau

SEQ ID NO: 1548366 - RNA, 21 nt, Pseudomonas aeruginosa PA01
guagaccacgcaggccagcgc

SEQ ID NO: 1548367 - RNA, 17 nt, Pseudomonas aeruginosa PA01
guagacugucgcggggc

SEQ ID NO: 1548368 - RNA, 19 nt, Pseudomonas aeruginosa PA01
guagacgaaacucaucagg

SEQ ID NO: 1548369 - RNA, 18 nt, Pseudomonas aeruginosa PA01
guagacguccuccaccgc

SEQ ID NO: 1548370 - RNA, 16 nt, Pseudomonas aeruginosa PA01
guagugcagcugcgag

SEQ ID NO: 1548371 - RNA, 15 nt, Pseudomonas aeruginosa PA01
guagugcaucagccu

SEQ ID NO: 1548372 - RNA, 17 nt, Pseudomonas aeruginosa PA01
guagucgcugcuggcgc

SEQ ID NO: 1548373 - RNA, 16 nt, Pseudomonas aeruginosa PA01
guagugcaacaccugg

SEQ ID NO: 1548374 - RNA, 17 nt, Pseudomonas aeruginosa PA01
guagugcaacaccuggc

SEQ ID NO: 1548375 - RNA, 13 nt, Pseudomonas aeruginosa PA01
guaguccagcagg

SEQ ID NO: 1548376 - RNA, 23 nt, Pseudomonas aeruginosa PA01
guaguccagcgguaccagcagcg

SEQ ID NO: 1548377 - RNA, 17 nt, Pseudomonas aeruginosa PA01
guaguccagcuccucga

SEQ ID NO: 1548378 - RNA, 17 nt, Pseudomonas aeruginosa PA01
guagucauugcgcugug

SEQ ID NO: 1548379 - RNA, 14 nt, Pseudomonas aeruginosa PA01
guaguccugggccg

SEQ ID NO: 1548380 - RNA, 15 nt, Pseudomonas aeruginosa PA01
guaguccaucaccgc

SEQ ID NO: 1548381 - RNA, 19 nt, Pseudomonas aeruginosa PA01
guaguccguuuccggcaug

SEQ ID NO: 1548382 - RNA, 23 nt, Pseudomonas aeruginosa PA01
guaguccuccgcgcccaggcgca

SEQ ID NO: 1548383 - RNA, 21 nt, Pseudomonas aeruginosa PA01
guaguagaucagcuucucuuu

SEQ ID NO: 1548384 - RNA, 13 nt, Pseudomonas aeruginosa PA01
guaguagugcccc

SEQ ID NO: 1548385 - RNA, 20 nt, Pseudomonas aeruginosa PA01
guaguaggggaauuucacgc

SEQ ID NO: 1548386 - RNA, 15 nt, Pseudomonas aeruginosa PA01
guagguguacccagg

SEQ ID NO: 1548387 - RNA, 13 nt, Pseudomonas aeruginosa PA01
guaguaccucgaa

SEQ ID NO: 1548388 - RNA, 19 nt, Pseudomonas aeruginosa PA01
guagguuuucguugggugg

SEQ ID NO: 1548389 - RNA, 13 nt, Pseudomonas aeruginosa PA01
guagguccaggcg

SEQ ID NO: 1548390 - RNA, 14 nt, Pseudomonas aeruginosa PA01
guagguccaggcga

SEQ ID NO: 1548391 - RNA, 22 nt, Pseudomonas aeruginosa PA01
guagguccaggcgucggcgccu

SEQ ID NO: 1548392 - RNA, 22 nt, Pseudomonas aeruginosa PA01
guagggcuggacguacauggga

SEQ ID NO: 1548393 - RNA, 21 nt, Pseudomonas aeruginosa PA01
guagguagagaugcagcaggu

SEQ ID NO: 1548394 - RNA, 17 nt, Pseudomonas aeruginosa PA01
guagggcguauaaccgc

SEQ ID NO: 1548395 - RNA, 17 nt, Pseudomonas aeruginosa PA01
guagggcgcauaaccgc

SEQ ID NO: 1548396 - RNA, 19 nt, Pseudomonas aeruginosa PA01
guaggcgagcagcggcacg

SEQ ID NO: 1548397 - RNA, 22 nt, Pseudomonas aeruginosa PA01
guaggcgauggccuggucggcg

SEQ ID NO: 1548398 - RNA, 17 nt, Pseudomonas aeruginosa PA01
guagggcgaauaaccgc

SEQ ID NO: 1548399 - RNA, 22 nt, Pseudomonas aeruginosa PA01
guagggcgaauaacgccacagg

SEQ ID NO: 1548400 - RNA, 23 nt, Pseudomonas aeruginosa PA01
guagggcgaauaacgccgcaggc

SEQ ID NO: 1548401 - RNA, 14 nt, Pseudomonas aeruginosa PA01
guaggccgagccca

SEQ ID NO: 1548402 - RNA, 13 nt, Pseudomonas aeruginosa PA01
guaggccuggccg

SEQ ID NO: 1548403 - RNA, 18 nt, Pseudomonas aeruginosa PA01
guaggccuggccgcccag

SEQ ID NO: 1548404 - RNA, 14 nt, Pseudomonas aeruginosa PA01
guaggccgcuuccg

SEQ ID NO: 1548405 - RNA, 12 nt, Pseudomonas aeruginosa PA01
guaggccaggca

SEQ ID NO: 1548406 - RNA, 16 nt, Pseudomonas aeruginosa PA01
guaggcauccacgccc

SEQ ID NO: 1548407 - RNA, 21 nt, Pseudomonas aeruginosa PA01
guaggcaucgacgccagcggc

SEQ ID NO: 1548408 - RNA, 16 nt, Pseudomonas aeruginosa PA01
guagccugcggccagc

SEQ ID NO: 1548409 - RNA, 18 nt, Pseudomonas aeruginosa PA01
guagccugcggccagcgc

SEQ ID NO: 1548410 - RNA, 19 nt, Pseudomonas aeruginosa PA01
guagccugcggccagcgcc

SEQ ID NO: 1548411 - RNA, 14 nt, Pseudomonas aeruginosa PA01
guagccgcguacgg

SEQ ID NO: 1548412 - RNA, 23 nt, Pseudomonas aeruginosa PA01
guagccguauucgaagcucggca

SEQ ID NO: 1548413 - RNA, 19 nt, Pseudomonas aeruginosa PA01
guagccgucguagcgcagc

SEQ ID NO: 1548414 - RNA, 21 nt, Pseudomonas aeruginosa PA01
guagccgucguagcgcagcgg

SEQ ID NO: 1548415 - RNA, 14 nt, Pseudomonas aeruginosa PA01
guagccggccaggg

SEQ ID NO: 1548416 - RNA, 15 nt, Pseudomonas aeruginosa PA01
guagccggccagggc

SEQ ID NO: 1548417 - RNA, 18 nt, Pseudomonas aeruginosa PA01
guagccggccagggcgcg

SEQ ID NO: 1548418 - RNA, 20 nt, Pseudomonas aeruginosa PA01
guagccggcuuccucgcccu

SEQ ID NO: 1548419 - RNA, 20 nt, Pseudomonas aeruginosa PA01
guagccgcccuuuuccggau

SEQ ID NO: 1548420 - RNA, 21 nt, Pseudomonas aeruginosa PA01
guagccgaucaacgcggccag

SEQ ID NO: 1548421 - RNA, 22 nt, Pseudomonas aeruginosa PA01
guagccgaucaacgcggccagc

SEQ ID NO: 1548422 - RNA, 23 nt, Pseudomonas aeruginosa PA01
guagccgaucaacgcggccagca

SEQ ID NO: 1548423 - RNA, 15 nt, Pseudomonas aeruginosa PA01
guagccgagaagcag

SEQ ID NO: 1548424 - RNA, 18 nt, Pseudomonas aeruginosa PA01
guagcgcuucgcgcagcu

SEQ ID NO: 1548425 - RNA, 15 nt, Pseudomonas aeruginosa PA01
guagcgcugcgccag

SEQ ID NO: 1548426 - RNA, 18 nt, Pseudomonas aeruginosa PA01
guagcgcugcgccaggcu

SEQ ID NO: 1548427 - RNA, 21 nt, Pseudomonas aeruginosa PA01
guagcgcuccagcuccuccag

SEQ ID NO: 1548428 - RNA, 14 nt, Pseudomonas aeruginosa PA01
guagcgcuccuucu

SEQ ID NO: 1548429 - RNA, 20 nt, Pseudomonas aeruginosa PA01
guagcgcagguugcgcuggc

SEQ ID NO: 1548430 - RNA, 22 nt, Pseudomonas aeruginosa PA01
guagcgcagguugcgcuggcgc

SEQ ID NO: 1548431 - RNA, 18 nt, Pseudomonas aeruginosa PA01
guagcgcaguugccagga

SEQ ID NO: 1548432 - RNA, 20 nt, Pseudomonas aeruginosa PA01
guagcgcagcggcaggccac

SEQ ID NO: 1548433 - RNA, 13 nt, Pseudomonas aeruginosa PA01
guagcgccaggcc

SEQ ID NO: 1548434 - RNA, 21 nt, Pseudomonas aeruginosa PA01
guagcggucggguucuugcug

SEQ ID NO: 1548435 - RNA, 19 nt, Pseudomonas aeruginosa PA01
guagcggucgugcagcagc

SEQ ID NO: 1548436 - RNA, 20 nt, Pseudomonas aeruginosa PA01
guagcgggccagcagcuccg

SEQ ID NO: 1548437 - RNA, 16 nt, Pseudomonas aeruginosa PA01
guagcgggccaucagg

SEQ ID NO: 1548438 - RNA, 20 nt, Pseudomonas aeruginosa PA01
guagcgggccaucaggucca

SEQ ID NO: 1548439 - RNA, 14 nt, Pseudomonas aeruginosa PA01
guagcggcaggagc

SEQ ID NO: 1548440 - RNA, 20 nt, Pseudomonas aeruginosa PA01
guagcggaaguucaccucgg

SEQ ID NO: 1548441 - RNA, 15 nt, Pseudomonas aeruginosa PA01
guagcggaucagccg

SEQ ID NO: 1548442 - RNA, 18 nt, Pseudomonas aeruginosa PA01
guagcggaucaggcccau

SEQ ID NO: 1548443 - RNA, 17 nt, Pseudomonas aeruginosa PA01
guaggacgccucgucgg

SEQ ID NO: 1548444 - RNA, 12 nt, Pseudomonas aeruginosa PA01
guaggacaggcc

SEQ ID NO: 1548445 - RNA, 15 nt, Pseudomonas aeruginosa PA01
guaggcacaggaccc

SEQ ID NO: 1548446 - RNA, 20 nt, Pseudomonas aeruginosa PA01
guagcugagcaggccgacgg

SEQ ID NO: 1548447 - RNA, 20 nt, Pseudomonas aeruginosa PA01
guagcugcagcgccccagca

SEQ ID NO: 1548448 - RNA, 15 nt, Pseudomonas aeruginosa PA01
guagcugcgccgccu

SEQ ID NO: 1548449 - RNA, 16 nt, Pseudomonas aeruginosa PA01
guagcugcggccgagc

SEQ ID NO: 1548450 - RNA, 17 nt, Pseudomonas aeruginosa PA01
guagcuggaucugguug

SEQ ID NO: 1548451 - RNA, 19 nt, Pseudomonas aeruginosa PA01
guagcuggaucugguugaa

SEQ ID NO: 1548452 - RNA, 18 nt, Pseudomonas aeruginosa PA01
guagcuggcgcagggcgu

SEQ ID NO: 1548453 - RNA, 14 nt, Pseudomonas aeruginosa PA01
guagcuguucucuu

SEQ ID NO: 1548454 - RNA, 15 nt, Pseudomonas aeruginosa PA01
guagcguugcaggca

SEQ ID NO: 1548455 - RNA, 17 nt, Pseudomonas aeruginosa PA01
guagcguugcgccagac

SEQ ID NO: 1548456 - RNA, 16 nt, Pseudomonas aeruginosa PA01
guagcguuggaguagg

SEQ ID NO: 1548457 - RNA, 22 nt, Pseudomonas aeruginosa PA01
guagcguagggcgaauaaccgc

SEQ ID NO: 1548458 - RNA, 16 nt, Pseudomonas aeruginosa PA01
guagcucugcuggcug

SEQ ID NO: 1548459 - RNA, 17 nt, Pseudomonas aeruginosa PA01
guaguuguucggcuggg

SEQ ID NO: 1548460 - RNA, 22 nt, Pseudomonas aeruginosa PA01
guaguugacgucgccgaugcgg

SEQ ID NO: 1548461 - RNA, 22 nt, Pseudomonas aeruginosa PA01
guauaggagccugcgugagcug

SEQ ID NO: 1548462 - RNA, 23 nt, Pseudomonas aeruginosa PA01
guauaggagccugcgugagcugg

SEQ ID NO: 1548463 - RNA, 15 nt, Pseudomonas aeruginosa PA01
guauaccagcggcug

SEQ ID NO: 1548464 - RNA, 14 nt, Pseudomonas aeruginosa PA01
guauagaccagcac

SEQ ID NO: 1548465 - RNA, 23 nt, Pseudomonas aeruginosa PA01
guauaggcgcuggugcugcucca

SEQ ID NO: 1548466 - RNA, 18 nt, Pseudomonas aeruginosa PA01
guauccagguucacccag

SEQ ID NO: 1548467 - RNA, 18 nt, Pseudomonas aeruginosa PA01
guauccaccggacccggc

SEQ ID NO: 1548468 - RNA, 21 nt, Pseudomonas aeruginosa PA01
guauccaccggacccggcugc

SEQ ID NO: 1548469 - RNA, 18 nt, Pseudomonas aeruginosa PA01
guauccaccucgcccucg

SEQ ID NO: 1548470 - RNA, 23 nt, Pseudomonas aeruginosa PA01
guaucccagcgcgugcaggcgcc

SEQ ID NO: 1548471 - RNA, 15 nt, Pseudomonas aeruginosa PA01
guaugccgcaggcag

SEQ ID NO: 1548472 - RNA, 20 nt, Pseudomonas aeruginosa PA01
guauggcggucggccaggcg

SEQ ID NO: 1548473 - RNA, 14 nt, Pseudomonas aeruginosa PA01
guauggcugcugug

SEQ ID NO: 1548474 - RNA, 15 nt, Pseudomonas aeruginosa PA01
guauguuucuggccg

SEQ ID NO: 1548475 - RNA, 12 nt, Pseudomonas aeruginosa PA01
guauuccagggg

SEQ ID NO: 1548476 - RNA, 21 nt, Pseudomonas aeruginosa PA01
guauuuccccaacaucaaccc

SEQ ID NO: 1548477 - RNA, 20 nt, Pseudomonas aeruginosa PA01
gucaacaagaauaggaacag

SEQ ID NO: 1548478 - RNA, 20 nt, Pseudomonas aeruginosa PA01
gucgagguuguagcccuggg

SEQ ID NO: 1548479 - RNA, 21 nt, Pseudomonas aeruginosa PA01
gucgaguaauuuuguggagua

SEQ ID NO: 1548480 - RNA, 16 nt, Pseudomonas aeruginosa PA01
gucgaggucgacggcg

SEQ ID NO: 1548481 - RNA, 21 nt, Pseudomonas aeruginosa PA01
gucgaggucgacggcggccgc

SEQ ID NO: 1548482 - RNA, 22 nt, Pseudomonas aeruginosa PA01
gucgagguagaacaggcugccg

SEQ ID NO: 1548483 - RNA, 14 nt, Pseudomonas aeruginosa PA01
gucgaugaacgcgc

SEQ ID NO: 1548484 - RNA, 19 nt, Pseudomonas aeruginosa PA01
gucgaugccuucggcggcc

SEQ ID NO: 1548485 - RNA, 21 nt, Pseudomonas aeruginosa PA01
gucgaugggcgacagcuucca

SEQ ID NO: 1548486 - RNA, 21 nt, Pseudomonas aeruginosa PA01
gucgaugcccucgcggcggca

SEQ ID NO: 1548487 - RNA, 16 nt, Pseudomonas aeruginosa PA01
gucgcaggccugguag

SEQ ID NO: 1548488 - RNA, 20 nt, Pseudomonas aeruginosa PA01
gucgcagguaacccgcggcg

SEQ ID NO: 1548489 - RNA, 19 nt, Pseudomonas aeruginosa PA01
gucgcagucguagcgcagu

SEQ ID NO: 1548490 - RNA, 18 nt, Pseudomonas aeruginosa PA01
gucgaugucgaacaaccc

SEQ ID NO: 1548491 - RNA, 17 nt, Pseudomonas aeruginosa PA01
gucgcagcuccagcgga

SEQ ID NO: 1548492 - RNA, 21 nt, Pseudomonas aeruginosa PA01
gucgccaagcccggcgagagc

SEQ ID NO: 1548493 - RNA, 18 nt, Pseudomonas aeruginosa PA01
gucgcauccaccagcggg

SEQ ID NO: 1548494 - RNA, 12 nt, Pseudomonas aeruginosa PA01
gucgagacccgc

SEQ ID NO: 1548495 - RNA, 16 nt, Pseudomonas aeruginosa PA01
gucgagacgcgggccc

SEQ ID NO: 1548496 - RNA, 20 nt, Pseudomonas aeruginosa PA01
gucgagacgcgggcccagcg

SEQ ID NO: 1548497 - RNA, 15 nt, Pseudomonas aeruginosa PA01
gucgagcaccagcag

SEQ ID NO: 1548498 - RNA, 16 nt, Pseudomonas aeruginosa PA01
gucgagcaccagcagg

SEQ ID NO: 1548499 - RNA, 18 nt, Pseudomonas aeruginosa PA01
gucgagcaccagcagguc

SEQ ID NO: 1548500 - RNA, 15 nt, Pseudomonas aeruginosa PA01
gucgaggaaggccag

SEQ ID NO: 1548501 - RNA, 14 nt, Pseudomonas aeruginosa PA01
gucgagggccuugu

SEQ ID NO: 1548502 - RNA, 13 nt, Pseudomonas aeruginosa PA01
gucgaggcugccg

SEQ ID NO: 1548503 - RNA, 23 nt, Pseudomonas aeruginosa PA01
gucgaggcccucggcggcgagcg

SEQ ID NO: 1548504 - RNA, 14 nt, Pseudomonas aeruginosa PA01
gucgaggcgcucca

SEQ ID NO: 1548505 - RNA, 19 nt, Pseudomonas aeruginosa PA01
gucgagggucugcucgacg

SEQ ID NO: 1548506 - RNA, 20 nt, Pseudomonas aeruginosa PA01
gucgaggguggcgccgagca

SEQ ID NO: 1548507 - RNA, 17 nt, Pseudomonas aeruginosa PA01
gucgaggguugggcagc

SEQ ID NO: 1548508 - RNA, 14 nt, Pseudomonas aeruginosa PA01
gucgaagcagccca

SEQ ID NO: 1548509 - RNA, 19 nt, Pseudomonas aeruginosa PA01
gucgaagcagcccagcgcu

SEQ ID NO: 1548510 - RNA, 16 nt, Pseudomonas aeruginosa PA01
gucgaagcgcagcagg

SEQ ID NO: 1548511 - RNA, 13 nt, Pseudomonas aeruginosa PA01
gucgaagggcacg

SEQ ID NO: 1548512 - RNA, 22 nt, Pseudomonas aeruginosa PA01
gucgaagucguugaagcggccg

SEQ ID NO: 1548513 - RNA, 20 nt, Pseudomonas aeruginosa PA01
gucgaauuggacagcaggcu

SEQ ID NO: 1548514 - RNA, 20 nt, Pseudomonas aeruginosa PA01
gucgaaccagcucagcucca

SEQ ID NO: 1548515 - RNA, 16 nt, Pseudomonas aeruginosa PA01
gucgaacagcggcugg

SEQ ID NO: 1548516 - RNA, 14 nt, Pseudomonas aeruginosa PA01
guccuguggauaaa

SEQ ID NO: 1548517 - RNA, 13 nt, Pseudomonas aeruginosa PA01
gucgaaacgggcg

SEQ ID NO: 1548518 - RNA, 13 nt, Pseudomonas aeruginosa PA01
gucgaacacuuga

SEQ ID NO: 1548519 - RNA, 14 nt, Pseudomonas aeruginosa PA01
gucgaacagcagcu

SEQ ID NO: 1548520 - RNA, 19 nt, Pseudomonas aeruginosa PA01
guccucggcggcucaacgg

SEQ ID NO: 1548521 - RNA, 17 nt, Pseudomonas aeruginosa PA01
guccucgggcaccagca

SEQ ID NO: 1548522 - RNA, 22 nt, Pseudomonas aeruginosa PA01
guccucgccguuggcgaggacu

SEQ ID NO: 1548523 - RNA, 22 nt, Pseudomonas aeruginosa PA01
guccuggguauagaccagcacc

SEQ ID NO: 1548524 - RNA, 13 nt, Pseudomonas aeruginosa PA01
guccugggccggu

SEQ ID NO: 1548525 - RNA, 20 nt, Pseudomonas aeruginosa PA01
guccuggucgagcuuguugg

SEQ ID NO: 1548526 - RNA, 14 nt, Pseudomonas aeruginosa PA01
guccuggucgcuga

SEQ ID NO: 1548527 - RNA, 13 nt, Pseudomonas aeruginosa PA01
guccgagagcagg

SEQ ID NO: 1548528 - RNA, 21 nt, Pseudomonas aeruginosa PA01
guccgagguggcugaagcccc

SEQ ID NO: 1548529 - RNA, 14 nt, Pseudomonas aeruginosa PA01
guccgcagcacagc

SEQ ID NO: 1548530 - RNA, 20 nt, Pseudomonas aeruginosa PA01
guccgcagcacagccccagc

SEQ ID NO: 1548531 - RNA, 23 nt, Pseudomonas aeruginosa PA01
guccgcagcgccacuuccagcuu

SEQ ID NO: 1548532 - RNA, 11 nt, Pseudomonas aeruginosa PA01
guccgccgagg

SEQ ID NO: 1548533 - RNA, 17 nt, Pseudomonas aeruginosa PA01
guccgccgaggugcugc

SEQ ID NO: 1548534 - RNA, 18 nt, Pseudomonas aeruginosa PA01
guccgccacuucaagcug

SEQ ID NO: 1548535 - RNA, 14 nt, Pseudomonas aeruginosa PA01
guccgccagcaggc

SEQ ID NO: 1548536 - RNA, 15 nt, Pseudomonas aeruginosa PA01
guccgccagcaggcg

SEQ ID NO: 1548537 - RNA, 17 nt, Pseudomonas aeruginosa PA01
guccgccaguuccggca

SEQ ID NO: 1548538 - RNA, 15 nt, Pseudomonas aeruginosa PA01
guccgccgcccaguc

SEQ ID NO: 1548539 - RNA, 22 nt, Pseudomonas aeruginosa PA01
guccgccggucaccacuggaaa

SEQ ID NO: 1548540 - RNA, 19 nt, Pseudomonas aeruginosa PA01
guccgccugguccagcagg

SEQ ID NO: 1548541 - RNA, 19 nt, Pseudomonas aeruginosa PA01
guccgcgccgcgucgccgc

SEQ ID NO: 1548542 - RNA, 18 nt, Pseudomonas aeruginosa PA01
guccggugaaccugacca

SEQ ID NO: 1548543 - RNA, 16 nt, Pseudomonas aeruginosa PA01
guccgucccacaggcc

SEQ ID NO: 1548544 - RNA, 16 nt, Pseudomonas aeruginosa PA01
gucggacuugcggccc

SEQ ID NO: 1548545 - RNA, 13 nt, Pseudomonas aeruginosa PA01
gucgcucgcgcag

SEQ ID NO: 1548546 - RNA, 16 nt, Pseudomonas aeruginosa PA01
gucgcgucggccuggc

SEQ ID NO: 1548547 - RNA, 16 nt, Pseudomonas aeruginosa PA01
gucgcucauggcgccg

SEQ ID NO: 1548548 - RNA, 21 nt, Pseudomonas aeruginosa PA01
gucgcuccagaccuccaggua

SEQ ID NO: 1548549 - RNA, 14 nt, Pseudomonas aeruginosa PA01
gucgcuccagcccc

SEQ ID NO: 1548550 - RNA, 20 nt, Pseudomonas aeruginosa PA01
gucgcguuggcgugcucgcg

SEQ ID NO: 1548551 - RNA, 14 nt, Pseudomonas aeruginosa PA01
gucggcccuccccu

SEQ ID NO: 1548552 - RNA, 14 nt, Pseudomonas aeruginosa PA01
gucggccauggcau

SEQ ID NO: 1548553 - RNA, 19 nt, Pseudomonas aeruginosa PA01
gucggccaucuggcugccg

SEQ ID NO: 1548554 - RNA, 19 nt, Pseudomonas aeruginosa PA01
gucggccaggggagcgccg

SEQ ID NO: 1548555 - RNA, 21 nt, Pseudomonas aeruginosa PA01
gucggcgaaauccucgcgcac

SEQ ID NO: 1548556 - RNA, 16 nt, Pseudomonas aeruginosa PA01
gucggccuggcugccg

SEQ ID NO: 1548557 - RNA, 22 nt, Pseudomonas aeruginosa PA01
gucggccugcucgaacggcgga

SEQ ID NO: 1548558 - RNA, 17 nt, Pseudomonas aeruginosa PA01
gucggccugcuugcagg

SEQ ID NO: 1548559 - RNA, 13 nt, Pseudomonas aeruginosa PA01
gucggccgggguc

SEQ ID NO: 1548560 - RNA, 18 nt, Pseudomonas aeruginosa PA01
gucggccggggucaggcc

SEQ ID NO: 1548561 - RNA, 16 nt, Pseudomonas aeruginosa PA01
gucggccggcagcucc

SEQ ID NO: 1548562 - RNA, 14 nt, Pseudomonas aeruginosa PA01
gucgcgcagcuccu

SEQ ID NO: 1548563 - RNA, 14 nt, Pseudomonas aeruginosa PA01
gucgcgccagcacc

SEQ ID NO: 1548564 - RNA, 14 nt, Pseudomonas aeruginosa PA01
gucgcgcagggcag

SEQ ID NO: 1548565 - RNA, 15 nt, Pseudomonas aeruginosa PA01
gucgcgcagcggcuc

SEQ ID NO: 1548566 - RNA, 17 nt, Pseudomonas aeruginosa PA01
gucgcgccggccauucg

SEQ ID NO: 1548567 - RNA, 19 nt, Pseudomonas aeruginosa PA01
gucgcggucaucgccggcg

SEQ ID NO: 1548568 - RNA, 19 nt, Pseudomonas aeruginosa PA01
gucgcgcggcgccugcugc

SEQ ID NO: 1548569 - RNA, 16 nt, Pseudomonas aeruginosa PA01
gucgcgcucaggcgca

SEQ ID NO: 1548570 - RNA, 17 nt, Pseudomonas aeruginosa PA01
gucgcgcucuuccuuca

SEQ ID NO: 1548571 - RNA, 20 nt, Pseudomonas aeruginosa PA01
gucgcgguugccgaagcgcu

SEQ ID NO: 1548572 - RNA, 13 nt, Pseudomonas aeruginosa PA01
gucgcgguugcug

SEQ ID NO: 1548573 - RNA, 17 nt, Pseudomonas aeruginosa PA01
gucgcguacagcgggcc

SEQ ID NO: 1548574 - RNA, 22 nt, Pseudomonas aeruginosa PA01
gucgcguagaccaucgccggcg

SEQ ID NO: 1548575 - RNA, 21 nt, Pseudomonas aeruginosa PA01
gucgccaggccguagaccacc

SEQ ID NO: 1548576 - RNA, 21 nt, Pseudomonas aeruginosa PA01
gucgccacgcaguucgcgggc

SEQ ID NO: 1548577 - RNA, 20 nt, Pseudomonas aeruginosa PA01
gucgcgcaccacccaucugc

SEQ ID NO: 1548578 - RNA, 17 nt, Pseudomonas aeruginosa PA01
gucgcgcaccuggcggu

SEQ ID NO: 1548579 - RNA, 18 nt, Pseudomonas aeruginosa PA01
gucgccaugcggcaggcc

SEQ ID NO: 1548580 - RNA, 19 nt, Pseudomonas aeruginosa PA01
gucgccccacagcgguggg

SEQ ID NO: 1548581 - RNA, 15 nt, Pseudomonas aeruginosa PA01
gucgccccagggaau

SEQ ID NO: 1548582 - RNA, 13 nt, Pseudomonas aeruginosa PA01
gucgcccagcgcc

SEQ ID NO: 1548583 - RNA, 16 nt, Pseudomonas aeruginosa PA01
gucgcccaggccgcug

SEQ ID NO: 1548584 - RNA, 16 nt, Pseudomonas aeruginosa PA01
gucguagguucgaauc

SEQ ID NO: 1548585 - RNA, 18 nt, Pseudomonas aeruginosa PA01
gucguaguccugggccgg

SEQ ID NO: 1548586 - RNA, 17 nt, Pseudomonas aeruginosa PA01
gucguauaggcgcuggu

SEQ ID NO: 1548587 - RNA, 21 nt, Pseudomonas aeruginosa PA01
gucguauaggcgcuggugcug

SEQ ID NO: 1548588 - RNA, 21 nt, Pseudomonas aeruginosa PA01
gucggucacggaacggguccu

SEQ ID NO: 1548589 - RNA, 14 nt, Pseudomonas aeruginosa PA01
gucgguagaaaucc

SEQ ID NO: 1548590 - RNA, 19 nt, Pseudomonas aeruginosa PA01
gucgguagaaauccuccgg

SEQ ID NO: 1548591 - RNA, 22 nt, Pseudomonas aeruginosa PA01
gucggucuggcggcccugguug

SEQ ID NO: 1548592 - RNA, 15 nt, Pseudomonas aeruginosa PA01
gucggucggccagga

SEQ ID NO: 1548593 - RNA, 14 nt, Pseudomonas aeruginosa PA01
gucggucggcggcg

SEQ ID NO: 1548594 - RNA, 14 nt, Pseudomonas aeruginosa PA01
gucggcggcagcug

SEQ ID NO: 1548595 - RNA, 21 nt, Pseudomonas aeruginosa PA01
gucggcggccgccuugaccug

SEQ ID NO: 1548596 - RNA, 19 nt, Pseudomonas aeruginosa PA01
gucggcgcugucgccguug

SEQ ID NO: 1548597 - RNA, 12 nt, Pseudomonas aeruginosa PA01
gucggcgcugga

SEQ ID NO: 1548598 - RNA, 15 nt, Pseudomonas aeruginosa PA01
gucggcggcgguucg

SEQ ID NO: 1548599 - RNA, 14 nt, Pseudomonas aeruginosa PA01
gucggcgcggcgcu

SEQ ID NO: 1548600 - RNA, 16 nt, Pseudomonas aeruginosa PA01
gucggcgcgcaucugg

SEQ ID NO: 1548601 - RNA, 14 nt, Pseudomonas aeruginosa PA01
gucggcgcccuucg

SEQ ID NO: 1548602 - RNA, 15 nt, Pseudomonas aeruginosa PA01
gucggcgagcaggcg

SEQ ID NO: 1548603 - RNA, 13 nt, Pseudomonas aeruginosa PA01
gucguccagcgcc

SEQ ID NO: 1548604 - RNA, 15 nt, Pseudomonas aeruginosa PA01
gucguccagcggcuc

SEQ ID NO: 1548605 - RNA, 20 nt, Pseudomonas aeruginosa PA01
gucgucgcgguacagccggu

SEQ ID NO: 1548606 - RNA, 16 nt, Pseudomonas aeruginosa PA01
gucgucgggcagagug

SEQ ID NO: 1548607 - RNA, 15 nt, Pseudomonas aeruginosa PA01
gucgucgcagccgaa

SEQ ID NO: 1548608 - RNA, 16 nt, Pseudomonas aeruginosa PA01
gucaauaccacccuug

SEQ ID NO: 1548609 - RNA, 18 nt, Pseudomonas aeruginosa PA01
gucacuguuuuccauggc

SEQ ID NO: 1548610 - RNA, 14 nt, Pseudomonas aeruginosa PA01
gucacuguuuucca

SEQ ID NO: 1548611 - RNA, 16 nt, Pseudomonas aeruginosa PA01
gucaccagcagccccg

SEQ ID NO: 1548612 - RNA, 23 nt, Pseudomonas aeruginosa PA01
gucaccagcgugggcaacaggcc

SEQ ID NO: 1548613 - RNA, 14 nt, Pseudomonas aeruginosa PA01
gucaccacuggaaa

SEQ ID NO: 1548614 - RNA, 14 nt, Pseudomonas aeruginosa PA01
gucaccagguugcc

SEQ ID NO: 1548615 - RNA, 13 nt, Pseudomonas aeruginosa PA01
gucaguuccaggu

SEQ ID NO: 1548616 - RNA, 20 nt, Pseudomonas aeruginosa PA01
gucaggacagcgugcggccc

SEQ ID NO: 1548617 - RNA, 19 nt, Pseudomonas aeruginosa PA01
gucagcuugccgcaggucu

SEQ ID NO: 1548618 - RNA, 16 nt, Pseudomonas aeruginosa PA01
gucagaccagcccugg

SEQ ID NO: 1548619 - RNA, 14 nt, Pseudomonas aeruginosa PA01
gucagaaccaccgg

SEQ ID NO: 1548620 - RNA, 22 nt, Pseudomonas aeruginosa PA01
gucagcggguuggcuuccagcc

SEQ ID NO: 1548621 - RNA, 20 nt, Pseudomonas aeruginosa PA01
gucagcgguaugccgcaggc

SEQ ID NO: 1548622 - RNA, 16 nt, Pseudomonas aeruginosa PA01
gucccugccaggggcu

SEQ ID NO: 1548623 - RNA, 15 nt, Pseudomonas aeruginosa PA01
gucccuggagcaggg

SEQ ID NO: 1548624 - RNA, 16 nt, Pseudomonas aeruginosa PA01
gucccuggagcagggc

SEQ ID NO: 1548625 - RNA, 18 nt, Pseudomonas aeruginosa PA01
gucccugggccugcaggu

SEQ ID NO: 1548626 - RNA, 22 nt, Pseudomonas aeruginosa PA01
gucccugggccugcagguuguc

SEQ ID NO: 1548627 - RNA, 15 nt, Pseudomonas aeruginosa PA01
gucccugggcgcagg

SEQ ID NO: 1548628 - RNA, 17 nt, Pseudomonas aeruginosa PA01
gucccugggcgcagggg

SEQ ID NO: 1548629 - RNA, 16 nt, Pseudomonas aeruginosa PA01
gucccugucccgccgc

SEQ ID NO: 1548630 - RNA, 21 nt, Pseudomonas aeruginosa PA01
gucccugucccgccgcgccgc

SEQ ID NO: 1548631 - RNA, 20 nt, Pseudomonas aeruginosa PA01
gucccuuccccgauccuucg

SEQ ID NO: 1548632 - RNA, 14 nt, Pseudomonas aeruginosa PA01
guccgacagcaggu

SEQ ID NO: 1548633 - RNA, 20 nt, Pseudomonas aeruginosa PA01
gucccuucgugggccugcuc

SEQ ID NO: 1548634 - RNA, 18 nt, Pseudomonas aeruginosa PA01
guccccccuacgaaagcg

SEQ ID NO: 1548635 - RNA, 13 nt, Pseudomonas aeruginosa PA01
guccccggccagc

SEQ ID NO: 1548636 - RNA, 14 nt, Pseudomonas aeruginosa PA01
guccccggccagca

SEQ ID NO: 1548637 - RNA, 20 nt, Pseudomonas aeruginosa PA01
gucccggcuugccggcagcg

SEQ ID NO: 1548638 - RNA, 13 nt, Pseudomonas aeruginosa PA01
guccagcaggccc

SEQ ID NO: 1548639 - RNA, 16 nt, Pseudomonas aeruginosa PA01
guccagcaggcccagc

SEQ ID NO: 1548640 - RNA, 12 nt, Pseudomonas aeruginosa PA01
guccagcaggcg

SEQ ID NO: 1548641 - RNA, 16 nt, Pseudomonas aeruginosa PA01
guccaggcgggccagc

SEQ ID NO: 1548642 - RNA, 13 nt, Pseudomonas aeruginosa PA01
guccagcagguuc

SEQ ID NO: 1548643 - RNA, 17 nt, Pseudomonas aeruginosa PA01
guccagggcgaaccacu

SEQ ID NO: 1548644 - RNA, 18 nt, Pseudomonas aeruginosa PA01
guccaguagcgccugguu

SEQ ID NO: 1548645 - RNA, 18 nt, Pseudomonas aeruginosa PA01
guccaggugcggcugggu

SEQ ID NO: 1548646 - RNA, 14 nt, Pseudomonas aeruginosa PA01
guccaguucagggc

SEQ ID NO: 1548647 - RNA, 19 nt, Pseudomonas aeruginosa PA01
guccaguucuuccaccgug

SEQ ID NO: 1548648 - RNA, 17 nt, Pseudomonas aeruginosa PA01
gucccauugcaucugcg

SEQ ID NO: 1548649 - RNA, 16 nt, Pseudomonas aeruginosa PA01
gucccacaggccggcu

SEQ ID NO: 1548650 - RNA, 23 nt, Pseudomonas aeruginosa PA01
gucaugcgcccuacgccaccuga

SEQ ID NO: 1548651 - RNA, 22 nt, Pseudomonas aeruginosa PA01
gucaugccgccaucgaccagga

SEQ ID NO: 1548652 - RNA, 15 nt, Pseudomonas aeruginosa PA01
gucaugcccuggccg

SEQ ID NO: 1548653 - RNA, 12 nt, Pseudomonas aeruginosa PA01
gucaugcccagg

SEQ ID NO: 1548654 - RNA, 21 nt, Pseudomonas aeruginosa PA01
gucauacaacuguugcucggg

SEQ ID NO: 1548655 - RNA, 22 nt, Pseudomonas aeruginosa PA01
gucauuggcgaaauugccuccg

SEQ ID NO: 1548656 - RNA, 16 nt, Pseudomonas aeruginosa PA01
guccaccuggcggcug

SEQ ID NO: 1548657 - RNA, 14 nt, Pseudomonas aeruginosa PA01
guccaccuccaccu

SEQ ID NO: 1548658 - RNA, 16 nt, Pseudomonas aeruginosa PA01
guccacggagaagcgu

SEQ ID NO: 1548659 - RNA, 20 nt, Pseudomonas aeruginosa PA01
guccacguugcaguccaggc

SEQ ID NO: 1548660 - RNA, 21 nt, Pseudomonas aeruginosa PA01
guccacgucguaggccgagcc

SEQ ID NO: 1548661 - RNA, 17 nt, Pseudomonas aeruginosa PA01
guccacguugagcauca

SEQ ID NO: 1548662 - RNA, 23 nt, Pseudomonas aeruginosa PA01
gugcgacucguugcacgcaggcc

SEQ ID NO: 1548663 - RNA, 14 nt, Pseudomonas aeruginosa PA01
gugcgacgcagcag

SEQ ID NO: 1548664 - RNA, 20 nt, Pseudomonas aeruginosa PA01
gugccuuccgcgcccaggcu

SEQ ID NO: 1548665 - RNA, 16 nt, Pseudomonas aeruginosa PA01
gugccuucguagguga

SEQ ID NO: 1548666 - RNA, 18 nt, Pseudomonas aeruginosa PA01
gugccugcuucaggucgu

SEQ ID NO: 1548667 - RNA, 18 nt, Pseudomonas aeruginosa PA01
gugccugagcuggcuguc

SEQ ID NO: 1548668 - RNA, 19 nt, Pseudomonas aeruginosa PA01
gugccugcaccacgcaggc

SEQ ID NO: 1548669 - RNA, 13 nt, Pseudomonas aeruginosa PA01
gugccguggcucg

SEQ ID NO: 1548670 - RNA, 22 nt, Pseudomonas aeruginosa PA01
gugccguggcucggcggcaggc

SEQ ID NO: 1548671 - RNA, 13 nt, Pseudomonas aeruginosa PA01
gugccguggacca

SEQ ID NO: 1548672 - RNA, 12 nt, Pseudomonas aeruginosa PA01
gugccuccagcc

SEQ ID NO: 1548673 - RNA, 18 nt, Pseudomonas aeruginosa PA01
gugccuccagccucagcc

SEQ ID NO: 1548674 - RNA, 19 nt, Pseudomonas aeruginosa PA01
gugccuccagccucagcca

SEQ ID NO: 1548675 - RNA, 14 nt, Pseudomonas aeruginosa PA01
gugccgcggugcgg

SEQ ID NO: 1548676 - RNA, 15 nt, Pseudomonas aeruginosa PA01
gugccgcggugcggg

SEQ ID NO: 1548677 - RNA, 15 nt, Pseudomonas aeruginosa PA01
gugccgcgcagguuc

SEQ ID NO: 1548678 - RNA, 22 nt, Pseudomonas aeruginosa PA01
gugccgccaucgccucgccggc

SEQ ID NO: 1548679 - RNA, 13 nt, Pseudomonas aeruginosa PA01
gugccgccaggcc

SEQ ID NO: 1548680 - RNA, 14 nt, Pseudomonas aeruginosa PA01
gugccgccaggccu

SEQ ID NO: 1548681 - RNA, 18 nt, Pseudomonas aeruginosa PA01
gugccgccagucggccug

SEQ ID NO: 1548682 - RNA, 22 nt, Pseudomonas aeruginosa PA01
gugccgccggccaccagcagca

SEQ ID NO: 1548683 - RNA, 13 nt, Pseudomonas aeruginosa PA01
gugccgcccuggg

SEQ ID NO: 1548684 - RNA, 16 nt, Pseudomonas aeruginosa PA01
gugccgcccggcgcca

SEQ ID NO: 1548685 - RNA, 13 nt, Pseudomonas aeruginosa PA01
gugccgggccagc

SEQ ID NO: 1548686 - RNA, 14 nt, Pseudomonas aeruginosa PA01
gugccggcggcgga

SEQ ID NO: 1548687 - RNA, 19 nt, Pseudomonas aeruginosa PA01
gugccgggaagcgcaggcc

SEQ ID NO: 1548688 - RNA, 21 nt, Pseudomonas aeruginosa PA01
gugccgggaagcgcaggccgc

SEQ ID NO: 1548689 - RNA, 16 nt, Pseudomonas aeruginosa PA01
gugccgggccggccag

SEQ ID NO: 1548690 - RNA, 18 nt, Pseudomonas aeruginosa PA01
gugccgggccggccaggg

SEQ ID NO: 1548691 - RNA, 22 nt, Pseudomonas aeruginosa PA01
gugccggccaugcaggccaggg

SEQ ID NO: 1548692 - RNA, 21 nt, Pseudomonas aeruginosa PA01
gugccggagaacgccgccacg

SEQ ID NO: 1548693 - RNA, 17 nt, Pseudomonas aeruginosa PA01
gugccagggcggucggc

SEQ ID NO: 1548694 - RNA, 21 nt, Pseudomonas aeruginosa PA01
gugccaggcucgccgccagca

SEQ ID NO: 1548695 - RNA, 15 nt, Pseudomonas aeruginosa PA01
gugccaggcgcucgc

SEQ ID NO: 1548696 - RNA, 15 nt, Pseudomonas aeruginosa PA01
gugccaggcggcagc

SEQ ID NO: 1548697 - RNA, 22 nt, Pseudomonas aeruginosa PA01
gugccauacucggacggcucgc

SEQ ID NO: 1548698 - RNA, 20 nt, Pseudomonas aeruginosa PA01
gugccgaagaccaccauggu

SEQ ID NO: 1548699 - RNA, 21 nt, Pseudomonas aeruginosa PA01
gugccgaagaccaccaugguc

SEQ ID NO: 1548700 - RNA, 13 nt, Pseudomonas aeruginosa PA01
gugcccggcggga

SEQ ID NO: 1548701 - RNA, 12 nt, Pseudomonas aeruginosa PA01
gugccgcagaca

SEQ ID NO: 1548702 - RNA, 13 nt, Pseudomonas aeruginosa PA01
gugccgaggccgc

SEQ ID NO: 1548703 - RNA, 17 nt, Pseudomonas aeruginosa PA01
gugccaucaggccgcgg

SEQ ID NO: 1548704 - RNA, 18 nt, Pseudomonas aeruginosa PA01
gugcccagcaggcugcug

SEQ ID NO: 1548705 - RNA, 14 nt, Pseudomonas aeruginosa PA01
gugcccagcggcgc

SEQ ID NO: 1548706 - RNA, 16 nt, Pseudomonas aeruginosa PA01
gugcccaggcgcuggc

SEQ ID NO: 1548707 - RNA, 22 nt, Pseudomonas aeruginosa PA01
gugccccgacugucgugccucc

SEQ ID NO: 1548708 - RNA, 23 nt, Pseudomonas aeruginosa PA01
gugccccgacugucgugccucca

SEQ ID NO: 1548709 - RNA, 11 nt, Pseudomonas aeruginosa PA01
gugcccggcag

SEQ ID NO: 1548710 - RNA, 16 nt, Pseudomonas aeruginosa PA01
gugcccgagcgacugg

SEQ ID NO: 1548711 - RNA, 14 nt, Pseudomonas aeruginosa PA01
gugccccgcuggcc

SEQ ID NO: 1548712 - RNA, 22 nt, Pseudomonas aeruginosa PA01
gugccccguggcgggccagcag

SEQ ID NO: 1548713 - RNA, 18 nt, Pseudomonas aeruginosa PA01
gugcaucggccgccaggc

SEQ ID NO: 1548714 - RNA, 13 nt, Pseudomonas aeruginosa PA01
gugcauccgccgc

SEQ ID NO: 1548715 - RNA, 20 nt, Pseudomonas aeruginosa PA01
gugcaucaccggcagcagcg

SEQ ID NO: 1548716 - RNA, 16 nt, Pseudomonas aeruginosa PA01
gugcagguucaccgcc

SEQ ID NO: 1548717 - RNA, 22 nt, Pseudomonas aeruginosa PA01
gugcaguucgccguucagcucc

SEQ ID NO: 1548718 - RNA, 19 nt, Pseudomonas aeruginosa PA01
gugcaccgaggcgcgccga

SEQ ID NO: 1548719 - RNA, 15 nt, Pseudomonas aeruginosa PA01
gugcaccgcgcugga

SEQ ID NO: 1548720 - RNA, 18 nt, Pseudomonas aeruginosa PA01
gugcaccgcgcuggagac

SEQ ID NO: 1548721 - RNA, 13 nt, Pseudomonas aeruginosa PA01
gugcagcagcacg

SEQ ID NO: 1548722 - RNA, 22 nt, Pseudomonas aeruginosa PA01
gugaugccgauggacaggcugg

SEQ ID NO: 1548723 - RNA, 17 nt, Pseudomonas aeruginosa PA01
gugaugucgcggcaggc

SEQ ID NO: 1548724 - RNA, 15 nt, Pseudomonas aeruginosa PA01
gugauguaggccgcu

SEQ ID NO: 1548725 - RNA, 16 nt, Pseudomonas aeruginosa PA01
gucuagcgcaggcgga

SEQ ID NO: 1548726 - RNA, 22 nt, Pseudomonas aeruginosa PA01
gugcggccgaucaucggcuggu

SEQ ID NO: 1548727 - RNA, 17 nt, Pseudomonas aeruginosa PA01
gugcggccguucaggga

SEQ ID NO: 1548728 - RNA, 20 nt, Pseudomonas aeruginosa PA01
gugcggcgaugucggccugc

SEQ ID NO: 1548729 - RNA, 20 nt, Pseudomonas aeruginosa PA01
gugcgcuggaacggccaggu

SEQ ID NO: 1548730 - RNA, 17 nt, Pseudomonas aeruginosa PA01
gugcgcugguaccugcc

SEQ ID NO: 1548731 - RNA, 18 nt, Pseudomonas aeruginosa PA01
gugcggaaaccgcggccg

SEQ ID NO: 1548732 - RNA, 15 nt, Pseudomonas aeruginosa PA01
gugcggcagcaggcu

SEQ ID NO: 1548733 - RNA, 18 nt, Pseudomonas aeruginosa PA01
gugcggcacgcugcuugc

SEQ ID NO: 1548734 - RNA, 13 nt, Pseudomonas aeruginosa PA01
gugcggccaggcg

SEQ ID NO: 1548735 - RNA, 13 nt, Pseudomonas aeruginosa PA01
gugcggugccgcg

SEQ ID NO: 1548736 - RNA, 13 nt, Pseudomonas aeruginosa PA01
gugcggcauuccg

SEQ ID NO: 1548737 - RNA, 20 nt, Pseudomonas aeruginosa PA01
gugcggggaaagcuccucgg

SEQ ID NO: 1548738 - RNA, 14 nt, Pseudomonas aeruginosa PA01
gugcgggcaguccu

SEQ ID NO: 1548739 - RNA, 13 nt, Pseudomonas aeruginosa PA01
gugcguccaucca

SEQ ID NO: 1548740 - RNA, 17 nt, Pseudomonas aeruginosa PA01
gugcgcuccgccaggcc

SEQ ID NO: 1548741 - RNA, 20 nt, Pseudomonas aeruginosa PA01
gugcgcuccgccaggccgcg

SEQ ID NO: 1548742 - RNA, 14 nt, Pseudomonas aeruginosa PA01
gugcgcgcccucgg

SEQ ID NO: 1548743 - RNA, 14 nt, Pseudomonas aeruginosa PA01
gugcgcgcggccug

SEQ ID NO: 1548744 - RNA, 20 nt, Pseudomonas aeruginosa PA01
gugcgccgguugcugcuugc

SEQ ID NO: 1548745 - RNA, 17 nt, Pseudomonas aeruginosa PA01
gugcgcaggcugccuuc

SEQ ID NO: 1548746 - RNA, 16 nt, Pseudomonas aeruginosa PA01
gugcgcaccucgcccu

SEQ ID NO: 1548747 - RNA, 14 nt, Pseudomonas aeruginosa PA01
gugcgccaggccgg

SEQ ID NO: 1548748 - RNA, 18 nt, Pseudomonas aeruginosa PA01
gugcgccaggccggugca

SEQ ID NO: 1548749 - RNA, 15 nt, Pseudomonas aeruginosa PA01
gugcgcccagcagca

SEQ ID NO: 1548750 - RNA, 18 nt, Pseudomonas aeruginosa PA01
gugcgagggcggcggcuc

SEQ ID NO: 1548751 - RNA, 18 nt, Pseudomonas aeruginosa PA01
gugcuugucacgcucggc

SEQ ID NO: 1548752 - RNA, 13 nt, Pseudomonas aeruginosa PA01
gugcuucacgaau

SEQ ID NO: 1548753 - RNA, 15 nt, Pseudomonas aeruginosa PA01
gugcugcaccagcag

SEQ ID NO: 1548754 - RNA, 17 nt, Pseudomonas aeruginosa PA01
gugcugcaccagcaggu

SEQ ID NO: 1548755 - RNA, 15 nt, Pseudomonas aeruginosa PA01
gugcugcgcgcggcc

SEQ ID NO: 1548756 - RNA, 14 nt, Pseudomonas aeruginosa PA01
gugcucgaggaagc

SEQ ID NO: 1548757 - RNA, 20 nt, Pseudomonas aeruginosa PA01
gugcuccuugacccucuggu

SEQ ID NO: 1548758 - RNA, 22 nt, Pseudomonas aeruginosa PA01
gugcuccuugacccucugguug

SEQ ID NO: 1548759 - RNA, 14 nt, Pseudomonas aeruginosa PA01
gugcucaggcggcc

SEQ ID NO: 1548760 - RNA, 18 nt, Pseudomonas aeruginosa PA01
gugcguguucggcggcuc

SEQ ID NO: 1548761 - RNA, 19 nt, Pseudomonas aeruginosa PA01
gugguggcggggaacagca

SEQ ID NO: 1548762 - RNA, 17 nt, Pseudomonas aeruginosa PA01
gugguggaaguggacgg

SEQ ID NO: 1548763 - RNA, 16 nt, Pseudomonas aeruginosa PA01
guguaauugacgauga

SEQ ID NO: 1548764 - RNA, 13 nt, Pseudomonas aeruginosa PA01
guguccgauucuu

SEQ ID NO: 1548765 - RNA, 16 nt, Pseudomonas aeruginosa PA01
gugguaccgcugcgug

SEQ ID NO: 1548766 - RNA, 13 nt, Pseudomonas aeruginosa PA01
guggucaggcgcc

SEQ ID NO: 1548767 - RNA, 18 nt, Pseudomonas aeruginosa PA01
guggucaggcgccaggac

SEQ ID NO: 1548768 - RNA, 17 nt, Pseudomonas aeruginosa PA01
gugguccgccagcaggc

SEQ ID NO: 1548769 - RNA, 18 nt, Pseudomonas aeruginosa PA01
gugguccgccagcaggcg

SEQ ID NO: 1548770 - RNA, 15 nt, Pseudomonas aeruginosa PA01
guggucuucagcaca

SEQ ID NO: 1548771 - RNA, 17 nt, Pseudomonas aeruginosa PA01
guggugaucagcggccg

SEQ ID NO: 1548772 - RNA, 18 nt, Pseudomonas aeruginosa PA01
guggucgaugcccaccug

SEQ ID NO: 1548773 - RNA, 15 nt, Pseudomonas aeruginosa PA01
guggucgcgcaggcg

SEQ ID NO: 1548774 - RNA, 13 nt, Pseudomonas aeruginosa PA01
gugggcggcggcu

SEQ ID NO: 1548775 - RNA, 14 nt, Pseudomonas aeruginosa PA01
gugggcggcggcua

SEQ ID NO: 1548776 - RNA, 24 nt, Pseudomonas aeruginosa PA01
gugggcgucgcuauggugagguug

SEQ ID NO: 1548777 - RNA, 21 nt, Pseudomonas aeruginosa PA01
gugggaaacggugcuagcggg

SEQ ID NO: 1548778 - RNA, 17 nt, Pseudomonas aeruginosa PA01
guggcugugcuggccac

SEQ ID NO: 1548779 - RNA, 20 nt, Pseudomonas aeruginosa PA01
guggcuggugaugccgcgga

SEQ ID NO: 1548780 - RNA, 16 nt, Pseudomonas aeruginosa PA01
guggcucggcggcagg

SEQ ID NO: 1548781 - RNA, 23 nt, Pseudomonas aeruginosa PA01
guggcggcgcgcgucguccaggg

SEQ ID NO: 1548782 - RNA, 21 nt, Pseudomonas aeruginosa PA01
guggcuggcgccgcgggucug

SEQ ID NO: 1548783 - RNA, 18 nt, Pseudomonas aeruginosa PA01
guggccgucgcgccgcgg

SEQ ID NO: 1548784 - RNA, 22 nt, Pseudomonas aeruginosa PA01
guggccggugugcgacuggggc

SEQ ID NO: 1548785 - RNA, 21 nt, Pseudomonas aeruginosa PA01
guggcgccccaggcgggcacg

SEQ ID NO: 1548786 - RNA, 18 nt, Pseudomonas aeruginosa PA01
guggcgcuugagcagcca

SEQ ID NO: 1548787 - RNA, 19 nt, Pseudomonas aeruginosa PA01
guggcgcuugagcagccag

SEQ ID NO: 1548788 - RNA, 21 nt, Pseudomonas aeruginosa PA01
guggcgcugucgccggucagg

SEQ ID NO: 1548789 - RNA, 23 nt, Pseudomonas aeruginosa PA01
guggaccaacgggcugccagcau

SEQ ID NO: 1548790 - RNA, 19 nt, Pseudomonas aeruginosa PA01
guggacugguugaccugca

SEQ ID NO: 1548791 - RNA, 22 nt, Pseudomonas aeruginosa PA01
guuacgcgcagcgguaguucag

SEQ ID NO: 1548792 - RNA, 14 nt, Pseudomonas aeruginosa PA01
guuaccaggucugu

SEQ ID NO: 1548793 - RNA, 18 nt, Pseudomonas aeruginosa PA01
guguuuccucagcucugu

SEQ ID NO: 1548794 - RNA, 15 nt, Pseudomonas aeruginosa PA01
guguccgcggugccg

SEQ ID NO: 1548795 - RNA, 20 nt, Pseudomonas aeruginosa PA01
gugucgagggcugggcagcg

SEQ ID NO: 1548796 - RNA, 16 nt, Pseudomonas aeruginosa PA01
guguuguucgccagca

SEQ ID NO: 1548797 - RNA, 19 nt, Pseudomonas aeruginosa PA01
guguuggucaggcccugcu

SEQ ID NO: 1548798 - RNA, 15 nt, Pseudomonas aeruginosa PA01
guguugucgcggcug

SEQ ID NO: 1548799 - RNA, 14 nt, Pseudomonas aeruginosa PA01
guucggaucggccc

SEQ ID NO: 1548800 - RNA, 17 nt, Pseudomonas aeruginosa PA01
guucggaccugucccga

SEQ ID NO: 1548801 - RNA, 15 nt, Pseudomonas aeruginosa PA01
guucggccagcggca

SEQ ID NO: 1548802 - RNA, 19 nt, Pseudomonas aeruginosa PA01
guucgcugaggacugccag

SEQ ID NO: 1548803 - RNA, 22 nt, Pseudomonas aeruginosa PA01
guucgcuggacaggcgcagggg

SEQ ID NO: 1548804 - RNA, 13 nt, Pseudomonas aeruginosa PA01
guucgcuguucuu

SEQ ID NO: 1548805 - RNA, 15 nt, Pseudomonas aeruginosa PA01
guucggccagggagu

SEQ ID NO: 1548806 - RNA, 23 nt, Pseudomonas aeruginosa PA01
guucggccagggagucgcuggcc

SEQ ID NO: 1548807 - RNA, 15 nt, Pseudomonas aeruginosa PA01
guucggugccgccgg

SEQ ID NO: 1548808 - RNA, 18 nt, Pseudomonas aeruginosa PA01
guucgguguaguucaccg

SEQ ID NO: 1548809 - RNA, 18 nt, Pseudomonas aeruginosa PA01
guuccucgccgcugcugg

SEQ ID NO: 1548810 - RNA, 19 nt, Pseudomonas aeruginosa PA01
guuccucgccgcugcuggc

SEQ ID NO: 1548811 - RNA, 13 nt, Pseudomonas aeruginosa PA01
guuccucuaaugg

SEQ ID NO: 1548812 - RNA, 16 nt, Pseudomonas aeruginosa PA01
guucccggaucagcuc

SEQ ID NO: 1548813 - RNA, 15 nt, Pseudomonas aeruginosa PA01
guucccgcauggcuc

SEQ ID NO: 1548814 - RNA, 20 nt, Pseudomonas aeruginosa PA01
guucccgccgcucugcuggc

SEQ ID NO: 1548815 - RNA, 22 nt, Pseudomonas aeruginosa PA01
guucccgccgcucugcuggccg

SEQ ID NO: 1548816 - RNA, 15 nt, Pseudomonas aeruginosa PA01
guuccggcaggaccu

SEQ ID NO: 1548817 - RNA, 21 nt, Pseudomonas aeruginosa PA01
guuccggcucagccgcuggcg

SEQ ID NO: 1548818 - RNA, 13 nt, Pseudomonas aeruginosa PA01
guucccagcagcg

SEQ ID NO: 1548819 - RNA, 16 nt, Pseudomonas aeruginosa PA01
guucccagcagcgccu

SEQ ID NO: 1548820 - RNA, 19 nt, Pseudomonas aeruginosa PA01
guucccagcagcgccucgg

SEQ ID NO: 1548821 - RNA, 18 nt, Pseudomonas aeruginosa PA01
guuccaggagggcugcug

SEQ ID NO: 1548822 - RNA, 22 nt, Pseudomonas aeruginosa PA01
guuccaggagggcugcugucca

SEQ ID NO: 1548823 - RNA, 23 nt, Pseudomonas aeruginosa PA01
guuccaggagggcugcuguccag

SEQ ID NO: 1548824 - RNA, 19 nt, Pseudomonas aeruginosa PA01
guuccaggcguccgcuggc

SEQ ID NO: 1548825 - RNA, 19 nt, Pseudomonas aeruginosa PA01
guuccaggcgugcugcacg

SEQ ID NO: 1548826 - RNA, 14 nt, Pseudomonas aeruginosa PA01
guuccagggucagc

SEQ ID NO: 1548827 - RNA, 18 nt, Pseudomonas aeruginosa PA01
guuccagggucagcuggc

SEQ ID NO: 1548828 - RNA, 19 nt, Pseudomonas aeruginosa PA01
guuccagggucagcuggcg

SEQ ID NO: 1548829 - RNA, 22 nt, Pseudomonas aeruginosa PA01
guuccagggucagcuggcgcgc

SEQ ID NO: 1548830 - RNA, 16 nt, Pseudomonas aeruginosa PA01
guuccaggucgcugcu

SEQ ID NO: 1548831 - RNA, 16 nt, Pseudomonas aeruginosa PA01
guuccagccccgccgg

SEQ ID NO: 1548832 - RNA, 19 nt, Pseudomonas aeruginosa PA01
guucagcaggucgcggccc

SEQ ID NO: 1548833 - RNA, 14 nt, Pseudomonas aeruginosa PA01
guucaggugcugga

SEQ ID NO: 1548834 - RNA, 17 nt, Pseudomonas aeruginosa PA01
guucagucggccaggcg

SEQ ID NO: 1548835 - RNA, 18 nt, Pseudomonas aeruginosa PA01
guucagucgguuagaaua

SEQ ID NO: 1548836 - RNA, 14 nt, Pseudomonas aeruginosa PA01
guucaguucugggc

SEQ ID NO: 1548837 - RNA, 17 nt, Pseudomonas aeruginosa PA01
guucacuccacgaggau

SEQ ID NO: 1548838 - RNA, 17 nt, Pseudomonas aeruginosa PA01
guucacauuggcuuccg

SEQ ID NO: 1548839 - RNA, 19 nt, Pseudomonas aeruginosa PA01
guucugccgcagacgcccu

SEQ ID NO: 1548840 - RNA, 23 nt, Pseudomonas aeruginosa PA01
guucugcgacaucuccaggccgc

SEQ ID NO: 1548841 - RNA, 14 nt, Pseudomonas aeruginosa PA01
guucgugccaggcg

SEQ ID NO: 1548842 - RNA, 16 nt, Pseudomonas aeruginosa PA01
guucgugccaggcgac

SEQ ID NO: 1548843 - RNA, 16 nt, Pseudomonas aeruginosa PA01
guucguugggccggaa

SEQ ID NO: 1548844 - RNA, 14 nt, Pseudomonas aeruginosa PA01
guucugccagagcg

SEQ ID NO: 1548845 - RNA, 22 nt, Pseudomonas aeruginosa PA01
guucugccagagcgcugccugc

SEQ ID NO: 1548846 - RNA, 16 nt, Pseudomonas aeruginosa PA01
guucucuuugaccuug

SEQ ID NO: 1548847 - RNA, 19 nt, Pseudomonas aeruginosa PA01
guugaaagccuuuauccac

SEQ ID NO: 1548848 - RNA, 16 nt, Pseudomonas aeruginosa PA01
guucuugauccgcucc

SEQ ID NO: 1548849 - RNA, 21 nt, Pseudomonas aeruginosa PA01
guucuugaagaagcugccggc

SEQ ID NO: 1548850 - RNA, 14 nt, Pseudomonas aeruginosa PA01
guucuugcccagca

SEQ ID NO: 1548851 - RNA, 19 nt, Pseudomonas aeruginosa PA01
guucuuguugagcuggccg

SEQ ID NO: 1548852 - RNA, 14 nt, Pseudomonas aeruginosa PA01
guucuucagcacuu

SEQ ID NO: 1548853 - RNA, 18 nt, Pseudomonas aeruginosa PA01
guugaucgacgccagcuc

SEQ ID NO: 1548854 - RNA, 17 nt, Pseudomonas aeruginosa PA01
guugaugguuucuuccc

SEQ ID NO: 1548855 - RNA, 13 nt, Pseudomonas aeruginosa PA01
guugaagagcagc

SEQ ID NO: 1548856 - RNA, 14 nt, Pseudomonas aeruginosa PA01
guugaccccgcggg

SEQ ID NO: 1548857 - RNA, 13 nt, Pseudomonas aeruginosa PA01
guugaccagcaug

SEQ ID NO: 1548858 - RNA, 21 nt, Pseudomonas aeruginosa PA01
guugaccagcauguuguuaug

SEQ ID NO: 1548859 - RNA, 15 nt, Pseudomonas aeruginosa PA01
guugacgcuggcuga

SEQ ID NO: 1548860 - RNA, 19 nt, Pseudomonas aeruginosa PA01
guugacgccaguuucuauc

SEQ ID NO: 1548861 - RNA, 22 nt, Pseudomonas aeruginosa PA01
guugacgccaguuucuaucucc

SEQ ID NO: 1548862 - RNA, 17 nt, Pseudomonas aeruginosa PA01
guugagauccuggccgg

SEQ ID NO: 1548863 - RNA, 13 nt, Pseudomonas aeruginosa PA01
guuguggcggcgc

SEQ ID NO: 1548864 - RNA, 16 nt, Pseudomonas aeruginosa PA01
guuguggcggcgcuca

SEQ ID NO: 1548865 - RNA, 15 nt, Pseudomonas aeruginosa PA01
guuguucgccagcag

SEQ ID NO: 1548866 - RNA, 19 nt, Pseudomonas aeruginosa PA01
guuuaccaggaccagcgcc

SEQ ID NO: 1548867 - RNA, 16 nt, Pseudomonas aeruginosa PA01
guugcccagcaggcuc

SEQ ID NO: 1548868 - RNA, 13 nt, Pseudomonas aeruginosa PA01
guugccauccagc

SEQ ID NO: 1548869 - RNA, 13 nt, Pseudomonas aeruginosa PA01
guugcccaccagc

SEQ ID NO: 1548870 - RNA, 15 nt, Pseudomonas aeruginosa PA01
guuggacgcggccug

SEQ ID NO: 1548871 - RNA, 18 nt, Pseudomonas aeruginosa PA01
guugccgccgcuggccug

SEQ ID NO: 1548872 - RNA, 22 nt, Pseudomonas aeruginosa PA01
guugccgaucaucuucuggaca

SEQ ID NO: 1548873 - RNA, 15 nt, Pseudomonas aeruginosa PA01
guugccgcagcagcg

SEQ ID NO: 1548874 - RNA, 14 nt, Pseudomonas aeruginosa PA01
guuggcuuccagcc

SEQ ID NO: 1548875 - RNA, 15 nt, Pseudomonas aeruginosa PA01
guuggcuggcggggu

SEQ ID NO: 1548876 - RNA, 21 nt, Pseudomonas aeruginosa PA01
guuggggcugcccaccaccag

SEQ ID NO: 1548877 - RNA, 14 nt, Pseudomonas aeruginosa PA01
guuguagaccaucu

SEQ ID NO: 1548878 - RNA, 18 nt, Pseudomonas aeruginosa PA01
guuguagaucggcagcau

SEQ ID NO: 1548879 - RNA, 18 nt, Pseudomonas aeruginosa PA01
guuguagaugaucuccag

SEQ ID NO: 1548880 - RNA, 17 nt, Pseudomonas aeruginosa PA01
guuguaggccaugauca

SEQ ID NO: 1548881 - RNA, 23 nt, Pseudomonas aeruginosa PA01
guuugccaaaaacgcucggugaa

SEQ ID NO: 1548882 - RNA, 16 nt, Pseudomonas aeruginosa PA01
guuuucauuuuccauu

SEQ ID NO: 1548883 - RNA, 18 nt, Pseudomonas aeruginosa PA01
guuuuccugccccgugca

SEQ ID NO: 1548884 - RNA, 22 nt, Pseudomonas aeruginosa PA01
uaaaacggcaggcaaaaaaaag

SEQ ID NO: 1548885 - RNA, 17 nt, Pseudomonas aeruginosa PA01
uaaagaaaaggccgcgu

SEQ ID NO: 1548886 - RNA, 22 nt, Pseudomonas aeruginosa PA01
uaaccgcuugcgguuauccgcc

SEQ ID NO: 1548887 - RNA, 22 nt, Pseudomonas aeruginosa PA01
uaaccgcucgcgguuauccgcc

SEQ ID NO: 1548888 - RNA, 22 nt, Pseudomonas aeruginosa PA01
uaggcgcgcaacgcuuccagca

SEQ ID NO: 1548889 - RNA, 18 nt, Pseudomonas aeruginosa PA01
uaggcgcgccaaggccgc

SEQ ID NO: 1548890 - RNA, 15 nt, Pseudomonas aeruginosa PA01
uaggcgaagcggcuc

SEQ ID NO: 1548891 - RNA, 16 nt, Pseudomonas aeruginosa PA01
uaggcgagcagcggca

SEQ ID NO: 1548892 - RNA, 22 nt, Pseudomonas aeruginosa PA01
uaggccaugaucaucgccugcu

SEQ ID NO: 1548893 - RNA, 23 nt, Pseudomonas aeruginosa PA01
uaggccaugaucaucgccugcug

SEQ ID NO: 1548894 - RNA, 23 nt, Pseudomonas aeruginosa PA01
uaggccaggcagaccagcgcaag

SEQ ID NO: 1548895 - RNA, 14 nt, Pseudomonas aeruginosa PA01
uaggccagccccag

SEQ ID NO: 1548896 - RNA, 18 nt, Pseudomonas aeruginosa PA01
uaggcucugcuccagcaa

SEQ ID NO: 1548897 - RNA, 15 nt, Pseudomonas aeruginosa PA01
uaggcuggaagccgc

SEQ ID NO: 1548898 - RNA, 15 nt, Pseudomonas aeruginosa PA01
uagggacggugcagg

SEQ ID NO: 1548899 - RNA, 18 nt, Pseudomonas aeruginosa PA01
uagggcgaauagcgccgc

SEQ ID NO: 1548900 - RNA, 14 nt, Pseudomonas aeruginosa PA01
uaguagcauucuug

SEQ ID NO: 1548901 - RNA, 15 nt, Pseudomonas aeruginosa PA01
uaggucaugcccagg

SEQ ID NO: 1548902 - RNA, 15 nt, Pseudomonas aeruginosa PA01
uagggguggccaggc

SEQ ID NO: 1548903 - RNA, 13 nt, Pseudomonas aeruginosa PA01
uaguguugaagcc

SEQ ID NO: 1548904 - RNA, 22 nt, Pseudomonas aeruginosa PA01
uaguccagcgguaccagcagcg

SEQ ID NO: 1548905 - RNA, 19 nt, Pseudomonas aeruginosa PA01
uagucccagaccacccggc

SEQ ID NO: 1548906 - RNA, 22 nt, Pseudomonas aeruginosa PA01
uauagaccagcaccgccugcaa

SEQ ID NO: 1548907 - RNA, 14 nt, Pseudomonas aeruginosa PA01
uagcggcaggagca

SEQ ID NO: 1548908 - RNA, 19 nt, Pseudomonas aeruginosa PA01
uagcggucgugcagcagcg

SEQ ID NO: 1548909 - RNA, 22 nt, Pseudomonas aeruginosa PA01
uagcgccgguaguucgcugacc

SEQ ID NO: 1548910 - RNA, 16 nt, Pseudomonas aeruginosa PA01
uagcgcggcagcgcca

SEQ ID NO: 1548911 - RNA, 16 nt, Pseudomonas aeruginosa PA01
uagcgcugcgccaggc

SEQ ID NO: 1548912 - RNA, 17 nt, Pseudomonas aeruginosa PA01
uagcgcuucgcgcagcu

SEQ ID NO: 1548913 - RNA, 23 nt, Pseudomonas aeruginosa PA01
uagcgcuucgcgcagcucggcca

SEQ ID NO: 1548914 - RNA, 19 nt, Pseudomonas aeruginosa PA01
uagcgauaggccuugccuu

SEQ ID NO: 1548915 - RNA, 19 nt, Pseudomonas aeruginosa PA01
uagcgaugcgguuccuggc

SEQ ID NO: 1548916 - RNA, 15 nt, Pseudomonas aeruginosa PA01
uagcgauugaacucg

SEQ ID NO: 1548917 - RNA, 21 nt, Pseudomonas aeruginosa PA01
uagcgccccggccgcgccagc

SEQ ID NO: 1548918 - RNA, 18 nt, Pseudomonas aeruginosa PA01
uagcgccccuuggccagc

SEQ ID NO: 1548919 - RNA, 16 nt, Pseudomonas aeruginosa PA01
uagcgcagcggcaggc

SEQ ID NO: 1548920 - RNA, 19 nt, Pseudomonas aeruginosa PA01
uagcgcagguugcgcuggc

SEQ ID NO: 1548921 - RNA, 22 nt, Pseudomonas aeruginosa PA01
uagcgcaguccgguagcgcgcc

SEQ ID NO: 1548922 - RNA, 22 nt, Pseudomonas aeruginosa PA01
uagcgcaguucgccgccgagcg

SEQ ID NO: 1548923 - RNA, 23 nt, Pseudomonas aeruginosa PA01
uagccugcggccagcgccaggag

SEQ ID NO: 1548924 - RNA, 15 nt, Pseudomonas aeruginosa PA01
uagcccaggccgaag

SEQ ID NO: 1548925 - RNA, 15 nt, Pseudomonas aeruginosa PA01
uagccaggggucagg

SEQ ID NO: 1548926 - RNA, 16 nt, Pseudomonas aeruginosa PA01
uagccaggggucaggc

SEQ ID NO: 1548927 - RNA, 14 nt, Pseudomonas aeruginosa PA01
uagccgugcagcag

SEQ ID NO: 1548928 - RNA, 19 nt, Pseudomonas aeruginosa PA01
uagccgucgaacagcagcu

SEQ ID NO: 1548929 - RNA, 16 nt, Pseudomonas aeruginosa PA01
uagccguugaggccgu

SEQ ID NO: 1548930 - RNA, 22 nt, Pseudomonas aeruginosa PA01
uagccggcgaaccaggcggccg

SEQ ID NO: 1548931 - RNA, 21 nt, Pseudomonas aeruginosa PA01
uagccggcgaucauccagccc

SEQ ID NO: 1548932 - RNA, 19 nt, Pseudomonas aeruginosa PA01
uagccggcgauccgcugca

SEQ ID NO: 1548933 - RNA, 22 nt, Pseudomonas aeruginosa PA01
uagccggcgcggcgcagcggcg

SEQ ID NO: 1548934 - RNA, 19 nt, Pseudomonas aeruginosa PA01
uagccguagauggucagca

SEQ ID NO: 1548935 - RNA, 21 nt, Pseudomonas aeruginosa PA01
uagccgccuuguuccaggcgu

SEQ ID NO: 1548936 - RNA, 15 nt, Pseudomonas aeruginosa PA01
uagccgcgcgccagc

SEQ ID NO: 1548937 - RNA, 13 nt, Pseudomonas aeruginosa PA01
uagcccugcugcu

SEQ ID NO: 1548938 - RNA, 19 nt, Pseudomonas aeruginosa PA01
uagcccggguugcccucgc

SEQ ID NO: 1548939 - RNA, 16 nt, Pseudomonas aeruginosa PA01
uagcccuucuccgcca

SEQ ID NO: 1548940 - RNA, 22 nt, Pseudomonas aeruginosa PA01
uagcucagcuggauagaguacu

SEQ ID NO: 1548941 - RNA, 21 nt, Pseudomonas aeruginosa PA01
uagcuaccgucggccugcaac

SEQ ID NO: 1548942 - RNA, 21 nt, Pseudomonas aeruginosa PA01
uagcucagucgguagagcagu

SEQ ID NO: 1548943 - RNA, 14 nt, Pseudomonas aeruginosa PA01
uagcugccggcguc

SEQ ID NO: 1548944 - RNA, 15 nt, Pseudomonas aeruginosa PA01
uagcugcgcagggcg

SEQ ID NO: 1548945 - RNA, 22 nt, Pseudomonas aeruginosa PA01
uagcugaagcugucgcccucgc

SEQ ID NO: 1548946 - RNA, 12 nt, Pseudomonas aeruginosa PA01
uagcuuuccagg

SEQ ID NO: 1548947 - RNA, 18 nt, Pseudomonas aeruginosa PA01
uaggaacgugcggccugc

SEQ ID NO: 1548948 - RNA, 19 nt, Pseudomonas aeruginosa PA01
uaggagccugcgugagcug

SEQ ID NO: 1548949 - RNA, 20 nt, Pseudomonas aeruginosa PA01
uaggaugccgagguguagaa

SEQ ID NO: 1548950 - RNA, 16 nt, Pseudomonas aeruginosa PA01
uagcaggucacgcccu

SEQ ID NO: 1548951 - RNA, 20 nt, Pseudomonas aeruginosa PA01
uagcagccgcaggaugccgc

SEQ ID NO: 1548952 - RNA, 16 nt, Pseudomonas aeruginosa PA01
uagcagccauagcaau

SEQ ID NO: 1548953 - RNA, 19 nt, Pseudomonas aeruginosa PA01
uagcacauggucuucccag

SEQ ID NO: 1548954 - RNA, 21 nt, Pseudomonas aeruginosa PA01
uagaugaacuggucgcuccag

SEQ ID NO: 1548955 - RNA, 15 nt, Pseudomonas aeruginosa PA01
uagaugcggcugugc

SEQ ID NO: 1548956 - RNA, 16 nt, Pseudomonas aeruginosa PA01
uagaggaucucgccac

SEQ ID NO: 1548957 - RNA, 20 nt, Pseudomonas aeruginosa PA01
uagagguugauucaggcggc

SEQ ID NO: 1548958 - RNA, 19 nt, Pseudomonas aeruginosa PA01
uagagggcguagugcauca

SEQ ID NO: 1548959 - RNA, 13 nt, Pseudomonas aeruginosa PA01
uagaguacucggc

SEQ ID NO: 1548960 - RNA, 20 nt, Pseudomonas aeruginosa PA01
uagaguacucggcuacgaac

SEQ ID NO: 1548961 - RNA, 13 nt, Pseudomonas aeruginosa PA01
uagagaugcagca

SEQ ID NO: 1548962 - RNA, 21 nt, Pseudomonas aeruginosa PA01
uagagccuggaguugugccag

SEQ ID NO: 1548963 - RNA, 21 nt, Pseudomonas aeruginosa PA01
uagagauauucccgcgacaac

SEQ ID NO: 1548964 - RNA, 21 nt, Pseudomonas aeruginosa PA01
uaccgccagcucgcuguccag

SEQ ID NO: 1548965 - RNA, 12 nt, Pseudomonas aeruginosa PA01
uaccgccgaggg

SEQ ID NO: 1548966 - RNA, 21 nt, Pseudomonas aeruginosa PA01
uaccgccgagggcgccaggug

SEQ ID NO: 1548967 - RNA, 15 nt, Pseudomonas aeruginosa PA01
uaccacguggccggc

SEQ ID NO: 1548968 - RNA, 14 nt, Pseudomonas aeruginosa PA01
uaccuccagccagc

SEQ ID NO: 1548969 - RNA, 23 nt, Pseudomonas aeruginosa PA01
uaccuccagccagcagcccggcc

SEQ ID NO: 1548970 - RNA, 19 nt, Pseudomonas aeruginosa PA01
uaccggccugucacgccgg

SEQ ID NO: 1548971 - RNA, 15 nt, Pseudomonas aeruginosa PA01
uaccgggccaggcaa

SEQ ID NO: 1548972 - RNA, 13 nt, Pseudomonas aeruginosa PA01
uaccucgccaggc

SEQ ID NO: 1548973 - RNA, 20 nt, Pseudomonas aeruginosa PA01
uaccuuucuccccucaggcg

SEQ ID NO: 1548974 - RNA, 15 nt, Pseudomonas aeruginosa PA01
uacuccagcagcgca

SEQ ID NO: 1548975 - RNA, 23 nt, Pseudomonas aeruginosa PA01
uacgaaaucuccuuggccaugua

SEQ ID NO: 1548976 - RNA, 14 nt, Pseudomonas aeruginosa PA01
uacgaucagccagg

SEQ ID NO: 1548977 - RNA, 22 nt, Pseudomonas aeruginosa PA01
uacggaugccgcgagccagccg

SEQ ID NO: 1548978 - RNA, 19 nt, Pseudomonas aeruginosa PA01
uacggaugcugucccaacc

SEQ ID NO: 1548979 - RNA, 16 nt, Pseudomonas aeruginosa PA01
uacggaggaaacccau

SEQ ID NO: 1548980 - RNA, 22 nt, Pseudomonas aeruginosa PA01
uacggcagcggcgugaagccgc

SEQ ID NO: 1548981 - RNA, 22 nt, Pseudomonas aeruginosa PA01
uacgggggcgugucgagggcug

SEQ ID NO: 1548982 - RNA, 21 nt, Pseudomonas aeruginosa PA01
uagaccccggugugcgcugca

SEQ ID NO: 1548983 - RNA, 13 nt, Pseudomonas aeruginosa PA01
uagaccaccagca

SEQ ID NO: 1548984 - RNA, 16 nt, Pseudomonas aeruginosa PA01
uagaccaccagcagca

SEQ ID NO: 1548985 - RNA, 16 nt, Pseudomonas aeruginosa PA01
uagaccaccgugcgca

SEQ ID NO: 1548986 - RNA, 13 nt, Pseudomonas aeruginosa PA01
uagaccagcaccg

SEQ ID NO: 1548987 - RNA, 19 nt, Pseudomonas aeruginosa PA01
uagaccaggaaggccgggc

SEQ ID NO: 1548988 - RNA, 14 nt, Pseudomonas aeruginosa PA01
uagaccuucucguc

SEQ ID NO: 1548989 - RNA, 14 nt, Pseudomonas aeruginosa PA01
uagacgcaggugcc

SEQ ID NO: 1548990 - RNA, 21 nt, Pseudomonas aeruginosa PA01
uagacguagucggcagucgcc

SEQ ID NO: 1548991 - RNA, 18 nt, Pseudomonas aeruginosa PA01
uagaaaugguggaccagc

SEQ ID NO: 1548992 - RNA, 22 nt, Pseudomonas aeruginosa PA01
uagaaaagaaaauuuucgaaaa

SEQ ID NO: 1548993 - RNA, 16 nt, Pseudomonas aeruginosa PA01
uacuuggcccggcguu

SEQ ID NO: 1548994 - RNA, 16 nt, Pseudomonas aeruginosa PA01
uacugggucuuguagu

SEQ ID NO: 1548995 - RNA, 18 nt, Pseudomonas aeruginosa PA01
uacuggucgcgcgcggcc

SEQ ID NO: 1548996 - RNA, 19 nt, Pseudomonas aeruginosa PA01
uacuccgagggccgcgccg

SEQ ID NO: 1548997 - RNA, 22 nt, Pseudomonas aeruginosa PA01
uacuccgagggccgcgccgacc

SEQ ID NO: 1548998 - RNA, 22 nt, Pseudomonas aeruginosa PA01
uaaugacgaucucgaugaccuu

SEQ ID NO: 1548999 - RNA, 19 nt, Pseudomonas aeruginosa PA01
uaaucgccauuggccaggg

SEQ ID NO: 1549000 - RNA, 20 nt, Pseudomonas aeruginosa PA01
uaaucgccauuggccagggu

SEQ ID NO: 1549001 - RNA, 20 nt, Pseudomonas aeruginosa PA01
uacagccgggaucuccucga

SEQ ID NO: 1549002 - RNA, 14 nt, Pseudomonas aeruginosa PA01
uacagcaauuacac

SEQ ID NO: 1549003 - RNA, 13 nt, Pseudomonas aeruginosa PA01
uacagcaggaaaa

SEQ ID NO: 1549004 - RNA, 15 nt, Pseudomonas aeruginosa PA01
uacagcgggccgggg

SEQ ID NO: 1549005 - RNA, 17 nt, Pseudomonas aeruginosa PA01
uacagcgcgacaucggc

SEQ ID NO: 1549006 - RNA, 20 nt, Pseudomonas aeruginosa PA01
uacaggacugugcuuaauac

SEQ ID NO: 1549007 - RNA, 14 nt, Pseudomonas aeruginosa PA01
uacaggcgcgccug

SEQ ID NO: 1549008 - RNA, 15 nt, Pseudomonas aeruginosa PA01
uacaggcgcagcagc

SEQ ID NO: 1549009 - RNA, 21 nt, Pseudomonas aeruginosa PA01
uacacaaugaucgcgccggau

SEQ ID NO: 1549010 - RNA, 20 nt, Pseudomonas aeruginosa PA01
uacaccuugcgacaggcuuc

SEQ ID NO: 1549011 - RNA, 18 nt, Pseudomonas aeruginosa PA01
uacaccgcugcgccgccg

SEQ ID NO: 1549012 - RNA, 21 nt, Pseudomonas aeruginosa PA01
uauugaggauccacuugccgu

SEQ ID NO: 1549013 - RNA, 17 nt, Pseudomonas aeruginosa PA01
aaauccuuucgaucugg

SEQ ID NO: 1549014 - RNA, 20 nt, Pseudomonas aeruginosa PA01
uauucgacgguauguuucug

SEQ ID NO: 1549015 - RNA, 21 nt, Pseudomonas aeruginosa PA01
uauuccuugcgggaacuggcg

SEQ ID NO: 1549016 - RNA, 15 nt, Pseudomonas aeruginosa PA01
uauucgcccuacgaa

SEQ ID NO: 1549017 - RNA, 17 nt, Pseudomonas aeruginosa PA01
uauucgccggccaggua

SEQ ID NO: 1549018 - RNA, 23 nt, Pseudomonas aeruginosa PA01
uauccgcccuacggaccggugcc

SEQ ID NO: 1549019 - RNA, 14 nt, Pseudomonas aeruginosa PA01
uauccgccgggccg

SEQ ID NO: 1549020 - RNA, 16 nt, Pseudomonas aeruginosa PA01
ucaacuggucgcagcc

SEQ ID NO: 1549021 - RNA, 17 nt, Pseudomonas aeruginosa PA01
ucaacugcuuaccuugc

SEQ ID NO: 1549022 - RNA, 13 nt, Pseudomonas aeruginosa PA01
ucaagcgcggaaa

SEQ ID NO: 1549023 - RNA, 18 nt, Pseudomonas aeruginosa PA01
ucaaggugaagugaucga

SEQ ID NO: 1549024 - RNA, 19 nt, Pseudomonas aeruginosa PA01
ucaagugucgaugaagaag

SEQ ID NO: 1549025 - RNA, 12 nt, Pseudomonas aeruginosa PA01
ucaccagcacca

SEQ ID NO: 1549026 - RNA, 13 nt, Pseudomonas aeruginosa PA01
ucaccacuggaaa

SEQ ID NO: 1549027 - RNA, 22 nt, Pseudomonas aeruginosa PA01
ucaccgaaaggcucuugggcuc

SEQ ID NO: 1549028 - RNA, 21 nt, Pseudomonas aeruginosa PA01
ucacccgcagcggcagcggcu

SEQ ID NO: 1549029 - RNA, 22 nt, Pseudomonas aeruginosa PA01
ucacccgcagcggcagcggcuc

SEQ ID NO: 1549030 - RNA, 22 nt, Pseudomonas aeruginosa PA01
ucaccccgcccuuggcggcgcc

SEQ ID NO: 1549031 - RNA, 20 nt, Pseudomonas aeruginosa PA01
ucaccccgcaaccgcagacu

SEQ ID NO: 1549032 - RNA, 22 nt, Pseudomonas aeruginosa PA01
ucaccccgcaaccgcagacucc

SEQ ID NO: 1549033 - RNA, 19 nt, Pseudomonas aeruginosa PA01
ucacccagagcaccagggu

SEQ ID NO: 1549034 - RNA, 19 nt, Pseudomonas aeruginosa PA01
ucaccccgaccagcgcgcu

SEQ ID NO: 1549035 - RNA, 19 nt, Pseudomonas aeruginosa PA01
ucaccccaggaaaacauca

SEQ ID NO: 1549036 - RNA, 15 nt, Pseudomonas aeruginosa PA01
ucaccgcauagucgc

SEQ ID NO: 1549037 - RNA, 18 nt, Pseudomonas aeruginosa PA01
ucaccgcaucgaaggcgc

SEQ ID NO: 1549038 - RNA, 21 nt, Pseudomonas aeruginosa PA01
ucaccggggccuucaggcgcu

SEQ ID NO: 1549039 - RNA, 15 nt, Pseudomonas aeruginosa PA01
ucaccgccucggaga

SEQ ID NO: 1549040 - RNA, 22 nt, Pseudomonas aeruginosa PA01
ucaccgcgucgggaaaggccgc

SEQ ID NO: 1549041 - RNA, 13 nt, Pseudomonas aeruginosa PA01
ucaccgcggcgcu

SEQ ID NO: 1549042 - RNA, 18 nt, Pseudomonas aeruginosa PA01
ucaccggcagcagcggau

SEQ ID NO: 1549043 - RNA, 21 nt, Pseudomonas aeruginosa PA01
ucaccggacggcugaggcugg

SEQ ID NO: 1549044 - RNA, 17 nt, Pseudomonas aeruginosa PA01
ucaccuugccaucaucg

SEQ ID NO: 1549045 - RNA, 18 nt, Pseudomonas aeruginosa PA01
ucaccuuggugccgaccu

SEQ ID NO: 1549046 - RNA, 19 nt, Pseudomonas aeruginosa PA01
ucaccuuggugccgaccuu

SEQ ID NO: 1549047 - RNA, 21 nt, Pseudomonas aeruginosa PA01
ucaccuuggugccgaccuuca

SEQ ID NO: 1549048 - RNA, 13 nt, Pseudomonas aeruginosa PA01
ucacgaacagcuu

SEQ ID NO: 1549049 - RNA, 18 nt, Pseudomonas aeruginosa PA01
ucacgaacagcuugccgu

SEQ ID NO: 1549050 - RNA, 20 nt, Pseudomonas aeruginosa PA01
ucaccuggccgugcucgaug

SEQ ID NO: 1549051 - RNA, 19 nt, Pseudomonas aeruginosa PA01
ucaccuucucguagcgcuc

SEQ ID NO: 1549052 - RNA, 17 nt, Pseudomonas aeruginosa PA01
ucacggucgugcuugca

SEQ ID NO: 1549053 - RNA, 16 nt, Pseudomonas aeruginosa PA01
ucacgcaggcgcuggc

SEQ ID NO: 1549054 - RNA, 21 nt, Pseudomonas aeruginosa PA01
ucacgcaguacagcugcaccg

SEQ ID NO: 1549055 - RNA, 22 nt, Pseudomonas aeruginosa PA01
ucacgcgaccaccuucuacacc

SEQ ID NO: 1549056 - RNA, 23 nt, Pseudomonas aeruginosa PA01
ucacgauggccggcagcagcgcc

SEQ ID NO: 1549057 - RNA, 17 nt, Pseudomonas aeruginosa PA01
ucacguaggagccggcc

SEQ ID NO: 1549058 - RNA, 22 nt, Pseudomonas aeruginosa PA01
ucacguaggagccggccaggcg

SEQ ID NO: 1549059 - RNA, 14 nt, Pseudomonas aeruginosa PA01
ucacuacaggaccu

SEQ ID NO: 1549060 - RNA, 23 nt, Pseudomonas aeruginosa PA01
ucauacuugggucguuagcucag

SEQ ID NO: 1549061 - RNA, 15 nt, Pseudomonas aeruginosa PA01
ucauagcucagcugg

SEQ ID NO: 1549062 - RNA, 13 nt, Pseudomonas aeruginosa PA01
ucaucaccggcag

SEQ ID NO: 1549063 - RNA, 15 nt, Pseudomonas aeruginosa PA01
ucaucaccggcagga

SEQ ID NO: 1549064 - RNA, 22 nt, Pseudomonas aeruginosa PA01
ucaucaccaggucgcuguccuc

SEQ ID NO: 1549065 - RNA, 12 nt, Pseudomonas aeruginosa PA01
ucaucaccagcu

SEQ ID NO: 1549066 - RNA, 20 nt, Pseudomonas aeruginosa PA01
ucauauggccucuugaaaac

SEQ ID NO: 1549067 - RNA, 16 nt, Pseudomonas aeruginosa PA01
ucaucgccgccaggca

SEQ ID NO: 1549068 - RNA, 14 nt, Pseudomonas aeruginosa PA01
ucaucgccaccggu

SEQ ID NO: 1549069 - RNA, 16 nt, Pseudomonas aeruginosa PA01
ucaucgagcaguucca

SEQ ID NO: 1549070 - RNA, 16 nt, Pseudomonas aeruginosa PA01
ucaucccgguuuccgc

SEQ ID NO: 1549071 - RNA, 22 nt, Pseudomonas aeruginosa PA01
ucauccgcugguagcccaggcc

SEQ ID NO: 1549072 - RNA, 13 nt, Pseudomonas aeruginosa PA01
ucaucaggaucag

SEQ ID NO: 1549073 - RNA, 12 nt, Pseudomonas aeruginosa PA01
ucaucaggcuca

SEQ ID NO: 1549074 - RNA, 13 nt, Pseudomonas aeruginosa PA01
ucaucaggcugcc

SEQ ID NO: 1549075 - RNA, 16 nt, Pseudomonas aeruginosa PA01
ucaucaggcugcuguc

SEQ ID NO: 1549076 - RNA, 14 nt, Pseudomonas aeruginosa PA01
ucagucgcugcucg

SEQ ID NO: 1549077 - RNA, 23 nt, Pseudomonas aeruginosa PA01
ucagucgagcaguucccccagca

SEQ ID NO: 1549078 - RNA, 13 nt, Pseudomonas aeruginosa PA01
ucagucaggaucg

SEQ ID NO: 1549079 - RNA, 12 nt, Pseudomonas aeruginosa PA01
ucaguaccugca

SEQ ID NO: 1549080 - RNA, 13 nt, Pseudomonas aeruginosa PA01
ucaguuccagguc

SEQ ID NO: 1549081 - RNA, 19 nt, Pseudomonas aeruginosa PA01
ucagggaagaugcacacca

SEQ ID NO: 1549082 - RNA, 14 nt, Pseudomonas aeruginosa PA01
ucagggcaccgccg

SEQ ID NO: 1549083 - RNA, 23 nt, Pseudomonas aeruginosa PA01
ucagggcuugcgcgccaccagcg

SEQ ID NO: 1549084 - RNA, 17 nt, Pseudomonas aeruginosa PA01
ucagggucuucaggcgu

SEQ ID NO: 1549085 - RNA, 14 nt, Pseudomonas aeruginosa PA01
ucagguuggacagg

SEQ ID NO: 1549086 - RNA, 21 nt, Pseudomonas aeruginosa PA01
ucaggugcguacuuggcccgg

SEQ ID NO: 1549087 - RNA, 17 nt, Pseudomonas aeruginosa PA01
ucaggguggcgaccgcc

SEQ ID NO: 1549088 - RNA, 18 nt, Pseudomonas aeruginosa PA01
ucaggguggcgcugccuu

SEQ ID NO: 1549089 - RNA, 15 nt, Pseudomonas aeruginosa PA01
ucagcuggauagagu

SEQ ID NO: 1549090 - RNA, 19 nt, Pseudomonas aeruginosa PA01
ucagcuggcgcgccuccug

SEQ ID NO: 1549091 - RNA, 20 nt, Pseudomonas aeruginosa PA01
ucagcgccguugcggcagca

SEQ ID NO: 1549092 - RNA, 22 nt, Pseudomonas aeruginosa PA01
ucagcgccgcucggcgagccgc

SEQ ID NO: 1549093 - RNA, 20 nt, Pseudomonas aeruginosa PA01
ucagcgccgguagcggcgca

SEQ ID NO: 1549094 - RNA, 13 nt, Pseudomonas aeruginosa PA01
ucagcgccuccau

SEQ ID NO: 1549095 - RNA, 18 nt, Pseudomonas aeruginosa PA01
ucagcgcgccgagccagg

SEQ ID NO: 1549096 - RNA, 19 nt, Pseudomonas aeruginosa PA01
ucagcgcgccgagccaggu

SEQ ID NO: 1549097 - RNA, 22 nt, Pseudomonas aeruginosa PA01
ucagcgcggugagcagggugac

SEQ ID NO: 1549098 - RNA, 15 nt, Pseudomonas aeruginosa PA01
ucagcuucagcuccg

SEQ ID NO: 1549099 - RNA, 14 nt, Pseudomonas aeruginosa PA01
ucagcuucagggug

SEQ ID NO: 1549100 - RNA, 20 nt, Pseudomonas aeruginosa PA01
ucagcuucaggguggcgcug

SEQ ID NO: 1549101 - RNA, 18 nt, Pseudomonas aeruginosa PA01
ucaggaagacuucuggau

SEQ ID NO: 1549102 - RNA, 13 nt, Pseudomonas aeruginosa PA01
ucaggaucacauc

SEQ ID NO: 1549103 - RNA, 18 nt, Pseudomonas aeruginosa PA01
ucaggaacgaagaacccc

SEQ ID NO: 1549104 - RNA, 22 nt, Pseudomonas aeruginosa PA01
ucaggaacgaagaaccccggcu

SEQ ID NO: 1549105 - RNA, 12 nt, Pseudomonas aeruginosa PA01
ucagccagccca

SEQ ID NO: 1549106 - RNA, 14 nt, Pseudomonas aeruginosa PA01
ucagccagcccagu

SEQ ID NO: 1549107 - RNA, 18 nt, Pseudomonas aeruginosa PA01
ucagccacgggcgccagc

SEQ ID NO: 1549108 - RNA, 13 nt, Pseudomonas aeruginosa PA01
ucagccgcggccg

SEQ ID NO: 1549109 - RNA, 19 nt, Pseudomonas aeruginosa PA01
ucagccgcggccggggaac

SEQ ID NO: 1549110 - RNA, 16 nt, Pseudomonas aeruginosa PA01
ucagccauuggccgac

SEQ ID NO: 1549111 - RNA, 21 nt, Pseudomonas aeruginosa PA01
ucagccauuggccgacgccgc

SEQ ID NO: 1549112 - RNA, 12 nt, Pseudomonas aeruginosa PA01
ucagcccacccc

SEQ ID NO: 1549113 - RNA, 22 nt, Pseudomonas aeruginosa PA01
ucagcccacccccagcccggcc

SEQ ID NO: 1549114 - RNA, 22 nt, Pseudomonas aeruginosa PA01
ucagcccacccccggcccggcc

SEQ ID NO: 1549115 - RNA, 21 nt, Pseudomonas aeruginosa PA01
ucagccgaugcucgcgccagc

SEQ ID NO: 1549116 - RNA, 17 nt, Pseudomonas aeruginosa PA01
ucagccucacccugcug

SEQ ID NO: 1549117 - RNA, 22 nt, Pseudomonas aeruginosa PA01
ucagccuggucauccuggcccu

SEQ ID NO: 1549118 - RNA, 21 nt, Pseudomonas aeruginosa PA01
ucagcgaguugaccuuggcca

SEQ ID NO: 1549119 - RNA, 21 nt, Pseudomonas aeruginosa PA01
ucagcgcccggcugugcucga

SEQ ID NO: 1549120 - RNA, 16 nt, Pseudomonas aeruginosa PA01
ucagcgccgccaggcc

SEQ ID NO: 1549121 - RNA, 16 nt, Pseudomonas aeruginosa PA01
ucagcgagagcugucc

SEQ ID NO: 1549122 - RNA, 17 nt, Pseudomonas aeruginosa PA01
ucauuggcgcgucggug

SEQ ID NO: 1549123 - RNA, 20 nt, Pseudomonas aeruginosa PA01
ucauuacgaaugagcugcuc

SEQ ID NO: 1549124 - RNA, 14 nt, Pseudomonas aeruginosa PA01
ucauggucgggcag

SEQ ID NO: 1549125 - RNA, 14 nt, Pseudomonas aeruginosa PA01
ucaugggggccagc

SEQ ID NO: 1549126 - RNA, 15 nt, Pseudomonas aeruginosa PA01
ucauggccuggcgcu

SEQ ID NO: 1549127 - RNA, 14 nt, Pseudomonas aeruginosa PA01
ucauggcauggcca

SEQ ID NO: 1549128 - RNA, 16 nt, Pseudomonas aeruginosa PA01
ucauggaacagcagcc

SEQ ID NO: 1549129 - RNA, 18 nt, Pseudomonas aeruginosa PA01
ucauggaacagcagccag

SEQ ID NO: 1549130 - RNA, 17 nt, Pseudomonas aeruginosa PA01
ucauggaacugcagggc

SEQ ID NO: 1549131 - RNA, 17 nt, Pseudomonas aeruginosa PA01
ucaugcccagcuucacc

SEQ ID NO: 1549132 - RNA, 18 nt, Pseudomonas aeruginosa PA01
ucaugcccagcuuggcca

SEQ ID NO: 1549133 - RNA, 14 nt, Pseudomonas aeruginosa PA01
ucaugcccuggccg

SEQ ID NO: 1549134 - RNA, 21 nt, Pseudomonas aeruginosa PA01
ucaugcccuggccgacgcuga

SEQ ID NO: 1549135 - RNA, 17 nt, Pseudomonas aeruginosa PA01
ucaugccgaacuucucc

SEQ ID NO: 1549136 - RNA, 20 nt, Pseudomonas aeruginosa PA01
ucaugagauccgccagcaga

SEQ ID NO: 1549137 - RNA, 13 nt, Pseudomonas aeruginosa PA01
ucaucuuggccca

SEQ ID NO: 1549138 - RNA, 15 nt, Pseudomonas aeruginosa PA01
ucaugaaaaagcccc

SEQ ID NO: 1549139 - RNA, 18 nt, Pseudomonas aeruginosa PA01
uccaccuggcgcagguag

SEQ ID NO: 1549140 - RNA, 13 nt, Pseudomonas aeruginosa PA01
uccaccuccaccu

SEQ ID NO: 1549141 - RNA, 14 nt, Pseudomonas aeruginosa PA01
uccaccucgcccuc

SEQ ID NO: 1549142 - RNA, 22 nt, Pseudomonas aeruginosa PA01
uccaccgucgcggucaucgccg

SEQ ID NO: 1549143 - RNA, 19 nt, Pseudomonas aeruginosa PA01
uccaccguuccgacccggc

SEQ ID NO: 1549144 - RNA, 13 nt, Pseudomonas aeruginosa PA01
uccaccggcccgg

SEQ ID NO: 1549145 - RNA, 19 nt, Pseudomonas aeruginosa PA01
uccacgaagaacgccagcc

SEQ ID NO: 1549146 - RNA, 15 nt, Pseudomonas aeruginosa PA01
uccacucguuaaccu

SEQ ID NO: 1549147 - RNA, 21 nt, Pseudomonas aeruginosa PA01
uccacucgcccuugaccaguc

SEQ ID NO: 1549148 - RNA, 22 nt, Pseudomonas aeruginosa PA01
uccacucgcccuugaccagucc

SEQ ID NO: 1549149 - RNA, 18 nt, Pseudomonas aeruginosa PA01
uccacuccggcagcaccc

SEQ ID NO: 1549150 - RNA, 15 nt, Pseudomonas aeruginosa PA01
uccacugcuuggcca

SEQ ID NO: 1549151 - RNA, 18 nt, Pseudomonas aeruginosa PA01
uccacugcuuggccaggc

SEQ ID NO: 1549152 - RNA, 23 nt, Pseudomonas aeruginosa PA01
uccacuggcccacggcgccuucc

SEQ ID NO: 1549153 - RNA, 16 nt, Pseudomonas aeruginosa PA01
uccagaugaaacugcc

SEQ ID NO: 1549154 - RNA, 17 nt, Pseudomonas aeruginosa PA01
uccagaugaaacugccc

SEQ ID NO: 1549155 - RNA, 19 nt, Pseudomonas aeruginosa PA01
uccagaccucgagcaggcc

SEQ ID NO: 1549156 - RNA, 17 nt, Pseudomonas aeruginosa PA01
uccagacucuccagguc

SEQ ID NO: 1549157 - RNA, 22 nt, Pseudomonas aeruginosa PA01
uccagaggcauucaucaccagc

SEQ ID NO: 1549158 - RNA, 18 nt, Pseudomonas aeruginosa PA01
uccagagugcgcagcagc

SEQ ID NO: 1549159 - RNA, 19 nt, Pseudomonas aeruginosa PA01
uccagagugcgcagcagcg

SEQ ID NO: 1549160 - RNA, 20 nt, Pseudomonas aeruginosa PA01
uccagagugcgcagcagcgu

SEQ ID NO: 1549161 - RNA, 13 nt, Pseudomonas aeruginosa PA01
uccaccagccagc

SEQ ID NO: 1549162 - RNA, 18 nt, Pseudomonas aeruginosa PA01
uccaccagccaguagucu

SEQ ID NO: 1549163 - RNA, 19 nt, Pseudomonas aeruginosa PA01
uccacccguucgccggccu

SEQ ID NO: 1549164 - RNA, 21 nt, Pseudomonas aeruginosa PA01
uccaccgaguggcgcagcgcc

SEQ ID NO: 1549165 - RNA, 14 nt, Pseudomonas aeruginosa PA01
uccaccgauuucag

SEQ ID NO: 1549166 - RNA, 19 nt, Pseudomonas aeruginosa PA01
uccaccgcccccggcgcca

SEQ ID NO: 1549167 - RNA, 14 nt, Pseudomonas aeruginosa PA01
uccaccgccugccc

SEQ ID NO: 1549168 - RNA, 13 nt, Pseudomonas aeruginosa PA01
uccaccgccgcca

SEQ ID NO: 1549169 - RNA, 14 nt, Pseudomonas aeruginosa PA01
uccaccgccagggc

SEQ ID NO: 1549170 - RNA, 15 nt, Pseudomonas aeruginosa PA01
uccaccgccagggcg

SEQ ID NO: 1549171 - RNA, 13 nt, Pseudomonas aeruginosa PA01
uccaccaccagca

SEQ ID NO: 1549172 - RNA, 15 nt, Pseudomonas aeruginosa PA01
uccaccaccagcagg

SEQ ID NO: 1549173 - RNA, 19 nt, Pseudomonas aeruginosa PA01
uccaaagccuggagcaggg

SEQ ID NO: 1549174 - RNA, 20 nt, Pseudomonas aeruginosa PA01
uccaggcuguggcgcggcug

SEQ ID NO: 1549175 - RNA, 18 nt, Pseudomonas aeruginosa PA01
uccaggcuuuccaccgcc

SEQ ID NO: 1549176 - RNA, 19 nt, Pseudomonas aeruginosa PA01
uccagggagaacagcaggg

SEQ ID NO: 1549177 - RNA, 20 nt, Pseudomonas aeruginosa PA01
uccagggagaacagcagggu

SEQ ID NO: 1549178 - RNA, 21 nt, Pseudomonas aeruginosa PA01
uccaggcuggccuuggccaug

SEQ ID NO: 1549179 - RNA, 19 nt, Pseudomonas aeruginosa PA01
uccagcuucuucugcagcu

SEQ ID NO: 1549180 - RNA, 20 nt, Pseudomonas aeruginosa PA01
uccaggcucuucagcacgcg

SEQ ID NO: 1549181 - RNA, 20 nt, Pseudomonas aeruginosa PA01
uccagggugggcggugcggc

SEQ ID NO: 1549182 - RNA, 16 nt, Pseudomonas aeruginosa PA01
uccagggccaggauga

SEQ ID NO: 1549183 - RNA, 18 nt, Pseudomonas aeruginosa PA01
uccagggcgcugaccagg

SEQ ID NO: 1549184 - RNA, 14 nt, Pseudomonas aeruginosa PA01
uccagggcggcgcg

SEQ ID NO: 1549185 - RNA, 16 nt, Pseudomonas aeruginosa PA01
uccagggccugcucca

SEQ ID NO: 1549186 - RNA, 14 nt, Pseudomonas aeruginosa PA01
uccagggucggcac

SEQ ID NO: 1549187 - RNA, 16 nt, Pseudomonas aeruginosa PA01
uccagcuggcgcagcc

SEQ ID NO: 1549188 - RNA, 17 nt, Pseudomonas aeruginosa PA01
uccagcuggcgcagccg

SEQ ID NO: 1549189 - RNA, 23 nt, Pseudomonas aeruginosa PA01
uccagcuggcgcguugugccgcc

SEQ ID NO: 1549190 - RNA, 18 nt, Pseudomonas aeruginosa PA01
uccagcuuggcacggccg

SEQ ID NO: 1549191 - RNA, 18 nt, Pseudomonas aeruginosa PA01
uccaguacacccagggca

SEQ ID NO: 1549192 - RNA, 19 nt, Pseudomonas aeruginosa PA01
uccaguacacccagggcag

SEQ ID NO: 1549193 - RNA, 23 nt, Pseudomonas aeruginosa PA01
uccagccgcugcagggcggcgcu

SEQ ID NO: 1549194 - RNA, 23 nt, Pseudomonas aeruginosa PA01
uccagccggcgcuucugcgagcc

SEQ ID NO: 1549195 - RNA, 13 nt, Pseudomonas aeruginosa PA01
uccagcccuucga

SEQ ID NO: 1549196 - RNA, 18 nt, Pseudomonas aeruginosa PA01
uccagccggcauccagca

SEQ ID NO: 1549197 - RNA, 12 nt, Pseudomonas aeruginosa PA01
uccagcccugga

SEQ ID NO: 1549198 - RNA, 14 nt, Pseudomonas aeruginosa PA01
uccagccagugcau

SEQ ID NO: 1549199 - RNA, 15 nt, Pseudomonas aeruginosa PA01
uccagccaguggcug

SEQ ID NO: 1549200 - RNA, 12 nt, Pseudomonas aeruginosa PA01
uccagccaggcc

SEQ ID NO: 1549201 - RNA, 19 nt, Pseudomonas aeruginosa PA01
uccagcgagcgggcgaggg

SEQ ID NO: 1549202 - RNA, 14 nt, Pseudomonas aeruginosa PA01
uccagcgaauggac

SEQ ID NO: 1549203 - RNA, 13 nt, Pseudomonas aeruginosa PA01
uccagcuccucca

SEQ ID NO: 1549204 - RNA, 14 nt, Pseudomonas aeruginosa PA01
uccagccagcagcc

SEQ ID NO: 1549205 - RNA, 16 nt, Pseudomonas aeruginosa PA01
uccagccagcagcccg

SEQ ID NO: 1549206 - RNA, 15 nt, Pseudomonas aeruginosa PA01
uccagcagacggcug

SEQ ID NO: 1549207 - RNA, 16 nt, Pseudomonas aeruginosa PA01
uccagcacccagguag

SEQ ID NO: 1549208 - RNA, 16 nt, Pseudomonas aeruginosa PA01
uccagcacgcggaggg

SEQ ID NO: 1549209 - RNA, 13 nt, Pseudomonas aeruginosa PA01
uccagcaaugcca

SEQ ID NO: 1549210 - RNA, 13 nt, Pseudomonas aeruginosa PA01
uccagcaaggcgu

SEQ ID NO: 1549211 - RNA, 22 nt, Pseudomonas aeruginosa PA01
uccagcaacggcaucgcucugc

SEQ ID NO: 1549212 - RNA, 21 nt, Pseudomonas aeruginosa PA01
uccagcaacgugaagcccuuc

SEQ ID NO: 1549213 - RNA, 22 nt, Pseudomonas aeruginosa PA01
ugcaccgcgcuggagaccuugu

SEQ ID NO: 1549214 - RNA, 16 nt, Pseudomonas aeruginosa PA01
ugcacccuuggcgcag

SEQ ID NO: 1549215 - RNA, 17 nt, Pseudomonas aeruginosa PA01
ugauuugauugaaaaaa

SEQ ID NO: 1549216 - RNA, 19 nt, Pseudomonas aeruginosa PA01
ugcacgccgauggcguugu

SEQ ID NO: 1549217 - RNA, 13 nt, Pseudomonas aeruginosa PA01
ugcacggccaggc

SEQ ID NO: 1549218 - RNA, 14 nt, Pseudomonas aeruginosa PA01
ugcacggccaggcc

SEQ ID NO: 1549219 - RNA, 18 nt, Pseudomonas aeruginosa PA01
ugcacggauaccacccgc

SEQ ID NO: 1549220 - RNA, 13 nt, Pseudomonas aeruginosa PA01
ugcacgcgccggg

SEQ ID NO: 1549221 - RNA, 16 nt, Pseudomonas aeruginosa PA01
ugcacgcgccgggucg

SEQ ID NO: 1549222 - RNA, 16 nt, Pseudomonas aeruginosa PA01
ugcaggccgagaccgc

SEQ ID NO: 1549223 - RNA, 22 nt, Pseudomonas aeruginosa PA01
ugcaggacgaagucgccggcau

SEQ ID NO: 1549224 - RNA, 20 nt, Pseudomonas aeruginosa PA01
ugcaggaagcgccgggccgc

SEQ ID NO: 1549225 - RNA, 15 nt, Pseudomonas aeruginosa PA01
ugcagcgcgcgcugg

SEQ ID NO: 1549226 - RNA, 19 nt, Pseudomonas aeruginosa PA01
ugcagcgccucguggaaca

SEQ ID NO: 1549227 - RNA, 18 nt, Pseudomonas aeruginosa PA01
ugcagcgccuguuccagg

SEQ ID NO: 1549228 - RNA, 10 nt, Pseudomonas aeruginosa PA01
ugcagcggca

SEQ ID NO: 1549229 - RNA, 16 nt, Pseudomonas aeruginosa PA01
ugcagcugcgagaaca

SEQ ID NO: 1549230 - RNA, 19 nt, Pseudomonas aeruginosa PA01
ugcagcgcuuguagcagcc

SEQ ID NO: 1549231 - RNA, 17 nt, Pseudomonas aeruginosa PA01
ugcagcggaagcccugc

SEQ ID NO: 1549232 - RNA, 19 nt, Pseudomonas aeruginosa PA01
ugcagcggaagcccugcug

SEQ ID NO: 1549233 - RNA, 13 nt, Pseudomonas aeruginosa PA01
ugcaggaacaggu

SEQ ID NO: 1549234 - RNA, 14 nt, Pseudomonas aeruginosa PA01
ugcaggaacagcca

SEQ ID NO: 1549235 - RNA, 15 nt, Pseudomonas aeruginosa PA01
ugcaggaacagccag

SEQ ID NO: 1549236 - RNA, 18 nt, Pseudomonas aeruginosa PA01
ugcagcuugcgcgccagg

SEQ ID NO: 1549237 - RNA, 20 nt, Pseudomonas aeruginosa PA01
ugcagcuugguauccaccuc

SEQ ID NO: 1549238 - RNA, 20 nt, Pseudomonas aeruginosa PA01
ugcagcuugugggcaugcuc

SEQ ID NO: 1549239 - RNA, 15 nt, Pseudomonas aeruginosa PA01
ugcagagaaaaggcc

SEQ ID NO: 1549240 - RNA, 19 nt, Pseudomonas aeruginosa PA01
ugcagagaaaaggccgcuu

SEQ ID NO: 1549241 - RNA, 16 nt, Pseudomonas aeruginosa PA01
ugcagagcggccaggu

SEQ ID NO: 1549242 - RNA, 19 nt, Pseudomonas aeruginosa PA01
ugcagacgguucagcagcg

SEQ ID NO: 1549243 - RNA, 12 nt, Pseudomonas aeruginosa PA01
ugcagcagguag

SEQ ID NO: 1549244 - RNA, 22 nt, Pseudomonas aeruginosa PA01
ugcagcaggucgagcaguuccg

SEQ ID NO: 1549245 - RNA, 18 nt, Pseudomonas aeruginosa PA01
ugcagcagguuccuccug

SEQ ID NO: 1549246 - RNA, 18 nt, Pseudomonas aeruginosa PA01
ugcagcaguuccaggcgu

SEQ ID NO: 1549247 - RNA, 19 nt, Pseudomonas aeruginosa PA01
ugcagcgaggggaagaucu

SEQ ID NO: 1549248 - RNA, 21 nt, Pseudomonas aeruginosa PA01
ugcagcgaggggaagaucucc

SEQ ID NO: 1549249 - RNA, 21 nt, Pseudomonas aeruginosa PA01
ugcagccagcuucagccgacc

SEQ ID NO: 1549250 - RNA, 13 nt, Pseudomonas aeruginosa PA01
ugcagccagccgu

SEQ ID NO: 1549251 - RNA, 20 nt, Pseudomonas aeruginosa PA01
ugcauccgccgcagaccagc

SEQ ID NO: 1549252 - RNA, 16 nt, Pseudomonas aeruginosa PA01
ugcaugaaggcgcuga

SEQ ID NO: 1549253 - RNA, 15 nt, Pseudomonas aeruginosa PA01
ugcaugccguccggg

SEQ ID NO: 1549254 - RNA, 16 nt, Pseudomonas aeruginosa PA01
ugcauggccgggccga

SEQ ID NO: 1549255 - RNA, 20 nt, Pseudomonas aeruginosa PA01
ugcauggcaccgucaagggc

SEQ ID NO: 1549256 - RNA, 22 nt, Pseudomonas aeruginosa PA01
ugcauggccuguaccaaggugc

SEQ ID NO: 1549257 - RNA, 13 nt, Pseudomonas aeruginosa PA01
ugcaugugccagg

SEQ ID NO: 1549258 - RNA, 22 nt, Pseudomonas aeruginosa PA01
ugcaggguauuuuccagcaggc

SEQ ID NO: 1549259 - RNA, 21 nt, Pseudomonas aeruginosa PA01
ugcagggcugcuguugccagg

SEQ ID NO: 1549260 - RNA, 15 nt, Pseudomonas aeruginosa PA01
ugcagggcagcggcc

SEQ ID NO: 1549261 - RNA, 13 nt, Pseudomonas aeruginosa PA01
ugcagggccaggg

SEQ ID NO: 1549262 - RNA, 12 nt, Pseudomonas aeruginosa PA01
ugcagggccgcc

SEQ ID NO: 1549263 - RNA, 15 nt, Pseudomonas aeruginosa PA01
ugcaggcucacgcgu

SEQ ID NO: 1549264 - RNA, 15 nt, Pseudomonas aeruginosa PA01
ugcaggcucagcacc

SEQ ID NO: 1549265 - RNA, 16 nt, Pseudomonas aeruginosa PA01
ugcaggcucagcaccu

SEQ ID NO: 1549266 - RNA, 21 nt, Pseudomonas aeruginosa PA01
ugcaggccggccuccagcgcc

SEQ ID NO: 1549267 - RNA, 19 nt, Pseudomonas aeruginosa PA01
ugcaggccggcgagccagg

SEQ ID NO: 1549268 - RNA, 17 nt, Pseudomonas aeruginosa PA01
ugcaggcgcccuggccg

SEQ ID NO: 1549269 - RNA, 19 nt, Pseudomonas aeruginosa PA01
ugccaaguugccuggcagg

SEQ ID NO: 1549270 - RNA, 11 nt, Pseudomonas aeruginosa PA01
ugccagcaccu

SEQ ID NO: 1549271 - RNA, 11 nt, Pseudomonas aeruginosa PA01
ugccaccacca

SEQ ID NO: 1549272 - RNA, 13 nt, Pseudomonas aeruginosa PA01
ugccacgcaccac

SEQ ID NO: 1549273 - RNA, 21 nt, Pseudomonas aeruginosa PA01
ugccacagguggaucgcggcg

SEQ ID NO: 1549274 - RNA, 18 nt, Pseudomonas aeruginosa PA01
ugccacaguuucauggug

SEQ ID NO: 1549275 - RNA, 16 nt, Pseudomonas aeruginosa PA01
ugccacaggcccugga

SEQ ID NO: 1549276 - RNA, 19 nt, Pseudomonas aeruginosa PA01
ugccaucaggccgcggccc

SEQ ID NO: 1549277 - RNA, 20 nt, Pseudomonas aeruginosa PA01
ugccauaggcauauucuuca

SEQ ID NO: 1549278 - RNA, 15 nt, Pseudomonas aeruginosa PA01
ugccauacagcgccc

SEQ ID NO: 1549279 - RNA, 18 nt, Pseudomonas aeruginosa PA01
ugccagugccucgcgcgu

SEQ ID NO: 1549280 - RNA, 12 nt, Pseudomonas aeruginosa PA01
ugccagggccuu

SEQ ID NO: 1549281 - RNA, 16 nt, Pseudomonas aeruginosa PA01
ugccagggauacucau

SEQ ID NO: 1549282 - RNA, 22 nt, Pseudomonas aeruginosa PA01
ugccagggcuucccaggccagc

SEQ ID NO: 1549283 - RNA, 20 nt, Pseudomonas aeruginosa PA01
ugccaggcucgccgccagca

SEQ ID NO: 1549284 - RNA, 17 nt, Pseudomonas aeruginosa PA01
ugccaggauuucuccug

SEQ ID NO: 1549285 - RNA, 15 nt, Pseudomonas aeruginosa PA01
ugccaggcggcagcc

SEQ ID NO: 1549286 - RNA, 13 nt, Pseudomonas aeruginosa PA01
ugccaggaccagc

SEQ ID NO: 1549287 - RNA, 16 nt, Pseudomonas aeruginosa PA01
ugccagcaggccgagc

SEQ ID NO: 1549288 - RNA, 12 nt, Pseudomonas aeruginosa PA01
ugccagcaggcc

SEQ ID NO: 1549289 - RNA, 13 nt, Pseudomonas aeruginosa PA01
ugccagccggccu

SEQ ID NO: 1549290 - RNA, 21 nt, Pseudomonas aeruginosa PA01
ugcccgcugcaugugccaggc

SEQ ID NO: 1549291 - RNA, 22 nt, Pseudomonas aeruginosa PA01
ugcccggccaugccgccgacgc

SEQ ID NO: 1549292 - RNA, 18 nt, Pseudomonas aeruginosa PA01
ugcccggcagaucucccu

SEQ ID NO: 1549293 - RNA, 17 nt, Pseudomonas aeruginosa PA01
ugcccggcauaggcgcc

SEQ ID NO: 1549294 - RNA, 21 nt, Pseudomonas aeruginosa PA01
ugcccggcauaggcgccagcc

SEQ ID NO: 1549295 - RNA, 18 nt, Pseudomonas aeruginosa PA01
ugcccgcugggcaggugg

SEQ ID NO: 1549296 - RNA, 21 nt, Pseudomonas aeruginosa PA01
ugcccgggguuggcgcugacc

SEQ ID NO: 1549297 - RNA, 23 nt, Pseudomonas aeruginosa PA01
ugcccggcugguugccagcagcg

SEQ ID NO: 1549298 - RNA, 15 nt, Pseudomonas aeruginosa PA01
ugcccgguggggcgg

SEQ ID NO: 1549299 - RNA, 22 nt, Pseudomonas aeruginosa PA01
ugcccgguauucagccagagcc

SEQ ID NO: 1549300 - RNA, 18 nt, Pseudomonas aeruginosa PA01
ugcccgguggccuccugc

SEQ ID NO: 1549301 - RNA, 17 nt, Pseudomonas aeruginosa PA01
ugcccgucaggccuugc

SEQ ID NO: 1549302 - RNA, 14 nt, Pseudomonas aeruginosa PA01
ugcccggccaggcg

SEQ ID NO: 1549303 - RNA, 17 nt, Pseudomonas aeruginosa PA01
ugccccguagccaugcc

SEQ ID NO: 1549304 - RNA, 18 nt, Pseudomonas aeruginosa PA01
ugcccgaccgguuccagc

SEQ ID NO: 1549305 - RNA, 23 nt, Pseudomonas aeruginosa PA01
ugcccgaccgguuccagcggccg

SEQ ID NO: 1549306 - RNA, 23 nt, Pseudomonas aeruginosa PA01
ugcccgaggugucgccgcggacg

SEQ ID NO: 1549307 - RNA, 16 nt, Pseudomonas aeruginosa PA01
ugccccuugagccagu

SEQ ID NO: 1549308 - RNA, 18 nt, Pseudomonas aeruginosa PA01
ugccccuugagccagucc

SEQ ID NO: 1549309 - RNA, 17 nt, Pseudomonas aeruginosa PA01
ugcccgaugccgcgccg

SEQ ID NO: 1549310 - RNA, 19 nt, Pseudomonas aeruginosa PA01
ugcccgccggcgcccuggg

SEQ ID NO: 1549311 - RNA, 21 nt, Pseudomonas aeruginosa PA01
ugcccgccggcgcgcccaggc

SEQ ID NO: 1549312 - RNA, 22 nt, Pseudomonas aeruginosa PA01
ugcccgccggcgcgcccaggcc

SEQ ID NO: 1549313 - RNA, 14 nt, Pseudomonas aeruginosa PA01
ugcccgccagcagg

SEQ ID NO: 1549314 - RNA, 14 nt, Pseudomonas aeruginosa PA01
ugcccaucaggcuc

SEQ ID NO: 1549315 - RNA, 20 nt, Pseudomonas aeruginosa PA01
ugcccaucaggcucaggcgu

SEQ ID NO: 1549316 - RNA, 18 nt, Pseudomonas aeruginosa PA01
ugccccacaggcccugca

SEQ ID NO: 1549317 - RNA, 13 nt, Pseudomonas aeruginosa PA01
ugccccagcaucg

SEQ ID NO: 1549318 - RNA, 19 nt, Pseudomonas aeruginosa PA01
ugccccagcaucgccggca

SEQ ID NO: 1549319 - RNA, 18 nt, Pseudomonas aeruginosa PA01
ugccccacuuccggcccg

SEQ ID NO: 1549320 - RNA, 12 nt, Pseudomonas aeruginosa PA01
ugccccaggcga

SEQ ID NO: 1549321 - RNA, 21 nt, Pseudomonas aeruginosa PA01
ugcccccggcaacacccuccc

SEQ ID NO: 1549322 - RNA, 22 nt, Pseudomonas aeruginosa PA01
ugccccguggcgggccagcagg

SEQ ID NO: 1549323 - RNA, 19 nt, Pseudomonas aeruginosa PA01
ugcccagcaggcugcugcu

SEQ ID NO: 1549324 - RNA, 22 nt, Pseudomonas aeruginosa PA01
ugcccacggccaggcccacgcc

SEQ ID NO: 1549325 - RNA, 14 nt, Pseudomonas aeruginosa PA01
ugcccacgcagaag

SEQ ID NO: 1549326 - RNA, 21 nt, Pseudomonas aeruginosa PA01
ugcccaccagcgucgccaggc

SEQ ID NO: 1549327 - RNA, 22 nt, Pseudomonas aeruginosa PA01
ugcccaccagcgucgccaggcc

SEQ ID NO: 1549328 - RNA, 19 nt, Pseudomonas aeruginosa PA01
ugcccagguagucgcccag

SEQ ID NO: 1549329 - RNA, 16 nt, Pseudomonas aeruginosa PA01
ugcccagcguggccag

SEQ ID NO: 1549330 - RNA, 17 nt, Pseudomonas aeruginosa PA01
ugcccagcguggccagc

SEQ ID NO: 1549331 - RNA, 14 nt, Pseudomonas aeruginosa PA01
ugcccaggccgaag

SEQ ID NO: 1549332 - RNA, 11 nt, Pseudomonas aeruginosa PA01
ugcccaggcuc

SEQ ID NO: 1549333 - RNA, 18 nt, Pseudomonas aeruginosa PA01
ugcccaggcugaggucgc

SEQ ID NO: 1549334 - RNA, 17 nt, Pseudomonas aeruginosa PA01
ugcccagcggcgccagc

SEQ ID NO: 1549335 - RNA, 20 nt, Pseudomonas aeruginosa PA01
ugcccagcgccgccagcagg

SEQ ID NO: 1549336 - RNA, 21 nt, Pseudomonas aeruginosa PA01
ugcccagcgccgccagcaggu

SEQ ID NO: 1549337 - RNA, 19 nt, Pseudomonas aeruginosa PA01
ugcccagcgccgccugcug

SEQ ID NO: 1549338 - RNA, 23 nt, Pseudomonas aeruginosa PA01
ugcccagcgccgccugcuggcug

SEQ ID NO: 1549339 - RNA, 16 nt, Pseudomonas aeruginosa PA01
ugcccagcgcaggccg

SEQ ID NO: 1549340 - RNA, 14 nt, Pseudomonas aeruginosa PA01
ugcccagccagggc

SEQ ID NO: 1549341 - RNA, 15 nt, Pseudomonas aeruginosa PA01
ugcccagccagggcc

SEQ ID NO: 1549342 - RNA, 16 nt, Pseudomonas aeruginosa PA01
ugcccagccagggccg

SEQ ID NO: 1549343 - RNA, 22 nt, Pseudomonas aeruginosa PA01
ugcccagccgacgcgcagcggu

SEQ ID NO: 1549344 - RNA, 18 nt, Pseudomonas aeruginosa PA01
ugccgccgggggucucgu

SEQ ID NO: 1549345 - RNA, 18 nt, Pseudomonas aeruginosa PA01
ugccgccgcgcugcaggc

SEQ ID NO: 1549346 - RNA, 17 nt, Pseudomonas aeruginosa PA01
ugccgccggcgccgccg

SEQ ID NO: 1549347 - RNA, 14 nt, Pseudomonas aeruginosa PA01
ugccgccggccacc

SEQ ID NO: 1549348 - RNA, 19 nt, Pseudomonas aeruginosa PA01
ugccgccggccaccagcag

SEQ ID NO: 1549349 - RNA, 20 nt, Pseudomonas aeruginosa PA01
ugccgccuucgcgggccagg

SEQ ID NO: 1549350 - RNA, 15 nt, Pseudomonas aeruginosa PA01
ugccgcgagccagcc

SEQ ID NO: 1549351 - RNA, 17 nt, Pseudomonas aeruginosa PA01
ugccgcgagccagccgu

SEQ ID NO: 1549352 - RNA, 22 nt, Pseudomonas aeruginosa PA01
ugccgcgagcuuggcccuggcc

SEQ ID NO: 1549353 - RNA, 15 nt, Pseudomonas aeruginosa PA01
ugccgcgcgccuggc

SEQ ID NO: 1549354 - RNA, 16 nt, Pseudomonas aeruginosa PA01
ugccgcgcgccuggcu

SEQ ID NO: 1549355 - RNA, 22 nt, Pseudomonas aeruginosa PA01
ugccgcgcgccuggcuggccag

SEQ ID NO: 1549356 - RNA, 22 nt, Pseudomonas aeruginosa PA01
ugccgcgccgaugccguuaccu

SEQ ID NO: 1549357 - RNA, 13 nt, Pseudomonas aeruginosa PA01
ugccgcgcccggc

SEQ ID NO: 1549358 - RNA, 18 nt, Pseudomonas aeruginosa PA01
ugccgcgcccggccaggc

SEQ ID NO: 1549359 - RNA, 14 nt, Pseudomonas aeruginosa PA01
ugccgcgcagcuug

SEQ ID NO: 1549360 - RNA, 21 nt, Pseudomonas aeruginosa PA01
ugccgcuguaggacagguuca

SEQ ID NO: 1549361 - RNA, 16 nt, Pseudomonas aeruginosa PA01
ugccgcuggcggccuu

SEQ ID NO: 1549362 - RNA, 20 nt, Pseudomonas aeruginosa PA01
ugccggacaacaggccgggc

SEQ ID NO: 1549363 - RNA, 18 nt, Pseudomonas aeruginosa PA01
ugccggaaagccuggccg

SEQ ID NO: 1549364 - RNA, 17 nt, Pseudomonas aeruginosa PA01
ugccgcgguaggucagc

SEQ ID NO: 1549365 - RNA, 19 nt, Pseudomonas aeruginosa PA01
ugccgcgcucggaucaggc

SEQ ID NO: 1549366 - RNA, 19 nt, Pseudomonas aeruginosa PA01
ugccgcugcgcgcaguuca

SEQ ID NO: 1549367 - RNA, 16 nt, Pseudomonas aeruginosa PA01
ugccgcuggccgacca

SEQ ID NO: 1549368 - RNA, 13 nt, Pseudomonas aeruginosa PA01
ugccgcuggccuc

SEQ ID NO: 1549369 - RNA, 14 nt, Pseudomonas aeruginosa PA01
ugccgcugcaggcc

SEQ ID NO: 1549370 - RNA, 21 nt, Pseudomonas aeruginosa PA01
ugccgcucguuggcggccagc

SEQ ID NO: 1549371 - RNA, 15 nt, Pseudomonas aeruginosa PA01
ugccgcguuccuugu

SEQ ID NO: 1549372 - RNA, 13 nt, Pseudomonas aeruginosa PA01
ugccgcucagcgg

SEQ ID NO: 1549373 - RNA, 23 nt, Pseudomonas aeruginosa PA01
ugccguucaggccggcgccgccg

SEQ ID NO: 1549374 - RNA, 18 nt, Pseudomonas aeruginosa PA01
ugccguggaccaacagcc

SEQ ID NO: 1549375 - RNA, 17 nt, Pseudomonas aeruginosa PA01
ugccgugggcgccgccg

SEQ ID NO: 1549376 - RNA, 13 nt, Pseudomonas aeruginosa PA01
ugccguucucccg

SEQ ID NO: 1549377 - RNA, 17 nt, Pseudomonas aeruginosa PA01
ugccguugggccagggc

SEQ ID NO: 1549378 - RNA, 13 nt, Pseudomonas aeruginosa PA01
ugccguugcuacc

SEQ ID NO: 1549379 - RNA, 12 nt, Pseudomonas aeruginosa PA01
ugccguugcuca

SEQ ID NO: 1549380 - RNA, 18 nt, Pseudomonas aeruginosa PA01
ugccucagagucgcaccg

SEQ ID NO: 1549381 - RNA, 14 nt, Pseudomonas aeruginosa PA01
ugccgugcagcuug

SEQ ID NO: 1549382 - RNA, 16 nt, Pseudomonas aeruginosa PA01
ugccguccaggcgcga

SEQ ID NO: 1549383 - RNA, 19 nt, Pseudomonas aeruginosa PA01
ugccgucacuugaaguccc

SEQ ID NO: 1549384 - RNA, 15 nt, Pseudomonas aeruginosa PA01
ugccguaguggcguu

SEQ ID NO: 1549385 - RNA, 22 nt, Pseudomonas aeruginosa PA01
ugccgggcucugguagccgcag

SEQ ID NO: 1549386 - RNA, 20 nt, Pseudomonas aeruginosa PA01
ugccgggcuuuuucucgucg

SEQ ID NO: 1549387 - RNA, 20 nt, Pseudomonas aeruginosa PA01
ugccgggaagcgcaggccgc

SEQ ID NO: 1549388 - RNA, 21 nt, Pseudomonas aeruginosa PA01
ugccgggccagcuccagcacc

SEQ ID NO: 1549389 - RNA, 12 nt, Pseudomonas aeruginosa PA01
ugccggcacgcu

SEQ ID NO: 1549390 - RNA, 20 nt, Pseudomonas aeruginosa PA01
ugccggcggcggacgcaggc

SEQ ID NO: 1549391 - RNA, 21 nt, Pseudomonas aeruginosa PA01
ugccggcggcggacgcaggcc

SEQ ID NO: 1549392 - RNA, 22 nt, Pseudomonas aeruginosa PA01
ugccggcgggacgcgcaugcag

SEQ ID NO: 1549393 - RNA, 16 nt, Pseudomonas aeruginosa PA01
ugccggauagaggaau

SEQ ID NO: 1549394 - RNA, 20 nt, Pseudomonas aeruginosa PA01
ugccgccgaucagcgcgccu

SEQ ID NO: 1549395 - RNA, 22 nt, Pseudomonas aeruginosa PA01
ugccgccgaugcuguucagcag

SEQ ID NO: 1549396 - RNA, 19 nt, Pseudomonas aeruginosa PA01
ugccgccgcagagccagcc

SEQ ID NO: 1549397 - RNA, 19 nt, Pseudomonas aeruginosa PA01
ugccgccgccggagggaau

SEQ ID NO: 1549398 - RNA, 21 nt, Pseudomonas aeruginosa PA01
ugccgcccggcgccaccgcgu

SEQ ID NO: 1549399 - RNA, 22 nt, Pseudomonas aeruginosa PA01
ugccgcccugggguuucugcug

SEQ ID NO: 1549400 - RNA, 22 nt, Pseudomonas aeruginosa PA01
ugccgcccuugccauccuccag

SEQ ID NO: 1549401 - RNA, 13 nt, Pseudomonas aeruginosa PA01
ugccgcaugcagu

SEQ ID NO: 1549402 - RNA, 17 nt, Pseudomonas aeruginosa PA01
ugccgcaugcaguggaa

SEQ ID NO: 1549403 - RNA, 14 nt, Pseudomonas aeruginosa PA01
ugccgccaagcccu

SEQ ID NO: 1549404 - RNA, 19 nt, Pseudomonas aeruginosa PA01
ugccgccaucgaccaggaa

SEQ ID NO: 1549405 - RNA, 18 nt, Pseudomonas aeruginosa PA01
ugccgccagcgcggcgcu

SEQ ID NO: 1549406 - RNA, 19 nt, Pseudomonas aeruginosa PA01
ugccgccagucggccuggc

SEQ ID NO: 1549407 - RNA, 19 nt, Pseudomonas aeruginosa PA01
ugccgcaaacccccugcgc

SEQ ID NO: 1549408 - RNA, 15 nt, Pseudomonas aeruginosa PA01
ugccgaugcugauca

SEQ ID NO: 1549409 - RNA, 14 nt, Pseudomonas aeruginosa PA01
ugccgauggacagg

SEQ ID NO: 1549410 - RNA, 17 nt, Pseudomonas aeruginosa PA01
ugccgauggcgcaccac

SEQ ID NO: 1549411 - RNA, 17 nt, Pseudomonas aeruginosa PA01
ugccgauggcgccgccg

SEQ ID NO: 1549412 - RNA, 21 nt, Pseudomonas aeruginosa PA01
ugccgauggcgccgccgaggu

SEQ ID NO: 1549413 - RNA, 22 nt, Pseudomonas aeruginosa PA01
ugccgaucaguggucgcagcuc

SEQ ID NO: 1549414 - RNA, 23 nt, Pseudomonas aeruginosa PA01
ugccgaucaugggggccagcagg

SEQ ID NO: 1549415 - RNA, 18 nt, Pseudomonas aeruginosa PA01
ugccgcaggccgcggccg

SEQ ID NO: 1549416 - RNA, 17 nt, Pseudomonas aeruginosa PA01
ugccgcaggucuugucg

SEQ ID NO: 1549417 - RNA, 13 nt, Pseudomonas aeruginosa PA01
ugccgcagcgccu

SEQ ID NO: 1549418 - RNA, 13 nt, Pseudomonas aeruginosa PA01
ugccgcagcagcg

SEQ ID NO: 1549419 - RNA, 21 nt, Pseudomonas aeruginosa PA01
ugccgcagacaucgccgaggg

SEQ ID NO: 1549420 - RNA, 13 nt, Pseudomonas aeruginosa PA01
ugcccuccugcuc

SEQ ID NO: 1549421 - RNA, 14 nt, Pseudomonas aeruginosa PA01
ugcccucgcggacg

SEQ ID NO: 1549422 - RNA, 21 nt, Pseudomonas aeruginosa PA01
ugcccucgcggacgcuggcga

SEQ ID NO: 1549423 - RNA, 13 nt, Pseudomonas aeruginosa PA01
ugcccucgcggcg

SEQ ID NO: 1549424 - RNA, 20 nt, Pseudomonas aeruginosa PA01
ugcccucgcggcggcaggcc

SEQ ID NO: 1549425 - RNA, 11 nt, Pseudomonas aeruginosa PA01
ugcccuuggcu

SEQ ID NO: 1549426 - RNA, 21 nt, Pseudomonas aeruginosa PA01
ugcccuuguacagcuucaggc

SEQ ID NO: 1549427 - RNA, 17 nt, Pseudomonas aeruginosa PA01
ugcccuuguccggcccg

SEQ ID NO: 1549428 - RNA, 20 nt, Pseudomonas aeruginosa PA01
ugcccuggcagacgcugcuc

SEQ ID NO: 1549429 - RNA, 21 nt, Pseudomonas aeruginosa PA01
ugcccuggccgacgcugagga

SEQ ID NO: 1549430 - RNA, 20 nt, Pseudomonas aeruginosa PA01
ugcccuggccgcugccgcuc

SEQ ID NO: 1549431 - RNA, 12 nt, Pseudomonas aeruginosa PA01
ugcccuggcuuu

SEQ ID NO: 1549432 - RNA, 21 nt, Pseudomonas aeruginosa PA01
ugcccugggcgaacagcaccc

SEQ ID NO: 1549433 - RNA, 22 nt, Pseudomonas aeruginosa PA01
ugcccugggcgaacagcaccca

SEQ ID NO: 1549434 - RNA, 17 nt, Pseudomonas aeruginosa PA01
ugccgacgccgcggccg

SEQ ID NO: 1549435 - RNA, 22 nt, Pseudomonas aeruginosa PA01
ugccgaccuguaccgcucccca

SEQ ID NO: 1549436 - RNA, 18 nt, Pseudomonas aeruginosa PA01
ugccgaggaacgccgaca

SEQ ID NO: 1549437 - RNA, 14 nt, Pseudomonas aeruginosa PA01
ugccgaggcggccg

SEQ ID NO: 1549438 - RNA, 20 nt, Pseudomonas aeruginosa PA01
ugccgagaaucugcccggcc

SEQ ID NO: 1549439 - RNA, 14 nt, Pseudomonas aeruginosa PA01
ugccgacaagccuc

SEQ ID NO: 1549440 - RNA, 15 nt, Pseudomonas aeruginosa PA01
ugccgaagucuuuca

SEQ ID NO: 1549441 - RNA, 15 nt, Pseudomonas aeruginosa PA01
ugccgaaggcguggg

SEQ ID NO: 1549442 - RNA, 23 nt, Pseudomonas aeruginosa PA01
ugccgaagggaaacaccaggccg

SEQ ID NO: 1549443 - RNA, 18 nt, Pseudomonas aeruginosa PA01
ugccgaacuucuccgcca

SEQ ID NO: 1549444 - RNA, 19 nt, Pseudomonas aeruginosa PA01
ugccgaagaucgacaggcc

SEQ ID NO: 1549445 - RNA, 18 nt, Pseudomonas aeruginosa PA01
ugccgaacugcagggcgu

SEQ ID NO: 1549446 - RNA, 14 nt, Pseudomonas aeruginosa PA01
ugccgaacaggcgu

SEQ ID NO: 1549447 - RNA, 23 nt, Pseudomonas aeruginosa PA01
ugccgaacaccugcaucaccagg

SEQ ID NO: 1549448 - RNA, 12 nt, Pseudomonas aeruginosa PA01
ugcgcagcuucu

SEQ ID NO: 1549449 - RNA, 18 nt, Pseudomonas aeruginosa PA01
ugcgcagcuucugcaggg

SEQ ID NO: 1549450 - RNA, 20 nt, Pseudomonas aeruginosa PA01
ugcgcagcuucugcagggcg

SEQ ID NO: 1549451 - RNA, 21 nt, Pseudomonas aeruginosa PA01
ugcgcagcuucugcagggcgg

SEQ ID NO: 1549452 - RNA, 17 nt, Pseudomonas aeruginosa PA01
ugcgacuggaugcagcc

SEQ ID NO: 1549453 - RNA, 17 nt, Pseudomonas aeruginosa PA01
ugcgagacccccgggau

SEQ ID NO: 1549454 - RNA, 20 nt, Pseudomonas aeruginosa PA01
ugccugcgcccucaagucuc

SEQ ID NO: 1549455 - RNA, 20 nt, Pseudomonas aeruginosa PA01
ugccuggggacggcaggccc

SEQ ID NO: 1549456 - RNA, 12 nt, Pseudomonas aeruginosa PA01
ugccuggaauuc

SEQ ID NO: 1549457 - RNA, 17 nt, Pseudomonas aeruginosa PA01
ugcgaccagguccggag

SEQ ID NO: 1549458 - RNA, 11 nt, Pseudomonas aeruginosa PA01
ugcgaccuggc

SEQ ID NO: 1549459 - RNA, 14 nt, Pseudomonas aeruginosa PA01
ugcgacaucuccag

SEQ ID NO: 1549460 - RNA, 18 nt, Pseudomonas aeruginosa PA01
ugcgacaucuccaggccg

SEQ ID NO: 1549461 - RNA, 17 nt, Pseudomonas aeruginosa PA01
ugcgcaggugcuuguca

SEQ ID NO: 1549462 - RNA, 13 nt, Pseudomonas aeruginosa PA01
ugcgcaggcuggc

SEQ ID NO: 1549463 - RNA, 23 nt, Pseudomonas aeruginosa PA01
ugcgcaggcuggccgagcgccgc

SEQ ID NO: 1549464 - RNA, 17 nt, Pseudomonas aeruginosa PA01
ugcgcaggcugguaugc

SEQ ID NO: 1549465 - RNA, 17 nt, Pseudomonas aeruginosa PA01
ugcgcaugucguccagg

SEQ ID NO: 1549466 - RNA, 13 nt, Pseudomonas aeruginosa PA01
ugcgcaugcuggg

SEQ ID NO: 1549467 - RNA, 21 nt, Pseudomonas aeruginosa PA01
ugcgccccagcgccugggccg

SEQ ID NO: 1549468 - RNA, 19 nt, Pseudomonas aeruginosa PA01
ugcgcccagggacgcgccg

SEQ ID NO: 1549469 - RNA, 14 nt, Pseudomonas aeruginosa PA01
aaauggcagaacau

SEQ ID NO: 1549470 - RNA, 20 nt, Pseudomonas aeruginosa PA01
aaauggccgcuucaagcggc

SEQ ID NO: 1549471 - RNA, 15 nt, Pseudomonas aeruginosa PA01
ugcgccucgccgccc

SEQ ID NO: 1549472 - RNA, 23 nt, Pseudomonas aeruginosa PA01
ugcgccucgcuggcguucuccag

SEQ ID NO: 1549473 - RNA, 12 nt, Pseudomonas aeruginosa PA01
ugcgccucccgc

SEQ ID NO: 1549474 - RNA, 16 nt, Pseudomonas aeruginosa PA01
ugcgccucgaccuggc

SEQ ID NO: 1549475 - RNA, 22 nt, Pseudomonas aeruginosa PA01
aaauggucaccaugaucaucgg

SEQ ID NO: 1549476 - RNA, 19 nt, Pseudomonas aeruginosa PA01
aaauggguucccagcagca

SEQ ID NO: 1549477 - RNA, 19 nt, Pseudomonas aeruginosa PA01
ugcgcgaucccccgccccu

SEQ ID NO: 1549478 - RNA, 22 nt, Pseudomonas aeruginosa PA01
ugcgcgcaccauagcgagccgc

SEQ ID NO: 1549479 - RNA, 20 nt, Pseudomonas aeruginosa PA01
ugcgcgaaugguucaucuuc

SEQ ID NO: 1549480 - RNA, 23 nt, Pseudomonas aeruginosa PA01
ugcguagggcgaguaagcgcggu

SEQ ID NO: 1549481 - RNA, 18 nt, Pseudomonas aeruginosa PA01
ugcguaguugagccccag

SEQ ID NO: 1549482 - RNA, 15 nt, Pseudomonas aeruginosa PA01
ugcguaccagcgcgc

SEQ ID NO: 1549483 - RNA, 18 nt, Pseudomonas aeruginosa PA01
ugcggguggucgccgccc

SEQ ID NO: 1549484 - RNA, 15 nt, Pseudomonas aeruginosa PA01
ugcggguugccgcag

SEQ ID NO: 1549485 - RNA, 20 nt, Pseudomonas aeruginosa PA01
ugcggccugcaacgccgcca

SEQ ID NO: 1549486 - RNA, 19 nt, Pseudomonas aeruginosa PA01
ugcggccgaucaucggcug

SEQ ID NO: 1549487 - RNA, 22 nt, Pseudomonas aeruginosa PA01
ugcgggcagacaccaccagguu

SEQ ID NO: 1549488 - RNA, 19 nt, Pseudomonas aeruginosa PA01
ugcggcccgccacagaucg

SEQ ID NO: 1549489 - RNA, 21 nt, Pseudomonas aeruginosa PA01
ugcggcccagcggcaggucgu

SEQ ID NO: 1549490 - RNA, 19 nt, Pseudomonas aeruginosa PA01
ugcggccccaaggggccgc

SEQ ID NO: 1549491 - RNA, 12 nt, Pseudomonas aeruginosa PA01
ugcggccagcgc

SEQ ID NO: 1549492 - RNA, 18 nt, Pseudomonas aeruginosa PA01
ugcggccagcgccaggag

SEQ ID NO: 1549493 - RNA, 20 nt, Pseudomonas aeruginosa PA01
ugcggccagcgccaggagca

SEQ ID NO: 1549494 - RNA, 21 nt, Pseudomonas aeruginosa PA01
ugcgggcugcgugccagcacc

SEQ ID NO: 1549495 - RNA, 22 nt, Pseudomonas aeruginosa PA01
ugcggggaaagcuccucggccu

SEQ ID NO: 1549496 - RNA, 19 nt, Pseudomonas aeruginosa PA01
ugcgggcguagcgcggcag

SEQ ID NO: 1549497 - RNA, 17 nt, Pseudomonas aeruginosa PA01
ugcgggcgagcagggag

SEQ ID NO: 1549498 - RNA, 16 nt, Pseudomonas aeruginosa PA01
ugcggaucgaggaauu

SEQ ID NO: 1549499 - RNA, 15 nt, Pseudomonas aeruginosa PA01
ugcggagagguggcc

SEQ ID NO: 1549500 - RNA, 14 nt, Pseudomonas aeruginosa PA01
ugcggagggucagg

SEQ ID NO: 1549501 - RNA, 20 nt, Pseudomonas aeruginosa PA01
ugcgcugcaucggcgcgccg

SEQ ID NO: 1549502 - RNA, 18 nt, Pseudomonas aeruginosa PA01
ugcgcuacggcaucaccg

SEQ ID NO: 1549503 - RNA, 14 nt, Pseudomonas aeruginosa PA01
ugcgcgccgggucg

SEQ ID NO: 1549504 - RNA, 13 nt, Pseudomonas aeruginosa PA01
ugcgcgccgccgg

SEQ ID NO: 1549505 - RNA, 14 nt, Pseudomonas aeruginosa PA01
ugcgcgccaccagc

SEQ ID NO: 1549506 - RNA, 18 nt, Pseudomonas aeruginosa PA01
ugcgcgcauagcaggccu

SEQ ID NO: 1549507 - RNA, 13 nt, Pseudomonas aeruginosa PA01
ugcgcgccagcgc

SEQ ID NO: 1549508 - RNA, 23 nt, Pseudomonas aeruginosa PA01
ugcgcggcgccgguugcugcugg

SEQ ID NO: 1549509 - RNA, 23 nt, Pseudomonas aeruginosa PA01
ugcgcgcggcgucgaccacggcc

SEQ ID NO: 1549510 - RNA, 22 nt, Pseudomonas aeruginosa PA01
ugcgcggcaggaucaggcucga

SEQ ID NO: 1549511 - RNA, 16 nt, Pseudomonas aeruginosa PA01
ugcgcggcagguggcu

SEQ ID NO: 1549512 - RNA, 18 nt, Pseudomonas aeruginosa PA01
ugcgcgugcuggugccga

SEQ ID NO: 1549513 - RNA, 14 nt, Pseudomonas aeruginosa PA01
ugcgcggucaccag

SEQ ID NO: 1549514 - RNA, 19 nt, Pseudomonas aeruginosa PA01
ugcgcggucaccaggguca

SEQ ID NO: 1549515 - RNA, 19 nt, Pseudomonas aeruginosa PA01
ugagccucuaaggaaaaac

SEQ ID NO: 1549516 - RNA, 23 nt, Pseudomonas aeruginosa PA01
ugagccgggguucuucguuccug

SEQ ID NO: 1549517 - RNA, 21 nt, Pseudomonas aeruginosa PA01
ugagccauucggcuuccuggg

SEQ ID NO: 1549518 - RNA, 23 nt, Pseudomonas aeruginosa PA01
ugagccccggcgucggcgcgggc

SEQ ID NO: 1549519 - RNA, 12 nt, Pseudomonas aeruginosa PA01
ugagcaucaccg

SEQ ID NO: 1549520 - RNA, 22 nt, Pseudomonas aeruginosa PA01
ugagauggucgaaccagcucag

SEQ ID NO: 1549521 - RNA, 18 nt, Pseudomonas aeruginosa PA01
ugagcaccggaaaggcgu

SEQ ID NO: 1549522 - RNA, 18 nt, Pseudomonas aeruginosa PA01
ugagcaccggcagugaga

SEQ ID NO: 1549523 - RNA, 15 nt, Pseudomonas aeruginosa PA01
ugagcaggccgacgg

SEQ ID NO: 1549524 - RNA, 17 nt, Pseudomonas aeruginosa PA01
ugagcagggccgagcgc

SEQ ID NO: 1549525 - RNA, 20 nt, Pseudomonas aeruginosa PA01
ugagcagggccgagcgcagc

SEQ ID NO: 1549526 - RNA, 13 nt, Pseudomonas aeruginosa PA01
ugagcagccaggc

SEQ ID NO: 1549527 - RNA, 18 nt, Pseudomonas aeruginosa PA01
ugaccuucagguagaugu

SEQ ID NO: 1549528 - RNA, 15 nt, Pseudomonas aeruginosa PA01
ugaggauuuucuccg

SEQ ID NO: 1549529 - RNA, 13 nt, Pseudomonas aeruginosa PA01
ugagcugugguug

SEQ ID NO: 1549530 - RNA, 17 nt, Pseudomonas aeruginosa PA01
ugagcuggcgcuggucc

SEQ ID NO: 1549531 - RNA, 13 nt, Pseudomonas aeruginosa PA01
ugagcuggcuguc

SEQ ID NO: 1549532 - RNA, 19 nt, Pseudomonas aeruginosa PA01
ugaguagcuggcgcagggc

SEQ ID NO: 1549533 - RNA, 17 nt, Pseudomonas aeruginosa PA01
ugagguucaggccgggc

SEQ ID NO: 1549534 - RNA, 15 nt, Pseudomonas aeruginosa PA01
ugagguucaugccgc

SEQ ID NO: 1549535 - RNA, 17 nt, Pseudomonas aeruginosa PA01
ugaggcccaucaggaug

SEQ ID NO: 1549536 - RNA, 18 nt, Pseudomonas aeruginosa PA01
ugagucgcaggcucaguu

SEQ ID NO: 1549537 - RNA, 14 nt, Pseudomonas aeruginosa PA01
ugaguugcaggccg

SEQ ID NO: 1549538 - RNA, 14 nt, Pseudomonas aeruginosa PA01
ugaguuugcccagc

SEQ ID NO: 1549539 - RNA, 19 nt, Pseudomonas aeruginosa PA01
ugaucccuagggguucucc

SEQ ID NO: 1549540 - RNA, 19 nt, Pseudomonas aeruginosa PA01
ugaucacccgcccgccguc

SEQ ID NO: 1549541 - RNA, 13 nt, Pseudomonas aeruginosa PA01
ugaucaccagacc

SEQ ID NO: 1549542 - RNA, 14 nt, Pseudomonas aeruginosa PA01
ugaucaccagaccg

SEQ ID NO: 1549543 - RNA, 18 nt, Pseudomonas aeruginosa PA01
ugaucaccagccacugcu

SEQ ID NO: 1549544 - RNA, 14 nt, Pseudomonas aeruginosa PA01
ugaucacccagagc

SEQ ID NO: 1549545 - RNA, 18 nt, Pseudomonas aeruginosa PA01
ugaugaagcccgcggcau

SEQ ID NO: 1549546 - RNA, 23 nt, Pseudomonas aeruginosa PA01
ugaugccgauggacaggcugggc

SEQ ID NO: 1549547 - RNA, 14 nt, Pseudomonas aeruginosa PA01
ugaugccgugcagc

SEQ ID NO: 1549548 - RNA, 22 nt, Pseudomonas aeruginosa PA01
ugaugccguucacuaucucgcu

SEQ ID NO: 1549549 - RNA, 16 nt, Pseudomonas aeruginosa PA01
ugaugcaggcagugug

SEQ ID NO: 1549550 - RNA, 22 nt, Pseudomonas aeruginosa PA01
ugaugugcaguucgaccuccag

SEQ ID NO: 1549551 - RNA, 14 nt, Pseudomonas aeruginosa PA01
ugauguaggacagg

SEQ ID NO: 1549552 - RNA, 15 nt, Pseudomonas aeruginosa PA01
ugaugguaucgccgu

SEQ ID NO: 1549553 - RNA, 20 nt, Pseudomonas aeruginosa PA01
ugacacggauauccgggccc

SEQ ID NO: 1549554 - RNA, 17 nt, Pseudomonas aeruginosa PA01
ugaccgcgugggccggc

SEQ ID NO: 1549555 - RNA, 15 nt, Pseudomonas aeruginosa PA01
ugaccugcagcgccu

SEQ ID NO: 1549556 - RNA, 18 nt, Pseudomonas aeruginosa PA01
ugaccucggccagccagg

SEQ ID NO: 1549557 - RNA, 22 nt, Pseudomonas aeruginosa PA01
ugaccucgacgccgagccagcc

SEQ ID NO: 1549558 - RNA, 23 nt, Pseudomonas aeruginosa PA01
ugaccucgagcuggacgcgcuug

SEQ ID NO: 1549559 - RNA, 17 nt, Pseudomonas aeruginosa PA01
ugaccuggccgucccug

SEQ ID NO: 1549560 - RNA, 21 nt, Pseudomonas aeruginosa PA01
ugaccugguagucgcgguugc

SEQ ID NO: 1549561 - RNA, 20 nt, Pseudomonas aeruginosa PA01
ugaccuggucguugcgcgca

SEQ ID NO: 1549562 - RNA, 20 nt, Pseudomonas aeruginosa PA01
ugaccugguugcgccauugc

SEQ ID NO: 1549563 - RNA, 20 nt, Pseudomonas aeruginosa PA01
ugaccuguccagucaccagg

SEQ ID NO: 1549564 - RNA, 22 nt, Pseudomonas aeruginosa PA01
ugaccuguccagucaccagguc

SEQ ID NO: 1549565 - RNA, 17 nt, Pseudomonas aeruginosa PA01
ugaccugcugggccagc

SEQ ID NO: 1549566 - RNA, 20 nt, Pseudomonas aeruginosa PA01
ugaccugcugggccagcgcc

SEQ ID NO: 1549567 - RNA, 22 nt, Pseudomonas aeruginosa PA01
ugaccugcugggccagcgccgu

SEQ ID NO: 1549568 - RNA, 15 nt, Pseudomonas aeruginosa PA01
ugaccaggcugauca

SEQ ID NO: 1549569 - RNA, 20 nt, Pseudomonas aeruginosa PA01
ugaccaggcugaucagcccg

SEQ ID NO: 1549570 - RNA, 15 nt, Pseudomonas aeruginosa PA01
ugaccagcggcaccg

SEQ ID NO: 1549571 - RNA, 22 nt, Pseudomonas aeruginosa PA01
ugaccagcggcaccgagagcug

SEQ ID NO: 1549572 - RNA, 13 nt, Pseudomonas aeruginosa PA01
ugaccauaggcuu

SEQ ID NO: 1549573 - RNA, 22 nt, Pseudomonas aeruginosa PA01
ugaccauaggcuugcgccgaag

SEQ ID NO: 1549574 - RNA, 17 nt, Pseudomonas aeruginosa PA01
ugacauccaccaggguc

SEQ ID NO: 1549575 - RNA, 22 nt, Pseudomonas aeruginosa PA01
ucuucguggacggacagggaaa

SEQ ID NO: 1549576 - RNA, 13 nt, Pseudomonas aeruginosa PA01
ucuucguagguca

SEQ ID NO: 1549577 - RNA, 17 nt, Pseudomonas aeruginosa PA01
ugaacaccucuucgcca

SEQ ID NO: 1549578 - RNA, 14 nt, Pseudomonas aeruginosa PA01
ugaacaccagcgaa

SEQ ID NO: 1549579 - RNA, 17 nt, Pseudomonas aeruginosa PA01
ugaauagcagccauagc

SEQ ID NO: 1549580 - RNA, 14 nt, Pseudomonas aeruginosa PA01
ugaagaucaucugg

SEQ ID NO: 1549581 - RNA, 14 nt, Pseudomonas aeruginosa PA01
ugaagccgcgcgcc

SEQ ID NO: 1549582 - RNA, 21 nt, Pseudomonas aeruginosa PA01
ugaagccgccgcccagcagca

SEQ ID NO: 1549583 - RNA, 21 nt, Pseudomonas aeruginosa PA01
ugaagcccuucugucuugucc

SEQ ID NO: 1549584 - RNA, 20 nt, Pseudomonas aeruginosa PA01
ugaagccccuggcgcugggc

SEQ ID NO: 1549585 - RNA, 13 nt, Pseudomonas aeruginosa PA01
ugaaggugcccag

SEQ ID NO: 1549586 - RNA, 14 nt, Pseudomonas aeruginosa PA01
ugaagagcagcacc

SEQ ID NO: 1549587 - RNA, 18 nt, Pseudomonas aeruginosa PA01
ucgccuugaccagcggcc

SEQ ID NO: 1549588 - RNA, 21 nt, Pseudomonas aeruginosa PA01
ucgccuuccaccaccaggguc

SEQ ID NO: 1549589 - RNA, 16 nt, Pseudomonas aeruginosa PA01
ucgcgacugcugauca

SEQ ID NO: 1549590 - RNA, 16 nt, Pseudomonas aeruginosa PA01
ucgcgaagaccggccg

SEQ ID NO: 1549591 - RNA, 20 nt, Pseudomonas aeruginosa PA01
ucgcgccgcgccagcaggcg

SEQ ID NO: 1549592 - RNA, 15 nt, Pseudomonas aeruginosa PA01
ucgcgcagcggcgcg

SEQ ID NO: 1549593 - RNA, 13 nt, Pseudomonas aeruginosa PA01
ucgcgcagcggcu

SEQ ID NO: 1549594 - RNA, 14 nt, Pseudomonas aeruginosa PA01
ucgcgcagcggcuc

SEQ ID NO: 1549595 - RNA, 18 nt, Pseudomonas aeruginosa PA01
ucgcgcagggccagggcg

SEQ ID NO: 1549596 - RNA, 20 nt, Pseudomonas aeruginosa PA01
ucgcgcagggccagggcggc

SEQ ID NO: 1549597 - RNA, 23 nt, Pseudomonas aeruginosa PA01
ucgcgcaggugcuuggcaccgcg

SEQ ID NO: 1549598 - RNA, 19 nt, Pseudomonas aeruginosa PA01
ucgcgcaacgccgacggcg

SEQ ID NO: 1549599 - RNA, 14 nt, Pseudomonas aeruginosa PA01
ucgcgcaacugcuc

SEQ ID NO: 1549600 - RNA, 15 nt, Pseudomonas aeruginosa PA01
ucgcgcaccgcggcg

SEQ ID NO: 1549601 - RNA, 13 nt, Pseudomonas aeruginosa PA01
ucgcgcagccagu

SEQ ID NO: 1549602 - RNA, 14 nt, Pseudomonas aeruginosa PA01
ucgcgcacgcugua

SEQ ID NO: 1549603 - RNA, 12 nt, Pseudomonas aeruginosa PA01
ucgcgcacggcg

SEQ ID NO: 1549604 - RNA, 16 nt, Pseudomonas aeruginosa PA01
ucgcgcagcaggcggc

SEQ ID NO: 1549605 - RNA, 22 nt, Pseudomonas aeruginosa PA01
ucgccgccggcgaacagccagc

SEQ ID NO: 1549606 - RNA, 13 nt, Pseudomonas aeruginosa PA01
ucgccgccgggcg

SEQ ID NO: 1549607 - RNA, 10 nt, Pseudomonas aeruginosa PA01
ucgccgcgac

SEQ ID NO: 1549608 - RNA, 19 nt, Pseudomonas aeruginosa PA01
ucgccgcgaccugcucguc

SEQ ID NO: 1549609 - RNA, 22 nt, Pseudomonas aeruginosa PA01
ucgccgcgcgccaucaguuccu

SEQ ID NO: 1549610 - RNA, 18 nt, Pseudomonas aeruginosa PA01
ucgccgcgccgccgaggg

SEQ ID NO: 1549611 - RNA, 15 nt, Pseudomonas aeruginosa PA01
ucgccgcugcuggca

SEQ ID NO: 1549612 - RNA, 21 nt, Pseudomonas aeruginosa PA01
ucgccgcugaaguccuggccg

SEQ ID NO: 1549613 - RNA, 14 nt, Pseudomonas aeruginosa PA01
ucgccggaagcuuc

SEQ ID NO: 1549614 - RNA, 21 nt, Pseudomonas aeruginosa PA01
ucgccggaagcuucaggcucg

SEQ ID NO: 1549615 - RNA, 13 nt, Pseudomonas aeruginosa PA01
ucgccggccaggu

SEQ ID NO: 1549616 - RNA, 22 nt, Pseudomonas aeruginosa PA01
ucgccggccagguagcggcguu

SEQ ID NO: 1549617 - RNA, 16 nt, Pseudomonas aeruginosa PA01
ucgccgcggcagaucc

SEQ ID NO: 1549618 - RNA, 19 nt, Pseudomonas aeruginosa PA01
ucgccggcgcgggcggccu

SEQ ID NO: 1549619 - RNA, 11 nt, Pseudomonas aeruginosa PA01
ucgccggcguc

SEQ ID NO: 1549620 - RNA, 16 nt, Pseudomonas aeruginosa PA01
ucgccuccaccagcgc

SEQ ID NO: 1549621 - RNA, 21 nt, Pseudomonas aeruginosa PA01
ucgccucccgccaaauggcuc

SEQ ID NO: 1549622 - RNA, 17 nt, Pseudomonas aeruginosa PA01
ucgccucccggcucgcc

SEQ ID NO: 1549623 - RNA, 20 nt, Pseudomonas aeruginosa PA01
ucgccucgaacauggccacc

SEQ ID NO: 1549624 - RNA, 23 nt, Pseudomonas aeruginosa PA01
ucgccucgggccaugagcagggc

SEQ ID NO: 1549625 - RNA, 12 nt, Pseudomonas aeruginosa PA01
ucgccucggcca

SEQ ID NO: 1549626 - RNA, 14 nt, Pseudomonas aeruginosa PA01
ucgccggucaggcu

SEQ ID NO: 1549627 - RNA, 19 nt, Pseudomonas aeruginosa PA01
ucgccggguguuuuuccuc

SEQ ID NO: 1549628 - RNA, 16 nt, Pseudomonas aeruginosa PA01
ucgccggguuguccag

SEQ ID NO: 1549629 - RNA, 20 nt, Pseudomonas aeruginosa PA01
ucgccgugguggccguggcg

SEQ ID NO: 1549630 - RNA, 18 nt, Pseudomonas aeruginosa PA01
ucgccgucgucacggaac

SEQ ID NO: 1549631 - RNA, 16 nt, Pseudomonas aeruginosa PA01
ucgccgucgagccagc

SEQ ID NO: 1549632 - RNA, 18 nt, Pseudomonas aeruginosa PA01
ucgccgucgagccagccc

SEQ ID NO: 1549633 - RNA, 17 nt, Pseudomonas aeruginosa PA01
ucgccgucuuccaccag

SEQ ID NO: 1549634 - RNA, 22 nt, Pseudomonas aeruginosa PA01
ucgccguucagguucagggugg

SEQ ID NO: 1549635 - RNA, 19 nt, Pseudomonas aeruginosa PA01
ucgccgaccacuuccaggu

SEQ ID NO: 1549636 - RNA, 21 nt, Pseudomonas aeruginosa PA01
ucgccgaccacuuccagguag

SEQ ID NO: 1549637 - RNA, 22 nt, Pseudomonas aeruginosa PA01
ucgccgaacggcagcuggaucc

SEQ ID NO: 1549638 - RNA, 16 nt, Pseudomonas aeruginosa PA01
ucgccgaagacgccug

SEQ ID NO: 1549639 - RNA, 23 nt, Pseudomonas aeruginosa PA01
ucgccgaagauccgcuccaggcu

SEQ ID NO: 1549640 - RNA, 18 nt, Pseudomonas aeruginosa PA01
ucgcccuugaccaguccc

SEQ ID NO: 1549641 - RNA, 21 nt, Pseudomonas aeruginosa PA01
ucgccgagcgccgccaggcag

SEQ ID NO: 1549642 - RNA, 17 nt, Pseudomonas aeruginosa PA01
ucgccgacuuccaggcg

SEQ ID NO: 1549643 - RNA, 20 nt, Pseudomonas aeruginosa PA01
ucgccgacguccuccaggac

SEQ ID NO: 1549644 - RNA, 14 nt, Pseudomonas aeruginosa PA01
ucgccgacccugca

SEQ ID NO: 1549645 - RNA, 23 nt, Pseudomonas aeruginosa PA01
ucgcccugcggauggcgcggggc

SEQ ID NO: 1549646 - RNA, 18 nt, Pseudomonas aeruginosa PA01
ucgcccuggccucggcgu

SEQ ID NO: 1549647 - RNA, 16 nt, Pseudomonas aeruginosa PA01
ucgccgccgcagccgu

SEQ ID NO: 1549648 - RNA, 10 nt, Pseudomonas aeruginosa PA01
ucgccgccgg

SEQ ID NO: 1549649 - RNA, 13 nt, Pseudomonas aeruginosa PA01
ucgccgccgccag

SEQ ID NO: 1549650 - RNA, 14 nt, Pseudomonas aeruginosa PA01
ucgccgcccacgcc

SEQ ID NO: 1549651 - RNA, 18 nt, Pseudomonas aeruginosa PA01
ucgccgcccgcgccucca

SEQ ID NO: 1549652 - RNA, 13 nt, Pseudomonas aeruginosa PA01
ucgccgccgacac

SEQ ID NO: 1549653 - RNA, 17 nt, Pseudomonas aeruginosa PA01
ucgccgccgagcgccug

SEQ ID NO: 1549654 - RNA, 19 nt, Pseudomonas aeruginosa PA01
ucgccgccgagcgccuggc

SEQ ID NO: 1549655 - RNA, 13 nt, Pseudomonas aeruginosa PA01
ucgccgccgaggc

SEQ ID NO: 1549656 - RNA, 13 nt, Pseudomonas aeruginosa PA01
ucgccgaugcccg

SEQ ID NO: 1549657 - RNA, 16 nt, Pseudomonas aeruginosa PA01
ucgccgaugcccgggc

SEQ ID NO: 1549658 - RNA, 16 nt, Pseudomonas aeruginosa PA01
ucgccgaggggcggga

SEQ ID NO: 1549659 - RNA, 17 nt, Pseudomonas aeruginosa PA01
ucgccgcagcccuaggc

SEQ ID NO: 1549660 - RNA, 16 nt, Pseudomonas aeruginosa PA01
ucgccgcaccggcgau

SEQ ID NO: 1549661 - RNA, 15 nt, Pseudomonas aeruginosa PA01
ucgccauggcgcugc

SEQ ID NO: 1549662 - RNA, 14 nt, Pseudomonas aeruginosa PA01
ucgccauuggccag

SEQ ID NO: 1549663 - RNA, 16 nt, Pseudomonas aeruginosa PA01
ucgccauuggccaggg

SEQ ID NO: 1549664 - RNA, 12 nt, Pseudomonas aeruginosa PA01
ucgcccaccuug

SEQ ID NO: 1549665 - RNA, 18 nt, Pseudomonas aeruginosa PA01
ucgccaugcggcaggccu

SEQ ID NO: 1549666 - RNA, 14 nt, Pseudomonas aeruginosa PA01
ucgcccagcggcug

SEQ ID NO: 1549667 - RNA, 12 nt, Pseudomonas aeruginosa PA01
ucgcccaggccg

SEQ ID NO: 1549668 - RNA, 12 nt, Pseudomonas aeruginosa PA01
ucgcccagggcc

SEQ ID NO: 1549669 - RNA, 15 nt, Pseudomonas aeruginosa PA01
ucgcccgcugcgcug

SEQ ID NO: 1549670 - RNA, 22 nt, Pseudomonas aeruginosa PA01
ucgccccguuggugcccuugau

SEQ ID NO: 1549671 - RNA, 13 nt, Pseudomonas aeruginosa PA01
ucgcccggcugca

SEQ ID NO: 1549672 - RNA, 19 nt, Pseudomonas aeruginosa PA01
ucgcccggcugcacagguu

SEQ ID NO: 1549673 - RNA, 20 nt, Pseudomonas aeruginosa PA01
ucgcccuacccgacaggcag

SEQ ID NO: 1549674 - RNA, 21 nt, Pseudomonas aeruginosa PA01
ucgcccuaccgcccacccugc

SEQ ID NO: 1549675 - RNA, 20 nt, Pseudomonas aeruginosa PA01
ucgcccuacggccccaggcu

SEQ ID NO: 1549676 - RNA, 12 nt, Pseudomonas aeruginosa PA01
ucgcccucagca

SEQ ID NO: 1549677 - RNA, 20 nt, Pseudomonas aeruginosa PA01
ucgcccauggcacgcagggc

SEQ ID NO: 1549678 - RNA, 20 nt, Pseudomonas aeruginosa PA01
ucgcccccaccgcccccgca

SEQ ID NO: 1549679 - RNA, 21 nt, Pseudomonas aeruginosa PA01
ucgccaagguacggggcugcg

SEQ ID NO: 1549680 - RNA, 15 nt, Pseudomonas aeruginosa PA01
ucgccaagcccggcg

SEQ ID NO: 1549681 - RNA, 16 nt, Pseudomonas aeruginosa PA01
ucgccacgccggcgcu

SEQ ID NO: 1549682 - RNA, 13 nt, Pseudomonas aeruginosa PA01
ucgccacgcugcu

SEQ ID NO: 1549683 - RNA, 16 nt, Pseudomonas aeruginosa PA01
ucgccacgcugcugcc

SEQ ID NO: 1549684 - RNA, 17 nt, Pseudomonas aeruginosa PA01
ucgccacgcugcugccg

SEQ ID NO: 1549685 - RNA, 12 nt, Pseudomonas aeruginosa PA01
ucgccaccagca

SEQ ID NO: 1549686 - RNA, 19 nt, Pseudomonas aeruginosa PA01
ucgccaccuguuccacgag

SEQ ID NO: 1549687 - RNA, 14 nt, Pseudomonas aeruginosa PA01
ucgccaggcugauc

SEQ ID NO: 1549688 - RNA, 16 nt, Pseudomonas aeruginosa PA01
ucgccaggcgauccag

SEQ ID NO: 1549689 - RNA, 20 nt, Pseudomonas aeruginosa PA01
ucgccagggggaucgcgaag

SEQ ID NO: 1549690 - RNA, 16 nt, Pseudomonas aeruginosa PA01
ucgccagcggccaggg

SEQ ID NO: 1549691 - RNA, 13 nt, Pseudomonas aeruginosa PA01
ucgccagcggcgu

SEQ ID NO: 1549692 - RNA, 21 nt, Pseudomonas aeruginosa PA01
ucgccagcggcguauccucgg

SEQ ID NO: 1549693 - RNA, 18 nt, Pseudomonas aeruginosa PA01
ucgccagcucgccgcgcu

SEQ ID NO: 1549694 - RNA, 20 nt, Pseudomonas aeruginosa PA01
ucgccagcucgccgcgcucc

SEQ ID NO: 1549695 - RNA, 21 nt, Pseudomonas aeruginosa PA01
ucgccagcucgccgcgcucca

SEQ ID NO: 1549696 - RNA, 17 nt, Pseudomonas aeruginosa PA01
ucgccagcccguagucg

SEQ ID NO: 1549697 - RNA, 18 nt, Pseudomonas aeruginosa PA01
ucgccagccucggcgaag

SEQ ID NO: 1549698 - RNA, 14 nt, Pseudomonas aeruginosa PA01
ucgcucucgcgcuu

SEQ ID NO: 1549699 - RNA, 14 nt, Pseudomonas aeruginosa PA01
ucgcugaccggccg

SEQ ID NO: 1549700 - RNA, 19 nt, Pseudomonas aeruginosa PA01
ucgcugaccggccgcagca

SEQ ID NO: 1549701 - RNA, 14 nt, Pseudomonas aeruginosa PA01
ucgcugagcggcug

SEQ ID NO: 1549702 - RNA, 19 nt, Pseudomonas aeruginosa PA01
ucgcugacgccauucaggc

SEQ ID NO: 1549703 - RNA, 23 nt, Pseudomonas aeruginosa PA01
ucgcugacuuccaucagcuccac

SEQ ID NO: 1549704 - RNA, 14 nt, Pseudomonas aeruginosa PA01
ucgcuggccugcag

SEQ ID NO: 1549705 - RNA, 23 nt, Pseudomonas aeruginosa PA01
ucgcuggcgaagaaccacuggau

SEQ ID NO: 1549706 - RNA, 21 nt, Pseudomonas aeruginosa PA01
ucgcugggcgccggcaggccu

SEQ ID NO: 1549707 - RNA, 20 nt, Pseudomonas aeruginosa PA01
ucgcuggguuuucuggcagg

SEQ ID NO: 1549708 - RNA, 17 nt, Pseudomonas aeruginosa PA01
ucgcugcccaucgccuc

SEQ ID NO: 1549709 - RNA, 23 nt, Pseudomonas aeruginosa PA01
ucgcugccggucaggcuggugcc

SEQ ID NO: 1549710 - RNA, 15 nt, Pseudomonas aeruginosa PA01
ucgcugcucagggcc

SEQ ID NO: 1549711 - RNA, 23 nt, Pseudomonas aeruginosa PA01
ucgcuccgcuaagcgucacuccc

SEQ ID NO: 1549712 - RNA, 14 nt, Pseudomonas aeruginosa PA01
ucgcucccaggcuc

SEQ ID NO: 1549713 - RNA, 12 nt, Pseudomonas aeruginosa PA01
ucgcuccgggcc

SEQ ID NO: 1549714 - RNA, 13 nt, Pseudomonas aeruginosa PA01
ucgcuccucagag

SEQ ID NO: 1549715 - RNA, 13 nt, Pseudomonas aeruginosa PA01
ucgcuccagaccu

SEQ ID NO: 1549716 - RNA, 23 nt, Pseudomonas aeruginosa PA01
ucgcucaacggcgugccgggcag

SEQ ID NO: 1549717 - RNA, 15 nt, Pseudomonas aeruginosa PA01
ucgcuauccaccguc

SEQ ID NO: 1549718 - RNA, 16 nt, Pseudomonas aeruginosa PA01
ucgcgguugcgcugcu

SEQ ID NO: 1549719 - RNA, 17 nt, Pseudomonas aeruginosa PA01
ucgcguucgcuccgggc

SEQ ID NO: 1549720 - RNA, 17 nt, Pseudomonas aeruginosa PA01
ucgcggccucuucgucg

SEQ ID NO: 1549721 - RNA, 13 nt, Pseudomonas aeruginosa PA01
ucgcggcggcgcg

SEQ ID NO: 1549722 - RNA, 22 nt, Pseudomonas aeruginosa PA01
ucgcgggcgauggcccguucca

SEQ ID NO: 1549723 - RNA, 13 nt, Pseudomonas aeruginosa PA01
ucgcgggccaggc

SEQ ID NO: 1549724 - RNA, 14 nt, Pseudomonas aeruginosa PA01
ucgcgggccugggc

SEQ ID NO: 1549725 - RNA, 16 nt, Pseudomonas aeruginosa PA01
ucgcgggccugggcau

SEQ ID NO: 1549726 - RNA, 15 nt, Pseudomonas aeruginosa PA01
ucgcgguaggccagc

SEQ ID NO: 1549727 - RNA, 21 nt, Pseudomonas aeruginosa PA01
ucgcgggucaccaccgggaug

SEQ ID NO: 1549728 - RNA, 20 nt, Pseudomonas aeruginosa PA01
ucgcggguucgagucccguc

SEQ ID NO: 1549729 - RNA, 18 nt, Pseudomonas aeruginosa PA01
ucgcgcuggaccuggccg

SEQ ID NO: 1549730 - RNA, 15 nt, Pseudomonas aeruginosa PA01
ucgcgcugcccggcg

SEQ ID NO: 1549731 - RNA, 14 nt, Pseudomonas aeruginosa PA01
ucgcgcuccaggcc

SEQ ID NO: 1549732 - RNA, 17 nt, Pseudomonas aeruginosa PA01
ucgcggaaguaggcggc

SEQ ID NO: 1549733 - RNA, 13 nt, Pseudomonas aeruginosa PA01
ucgcgcuugccuu

SEQ ID NO: 1549734 - RNA, 17 nt, Pseudomonas aeruginosa PA01
ucgcgcugggcgcagcc

SEQ ID NO: 1549735 - RNA, 20 nt, Pseudomonas aeruginosa PA01
ucgcggccagccgcuagcgg

SEQ ID NO: 1549736 - RNA, 13 nt, Pseudomonas aeruginosa PA01
ucgcggcccuggu

SEQ ID NO: 1549737 - RNA, 15 nt, Pseudomonas aeruginosa PA01
ucgcggacgccgaag

SEQ ID NO: 1549738 - RNA, 17 nt, Pseudomonas aeruginosa PA01
ucgcggacaccgcggug

SEQ ID NO: 1549739 - RNA, 22 nt, Pseudomonas aeruginosa PA01
ucgcgcgcgcuucuugucgucg

SEQ ID NO: 1549740 - RNA, 21 nt, Pseudomonas aeruginosa PA01
ucgcgccguccaucaggcguu

SEQ ID NO: 1549741 - RNA, 23 nt, Pseudomonas aeruginosa PA01
ucgcgcgggguggccgugcagcc

SEQ ID NO: 1549742 - RNA, 19 nt, Pseudomonas aeruginosa PA01
ucgcgcgguaucccuggaa

SEQ ID NO: 1549743 - RNA, 11 nt, Pseudomonas aeruginosa PA01
ucgcgcggcca

SEQ ID NO: 1549744 - RNA, 13 nt, Pseudomonas aeruginosa PA01
ucgcgcggccagc

SEQ ID NO: 1549745 - RNA, 15 nt, Pseudomonas aeruginosa PA01
ucgcgcggccagcgu

SEQ ID NO: 1549746 - RNA, 21 nt, Pseudomonas aeruginosa PA01
ucgcgcguggccgccaggguc

SEQ ID NO: 1549747 - RNA, 22 nt, Pseudomonas aeruginosa PA01
ucgcuuucagcaaucaggaacg

SEQ ID NO: 1549748 - RNA, 15 nt, Pseudomonas aeruginosa PA01
ucgcuuuccuggccg

SEQ ID NO: 1549749 - RNA, 16 nt, Pseudomonas aeruginosa PA01
ucgcuuccucggcacu

SEQ ID NO: 1549750 - RNA, 23 nt, Pseudomonas aeruginosa PA01
ucgcuuagaacggaaugucgucg

SEQ ID NO: 1549751 - RNA, 16 nt, Pseudomonas aeruginosa PA01
ucgcugucagggcuug

SEQ ID NO: 1549752 - RNA, 17 nt, Pseudomonas aeruginosa PA01
ucgcugucgcccggguu

SEQ ID NO: 1549753 - RNA, 20 nt, Pseudomonas aeruginosa PA01
ucggaacgaccgguagccau

SEQ ID NO: 1549754 - RNA, 19 nt, Pseudomonas aeruginosa PA01
ucggacaagggccagagca

SEQ ID NO: 1549755 - RNA, 16 nt, Pseudomonas aeruginosa PA01
ucggagguucgaaucc

SEQ ID NO: 1549756 - RNA, 20 nt, Pseudomonas aeruginosa PA01
ucggagagacccgccagcgg

SEQ ID NO: 1549757 - RNA, 13 nt, Pseudomonas aeruginosa PA01
ucggacuccgccc

SEQ ID NO: 1549758 - RNA, 14 nt, Pseudomonas aeruginosa PA01
ucggacuugcucca

SEQ ID NO: 1549759 - RNA, 16 nt, Pseudomonas aeruginosa PA01
ucggagaacagcagcg

SEQ ID NO: 1549760 - RNA, 15 nt, Pseudomonas aeruginosa PA01
ucggagaaguaguca

SEQ ID NO: 1549761 - RNA, 22 nt, Pseudomonas aeruginosa PA01
ucggacggcucgcgcagcggcg

SEQ ID NO: 1549762 - RNA, 19 nt, Pseudomonas aeruginosa PA01
ucggacgacaucucguccu

SEQ ID NO: 1549763 - RNA, 18 nt, Pseudomonas aeruginosa PA01
ucggccaacugagcggcg

SEQ ID NO: 1549764 - RNA, 13 nt, Pseudomonas aeruginosa PA01
ucggccaccagcg

SEQ ID NO: 1549765 - RNA, 16 nt, Pseudomonas aeruginosa PA01
ucggccaccagggugc

SEQ ID NO: 1549766 - RNA, 22 nt, Pseudomonas aeruginosa PA01
ucggccaccuucgcccgcugcg

SEQ ID NO: 1549767 - RNA, 17 nt, Pseudomonas aeruginosa PA01
ucggcauccggcaggcg

SEQ ID NO: 1549768 - RNA, 15 nt, Pseudomonas aeruginosa PA01
ucggcacucaggaaa

SEQ ID NO: 1549769 - RNA, 16 nt, Pseudomonas aeruginosa PA01
ucggcacgcagcagcu

SEQ ID NO: 1549770 - RNA, 11 nt, Pseudomonas aeruginosa PA01
ucggcagggcg

SEQ ID NO: 1549771 - RNA, 15 nt, Pseudomonas aeruginosa PA01
ucggcagcaucagcc

SEQ ID NO: 1549772 - RNA, 13 nt, Pseudomonas aeruginosa PA01
ucggcaggaaggc

SEQ ID NO: 1549773 - RNA, 18 nt, Pseudomonas aeruginosa PA01
ucggcaggaaggccugga

SEQ ID NO: 1549774 - RNA, 18 nt, Pseudomonas aeruginosa PA01
ucggcaggaccgacucca

SEQ ID NO: 1549775 - RNA, 19 nt, Pseudomonas aeruginosa PA01
ucggcagcggauccgggug

SEQ ID NO: 1549776 - RNA, 21 nt, Pseudomonas aeruginosa PA01
ucggcagcucgcuaugcagca

SEQ ID NO: 1549777 - RNA, 21 nt, Pseudomonas aeruginosa PA01
ucggauaccagaucaccacca

SEQ ID NO: 1549778 - RNA, 22 nt, Pseudomonas aeruginosa PA01
ucggauacggcaggguagccac

SEQ ID NO: 1549779 - RNA, 19 nt, Pseudomonas aeruginosa PA01
ucggaucggauagccgugc

SEQ ID NO: 1549780 - RNA, 16 nt, Pseudomonas aeruginosa PA01
ucggaucggcccggcg

SEQ ID NO: 1549781 - RNA, 15 nt, Pseudomonas aeruginosa PA01
ucggaugcacgugca

SEQ ID NO: 1549782 - RNA, 18 nt, Pseudomonas aeruginosa PA01
ucggaugcacgugcagcu

SEQ ID NO: 1549783 - RNA, 15 nt, Pseudomonas aeruginosa PA01
ucggcaaagccgcug

SEQ ID NO: 1549784 - RNA, 13 nt, Pseudomonas aeruginosa PA01
ucggauuccagcg

SEQ ID NO: 1549785 - RNA, 18 nt, Pseudomonas aeruginosa PA01
ucgggcaccagcacggug

SEQ ID NO: 1549786 - RNA, 19 nt, Pseudomonas aeruginosa PA01
ucgggcagauguccaggca

SEQ ID NO: 1549787 - RNA, 12 nt, Pseudomonas aeruginosa PA01
ucggggcaggcg

SEQ ID NO: 1549788 - RNA, 22 nt, Pseudomonas aeruginosa PA01
ucggggcauucguccagccgcc

SEQ ID NO: 1549789 - RNA, 20 nt, Pseudomonas aeruginosa PA01
ucggggaacagcgccagcgg

SEQ ID NO: 1549790 - RNA, 16 nt, Pseudomonas aeruginosa PA01
ucgggcgucuccugcc

SEQ ID NO: 1549791 - RNA, 15 nt, Pseudomonas aeruginosa PA01
ucgggcggcaagggc

SEQ ID NO: 1549792 - RNA, 21 nt, Pseudomonas aeruginosa PA01
ucgggcgcggacaagcccagc

SEQ ID NO: 1549793 - RNA, 21 nt, Pseudomonas aeruginosa PA01
ucgggcgaaacggcaggccag

SEQ ID NO: 1549794 - RNA, 11 nt, Pseudomonas aeruginosa PA01
ucgggccgcgc

SEQ ID NO: 1549795 - RNA, 12 nt, Pseudomonas aeruginosa PA01
ucggggugcagg

SEQ ID NO: 1549796 - RNA, 15 nt, Pseudomonas aeruginosa PA01
ucggggugcgcggcg

SEQ ID NO: 1549797 - RNA, 18 nt, Pseudomonas aeruginosa PA01
ucggggugggcauaggaa

SEQ ID NO: 1549798 - RNA, 12 nt, Pseudomonas aeruginosa PA01
ucggggcugcuc

SEQ ID NO: 1549799 - RNA, 16 nt, Pseudomonas aeruginosa PA01
ucgggucgagcuugcc

SEQ ID NO: 1549800 - RNA, 22 nt, Pseudomonas aeruginosa PA01
ucgguaucgcuuccaaggguau

SEQ ID NO: 1549801 - RNA, 15 nt, Pseudomonas aeruginosa PA01
ucgguauggcugcug

SEQ ID NO: 1549802 - RNA, 20 nt, Pseudomonas aeruginosa PA01
ucgguagggccgaggucgag

SEQ ID NO: 1549803 - RNA, 20 nt, Pseudomonas aeruginosa PA01
ucgguucugcgcaccaugcc

SEQ ID NO: 1549804 - RNA, 18 nt, Pseudomonas aeruginosa PA01
ucggugugaucaccagcc

SEQ ID NO: 1549805 - RNA, 14 nt, Pseudomonas aeruginosa PA01
ucggugggcuugcc

SEQ ID NO: 1549806 - RNA, 13 nt, Pseudomonas aeruginosa PA01
ucgguggcaggaa

SEQ ID NO: 1549807 - RNA, 19 nt, Pseudomonas aeruginosa PA01
ucgguggcaggaaaugccu

SEQ ID NO: 1549808 - RNA, 16 nt, Pseudomonas aeruginosa PA01
ucgguggcgaccagga

SEQ ID NO: 1549809 - RNA, 14 nt, Pseudomonas aeruginosa PA01
ucggucaggcgcug

SEQ ID NO: 1549810 - RNA, 13 nt, Pseudomonas aeruginosa PA01
ucggucaggcuga

SEQ ID NO: 1549811 - RNA, 23 nt, Pseudomonas aeruginosa PA01
ucggugaacuucuccagguacag

SEQ ID NO: 1549812 - RNA, 20 nt, Pseudomonas aeruginosa PA01
ucggugaacgagcccaggca

SEQ ID NO: 1549813 - RNA, 15 nt, Pseudomonas aeruginosa PA01
ucggucgcgccccca

SEQ ID NO: 1549814 - RNA, 15 nt, Pseudomonas aeruginosa PA01
ucggugccgccggcg

SEQ ID NO: 1549815 - RNA, 17 nt, Pseudomonas aeruginosa PA01
ucggugcccucgcggac

SEQ ID NO: 1549816 - RNA, 15 nt, Pseudomonas aeruginosa PA01
ucggugcgggcagac

SEQ ID NO: 1549817 - RNA, 17 nt, Pseudomonas aeruginosa PA01
ucggugccuucccagcc

SEQ ID NO: 1549818 - RNA, 22 nt, Pseudomonas aeruginosa PA01
ucggugcgccccaggugcagcg

SEQ ID NO: 1549819 - RNA, 16 nt, Pseudomonas aeruginosa PA01
ucggccugaucaucug

SEQ ID NO: 1549820 - RNA, 19 nt, Pseudomonas aeruginosa PA01
ucggccugaucaucugggc

SEQ ID NO: 1549821 - RNA, 22 nt, Pseudomonas aeruginosa PA01
ucggccugaucaucugggccau

SEQ ID NO: 1549822 - RNA, 16 nt, Pseudomonas aeruginosa PA01
ucggccggcagcuccg

SEQ ID NO: 1549823 - RNA, 19 nt, Pseudomonas aeruginosa PA01
ucggccugcgucgcaucca

SEQ ID NO: 1549824 - RNA, 19 nt, Pseudomonas aeruginosa PA01
ucggccugcucgaacggcg

SEQ ID NO: 1549825 - RNA, 14 nt, Pseudomonas aeruginosa PA01
ucggccuggcugcc

SEQ ID NO: 1549826 - RNA, 13 nt, Pseudomonas aeruginosa PA01
ucggccugcugcu

SEQ ID NO: 1549827 - RNA, 19 nt, Pseudomonas aeruginosa PA01
ucggccuggggcucggcuu

SEQ ID NO: 1549828 - RNA, 22 nt, Pseudomonas aeruginosa PA01
ucggccuggggcucggcuucca

SEQ ID NO: 1549829 - RNA, 13 nt, Pseudomonas aeruginosa PA01
ucggccugguccg

SEQ ID NO: 1549830 - RNA, 14 nt, Pseudomonas aeruginosa PA01
ucggccuggugcac

SEQ ID NO: 1549831 - RNA, 23 nt, Pseudomonas aeruginosa PA01
ucggccugguuguaggcgccgcc

SEQ ID NO: 1549832 - RNA, 18 nt, Pseudomonas aeruginosa PA01
ucggccuguucgcccaag

SEQ ID NO: 1549833 - RNA, 20 nt, Pseudomonas aeruginosa PA01
ucggcgaacccggcgcggcg

SEQ ID NO: 1549834 - RNA, 16 nt, Pseudomonas aeruginosa PA01
ucggccuuagcgguug

SEQ ID NO: 1549835 - RNA, 23 nt, Pseudomonas aeruginosa PA01
ucggccuugagcgccgaaggcgu

SEQ ID NO: 1549836 - RNA, 23 nt, Pseudomonas aeruginosa PA01
ucggccuuguccgcgcgcuucca

SEQ ID NO: 1549837 - RNA, 23 nt, Pseudomonas aeruginosa PA01
ucggcgauguugcgcagggugcc

SEQ ID NO: 1549838 - RNA, 13 nt, Pseudomonas aeruginosa PA01
ucggcgauggcca

SEQ ID NO: 1549839 - RNA, 17 nt, Pseudomonas aeruginosa PA01
ucggcgcccgccugcag

SEQ ID NO: 1549840 - RNA, 20 nt, Pseudomonas aeruginosa PA01
ucggcgcccuggguggucug

SEQ ID NO: 1549841 - RNA, 17 nt, Pseudomonas aeruginosa PA01
ucggcgcccagggcuuc

SEQ ID NO: 1549842 - RNA, 16 nt, Pseudomonas aeruginosa PA01
ucggcgcccagguagg

SEQ ID NO: 1549843 - RNA, 15 nt, Pseudomonas aeruginosa PA01
ucggcgagcagguag

SEQ ID NO: 1549844 - RNA, 14 nt, Pseudomonas aeruginosa PA01
ucggcgagccggcg

SEQ ID NO: 1549845 - RNA, 15 nt, Pseudomonas aeruginosa PA01
ucggcgaggccggcg

SEQ ID NO: 1549846 - RNA, 13 nt, Pseudomonas aeruginosa PA01
ucggcgaagcgga

SEQ ID NO: 1549847 - RNA, 13 nt, Pseudomonas aeruginosa PA01
ucggcgacgcuga

SEQ ID NO: 1549848 - RNA, 11 nt, Pseudomonas aeruginosa PA01
ucggcccuucg

SEQ ID NO: 1549849 - RNA, 21 nt, Pseudomonas aeruginosa PA01
ucggcccuucgacaugggccg

SEQ ID NO: 1549850 - RNA, 22 nt, Pseudomonas aeruginosa PA01
ucggccgacagagcggccggcg

SEQ ID NO: 1549851 - RNA, 18 nt, Pseudomonas aeruginosa PA01
ucggcccggagccaacgc

SEQ ID NO: 1549852 - RNA, 22 nt, Pseudomonas aeruginosa PA01
ucggcccgguuuuccgcuucca

SEQ ID NO: 1549853 - RNA, 16 nt, Pseudomonas aeruginosa PA01
ucggcccgggccuggu

SEQ ID NO: 1549854 - RNA, 17 nt, Pseudomonas aeruginosa PA01
ucggcccgggccuggug

SEQ ID NO: 1549855 - RNA, 18 nt, Pseudomonas aeruginosa PA01
ucggccgcccagcggaug

SEQ ID NO: 1549856 - RNA, 15 nt, Pseudomonas aeruginosa PA01
ucggccccaccuggc

SEQ ID NO: 1549857 - RNA, 23 nt, Pseudomonas aeruginosa PA01
ucggcccgacccacuugaacacc

SEQ ID NO: 1549858 - RNA, 17 nt, Pseudomonas aeruginosa PA01
ucggccaucuggcugcc

SEQ ID NO: 1549859 - RNA, 22 nt, Pseudomonas aeruginosa PA01
ucggccauggucucgcugaccc

SEQ ID NO: 1549860 - RNA, 23 nt, Pseudomonas aeruginosa PA01
ucggccauggucucgcugaccca

SEQ ID NO: 1549861 - RNA, 15 nt, Pseudomonas aeruginosa PA01
ucggccagccagggc

SEQ ID NO: 1549862 - RNA, 17 nt, Pseudomonas aeruginosa PA01
ucggccagcaaugcccg

SEQ ID NO: 1549863 - RNA, 14 nt, Pseudomonas aeruginosa PA01
ucggccagcggcag

SEQ ID NO: 1549864 - RNA, 18 nt, Pseudomonas aeruginosa PA01
ucggccagcucgccgaac

SEQ ID NO: 1549865 - RNA, 20 nt, Pseudomonas aeruginosa PA01
ucggccaggcggccgacgau

SEQ ID NO: 1549866 - RNA, 18 nt, Pseudomonas aeruginosa PA01
ucggccaggacgccacca

SEQ ID NO: 1549867 - RNA, 22 nt, Pseudomonas aeruginosa PA01
ucggccaggacgccaccaggcc

SEQ ID NO: 1549868 - RNA, 10 nt, Pseudomonas aeruginosa PA01
ucggccagga

SEQ ID NO: 1549869 - RNA, 14 nt, Pseudomonas aeruginosa PA01
ucggccagggaguc

SEQ ID NO: 1549870 - RNA, 19 nt, Pseudomonas aeruginosa PA01
ucggccaguccggucagca

SEQ ID NO: 1549871 - RNA, 13 nt, Pseudomonas aeruginosa PA01
ucggccaucagca

SEQ ID NO: 1549872 - RNA, 18 nt, Pseudomonas aeruginosa PA01
ucggccaucgagcgcucc

SEQ ID NO: 1549873 - RNA, 16 nt, Pseudomonas aeruginosa PA01
ucggcuccagcaccag

SEQ ID NO: 1549874 - RNA, 15 nt, Pseudomonas aeruginosa PA01
ucggcuccagccagg

SEQ ID NO: 1549875 - RNA, 17 nt, Pseudomonas aeruginosa PA01
ucggcguuguccaggcu

SEQ ID NO: 1549876 - RNA, 20 nt, Pseudomonas aeruginosa PA01
ucggcuguuucaggccggcg

SEQ ID NO: 1549877 - RNA, 14 nt, Pseudomonas aeruginosa PA01
ucggcuuccugggc

SEQ ID NO: 1549878 - RNA, 18 nt, Pseudomonas aeruginosa PA01
ucggcuucguccugcugc

SEQ ID NO: 1549879 - RNA, 12 nt, Pseudomonas aeruginosa PA01
ucggcuucaacg

SEQ ID NO: 1549880 - RNA, 18 nt, Pseudomonas aeruginosa PA01
ucggcugcaacgccggcc

SEQ ID NO: 1549881 - RNA, 15 nt, Pseudomonas aeruginosa PA01
ucggcuggcagggcg

SEQ ID NO: 1549882 - RNA, 15 nt, Pseudomonas aeruginosa PA01
ucggcugggccagga

SEQ ID NO: 1549883 - RNA, 21 nt, Pseudomonas aeruginosa PA01
ucgggaaaggccgccacggcg

SEQ ID NO: 1549884 - RNA, 18 nt, Pseudomonas aeruginosa PA01
ucggcuugacuggcaguc

SEQ ID NO: 1549885 - RNA, 21 nt, Pseudomonas aeruginosa PA01
ucgggauaccggccaucagca

SEQ ID NO: 1549886 - RNA, 22 nt, Pseudomonas aeruginosa PA01
ucgggaaccacgacgaagcgcc

SEQ ID NO: 1549887 - RNA, 14 nt, Pseudomonas aeruginosa PA01
ucggcggcgcgaac

SEQ ID NO: 1549888 - RNA, 15 nt, Pseudomonas aeruginosa PA01
ucggcggcgugcagg

SEQ ID NO: 1549889 - RNA, 12 nt, Pseudomonas aeruginosa PA01
ucggcggcucug

SEQ ID NO: 1549890 - RNA, 15 nt, Pseudomonas aeruginosa PA01
ucggcggcucugguc

SEQ ID NO: 1549891 - RNA, 22 nt, Pseudomonas aeruginosa PA01
ucggcggguauccgccgggccg

SEQ ID NO: 1549892 - RNA, 13 nt, Pseudomonas aeruginosa PA01
ucggcgggcugcc

SEQ ID NO: 1549893 - RNA, 14 nt, Pseudomonas aeruginosa PA01
ucggcgggcugccg

SEQ ID NO: 1549894 - RNA, 22 nt, Pseudomonas aeruginosa PA01
ucggcgggaucgacgccgcugg

SEQ ID NO: 1549895 - RNA, 20 nt, Pseudomonas aeruginosa PA01
ucggcgugauccgcagguag

SEQ ID NO: 1549896 - RNA, 18 nt, Pseudomonas aeruginosa PA01
ucggcgucgcgcuugccu

SEQ ID NO: 1549897 - RNA, 13 nt, Pseudomonas aeruginosa PA01
ucggcgguggggc

SEQ ID NO: 1549898 - RNA, 19 nt, Pseudomonas aeruginosa PA01
ucggcguagccggccaggg

SEQ ID NO: 1549899 - RNA, 19 nt, Pseudomonas aeruginosa PA01
ucggcgcugccggccaggg

SEQ ID NO: 1549900 - RNA, 15 nt, Pseudomonas aeruginosa PA01
ucggcggccgggucg

SEQ ID NO: 1549901 - RNA, 11 nt, Pseudomonas aeruginosa PA01
ucggcggccuc

SEQ ID NO: 1549902 - RNA, 11 nt, Pseudomonas aeruginosa PA01
ucggcggccuu

SEQ ID NO: 1549903 - RNA, 21 nt, Pseudomonas aeruginosa PA01
ucggcgcgacggcccacggcg

SEQ ID NO: 1549904 - RNA, 22 nt, Pseudomonas aeruginosa PA01
ucggcgcgggccuucaggcugc

SEQ ID NO: 1549905 - RNA, 15 nt, Pseudomonas aeruginosa PA01
ucggcgcggccggcg

SEQ ID NO: 1549906 - RNA, 12 nt, Pseudomonas aeruginosa PA01
ucggcgcgcgcc

SEQ ID NO: 1549907 - RNA, 21 nt, Pseudomonas aeruginosa PA01
ucguccagcggguagaugcca

SEQ ID NO: 1549908 - RNA, 16 nt, Pseudomonas aeruginosa PA01
ucguccagcucggcca

SEQ ID NO: 1549909 - RNA, 20 nt, Pseudomonas aeruginosa PA01
ucguccagcaggcccagcca

SEQ ID NO: 1549910 - RNA, 18 nt, Pseudomonas aeruginosa PA01
ucguccaguuccaggguc

SEQ ID NO: 1549911 - RNA, 14 nt, Pseudomonas aeruginosa PA01
ucgucacgcaggcu

SEQ ID NO: 1549912 - RNA, 15 nt, Pseudomonas aeruginosa PA01
ucgucacggcgugcc

SEQ ID NO: 1549913 - RNA, 20 nt, Pseudomonas aeruginosa PA01
ucgucacuguuuuccauggc

SEQ ID NO: 1549914 - RNA, 13 nt, Pseudomonas aeruginosa PA01
ucgucgaccugcg

SEQ ID NO: 1549915 - RNA, 15 nt, Pseudomonas aeruginosa PA01
ucgucgaagcgcagc

SEQ ID NO: 1549916 - RNA, 18 nt, Pseudomonas aeruginosa PA01
ucgucgaagcugucguag

SEQ ID NO: 1549917 - RNA, 13 nt, Pseudomonas aeruginosa PA01
ucguccugcugcu

SEQ ID NO: 1549918 - RNA, 14 nt, Pseudomonas aeruginosa PA01
ucguccugcugcug

SEQ ID NO: 1549919 - RNA, 21 nt, Pseudomonas aeruginosa PA01
ucgucgaugcuccaaugcacc

SEQ ID NO: 1549920 - RNA, 21 nt, Pseudomonas aeruginosa PA01
ucgucgaucagguccuggccg

SEQ ID NO: 1549921 - RNA, 15 nt, Pseudomonas aeruginosa PA01
ucgucgcccuggccg

SEQ ID NO: 1549922 - RNA, 13 nt, Pseudomonas aeruginosa PA01
ucgucgccagccc

SEQ ID NO: 1549923 - RNA, 15 nt, Pseudomonas aeruginosa PA01
ucgucgccgcccggc

SEQ ID NO: 1549924 - RNA, 17 nt, Pseudomonas aeruginosa PA01
ucgucgccgcccggcag

SEQ ID NO: 1549925 - RNA, 22 nt, Pseudomonas aeruginosa PA01
ucgucgccgcccggcagcggcu

SEQ ID NO: 1549926 - RNA, 15 nt, Pseudomonas aeruginosa PA01
ucgucgcgccaggcg

SEQ ID NO: 1549927 - RNA, 17 nt, Pseudomonas aeruginosa PA01
ucgucggcgcggccggc

SEQ ID NO: 1549928 - RNA, 23 nt, Pseudomonas aeruginosa PA01
ucguacacguuggccgucuccag

SEQ ID NO: 1549929 - RNA, 13 nt, Pseudomonas aeruginosa PA01
ucguagaggcugu

SEQ ID NO: 1549930 - RNA, 16 nt, Pseudomonas aeruginosa PA01
ucguagcgcagcggca

SEQ ID NO: 1549931 - RNA, 17 nt, Pseudomonas aeruginosa PA01
ucguagcgcagcggcag

SEQ ID NO: 1549932 - RNA, 21 nt, Pseudomonas aeruginosa PA01
ucguagcgcagcggcaggcca

SEQ ID NO: 1549933 - RNA, 20 nt, Pseudomonas aeruginosa PA01
ucguagcccuucuccgccag

SEQ ID NO: 1549934 - RNA, 18 nt, Pseudomonas aeruginosa PA01
ucguagcggucgugcagc

SEQ ID NO: 1549935 - RNA, 15 nt, Pseudomonas aeruginosa PA01
ucguagccaggcacc

SEQ ID NO: 1549936 - RNA, 13 nt, Pseudomonas aeruginosa PA01
ucguagcccaugg

SEQ ID NO: 1549937 - RNA, 23 nt, Pseudomonas aeruginosa PA01
ucguagguuuccggguccuggau

SEQ ID NO: 1549938 - RNA, 23 nt, Pseudomonas aeruginosa PA01
ucguaggcgcgggcggcggcgcg

SEQ ID NO: 1549939 - RNA, 20 nt, Pseudomonas aeruginosa PA01
ucguauaggcgcuggugcug

SEQ ID NO: 1549940 - RNA, 13 nt, Pseudomonas aeruginosa PA01
ucgucuggcgccu

SEQ ID NO: 1549941 - RNA, 19 nt, Pseudomonas aeruginosa PA01
ucgucuggcgccuggccug

SEQ ID NO: 1549942 - RNA, 21 nt, Pseudomonas aeruginosa PA01
ucgucggggugccgccagucg

SEQ ID NO: 1549943 - RNA, 14 nt, Pseudomonas aeruginosa PA01
ucgucggucggcca

SEQ ID NO: 1549944 - RNA, 17 nt, Pseudomonas aeruginosa PA01
ucgucggucggccagga

SEQ ID NO: 1549945 - RNA, 22 nt, Pseudomonas aeruginosa PA01
ucgucuuucaggugggccacuu

SEQ ID NO: 1549946 - RNA, 20 nt, Pseudomonas aeruginosa PA01
ucgugccacaggcccuggau

SEQ ID NO: 1549947 - RNA, 12 nt, Pseudomonas aeruginosa PA01
ucgugccaggcg

SEQ ID NO: 1549948 - RNA, 21 nt, Pseudomonas aeruginosa PA01
ucgugcagccagacccagugg

SEQ ID NO: 1549949 - RNA, 13 nt, Pseudomonas aeruginosa PA01
ucgugcagcagcg

SEQ ID NO: 1549950 - RNA, 13 nt, Pseudomonas aeruginosa PA01
ucguggggccaga

SEQ ID NO: 1549951 - RNA, 19 nt, Pseudomonas aeruginosa PA01
ucguguaggguucgcugcc

SEQ ID NO: 1549952 - RNA, 22 nt, Pseudomonas aeruginosa PA01
ucgugguccagcucggucagcg

SEQ ID NO: 1549953 - RNA, 12 nt, Pseudomonas aeruginosa PA01
ucguggaaaaag

SEQ ID NO: 1549954 - RNA, 13 nt, Pseudomonas aeruginosa PA01
ucguucagcagca

SEQ ID NO: 1549955 - RNA, 16 nt, Pseudomonas aeruginosa PA01
ucguucagcccacccc

SEQ ID NO: 1549956 - RNA, 14 nt, Pseudomonas aeruginosa PA01
ucguucaguugccu

SEQ ID NO: 1549957 - RNA, 16 nt, Pseudomonas aeruginosa PA01
ucguucccggccuggc

SEQ ID NO: 1549958 - RNA, 23 nt, Pseudomonas aeruginosa PA01
ucguucgcccagaccugcaauuc

SEQ ID NO: 1549959 - RNA, 19 nt, Pseudomonas aeruginosa PA01
ucguuccggcucagccgcu

SEQ ID NO: 1549960 - RNA, 18 nt, Pseudomonas aeruginosa PA01
ucguuccaucgcaggcag

SEQ ID NO: 1549961 - RNA, 21 nt, Pseudomonas aeruginosa PA01
ucguucugggucgcgcagggc

SEQ ID NO: 1549962 - RNA, 18 nt, Pseudomonas aeruginosa PA01
ucguugccagccggccuu

SEQ ID NO: 1549963 - RNA, 22 nt, Pseudomonas aeruginosa PA01
ucguugcacgcaggccgcugcc

SEQ ID NO: 1549964 - RNA, 14 nt, Pseudomonas aeruginosa PA01
ucguugcccggcuu

SEQ ID NO: 1549965 - RNA, 17 nt, Pseudomonas aeruginosa PA01
ucguugccgaucaucuu

SEQ ID NO: 1549966 - RNA, 16 nt, Pseudomonas aeruginosa PA01
ucguuggcggccagca

SEQ ID NO: 1549967 - RNA, 18 nt, Pseudomonas aeruginosa PA01
ucguuucccggcgcggcu

SEQ ID NO: 1549968 - RNA, 17 nt, Pseudomonas aeruginosa PA01
ucuccacuaccgccgag

SEQ ID NO: 1549969 - RNA, 17 nt, Pseudomonas aeruginosa PA01
ucuccagaaucucccgc

SEQ ID NO: 1549970 - RNA, 15 nt, Pseudomonas aeruginosa PA01
ucuccagccgcaccc

SEQ ID NO: 1549971 - RNA, 11 nt, Pseudomonas aeruginosa PA01
ucuccaggcuu

SEQ ID NO: 1549972 - RNA, 17 nt, Pseudomonas aeruginosa PA01
ucuccagggaaaccacc

SEQ ID NO: 1549973 - RNA, 20 nt, Pseudomonas aeruginosa PA01
ucuccagggaaaccaccugg

SEQ ID NO: 1549974 - RNA, 12 nt, Pseudomonas aeruginosa PA01
ucucccuucagg

SEQ ID NO: 1549975 - RNA, 17 nt, Pseudomonas aeruginosa PA01
ucuccccagacccucuc

SEQ ID NO: 1549976 - RNA, 18 nt, Pseudomonas aeruginosa PA01
ucuccccagacccucucc

SEQ ID NO: 1549977 - RNA, 21 nt, Pseudomonas aeruginosa PA01
ucuccccagacccucucccug

SEQ ID NO: 1549978 - RNA, 17 nt, Pseudomonas aeruginosa PA01
ucucgcgacccuggccg

SEQ ID NO: 1549979 - RNA, 12 nt, Pseudomonas aeruginosa PA01
ucucgcggcgcg

SEQ ID NO: 1549980 - RNA, 15 nt, Pseudomonas aeruginosa PA01
ucucgcggcgcggcg

SEQ ID NO: 1549981 - RNA, 19 nt, Pseudomonas aeruginosa PA01
ucucgcgggcguuggccug

SEQ ID NO: 1549982 - RNA, 21 nt, Pseudomonas aeruginosa PA01
ucucgcgggcguuggccugga

SEQ ID NO: 1549983 - RNA, 17 nt, Pseudomonas aeruginosa PA01
ucucgccgcgcacgucg

SEQ ID NO: 1549984 - RNA, 19 nt, Pseudomonas aeruginosa PA01
ucucgccggcacuguuccu

SEQ ID NO: 1549985 - RNA, 14 nt, Pseudomonas aeruginosa PA01
ucucgccgccggag

SEQ ID NO: 1549986 - RNA, 15 nt, Pseudomonas aeruginosa PA01
ucucgaucggcccgg

SEQ ID NO: 1549987 - RNA, 22 nt, Pseudomonas aeruginosa PA01
ucucgauggcagccuuggccac

SEQ ID NO: 1549988 - RNA, 14 nt, Pseudomonas aeruginosa PA01
ucucgcagcaggcg

SEQ ID NO: 1549989 - RNA, 21 nt, Pseudomonas aeruginosa PA01
ucucgaagcgcgccugcucuu

SEQ ID NO: 1549990 - RNA, 19 nt, Pseudomonas aeruginosa PA01
ucucgaucaucgccagcgg

SEQ ID NO: 1549991 - RNA, 22 nt, Pseudomonas aeruginosa PA01
ucucgaacaccaggcgccaggg

SEQ ID NO: 1549992 - RNA, 13 nt, Pseudomonas aeruginosa PA01
ucucgaacagcag

SEQ ID NO: 1549993 - RNA, 16 nt, Pseudomonas aeruginosa PA01
ucucgaacagcagcaa

SEQ ID NO: 1549994 - RNA, 15 nt, Pseudomonas aeruginosa PA01
ucucgaacagcuccu

SEQ ID NO: 1549995 - RNA, 17 nt, Pseudomonas aeruginosa PA01
ucucgaacgccaggcag

SEQ ID NO: 1549996 - RNA, 19 nt, Pseudomonas aeruginosa PA01
ucuccgugcuggccggcag

SEQ ID NO: 1549997 - RNA, 21 nt, Pseudomonas aeruginosa PA01
ucuccgugcuggccggcagca

SEQ ID NO: 1549998 - RNA, 12 nt, Pseudomonas aeruginosa PA01
ucuccggcgccg

SEQ ID NO: 1549999 - RNA, 19 nt, Pseudomonas aeruginosa PA01
ucuccucgcugaugugccg

SEQ ID NO: 1550000 - RNA, 18 nt, Pseudomonas aeruginosa PA01
ucuccucggccgacaggc

SEQ ID NO: 1550001 - RNA, 23 nt, Pseudomonas aeruginosa PA01
ucucgcugaguuugcccagcgcc

SEQ ID NO: 1550002 - RNA, 12 nt, Pseudomonas aeruginosa PA01
ucucggccaggu

SEQ ID NO: 1550003 - RNA, 12 nt, Pseudomonas aeruginosa PA01
ucucggccaggc

SEQ ID NO: 1550004 - RNA, 18 nt, Pseudomonas aeruginosa PA01
ucucggcggccaggcggc

SEQ ID NO: 1550005 - RNA, 21 nt, Pseudomonas aeruginosa PA01
ucucguugaguucgaagcgcc

SEQ ID NO: 1550006 - RNA, 11 nt, Pseudomonas aeruginosa PA01
ucucugcaucu

SEQ ID NO: 1550007 - RNA, 15 nt, Pseudomonas aeruginosa PA01
ucucucuucagcagg

SEQ ID NO: 1550008 - RNA, 19 nt, Pseudomonas aeruginosa PA01
ucucucuaccccgaccacc

SEQ ID NO: 1550009 - RNA, 18 nt, Pseudomonas aeruginosa PA01
aaaugcuugaaaaucaag

SEQ ID NO: 1550010 - RNA, 15 nt, Pseudomonas aeruginosa PA01
ucugcaacgcggcgu

SEQ ID NO: 1550011 - RNA, 18 nt, Pseudomonas aeruginosa PA01
ucuuccucggacuugcuc

SEQ ID NO: 1550012 - RNA, 12 nt, Pseudomonas aeruginosa PA01
ucuuccuggguc

SEQ ID NO: 1550013 - RNA, 13 nt, Pseudomonas aeruginosa PA01
ucuuccuugucgu

SEQ ID NO: 1550014 - RNA, 22 nt, Pseudomonas aeruginosa PA01
ucuucgcguuggcggugccgca

SEQ ID NO: 1550015 - RNA, 14 nt, Pseudomonas aeruginosa PA01
ucuucgccuugccc

SEQ ID NO: 1550016 - RNA, 13 nt, Pseudomonas aeruginosa PA01
ucuucaccaggcc

SEQ ID NO: 1550017 - RNA, 22 nt, Pseudomonas aeruginosa PA01
ucuuccacgcgccgauccaggc

SEQ ID NO: 1550018 - RNA, 15 nt, Pseudomonas aeruginosa PA01
ucuuccacuugcgcc

SEQ ID NO: 1550019 - RNA, 15 nt, Pseudomonas aeruginosa PA01
ucuuccagcaugcuc

SEQ ID NO: 1550020 - RNA, 13 nt, Pseudomonas aeruginosa PA01
ucugugcuuugcc

SEQ ID NO: 1550021 - RNA, 13 nt, Pseudomonas aeruginosa PA01
ucugucuuguccu

SEQ ID NO: 1550022 - RNA, 18 nt, Pseudomonas aeruginosa PA01
ucugucgcagcgggcuga

SEQ ID NO: 1550023 - RNA, 19 nt, Pseudomonas aeruginosa PA01
ucugguugcucaccaaugc

SEQ ID NO: 1550024 - RNA, 15 nt, Pseudomonas aeruginosa PA01
ucuggaucacguagg

SEQ ID NO: 1550025 - RNA, 18 nt, Pseudomonas aeruginosa PA01
ucugccagcucuugcccu

SEQ ID NO: 1550026 - RNA, 17 nt, Pseudomonas aeruginosa PA01
ucugccagaaggccugc

SEQ ID NO: 1550027 - RNA, 21 nt, Pseudomonas aeruginosa PA01
ucugccacccggcgcccggcg

SEQ ID NO: 1550028 - RNA, 22 nt, Pseudomonas aeruginosa PA01
ucugcauggcaccgucaagggc

SEQ ID NO: 1550029 - RNA, 15 nt, Pseudomonas aeruginosa PA01
ucugggcggccaggu

SEQ ID NO: 1550030 - RNA, 15 nt, Pseudomonas aeruginosa PA01
ucugggacggcagcc

SEQ ID NO: 1550031 - RNA, 22 nt, Pseudomonas aeruginosa PA01
ucugggacggcagccugggggu

SEQ ID NO: 1550032 - RNA, 22 nt, Pseudomonas aeruginosa PA01
ucuaaggggcggcucggcucca

SEQ ID NO: 1550033 - RNA, 19 nt, Pseudomonas aeruginosa PA01
ucuaaccggcguccgggug

SEQ ID NO: 1550034 - RNA, 14 nt, Pseudomonas aeruginosa PA01
ucuaccccgaccac

SEQ ID NO: 1550035 - RNA, 17 nt, Pseudomonas aeruginosa PA01
ucuaccgagaucaccuu

SEQ ID NO: 1550036 - RNA, 20 nt, Pseudomonas aeruginosa PA01
ucuaccaggcgguuggcccg

SEQ ID NO: 1550037 - RNA, 24 nt, Pseudomonas aeruginosa PA01
ucuacgccuugcggcgccgaggcc

SEQ ID NO: 1550038 - RNA, 20 nt, Pseudomonas aeruginosa PA01
ucucagcccucggcccggag

SEQ ID NO: 1550039 - RNA, 22 nt, Pseudomonas aeruginosa PA01
ucucaggaccuuccgccagcag

SEQ ID NO: 1550040 - RNA, 18 nt, Pseudomonas aeruginosa PA01
ucuaucccgugccgggcc

SEQ ID NO: 1550041 - RNA, 20 nt, Pseudomonas aeruginosa PA01
ucuaucacacuguccagggc

SEQ ID NO: 1550042 - RNA, 14 nt, Pseudomonas aeruginosa PA01
ucuagugaaagucc

SEQ ID NO: 1550043 - RNA, 16 nt, Pseudomonas aeruginosa PA01
ucuagcgaaggcuccg

SEQ ID NO: 1550044 - RNA, 18 nt, Pseudomonas aeruginosa PA01
uuaccugaguaguuucug

SEQ ID NO: 1550045 - RNA, 16 nt, Pseudomonas aeruginosa PA01
uuaccuugccggugcg

SEQ ID NO: 1550046 - RNA, 13 nt, Pseudomonas aeruginosa PA01
uuaccuuggccac

SEQ ID NO: 1550047 - RNA, 13 nt, Pseudomonas aeruginosa PA01
uuacuuaaauuca

SEQ ID NO: 1550048 - RNA, 18 nt, Pseudomonas aeruginosa PA01
uuacgcuauucugauugc

SEQ ID NO: 1550049 - RNA, 16 nt, Pseudomonas aeruginosa PA01
uuagacccacugaaga

SEQ ID NO: 1550050 - RNA, 20 nt, Pseudomonas aeruginosa PA01
uuagcucagucgguagagca

SEQ ID NO: 1550051 - RNA, 12 nt, Pseudomonas aeruginosa PA01
uguuuccgaacu

SEQ ID NO: 1550052 - RNA, 15 nt, Pseudomonas aeruginosa PA01
uguuuccucagcucu

SEQ ID NO: 1550053 - RNA, 18 nt, Pseudomonas aeruginosa PA01
uguuucagcggguagcug

SEQ ID NO: 1550054 - RNA, 21 nt, Pseudomonas aeruginosa PA01
uguuucagcggguagcugcug

SEQ ID NO: 1550055 - RNA, 14 nt, Pseudomonas aeruginosa PA01
uguuuuccuggccc

SEQ ID NO: 1550056 - RNA, 19 nt, Pseudomonas aeruginosa PA01
uguucaccagguugugauc

SEQ ID NO: 1550057 - RNA, 18 nt, Pseudomonas aeruginosa PA01
uguuccaaggugcugccg

SEQ ID NO: 1550058 - RNA, 23 nt, Pseudomonas aeruginosa PA01
uguuccaaggugcugccgaucag

SEQ ID NO: 1550059 - RNA, 16 nt, Pseudomonas aeruginosa PA01
uguuccacgagagaaa

SEQ ID NO: 1550060 - RNA, 17 nt, Pseudomonas aeruginosa PA01
uguuccucguccagcag

SEQ ID NO: 1550061 - RNA, 18 nt, Pseudomonas aeruginosa PA01
uguucgaggcgccgacca

SEQ ID NO: 1550062 - RNA, 12 nt, Pseudomonas aeruginosa PA01
uguucgccgcca

SEQ ID NO: 1550063 - RNA, 20 nt, Pseudomonas aeruginosa PA01
uguucggcuggaccuccugg

SEQ ID NO: 1550064 - RNA, 18 nt, Pseudomonas aeruginosa PA01
uguugacgauggcccaga

SEQ ID NO: 1550065 - RNA, 23 nt, Pseudomonas aeruginosa PA01
uguugcucaccgcauaggucaug

SEQ ID NO: 1550066 - RNA, 15 nt, Pseudomonas aeruginosa PA01
uguugccgcugcagg

SEQ ID NO: 1550067 - RNA, 14 nt, Pseudomonas aeruginosa PA01
uguugcccaccucc

SEQ ID NO: 1550068 - RNA, 23 nt, Pseudomonas aeruginosa PA01
uguugccggcaaacgccgccacc

SEQ ID NO: 1550069 - RNA, 21 nt, Pseudomonas aeruginosa PA01
uguugaucgccgcgccgccga

SEQ ID NO: 1550070 - RNA, 20 nt, Pseudomonas aeruginosa PA01
uguugaucaccaccggcugg

SEQ ID NO: 1550071 - RNA, 14 nt, Pseudomonas aeruginosa PA01
uguugcccaccagc

SEQ ID NO: 1550072 - RNA, 16 nt, Pseudomonas aeruginosa PA01
uguuguggcuggccuc

SEQ ID NO: 1550073 - RNA, 18 nt, Pseudomonas aeruginosa PA01
uguuguggcuggccucgg

SEQ ID NO: 1550074 - RNA, 20 nt, Pseudomonas aeruginosa PA01
uguuguagaccaucugccag

SEQ ID NO: 1550075 - RNA, 15 nt, Pseudomonas aeruginosa PA01
uguuggccagcagcc

SEQ ID NO: 1550076 - RNA, 14 nt, Pseudomonas aeruginosa PA01
uguuggcggccugg

SEQ ID NO: 1550077 - RNA, 15 nt, Pseudomonas aeruginosa PA01
uguuggcggccuggg

SEQ ID NO: 1550078 - RNA, 18 nt, Pseudomonas aeruginosa PA01
uguuguuauggccgaccc

SEQ ID NO: 1550079 - RNA, 22 nt, Pseudomonas aeruginosa PA01
uguagaccagauagaccaaggc

SEQ ID NO: 1550080 - RNA, 13 nt, Pseudomonas aeruginosa PA01
uguaccaccgcca

SEQ ID NO: 1550081 - RNA, 14 nt, Pseudomonas aeruginosa PA01
uguacccccaccgg

SEQ ID NO: 1550082 - RNA, 23 nt, Pseudomonas aeruginosa PA01
uguaccaggggauggucggugac

SEQ ID NO: 1550083 - RNA, 19 nt, Pseudomonas aeruginosa PA01
uguacagaaacaaagagcc

SEQ ID NO: 1550084 - RNA, 21 nt, Pseudomonas aeruginosa PA01
uguacagaaacaaagagcccg

SEQ ID NO: 1550085 - RNA, 15 nt, Pseudomonas aeruginosa PA01
uggucuuuccuuuca

SEQ ID NO: 1550086 - RNA, 14 nt, Pseudomonas aeruginosa PA01
uggucggcggccuu

SEQ ID NO: 1550087 - RNA, 13 nt, Pseudomonas aeruginosa PA01
uggucggcuuccg

SEQ ID NO: 1550088 - RNA, 12 nt, Pseudomonas aeruginosa PA01
uggugacggucc

SEQ ID NO: 1550089 - RNA, 17 nt, Pseudomonas aeruginosa PA01
uggugaagcccaccacc

SEQ ID NO: 1550090 - RNA, 15 nt, Pseudomonas aeruginosa PA01
uguaguucaucuugc

SEQ ID NO: 1550091 - RNA, 20 nt, Pseudomonas aeruginosa PA01
uguaguucaccguccacugg

SEQ ID NO: 1550092 - RNA, 22 nt, Pseudomonas aeruginosa PA01
uguaguucuugcgcauuuugcc

SEQ ID NO: 1550093 - RNA, 19 nt, Pseudomonas aeruginosa PA01
uguagcugaggccguagcc

SEQ ID NO: 1550094 - RNA, 20 nt, Pseudomonas aeruginosa PA01
uguaggcgcaccaggccagg

SEQ ID NO: 1550095 - RNA, 20 nt, Pseudomonas aeruginosa PA01
uguagucgucccacuugucc

SEQ ID NO: 1550096 - RNA, 19 nt, Pseudomonas aeruginosa PA01
ugucagacacgaaaaagcc

SEQ ID NO: 1550097 - RNA, 19 nt, Pseudomonas aeruginosa PA01
ugucgcgggucugcgaguu

SEQ ID NO: 1550098 - RNA, 17 nt, Pseudomonas aeruginosa PA01
ugucgcgggcaugcugc

SEQ ID NO: 1550099 - RNA, 15 nt, Pseudomonas aeruginosa PA01
uguccaccaccagca

SEQ ID NO: 1550100 - RNA, 21 nt, Pseudomonas aeruginosa PA01
uguccaccgccgccagcaaca

SEQ ID NO: 1550101 - RNA, 18 nt, Pseudomonas aeruginosa PA01
ugucgcccuucuuccagu

SEQ ID NO: 1550102 - RNA, 19 nt, Pseudomonas aeruginosa PA01
ugucgccaucagugacauc

SEQ ID NO: 1550103 - RNA, 18 nt, Pseudomonas aeruginosa PA01
uguccaggcgaugguugc

SEQ ID NO: 1550104 - RNA, 19 nt, Pseudomonas aeruginosa PA01
uguccaggcuguggcgcgg

SEQ ID NO: 1550105 - RNA, 23 nt, Pseudomonas aeruginosa PA01
ugugcaguucgaccuccaggccg

SEQ ID NO: 1550106 - RNA, 16 nt, Pseudomonas aeruginosa PA01
ugugcagagaggcugg

SEQ ID NO: 1550107 - RNA, 17 nt, Pseudomonas aeruginosa PA01
ugugcagagaggcuggc

SEQ ID NO: 1550108 - RNA, 13 nt, Pseudomonas aeruginosa PA01
ugugcgccaggcc

SEQ ID NO: 1550109 - RNA, 15 nt, Pseudomonas aeruginosa PA01
ugugcgcaggcuggc

SEQ ID NO: 1550110 - RNA, 19 nt, Pseudomonas aeruginosa PA01
ugugccgugaucaccugga

SEQ ID NO: 1550111 - RNA, 16 nt, Pseudomonas aeruginosa PA01
ugugacggccggggcg

SEQ ID NO: 1550112 - RNA, 21 nt, Pseudomonas aeruginosa PA01
ugugaccgagauucugcaggc

SEQ ID NO: 1550113 - RNA, 19 nt, Pseudomonas aeruginosa PA01
ugugacgucuguugcggug

SEQ ID NO: 1550114 - RNA, 17 nt, Pseudomonas aeruginosa PA01
uguuacagcaggaaaag

SEQ ID NO: 1550115 - RNA, 22 nt, Pseudomonas aeruginosa PA01
ugugcugggucacguggccgcc

SEQ ID NO: 1550116 - RNA, 13 nt, Pseudomonas aeruginosa PA01
ugugcuggccacc

SEQ ID NO: 1550117 - RNA, 18 nt, Pseudomonas aeruginosa PA01
uguggcggcguggcucga

SEQ ID NO: 1550118 - RNA, 21 nt, Pseudomonas aeruginosa PA01
uguggcuauccuccaggccgc

SEQ ID NO: 1550119 - RNA, 22 nt, Pseudomonas aeruginosa PA01
ugugggacaggaagagcaggcg

SEQ ID NO: 1550120 - RNA, 14 nt, Pseudomonas aeruginosa PA01
uguggccgagcccc

SEQ ID NO: 1550121 - RNA, 17 nt, Pseudomonas aeruginosa PA01
uguggccgucgcgccgc

SEQ ID NO: 1550122 - RNA, 22 nt, Pseudomonas aeruginosa PA01
uguggguaugugacgucuguug

SEQ ID NO: 1550123 - RNA, 15 nt, Pseudomonas aeruginosa PA01
uguggucaggcgcca

SEQ ID NO: 1550124 - RNA, 12 nt, Pseudomonas aeruginosa PA01
uggggcgccggc

SEQ ID NO: 1550125 - RNA, 23 nt, Pseudomonas aeruginosa PA01
uggggcggauaagcaagcgcaac

SEQ ID NO: 1550126 - RNA, 15 nt, Pseudomonas aeruginosa PA01
uggggcggcacggug

SEQ ID NO: 1550127 - RNA, 14 nt, Pseudomonas aeruginosa PA01
uggggcggccggcg

SEQ ID NO: 1550128 - RNA, 17 nt, Pseudomonas aeruginosa PA01
uggggcggccucaggcc

SEQ ID NO: 1550129 - RNA, 15 nt, Pseudomonas aeruginosa PA01
ugggcguuggccagc

SEQ ID NO: 1550130 - RNA, 23 nt, Pseudomonas aeruginosa PA01
ugggcuacaucgucugcgcggcg

SEQ ID NO: 1550131 - RNA, 23 nt, Pseudomonas aeruginosa PA01
ugggcucagauuaucugcgacug

SEQ ID NO: 1550132 - RNA, 18 nt, Pseudomonas aeruginosa PA01
uggggaaucugcgccagg

SEQ ID NO: 1550133 - RNA, 16 nt, Pseudomonas aeruginosa PA01
ugggcguggcggccgc

SEQ ID NO: 1550134 - RNA, 17 nt, Pseudomonas aeruginosa PA01
ugggcggccggccaggu

SEQ ID NO: 1550135 - RNA, 13 nt, Pseudomonas aeruginosa PA01
ugggcggccaggu

SEQ ID NO: 1550136 - RNA, 23 nt, Pseudomonas aeruginosa PA01
ugggcggcgaccgaacagcgcgc

SEQ ID NO: 1550137 - RNA, 21 nt, Pseudomonas aeruginosa PA01
ugggcgcguucucccugagcc

SEQ ID NO: 1550138 - RNA, 21 nt, Pseudomonas aeruginosa PA01
ugggcgccgccagccagagca

SEQ ID NO: 1550139 - RNA, 22 nt, Pseudomonas aeruginosa PA01
ugggcgccgccggugcaccagg

SEQ ID NO: 1550140 - RNA, 19 nt, Pseudomonas aeruginosa PA01
ugggcgcaggggcgcgccg

SEQ ID NO: 1550141 - RNA, 19 nt, Pseudomonas aeruginosa PA01
uggcgucgggcuucuucac

SEQ ID NO: 1550142 - RNA, 15 nt, Pseudomonas aeruginosa PA01
uggcguugacugccu

SEQ ID NO: 1550143 - RNA, 14 nt, Pseudomonas aeruginosa PA01
uggcguugccgugc

SEQ ID NO: 1550144 - RNA, 16 nt, Pseudomonas aeruginosa PA01
uggcguugccgugccg

SEQ ID NO: 1550145 - RNA, 14 nt, Pseudomonas aeruginosa PA01
uggcguuccaggcg

SEQ ID NO: 1550146 - RNA, 18 nt, Pseudomonas aeruginosa PA01
uggcuuuccagggccugg

SEQ ID NO: 1550147 - RNA, 15 nt, Pseudomonas aeruginosa PA01
ugggaugccgggccg

SEQ ID NO: 1550148 - RNA, 18 nt, Pseudomonas aeruginosa PA01
ugggaucgcugagcaucu

SEQ ID NO: 1550149 - RNA, 21 nt, Pseudomonas aeruginosa PA01
ugggcaccaguggcgccgcca

SEQ ID NO: 1550150 - RNA, 15 nt, Pseudomonas aeruginosa PA01
uggcuuuucucgccu

SEQ ID NO: 1550151 - RNA, 15 nt, Pseudomonas aeruginosa PA01
uggucaacaccagcg

SEQ ID NO: 1550152 - RNA, 15 nt, Pseudomonas aeruginosa PA01
uggucaccuugaccu

SEQ ID NO: 1550153 - RNA, 17 nt, Pseudomonas aeruginosa PA01
uggucaccagcgugggc

SEQ ID NO: 1550154 - RNA, 14 nt, Pseudomonas aeruginosa PA01
uggucaccaugauc

SEQ ID NO: 1550155 - RNA, 12 nt, Pseudomonas aeruginosa PA01
uggucaggacgc

SEQ ID NO: 1550156 - RNA, 14 nt, Pseudomonas aeruginosa PA01
uggucaggcccugc

SEQ ID NO: 1550157 - RNA, 15 nt, Pseudomonas aeruginosa PA01
uggucaggcgccagg

SEQ ID NO: 1550158 - RNA, 19 nt, Pseudomonas aeruginosa PA01
uggucagcaccagggccag

SEQ ID NO: 1550159 - RNA, 21 nt, Pseudomonas aeruginosa PA01
uggucagcaccagggccaggg

SEQ ID NO: 1550160 - RNA, 18 nt, Pseudomonas aeruginosa PA01
ugguccagcacgcuggcg

SEQ ID NO: 1550161 - RNA, 22 nt, Pseudomonas aeruginosa PA01
ugguccagcucggucagcggcg

SEQ ID NO: 1550162 - RNA, 13 nt, Pseudomonas aeruginosa PA01
uggucgaagcgga

SEQ ID NO: 1550163 - RNA, 18 nt, Pseudomonas aeruginosa PA01
uggucgacauagcgcagc

SEQ ID NO: 1550164 - RNA, 21 nt, Pseudomonas aeruginosa PA01
uggucgacauagcgcagcacc

SEQ ID NO: 1550165 - RNA, 21 nt, Pseudomonas aeruginosa PA01
ugguccguucggcgcccaggu

SEQ ID NO: 1550166 - RNA, 16 nt, Pseudomonas aeruginosa PA01
ugguccugaggcuccc

SEQ ID NO: 1550167 - RNA, 13 nt, Pseudomonas aeruginosa PA01
ugguccggcacuu

SEQ ID NO: 1550168 - RNA, 12 nt, Pseudomonas aeruginosa PA01
uggucgccgccc

SEQ ID NO: 1550169 - RNA, 17 nt, Pseudomonas aeruginosa PA01
uggucgaucuccuccuc

SEQ ID NO: 1550170 - RNA, 18 nt, Pseudomonas aeruginosa PA01
uggucgcgaucaccgcgu

SEQ ID NO: 1550171 - RNA, 19 nt, Pseudomonas aeruginosa PA01
uggucgcgaucaccgcguc

SEQ ID NO: 1550172 - RNA, 23 nt, Pseudomonas aeruginosa PA01
uggucgcugaggccgcccuggcc

SEQ ID NO: 1550173 - RNA, 19 nt, Pseudomonas aeruginosa PA01
uggucggcauccggcaggc

SEQ ID NO: 1550174 - RNA, 14 nt, Pseudomonas aeruginosa PA01
uggguucaggcucc

SEQ ID NO: 1550175 - RNA, 15 nt, Pseudomonas aeruginosa PA01
ugguaguccagcagg

SEQ ID NO: 1550176 - RNA, 22 nt, Pseudomonas aeruginosa PA01
ugguauggcggucggccaggcg

SEQ ID NO: 1550177 - RNA, 22 nt, Pseudomonas aeruginosa PA01
ugguaccgcugcgugccagggc

SEQ ID NO: 1550178 - RNA, 17 nt, Pseudomonas aeruginosa PA01
ugguacucguccuccca

SEQ ID NO: 1550179 - RNA, 12 nt, Pseudomonas aeruginosa PA01
uggcgggccagc

SEQ ID NO: 1550180 - RNA, 13 nt, Pseudomonas aeruginosa PA01
uggcggcaugccg

SEQ ID NO: 1550181 - RNA, 13 nt, Pseudomonas aeruginosa PA01
uggcggcauugag

SEQ ID NO: 1550182 - RNA, 16 nt, Pseudomonas aeruginosa PA01
uggcggucggccaggc

SEQ ID NO: 1550183 - RNA, 21 nt, Pseudomonas aeruginosa PA01
uggcgcuguaggcgagcagcg

SEQ ID NO: 1550184 - RNA, 16 nt, Pseudomonas aeruginosa PA01
uggcgcuugagcagcc

SEQ ID NO: 1550185 - RNA, 21 nt, Pseudomonas aeruginosa PA01
uggcgcuugagcagccaggcg

SEQ ID NO: 1550186 - RNA, 18 nt, Pseudomonas aeruginosa PA01
uggcgcuugccgcgcccg

SEQ ID NO: 1550187 - RNA, 15 nt, Pseudomonas aeruginosa PA01
uggcgcuugcgcagc

SEQ ID NO: 1550188 - RNA, 23 nt, Pseudomonas aeruginosa PA01
uggcggauguaguccagcgccgc

SEQ ID NO: 1550189 - RNA, 22 nt, Pseudomonas aeruginosa PA01
uggcggacaacccggcgcuggc

SEQ ID NO: 1550190 - RNA, 22 nt, Pseudomonas aeruginosa PA01
uggcggacugguaggacagggc

SEQ ID NO: 1550191 - RNA, 20 nt, Pseudomonas aeruginosa PA01
uggcggauaaccgcaagcgg

SEQ ID NO: 1550192 - RNA, 16 nt, Pseudomonas aeruginosa PA01
uggcggauagccgcaa

SEQ ID NO: 1550193 - RNA, 20 nt, Pseudomonas aeruginosa PA01
uggcggauagccgcaagcgg

SEQ ID NO: 1550194 - RNA, 16 nt, Pseudomonas aeruginosa PA01
uggcggaaggugccuu

SEQ ID NO: 1550195 - RNA, 15 nt, Pseudomonas aeruginosa PA01
uggcgccgaugcugu

SEQ ID NO: 1550196 - RNA, 15 nt, Pseudomonas aeruginosa PA01
uggcgccggccagag

SEQ ID NO: 1550197 - RNA, 21 nt, Pseudomonas aeruginosa PA01
uggcgccgggguuuucuuuuu

SEQ ID NO: 1550198 - RNA, 18 nt, Pseudomonas aeruginosa PA01
uggcgcugaccgcuccca

SEQ ID NO: 1550199 - RNA, 21 nt, Pseudomonas aeruginosa PA01
uggcgcugaggaagagcagcg

SEQ ID NO: 1550200 - RNA, 17 nt, Pseudomonas aeruginosa PA01
uggcgcucgccguggga

SEQ ID NO: 1550201 - RNA, 13 nt, Pseudomonas aeruginosa PA01
uggcgcucggcca

SEQ ID NO: 1550202 - RNA, 16 nt, Pseudomonas aeruginosa PA01
uggcgcucggccacau

SEQ ID NO: 1550203 - RNA, 21 nt, Pseudomonas aeruginosa PA01
uggcgcucucgaacaccaggc

SEQ ID NO: 1550204 - RNA, 17 nt, Pseudomonas aeruginosa PA01
uggcgcucugcagugug

SEQ ID NO: 1550205 - RNA, 23 nt, Pseudomonas aeruginosa PA01
uggcgcugaacaagcccuggugg

SEQ ID NO: 1550206 - RNA, 13 nt, Pseudomonas aeruginosa PA01
uggcgccucgcaa

SEQ ID NO: 1550207 - RNA, 17 nt, Pseudomonas aeruginosa PA01
uggcgaugcccuggccg

SEQ ID NO: 1550208 - RNA, 14 nt, Pseudomonas aeruginosa PA01
uggcgaucaggcag

SEQ ID NO: 1550209 - RNA, 15 nt, Pseudomonas aeruginosa PA01
uggcgaucaggccaa

SEQ ID NO: 1550210 - RNA, 16 nt, Pseudomonas aeruginosa PA01
uggcgauaucgaaggc

SEQ ID NO: 1550211 - RNA, 19 nt, Pseudomonas aeruginosa PA01
uggcgaggacgccgggcug

SEQ ID NO: 1550212 - RNA, 13 nt, Pseudomonas aeruginosa PA01
uggccgcugaaau

SEQ ID NO: 1550213 - RNA, 16 nt, Pseudomonas aeruginosa PA01
uggccgcugccgcucu

SEQ ID NO: 1550214 - RNA, 19 nt, Pseudomonas aeruginosa PA01
uggccgcugccgcucuggc

SEQ ID NO: 1550215 - RNA, 16 nt, Pseudomonas aeruginosa PA01
uggccgggcagacuuc

SEQ ID NO: 1550216 - RNA, 17 nt, Pseudomonas aeruginosa PA01
uggccgggcuucuucag

SEQ ID NO: 1550217 - RNA, 15 nt, Pseudomonas aeruginosa PA01
uggccggcgcggacg

SEQ ID NO: 1550218 - RNA, 13 nt, Pseudomonas aeruginosa PA01
uggccggcugcuc

SEQ ID NO: 1550219 - RNA, 14 nt, Pseudomonas aeruginosa PA01
uggccggcugcucc

SEQ ID NO: 1550220 - RNA, 14 nt, Pseudomonas aeruginosa PA01
uggccgcgccgccc

SEQ ID NO: 1550221 - RNA, 18 nt, Pseudomonas aeruginosa PA01
uggccgcgccgcccuggc

SEQ ID NO: 1550222 - RNA, 22 nt, Pseudomonas aeruginosa PA01
uggccgcgccgcccuggccgcc

SEQ ID NO: 1550223 - RNA, 24 nt, Pseudomonas aeruginosa PA01
uggccgcguaccaguagcgacagc

SEQ ID NO: 1550224 - RNA, 15 nt, Pseudomonas aeruginosa PA01
uggccgccgccgccg

SEQ ID NO: 1550225 - RNA, 18 nt, Pseudomonas aeruginosa PA01
uggccgccugcucggccu

SEQ ID NO: 1550226 - RNA, 12 nt, Pseudomonas aeruginosa PA01
uggccgccuggc

SEQ ID NO: 1550227 - RNA, 20 nt, Pseudomonas aeruginosa PA01
uggccgccuggccggccagc

SEQ ID NO: 1550228 - RNA, 14 nt, Pseudomonas aeruginosa PA01
uggccuuggccacg

SEQ ID NO: 1550229 - RNA, 24 nt, Pseudomonas aeruginosa PA01
uggccucguugaucggcaacgagc

SEQ ID NO: 1550230 - RNA, 16 nt, Pseudomonas aeruginosa PA01
uggcgaacggcugguc

SEQ ID NO: 1550231 - RNA, 13 nt, Pseudomonas aeruginosa PA01
uggcgaagccagc

SEQ ID NO: 1550232 - RNA, 24 nt, Pseudomonas aeruginosa PA01
uggcgaaggcaaugccgcccucca

SEQ ID NO: 1550233 - RNA, 22 nt, Pseudomonas aeruginosa PA01
uggcgaaguugccgccgcuggc

SEQ ID NO: 1550234 - RNA, 23 nt, Pseudomonas aeruginosa PA01
uggccuccugcaacgccuggugc

SEQ ID NO: 1550235 - RNA, 18 nt, Pseudomonas aeruginosa PA01
uggccguagccggugccg

SEQ ID NO: 1550236 - RNA, 16 nt, Pseudomonas aeruginosa PA01
uggccguccaggcugc

SEQ ID NO: 1550237 - RNA, 16 nt, Pseudomonas aeruginosa PA01
uggccgucuccaggcg

SEQ ID NO: 1550238 - RNA, 22 nt, Pseudomonas aeruginosa PA01
uggccgucuccaggcgcgccgu

SEQ ID NO: 1550239 - RNA, 15 nt, Pseudomonas aeruginosa PA01
uggcagccuuggcca

SEQ ID NO: 1550240 - RNA, 16 nt, Pseudomonas aeruginosa PA01
uggcagcgccguugcc

SEQ ID NO: 1550241 - RNA, 23 nt, Pseudomonas aeruginosa PA01
uggcaggaaaugccuggcuacgc

SEQ ID NO: 1550242 - RNA, 17 nt, Pseudomonas aeruginosa PA01
uggcagcucugcgacug

SEQ ID NO: 1550243 - RNA, 14 nt, Pseudomonas aeruginosa PA01
uggccagcagcauc

SEQ ID NO: 1550244 - RNA, 18 nt, Pseudomonas aeruginosa PA01
uggccagcagccaggccu

SEQ ID NO: 1550245 - RNA, 19 nt, Pseudomonas aeruginosa PA01
uggccagcgaacccaggcc

SEQ ID NO: 1550246 - RNA, 15 nt, Pseudomonas aeruginosa PA01
uggccagcgccacca

SEQ ID NO: 1550247 - RNA, 20 nt, Pseudomonas aeruginosa PA01
uggccagcgccaccagcagg

SEQ ID NO: 1550248 - RNA, 19 nt, Pseudomonas aeruginosa PA01
uggccaggccccaggccgc

SEQ ID NO: 1550249 - RNA, 17 nt, Pseudomonas aeruginosa PA01
uggccaggcgcaccagc

SEQ ID NO: 1550250 - RNA, 22 nt, Pseudomonas aeruginosa PA01
uggccaggcgcaccagcaggcg

SEQ ID NO: 1550251 - RNA, 21 nt, Pseudomonas aeruginosa PA01
uggccaggcgcgacagcucgu

SEQ ID NO: 1550252 - RNA, 12 nt, Pseudomonas aeruginosa PA01
uggccagcgcgg

SEQ ID NO: 1550253 - RNA, 20 nt, Pseudomonas aeruginosa PA01
uggccagcgcccaggccggg

SEQ ID NO: 1550254 - RNA, 17 nt, Pseudomonas aeruginosa PA01
uggccagcgcggugcgc

SEQ ID NO: 1550255 - RNA, 15 nt, Pseudomonas aeruginosa PA01
uggccagcgcuucca

SEQ ID NO: 1550256 - RNA, 22 nt, Pseudomonas aeruginosa PA01
uggccaggucgcgcagggccag

SEQ ID NO: 1550257 - RNA, 13 nt, Pseudomonas aeruginosa PA01
uggccaggaagcg

SEQ ID NO: 1550258 - RNA, 23 nt, Pseudomonas aeruginosa PA01
uggccaggaagcgggccucggcg

SEQ ID NO: 1550259 - RNA, 17 nt, Pseudomonas aeruginosa PA01
uggccagggggccuggc

SEQ ID NO: 1550260 - RNA, 15 nt, Pseudomonas aeruginosa PA01
uggccaucagcgccg

SEQ ID NO: 1550261 - RNA, 22 nt, Pseudomonas aeruginosa PA01
uggccauccgcccugcgggaug

SEQ ID NO: 1550262 - RNA, 19 nt, Pseudomonas aeruginosa PA01
uggccaguuggcccuugac

SEQ ID NO: 1550263 - RNA, 22 nt, Pseudomonas aeruginosa PA01
uggccaugaugugcgcaggcug

SEQ ID NO: 1550264 - RNA, 23 nt, Pseudomonas aeruginosa PA01
uggccaugaugugcgcaggcugg

SEQ ID NO: 1550265 - RNA, 22 nt, Pseudomonas aeruginosa PA01
uggccgagcccagcggcagggc

SEQ ID NO: 1550266 - RNA, 19 nt, Pseudomonas aeruginosa PA01
uggccgaguggccgaaggc

SEQ ID NO: 1550267 - RNA, 17 nt, Pseudomonas aeruginosa PA01
uggccauggcagagcug

SEQ ID NO: 1550268 - RNA, 21 nt, Pseudomonas aeruginosa PA01
uggccgaucaccuggccauuc

SEQ ID NO: 1550269 - RNA, 15 nt, Pseudomonas aeruginosa PA01
uggccgaucagcuug

SEQ ID NO: 1550270 - RNA, 20 nt, Pseudomonas aeruginosa PA01
uggccgaucagcuuggccuu

SEQ ID NO: 1550271 - RNA, 15 nt, Pseudomonas aeruginosa PA01
uggccgaugccgacc

SEQ ID NO: 1550272 - RNA, 13 nt, Pseudomonas aeruginosa PA01
uggccgcagcagc

SEQ ID NO: 1550273 - RNA, 18 nt, Pseudomonas aeruginosa PA01
uggccgcagcggcuguug

SEQ ID NO: 1550274 - RNA, 16 nt, Pseudomonas aeruginosa PA01
uggcacgaacccaggc

SEQ ID NO: 1550275 - RNA, 20 nt, Pseudomonas aeruginosa PA01
uggcaacccagggcgcugcc

SEQ ID NO: 1550276 - RNA, 15 nt, Pseudomonas aeruginosa PA01
uggcaaucaucgcgu

SEQ ID NO: 1550277 - RNA, 21 nt, Pseudomonas aeruginosa PA01
uuagggauggauacccuucau

SEQ ID NO: 1550278 - RNA, 13 nt, Pseudomonas aeruginosa PA01
uucaccagcgacg

SEQ ID NO: 1550279 - RNA, 16 nt, Pseudomonas aeruginosa PA01
uucaccaccccacaaa

SEQ ID NO: 1550280 - RNA, 19 nt, Pseudomonas aeruginosa PA01
uucaguagguagagaugca

SEQ ID NO: 1550281 - RNA, 19 nt, Pseudomonas aeruginosa PA01
uucagugcacguuccagcu

SEQ ID NO: 1550282 - RNA, 20 nt, Pseudomonas aeruginosa PA01
uucagugcacguuccagcuc

SEQ ID NO: 1550283 - RNA, 18 nt, Pseudomonas aeruginosa PA01
uucaucgccgccaggcag

SEQ ID NO: 1550284 - RNA, 16 nt, Pseudomonas aeruginosa PA01
uucaugaagucagcca

SEQ ID NO: 1550285 - RNA, 12 nt, Pseudomonas aeruginosa PA01
uucaucuuggcc

SEQ ID NO: 1550286 - RNA, 21 nt, Pseudomonas aeruginosa PA01
uucauggugcccagcaggcug

SEQ ID NO: 1550287 - RNA, 22 nt, Pseudomonas aeruginosa PA01
uucaugucuucucaaagggcag

SEQ ID NO: 1550288 - RNA, 15 nt, Pseudomonas aeruginosa PA01
uucauugggcagcca

SEQ ID NO: 1550289 - RNA, 21 nt, Pseudomonas aeruginosa PA01
uuccgguugcagccaccagcc

SEQ ID NO: 1550290 - RNA, 20 nt, Pseudomonas aeruginosa PA01
uucgacgaagggcucagccc

SEQ ID NO: 1550291 - RNA, 15 nt, Pseudomonas aeruginosa PA01
uucgaccuccaggcc

SEQ ID NO: 1550292 - RNA, 16 nt, Pseudomonas aeruginosa PA01
uucgaccuccaggccg

SEQ ID NO: 1550293 - RNA, 14 nt, Pseudomonas aeruginosa PA01
uucgaauccuccug

SEQ ID NO: 1550294 - RNA, 15 nt, Pseudomonas aeruginosa PA01
uuccuucucccggcu

SEQ ID NO: 1550295 - RNA, 13 nt, Pseudomonas aeruginosa PA01
uuccuuccagggu

SEQ ID NO: 1550296 - RNA, 21 nt, Pseudomonas aeruginosa PA01
uuccuuccaggguuuccagca

SEQ ID NO: 1550297 - RNA, 17 nt, Pseudomonas aeruginosa PA01
uucgaagauuccgcuga

SEQ ID NO: 1550298 - RNA, 20 nt, Pseudomonas aeruginosa PA01
uuccuugaccacggcgagga

SEQ ID NO: 1550299 - RNA, 20 nt, Pseudomonas aeruginosa PA01
uuccuugaccaucuuuuccu

SEQ ID NO: 1550300 - RNA, 18 nt, Pseudomonas aeruginosa PA01
uuccgccggaagcuucca

SEQ ID NO: 1550301 - RNA, 22 nt, Pseudomonas aeruginosa PA01
uuccggggugcauaggguccag

SEQ ID NO: 1550302 - RNA, 19 nt, Pseudomonas aeruginosa PA01
uuccggcgcagcggaggau

SEQ ID NO: 1550303 - RNA, 16 nt, Pseudomonas aeruginosa PA01
uucccguuuugccgac

SEQ ID NO: 1550304 - RNA, 23 nt, Pseudomonas aeruginosa PA01
uucccggcgcggcuacccucucc

SEQ ID NO: 1550305 - RNA, 21 nt, Pseudomonas aeruginosa PA01
uucgcccagcucgccgcucca

SEQ ID NO: 1550306 - RNA, 17 nt, Pseudomonas aeruginosa PA01
uucgcccuaccccccaa

SEQ ID NO: 1550307 - RNA, 13 nt, Pseudomonas aeruginosa PA01
uucgcgcaggacc

SEQ ID NO: 1550308 - RNA, 22 nt, Pseudomonas aeruginosa PA01
uucgcgcacgauagcgaaagaa

SEQ ID NO: 1550309 - RNA, 18 nt, Pseudomonas aeruginosa PA01
uucgcggaucucaggacc

SEQ ID NO: 1550310 - RNA, 23 nt, Pseudomonas aeruginosa PA01
uucgacgcgccacgcaggaacag

SEQ ID NO: 1550311 - RNA, 14 nt, Pseudomonas aeruginosa PA01
uucgacgcgcggcu

SEQ ID NO: 1550312 - RNA, 14 nt, Pseudomonas aeruginosa PA01
uucgacgcagcgcg

SEQ ID NO: 1550313 - RNA, 14 nt, Pseudomonas aeruginosa PA01
uucgaguccccuag

SEQ ID NO: 1550314 - RNA, 13 nt, Pseudomonas aeruginosa PA01
uucgaucccguca

SEQ ID NO: 1550315 - RNA, 23 nt, Pseudomonas aeruginosa PA01
uucggggaacagcgccagcggca

SEQ ID NO: 1550316 - RNA, 18 nt, Pseudomonas aeruginosa PA01
uucggggucggccugcgg

SEQ ID NO: 1550317 - RNA, 15 nt, Pseudomonas aeruginosa PA01
uucggguccaggcgc

SEQ ID NO: 1550318 - RNA, 18 nt, Pseudomonas aeruginosa PA01
uucggggcccuccaggcg

SEQ ID NO: 1550319 - RNA, 18 nt, Pseudomonas aeruginosa PA01
uucguugccauagccgac

SEQ ID NO: 1550320 - RNA, 16 nt, Pseudomonas aeruginosa PA01
uucguugaccacgcuc

SEQ ID NO: 1550321 - RNA, 21 nt, Pseudomonas aeruginosa PA01
uucguugagggccuugagcac

SEQ ID NO: 1550322 - RNA, 18 nt, Pseudomonas aeruginosa PA01
uucggcuguuucaggccg

SEQ ID NO: 1550323 - RNA, 14 nt, Pseudomonas aeruginosa PA01
uucggcggccaggc

SEQ ID NO: 1550324 - RNA, 15 nt, Pseudomonas aeruginosa PA01
uucggcgaccagccc

SEQ ID NO: 1550325 - RNA, 21 nt, Pseudomonas aeruginosa PA01
uucggcgcccacuccaaccau

SEQ ID NO: 1550326 - RNA, 21 nt, Pseudomonas aeruginosa PA01
uucggcgcgcggcagcaccag

SEQ ID NO: 1550327 - RNA, 18 nt, Pseudomonas aeruginosa PA01
uucggcgaugaccagcuc

SEQ ID NO: 1550328 - RNA, 18 nt, Pseudomonas aeruginosa PA01
uucggcagguugcucgcc

SEQ ID NO: 1550329 - RNA, 19 nt, Pseudomonas aeruginosa PA01
uucggcagguugcucgccu

SEQ ID NO: 1550330 - RNA, 12 nt, Pseudomonas aeruginosa PA01
uucggccagcgg

SEQ ID NO: 1550331 - RNA, 16 nt, Pseudomonas aeruginosa PA01
uucggccaguccuuga

SEQ ID NO: 1550332 - RNA, 14 nt, Pseudomonas aeruginosa PA01
uucgcgggccaggc

SEQ ID NO: 1550333 - RNA, 15 nt, Pseudomonas aeruginosa PA01
uucgcgggccaggcc

SEQ ID NO: 1550334 - RNA, 16 nt, Pseudomonas aeruginosa PA01
uucugggcggccaggu

SEQ ID NO: 1550335 - RNA, 21 nt, Pseudomonas aeruginosa PA01
uucugguccaccagcccgcag

SEQ ID NO: 1550336 - RNA, 20 nt, Pseudomonas aeruginosa PA01
uucugggucgcgcagggcag

SEQ ID NO: 1550337 - RNA, 15 nt, Pseudomonas aeruginosa PA01
uucuucguuccugau

SEQ ID NO: 1550338 - RNA, 19 nt, Pseudomonas aeruginosa PA01
uucuucgcgugggccaggg

SEQ ID NO: 1550339 - RNA, 14 nt, Pseudomonas aeruginosa PA01
uucuucgccuugcc

SEQ ID NO: 1550340 - RNA, 16 nt, Pseudomonas aeruginosa PA01
uucuucgccuugcccu

SEQ ID NO: 1550341 - RNA, 22 nt, Pseudomonas aeruginosa PA01
uucuuccccgccacuuccagca

SEQ ID NO: 1550342 - RNA, 19 nt, Pseudomonas aeruginosa PA01
uucuucacccgcagcggca

SEQ ID NO: 1550343 - RNA, 20 nt, Pseudomonas aeruginosa PA01
uucuucacccgcagcggcag

SEQ ID NO: 1550344 - RNA, 10 nt, Pseudomonas aeruginosa PA01
uucuucaguu

SEQ ID NO: 1550345 - RNA, 16 nt, Pseudomonas aeruginosa PA01
uucuuccacuugcgcc

SEQ ID NO: 1550346 - RNA, 23 nt, Pseudomonas aeruginosa PA01
uucuccgaccagguagagcagcc

SEQ ID NO: 1550347 - RNA, 16 nt, Pseudomonas aeruginosa PA01
uucuccagguacagcc

SEQ ID NO: 1550348 - RNA, 20 nt, Pseudomonas aeruginosa PA01
uucuccagguacagccgcag

SEQ ID NO: 1550349 - RNA, 22 nt, Pseudomonas aeruginosa PA01
uucuccaggucgaacagcggcu

SEQ ID NO: 1550350 - RNA, 17 nt, Pseudomonas aeruginosa PA01
uucuccaggcccauccu

SEQ ID NO: 1550351 - RNA, 19 nt, Pseudomonas aeruginosa PA01
uucuccaggcccauccugg

SEQ ID NO: 1550352 - RNA, 22 nt, Pseudomonas aeruginosa PA01
uucucccuucagggagaggaag

SEQ ID NO: 1550353 - RNA, 17 nt, Pseudomonas aeruginosa PA01
uucugcuggccgcgcag

SEQ ID NO: 1550354 - RNA, 19 nt, Pseudomonas aeruginosa PA01
uucugcuccggacugccga

SEQ ID NO: 1550355 - RNA, 16 nt, Pseudomonas aeruginosa PA01
uucugcucggccugga

SEQ ID NO: 1550356 - RNA, 14 nt, Pseudomonas aeruginosa PA01
uucugcuguggagc

SEQ ID NO: 1550357 - RNA, 21 nt, Pseudomonas aeruginosa PA01
uucucauugcgccgccggcuc

SEQ ID NO: 1550358 - RNA, 17 nt, Pseudomonas aeruginosa PA01
uucuccaccgccaccug

SEQ ID NO: 1550359 - RNA, 14 nt, Pseudomonas aeruginosa PA01
uuuaagagaaugcg

SEQ ID NO: 1550360 - RNA, 19 nt, Pseudomonas aeruginosa PA01
uugugauguaagacuggug

SEQ ID NO: 1550361 - RNA, 14 nt, Pseudomonas aeruginosa PA01
uugugcgccagcuc

SEQ ID NO: 1550362 - RNA, 16 nt, Pseudomonas aeruginosa PA01
uuguggagucaggcgc

SEQ ID NO: 1550363 - RNA, 14 nt, Pseudomonas aeruginosa PA01
uugucggucaggua

SEQ ID NO: 1550364 - RNA, 17 nt, Pseudomonas aeruginosa PA01
uugugguugggcaggcg

SEQ ID NO: 1550365 - RNA, 19 nt, Pseudomonas aeruginosa PA01
uuguucggcugggccagga

SEQ ID NO: 1550366 - RNA, 16 nt, Pseudomonas aeruginosa PA01
uuguugacguucugcc

SEQ ID NO: 1550367 - RNA, 17 nt, Pseudomonas aeruginosa PA01
uuguugacguucugccc

SEQ ID NO: 1550368 - RNA, 17 nt, Pseudomonas aeruginosa PA01
uuguucuucauccaguc

SEQ ID NO: 1550369 - RNA, 16 nt, Pseudomonas aeruginosa PA01
uuguaggcgccgccgu

SEQ ID NO: 1550370 - RNA, 21 nt, Pseudomonas aeruginosa PA01
uuguagaaacgguccagggcc

SEQ ID NO: 1550371 - RNA, 17 nt, Pseudomonas aeruginosa PA01
uuguccuucggccaguc

SEQ ID NO: 1550372 - RNA, 15 nt, Pseudomonas aeruginosa PA01
uuguccucggcggcu

SEQ ID NO: 1550373 - RNA, 14 nt, Pseudomonas aeruginosa PA01
uuguccggcccgga

SEQ ID NO: 1550374 - RNA, 22 nt, Pseudomonas aeruginosa PA01
uugucgaugagccagccugcag

SEQ ID NO: 1550375 - RNA, 11 nt, Pseudomonas aeruginosa PA01
uuguccaggcu

SEQ ID NO: 1550376 - RNA, 22 nt, Pseudomonas aeruginosa PA01
uuguccaggcuguggcgcggcu

SEQ ID NO: 1550377 - RNA, 12 nt, Pseudomonas aeruginosa PA01
uuguccagggca

SEQ ID NO: 1550378 - RNA, 12 nt, Pseudomonas aeruginosa PA01
uuguccagggcc

SEQ ID NO: 1550379 - RNA, 23 nt, Pseudomonas aeruginosa PA01
uugagcacgucgccuucgcugag

SEQ ID NO: 1550380 - RNA, 13 nt, Pseudomonas aeruginosa PA01
uugaguagaaaag

SEQ ID NO: 1550381 - RNA, 23 nt, Pseudomonas aeruginosa PA01
uugagucgcgcgcgcuucuuguc

SEQ ID NO: 1550382 - RNA, 14 nt, Pseudomonas aeruginosa PA01
uugagggcacggcc

SEQ ID NO: 1550383 - RNA, 15 nt, Pseudomonas aeruginosa PA01
uugagggccuugagc

SEQ ID NO: 1550384 - RNA, 17 nt, Pseudomonas aeruginosa PA01
uugaggucgugcagcac

SEQ ID NO: 1550385 - RNA, 18 nt, Pseudomonas aeruginosa PA01
uugaggucgugcagcaca

SEQ ID NO: 1550386 - RNA, 14 nt, Pseudomonas aeruginosa PA01
uugaggaagugcag

SEQ ID NO: 1550387 - RNA, 13 nt, Pseudomonas aeruginosa PA01
uugaggaagugga

SEQ ID NO: 1550388 - RNA, 19 nt, Pseudomonas aeruginosa PA01
uugauagcgcggccuucag

SEQ ID NO: 1550389 - RNA, 22 nt, Pseudomonas aeruginosa PA01
uugauacgguuugaggcguugg

SEQ ID NO: 1550390 - RNA, 16 nt, Pseudomonas aeruginosa PA01
uugauacccaccggcu

SEQ ID NO: 1550391 - RNA, 13 nt, Pseudomonas aeruginosa PA01
uugaucuuguccg

SEQ ID NO: 1550392 - RNA, 13 nt, Pseudomonas aeruginosa PA01
uugaucuuguccu

SEQ ID NO: 1550393 - RNA, 17 nt, Pseudomonas aeruginosa PA01
uugaucgacgccagcuc

SEQ ID NO: 1550394 - RNA, 20 nt, Pseudomonas aeruginosa PA01
uugcagagcggccaggucga

SEQ ID NO: 1550395 - RNA, 13 nt, Pseudomonas aeruginosa PA01
uugcagcaccccc

SEQ ID NO: 1550396 - RNA, 18 nt, Pseudomonas aeruginosa PA01
uugcacuugaaguguccg

SEQ ID NO: 1550397 - RNA, 19 nt, Pseudomonas aeruginosa PA01
uugcacuugcggcaguccu

SEQ ID NO: 1550398 - RNA, 17 nt, Pseudomonas aeruginosa PA01
uugcagggggcuuugcg

SEQ ID NO: 1550399 - RNA, 22 nt, Pseudomonas aeruginosa PA01
uugcaggcagucccagaaggcc

SEQ ID NO: 1550400 - RNA, 14 nt, Pseudomonas aeruginosa PA01
uugcaggccagcgc

SEQ ID NO: 1550401 - RNA, 16 nt, Pseudomonas aeruginosa PA01
uugcaggccagcgcca

SEQ ID NO: 1550402 - RNA, 15 nt, Pseudomonas aeruginosa PA01
uugccagaguugccu

SEQ ID NO: 1550403 - RNA, 20 nt, Pseudomonas aeruginosa PA01
uugcagugcgccgcagcgca

SEQ ID NO: 1550404 - RNA, 16 nt, Pseudomonas aeruginosa PA01
uugcgcuggcgcagca

SEQ ID NO: 1550405 - RNA, 14 nt, Pseudomonas aeruginosa PA01
uugcggcgcaggcg

SEQ ID NO: 1550406 - RNA, 15 nt, Pseudomonas aeruginosa PA01
uugcgcgccagcgcc

SEQ ID NO: 1550407 - RNA, 16 nt, Pseudomonas aeruginosa PA01
uugcgcgagcaccgcg

SEQ ID NO: 1550408 - RNA, 14 nt, Pseudomonas aeruginosa PA01
uugcgacugacgcu

SEQ ID NO: 1550409 - RNA, 11 nt, Pseudomonas aeruginosa PA01
uugccguggcu

SEQ ID NO: 1550410 - RNA, 18 nt, Pseudomonas aeruginosa PA01
uugccuccgcucugcugg

SEQ ID NO: 1550411 - RNA, 16 nt, Pseudomonas aeruginosa PA01
uugccgucgagcacca

SEQ ID NO: 1550412 - RNA, 18 nt, Pseudomonas aeruginosa PA01
uugccgucgagcaccagc

SEQ ID NO: 1550413 - RNA, 17 nt, Pseudomonas aeruginosa PA01
uugcccacggccaggcc

SEQ ID NO: 1550414 - RNA, 23 nt, Pseudomonas aeruginosa PA01
uugccagccggccuugcuuugcg

SEQ ID NO: 1550415 - RNA, 19 nt, Pseudomonas aeruginosa PA01
uuggaaguugccgccagcg

SEQ ID NO: 1550416 - RNA, 13 nt, Pseudomonas aeruginosa PA01
uuggaacuguugg

SEQ ID NO: 1550417 - RNA, 18 nt, Pseudomonas aeruginosa PA01
uuggaagaaagacguucc

SEQ ID NO: 1550418 - RNA, 13 nt, Pseudomonas aeruginosa PA01
uuggaauugcuga

SEQ ID NO: 1550419 - RNA, 20 nt, Pseudomonas aeruginosa PA01
uuggacagguccuggaacag

SEQ ID NO: 1550420 - RNA, 18 nt, Pseudomonas aeruginosa PA01
uuggcaucgugcuucuca

SEQ ID NO: 1550421 - RNA, 13 nt, Pseudomonas aeruginosa PA01
uuggcacccugga

SEQ ID NO: 1550422 - RNA, 16 nt, Pseudomonas aeruginosa PA01
uugcggcgccgaggcc

SEQ ID NO: 1550423 - RNA, 16 nt, Pseudomonas aeruginosa PA01
uugcuggcacaggucc

SEQ ID NO: 1550424 - RNA, 16 nt, Pseudomonas aeruginosa PA01
uuggcuuccagccagc

SEQ ID NO: 1550425 - RNA, 13 nt, Pseudomonas aeruginosa PA01
uuggcgcagguag

SEQ ID NO: 1550426 - RNA, 20 nt, Pseudomonas aeruginosa PA01
uuggcgaaguugccgccgcu

SEQ ID NO: 1550427 - RNA, 13 nt, Pseudomonas aeruginosa PA01
uuggcgaacucca

SEQ ID NO: 1550428 - RNA, 16 nt, Pseudomonas aeruginosa PA01
uuggccuggcccggcg

SEQ ID NO: 1550429 - RNA, 16 nt, Pseudomonas aeruginosa PA01
uuggcgaacaggcagc

SEQ ID NO: 1550430 - RNA, 14 nt, Pseudomonas aeruginosa PA01
uuggccagcagcau

SEQ ID NO: 1550431 - RNA, 22 nt, Pseudomonas aeruginosa PA01
uuggccacgcugcggaucaacu

SEQ ID NO: 1550432 - RNA, 20 nt, Pseudomonas aeruginosa PA01
uuggccacguagggcguggu

SEQ ID NO: 1550433 - RNA, 15 nt, Pseudomonas aeruginosa PA01
uuggccagcgcggcg

SEQ ID NO: 1550434 - RNA, 14 nt, Pseudomonas aeruginosa PA01
uuggccagcaggcg

SEQ ID NO: 1550435 - RNA, 14 nt, Pseudomonas aeruginosa PA01
uuggccaugggcac

SEQ ID NO: 1550436 - RNA, 18 nt, Pseudomonas aeruginosa PA01
uuggccaugggcacgccg

SEQ ID NO: 1550437 - RNA, 21 nt, Pseudomonas aeruginosa PA01
uuggccauguacguaucccag

SEQ ID NO: 1550438 - RNA, 13 nt, Pseudomonas aeruginosa PA01
uuggcccagaccu

SEQ ID NO: 1550439 - RNA, 18 nt, Pseudomonas aeruginosa PA01
uuggccgaaagcacugcg

SEQ ID NO: 1550440 - RNA, 13 nt, Pseudomonas aeruginosa PA01
uuggccagcgcca

SEQ ID NO: 1550441 - RNA, 14 nt, Pseudomonas aeruginosa PA01
uuggccagcgccac

SEQ ID NO: 1550442 - RNA, 21 nt, Pseudomonas aeruginosa PA01
uuggccgggguauccgggcac

SEQ ID NO: 1550443 - RNA, 23 nt, Pseudomonas aeruginosa PA01
uugggucagcggguuggcuucca

SEQ ID NO: 1550444 - RNA, 18 nt, Pseudomonas aeruginosa PA01
uuggugcugccgaugcug

SEQ ID NO: 1550445 - RNA, 18 nt, Pseudomonas aeruginosa PA01
uuggugcugcgcgcggcc

SEQ ID NO: 1550446 - RNA, 20 nt, Pseudomonas aeruginosa PA01
uugguguagcugcagcgccc

SEQ ID NO: 1550447 - RNA, 12 nt, Pseudomonas aeruginosa PA01
uuggucugcucg

SEQ ID NO: 1550448 - RNA, 12 nt, Pseudomonas aeruginosa PA01
uuggucaggccg

SEQ ID NO: 1550449 - RNA, 23 nt, Pseudomonas aeruginosa PA01
uuggucaggccgaccagcgccga

SEQ ID NO: 1550450 - RNA, 23 nt, Pseudomonas aeruginosa PA01
aaguugcgcagcaacuggucgcc

SEQ ID NO: 1550451 - RNA, 23 nt, Pseudomonas aeruginosa PA01
aaguucccgccgcucugcuggcc

SEQ ID NO: 1550452 - RNA, 16 nt, Pseudomonas aeruginosa PA01
aauagcagccauagca

SEQ ID NO: 1550453 - RNA, 16 nt, Pseudomonas aeruginosa PA01
aauagaucugcaccag

SEQ ID NO: 1550454 - RNA, 19 nt, Pseudomonas aeruginosa PA01
aauacugcacgcccaggcg

SEQ ID NO: 1550455 - RNA, 18 nt, Pseudomonas aeruginosa PA01
aauaccacguggccggcg

SEQ ID NO: 1550456 - RNA, 13 nt, Pseudomonas aeruginosa PA01
aauagccucagua

SEQ ID NO: 1550457 - RNA, 15 nt, Pseudomonas aeruginosa PA01
aagccuggagcaggg

SEQ ID NO: 1550458 - RNA, 20 nt, Pseudomonas aeruginosa PA01
aagccguggcgggccaugcg

SEQ ID NO: 1550459 - RNA, 18 nt, Pseudomonas aeruginosa PA01
aagccggccccugggccg

SEQ ID NO: 1550460 - RNA, 14 nt, Pseudomonas aeruginosa PA01
aagccgcgcgccga

SEQ ID NO: 1550461 - RNA, 22 nt, Pseudomonas aeruginosa PA01
aagccgcucggcguagccggcg

SEQ ID NO: 1550462 - RNA, 13 nt, Pseudomonas aeruginosa PA01
aagccggaagcgc

SEQ ID NO: 1550463 - RNA, 17 nt, Pseudomonas aeruginosa PA01
aagccggaagcgcucgc

SEQ ID NO: 1550464 - RNA, 14 nt, Pseudomonas aeruginosa PA01
aagccggaggcagc

SEQ ID NO: 1550465 - RNA, 19 nt, Pseudomonas aeruginosa PA01
aagcgauuccaugggcaga

SEQ ID NO: 1550466 - RNA, 11 nt, Pseudomonas aeruginosa PA01
aagccagccag

SEQ ID NO: 1550467 - RNA, 15 nt, Pseudomonas aeruginosa PA01
aagccagccaggucg

SEQ ID NO: 1550468 - RNA, 19 nt, Pseudomonas aeruginosa PA01
aagccagccaugugcuccu

SEQ ID NO: 1550469 - RNA, 13 nt, Pseudomonas aeruginosa PA01
aagccaggcaccg

SEQ ID NO: 1550470 - RNA, 11 nt, Pseudomonas aeruginosa PA01
aagaaggcgga

SEQ ID NO: 1550471 - RNA, 23 nt, Pseudomonas aeruginosa PA01
aagcccagcgagccgaucaccag

SEQ ID NO: 1550472 - RNA, 12 nt, Pseudomonas aeruginosa PA01
aagcccaggcug

SEQ ID NO: 1550473 - RNA, 21 nt, Pseudomonas aeruginosa PA01
aagcccugcuggcgcagccag

SEQ ID NO: 1550474 - RNA, 19 nt, Pseudomonas aeruginosa PA01
aagcccuucugucuugucc

SEQ ID NO: 1550475 - RNA, 17 nt, Pseudomonas aeruginosa PA01
aagccgacgccgagcag

SEQ ID NO: 1550476 - RNA, 19 nt, Pseudomonas aeruginosa PA01
aagccgacgccgagcagca

SEQ ID NO: 1550477 - RNA, 14 nt, Pseudomonas aeruginosa PA01
aagccgagcggcaa

SEQ ID NO: 1550478 - RNA, 17 nt, Pseudomonas aeruginosa PA01
aagcccggcgagagcgu

SEQ ID NO: 1550479 - RNA, 19 nt, Pseudomonas aeruginosa PA01
aagcccgugggaucgccac

SEQ ID NO: 1550480 - RNA, 18 nt, Pseudomonas aeruginosa PA01
aagccccagccuccaccc

SEQ ID NO: 1550481 - RNA, 16 nt, Pseudomonas aeruginosa PA01
aagccccgccaaggcg

SEQ ID NO: 1550482 - RNA, 13 nt, Pseudomonas aeruginosa PA01
aagccccgcgaac

SEQ ID NO: 1550483 - RNA, 20 nt, Pseudomonas aeruginosa PA01
aagcggcggcuucagccaga

SEQ ID NO: 1550484 - RNA, 23 nt, Pseudomonas aeruginosa PA01
aagcgggcuuuuucguuggccag

SEQ ID NO: 1550485 - RNA, 20 nt, Pseudomonas aeruginosa PA01
aagcgguagugggcgaggcg

SEQ ID NO: 1550486 - RNA, 13 nt, Pseudomonas aeruginosa PA01
aagcgccuucugc

SEQ ID NO: 1550487 - RNA, 13 nt, Pseudomonas aeruginosa PA01
aagcgcgcgccag

SEQ ID NO: 1550488 - RNA, 12 nt, Pseudomonas aeruginosa PA01
aagcgccaggcg

SEQ ID NO: 1550489 - RNA, 12 nt, Pseudomonas aeruginosa PA01
aagcgcaggcgg

SEQ ID NO: 1550490 - RNA, 16 nt, Pseudomonas aeruginosa PA01
aagcgguuagccggcg

SEQ ID NO: 1550491 - RNA, 16 nt, Pseudomonas aeruginosa PA01
aagcguucccccuuuu

SEQ ID NO: 1550492 - RNA, 18 nt, Pseudomonas aeruginosa PA01
aagcguucccccuuuuuc

SEQ ID NO: 1550493 - RNA, 19 nt, Pseudomonas aeruginosa PA01
aagcuucgucgcgcaggcg

SEQ ID NO: 1550494 - RNA, 17 nt, Pseudomonas aeruginosa PA01
aagcuucuucggcagcc

SEQ ID NO: 1550495 - RNA, 13 nt, Pseudomonas aeruginosa PA01
aagcuucaggcuc

SEQ ID NO: 1550496 - RNA, 16 nt, Pseudomonas aeruginosa PA01
aagugcggggugaucu

SEQ ID NO: 1550497 - RNA, 18 nt, Pseudomonas aeruginosa PA01
aagucugugaucaggcug

SEQ ID NO: 1550498 - RNA, 17 nt, Pseudomonas aeruginosa PA01
aaguccuugugcugcuc

SEQ ID NO: 1550499 - RNA, 17 nt, Pseudomonas aeruginosa PA01
aagucggcgagccggcg

SEQ ID NO: 1550500 - RNA, 16 nt, Pseudomonas aeruginosa PA01
aagucgcccgccggcg

SEQ ID NO: 1550501 - RNA, 23 nt, Pseudomonas aeruginosa PA01
aaguagugcagcugcgagaacag

SEQ ID NO: 1550502 - RNA, 16 nt, Pseudomonas aeruginosa PA01
aaguaggaguagguca

SEQ ID NO: 1550503 - RNA, 19 nt, Pseudomonas aeruginosa PA01
aaguacggcgcggugaggg

SEQ ID NO: 1550504 - RNA, 16 nt, Pseudomonas aeruginosa PA01
aaguagauaaaugccc

SEQ ID NO: 1550505 - RNA, 23 nt, Pseudomonas aeruginosa PA01
aagguccuugggccaggcaucca

SEQ ID NO: 1550506 - RNA, 17 nt, Pseudomonas aeruginosa PA01
aaggauuccacccgcuc

SEQ ID NO: 1550507 - RNA, 22 nt, Pseudomonas aeruginosa PA01
aaggcguucucguccucggcgu

SEQ ID NO: 1550508 - RNA, 22 nt, Pseudomonas aeruginosa PA01
aaggcgguguagaccaccagca

SEQ ID NO: 1550509 - RNA, 14 nt, Pseudomonas aeruginosa PA01
aagggaaacaccag

SEQ ID NO: 1550510 - RNA, 14 nt, Pseudomonas aeruginosa PA01
aaggauguccgggu

SEQ ID NO: 1550511 - RNA, 15 nt, Pseudomonas aeruginosa PA01
aaggaugcgccagcg

SEQ ID NO: 1550512 - RNA, 17 nt, Pseudomonas aeruginosa PA01
aagggcgccgccgagga

SEQ ID NO: 1550513 - RNA, 14 nt, Pseudomonas aeruginosa PA01
aagggagccaggcg

SEQ ID NO: 1550514 - RNA, 12 nt, Pseudomonas aeruginosa PA01
aagggccgcagg

SEQ ID NO: 1550515 - RNA, 12 nt, Pseudomonas aeruginosa PA01
aagggccagagc

SEQ ID NO: 1550516 - RNA, 15 nt, Pseudomonas aeruginosa PA01
aagggaugccgccgg

SEQ ID NO: 1550517 - RNA, 13 nt, Pseudomonas aeruginosa PA01
aauuggccaggcu

SEQ ID NO: 1550518 - RNA, 15 nt, Pseudomonas aeruginosa PA01
aauugcgcuggaagu

SEQ ID NO: 1550519 - RNA, 18 nt, Pseudomonas aeruginosa PA01
aauugccuccgcucugcu

SEQ ID NO: 1550520 - RNA, 22 nt, Pseudomonas aeruginosa PA01
aauugccuccgcucugcuggcc

SEQ ID NO: 1550521 - RNA, 13 nt, Pseudomonas aeruginosa PA01
aauugccguaggg

SEQ ID NO: 1550522 - RNA, 14 nt, Pseudomonas aeruginosa PA01
aauugcccguaggg

SEQ ID NO: 1550523 - RNA, 15 nt, Pseudomonas aeruginosa PA01
aauucgcguccacca

SEQ ID NO: 1550524 - RNA, 21 nt, Pseudomonas aeruginosa PA01
aauuccagcuuguccacgcca

SEQ ID NO: 1550525 - RNA, 17 nt, Pseudomonas aeruginosa PA01
aauucagcgcagcgaag

SEQ ID NO: 1550526 - RNA, 19 nt, Pseudomonas aeruginosa PA01
aaugcuuccguagguggau

SEQ ID NO: 1550527 - RNA, 19 nt, Pseudomonas aeruginosa PA01
aauggaaacgccagcccuc

SEQ ID NO: 1550528 - RNA, 18 nt, Pseudomonas aeruginosa PA01
aauggcgccggccagagc

SEQ ID NO: 1550529 - RNA, 13 nt, Pseudomonas aeruginosa PA01
aauggaugaacgu

SEQ ID NO: 1550530 - RNA, 16 nt, Pseudomonas aeruginosa PA01
aauggcgcuccagggc

SEQ ID NO: 1550531 - RNA, 17 nt, Pseudomonas aeruginosa PA01
aauggcgcuccagggcg

SEQ ID NO: 1550532 - RNA, 11 nt, Pseudomonas aeruginosa PA01
aaugcccggca

SEQ ID NO: 1550533 - RNA, 22 nt, Pseudomonas aeruginosa PA01
aaugccgggcuuuuucauuucc

SEQ ID NO: 1550534 - RNA, 12 nt, Pseudomonas aeruginosa PA01
aaugaaaaaggg

SEQ ID NO: 1550535 - RNA, 21 nt, Pseudomonas aeruginosa PA01
aaucccuuggcugcucgccuc

SEQ ID NO: 1550536 - RNA, 13 nt, Pseudomonas aeruginosa PA01
aauccccaguagc

SEQ ID NO: 1550537 - RNA, 19 nt, Pseudomonas aeruginosa PA01
aauccgcuucguugccaua

SEQ ID NO: 1550538 - RNA, 13 nt, Pseudomonas aeruginosa PA01
aaucgccagcagg

SEQ ID NO: 1550539 - RNA, 18 nt, Pseudomonas aeruginosa PA01
aaucgccauuggccaggg

SEQ ID NO: 1550540 - RNA, 22 nt, Pseudomonas aeruginosa PA01
aaucgguugccgcgccaaaaag

SEQ ID NO: 1550541 - RNA, 13 nt, Pseudomonas aeruginosa PA01
aaucgucgccgga

SEQ ID NO: 1550542 - RNA, 18 nt, Pseudomonas aeruginosa PA01
aauccacgcugugcggca

SEQ ID NO: 1550543 - RNA, 16 nt, Pseudomonas aeruginosa PA01
aauccagggagaacag

SEQ ID NO: 1550544 - RNA, 11 nt, Pseudomonas aeruginosa PA01
aaucagggcug

SEQ ID NO: 1550545 - RNA, 15 nt, Pseudomonas aeruginosa PA01
aaucaucggcccugg

SEQ ID NO: 1550546 - RNA, 12 nt, Pseudomonas aeruginosa PA01
aaccuucucccu

SEQ ID NO: 1550547 - RNA, 15 nt, Pseudomonas aeruginosa PA01
aacgaagugaagcga

SEQ ID NO: 1550548 - RNA, 16 nt, Pseudomonas aeruginosa PA01
aacgaccacgccugcc

SEQ ID NO: 1550549 - RNA, 13 nt, Pseudomonas aeruginosa PA01
aaccugcauguca

SEQ ID NO: 1550550 - RNA, 17 nt, Pseudomonas aeruginosa PA01
aaccugccagaaaaccc

SEQ ID NO: 1550551 - RNA, 18 nt, Pseudomonas aeruginosa PA01
aaccugccagaaaaccca

SEQ ID NO: 1550552 - RNA, 24 nt, Pseudomonas aeruginosa PA01
aaccgucggcaauucuucaagguc

SEQ ID NO: 1550553 - RNA, 19 nt, Pseudomonas aeruginosa PA01
aacgcacuucguccgccac

SEQ ID NO: 1550554 - RNA, 20 nt, Pseudomonas aeruginosa PA01
aacgauugcggcagaagcuu

SEQ ID NO: 1550555 - RNA, 16 nt, Pseudomonas aeruginosa PA01
aacgauucgacgcagc

SEQ ID NO: 1550556 - RNA, 14 nt, Pseudomonas aeruginosa PA01
aacgagagguugcu

SEQ ID NO: 1550557 - RNA, 21 nt, Pseudomonas aeruginosa PA01
aacgagagguugcuguagaau

SEQ ID NO: 1550558 - RNA, 17 nt, Pseudomonas aeruginosa PA01
aacgauaccgccgccgg

SEQ ID NO: 1550559 - RNA, 19 nt, Pseudomonas aeruginosa PA01
aacgcgaaugcccggcagc

SEQ ID NO: 1550560 - RNA, 17 nt, Pseudomonas aeruginosa PA01
aacgccgguggcguuau

SEQ ID NO: 1550561 - RNA, 18 nt, Pseudomonas aeruginosa PA01
aacgccgggucuucagug

SEQ ID NO: 1550562 - RNA, 17 nt, Pseudomonas aeruginosa PA01
aacgccgcagcucggcc

SEQ ID NO: 1550563 - RNA, 13 nt, Pseudomonas aeruginosa PA01
aacgccgcaggcg

SEQ ID NO: 1550564 - RNA, 19 nt, Pseudomonas aeruginosa PA01
aacgcccgcggcagcagcc

SEQ ID NO: 1550565 - RNA, 22 nt, Pseudomonas aeruginosa PA01
aacgcccggcaucugccgggcg

SEQ ID NO: 1550566 - RNA, 12 nt, Pseudomonas aeruginosa PA01
aacgccaggcug

SEQ ID NO: 1550567 - RNA, 14 nt, Pseudomonas aeruginosa PA01
aacggcaggccagc

SEQ ID NO: 1550568 - RNA, 12 nt, Pseudomonas aeruginosa PA01
aacggcagcugg

SEQ ID NO: 1550569 - RNA, 20 nt, Pseudomonas aeruginosa PA01
aacgcuucgaagcucucgcc

SEQ ID NO: 1550570 - RNA, 14 nt, Pseudomonas aeruginosa PA01
aacgcuuccagcac

SEQ ID NO: 1550571 - RNA, 13 nt, Pseudomonas aeruginosa PA01
aacgcggccagca

SEQ ID NO: 1550572 - RNA, 15 nt, Pseudomonas aeruginosa PA01
aacgcggccagcagc

SEQ ID NO: 1550573 - RNA, 16 nt, Pseudomonas aeruginosa PA01
aacgcggccagcagca

SEQ ID NO: 1550574 - RNA, 15 nt, Pseudomonas aeruginosa PA01
aacgcggagcaggcg

SEQ ID NO: 1550575 - RNA, 15 nt, Pseudomonas aeruginosa PA01
aacgcgcugacggca

SEQ ID NO: 1550576 - RNA, 16 nt, Pseudomonas aeruginosa PA01
aacgcgcccacuccuc

SEQ ID NO: 1550577 - RNA, 18 nt, Pseudomonas aeruginosa PA01
aacgcgcccacuccuccg

SEQ ID NO: 1550578 - RNA, 17 nt, Pseudomonas aeruginosa PA01
aacgcgcccggccaggc

SEQ ID NO: 1550579 - RNA, 15 nt, Pseudomonas aeruginosa PA01
aacgggcgcucuggc

SEQ ID NO: 1550580 - RNA, 19 nt, Pseudomonas aeruginosa PA01
aacgggcccugccagagga

SEQ ID NO: 1550581 - RNA, 12 nt, Pseudomonas aeruginosa PA01
aacgggacaggu

SEQ ID NO: 1550582 - RNA, 16 nt, Pseudomonas aeruginosa PA01
aacggcggauaaccgc

SEQ ID NO: 1550583 - RNA, 17 nt, Pseudomonas aeruginosa PA01
aacggcguguccagggu

SEQ ID NO: 1550584 - RNA, 23 nt, Pseudomonas aeruginosa PA01
aacggccgcuugaucuuguccug

SEQ ID NO: 1550585 - RNA, 19 nt, Pseudomonas aeruginosa PA01
aacggcgcccucgggcgcc

SEQ ID NO: 1550586 - RNA, 21 nt, Pseudomonas aeruginosa PA01
aacggccaggucuucuggaaa

SEQ ID NO: 1550587 - RNA, 23 nt, Pseudomonas aeruginosa PA01
aacgguagcccgcggcgagcagc

SEQ ID NO: 1550588 - RNA, 13 nt, Pseudomonas aeruginosa PA01
aacgugcggccug

SEQ ID NO: 1550589 - RNA, 13 nt, Pseudomonas aeruginosa PA01
aacgucaggcugu

SEQ ID NO: 1550590 - RNA, 16 nt, Pseudomonas aeruginosa PA01
aacgucuucaggcgcu

SEQ ID NO: 1550591 - RNA, 18 nt, Pseudomonas aeruginosa PA01
aacucgugcuccaccucg

SEQ ID NO: 1550592 - RNA, 16 nt, Pseudomonas aeruginosa PA01
aacugcgauggaacga

SEQ ID NO: 1550593 - RNA, 17 nt, Pseudomonas aeruginosa PA01
aacugcgcccccagcgc

SEQ ID NO: 1550594 - RNA, 18 nt, Pseudomonas aeruginosa PA01
aacugcacguugcugugc

SEQ ID NO: 1550595 - RNA, 20 nt, Pseudomonas aeruginosa PA01
aacugcagggcgucgccggg

SEQ ID NO: 1550596 - RNA, 10 nt, Pseudomonas aeruginosa PA01
aacugcaugu

SEQ ID NO: 1550597 - RNA, 19 nt, Pseudomonas aeruginosa PA01
aacugacggcggaaggcgg

SEQ ID NO: 1550598 - RNA, 21 nt, Pseudomonas aeruginosa PA01
aacugggcgagcaucuucuuc

SEQ ID NO: 1550599 - RNA, 20 nt, Pseudomonas aeruginosa PA01
aacuggucgccgcagguccg

SEQ ID NO: 1550600 - RNA, 17 nt, Pseudomonas aeruginosa PA01
aacuggucgcuccagcc

SEQ ID NO: 1550601 - RNA, 16 nt, Pseudomonas aeruginosa PA01
aacuggucggggcgca

SEQ ID NO: 1550602 - RNA, 20 nt, Pseudomonas aeruginosa PA01
aacuggaagccugccagacc

SEQ ID NO: 1550603 - RNA, 18 nt, Pseudomonas aeruginosa PA01
aacugcuuaccuugccgg

SEQ ID NO: 1550604 - RNA, 11 nt, Pseudomonas aeruginosa PA01
aacugcuugcc

SEQ ID NO: 1550605 - RNA, 19 nt, Pseudomonas aeruginosa PA01
aacuggaugaugguaucca

SEQ ID NO: 1550606 - RNA, 21 nt, Pseudomonas aeruginosa PA01
aacuggaugucgcuggccagc

SEQ ID NO: 1550607 - RNA, 16 nt, Pseudomonas aeruginosa PA01
aacuuuaggucugccu

SEQ ID NO: 1550608 - RNA, 15 nt, Pseudomonas aeruginosa PA01
aacuugucgccgcug

SEQ ID NO: 1550609 - RNA, 16 nt, Pseudomonas aeruginosa PA01
aagaagccgaucacca

SEQ ID NO: 1550610 - RNA, 14 nt, Pseudomonas aeruginosa PA01
aagaagccgcacuu

SEQ ID NO: 1550611 - RNA, 15 nt, Pseudomonas aeruginosa PA01
aacuuuuuggaucag

SEQ ID NO: 1550612 - RNA, 14 nt, Pseudomonas aeruginosa PA01
aagaaaagaaggcg

SEQ ID NO: 1550613 - RNA, 21 nt, Pseudomonas aeruginosa PA01
aagaaaauuuucgaaaauaac

SEQ ID NO: 1550614 - RNA, 16 nt, Pseudomonas aeruginosa PA01
aagaaacgguggaggc

SEQ ID NO: 1550615 - RNA, 18 nt, Pseudomonas aeruginosa PA01
aaauuucgugaaaugaaa

SEQ ID NO: 1550616 - RNA, 16 nt, Pseudomonas aeruginosa PA01
aacaagccaccuucga

SEQ ID NO: 1550617 - RNA, 17 nt, Pseudomonas aeruginosa PA01
aacacacgcuucugcug

SEQ ID NO: 1550618 - RNA, 18 nt, Pseudomonas aeruginosa PA01
aacacauagaccagcagc

SEQ ID NO: 1550619 - RNA, 20 nt, Pseudomonas aeruginosa PA01
aacaccaggagcgccagcac

SEQ ID NO: 1550620 - RNA, 21 nt, Pseudomonas aeruginosa PA01
aacaccagcgccgccaggcag

SEQ ID NO: 1550621 - RNA, 16 nt, Pseudomonas aeruginosa PA01
aacacuguggagucga

SEQ ID NO: 1550622 - RNA, 13 nt, Pseudomonas aeruginosa PA01
aacagcagccagg

SEQ ID NO: 1550623 - RNA, 15 nt, Pseudomonas aeruginosa PA01
aacagcagccaggcg

SEQ ID NO: 1550624 - RNA, 20 nt, Pseudomonas aeruginosa PA01
aacagcagcggcaccagcac

SEQ ID NO: 1550625 - RNA, 10 nt, Pseudomonas aeruginosa PA01
aacagcagca

SEQ ID NO: 1550626 - RNA, 14 nt, Pseudomonas aeruginosa PA01
aacagcagcaagcc

SEQ ID NO: 1550627 - RNA, 14 nt, Pseudomonas aeruginosa PA01
aacagcgagcccag

SEQ ID NO: 1550628 - RNA, 23 nt, Pseudomonas aeruginosa PA01
aacagccgccccaccaccaucgc

SEQ ID NO: 1550629 - RNA, 13 nt, Pseudomonas aeruginosa PA01
aacagcgccacca

SEQ ID NO: 1550630 - RNA, 15 nt, Pseudomonas aeruginosa PA01
aacagcgccaccagc

SEQ ID NO: 1550631 - RNA, 23 nt, Pseudomonas aeruginosa PA01
aacagcgccaccagcaugcccag

SEQ ID NO: 1550632 - RNA, 15 nt, Pseudomonas aeruginosa PA01
aacagcgccagcggc

SEQ ID NO: 1550633 - RNA, 13 nt, Pseudomonas aeruginosa PA01
aacagcggaaugc

SEQ ID NO: 1550634 - RNA, 14 nt, Pseudomonas aeruginosa PA01
aacagcgcgaacag

SEQ ID NO: 1550635 - RNA, 17 nt, Pseudomonas aeruginosa PA01
aacagcuccgguacccg

SEQ ID NO: 1550636 - RNA, 13 nt, Pseudomonas aeruginosa PA01
aacagcuccucca

SEQ ID NO: 1550637 - RNA, 16 nt, Pseudomonas aeruginosa PA01
aacagcuccuccagcg

SEQ ID NO: 1550638 - RNA, 20 nt, Pseudomonas aeruginosa PA01
aacagcuccuccagcguggc

SEQ ID NO: 1550639 - RNA, 21 nt, Pseudomonas aeruginosa PA01
aacagggguucgaguccccua

SEQ ID NO: 1550640 - RNA, 14 nt, Pseudomonas aeruginosa PA01
aacaguugccgcag

SEQ ID NO: 1550641 - RNA, 19 nt, Pseudomonas aeruginosa PA01
aacaguggguaggccaggc

SEQ ID NO: 1550642 - RNA, 20 nt, Pseudomonas aeruginosa PA01
aacaguggguaggccaggca

SEQ ID NO: 1550643 - RNA, 21 nt, Pseudomonas aeruginosa PA01
aacaucagcagcgccagcagg

SEQ ID NO: 1550644 - RNA, 14 nt, Pseudomonas aeruginosa PA01
aacaucgccagcgc

SEQ ID NO: 1550645 - RNA, 23 nt, Pseudomonas aeruginosa PA01
aacaucgccugcuuggcggcggu

SEQ ID NO: 1550646 - RNA, 14 nt, Pseudomonas aeruginosa PA01
aacccggcgcuggc

SEQ ID NO: 1550647 - RNA, 19 nt, Pseudomonas aeruginosa PA01
aacccggccaggcccucag

SEQ ID NO: 1550648 - RNA, 16 nt, Pseudomonas aeruginosa PA01
aaccccggccuggcgc

SEQ ID NO: 1550649 - RNA, 17 nt, Pseudomonas aeruginosa PA01
aaccccuggaucuccug

SEQ ID NO: 1550650 - RNA, 18 nt, Pseudomonas aeruginosa PA01
aaccgacgcgcaggagug

SEQ ID NO: 1550651 - RNA, 23 nt, Pseudomonas aeruginosa PA01
aaccgagcggucggagguucgaa

SEQ ID NO: 1550652 - RNA, 22 nt, Pseudomonas aeruginosa PA01
aacccucggugcggccgaggaa

SEQ ID NO: 1550653 - RNA, 22 nt, Pseudomonas aeruginosa PA01
aacccugcccagugggccaccg

SEQ ID NO: 1550654 - RNA, 17 nt, Pseudomonas aeruginosa PA01
aaccgccguagccgucg

SEQ ID NO: 1550655 - RNA, 14 nt, Pseudomonas aeruginosa PA01
aaccgcggccggcu

SEQ ID NO: 1550656 - RNA, 23 nt, Pseudomonas aeruginosa PA01
aaccgaucagcaccgccaccagc

SEQ ID NO: 1550657 - RNA, 15 nt, Pseudomonas aeruginosa PA01
aaccgauggccaggg

SEQ ID NO: 1550658 - RNA, 13 nt, Pseudomonas aeruginosa PA01
aaccgggcagcag

SEQ ID NO: 1550659 - RNA, 22 nt, Pseudomonas aeruginosa PA01
aaccaggaaggcguagaccucg

SEQ ID NO: 1550660 - RNA, 14 nt, Pseudomonas aeruginosa PA01
aaccagacgcucgg

SEQ ID NO: 1550661 - RNA, 15 nt, Pseudomonas aeruginosa PA01
aaccacgggaauggc

SEQ ID NO: 1550662 - RNA, 15 nt, Pseudomonas aeruginosa PA01
aaccaccgcucucga

SEQ ID NO: 1550663 - RNA, 14 nt, Pseudomonas aeruginosa PA01
aaccaguccagcac

SEQ ID NO: 1550664 - RNA, 15 nt, Pseudomonas aeruginosa PA01
aaccaguccagcacg

SEQ ID NO: 1550665 - RNA, 23 nt, Pseudomonas aeruginosa PA01
aacccaggcgcugcguuccuguu

SEQ ID NO: 1550666 - RNA, 16 nt, Pseudomonas aeruginosa PA01
aacccagggugcggua

SEQ ID NO: 1550667 - RNA, 14 nt, Pseudomonas aeruginosa PA01
aacccaaucacaac

SEQ ID NO: 1550668 - RNA, 16 nt, Pseudomonas aeruginosa PA01
accgcgcgccugcaac

SEQ ID NO: 1550669 - RNA, 20 nt, Pseudomonas aeruginosa PA01
accgcgcggauccccucccg

SEQ ID NO: 1550670 - RNA, 22 nt, Pseudomonas aeruginosa PA01
accgcgcgauaaaaagccccgc

SEQ ID NO: 1550671 - RNA, 23 nt, Pseudomonas aeruginosa PA01
accgcgccgggaagcaccgacuc

SEQ ID NO: 1550672 - RNA, 15 nt, Pseudomonas aeruginosa PA01
accgcgcuugacgac

SEQ ID NO: 1550673 - RNA, 17 nt, Pseudomonas aeruginosa PA01
accgcggauccacgccu

SEQ ID NO: 1550674 - RNA, 21 nt, Pseudomonas aeruginosa PA01
accgcggauccacgccuggcc

SEQ ID NO: 1550675 - RNA, 18 nt, Pseudomonas aeruginosa PA01
accgcuccggcgccgagg

SEQ ID NO: 1550676 - RNA, 13 nt, Pseudomonas aeruginosa PA01
accgcugccgccg

SEQ ID NO: 1550677 - RNA, 14 nt, Pseudomonas aeruginosa PA01
accgcugccgccgu

SEQ ID NO: 1550678 - RNA, 15 nt, Pseudomonas aeruginosa PA01
accgcugccgccguc

SEQ ID NO: 1550679 - RNA, 22 nt, Pseudomonas aeruginosa PA01
accgcucgcgguuauccgccgg

SEQ ID NO: 1550680 - RNA, 19 nt, Pseudomonas aeruginosa PA01
accgcugcgcaggugcuug

SEQ ID NO: 1550681 - RNA, 12 nt, Pseudomonas aeruginosa PA01
accgcugcgccg

SEQ ID NO: 1550682 - RNA, 16 nt, Pseudomonas aeruginosa PA01
accgcugcgccgccgu

SEQ ID NO: 1550683 - RNA, 16 nt, Pseudomonas aeruginosa PA01
accgcugcggccggcg

SEQ ID NO: 1550684 - RNA, 13 nt, Pseudomonas aeruginosa PA01
accgccugcucgc

SEQ ID NO: 1550685 - RNA, 23 nt, Pseudomonas aeruginosa PA01
accgcgccgcgcuuggccuugcc

SEQ ID NO: 1550686 - RNA, 15 nt, Pseudomonas aeruginosa PA01
accgcgacaacccug

SEQ ID NO: 1550687 - RNA, 19 nt, Pseudomonas aeruginosa PA01
accgcgacaacccuguccc

SEQ ID NO: 1550688 - RNA, 24 nt, Pseudomonas aeruginosa PA01
accgcgacaacccuguccccucac

SEQ ID NO: 1550689 - RNA, 23 nt, Pseudomonas aeruginosa PA01
accgccugcagcaccaccucgcc

SEQ ID NO: 1550690 - RNA, 20 nt, Pseudomonas aeruginosa PA01
accgccucggagaacagcag

SEQ ID NO: 1550691 - RNA, 12 nt, Pseudomonas aeruginosa PA01
accgccaugcug

SEQ ID NO: 1550692 - RNA, 16 nt, Pseudomonas aeruginosa PA01
accgcccagccgaggu

SEQ ID NO: 1550693 - RNA, 14 nt, Pseudomonas aeruginosa PA01
accgcccaggcugc

SEQ ID NO: 1550694 - RNA, 16 nt, Pseudomonas aeruginosa PA01
accgccggguacagcg

SEQ ID NO: 1550695 - RNA, 17 nt, Pseudomonas aeruginosa PA01
accccguuguacccggc

SEQ ID NO: 1550696 - RNA, 16 nt, Pseudomonas aeruginosa PA01
accccgccgcuggcgg

SEQ ID NO: 1550697 - RNA, 22 nt, Pseudomonas aeruginosa PA01
accccgccggcguucgacgccu

SEQ ID NO: 1550698 - RNA, 23 nt, Pseudomonas aeruginosa PA01
accccgccggggcgugcaggccg

SEQ ID NO: 1550699 - RNA, 17 nt, Pseudomonas aeruginosa PA01
accgauggccagggggc

SEQ ID NO: 1550700 - RNA, 17 nt, Pseudomonas aeruginosa PA01
accgaucgcccgcgccu

SEQ ID NO: 1550701 - RNA, 23 nt, Pseudomonas aeruginosa PA01
accccugggaugccgccaagccc

SEQ ID NO: 1550702 - RNA, 14 nt, Pseudomonas aeruginosa PA01
accccuucgagcaa

SEQ ID NO: 1550703 - RNA, 14 nt, Pseudomonas aeruginosa PA01
accccuuccccccg

SEQ ID NO: 1550704 - RNA, 17 nt, Pseudomonas aeruginosa PA01
accgccaaggccucggc

SEQ ID NO: 1550705 - RNA, 20 nt, Pseudomonas aeruginosa PA01
accgccaaggccucggcauc

SEQ ID NO: 1550706 - RNA, 14 nt, Pseudomonas aeruginosa PA01
accgauucgccggc

SEQ ID NO: 1550707 - RNA, 16 nt, Pseudomonas aeruginosa PA01
accggcaaggcggccu

SEQ ID NO: 1550708 - RNA, 15 nt, Pseudomonas aeruginosa PA01
accgcuuccugggcu

SEQ ID NO: 1550709 - RNA, 13 nt, Pseudomonas aeruginosa PA01
accggcagcagcg

SEQ ID NO: 1550710 - RNA, 21 nt, Pseudomonas aeruginosa PA01
accggcagucccugccagggg

SEQ ID NO: 1550711 - RNA, 16 nt, Pseudomonas aeruginosa PA01
accggcaggacgauga

SEQ ID NO: 1550712 - RNA, 16 nt, Pseudomonas aeruginosa PA01
accggcagcgccgcca

SEQ ID NO: 1550713 - RNA, 22 nt, Pseudomonas aeruginosa PA01
accggcagcgccgccagcagga

SEQ ID NO: 1550714 - RNA, 11 nt, Pseudomonas aeruginosa PA01
accggccagcg

SEQ ID NO: 1550715 - RNA, 17 nt, Pseudomonas aeruginosa PA01
accggccaucagcacca

SEQ ID NO: 1550716 - RNA, 22 nt, Pseudomonas aeruginosa PA01
accggccaucagcaccaggaag

SEQ ID NO: 1550717 - RNA, 18 nt, Pseudomonas aeruginosa PA01
accggcguccccuuccuc

SEQ ID NO: 1550718 - RNA, 15 nt, Pseudomonas aeruginosa PA01
accggcguccgggug

SEQ ID NO: 1550719 - RNA, 21 nt, Pseudomonas aeruginosa PA01
accggcggauuacuccgccgg

SEQ ID NO: 1550720 - RNA, 12 nt, Pseudomonas aeruginosa PA01
accggcgcgccu

SEQ ID NO: 1550721 - RNA, 14 nt, Pseudomonas aeruginosa PA01
accggcgccacccu

SEQ ID NO: 1550722 - RNA, 14 nt, Pseudomonas aeruginosa PA01
accggcgaugcuca

SEQ ID NO: 1550723 - RNA, 14 nt, Pseudomonas aeruginosa PA01
accggccgcagcag

SEQ ID NO: 1550724 - RNA, 21 nt, Pseudomonas aeruginosa PA01
accggcuuggucacgccguuc

SEQ ID NO: 1550725 - RNA, 14 nt, Pseudomonas aeruginosa PA01
accggcuggcggcu

SEQ ID NO: 1550726 - RNA, 15 nt, Pseudomonas aeruginosa PA01
accggcuggcggcuc

SEQ ID NO: 1550727 - RNA, 18 nt, Pseudomonas aeruginosa PA01
accgggaugaacugcagc

SEQ ID NO: 1550728 - RNA, 16 nt, Pseudomonas aeruginosa PA01
accgggaagcaggucu

SEQ ID NO: 1550729 - RNA, 17 nt, Pseudomonas aeruginosa PA01
accgggaagcaggucuc

SEQ ID NO: 1550730 - RNA, 13 nt, Pseudomonas aeruginosa PA01
accgggaggcgcc

SEQ ID NO: 1550731 - RNA, 13 nt, Pseudomonas aeruginosa PA01
accgggccgccgg

SEQ ID NO: 1550732 - RNA, 17 nt, Pseudomonas aeruginosa PA01
accgggcggcaggcgcc

SEQ ID NO: 1550733 - RNA, 12 nt, Pseudomonas aeruginosa PA01
accggggccuuc

SEQ ID NO: 1550734 - RNA, 19 nt, Pseudomonas aeruginosa PA01
accggucgagagggauacc

SEQ ID NO: 1550735 - RNA, 20 nt, Pseudomonas aeruginosa PA01
accgguacgcucaccaccac

SEQ ID NO: 1550736 - RNA, 14 nt, Pseudomonas aeruginosa PA01
accgguggacuggu

SEQ ID NO: 1550737 - RNA, 15 nt, Pseudomonas aeruginosa PA01
accgguggacugguu

SEQ ID NO: 1550738 - RNA, 15 nt, Pseudomonas aeruginosa PA01
accgucgggcaguuc

SEQ ID NO: 1550739 - RNA, 12 nt, Pseudomonas aeruginosa PA01
accgucggccgg

SEQ ID NO: 1550740 - RNA, 18 nt, Pseudomonas aeruginosa PA01
accgucgaucucgagcau

SEQ ID NO: 1550741 - RNA, 17 nt, Pseudomonas aeruginosa PA01
accgucugcaccgcccu

SEQ ID NO: 1550742 - RNA, 16 nt, Pseudomonas aeruginosa PA01
accgugaccagcaugg

SEQ ID NO: 1550743 - RNA, 13 nt, Pseudomonas aeruginosa PA01
accguggcggccg

SEQ ID NO: 1550744 - RNA, 17 nt, Pseudomonas aeruginosa PA01
accguggcggccgccgc

SEQ ID NO: 1550745 - RNA, 19 nt, Pseudomonas aeruginosa PA01
accgugcgcgcggccuguu

SEQ ID NO: 1550746 - RNA, 16 nt, Pseudomonas aeruginosa PA01
accgucauggugcguu

SEQ ID NO: 1550747 - RNA, 17 nt, Pseudomonas aeruginosa PA01
accgucauguuguucgc

SEQ ID NO: 1550748 - RNA, 18 nt, Pseudomonas aeruginosa PA01
accguccgcagcgccacu

SEQ ID NO: 1550749 - RNA, 13 nt, Pseudomonas aeruginosa PA01
accgucagccagg

SEQ ID NO: 1550750 - RNA, 23 nt, Pseudomonas aeruginosa PA01
accguucugccgcagcgccuccc

SEQ ID NO: 1550751 - RNA, 15 nt, Pseudomonas aeruginosa PA01
accguucccagcagc

SEQ ID NO: 1550752 - RNA, 17 nt, Pseudomonas aeruginosa PA01
accgugugcgugcucuu

SEQ ID NO: 1550753 - RNA, 19 nt, Pseudomonas aeruginosa PA01
accguuggcgaugaucugg

SEQ ID NO: 1550754 - RNA, 18 nt, Pseudomonas aeruginosa PA01
accucauacuugggucgu

SEQ ID NO: 1550755 - RNA, 16 nt, Pseudomonas aeruginosa PA01
accucagaccacgccc

SEQ ID NO: 1550756 - RNA, 12 nt, Pseudomonas aeruginosa PA01
accuccagccag

SEQ ID NO: 1550757 - RNA, 20 nt, Pseudomonas aeruginosa PA01
accuccagccagcagcccgg

SEQ ID NO: 1550758 - RNA, 18 nt, Pseudomonas aeruginosa PA01
accuccagggccagcuug

SEQ ID NO: 1550759 - RNA, 14 nt, Pseudomonas aeruginosa PA01
accuccagccggcc

SEQ ID NO: 1550760 - RNA, 16 nt, Pseudomonas aeruginosa PA01
accuccagcggcuugu

SEQ ID NO: 1550761 - RNA, 17 nt, Pseudomonas aeruginosa PA01
accuccggcgccaggcc

SEQ ID NO: 1550762 - RNA, 23 nt, Pseudomonas aeruginosa PA01
accucgccgaucuccuccgcccc

SEQ ID NO: 1550763 - RNA, 13 nt, Pseudomonas aeruginosa PA01
accucgagcugga

SEQ ID NO: 1550764 - RNA, 22 nt, Pseudomonas aeruginosa PA01
accuccuguucgcgcgccucgc

SEQ ID NO: 1550765 - RNA, 17 nt, Pseudomonas aeruginosa PA01
accucgaagcuggccag

SEQ ID NO: 1550766 - RNA, 18 nt, Pseudomonas aeruginosa PA01
accucgaaguccugcagg

SEQ ID NO: 1550767 - RNA, 21 nt, Pseudomonas aeruginosa PA01
accucgaaguccugcaggauc

SEQ ID NO: 1550768 - RNA, 15 nt, Pseudomonas aeruginosa PA01
accucgacgccgagc

SEQ ID NO: 1550769 - RNA, 18 nt, Pseudomonas aeruginosa PA01
accugaacgcgcccggcc

SEQ ID NO: 1550770 - RNA, 20 nt, Pseudomonas aeruginosa PA01
accugaacgcgcccggccag

SEQ ID NO: 1550771 - RNA, 17 nt, Pseudomonas aeruginosa PA01
accucguccagcaggac

SEQ ID NO: 1550772 - RNA, 21 nt, Pseudomonas aeruginosa PA01
accucggccagccagggcagc

SEQ ID NO: 1550773 - RNA, 13 nt, Pseudomonas aeruginosa PA01
accucggccaggc

SEQ ID NO: 1550774 - RNA, 18 nt, Pseudomonas aeruginosa PA01
accucggccaggcgguuc

SEQ ID NO: 1550775 - RNA, 20 nt, Pseudomonas aeruginosa PA01
accucggcgccauaggccag

SEQ ID NO: 1550776 - RNA, 11 nt, Pseudomonas aeruginosa PA01
accucucccca

SEQ ID NO: 1550777 - RNA, 20 nt, Pseudomonas aeruginosa PA01
accucuccccagacccucuc

SEQ ID NO: 1550778 - RNA, 18 nt, Pseudomonas aeruginosa PA01
accuuagacccacugaag

SEQ ID NO: 1550779 - RNA, 22 nt, Pseudomonas aeruginosa PA01
accuuaguuaucacaaccuuuc

SEQ ID NO: 1550780 - RNA, 15 nt, Pseudomonas aeruginosa PA01
accuguuccagcaac

SEQ ID NO: 1550781 - RNA, 20 nt, Pseudomonas aeruginosa PA01
accuguuccagcaacgccuc

SEQ ID NO: 1550782 - RNA, 14 nt, Pseudomonas aeruginosa PA01
accuguccagucac

SEQ ID NO: 1550783 - RNA, 21 nt, Pseudomonas aeruginosa PA01
accuguccagucaccaggucg

SEQ ID NO: 1550784 - RNA, 13 nt, Pseudomonas aeruginosa PA01
accuguggauaac

SEQ ID NO: 1550785 - RNA, 18 nt, Pseudomonas aeruginosa PA01
accugggacucccgcaga

SEQ ID NO: 1550786 - RNA, 13 nt, Pseudomonas aeruginosa PA01
accuggggcggcc

SEQ ID NO: 1550787 - RNA, 20 nt, Pseudomonas aeruginosa PA01
accugggugcuuuccugcuc

SEQ ID NO: 1550788 - RNA, 17 nt, Pseudomonas aeruginosa PA01
accugguggacacccug

SEQ ID NO: 1550789 - RNA, 19 nt, Pseudomonas aeruginosa PA01
accugguggacacccugcu

SEQ ID NO: 1550790 - RNA, 16 nt, Pseudomonas aeruginosa PA01
accugcugcccggcau

SEQ ID NO: 1550791 - RNA, 18 nt, Pseudomonas aeruginosa PA01
accugcucgucgaugcug

SEQ ID NO: 1550792 - RNA, 19 nt, Pseudomonas aeruginosa PA01
accugcucgcgcaccgcgg

SEQ ID NO: 1550793 - RNA, 16 nt, Pseudomonas aeruginosa PA01
accuggccgcguucgc

SEQ ID NO: 1550794 - RNA, 22 nt, Pseudomonas aeruginosa PA01
accuggccgcguucgccgaggc

SEQ ID NO: 1550795 - RNA, 19 nt, Pseudomonas aeruginosa PA01
accuggccgcuguggaagu

SEQ ID NO: 1550796 - RNA, 20 nt, Pseudomonas aeruginosa PA01
accuggccauucgcuucggc

SEQ ID NO: 1550797 - RNA, 16 nt, Pseudomonas aeruginosa PA01
accuggaucgccaggc

SEQ ID NO: 1550798 - RNA, 14 nt, Pseudomonas aeruginosa PA01
accuggccacgccc

SEQ ID NO: 1550799 - RNA, 13 nt, Pseudomonas aeruginosa PA01
accuggcagguau

SEQ ID NO: 1550800 - RNA, 16 nt, Pseudomonas aeruginosa PA01
accuggcgguacagcc

SEQ ID NO: 1550801 - RNA, 19 nt, Pseudomonas aeruginosa PA01
accuggcgguacagccccc

SEQ ID NO: 1550802 - RNA, 18 nt, Pseudomonas aeruginosa PA01
accuggcuccacugcuug

SEQ ID NO: 1550803 - RNA, 21 nt, Pseudomonas aeruginosa PA01
accuggcgcugaacaagcccu

SEQ ID NO: 1550804 - RNA, 22 nt, Pseudomonas aeruginosa PA01
accuggcgcugaacaagcccug

SEQ ID NO: 1550805 - RNA, 18 nt, Pseudomonas aeruginosa PA01
accugcaauuccaccggc

SEQ ID NO: 1550806 - RNA, 23 nt, Pseudomonas aeruginosa PA01
accugcaugcuuuugaacaccag

SEQ ID NO: 1550807 - RNA, 22 nt, Pseudomonas aeruginosa PA01
accugcaucacguacggcgccu

SEQ ID NO: 1550808 - RNA, 19 nt, Pseudomonas aeruginosa PA01
accugcgugcgccguagca

SEQ ID NO: 1550809 - RNA, 18 nt, Pseudomonas aeruginosa PA01
accugcggugucccuucu

SEQ ID NO: 1550810 - RNA, 20 nt, Pseudomonas aeruginosa PA01
accugcggugucccuucuuu

SEQ ID NO: 1550811 - RNA, 13 nt, Pseudomonas aeruginosa PA01
accugccgcccgg

SEQ ID NO: 1550812 - RNA, 21 nt, Pseudomonas aeruginosa PA01
accugccccgggcgccggguc

SEQ ID NO: 1550813 - RNA, 14 nt, Pseudomonas aeruginosa PA01
accuucuccgacca

SEQ ID NO: 1550814 - RNA, 18 nt, Pseudomonas aeruginosa PA01
accuucucguccuccucg

SEQ ID NO: 1550815 - RNA, 15 nt, Pseudomonas aeruginosa PA01
accuucgacggcagg

SEQ ID NO: 1550816 - RNA, 23 nt, Pseudomonas aeruginosa PA01
accuucgaucaccuuaguuauca

SEQ ID NO: 1550817 - RNA, 22 nt, Pseudomonas aeruginosa PA01
accuucgcccgcugcgcugcca

SEQ ID NO: 1550818 - RNA, 16 nt, Pseudomonas aeruginosa PA01
accuucgcccucagca

SEQ ID NO: 1550819 - RNA, 14 nt, Pseudomonas aeruginosa PA01
accuucaccggcac

SEQ ID NO: 1550820 - RNA, 11 nt, Pseudomonas aeruginosa PA01
accuucaccac

SEQ ID NO: 1550821 - RNA, 21 nt, Pseudomonas aeruginosa PA01
accuucagauacuccagcagc

SEQ ID NO: 1550822 - RNA, 15 nt, Pseudomonas aeruginosa PA01
accuucagcaccugc

SEQ ID NO: 1550823 - RNA, 19 nt, Pseudomonas aeruginosa PA01
accuugcggguggucuugc

SEQ ID NO: 1550824 - RNA, 21 nt, Pseudomonas aeruginosa PA01
accuugcgguagcgcucgccu

SEQ ID NO: 1550825 - RNA, 20 nt, Pseudomonas aeruginosa PA01
accuugcggccguucuccgg

SEQ ID NO: 1550826 - RNA, 19 nt, Pseudomonas aeruginosa PA01
accuugcgcaccgccugca

SEQ ID NO: 1550827 - RNA, 14 nt, Pseudomonas aeruginosa PA01
accuugccguugcu

SEQ ID NO: 1550828 - RNA, 19 nt, Pseudomonas aeruginosa PA01
accuugcgaaaagcccgcc

SEQ ID NO: 1550829 - RNA, 21 nt, Pseudomonas aeruginosa PA01
accuugcgaaaagcccgccac

SEQ ID NO: 1550830 - RNA, 11 nt, Pseudomonas aeruginosa PA01
accuuggacuu

SEQ ID NO: 1550831 - RNA, 22 nt, Pseudomonas aeruginosa PA01
accuugggguguccgauucuug

SEQ ID NO: 1550832 - RNA, 19 nt, Pseudomonas aeruginosa PA01
accuugucgauggucuuga

SEQ ID NO: 1550833 - RNA, 14 nt, Pseudomonas aeruginosa PA01
accuugucggccga

SEQ ID NO: 1550834 - RNA, 15 nt, Pseudomonas aeruginosa PA01
accuuguacggcagc

SEQ ID NO: 1550835 - RNA, 20 nt, Pseudomonas aeruginosa PA01
accuugaacucgcccggcuc

SEQ ID NO: 1550836 - RNA, 11 nt, Pseudomonas aeruginosa PA01
accuuucuccc

SEQ ID NO: 1550837 - RNA, 16 nt, Pseudomonas aeruginosa PA01
acgaaagaagccgcac

SEQ ID NO: 1550838 - RNA, 21 nt, Pseudomonas aeruginosa PA01
acgaaagaagccgcacuucca

SEQ ID NO: 1550839 - RNA, 14 nt, Pseudomonas aeruginosa PA01
acgaaaaagcccgg

SEQ ID NO: 1550840 - RNA, 19 nt, Pseudomonas aeruginosa PA01
acgaaauagucgcgggccu

SEQ ID NO: 1550841 - RNA, 18 nt, Pseudomonas aeruginosa PA01
acgaaacggugacgggca

SEQ ID NO: 1550842 - RNA, 14 nt, Pseudomonas aeruginosa PA01
acgaaagagcccgg

SEQ ID NO: 1550843 - RNA, 18 nt, Pseudomonas aeruginosa PA01
acgaaagccaugcccaga

SEQ ID NO: 1550844 - RNA, 13 nt, Pseudomonas aeruginosa PA01
acgaccuguugaa

SEQ ID NO: 1550845 - RNA, 18 nt, Pseudomonas aeruginosa PA01
acgaccuucuccgaccag

SEQ ID NO: 1550846 - RNA, 16 nt, Pseudomonas aeruginosa PA01
acgacccugcuggccg

SEQ ID NO: 1550847 - RNA, 16 nt, Pseudomonas aeruginosa PA01
acgaccgcccaggcug

SEQ ID NO: 1550848 - RNA, 17 nt, Pseudomonas aeruginosa PA01
acgaccgcccaggcugc

SEQ ID NO: 1550849 - RNA, 11 nt, Pseudomonas aeruginosa PA01
acgacaggcgg

SEQ ID NO: 1550850 - RNA, 23 nt, Pseudomonas aeruginosa PA01
acgacaggcggcgggccggcguc

SEQ ID NO: 1550851 - RNA, 12 nt, Pseudomonas aeruginosa PA01
acgacuccagcu

SEQ ID NO: 1550852 - RNA, 12 nt, Pseudomonas aeruginosa PA01
acgacgugccca

SEQ ID NO: 1550853 - RNA, 14 nt, Pseudomonas aeruginosa PA01
acgagaagccgauc

SEQ ID NO: 1550854 - RNA, 18 nt, Pseudomonas aeruginosa PA01
acgaagaccuugaacucg

SEQ ID NO: 1550855 - RNA, 16 nt, Pseudomonas aeruginosa PA01
acgaagaagccggccc

SEQ ID NO: 1550856 - RNA, 15 nt, Pseudomonas aeruginosa PA01
acgaagcccaggcug

SEQ ID NO: 1550857 - RNA, 16 nt, Pseudomonas aeruginosa PA01
acgaagcccaggcuga

SEQ ID NO: 1550858 - RNA, 14 nt, Pseudomonas aeruginosa PA01
acgaagggcucagc

SEQ ID NO: 1550859 - RNA, 19 nt, Pseudomonas aeruginosa PA01
acgaagguuucguccccuu

SEQ ID NO: 1550860 - RNA, 22 nt, Pseudomonas aeruginosa PA01
acgaagcgccggcggccugccc

SEQ ID NO: 1550861 - RNA, 23 nt, Pseudomonas aeruginosa PA01
acgaagcggucgccggcgcgcac

SEQ ID NO: 1550862 - RNA, 22 nt, Pseudomonas aeruginosa PA01
acgaaggcgcgcucgaucaggu

SEQ ID NO: 1550863 - RNA, 19 nt, Pseudomonas aeruginosa PA01
acgaaggcuggagcgcugc

SEQ ID NO: 1550864 - RNA, 23 nt, Pseudomonas aeruginosa PA01
acgaaggcuggagcgcugcggaa

SEQ ID NO: 1550865 - RNA, 17 nt, Pseudomonas aeruginosa PA01
acgaagccgauugccag

SEQ ID NO: 1550866 - RNA, 18 nt, Pseudomonas aeruginosa PA01
acgaagcucgggguuuuu

SEQ ID NO: 1550867 - RNA, 13 nt, Pseudomonas aeruginosa PA01
acgaaccauugcg

SEQ ID NO: 1550868 - RNA, 22 nt, Pseudomonas aeruginosa PA01
acgaacucgacgcgccaggugc

SEQ ID NO: 1550869 - RNA, 15 nt, Pseudomonas aeruginosa PA01
acgaacagccagagg

SEQ ID NO: 1550870 - RNA, 22 nt, Pseudomonas aeruginosa PA01
acgaacaggcugugcgccaggc

SEQ ID NO: 1550871 - RNA, 21 nt, Pseudomonas aeruginosa PA01
acgaaccccgggccgcgcaca

SEQ ID NO: 1550872 - RNA, 13 nt, Pseudomonas aeruginosa PA01
acgaacaucgcca

SEQ ID NO: 1550873 - RNA, 19 nt, Pseudomonas aeruginosa PA01
acgaacaucgccagcgcca

SEQ ID NO: 1550874 - RNA, 13 nt, Pseudomonas aeruginosa PA01
acgacagccccgg

SEQ ID NO: 1550875 - RNA, 18 nt, Pseudomonas aeruginosa PA01
acgaaguguuacagcagg

SEQ ID NO: 1550876 - RNA, 16 nt, Pseudomonas aeruginosa PA01
acgcaacccgcccggc

SEQ ID NO: 1550877 - RNA, 22 nt, Pseudomonas aeruginosa PA01
acgaugaucaccaggacccaga

SEQ ID NO: 1550878 - RNA, 16 nt, Pseudomonas aeruginosa PA01
acgaucuucugcaccc

SEQ ID NO: 1550879 - RNA, 23 nt, Pseudomonas aeruginosa PA01
acgaucucccgcgauucgccggg

SEQ ID NO: 1550880 - RNA, 18 nt, Pseudomonas aeruginosa PA01
acgaucuccugcugggcg

SEQ ID NO: 1550881 - RNA, 20 nt, Pseudomonas aeruginosa PA01
acgaugcucgguugccaggc

SEQ ID NO: 1550882 - RNA, 13 nt, Pseudomonas aeruginosa PA01
acgaugcagggcu

SEQ ID NO: 1550883 - RNA, 20 nt, Pseudomonas aeruginosa PA01
acgauggccggcagcagcgc

SEQ ID NO: 1550884 - RNA, 22 nt, Pseudomonas aeruginosa PA01
acgagguagaaauagaagguca

SEQ ID NO: 1550885 - RNA, 21 nt, Pseudomonas aeruginosa PA01
acgaggcgacccgggucaggc

SEQ ID NO: 1550886 - RNA, 16 nt, Pseudomonas aeruginosa PA01
acgaggcgaggguggc

SEQ ID NO: 1550887 - RNA, 22 nt, Pseudomonas aeruginosa PA01
acgagcuuggccacuccgggcu

SEQ ID NO: 1550888 - RNA, 22 nt, Pseudomonas aeruginosa PA01
acgaggaacgccucgcagagcg

SEQ ID NO: 1550889 - RNA, 16 nt, Pseudomonas aeruginosa PA01
acgaggaaggcgcgca

SEQ ID NO: 1550890 - RNA, 17 nt, Pseudomonas aeruginosa PA01
acgagccggacggcggc

SEQ ID NO: 1550891 - RNA, 20 nt, Pseudomonas aeruginosa PA01
acgagcagcucgccggcguc

SEQ ID NO: 1550892 - RNA, 15 nt, Pseudomonas aeruginosa PA01
acgauauacaaagca

SEQ ID NO: 1550893 - RNA, 12 nt, Pseudomonas aeruginosa PA01
acgaucaggugc

SEQ ID NO: 1550894 - RNA, 14 nt, Pseudomonas aeruginosa PA01
acgaucagccaggg

SEQ ID NO: 1550895 - RNA, 14 nt, Pseudomonas aeruginosa PA01
acgaucacccccag

SEQ ID NO: 1550896 - RNA, 23 nt, Pseudomonas aeruginosa PA01
acauggguguccggauugccgcg

SEQ ID NO: 1550897 - RNA, 22 nt, Pseudomonas aeruginosa PA01
acauggcgucggcgaucacguc

SEQ ID NO: 1550898 - RNA, 23 nt, Pseudomonas aeruginosa PA01
acauggcgucggcgaucacgucc

SEQ ID NO: 1550899 - RNA, 13 nt, Pseudomonas aeruginosa PA01
acauggccuucuc

SEQ ID NO: 1550900 - RNA, 17 nt, Pseudomonas aeruginosa PA01
acauggaucaccgccaa

SEQ ID NO: 1550901 - RNA, 16 nt, Pseudomonas aeruginosa PA01
acauggucggccaggu

SEQ ID NO: 1550902 - RNA, 18 nt, Pseudomonas aeruginosa PA01
accaacggcguguccagg

SEQ ID NO: 1550903 - RNA, 13 nt, Pseudomonas aeruginosa PA01
accaaggugcugg

SEQ ID NO: 1550904 - RNA, 22 nt, Pseudomonas aeruginosa PA01
accagcaguagugcgacgcagc

SEQ ID NO: 1550905 - RNA, 18 nt, Pseudomonas aeruginosa PA01
accagcagggccagcagc

SEQ ID NO: 1550906 - RNA, 17 nt, Pseudomonas aeruginosa PA01
accagcagggccaggcc

SEQ ID NO: 1550907 - RNA, 12 nt, Pseudomonas aeruginosa PA01
accagcaucacc

SEQ ID NO: 1550908 - RNA, 15 nt, Pseudomonas aeruginosa PA01
accagcaucagcagg

SEQ ID NO: 1550909 - RNA, 16 nt, Pseudomonas aeruginosa PA01
accagcaucagcagga

SEQ ID NO: 1550910 - RNA, 18 nt, Pseudomonas aeruginosa PA01
accagcaucagcaggaag

SEQ ID NO: 1550911 - RNA, 18 nt, Pseudomonas aeruginosa PA01
accagcgaaagcgucagc

SEQ ID NO: 1550912 - RNA, 22 nt, Pseudomonas aeruginosa PA01
accagcgaaagcgucagcgcgc

SEQ ID NO: 1550913 - RNA, 13 nt, Pseudomonas aeruginosa PA01
accagccagcccg

SEQ ID NO: 1550914 - RNA, 21 nt, Pseudomonas aeruginosa PA01
accagcauguccugcaggcuc

SEQ ID NO: 1550915 - RNA, 19 nt, Pseudomonas aeruginosa PA01
accagagccagccgcgagu

SEQ ID NO: 1550916 - RNA, 16 nt, Pseudomonas aeruginosa PA01
accagaucaccaccac

SEQ ID NO: 1550917 - RNA, 22 nt, Pseudomonas aeruginosa PA01
accagaucggcgcgcagggcca

SEQ ID NO: 1550918 - RNA, 12 nt, Pseudomonas aeruginosa PA01
accagcaggagc

SEQ ID NO: 1550919 - RNA, 20 nt, Pseudomonas aeruginosa PA01
accagcaggaucgagcccug

SEQ ID NO: 1550920 - RNA, 19 nt, Pseudomonas aeruginosa PA01
accagcaggccgaucacca

SEQ ID NO: 1550921 - RNA, 20 nt, Pseudomonas aeruginosa PA01
accagauggcuggucaggcu

SEQ ID NO: 1550922 - RNA, 22 nt, Pseudomonas aeruginosa PA01
accagauggcuggucaggcuga

SEQ ID NO: 1550923 - RNA, 14 nt, Pseudomonas aeruginosa PA01
accagaagccggcc

SEQ ID NO: 1550924 - RNA, 19 nt, Pseudomonas aeruginosa PA01
accagagacauccggccau

SEQ ID NO: 1550925 - RNA, 14 nt, Pseudomonas aeruginosa PA01
accagacgcagcag

SEQ ID NO: 1550926 - RNA, 14 nt, Pseudomonas aeruginosa PA01
accagacgcagcau

SEQ ID NO: 1550927 - RNA, 14 nt, Pseudomonas aeruginosa PA01
accagaccagcagg

SEQ ID NO: 1550928 - RNA, 15 nt, Pseudomonas aeruginosa PA01
accacgaucagcucg

SEQ ID NO: 1550929 - RNA, 14 nt, Pseudomonas aeruginosa PA01
accacgaucaggcc

SEQ ID NO: 1550930 - RNA, 22 nt, Pseudomonas aeruginosa PA01
accacgaucaggcccuuuucca

SEQ ID NO: 1550931 - RNA, 23 nt, Pseudomonas aeruginosa PA01
accacgacgaagcgccggcggcc

SEQ ID NO: 1550932 - RNA, 20 nt, Pseudomonas aeruginosa PA01
accacgaccgcguccaugcc

SEQ ID NO: 1550933 - RNA, 23 nt, Pseudomonas aeruginosa PA01
accaccgggaucgcuaccgacag

SEQ ID NO: 1550934 - RNA, 21 nt, Pseudomonas aeruginosa PA01
accaccgggaugaacugcagc

SEQ ID NO: 1550935 - RNA, 16 nt, Pseudomonas aeruginosa PA01
accacggccuucggca

SEQ ID NO: 1550936 - RNA, 19 nt, Pseudomonas aeruginosa PA01
accacggcgaagccgcgcc

SEQ ID NO: 1550937 - RNA, 14 nt, Pseudomonas aeruginosa PA01
accacgggcaguuc

SEQ ID NO: 1550938 - RNA, 15 nt, Pseudomonas aeruginosa PA01
accacucucuugccc

SEQ ID NO: 1550939 - RNA, 19 nt, Pseudomonas aeruginosa PA01
accaccgccgccagcaacg

SEQ ID NO: 1550940 - RNA, 20 nt, Pseudomonas aeruginosa PA01
accaccgccaggcuggccac

SEQ ID NO: 1550941 - RNA, 17 nt, Pseudomonas aeruginosa PA01
accaccacgccgucgcc

SEQ ID NO: 1550942 - RNA, 23 nt, Pseudomonas aeruginosa PA01
accaguugcucgcuccgagcagg

SEQ ID NO: 1550943 - RNA, 21 nt, Pseudomonas aeruginosa PA01
accaguugccgagcuugaccu

SEQ ID NO: 1550944 - RNA, 14 nt, Pseudomonas aeruginosa PA01
accaguagggggug

SEQ ID NO: 1550945 - RNA, 23 nt, Pseudomonas aeruginosa PA01
accaguacuugaacagcaggaug

SEQ ID NO: 1550946 - RNA, 23 nt, Pseudomonas aeruginosa PA01
accagugcaccgccggguacagc

SEQ ID NO: 1550947 - RNA, 12 nt, Pseudomonas aeruginosa PA01
accagucccugg

SEQ ID NO: 1550948 - RNA, 15 nt, Pseudomonas aeruginosa PA01
accagucggccguug

SEQ ID NO: 1550949 - RNA, 11 nt, Pseudomonas aeruginosa PA01
accauaaagcc

SEQ ID NO: 1550950 - RNA, 18 nt, Pseudomonas aeruginosa PA01
accaucacgucgcgcacc

SEQ ID NO: 1550951 - RNA, 14 nt, Pseudomonas aeruginosa PA01
accaggcgccaggg

SEQ ID NO: 1550952 - RNA, 20 nt, Pseudomonas aeruginosa PA01
accaggcgccgaugcccagg

SEQ ID NO: 1550953 - RNA, 20 nt, Pseudomonas aeruginosa PA01
accaggccucccagccgugg

SEQ ID NO: 1550954 - RNA, 18 nt, Pseudomonas aeruginosa PA01
accaggccgagcaggaag

SEQ ID NO: 1550955 - RNA, 21 nt, Pseudomonas aeruginosa PA01
accaggccgccaugcucggcc

SEQ ID NO: 1550956 - RNA, 19 nt, Pseudomonas aeruginosa PA01
accaggccgaacgggaagu

SEQ ID NO: 1550957 - RNA, 17 nt, Pseudomonas aeruginosa PA01
accaggccaggcugcgc

SEQ ID NO: 1550958 - RNA, 17 nt, Pseudomonas aeruginosa PA01
accaggccauagcgcgc

SEQ ID NO: 1550959 - RNA, 14 nt, Pseudomonas aeruginosa PA01
accagcgcuucggc

SEQ ID NO: 1550960 - RNA, 12 nt, Pseudomonas aeruginosa PA01
accagcgccgcc

SEQ ID NO: 1550961 - RNA, 20 nt, Pseudomonas aeruginosa PA01
accagcgccgccaccgccac

SEQ ID NO: 1550962 - RNA, 14 nt, Pseudomonas aeruginosa PA01
accagcgccgcggc

SEQ ID NO: 1550963 - RNA, 21 nt, Pseudomonas aeruginosa PA01
accagcgccgucaccagcagc

SEQ ID NO: 1550964 - RNA, 14 nt, Pseudomonas aeruginosa PA01
accagcgccaggcc

SEQ ID NO: 1550965 - RNA, 17 nt, Pseudomonas aeruginosa PA01
accagcgagucgaccca

SEQ ID NO: 1550966 - RNA, 16 nt, Pseudomonas aeruginosa PA01
accagcgccaggccgc

SEQ ID NO: 1550967 - RNA, 15 nt, Pseudomonas aeruginosa PA01
accagcgccaggcgc

SEQ ID NO: 1550968 - RNA, 17 nt, Pseudomonas aeruginosa PA01
accagcgccaggcgcgg

SEQ ID NO: 1550969 - RNA, 18 nt, Pseudomonas aeruginosa PA01
accagccuugagccuugc

SEQ ID NO: 1550970 - RNA, 15 nt, Pseudomonas aeruginosa PA01
accagcgaaccgccg

SEQ ID NO: 1550971 - RNA, 14 nt, Pseudomonas aeruginosa PA01
accagcgaggagcc

SEQ ID NO: 1550972 - RNA, 21 nt, Pseudomonas aeruginosa PA01
accagcgaggagccuuucacu

SEQ ID NO: 1550973 - RNA, 22 nt, Pseudomonas aeruginosa PA01
accagguucugccagagcgcug

SEQ ID NO: 1550974 - RNA, 20 nt, Pseudomonas aeruginosa PA01
accaggucgcggaucaggcu

SEQ ID NO: 1550975 - RNA, 23 nt, Pseudomonas aeruginosa PA01
accaggucgcggaucaggcuggg

SEQ ID NO: 1550976 - RNA, 23 nt, Pseudomonas aeruginosa PA01
accaggguggcgcgcaccaccug

SEQ ID NO: 1550977 - RNA, 23 nt, Pseudomonas aeruginosa PA01
accagguacggaucgguccccuc

SEQ ID NO: 1550978 - RNA, 17 nt, Pseudomonas aeruginosa PA01
accagguagagcagccc

SEQ ID NO: 1550979 - RNA, 13 nt, Pseudomonas aeruginosa PA01
accagggccagga

SEQ ID NO: 1550980 - RNA, 14 nt, Pseudomonas aeruginosa PA01
accagggccagggc

SEQ ID NO: 1550981 - RNA, 20 nt, Pseudomonas aeruginosa PA01
accagggccucggggccguc

SEQ ID NO: 1550982 - RNA, 17 nt, Pseudomonas aeruginosa PA01
accagggcgggccgcuc

SEQ ID NO: 1550983 - RNA, 15 nt, Pseudomonas aeruginosa PA01
accagggucuccagg

SEQ ID NO: 1550984 - RNA, 17 nt, Pseudomonas aeruginosa PA01
accagggucuccaggac

SEQ ID NO: 1550985 - RNA, 20 nt, Pseudomonas aeruginosa PA01
accaggcggccgucggccug

SEQ ID NO: 1550986 - RNA, 21 nt, Pseudomonas aeruginosa PA01
accaggcgucgcaccugggac

SEQ ID NO: 1550987 - RNA, 24 nt, Pseudomonas aeruginosa PA01
accaggcguuccaccaggcgucgc

SEQ ID NO: 1550988 - RNA, 19 nt, Pseudomonas aeruginosa PA01
accagggaagcgcgcgcca

SEQ ID NO: 1550989 - RNA, 14 nt, Pseudomonas aeruginosa PA01
accaggcuggccag

SEQ ID NO: 1550990 - RNA, 15 nt, Pseudomonas aeruginosa PA01
acccccggcccggcc

SEQ ID NO: 1550991 - RNA, 20 nt, Pseudomonas aeruginosa PA01
acccccggcccggccauccu

SEQ ID NO: 1550992 - RNA, 15 nt, Pseudomonas aeruginosa PA01
accccgaccagcgcg

SEQ ID NO: 1550993 - RNA, 13 nt, Pseudomonas aeruginosa PA01
acccccagcaggc

SEQ ID NO: 1550994 - RNA, 22 nt, Pseudomonas aeruginosa PA01
acccccagcaggccagccaacu

SEQ ID NO: 1550995 - RNA, 18 nt, Pseudomonas aeruginosa PA01
acccccaucgcccgcagc

SEQ ID NO: 1550996 - RNA, 15 nt, Pseudomonas aeruginosa PA01
accccccaauugccg

SEQ ID NO: 1550997 - RNA, 20 nt, Pseudomonas aeruginosa PA01
acccccagcccggccauccu

SEQ ID NO: 1550998 - RNA, 14 nt, Pseudomonas aeruginosa PA01
accccauccucgcc

SEQ ID NO: 1550999 - RNA, 22 nt, Pseudomonas aeruginosa PA01
accccaggaaaacaucacggca

SEQ ID NO: 1551000 - RNA, 14 nt, Pseudomonas aeruginosa PA01
accccacgccggcc

SEQ ID NO: 1551001 - RNA, 15 nt, Pseudomonas aeruginosa PA01
accccacgcgaccca

SEQ ID NO: 1551002 - RNA, 16 nt, Pseudomonas aeruginosa PA01
acccagcgaagcuucu

SEQ ID NO: 1551003 - RNA, 13 nt, Pseudomonas aeruginosa PA01
acccagacaggcc

SEQ ID NO: 1551004 - RNA, 23 nt, Pseudomonas aeruginosa PA01
acccagagcgcgcccugcaggcc

SEQ ID NO: 1551005 - RNA, 23 nt, Pseudomonas aeruginosa PA01
acccaacuuguuggcauccggcu

SEQ ID NO: 1551006 - RNA, 22 nt, Pseudomonas aeruginosa PA01
acccacauggcgguccagguca

SEQ ID NO: 1551007 - RNA, 13 nt, Pseudomonas aeruginosa PA01
accauucaugggc

SEQ ID NO: 1551008 - RNA, 23 nt, Pseudomonas aeruginosa PA01
accauccagccugcgcuguucgg

SEQ ID NO: 1551009 - RNA, 18 nt, Pseudomonas aeruginosa PA01
acagcccgucgcgcgccg

SEQ ID NO: 1551010 - RNA, 22 nt, Pseudomonas aeruginosa PA01
acagccccagccucggcagggc

SEQ ID NO: 1551011 - RNA, 23 nt, Pseudomonas aeruginosa PA01
acagccgcagaugcuccagggag

SEQ ID NO: 1551012 - RNA, 22 nt, Pseudomonas aeruginosa PA01
acagcgagacccgguacuccuc

SEQ ID NO: 1551013 - RNA, 14 nt, Pseudomonas aeruginosa PA01
acagcgaagcuggc

SEQ ID NO: 1551014 - RNA, 23 nt, Pseudomonas aeruginosa PA01
acagcgaaugcuugccggcgccu

SEQ ID NO: 1551015 - RNA, 15 nt, Pseudomonas aeruginosa PA01
acagcggaaugcuuc

SEQ ID NO: 1551016 - RNA, 23 nt, Pseudomonas aeruginosa PA01
acagcgucugggugaccagcagg

SEQ ID NO: 1551017 - RNA, 16 nt, Pseudomonas aeruginosa PA01
acagcgcuuccuggga

SEQ ID NO: 1551018 - RNA, 20 nt, Pseudomonas aeruginosa PA01
acagcgccacggccagcagg

SEQ ID NO: 1551019 - RNA, 21 nt, Pseudomonas aeruginosa PA01
acagcgcccagacacgccuca

SEQ ID NO: 1551020 - RNA, 22 nt, Pseudomonas aeruginosa PA01
acagcuugacccguugcgccuc

SEQ ID NO: 1551021 - RNA, 21 nt, Pseudomonas aeruginosa PA01
acagcuugacgaucuucugca

SEQ ID NO: 1551022 - RNA, 23 nt, Pseudomonas aeruginosa PA01
acagcuugggauggccagccagg

SEQ ID NO: 1551023 - RNA, 20 nt, Pseudomonas aeruginosa PA01
acagcuguccgcgccgcguc

SEQ ID NO: 1551024 - RNA, 15 nt, Pseudomonas aeruginosa PA01
acagcuucaggcgca

SEQ ID NO: 1551025 - RNA, 17 nt, Pseudomonas aeruginosa PA01
acagcucgcgggacagc

SEQ ID NO: 1551026 - RNA, 18 nt, Pseudomonas aeruginosa PA01
acagcucgcugucgccga

SEQ ID NO: 1551027 - RNA, 17 nt, Pseudomonas aeruginosa PA01
acagcucggcgcccugg

SEQ ID NO: 1551028 - RNA, 19 nt, Pseudomonas aeruginosa PA01
acagcucggcgcccuggcc

SEQ ID NO: 1551029 - RNA, 22 nt, Pseudomonas aeruginosa PA01
acagcucuggggucaguucguu

SEQ ID NO: 1551030 - RNA, 14 nt, Pseudomonas aeruginosa PA01
acagcugcaccgcg

SEQ ID NO: 1551031 - RNA, 20 nt, Pseudomonas aeruginosa PA01
acaggaaucgacccagccgc

SEQ ID NO: 1551032 - RNA, 18 nt, Pseudomonas aeruginosa PA01
acaggcagcgggccaggc

SEQ ID NO: 1551033 - RNA, 14 nt, Pseudomonas aeruginosa PA01
acaggcccugcagc

SEQ ID NO: 1551034 - RNA, 18 nt, Pseudomonas aeruginosa PA01
acaggcccuugaacaggc

SEQ ID NO: 1551035 - RNA, 15 nt, Pseudomonas aeruginosa PA01
acaggcgcagcagca

SEQ ID NO: 1551036 - RNA, 16 nt, Pseudomonas aeruginosa PA01
acaggcgcagcagcau

SEQ ID NO: 1551037 - RNA, 15 nt, Pseudomonas aeruginosa PA01
acaggccuguggaua

SEQ ID NO: 1551038 - RNA, 16 nt, Pseudomonas aeruginosa PA01
acaggccuguggauag

SEQ ID NO: 1551039 - RNA, 23 nt, Pseudomonas aeruginosa PA01
acaggcgcaggggcgagagacug

SEQ ID NO: 1551040 - RNA, 15 nt, Pseudomonas aeruginosa PA01
acagaucgccagcuc

SEQ ID NO: 1551041 - RNA, 15 nt, Pseudomonas aeruginosa PA01
acagaggaaggcgcc

SEQ ID NO: 1551042 - RNA, 15 nt, Pseudomonas aeruginosa PA01
acagcagcaagccga

SEQ ID NO: 1551043 - RNA, 22 nt, Pseudomonas aeruginosa PA01
acagccacucuagugaaagucc

SEQ ID NO: 1551044 - RNA, 17 nt, Pseudomonas aeruginosa PA01
acagccauagugcuggg

SEQ ID NO: 1551045 - RNA, 21 nt, Pseudomonas aeruginosa PA01
acagccagcgguugagcaggg

SEQ ID NO: 1551046 - RNA, 20 nt, Pseudomonas aeruginosa PA01
acagccaguaguccuccgcg

SEQ ID NO: 1551047 - RNA, 16 nt, Pseudomonas aeruginosa PA01
acagcacgagcuuggc

SEQ ID NO: 1551048 - RNA, 16 nt, Pseudomonas aeruginosa PA01
acagcacccaggcgac

SEQ ID NO: 1551049 - RNA, 15 nt, Pseudomonas aeruginosa PA01
acagcacccgguagc

SEQ ID NO: 1551050 - RNA, 20 nt, Pseudomonas aeruginosa PA01
acagcacccgguagccgauc

SEQ ID NO: 1551051 - RNA, 15 nt, Pseudomonas aeruginosa PA01
acagcaccgagcagg

SEQ ID NO: 1551052 - RNA, 17 nt, Pseudomonas aeruginosa PA01
acagcaccgagcaggca

SEQ ID NO: 1551053 - RNA, 12 nt, Pseudomonas aeruginosa PA01
acagcaccuugg

SEQ ID NO: 1551054 - RNA, 23 nt, Pseudomonas aeruginosa PA01
acacuugaccgucggcaagcagg

SEQ ID NO: 1551055 - RNA, 15 nt, Pseudomonas aeruginosa PA01
acaucagcagcgcca

SEQ ID NO: 1551056 - RNA, 18 nt, Pseudomonas aeruginosa PA01
acaugcaguagagcccuc

SEQ ID NO: 1551057 - RNA, 14 nt, Pseudomonas aeruginosa PA01
acaucgcccggcag

SEQ ID NO: 1551058 - RNA, 20 nt, Pseudomonas aeruginosa PA01
acaguucggcgguggagcag

SEQ ID NO: 1551059 - RNA, 21 nt, Pseudomonas aeruginosa PA01
acaguugcggagaauugcguu

SEQ ID NO: 1551060 - RNA, 17 nt, Pseudomonas aeruginosa PA01
acaguucaggcugggcc

SEQ ID NO: 1551061 - RNA, 16 nt, Pseudomonas aeruginosa PA01
acaguugccgcagcag

SEQ ID NO: 1551062 - RNA, 20 nt, Pseudomonas aeruginosa PA01
acagucgucgcgcagcuccu

SEQ ID NO: 1551063 - RNA, 14 nt, Pseudomonas aeruginosa PA01
acagucgaugacga

SEQ ID NO: 1551064 - RNA, 17 nt, Pseudomonas aeruginosa PA01
acagugccaggcucgcc

SEQ ID NO: 1551065 - RNA, 20 nt, Pseudomonas aeruginosa PA01
acagguggcuuuccagcauu

SEQ ID NO: 1551066 - RNA, 13 nt, Pseudomonas aeruginosa PA01
acagguucagguc

SEQ ID NO: 1551067 - RNA, 20 nt, Pseudomonas aeruginosa PA01
acagguucaggucgaugccc

SEQ ID NO: 1551068 - RNA, 17 nt, Pseudomonas aeruginosa PA01
acaggcgucccuggagc

SEQ ID NO: 1551069 - RNA, 21 nt, Pseudomonas aeruginosa PA01
acaggcuucgagcacuuccca

SEQ ID NO: 1551070 - RNA, 14 nt, Pseudomonas aeruginosa PA01
acagggcaaucaac

SEQ ID NO: 1551071 - RNA, 15 nt, Pseudomonas aeruginosa PA01
acagguagcuggaaa

SEQ ID NO: 1551072 - RNA, 16 nt, Pseudomonas aeruginosa PA01
acagguagcuggaaag

SEQ ID NO: 1551073 - RNA, 18 nt, Pseudomonas aeruginosa PA01
acagguccuggaacagga

SEQ ID NO: 1551074 - RNA, 18 nt, Pseudomonas aeruginosa PA01
acaggucgacgccauggc

SEQ ID NO: 1551075 - RNA, 16 nt, Pseudomonas aeruginosa PA01
acaggucgacggcuuc

SEQ ID NO: 1551076 - RNA, 17 nt, Pseudomonas aeruginosa PA01
agaacuuuucccagcgg

SEQ ID NO: 1551077 - RNA, 19 nt, Pseudomonas aeruginosa PA01
agaacucggcgcugccggc

SEQ ID NO: 1551078 - RNA, 20 nt, Pseudomonas aeruginosa PA01
agaagguucucggccaccac

SEQ ID NO: 1551079 - RNA, 20 nt, Pseudomonas aeruginosa PA01
agaaggugcccagcggcgcc

SEQ ID NO: 1551080 - RNA, 21 nt, Pseudomonas aeruginosa PA01
agaauggcguggcuuggcccu

SEQ ID NO: 1551081 - RNA, 14 nt, Pseudomonas aeruginosa PA01
agaauuccagcagg

SEQ ID NO: 1551082 - RNA, 23 nt, Pseudomonas aeruginosa PA01
agaaugcgcggccucgguugaga

SEQ ID NO: 1551083 - RNA, 19 nt, Pseudomonas aeruginosa PA01
agaauaccgccagcucgcu

SEQ ID NO: 1551084 - RNA, 15 nt, Pseudomonas aeruginosa PA01
agaaucgcagccaug

SEQ ID NO: 1551085 - RNA, 16 nt, Pseudomonas aeruginosa PA01
agacccaggugcgcag

SEQ ID NO: 1551086 - RNA, 16 nt, Pseudomonas aeruginosa PA01
agaccaggccgagcag

SEQ ID NO: 1551087 - RNA, 14 nt, Pseudomonas aeruginosa PA01
agaccaucugccag

SEQ ID NO: 1551088 - RNA, 15 nt, Pseudomonas aeruginosa PA01
agaccaucugccagc

SEQ ID NO: 1551089 - RNA, 20 nt, Pseudomonas aeruginosa PA01
agaccaucuggaucaggaag

SEQ ID NO: 1551090 - RNA, 11 nt, Pseudomonas aeruginosa PA01
agaccuggccg

SEQ ID NO: 1551091 - RNA, 13 nt, Pseudomonas aeruginosa PA01
agaccugcagcag

SEQ ID NO: 1551092 - RNA, 15 nt, Pseudomonas aeruginosa PA01
agaccugccgcccgg

SEQ ID NO: 1551093 - RNA, 17 nt, Pseudomonas aeruginosa PA01
agaccugccgcccggcc

SEQ ID NO: 1551094 - RNA, 19 nt, Pseudomonas aeruginosa PA01
agaccugccgcccggccag

SEQ ID NO: 1551095 - RNA, 20 nt, Pseudomonas aeruginosa PA01
agaccugccgcccggccagg

SEQ ID NO: 1551096 - RNA, 13 nt, Pseudomonas aeruginosa PA01
agaccuccaggua

SEQ ID NO: 1551097 - RNA, 15 nt, Pseudomonas aeruginosa PA01
agaccucgagcaggc

SEQ ID NO: 1551098 - RNA, 23 nt, Pseudomonas aeruginosa PA01
agaccucgcugacuuccaucagc

SEQ ID NO: 1551099 - RNA, 21 nt, Pseudomonas aeruginosa PA01
agaccucgaaguccugcagga

SEQ ID NO: 1551100 - RNA, 13 nt, Pseudomonas aeruginosa PA01
agacggccaggau

SEQ ID NO: 1551101 - RNA, 12 nt, Pseudomonas aeruginosa PA01
agacgggacagg

SEQ ID NO: 1551102 - RNA, 13 nt, Pseudomonas aeruginosa PA01
agacgggcgaggc

SEQ ID NO: 1551103 - RNA, 20 nt, Pseudomonas aeruginosa PA01
agacgcaggugcccuggcag

SEQ ID NO: 1551104 - RNA, 14 nt, Pseudomonas aeruginosa PA01
agacgaucagcggc

SEQ ID NO: 1551105 - RNA, 13 nt, Pseudomonas aeruginosa PA01
agaccagcccugg

SEQ ID NO: 1551106 - RNA, 14 nt, Pseudomonas aeruginosa PA01
agaccagcgcaagc

SEQ ID NO: 1551107 - RNA, 12 nt, Pseudomonas aeruginosa PA01
agaccagcagcg

SEQ ID NO: 1551108 - RNA, 12 nt, Pseudomonas aeruginosa PA01
agaccacgcagg

SEQ ID NO: 1551109 - RNA, 15 nt, Pseudomonas aeruginosa PA01
agaccacgcaggcca

SEQ ID NO: 1551110 - RNA, 13 nt, Pseudomonas aeruginosa PA01
agaccacgcccug

SEQ ID NO: 1551111 - RNA, 20 nt, Pseudomonas aeruginosa PA01
agaccacgcccugcgccagc

SEQ ID NO: 1551112 - RNA, 19 nt, Pseudomonas aeruginosa PA01
agaccacccggcugcaugc

SEQ ID NO: 1551113 - RNA, 12 nt, Pseudomonas aeruginosa PA01
agaacagcagcg

SEQ ID NO: 1551114 - RNA, 15 nt, Pseudomonas aeruginosa PA01
agaacagcaggguca

SEQ ID NO: 1551115 - RNA, 14 nt, Pseudomonas aeruginosa PA01
agaacaccugcgug

SEQ ID NO: 1551116 - RNA, 19 nt, Pseudomonas aeruginosa PA01
agaacacgccccagaagcc

SEQ ID NO: 1551117 - RNA, 23 nt, Pseudomonas aeruginosa PA01
agaacacgccccagaagccccag

SEQ ID NO: 1551118 - RNA, 20 nt, Pseudomonas aeruginosa PA01
agaacagcgagaccucgccc

SEQ ID NO: 1551119 - RNA, 22 nt, Pseudomonas aeruginosa PA01
agaaccaguacuugaacagcag

SEQ ID NO: 1551120 - RNA, 20 nt, Pseudomonas aeruginosa PA01
agaaccagacgcucggccag

SEQ ID NO: 1551121 - RNA, 22 nt, Pseudomonas aeruginosa PA01
agaacaucgcccauugccgggc

SEQ ID NO: 1551122 - RNA, 20 nt, Pseudomonas aeruginosa PA01
agaaagucgaucagcgcgcg

SEQ ID NO: 1551123 - RNA, 17 nt, Pseudomonas aeruginosa PA01
agaacccggccaggccc

SEQ ID NO: 1551124 - RNA, 14 nt, Pseudomonas aeruginosa PA01
agaacugccgggcc

SEQ ID NO: 1551125 - RNA, 17 nt, Pseudomonas aeruginosa PA01
agaacugccgggccagc

SEQ ID NO: 1551126 - RNA, 15 nt, Pseudomonas aeruginosa PA01
agaacugcucggcgu

SEQ ID NO: 1551127 - RNA, 20 nt, Pseudomonas aeruginosa PA01
agaacugcucggcguccagc

SEQ ID NO: 1551128 - RNA, 15 nt, Pseudomonas aeruginosa PA01
agaaaaagcccggca

SEQ ID NO: 1551129 - RNA, 18 nt, Pseudomonas aeruginosa PA01
acuucgcaccagccggcc

SEQ ID NO: 1551130 - RNA, 16 nt, Pseudomonas aeruginosa PA01
agaaagccucaggcgc

SEQ ID NO: 1551131 - RNA, 22 nt, Pseudomonas aeruginosa PA01
agaaagccucaggcgcugcgcg

SEQ ID NO: 1551132 - RNA, 22 nt, Pseudomonas aeruginosa PA01
agaaaggcugcuucggcagccu

SEQ ID NO: 1551133 - RNA, 17 nt, Pseudomonas aeruginosa PA01
agaaaccccgccaaggc

SEQ ID NO: 1551134 - RNA, 14 nt, Pseudomonas aeruginosa PA01
agaaacgcagggcc

SEQ ID NO: 1551135 - RNA, 20 nt, Pseudomonas aeruginosa PA01
agaaacgcagggccucuucg

SEQ ID NO: 1551136 - RNA, 22 nt, Pseudomonas aeruginosa PA01
agagcuggacgacgcuggccug

SEQ ID NO: 1551137 - RNA, 14 nt, Pseudomonas aeruginosa PA01
agagggcggcgacc

SEQ ID NO: 1551138 - RNA, 12 nt, Pseudomonas aeruginosa PA01
agagggugaggc

SEQ ID NO: 1551139 - RNA, 16 nt, Pseudomonas aeruginosa PA01
agaggucgagcugggu

SEQ ID NO: 1551140 - RNA, 16 nt, Pseudomonas aeruginosa PA01
agaggucggcgcgccc

SEQ ID NO: 1551141 - RNA, 20 nt, Pseudomonas aeruginosa PA01
agaggucggcgcgcccggcg

SEQ ID NO: 1551142 - RNA, 20 nt, Pseudomonas aeruginosa PA01
agagggucagccggccgauc

SEQ ID NO: 1551143 - RNA, 17 nt, Pseudomonas aeruginosa PA01
agaguccaugcucaggu

SEQ ID NO: 1551144 - RNA, 19 nt, Pseudomonas aeruginosa PA01
agagauuggguucaggcuc

SEQ ID NO: 1551145 - RNA, 21 nt, Pseudomonas aeruginosa PA01
agauacgcuccggugccaggg

SEQ ID NO: 1551146 - RNA, 14 nt, Pseudomonas aeruginosa PA01
agauagccuccucc

SEQ ID NO: 1551147 - RNA, 22 nt, Pseudomonas aeruginosa PA01
agaguuugccgaacugcagggc

SEQ ID NO: 1551148 - RNA, 23 nt, Pseudomonas aeruginosa PA01
agaguuugccgaacugcagggcg

SEQ ID NO: 1551149 - RNA, 20 nt, Pseudomonas aeruginosa PA01
agauauaacgcgagccacau

SEQ ID NO: 1551150 - RNA, 15 nt, Pseudomonas aeruginosa PA01
agauagggcaucagc

SEQ ID NO: 1551151 - RNA, 21 nt, Pseudomonas aeruginosa PA01
agaucagcgcggugagcaggg

SEQ ID NO: 1551152 - RNA, 14 nt, Pseudomonas aeruginosa PA01
agaucaccggggcc

SEQ ID NO: 1551153 - RNA, 12 nt, Pseudomonas aeruginosa PA01
agaucaggcugg

SEQ ID NO: 1551154 - RNA, 15 nt, Pseudomonas aeruginosa PA01
agaucaggccggcgu

SEQ ID NO: 1551155 - RNA, 17 nt, Pseudomonas aeruginosa PA01
agaugccgaacaccugc

SEQ ID NO: 1551156 - RNA, 18 nt, Pseudomonas aeruginosa PA01
agaugcacaccagcuccc

SEQ ID NO: 1551157 - RNA, 12 nt, Pseudomonas aeruginosa PA01
agaucugcaccg

SEQ ID NO: 1551158 - RNA, 16 nt, Pseudomonas aeruginosa PA01
agaucgccugcuggcc

SEQ ID NO: 1551159 - RNA, 15 nt, Pseudomonas aeruginosa PA01
agaucgccgcgccgu

SEQ ID NO: 1551160 - RNA, 23 nt, Pseudomonas aeruginosa PA01
agaucgccgcguagcgccaggcc

SEQ ID NO: 1551161 - RNA, 14 nt, Pseudomonas aeruginosa PA01
agaucgcgccgagc

SEQ ID NO: 1551162 - RNA, 22 nt, Pseudomonas aeruginosa PA01
agaucgucuuucucgaucucgu

SEQ ID NO: 1551163 - RNA, 14 nt, Pseudomonas aeruginosa PA01
agaucggcgcgcag

SEQ ID NO: 1551164 - RNA, 21 nt, Pseudomonas aeruginosa PA01
agaucggcgcgcagggccagc

SEQ ID NO: 1551165 - RNA, 13 nt, Pseudomonas aeruginosa PA01
agaucaucugggu

SEQ ID NO: 1551166 - RNA, 18 nt, Pseudomonas aeruginosa PA01
agaucauguagagcaggc

SEQ ID NO: 1551167 - RNA, 20 nt, Pseudomonas aeruginosa PA01
agaucauguagagcaggcug

SEQ ID NO: 1551168 - RNA, 19 nt, Pseudomonas aeruginosa PA01
agauccccugcaggacccg

SEQ ID NO: 1551169 - RNA, 19 nt, Pseudomonas aeruginosa PA01
agaugcugcgggcgccgcc

SEQ ID NO: 1551170 - RNA, 20 nt, Pseudomonas aeruginosa PA01
agaugcuccagggagcgcuc

SEQ ID NO: 1551171 - RNA, 22 nt, Pseudomonas aeruginosa PA01
agauggcuaaacaagccaccuu

SEQ ID NO: 1551172 - RNA, 16 nt, Pseudomonas aeruginosa PA01
agauggcuggucaggc

SEQ ID NO: 1551173 - RNA, 15 nt, Pseudomonas aeruginosa PA01
agauggucagcaacu

SEQ ID NO: 1551174 - RNA, 20 nt, Pseudomonas aeruginosa PA01
agauggguaucaugcgcccc

SEQ ID NO: 1551175 - RNA, 16 nt, Pseudomonas aeruginosa PA01
agauguccaggcaggc

SEQ ID NO: 1551176 - RNA, 21 nt, Pseudomonas aeruginosa PA01
agauucugcaggcgcuccaga

SEQ ID NO: 1551177 - RNA, 20 nt, Pseudomonas aeruginosa PA01
agauugaugaagcgcugcug

SEQ ID NO: 1551178 - RNA, 15 nt, Pseudomonas aeruginosa PA01
agauuccgcugagga

SEQ ID NO: 1551179 - RNA, 16 nt, Pseudomonas aeruginosa PA01
agauuccuggaccccg

SEQ ID NO: 1551180 - RNA, 19 nt, Pseudomonas aeruginosa PA01
agauuccuggaccccgccc

SEQ ID NO: 1551181 - RNA, 12 nt, Pseudomonas aeruginosa PA01
acucgaaaaugu

SEQ ID NO: 1551182 - RNA, 19 nt, Pseudomonas aeruginosa PA01
acucgacgcugcccagccc

SEQ ID NO: 1551183 - RNA, 17 nt, Pseudomonas aeruginosa PA01
acucgaaggccagcucg

SEQ ID NO: 1551184 - RNA, 19 nt, Pseudomonas aeruginosa PA01
acucgacaggccauucuuc

SEQ ID NO: 1551185 - RNA, 15 nt, Pseudomonas aeruginosa PA01
acuccugcaaacggg

SEQ ID NO: 1551186 - RNA, 16 nt, Pseudomonas aeruginosa PA01
acuccuccucgcucca

SEQ ID NO: 1551187 - RNA, 22 nt, Pseudomonas aeruginosa PA01
acuccuccucgcuccagaggaa

SEQ ID NO: 1551188 - RNA, 14 nt, Pseudomonas aeruginosa PA01
acuccgccugucca

SEQ ID NO: 1551189 - RNA, 23 nt, Pseudomonas aeruginosa PA01
acuccggccggcggccugagccg

SEQ ID NO: 1551190 - RNA, 15 nt, Pseudomonas aeruginosa PA01
acuccggcgcagccc

SEQ ID NO: 1551191 - RNA, 17 nt, Pseudomonas aeruginosa PA01
acucucuugcccauaua

SEQ ID NO: 1551192 - RNA, 15 nt, Pseudomonas aeruginosa PA01
acucggccuggaacc

SEQ ID NO: 1551193 - RNA, 21 nt, Pseudomonas aeruginosa PA01
acucgcuguccaugaagacgu

SEQ ID NO: 1551194 - RNA, 14 nt, Pseudomonas aeruginosa PA01
acucgcugccggcg

SEQ ID NO: 1551195 - RNA, 13 nt, Pseudomonas aeruginosa PA01
acucggccaggcg

SEQ ID NO: 1551196 - RNA, 15 nt, Pseudomonas aeruginosa PA01
acucggccaggcgcc

SEQ ID NO: 1551197 - RNA, 13 nt, Pseudomonas aeruginosa PA01
acucggacggcuc

SEQ ID NO: 1551198 - RNA, 20 nt, Pseudomonas aeruginosa PA01
acugauuugauugaaaaaau

SEQ ID NO: 1551199 - RNA, 21 nt, Pseudomonas aeruginosa PA01
acugagcuuaaggcagguuuc

SEQ ID NO: 1551200 - RNA, 18 nt, Pseudomonas aeruginosa PA01
acugccgauggucucucu

SEQ ID NO: 1551201 - RNA, 22 nt, Pseudomonas aeruginosa PA01
acugccgcuaucgcuggcgcag

SEQ ID NO: 1551202 - RNA, 23 nt, Pseudomonas aeruginosa PA01
acugcgcuggccgagcugccgca

SEQ ID NO: 1551203 - RNA, 23 nt, Pseudomonas aeruginosa PA01
acugcgccaugccguucaggccg

SEQ ID NO: 1551204 - RNA, 15 nt, Pseudomonas aeruginosa PA01
acugcgcaggcuggu

SEQ ID NO: 1551205 - RNA, 19 nt, Pseudomonas aeruginosa PA01
acugcgaggcggugcagcg

SEQ ID NO: 1551206 - RNA, 13 nt, Pseudomonas aeruginosa PA01
acugccgacggcg

SEQ ID NO: 1551207 - RNA, 22 nt, Pseudomonas aeruginosa PA01
acugcaugucgcugagcggcug

SEQ ID NO: 1551208 - RNA, 22 nt, Pseudomonas aeruginosa PA01
acuggcccacggcgccuuccca

SEQ ID NO: 1551209 - RNA, 18 nt, Pseudomonas aeruginosa PA01
acuggccagcaccagucc

SEQ ID NO: 1551210 - RNA, 17 nt, Pseudomonas aeruginosa PA01
acuggcgaaugccuucg

SEQ ID NO: 1551211 - RNA, 18 nt, Pseudomonas aeruginosa PA01
acuggcgaaugccuucga

SEQ ID NO: 1551212 - RNA, 13 nt, Pseudomonas aeruginosa PA01
acuggcgccaggc

SEQ ID NO: 1551213 - RNA, 20 nt, Pseudomonas aeruginosa PA01
acugggucuuguaguucauc

SEQ ID NO: 1551214 - RNA, 21 nt, Pseudomonas aeruginosa PA01
acugggcguggcggccgccgg

SEQ ID NO: 1551215 - RNA, 20 nt, Pseudomonas aeruginosa PA01
acuggucgcgcgcggccagc

SEQ ID NO: 1551216 - RNA, 19 nt, Pseudomonas aeruginosa PA01
acuggucgcuccagcccca

SEQ ID NO: 1551217 - RNA, 22 nt, Pseudomonas aeruginosa PA01
acugguccggguuggcgcaggc

SEQ ID NO: 1551218 - RNA, 19 nt, Pseudomonas aeruginosa PA01
acugguaggacagggccag

SEQ ID NO: 1551219 - RNA, 22 nt, Pseudomonas aeruginosa PA01
acugcgguuuuccugccccgug

SEQ ID NO: 1551220 - RNA, 21 nt, Pseudomonas aeruginosa PA01
acugcucgccgccggcgagga

SEQ ID NO: 1551221 - RNA, 21 nt, Pseudomonas aeruginosa PA01
acugcucgaucaaccccugga

SEQ ID NO: 1551222 - RNA, 20 nt, Pseudomonas aeruginosa PA01
acugcuugccgagcugggcg

SEQ ID NO: 1551223 - RNA, 17 nt, Pseudomonas aeruginosa PA01
acugcuuggccaggcgc

SEQ ID NO: 1551224 - RNA, 21 nt, Pseudomonas aeruginosa PA01
acugcugcugcggggccugcu

SEQ ID NO: 1551225 - RNA, 22 nt, Pseudomonas aeruginosa PA01
acugcugcugcggggccugcug

SEQ ID NO: 1551226 - RNA, 15 nt, Pseudomonas aeruginosa PA01
acuggaagccugcca

SEQ ID NO: 1551227 - RNA, 14 nt, Pseudomonas aeruginosa PA01
acuggaagaaggcg

SEQ ID NO: 1551228 - RNA, 21 nt, Pseudomonas aeruginosa PA01
acuggaacagcgcgucacucg

SEQ ID NO: 1551229 - RNA, 19 nt, Pseudomonas aeruginosa PA01
acugguuggccgccuggcg

SEQ ID NO: 1551230 - RNA, 18 nt, Pseudomonas aeruginosa PA01
acugucgugccuccagcc

SEQ ID NO: 1551231 - RNA, 17 nt, Pseudomonas aeruginosa PA01
acugucucgccgaugcc

SEQ ID NO: 1551232 - RNA, 17 nt, Pseudomonas aeruginosa PA01
acuguuccucagccccu

SEQ ID NO: 1551233 - RNA, 23 nt, Pseudomonas aeruginosa PA01
acuguucggucgguugcggccug

SEQ ID NO: 1551234 - RNA, 18 nt, Pseudomonas aeruginosa PA01
acuuccgucacgcccugc

SEQ ID NO: 1551235 - RNA, 11 nt, Pseudomonas aeruginosa PA01
acuucaggccg

SEQ ID NO: 1551236 - RNA, 17 nt, Pseudomonas aeruginosa PA01
acuucaggccggcgccg

SEQ ID NO: 1551237 - RNA, 19 nt, Pseudomonas aeruginosa PA01
acuucacguccagcuguac

SEQ ID NO: 1551238 - RNA, 15 nt, Pseudomonas aeruginosa PA01
acguccagggcacca

SEQ ID NO: 1551239 - RNA, 23 nt, Pseudomonas aeruginosa PA01
acgucgaucugcucguccaggcc

SEQ ID NO: 1551240 - RNA, 20 nt, Pseudomonas aeruginosa PA01
acgucgcgcaccuggcgguc

SEQ ID NO: 1551241 - RNA, 19 nt, Pseudomonas aeruginosa PA01
acgucguugggccccaccg

SEQ ID NO: 1551242 - RNA, 22 nt, Pseudomonas aeruginosa PA01
acgugcucgcggaccagcuccg

SEQ ID NO: 1551243 - RNA, 19 nt, Pseudomonas aeruginosa PA01
acgugccccaggccgaacu

SEQ ID NO: 1551244 - RNA, 14 nt, Pseudomonas aeruginosa PA01
acguugcugcccug

SEQ ID NO: 1551245 - RNA, 15 nt, Pseudomonas aeruginosa PA01
acguugcugcccugg

SEQ ID NO: 1551246 - RNA, 18 nt, Pseudomonas aeruginosa PA01
acguugcugcccuggcgc

SEQ ID NO: 1551247 - RNA, 21 nt, Pseudomonas aeruginosa PA01
acuaccagguucugccagagc

SEQ ID NO: 1551248 - RNA, 12 nt, Pseudomonas aeruginosa PA01
acuacaggaccu

SEQ ID NO: 1551249 - RNA, 21 nt, Pseudomonas aeruginosa PA01
acuacaggaccuucagauacu

SEQ ID NO: 1551250 - RNA, 20 nt, Pseudomonas aeruginosa PA01
acuauuccgccaccagccag

SEQ ID NO: 1551251 - RNA, 22 nt, Pseudomonas aeruginosa PA01
acggccguccugcggccguucg

SEQ ID NO: 1551252 - RNA, 20 nt, Pseudomonas aeruginosa PA01
acggccgcuugaucuugucc

SEQ ID NO: 1551253 - RNA, 22 nt, Pseudomonas aeruginosa PA01
acggcccgcucuugauacccac

SEQ ID NO: 1551254 - RNA, 19 nt, Pseudomonas aeruginosa PA01
acggccaggucuucuggaa

SEQ ID NO: 1551255 - RNA, 16 nt, Pseudomonas aeruginosa PA01
acggccccgagaaaac

SEQ ID NO: 1551256 - RNA, 19 nt, Pseudomonas aeruginosa PA01
acggccccgagaaaacccu

SEQ ID NO: 1551257 - RNA, 21 nt, Pseudomonas aeruginosa PA01
acggcgauacccaggccgucg

SEQ ID NO: 1551258 - RNA, 15 nt, Pseudomonas aeruginosa PA01
acggcggaaggcggc

SEQ ID NO: 1551259 - RNA, 24 nt, Pseudomonas aeruginosa PA01
acggaucgguccccuccagguagg

SEQ ID NO: 1551260 - RNA, 17 nt, Pseudomonas aeruginosa PA01
acggaucgcgcugggcg

SEQ ID NO: 1551261 - RNA, 22 nt, Pseudomonas aeruginosa PA01
acggcaaggaccugcugcccgg

SEQ ID NO: 1551262 - RNA, 18 nt, Pseudomonas aeruginosa PA01
acggcacacgucggcauc

SEQ ID NO: 1551263 - RNA, 24 nt, Pseudomonas aeruginosa PA01
acggcauuccugguccagccagcc

SEQ ID NO: 1551264 - RNA, 15 nt, Pseudomonas aeruginosa PA01
acggcauucucucuu

SEQ ID NO: 1551265 - RNA, 13 nt, Pseudomonas aeruginosa PA01
acggaagcgcugc

SEQ ID NO: 1551266 - RNA, 23 nt, Pseudomonas aeruginosa PA01
acggaagcgcugcucgaccaccu

SEQ ID NO: 1551267 - RNA, 15 nt, Pseudomonas aeruginosa PA01
acggaacgucggccu

SEQ ID NO: 1551268 - RNA, 14 nt, Pseudomonas aeruginosa PA01
acgcuggucaggcu

SEQ ID NO: 1551269 - RNA, 15 nt, Pseudomonas aeruginosa PA01
acgcuggucaggcug

SEQ ID NO: 1551270 - RNA, 16 nt, Pseudomonas aeruginosa PA01
acgcuggucaggcuga

SEQ ID NO: 1551271 - RNA, 20 nt, Pseudomonas aeruginosa PA01
acgcugcuugcgcaccuccu

SEQ ID NO: 1551272 - RNA, 21 nt, Pseudomonas aeruginosa PA01
acgcugcuugcgcaccuccuu

SEQ ID NO: 1551273 - RNA, 20 nt, Pseudomonas aeruginosa PA01
acgcugcuaggcuggaagcc

SEQ ID NO: 1551274 - RNA, 19 nt, Pseudomonas aeruginosa PA01
acgcugcucgcagccggug

SEQ ID NO: 1551275 - RNA, 20 nt, Pseudomonas aeruginosa PA01
acgcaauccucggugcgcac

SEQ ID NO: 1551276 - RNA, 15 nt, Pseudomonas aeruginosa PA01
acgcaagugcccugg

SEQ ID NO: 1551277 - RNA, 18 nt, Pseudomonas aeruginosa PA01
acgcaagugcccugggcg

SEQ ID NO: 1551278 - RNA, 20 nt, Pseudomonas aeruginosa PA01
acggguagagcgggccguug

SEQ ID NO: 1551279 - RNA, 16 nt, Pseudomonas aeruginosa PA01
acggggcgccuguccg

SEQ ID NO: 1551280 - RNA, 16 nt, Pseudomonas aeruginosa PA01
acgggcugccagcaua

SEQ ID NO: 1551281 - RNA, 23 nt, Pseudomonas aeruginosa PA01
acgggcggccgacgugcacccgc

SEQ ID NO: 1551282 - RNA, 17 nt, Pseudomonas aeruginosa PA01
acggcggaucgaucagc

SEQ ID NO: 1551283 - RNA, 16 nt, Pseudomonas aeruginosa PA01
acggcgggagcggccu

SEQ ID NO: 1551284 - RNA, 17 nt, Pseudomonas aeruginosa PA01
acggcgggagcggccug

SEQ ID NO: 1551285 - RNA, 13 nt, Pseudomonas aeruginosa PA01
acgguagcggcag

SEQ ID NO: 1551286 - RNA, 23 nt, Pseudomonas aeruginosa PA01
acgggucgucgcccuggccgauc

SEQ ID NO: 1551287 - RNA, 21 nt, Pseudomonas aeruginosa PA01
acgggucgcagccgagccccc

SEQ ID NO: 1551288 - RNA, 19 nt, Pseudomonas aeruginosa PA01
acgggugcguccauccagg

SEQ ID NO: 1551289 - RNA, 17 nt, Pseudomonas aeruginosa PA01
acggguguuucggccgc

SEQ ID NO: 1551290 - RNA, 15 nt, Pseudomonas aeruginosa PA01
acggguugaucaggu

SEQ ID NO: 1551291 - RNA, 14 nt, Pseudomonas aeruginosa PA01
acgguccaggauca

SEQ ID NO: 1551292 - RNA, 21 nt, Pseudomonas aeruginosa PA01
acgguccugcggaucgaggaa

SEQ ID NO: 1551293 - RNA, 23 nt, Pseudomonas aeruginosa PA01
acggugaucgccgcgagguggau

SEQ ID NO: 1551294 - RNA, 19 nt, Pseudomonas aeruginosa PA01
acggugcagccacccagca

SEQ ID NO: 1551295 - RNA, 14 nt, Pseudomonas aeruginosa PA01
agguguacaucggg

SEQ ID NO: 1551296 - RNA, 17 nt, Pseudomonas aeruginosa PA01
agguggugguagagcgg

SEQ ID NO: 1551297 - RNA, 13 nt, Pseudomonas aeruginosa PA01
aggugcugcaccg

SEQ ID NO: 1551298 - RNA, 14 nt, Pseudomonas aeruginosa PA01
agguggcaggccug

SEQ ID NO: 1551299 - RNA, 23 nt, Pseudomonas aeruginosa PA01
agguggcaggccuggaauacccc

SEQ ID NO: 1551300 - RNA, 16 nt, Pseudomonas aeruginosa PA01
agguggccggaaaaag

SEQ ID NO: 1551301 - RNA, 13 nt, Pseudomonas aeruginosa PA01
agguggcugguca

SEQ ID NO: 1551302 - RNA, 18 nt, Pseudomonas aeruginosa PA01
agguggcguugcagggug

SEQ ID NO: 1551303 - RNA, 16 nt, Pseudomonas aeruginosa PA01
aggugcccagcggcgc

SEQ ID NO: 1551304 - RNA, 20 nt, Pseudomonas aeruginosa PA01
aggugccgcucguccaguuc

SEQ ID NO: 1551305 - RNA, 15 nt, Pseudomonas aeruginosa PA01
aggugcgcaggcgcu

SEQ ID NO: 1551306 - RNA, 23 nt, Pseudomonas aeruginosa PA01
agguggaugaacagcggaaugcu

SEQ ID NO: 1551307 - RNA, 15 nt, Pseudomonas aeruginosa PA01
agguggauugcagcg

SEQ ID NO: 1551308 - RNA, 16 nt, Pseudomonas aeruginosa PA01
aggugcaggaacagcc

SEQ ID NO: 1551309 - RNA, 20 nt, Pseudomonas aeruginosa PA01
aggugcaggaacagccagua

SEQ ID NO: 1551310 - RNA, 17 nt, Pseudomonas aeruginosa PA01
aggugcacggccaggcc

SEQ ID NO: 1551311 - RNA, 14 nt, Pseudomonas aeruginosa PA01
aggugcaccgcgcu

SEQ ID NO: 1551312 - RNA, 14 nt, Pseudomonas aeruginosa PA01
aggugaccgcccag

SEQ ID NO: 1551313 - RNA, 15 nt, Pseudomonas aeruginosa PA01
aggugaagcccaggc

SEQ ID NO: 1551314 - RNA, 15 nt, Pseudomonas aeruginosa PA01
aggucucaccgcccu

SEQ ID NO: 1551315 - RNA, 15 nt, Pseudomonas aeruginosa PA01
aggucucgccgccgg

SEQ ID NO: 1551316 - RNA, 14 nt, Pseudomonas aeruginosa PA01
aggucugccccggc

SEQ ID NO: 1551317 - RNA, 21 nt, Pseudomonas aeruginosa PA01
aggucugcccgacgaaguugc

SEQ ID NO: 1551318 - RNA, 20 nt, Pseudomonas aeruginosa PA01
aggugaaaagcgcugacgaa

SEQ ID NO: 1551319 - RNA, 21 nt, Pseudomonas aeruginosa PA01
aggucuugcccaacuccagcu

SEQ ID NO: 1551320 - RNA, 17 nt, Pseudomonas aeruginosa PA01
aggucggucggcggcgg

SEQ ID NO: 1551321 - RNA, 18 nt, Pseudomonas aeruginosa PA01
aggucggucuggcggccc

SEQ ID NO: 1551322 - RNA, 22 nt, Pseudomonas aeruginosa PA01
aggucggcagcgucgagcuggc

SEQ ID NO: 1551323 - RNA, 23 nt, Pseudomonas aeruginosa PA01
aggucguugcgccggcccagcag

SEQ ID NO: 1551324 - RNA, 18 nt, Pseudomonas aeruginosa PA01
aggucguuggcaaagccc

SEQ ID NO: 1551325 - RNA, 21 nt, Pseudomonas aeruginosa PA01
aggucguuggcaaagcccgcu

SEQ ID NO: 1551326 - RNA, 18 nt, Pseudomonas aeruginosa PA01
aggucgcggaagugcggg

SEQ ID NO: 1551327 - RNA, 13 nt, Pseudomonas aeruginosa PA01
aggucgcggcccc

SEQ ID NO: 1551328 - RNA, 17 nt, Pseudomonas aeruginosa PA01
aggucgcggccccagca

SEQ ID NO: 1551329 - RNA, 19 nt, Pseudomonas aeruginosa PA01
aggucgcgggccaggcccu

SEQ ID NO: 1551330 - RNA, 21 nt, Pseudomonas aeruginosa PA01
aggucggcggcacgcuccaga

SEQ ID NO: 1551331 - RNA, 17 nt, Pseudomonas aeruginosa PA01
aggucggcggcagcugc

SEQ ID NO: 1551332 - RNA, 20 nt, Pseudomonas aeruginosa PA01
aggucggcgccggugcuggc

SEQ ID NO: 1551333 - RNA, 23 nt, Pseudomonas aeruginosa PA01
aggucgcugucgcguucccacuc

SEQ ID NO: 1551334 - RNA, 16 nt, Pseudomonas aeruginosa PA01
agguccggagggcccg

SEQ ID NO: 1551335 - RNA, 15 nt, Pseudomonas aeruginosa PA01
agguccaggcgacga

SEQ ID NO: 1551336 - RNA, 15 nt, Pseudomonas aeruginosa PA01
agguccaggcucagc

SEQ ID NO: 1551337 - RNA, 15 nt, Pseudomonas aeruginosa PA01
aggucaugcccaggc

SEQ ID NO: 1551338 - RNA, 15 nt, Pseudomonas aeruginosa PA01
aggucaucaggauca

SEQ ID NO: 1551339 - RNA, 21 nt, Pseudomonas aeruginosa PA01
aggucacuuccgucacgcccu

SEQ ID NO: 1551340 - RNA, 17 nt, Pseudomonas aeruginosa PA01
aggucgacgccauggcg

SEQ ID NO: 1551341 - RNA, 16 nt, Pseudomonas aeruginosa PA01
aggucgagcuggguca

SEQ ID NO: 1551342 - RNA, 15 nt, Pseudomonas aeruginosa PA01
aggucgaggccgcgg

SEQ ID NO: 1551343 - RNA, 18 nt, Pseudomonas aeruginosa PA01
aggucgagguucuccagg

SEQ ID NO: 1551344 - RNA, 14 nt, Pseudomonas aeruginosa PA01
aggucgagguugua

SEQ ID NO: 1551345 - RNA, 16 nt, Pseudomonas aeruginosa PA01
aggucgccgacacgug

SEQ ID NO: 1551346 - RNA, 17 nt, Pseudomonas aeruginosa PA01
aggucgccgacacgugu

SEQ ID NO: 1551347 - RNA, 15 nt, Pseudomonas aeruginosa PA01
agguccuuguuccug

SEQ ID NO: 1551348 - RNA, 12 nt, Pseudomonas aeruginosa PA01
agguccuguccc

SEQ ID NO: 1551349 - RNA, 20 nt, Pseudomonas aeruginosa PA01
aggucgacaugcaccaggcc

SEQ ID NO: 1551350 - RNA, 16 nt, Pseudomonas aeruginosa PA01
agguagcugagcaggc

SEQ ID NO: 1551351 - RNA, 15 nt, Pseudomonas aeruginosa PA01
agguagccugcggcc

SEQ ID NO: 1551352 - RNA, 20 nt, Pseudomonas aeruginosa PA01
agguagcggaccccggccuc

SEQ ID NO: 1551353 - RNA, 22 nt, Pseudomonas aeruginosa PA01
agguagguggaggccguggugg

SEQ ID NO: 1551354 - RNA, 19 nt, Pseudomonas aeruginosa PA01
agguagugcggcgggcgcc

SEQ ID NO: 1551355 - RNA, 18 nt, Pseudomonas aeruginosa PA01
agguagucgcccagcgcc

SEQ ID NO: 1551356 - RNA, 16 nt, Pseudomonas aeruginosa PA01
agguacuggcgaugga

SEQ ID NO: 1551357 - RNA, 20 nt, Pseudomonas aeruginosa PA01
agguacugggcgauguccug

SEQ ID NO: 1551358 - RNA, 16 nt, Pseudomonas aeruginosa PA01
agguagaccacgcagg

SEQ ID NO: 1551359 - RNA, 14 nt, Pseudomonas aeruginosa PA01
agguagaccgccuc

SEQ ID NO: 1551360 - RNA, 17 nt, Pseudomonas aeruginosa PA01
agguagagcuuggcucg

SEQ ID NO: 1551361 - RNA, 16 nt, Pseudomonas aeruginosa PA01
agguagauguucagug

SEQ ID NO: 1551362 - RNA, 16 nt, Pseudomonas aeruginosa PA01
agguaccggccaggcg

SEQ ID NO: 1551363 - RNA, 18 nt, Pseudomonas aeruginosa PA01
aggucacgcccugcaccu

SEQ ID NO: 1551364 - RNA, 14 nt, Pseudomonas aeruginosa PA01
agguaguugagguc

SEQ ID NO: 1551365 - RNA, 21 nt, Pseudomonas aeruginosa PA01
agguauccgccggccggggcg

SEQ ID NO: 1551366 - RNA, 21 nt, Pseudomonas aeruginosa PA01
agggugucggggguucgaauc

SEQ ID NO: 1551367 - RNA, 17 nt, Pseudomonas aeruginosa PA01
aggguggucgcgcucug

SEQ ID NO: 1551368 - RNA, 18 nt, Pseudomonas aeruginosa PA01
aggguggcgggcggcccc

SEQ ID NO: 1551369 - RNA, 23 nt, Pseudomonas aeruginosa PA01
aggguggcgcccaugccgcccgg

SEQ ID NO: 1551370 - RNA, 15 nt, Pseudomonas aeruginosa PA01
aggguggcgcgcacc

SEQ ID NO: 1551371 - RNA, 17 nt, Pseudomonas aeruginosa PA01
aggguggcgcgcaccac

SEQ ID NO: 1551372 - RNA, 23 nt, Pseudomonas aeruginosa PA01
agggugcucaggacguccuggcc

SEQ ID NO: 1551373 - RNA, 19 nt, Pseudomonas aeruginosa PA01
agggucagguugccgguga

SEQ ID NO: 1551374 - RNA, 16 nt, Pseudomonas aeruginosa PA01
agggucagucgagcag

SEQ ID NO: 1551375 - RNA, 13 nt, Pseudomonas aeruginosa PA01
agggucagcagcg

SEQ ID NO: 1551376 - RNA, 16 nt, Pseudomonas aeruginosa PA01
agggucagccgcaggc

SEQ ID NO: 1551377 - RNA, 21 nt, Pseudomonas aeruginosa PA01
aggguauugaggauccacuug

SEQ ID NO: 1551378 - RNA, 16 nt, Pseudomonas aeruginosa PA01
aggguauuuuccagca

SEQ ID NO: 1551379 - RNA, 20 nt, Pseudomonas aeruginosa PA01
aggguauuuuccagcaggca

SEQ ID NO: 1551380 - RNA, 19 nt, Pseudomonas aeruginosa PA01
agggucuccaggaccaguu

SEQ ID NO: 1551381 - RNA, 19 nt, Pseudomonas aeruginosa PA01
agggucggcccggagaccg

SEQ ID NO: 1551382 - RNA, 15 nt, Pseudomonas aeruginosa PA01
agggucgcagcaggc

SEQ ID NO: 1551383 - RNA, 15 nt, Pseudomonas aeruginosa PA01
agggucgccagcagg

SEQ ID NO: 1551384 - RNA, 18 nt, Pseudomonas aeruginosa PA01
agggucgcgagcagggcg

SEQ ID NO: 1551385 - RNA, 19 nt, Pseudomonas aeruginosa PA01
aggguuggcggcaucgcgu

SEQ ID NO: 1551386 - RNA, 14 nt, Pseudomonas aeruginosa PA01
aggguuuccagcag

SEQ ID NO: 1551387 - RNA, 15 nt, Pseudomonas aeruginosa PA01
aggguuuccagcagc

SEQ ID NO: 1551388 - RNA, 21 nt, Pseudomonas aeruginosa PA01
aguaaaacggcaggcaaaaaa

SEQ ID NO: 1551389 - RNA, 16 nt, Pseudomonas aeruginosa PA01
agguuggucugcucgg

SEQ ID NO: 1551390 - RNA, 14 nt, Pseudomonas aeruginosa PA01
agguguucggcccc

SEQ ID NO: 1551391 - RNA, 23 nt, Pseudomonas aeruginosa PA01
agguguucggccccggccaggua

SEQ ID NO: 1551392 - RNA, 16 nt, Pseudomonas aeruginosa PA01
agguguucggcggcgu

SEQ ID NO: 1551393 - RNA, 15 nt, Pseudomonas aeruginosa PA01
agguucugccagagc

SEQ ID NO: 1551394 - RNA, 13 nt, Pseudomonas aeruginosa PA01
agguugcgcuggc

SEQ ID NO: 1551395 - RNA, 22 nt, Pseudomonas aeruginosa PA01
agguugcgcuggcgcagcagca

SEQ ID NO: 1551396 - RNA, 20 nt, Pseudomonas aeruginosa PA01
agguugcccacggccaggcc

SEQ ID NO: 1551397 - RNA, 18 nt, Pseudomonas aeruginosa PA01
agguuggccuggcccggc

SEQ ID NO: 1551398 - RNA, 23 nt, Pseudomonas aeruginosa PA01
agguugcacggccgguagucggg

SEQ ID NO: 1551399 - RNA, 22 nt, Pseudomonas aeruginosa PA01
agguugaucgggugggacaugg

SEQ ID NO: 1551400 - RNA, 17 nt, Pseudomonas aeruginosa PA01
aguacagcugcaccgcg

SEQ ID NO: 1551401 - RNA, 14 nt, Pseudomonas aeruginosa PA01
aguaccaggccacc

SEQ ID NO: 1551402 - RNA, 18 nt, Pseudomonas aeruginosa PA01
aguaccaggccaccggug

SEQ ID NO: 1551403 - RNA, 12 nt, Pseudomonas aeruginosa PA01
aguaccagcaau

SEQ ID NO: 1551404 - RNA, 19 nt, Pseudomonas aeruginosa PA01
aguaccagcaaugcccagc

SEQ ID NO: 1551405 - RNA, 23 nt, Pseudomonas aeruginosa PA01
aguaccagcaaugcccagcgcag

SEQ ID NO: 1551406 - RNA, 15 nt, Pseudomonas aeruginosa PA01
aguacaugacgaagc

SEQ ID NO: 1551407 - RNA, 12 nt, Pseudomonas aeruginosa PA01
aguaccaccgug

SEQ ID NO: 1551408 - RNA, 22 nt, Pseudomonas aeruginosa PA01
aguaccaccgugcccgccggcg

SEQ ID NO: 1551409 - RNA, 14 nt, Pseudomonas aeruginosa PA01
aguaaccaccgcuc

SEQ ID NO: 1551410 - RNA, 18 nt, Pseudomonas aeruginosa PA01
aggcucuugggcucugcc

SEQ ID NO: 1551411 - RNA, 23 nt, Pseudomonas aeruginosa PA01
aggcucuugggcucugccuucag

SEQ ID NO: 1551412 - RNA, 15 nt, Pseudomonas aeruginosa PA01
aggcugaaaaaaggg

SEQ ID NO: 1551413 - RNA, 16 nt, Pseudomonas aeruginosa PA01
aggcugaaaaaagggg

SEQ ID NO: 1551414 - RNA, 18 nt, Pseudomonas aeruginosa PA01
aggcucucgcgcagcagg

SEQ ID NO: 1551415 - RNA, 16 nt, Pseudomonas aeruginosa PA01
aggcucugcuccagca

SEQ ID NO: 1551416 - RNA, 17 nt, Pseudomonas aeruginosa PA01
aggcugaucugccggua

SEQ ID NO: 1551417 - RNA, 18 nt, Pseudomonas aeruginosa PA01
aggcugaucagcccgcug

SEQ ID NO: 1551418 - RNA, 21 nt, Pseudomonas aeruginosa PA01
aggcugacccggucgcugacc

SEQ ID NO: 1551419 - RNA, 19 nt, Pseudomonas aeruginosa PA01
aggcugaccgcgugggccg

SEQ ID NO: 1551420 - RNA, 21 nt, Pseudomonas aeruginosa PA01
aggcugaccgcgugggccggc

SEQ ID NO: 1551421 - RNA, 23 nt, Pseudomonas aeruginosa PA01
aggcucgcgaugcugugcaggga

SEQ ID NO: 1551422 - RNA, 20 nt, Pseudomonas aeruginosa PA01
aggcucgguucugcgcacca

SEQ ID NO: 1551423 - RNA, 19 nt, Pseudomonas aeruginosa PA01
aggcucggcggccauugcc

SEQ ID NO: 1551424 - RNA, 16 nt, Pseudomonas aeruginosa PA01
aggcucccagguggaa

SEQ ID NO: 1551425 - RNA, 22 nt, Pseudomonas aeruginosa PA01
aggcucgccggguuguccaggc

SEQ ID NO: 1551426 - RNA, 18 nt, Pseudomonas aeruginosa PA01
aggcucaucgcccgcccu

SEQ ID NO: 1551427 - RNA, 22 nt, Pseudomonas aeruginosa PA01
aggcucagccgauuacuuggcu

SEQ ID NO: 1551428 - RNA, 18 nt, Pseudomonas aeruginosa PA01
aggcucagcgcgccgagu

SEQ ID NO: 1551429 - RNA, 14 nt, Pseudomonas aeruginosa PA01
aggcucagcucggc

SEQ ID NO: 1551430 - RNA, 16 nt, Pseudomonas aeruginosa PA01
aggcucaggccgggca

SEQ ID NO: 1551431 - RNA, 19 nt, Pseudomonas aeruginosa PA01
aggcgugggccagcccaga

SEQ ID NO: 1551432 - RNA, 17 nt, Pseudomonas aeruginosa PA01
aggcgugggcgccggcg

SEQ ID NO: 1551433 - RNA, 16 nt, Pseudomonas aeruginosa PA01
aggcguggucuuccuc

SEQ ID NO: 1551434 - RNA, 15 nt, Pseudomonas aeruginosa PA01
aggcgugccuguucc

SEQ ID NO: 1551435 - RNA, 18 nt, Pseudomonas aeruginosa PA01
aggcgucccgcuccagcc

SEQ ID NO: 1551436 - RNA, 18 nt, Pseudomonas aeruginosa PA01
aggcgucccuggagcagg

SEQ ID NO: 1551437 - RNA, 19 nt, Pseudomonas aeruginosa PA01
aggcgucccuggagcaggg

SEQ ID NO: 1551438 - RNA, 18 nt, Pseudomonas aeruginosa PA01
aggcgucgaaacgggcgc

SEQ ID NO: 1551439 - RNA, 22 nt, Pseudomonas aeruginosa PA01
aggcgucgaaacgggcgcucug

SEQ ID NO: 1551440 - RNA, 13 nt, Pseudomonas aeruginosa PA01
aggcgugcugcac

SEQ ID NO: 1551441 - RNA, 15 nt, Pseudomonas aeruginosa PA01
aggcguuccaccagg

SEQ ID NO: 1551442 - RNA, 17 nt, Pseudomonas aeruginosa PA01
aggcguuccaccaggcg

SEQ ID NO: 1551443 - RNA, 13 nt, Pseudomonas aeruginosa PA01
aggcguuccagcu

SEQ ID NO: 1551444 - RNA, 17 nt, Pseudomonas aeruginosa PA01
aggcggcggaagaagcc

SEQ ID NO: 1551445 - RNA, 22 nt, Pseudomonas aeruginosa PA01
aggcggcggcguuggccgagga

SEQ ID NO: 1551446 - RNA, 22 nt, Pseudomonas aeruginosa PA01
aggcggcgguagccgaggcggc

SEQ ID NO: 1551447 - RNA, 23 nt, Pseudomonas aeruginosa PA01
aggcggcccaugcggaucgccuc

SEQ ID NO: 1551448 - RNA, 19 nt, Pseudomonas aeruginosa PA01
aggcggccgucggccuggc

SEQ ID NO: 1551449 - RNA, 16 nt, Pseudomonas aeruginosa PA01
aggcggcgaaggccgc

SEQ ID NO: 1551450 - RNA, 18 nt, Pseudomonas aeruginosa PA01
aggcggauuuccugcggc

SEQ ID NO: 1551451 - RNA, 18 nt, Pseudomonas aeruginosa PA01
aggcggauaacgccagga

SEQ ID NO: 1551452 - RNA, 22 nt, Pseudomonas aeruginosa PA01
aggcguaccagcuugucgccuu

SEQ ID NO: 1551453 - RNA, 13 nt, Pseudomonas aeruginosa PA01
aggcguacgucga

SEQ ID NO: 1551454 - RNA, 23 nt, Pseudomonas aeruginosa PA01
aggcgguggccacgucgccccag

SEQ ID NO: 1551455 - RNA, 16 nt, Pseudomonas aeruginosa PA01
aggcgguacaccgcca

SEQ ID NO: 1551456 - RNA, 15 nt, Pseudomonas aeruginosa PA01
aggcgguggagcacg

SEQ ID NO: 1551457 - RNA, 20 nt, Pseudomonas aeruginosa PA01
aggcgguuguucagcgggcg

SEQ ID NO: 1551458 - RNA, 13 nt, Pseudomonas aeruginosa PA01
aggcgggcggcgu

SEQ ID NO: 1551459 - RNA, 16 nt, Pseudomonas aeruginosa PA01
aggcgggcgucggcgu

SEQ ID NO: 1551460 - RNA, 23 nt, Pseudomonas aeruginosa PA01
aggcgggcuggaaaacgccacac

SEQ ID NO: 1551461 - RNA, 21 nt, Pseudomonas aeruginosa PA01
aggcggucgccgaacagccgc

SEQ ID NO: 1551462 - RNA, 21 nt, Pseudomonas aeruginosa PA01
aggcggucggaaagcagggcg

SEQ ID NO: 1551463 - RNA, 17 nt, Pseudomonas aeruginosa PA01
aggcggucggccaucug

SEQ ID NO: 1551464 - RNA, 15 nt, Pseudomonas aeruginosa PA01
aggcggucagcaguu

SEQ ID NO: 1551465 - RNA, 22 nt, Pseudomonas aeruginosa PA01
aggcggucagcaguugccgggu

SEQ ID NO: 1551466 - RNA, 18 nt, Pseudomonas aeruginosa PA01
aggcggacacgcaggcgc

SEQ ID NO: 1551467 - RNA, 19 nt, Pseudomonas aeruginosa PA01
aggcggacacgcaggcgcc

SEQ ID NO: 1551468 - RNA, 19 nt, Pseudomonas aeruginosa PA01
aggcgcuucugcucggccu

SEQ ID NO: 1551469 - RNA, 17 nt, Pseudomonas aeruginosa PA01
aggcgcuucagcucgag

SEQ ID NO: 1551470 - RNA, 17 nt, Pseudomonas aeruginosa PA01
aggcgcugguccagcac

SEQ ID NO: 1551471 - RNA, 22 nt, Pseudomonas aeruginosa PA01
aggcgcuguccuguggcgcuuc

SEQ ID NO: 1551472 - RNA, 19 nt, Pseudomonas aeruginosa PA01
aggcgcuggcgcuguaggc

SEQ ID NO: 1551473 - RNA, 16 nt, Pseudomonas aeruginosa PA01
aggcgcucggcggcgc

SEQ ID NO: 1551474 - RNA, 15 nt, Pseudomonas aeruginosa PA01
aggcgcucggggaug

SEQ ID NO: 1551475 - RNA, 17 nt, Pseudomonas aeruginosa PA01
aggcgcugcagccacug

SEQ ID NO: 1551476 - RNA, 15 nt, Pseudomonas aeruginosa PA01
aggcgcuauccgccg

SEQ ID NO: 1551477 - RNA, 20 nt, Pseudomonas aeruginosa PA01
aggcgcguugcuuccaggca

SEQ ID NO: 1551478 - RNA, 23 nt, Pseudomonas aeruginosa PA01
aggcgcuccaccgcccccggcgc

SEQ ID NO: 1551479 - RNA, 22 nt, Pseudomonas aeruginosa PA01
aggcgcuccuugagcagcucga

SEQ ID NO: 1551480 - RNA, 18 nt, Pseudomonas aeruginosa PA01
aggcgcgucgcggccucu

SEQ ID NO: 1551481 - RNA, 22 nt, Pseudomonas aeruginosa PA01
aggcgcucgacgaucaggugca

SEQ ID NO: 1551482 - RNA, 22 nt, Pseudomonas aeruginosa PA01
aggcgcucgcgggccgccuggu

SEQ ID NO: 1551483 - RNA, 14 nt, Pseudomonas aeruginosa PA01
aggcgcgcagggcc

SEQ ID NO: 1551484 - RNA, 14 nt, Pseudomonas aeruginosa PA01
aggcgcgcaccugc

SEQ ID NO: 1551485 - RNA, 16 nt, Pseudomonas aeruginosa PA01
aggcgcggggcgaggu

SEQ ID NO: 1551486 - RNA, 15 nt, Pseudomonas aeruginosa PA01
aggcgcgggcggcgg

SEQ ID NO: 1551487 - RNA, 12 nt, Pseudomonas aeruginosa PA01
aggcgcgcucga

SEQ ID NO: 1551488 - RNA, 18 nt, Pseudomonas aeruginosa PA01
aggcgcggcggaagaaua

SEQ ID NO: 1551489 - RNA, 16 nt, Pseudomonas aeruginosa PA01
aggcgcgccuggcccu

SEQ ID NO: 1551490 - RNA, 19 nt, Pseudomonas aeruginosa PA01
aggcgacguuuuucccgug

SEQ ID NO: 1551491 - RNA, 22 nt, Pseudomonas aeruginosa PA01
aggcgaaguaucugggucuggc

SEQ ID NO: 1551492 - RNA, 16 nt, Pseudomonas aeruginosa PA01
aggcgaagcccagcga

SEQ ID NO: 1551493 - RNA, 22 nt, Pseudomonas aeruginosa PA01
aggcgaagcggcucggccaggg

SEQ ID NO: 1551494 - RNA, 19 nt, Pseudomonas aeruginosa PA01
aggccuugcagggccgcca

SEQ ID NO: 1551495 - RNA, 15 nt, Pseudomonas aeruginosa PA01
aggccuuccacgccu

SEQ ID NO: 1551496 - RNA, 14 nt, Pseudomonas aeruginosa PA01
aggccuguccgaag

SEQ ID NO: 1551497 - RNA, 21 nt, Pseudomonas aeruginosa PA01
aggccuggcccuggcgcaggc

SEQ ID NO: 1551498 - RNA, 22 nt, Pseudomonas aeruginosa PA01
aggccuggcccuggcgcaggcg

SEQ ID NO: 1551499 - RNA, 22 nt, Pseudomonas aeruginosa PA01
aggccugggcguacaggcccca

SEQ ID NO: 1551500 - RNA, 15 nt, Pseudomonas aeruginosa PA01
aggccugggucacca

SEQ ID NO: 1551501 - RNA, 18 nt, Pseudomonas aeruginosa PA01
aggccugggucaccagca

SEQ ID NO: 1551502 - RNA, 17 nt, Pseudomonas aeruginosa PA01
aggccugguccuuauuc

SEQ ID NO: 1551503 - RNA, 18 nt, Pseudomonas aeruginosa PA01
aggccuggagcgccucga

SEQ ID NO: 1551504 - RNA, 16 nt, Pseudomonas aeruginosa PA01
aggccuggaacaccag

SEQ ID NO: 1551505 - RNA, 16 nt, Pseudomonas aeruginosa PA01
aggcgcccaggcagca

SEQ ID NO: 1551506 - RNA, 17 nt, Pseudomonas aeruginosa PA01
aggcgcccaggcagcag

SEQ ID NO: 1551507 - RNA, 16 nt, Pseudomonas aeruginosa PA01
aggcgcccggucaggu

SEQ ID NO: 1551508 - RNA, 16 nt, Pseudomonas aeruginosa PA01
aggcgccggccucgca

SEQ ID NO: 1551509 - RNA, 13 nt, Pseudomonas aeruginosa PA01
aggcgccggcauu

SEQ ID NO: 1551510 - RNA, 15 nt, Pseudomonas aeruginosa PA01
aggcgccuuccaggc

SEQ ID NO: 1551511 - RNA, 16 nt, Pseudomonas aeruginosa PA01
aggcgccagagcgcgc

SEQ ID NO: 1551512 - RNA, 23 nt, Pseudomonas aeruginosa PA01
aggcgccagucauugcgcuccga

SEQ ID NO: 1551513 - RNA, 13 nt, Pseudomonas aeruginosa PA01
aggcgcagcagca

SEQ ID NO: 1551514 - RNA, 13 nt, Pseudomonas aeruginosa PA01
aggcgcagcagcg

SEQ ID NO: 1551515 - RNA, 15 nt, Pseudomonas aeruginosa PA01
aggcgcaggcgagga

SEQ ID NO: 1551516 - RNA, 14 nt, Pseudomonas aeruginosa PA01
aggcgcagccagca

SEQ ID NO: 1551517 - RNA, 19 nt, Pseudomonas aeruginosa PA01
aggcgcagcguccugcccu

SEQ ID NO: 1551518 - RNA, 18 nt, Pseudomonas aeruginosa PA01
aggcgcaaccagaccagc

SEQ ID NO: 1551519 - RNA, 14 nt, Pseudomonas aeruginosa PA01
aggcgcacaucacc

SEQ ID NO: 1551520 - RNA, 16 nt, Pseudomonas aeruginosa PA01
aggcgcaccagcaggc

SEQ ID NO: 1551521 - RNA, 14 nt, Pseudomonas aeruginosa PA01
aggcgcaccaggcc

SEQ ID NO: 1551522 - RNA, 15 nt, Pseudomonas aeruginosa PA01
aggcgauggccuggu

SEQ ID NO: 1551523 - RNA, 15 nt, Pseudomonas aeruginosa PA01
aggcgaucgccgcgg

SEQ ID NO: 1551524 - RNA, 17 nt, Pseudomonas aeruginosa PA01
aggcgaucgccgcggcg

SEQ ID NO: 1551525 - RNA, 15 nt, Pseudomonas aeruginosa PA01
aggcgaucaucgcca

SEQ ID NO: 1551526 - RNA, 21 nt, Pseudomonas aeruginosa PA01
aggcgauacgcggcccggaau

SEQ ID NO: 1551527 - RNA, 23 nt, Pseudomonas aeruginosa PA01
aggccggugcagaagacgcccag

SEQ ID NO: 1551528 - RNA, 21 nt, Pseudomonas aeruginosa PA01
aggccggugccgccggccacc

SEQ ID NO: 1551529 - RNA, 18 nt, Pseudomonas aeruginosa PA01
aggccgggcccugggccc

SEQ ID NO: 1551530 - RNA, 17 nt, Pseudomonas aeruginosa PA01
aggccggcgugcccauc

SEQ ID NO: 1551531 - RNA, 19 nt, Pseudomonas aeruginosa PA01
aggccggcuaaccgcgaag

SEQ ID NO: 1551532 - RNA, 13 nt, Pseudomonas aeruginosa PA01
aggccggcgucga

SEQ ID NO: 1551533 - RNA, 21 nt, Pseudomonas aeruginosa PA01
aggccguccuugaguagcugg

SEQ ID NO: 1551534 - RNA, 20 nt, Pseudomonas aeruginosa PA01
aggccguagaccaccagcag

SEQ ID NO: 1551535 - RNA, 18 nt, Pseudomonas aeruginosa PA01
aggccgggucgcagccgg

SEQ ID NO: 1551536 - RNA, 20 nt, Pseudomonas aeruginosa PA01
aggccguccaguucuuccac

SEQ ID NO: 1551537 - RNA, 18 nt, Pseudomonas aeruginosa PA01
aggccucggcgcgggccu

SEQ ID NO: 1551538 - RNA, 16 nt, Pseudomonas aeruginosa PA01
aggccucggucaggcg

SEQ ID NO: 1551539 - RNA, 22 nt, Pseudomonas aeruginosa PA01
aggccucgguggcccacuccag

SEQ ID NO: 1551540 - RNA, 19 nt, Pseudomonas aeruginosa PA01
aggccucggcauccucgcc

SEQ ID NO: 1551541 - RNA, 22 nt, Pseudomonas aeruginosa PA01
aggccgcggagcaccgcgccuu

SEQ ID NO: 1551542 - RNA, 15 nt, Pseudomonas aeruginosa PA01
aggccggcgagccag

SEQ ID NO: 1551543 - RNA, 13 nt, Pseudomonas aeruginosa PA01
aggccggcgaggg

SEQ ID NO: 1551544 - RNA, 22 nt, Pseudomonas aeruginosa PA01
aggccggcggccgaggcuuccu

SEQ ID NO: 1551545 - RNA, 15 nt, Pseudomonas aeruginosa PA01
aggccgccgcgggca

SEQ ID NO: 1551546 - RNA, 20 nt, Pseudomonas aeruginosa PA01
aggccgccgcgggcaaccgc

SEQ ID NO: 1551547 - RNA, 18 nt, Pseudomonas aeruginosa PA01
aggccgccgccugcucgc

SEQ ID NO: 1551548 - RNA, 19 nt, Pseudomonas aeruginosa PA01
aggccgccgauccaggaac

SEQ ID NO: 1551549 - RNA, 23 nt, Pseudomonas aeruginosa PA01
aggccgaugcccaauacccacag

SEQ ID NO: 1551550 - RNA, 13 nt, Pseudomonas aeruginosa PA01
aggccgauggccc

SEQ ID NO: 1551551 - RNA, 15 nt, Pseudomonas aeruginosa PA01
aggccgaucaggaaa

SEQ ID NO: 1551552 - RNA, 21 nt, Pseudomonas aeruginosa PA01
aggccgaucaucaucagguag

SEQ ID NO: 1551553 - RNA, 17 nt, Pseudomonas aeruginosa PA01
aggccgccaugcucggc

SEQ ID NO: 1551554 - RNA, 10 nt, Pseudomonas aeruginosa PA01
aggccgccga

SEQ ID NO: 1551555 - RNA, 16 nt, Pseudomonas aeruginosa PA01
agggcaacgccaggcu

SEQ ID NO: 1551556 - RNA, 21 nt, Pseudomonas aeruginosa PA01
agggcaacgccaggcugucag

SEQ ID NO: 1551557 - RNA, 21 nt, Pseudomonas aeruginosa PA01
agggcacccgguugaccccgc

SEQ ID NO: 1551558 - RNA, 10 nt, Pseudomonas aeruginosa PA01
agggcagcag

SEQ ID NO: 1551559 - RNA, 16 nt, Pseudomonas aeruginosa PA01
agggcagccgccgcgg

SEQ ID NO: 1551560 - RNA, 20 nt, Pseudomonas aeruginosa PA01
agggcagccgccgcggcacc

SEQ ID NO: 1551561 - RNA, 16 nt, Pseudomonas aeruginosa PA01
agggcaccgccgagga

SEQ ID NO: 1551562 - RNA, 15 nt, Pseudomonas aeruginosa PA01
agggcaucagccccu

SEQ ID NO: 1551563 - RNA, 22 nt, Pseudomonas aeruginosa PA01
agggcauccucgcgguucugcu

SEQ ID NO: 1551564 - RNA, 22 nt, Pseudomonas aeruginosa PA01
agggcaugggucagcgccagca

SEQ ID NO: 1551565 - RNA, 16 nt, Pseudomonas aeruginosa PA01
agggcaggaaccagac

SEQ ID NO: 1551566 - RNA, 17 nt, Pseudomonas aeruginosa PA01
agggccagcggguugau

SEQ ID NO: 1551567 - RNA, 23 nt, Pseudomonas aeruginosa PA01
agggccagggaggcgcuggccag

SEQ ID NO: 1551568 - RNA, 16 nt, Pseudomonas aeruginosa PA01
agggccagggcggcgg

SEQ ID NO: 1551569 - RNA, 15 nt, Pseudomonas aeruginosa PA01
agggccagcaacagg

SEQ ID NO: 1551570 - RNA, 19 nt, Pseudomonas aeruginosa PA01
agggccagagcacgaaagc

SEQ ID NO: 1551571 - RNA, 12 nt, Pseudomonas aeruginosa PA01
agggccagcaac

SEQ ID NO: 1551572 - RNA, 15 nt, Pseudomonas aeruginosa PA01
agggccagccagagc

SEQ ID NO: 1551573 - RNA, 12 nt, Pseudomonas aeruginosa PA01
agggccagcgcc

SEQ ID NO: 1551574 - RNA, 21 nt, Pseudomonas aeruginosa PA01
agggcauuggccaucagcgcc

SEQ ID NO: 1551575 - RNA, 18 nt, Pseudomonas aeruginosa PA01
agggcauuuccugggugc

SEQ ID NO: 1551576 - RNA, 15 nt, Pseudomonas aeruginosa PA01
agggccgccagccgc

SEQ ID NO: 1551577 - RNA, 17 nt, Pseudomonas aeruginosa PA01
agggccgaggucgagga

SEQ ID NO: 1551578 - RNA, 21 nt, Pseudomonas aeruginosa PA01
agggcccgugguagucgagcc

SEQ ID NO: 1551579 - RNA, 17 nt, Pseudomonas aeruginosa PA01
agggcccacagugccag

SEQ ID NO: 1551580 - RNA, 20 nt, Pseudomonas aeruginosa PA01
agggcccacagugccaggcu

SEQ ID NO: 1551581 - RNA, 21 nt, Pseudomonas aeruginosa PA01
agggcccacagugccaggcuc

SEQ ID NO: 1551582 - RNA, 16 nt, Pseudomonas aeruginosa PA01
agggcgauggcgguga

SEQ ID NO: 1551583 - RNA, 21 nt, Pseudomonas aeruginosa PA01
agggcgaugguccccggcccc

SEQ ID NO: 1551584 - RNA, 15 nt, Pseudomonas aeruginosa PA01
agggcgcccgcccgg

SEQ ID NO: 1551585 - RNA, 20 nt, Pseudomonas aeruginosa PA01
agggcgccaggugcaggaag

SEQ ID NO: 1551586 - RNA, 15 nt, Pseudomonas aeruginosa PA01
agggcgcggcgccag

SEQ ID NO: 1551587 - RNA, 13 nt, Pseudomonas aeruginosa PA01
agggcgcggauga

SEQ ID NO: 1551588 - RNA, 13 nt, Pseudomonas aeruginosa PA01
agggcggcgauga

SEQ ID NO: 1551589 - RNA, 12 nt, Pseudomonas aeruginosa PA01
agggcggcgccu

SEQ ID NO: 1551590 - RNA, 22 nt, Pseudomonas aeruginosa PA01
agggcggcccggaagcucugca

SEQ ID NO: 1551591 - RNA, 18 nt, Pseudomonas aeruginosa PA01
agggcggcgcgggcgcgc

SEQ ID NO: 1551592 - RNA, 13 nt, Pseudomonas aeruginosa PA01
agggcggcggcga

SEQ ID NO: 1551593 - RNA, 23 nt, Pseudomonas aeruginosa PA01
agggcgaacagcgccgcggcugg

SEQ ID NO: 1551594 - RNA, 18 nt, Pseudomonas aeruginosa PA01
agggcgaauaaccgcauc

SEQ ID NO: 1551595 - RNA, 23 nt, Pseudomonas aeruginosa PA01
agggcgaauaacgccacaggcgu

SEQ ID NO: 1551596 - RNA, 22 nt, Pseudomonas aeruginosa PA01
agggcgaauaacgccgcaggcg

SEQ ID NO: 1551597 - RNA, 22 nt, Pseudomonas aeruginosa PA01
agggccugggcgccgccagcca

SEQ ID NO: 1551598 - RNA, 20 nt, Pseudomonas aeruginosa PA01
agggccugguagaaacgcuu

SEQ ID NO: 1551599 - RNA, 14 nt, Pseudomonas aeruginosa PA01
agggccuugagcac

SEQ ID NO: 1551600 - RNA, 14 nt, Pseudomonas aeruginosa PA01
agggccuuggccuc

SEQ ID NO: 1551601 - RNA, 19 nt, Pseudomonas aeruginosa PA01
agggcgaccgccaggcggc

SEQ ID NO: 1551602 - RNA, 21 nt, Pseudomonas aeruginosa PA01
agggcgacguugcgcaggggc

SEQ ID NO: 1551603 - RNA, 13 nt, Pseudomonas aeruginosa PA01
agggcgagcaggg

SEQ ID NO: 1551604 - RNA, 15 nt, Pseudomonas aeruginosa PA01
agggcgagcagggcg

SEQ ID NO: 1551605 - RNA, 17 nt, Pseudomonas aeruginosa PA01
agggcgauccagaagau

SEQ ID NO: 1551606 - RNA, 17 nt, Pseudomonas aeruginosa PA01
agggcgauccgcccgca

SEQ ID NO: 1551607 - RNA, 14 nt, Pseudomonas aeruginosa PA01
agggccugcuccag

SEQ ID NO: 1551608 - RNA, 18 nt, Pseudomonas aeruginosa PA01
agggcccgaacgggcccu

SEQ ID NO: 1551609 - RNA, 20 nt, Pseudomonas aeruginosa PA01
aggggucgacgcagggcggc

SEQ ID NO: 1551610 - RNA, 17 nt, Pseudomonas aeruginosa PA01
aggggucggcaucgcgu

SEQ ID NO: 1551611 - RNA, 14 nt, Pseudomonas aeruginosa PA01
aggggugccuugcc

SEQ ID NO: 1551612 - RNA, 15 nt, Pseudomonas aeruginosa PA01
agggguggccaggcg

SEQ ID NO: 1551613 - RNA, 19 nt, Pseudomonas aeruginosa PA01
aggguaccgaaacagggcg

SEQ ID NO: 1551614 - RNA, 20 nt, Pseudomonas aeruginosa PA01
aggguaccguugcgcaggcg

SEQ ID NO: 1551615 - RNA, 15 nt, Pseudomonas aeruginosa PA01
aggguagcgccgcgg

SEQ ID NO: 1551616 - RNA, 18 nt, Pseudomonas aeruginosa PA01
aggggcggagcagccuca

SEQ ID NO: 1551617 - RNA, 19 nt, Pseudomonas aeruginosa PA01
aggggccgccguacaggcc

SEQ ID NO: 1551618 - RNA, 15 nt, Pseudomonas aeruginosa PA01
aggggccgcgcuuca

SEQ ID NO: 1551619 - RNA, 14 nt, Pseudomonas aeruginosa PA01
agggggaagugaag

SEQ ID NO: 1551620 - RNA, 14 nt, Pseudomonas aeruginosa PA01
aggggcugaacagc

SEQ ID NO: 1551621 - RNA, 20 nt, Pseudomonas aeruginosa PA01
agggcugcuguugccaggga

SEQ ID NO: 1551622 - RNA, 15 nt, Pseudomonas aeruginosa PA01
agggcugggcgcccu

SEQ ID NO: 1551623 - RNA, 14 nt, Pseudomonas aeruginosa PA01
agggcuucccaggc

SEQ ID NO: 1551624 - RNA, 22 nt, Pseudomonas aeruginosa PA01
aggggaugccauggcauccccu

SEQ ID NO: 1551625 - RNA, 15 nt, Pseudomonas aeruginosa PA01
aggggagcgccggcg

SEQ ID NO: 1551626 - RNA, 15 nt, Pseudomonas aeruginosa PA01
agggcucagcccagg

SEQ ID NO: 1551627 - RNA, 18 nt, Pseudomonas aeruginosa PA01
agggcucagcccaggcgc

SEQ ID NO: 1551628 - RNA, 10 nt, Pseudomonas aeruginosa PA01
agggcugaga

SEQ ID NO: 1551629 - RNA, 21 nt, Pseudomonas aeruginosa PA01
agggcguaggcgucgcgaacc

SEQ ID NO: 1551630 - RNA, 20 nt, Pseudomonas aeruginosa PA01
agggcggucggccaggggag

SEQ ID NO: 1551631 - RNA, 23 nt, Pseudomonas aeruginosa PA01
agggcgucaguuccacgcggacc

SEQ ID NO: 1551632 - RNA, 14 nt, Pseudomonas aeruginosa PA01
agggcguccuugcc

SEQ ID NO: 1551633 - RNA, 15 nt, Pseudomonas aeruginosa PA01
agggcgucgaaggcg

SEQ ID NO: 1551634 - RNA, 22 nt, Pseudomonas aeruginosa PA01
agggcgucugggacggcagccu

SEQ ID NO: 1551635 - RNA, 18 nt, Pseudomonas aeruginosa PA01
agggcgucgucgaggcug

SEQ ID NO: 1551636 - RNA, 19 nt, Pseudomonas aeruginosa PA01
aggcuggccuuggccaugc

SEQ ID NO: 1551637 - RNA, 13 nt, Pseudomonas aeruginosa PA01
aggcuggccagca

SEQ ID NO: 1551638 - RNA, 23 nt, Pseudomonas aeruginosa PA01
aggcuggcggcauaggcccggcg

SEQ ID NO: 1551639 - RNA, 13 nt, Pseudomonas aeruginosa PA01
aggcuggcggcca

SEQ ID NO: 1551640 - RNA, 16 nt, Pseudomonas aeruginosa PA01
aggcuggcggccaggg

SEQ ID NO: 1551641 - RNA, 18 nt, Pseudomonas aeruginosa PA01
aggcuggcggccagggca

SEQ ID NO: 1551642 - RNA, 19 nt, Pseudomonas aeruginosa PA01
aggcuguacagcaggagcg

SEQ ID NO: 1551643 - RNA, 13 nt, Pseudomonas aeruginosa PA01
aggcugugcagga

SEQ ID NO: 1551644 - RNA, 22 nt, Pseudomonas aeruginosa PA01
aggcugugcaggaaggcgacga

SEQ ID NO: 1551645 - RNA, 23 nt, Pseudomonas aeruginosa PA01
aggcugugccauuccugggcccc

SEQ ID NO: 1551646 - RNA, 15 nt, Pseudomonas aeruginosa PA01
aggcugucggccagc

SEQ ID NO: 1551647 - RNA, 14 nt, Pseudomonas aeruginosa PA01
aggcugucggccau

SEQ ID NO: 1551648 - RNA, 22 nt, Pseudomonas aeruginosa PA01
aggcuggaagccgcgcucgcgg

SEQ ID NO: 1551649 - RNA, 16 nt, Pseudomonas aeruginosa PA01
aggcuggccacgaaca

SEQ ID NO: 1551650 - RNA, 17 nt, Pseudomonas aeruginosa PA01
aggcugcugucgagggu

SEQ ID NO: 1551651 - RNA, 22 nt, Pseudomonas aeruginosa PA01
aggcugcugucgagggucugcu

SEQ ID NO: 1551652 - RNA, 13 nt, Pseudomonas aeruginosa PA01
aggcugccgccgc

SEQ ID NO: 1551653 - RNA, 19 nt, Pseudomonas aeruginosa PA01
aggcugcgcuugcugccau

SEQ ID NO: 1551654 - RNA, 20 nt, Pseudomonas aeruginosa PA01
aggcugcgccgcugcggcug

SEQ ID NO: 1551655 - RNA, 17 nt, Pseudomonas aeruginosa PA01
aggcugccggccaggua

SEQ ID NO: 1551656 - RNA, 16 nt, Pseudomonas aeruginosa PA01
aggcugccguccaggc

SEQ ID NO: 1551657 - RNA, 17 nt, Pseudomonas aeruginosa PA01
aggcugccguccaggcg

SEQ ID NO: 1551658 - RNA, 13 nt, Pseudomonas aeruginosa PA01
aggcugccgccgu

SEQ ID NO: 1551659 - RNA, 16 nt, Pseudomonas aeruginosa PA01
aggcugccgccguaga

SEQ ID NO: 1551660 - RNA, 22 nt, Pseudomonas aeruginosa PA01
aggcugccgagaaucugcccgg

SEQ ID NO: 1551661 - RNA, 17 nt, Pseudomonas aeruginosa PA01
aggcugccgagcagggu

SEQ ID NO: 1551662 - RNA, 22 nt, Pseudomonas aeruginosa PA01
aggcugcgcaccucggccaggc

SEQ ID NO: 1551663 - RNA, 21 nt, Pseudomonas aeruginosa PA01
aggcuuacccgcgaccacagg

SEQ ID NO: 1551664 - RNA, 19 nt, Pseudomonas aeruginosa PA01
aggcuguugcccugggccg

SEQ ID NO: 1551665 - RNA, 22 nt, Pseudomonas aeruginosa PA01
aggcuguugcccugggccggcg

SEQ ID NO: 1551666 - RNA, 16 nt, Pseudomonas aeruginosa PA01
aggcugugcgccaggc

SEQ ID NO: 1551667 - RNA, 15 nt, Pseudomonas aeruginosa PA01
aggcuuuccagcccg

SEQ ID NO: 1551668 - RNA, 18 nt, Pseudomonas aeruginosa PA01
aggcuuuccagcccggcg

SEQ ID NO: 1551669 - RNA, 16 nt, Pseudomonas aeruginosa PA01
aggcuuuccugcgccu

SEQ ID NO: 1551670 - RNA, 19 nt, Pseudomonas aeruginosa PA01
aggcuuucguaggcaggcg

SEQ ID NO: 1551671 - RNA, 21 nt, Pseudomonas aeruginosa PA01
agggaggcgcacaucacccgg

SEQ ID NO: 1551672 - RNA, 21 nt, Pseudomonas aeruginosa PA01
agggaugccgccggcaucccu

SEQ ID NO: 1551673 - RNA, 17 nt, Pseudomonas aeruginosa PA01
agggaugccggcggcau

SEQ ID NO: 1551674 - RNA, 21 nt, Pseudomonas aeruginosa PA01
agggauguuccaggcccgccg

SEQ ID NO: 1551675 - RNA, 16 nt, Pseudomonas aeruginosa PA01
agggaucgcgcggcug

SEQ ID NO: 1551676 - RNA, 17 nt, Pseudomonas aeruginosa PA01
agggaucgcgcggcugg

SEQ ID NO: 1551677 - RNA, 16 nt, Pseudomonas aeruginosa PA01
agggcaaaggcgcgca

SEQ ID NO: 1551678 - RNA, 20 nt, Pseudomonas aeruginosa PA01
agggaaaaaagggagccagg

SEQ ID NO: 1551679 - RNA, 15 nt, Pseudomonas aeruginosa PA01
agggaaacaccaggc

SEQ ID NO: 1551680 - RNA, 21 nt, Pseudomonas aeruginosa PA01
agggaaacacgucgaucaccu

SEQ ID NO: 1551681 - RNA, 19 nt, Pseudomonas aeruginosa PA01
agggaaucuuuccuccaga

SEQ ID NO: 1551682 - RNA, 15 nt, Pseudomonas aeruginosa PA01
agggacgcgcagcgg

SEQ ID NO: 1551683 - RNA, 16 nt, Pseudomonas aeruginosa PA01
agggacgcgccggcgg

SEQ ID NO: 1551684 - RNA, 13 nt, Pseudomonas aeruginosa PA01
agggagaacagca

SEQ ID NO: 1551685 - RNA, 22 nt, Pseudomonas aeruginosa PA01
agggagaacagcagggucaggg

SEQ ID NO: 1551686 - RNA, 22 nt, Pseudomonas aeruginosa PA01
agcguuccaugaacucuucccc

SEQ ID NO: 1551687 - RNA, 15 nt, Pseudomonas aeruginosa PA01
agcguuaucgccggu

SEQ ID NO: 1551688 - RNA, 16 nt, Pseudomonas aeruginosa PA01
agcguuaucgccgguc

SEQ ID NO: 1551689 - RNA, 13 nt, Pseudomonas aeruginosa PA01
agcguggccagcg

SEQ ID NO: 1551690 - RNA, 20 nt, Pseudomonas aeruginosa PA01
agcguggccagcgcccaggc

SEQ ID NO: 1551691 - RNA, 14 nt, Pseudomonas aeruginosa PA01
agcgugggcggccg

SEQ ID NO: 1551692 - RNA, 16 nt, Pseudomonas aeruginosa PA01
agcgugggcggccggc

SEQ ID NO: 1551693 - RNA, 21 nt, Pseudomonas aeruginosa PA01
agcgugggcggccggccaggu

SEQ ID NO: 1551694 - RNA, 19 nt, Pseudomonas aeruginosa PA01
agcgugcgcaugcccgcgu

SEQ ID NO: 1551695 - RNA, 16 nt, Pseudomonas aeruginosa PA01
agcgugcggcccuugu

SEQ ID NO: 1551696 - RNA, 13 nt, Pseudomonas aeruginosa PA01
agcgucugcagcu

SEQ ID NO: 1551697 - RNA, 18 nt, Pseudomonas aeruginosa PA01
agcgucgugcgccggccu

SEQ ID NO: 1551698 - RNA, 22 nt, Pseudomonas aeruginosa PA01
agcgucguagagcgugcggccg

SEQ ID NO: 1551699 - RNA, 16 nt, Pseudomonas aeruginosa PA01
agcgucgcgucggccu

SEQ ID NO: 1551700 - RNA, 14 nt, Pseudomonas aeruginosa PA01
agcgucgcgcggcc

SEQ ID NO: 1551701 - RNA, 18 nt, Pseudomonas aeruginosa PA01
agcgucgcgcggccagcg

SEQ ID NO: 1551702 - RNA, 20 nt, Pseudomonas aeruginosa PA01
agcgucgcgcggccagcgug

SEQ ID NO: 1551703 - RNA, 13 nt, Pseudomonas aeruginosa PA01
agcgggccagcag

SEQ ID NO: 1551704 - RNA, 12 nt, Pseudomonas aeruginosa PA01
agcgggccaggc

SEQ ID NO: 1551705 - RNA, 16 nt, Pseudomonas aeruginosa PA01
agcgggccaucagguc

SEQ ID NO: 1551706 - RNA, 22 nt, Pseudomonas aeruginosa PA01
agcgggccuucgccagcggcca

SEQ ID NO: 1551707 - RNA, 16 nt, Pseudomonas aeruginosa PA01
agcgggcgagggcggc

SEQ ID NO: 1551708 - RNA, 17 nt, Pseudomonas aeruginosa PA01
agcgggcgcuugaagcc

SEQ ID NO: 1551709 - RNA, 20 nt, Pseudomonas aeruginosa PA01
agcgggcugucguccugggu

SEQ ID NO: 1551710 - RNA, 16 nt, Pseudomonas aeruginosa PA01
agcgguaccagcagcg

SEQ ID NO: 1551711 - RNA, 17 nt, Pseudomonas aeruginosa PA01
agcgguagaacaggcga

SEQ ID NO: 1551712 - RNA, 21 nt, Pseudomonas aeruginosa PA01
agcgguauugucgaugggcag

SEQ ID NO: 1551713 - RNA, 18 nt, Pseudomonas aeruginosa PA01
agcgguagugggcgaggc

SEQ ID NO: 1551714 - RNA, 23 nt, Pseudomonas aeruginosa PA01
agcggugaucgaaaaaaggcgcc

SEQ ID NO: 1551715 - RNA, 18 nt, Pseudomonas aeruginosa PA01
agcggucguagcccaugg

SEQ ID NO: 1551716 - RNA, 18 nt, Pseudomonas aeruginosa PA01
agcggucgugcagcagcg

SEQ ID NO: 1551717 - RNA, 16 nt, Pseudomonas aeruginosa PA01
agcggucggccauggc

SEQ ID NO: 1551718 - RNA, 16 nt, Pseudomonas aeruginosa PA01
agcgguccucgggcac

SEQ ID NO: 1551719 - RNA, 21 nt, Pseudomonas aeruginosa PA01
agcgguccucgggcaccagca

SEQ ID NO: 1551720 - RNA, 23 nt, Pseudomonas aeruginosa PA01
agcgguccucgggcaccagcacg

SEQ ID NO: 1551721 - RNA, 15 nt, Pseudomonas aeruginosa PA01
agcggucgccggucg

SEQ ID NO: 1551722 - RNA, 20 nt, Pseudomonas aeruginosa PA01
agcggucggagguucgaauc

SEQ ID NO: 1551723 - RNA, 17 nt, Pseudomonas aeruginosa PA01
agcggugugcucaggcg

SEQ ID NO: 1551724 - RNA, 19 nt, Pseudomonas aeruginosa PA01
agcggcgccucgaagcgga

SEQ ID NO: 1551725 - RNA, 22 nt, Pseudomonas aeruginosa PA01
agcggcgcccuggcucuugccg

SEQ ID NO: 1551726 - RNA, 14 nt, Pseudomonas aeruginosa PA01
agcggcgccgaggg

SEQ ID NO: 1551727 - RNA, 16 nt, Pseudomonas aeruginosa PA01
agcggcgcgaggccgu

SEQ ID NO: 1551728 - RNA, 23 nt, Pseudomonas aeruginosa PA01
agcggcgcuuuccacucgggguc

SEQ ID NO: 1551729 - RNA, 16 nt, Pseudomonas aeruginosa PA01
agcgggaugugcacca

SEQ ID NO: 1551730 - RNA, 15 nt, Pseudomonas aeruginosa PA01
agcggcuugcagucg

SEQ ID NO: 1551731 - RNA, 20 nt, Pseudomonas aeruginosa PA01
agcggcuggcgaugcugacc

SEQ ID NO: 1551732 - RNA, 22 nt, Pseudomonas aeruginosa PA01
agcggcuggcugaagccgggca

SEQ ID NO: 1551733 - RNA, 23 nt, Pseudomonas aeruginosa PA01
agcggcugguggccguugagcac

SEQ ID NO: 1551734 - RNA, 16 nt, Pseudomonas aeruginosa PA01
agcggcuguugccgga

SEQ ID NO: 1551735 - RNA, 21 nt, Pseudomonas aeruginosa PA01
agcggcucgucaucguccagc

SEQ ID NO: 1551736 - RNA, 16 nt, Pseudomonas aeruginosa PA01
agcggcucggccaggg

SEQ ID NO: 1551737 - RNA, 21 nt, Pseudomonas aeruginosa PA01
agcggcucggccagggccgcu

SEQ ID NO: 1551738 - RNA, 21 nt, Pseudomonas aeruginosa PA01
agcggcuccucggccugggcg

SEQ ID NO: 1551739 - RNA, 23 nt, Pseudomonas aeruginosa PA01
agcggaaugcuuccguaggugga

SEQ ID NO: 1551740 - RNA, 17 nt, Pseudomonas aeruginosa PA01
agcggaaaagcaggcca

SEQ ID NO: 1551741 - RNA, 16 nt, Pseudomonas aeruginosa PA01
agcggcaugcccugcc

SEQ ID NO: 1551742 - RNA, 14 nt, Pseudomonas aeruginosa PA01
agcggcauggucag

SEQ ID NO: 1551743 - RNA, 21 nt, Pseudomonas aeruginosa PA01
agcggaggauucagcaggaau

SEQ ID NO: 1551744 - RNA, 22 nt, Pseudomonas aeruginosa PA01
agcggcgccaggcguuccagcu

SEQ ID NO: 1551745 - RNA, 19 nt, Pseudomonas aeruginosa PA01
agcggcgccaacucggccu

SEQ ID NO: 1551746 - RNA, 21 nt, Pseudomonas aeruginosa PA01
agcggccgcgaggacaacacu

SEQ ID NO: 1551747 - RNA, 11 nt, Pseudomonas aeruginosa PA01
agcggccaggg

SEQ ID NO: 1551748 - RNA, 19 nt, Pseudomonas aeruginosa PA01
agcgcggaucagucaggau

SEQ ID NO: 1551749 - RNA, 13 nt, Pseudomonas aeruginosa PA01
agcgcggcgcugg

SEQ ID NO: 1551750 - RNA, 17 nt, Pseudomonas aeruginosa PA01
agcgcggcggacaggca

SEQ ID NO: 1551751 - RNA, 20 nt, Pseudomonas aeruginosa PA01
agcgcggcgccccaggcgcc

SEQ ID NO: 1551752 - RNA, 17 nt, Pseudomonas aeruginosa PA01
agcgcggcucggggaug

SEQ ID NO: 1551753 - RNA, 15 nt, Pseudomonas aeruginosa PA01
agcgcggcuucagag

SEQ ID NO: 1551754 - RNA, 19 nt, Pseudomonas aeruginosa PA01
agcgcggcuucagagcugg

SEQ ID NO: 1551755 - RNA, 21 nt, Pseudomonas aeruginosa PA01
agcgcggcggcgcggagaucc

SEQ ID NO: 1551756 - RNA, 20 nt, Pseudomonas aeruginosa PA01
agcgcggcggcggccgcaug

SEQ ID NO: 1551757 - RNA, 16 nt, Pseudomonas aeruginosa PA01
agcgcugcgccaggcu

SEQ ID NO: 1551758 - RNA, 18 nt, Pseudomonas aeruginosa PA01
agcgcugccgcaugcagu

SEQ ID NO: 1551759 - RNA, 16 nt, Pseudomonas aeruginosa PA01
agcgcugccugcaccg

SEQ ID NO: 1551760 - RNA, 16 nt, Pseudomonas aeruginosa PA01
agcgcuggcagguugc

SEQ ID NO: 1551761 - RNA, 20 nt, Pseudomonas aeruginosa PA01
agcgcucggucagcucccug

SEQ ID NO: 1551762 - RNA, 18 nt, Pseudomonas aeruginosa PA01
agcgcggucauccgcccu

SEQ ID NO: 1551763 - RNA, 15 nt, Pseudomonas aeruginosa PA01
agcgcggugagcagg

SEQ ID NO: 1551764 - RNA, 19 nt, Pseudomonas aeruginosa PA01
agcgcggugagcaggguga

SEQ ID NO: 1551765 - RNA, 15 nt, Pseudomonas aeruginosa PA01
agcgcgccgagccag

SEQ ID NO: 1551766 - RNA, 18 nt, Pseudomonas aeruginosa PA01
agcgcgccgagccaggua

SEQ ID NO: 1551767 - RNA, 15 nt, Pseudomonas aeruginosa PA01
agcgcgccgccgagg

SEQ ID NO: 1551768 - RNA, 14 nt, Pseudomonas aeruginosa PA01
agcgcgccgccgau

SEQ ID NO: 1551769 - RNA, 19 nt, Pseudomonas aeruginosa PA01
agcgcgccggguugcgccg

SEQ ID NO: 1551770 - RNA, 14 nt, Pseudomonas aeruginosa PA01
agcgcgccugcucu

SEQ ID NO: 1551771 - RNA, 20 nt, Pseudomonas aeruginosa PA01
agcgcgcgcuggcgcagcgg

SEQ ID NO: 1551772 - RNA, 21 nt, Pseudomonas aeruginosa PA01
agcgcgcggcucggcgggcug

SEQ ID NO: 1551773 - RNA, 13 nt, Pseudomonas aeruginosa PA01
agcgcgcccggcg

SEQ ID NO: 1551774 - RNA, 18 nt, Pseudomonas aeruginosa PA01
agcgcgagggggccucgg

SEQ ID NO: 1551775 - RNA, 15 nt, Pseudomonas aeruginosa PA01
agcgcgaggcgagua

SEQ ID NO: 1551776 - RNA, 14 nt, Pseudomonas aeruginosa PA01
agcgcgaucagccg

SEQ ID NO: 1551777 - RNA, 19 nt, Pseudomonas aeruginosa PA01
agcgcgauuuugggcucag

SEQ ID NO: 1551778 - RNA, 17 nt, Pseudomonas aeruginosa PA01
agcucagucgguagagc

SEQ ID NO: 1551779 - RNA, 20 nt, Pseudomonas aeruginosa PA01
agcucagucgguagagcagu

SEQ ID NO: 1551780 - RNA, 23 nt, Pseudomonas aeruginosa PA01
agcucagcuggauagaguacucg

SEQ ID NO: 1551781 - RNA, 17 nt, Pseudomonas aeruginosa PA01
agcucagcugggagagc

SEQ ID NO: 1551782 - RNA, 12 nt, Pseudomonas aeruginosa PA01
agcucagcugga

SEQ ID NO: 1551783 - RNA, 14 nt, Pseudomonas aeruginosa PA01
agcucagcuggaua

SEQ ID NO: 1551784 - RNA, 16 nt, Pseudomonas aeruginosa PA01
agcucagcuggauaga

SEQ ID NO: 1551785 - RNA, 17 nt, Pseudomonas aeruginosa PA01
agcucguugcccggcuu

SEQ ID NO: 1551786 - RNA, 20 nt, Pseudomonas aeruginosa PA01
agcucugcacaaacucaggg

SEQ ID NO: 1551787 - RNA, 20 nt, Pseudomonas aeruginosa PA01
agcucugcgaucagggccuc

SEQ ID NO: 1551788 - RNA, 18 nt, Pseudomonas aeruginosa PA01
agcugccccacaggcccu

SEQ ID NO: 1551789 - RNA, 22 nt, Pseudomonas aeruginosa PA01
agcugccccacaggcccugcag

SEQ ID NO: 1551790 - RNA, 16 nt, Pseudomonas aeruginosa PA01
agcugccagugcucga

SEQ ID NO: 1551791 - RNA, 14 nt, Pseudomonas aeruginosa PA01
agcugccagccccg

SEQ ID NO: 1551792 - RNA, 13 nt, Pseudomonas aeruginosa PA01
agcugcagcgccc

SEQ ID NO: 1551793 - RNA, 20 nt, Pseudomonas aeruginosa PA01
agcugcacggcgacccgcac

SEQ ID NO: 1551794 - RNA, 19 nt, Pseudomonas aeruginosa PA01
agcugaagcugucgcccuc

SEQ ID NO: 1551795 - RNA, 17 nt, Pseudomonas aeruginosa PA01
agcuguucacaaaggcg

SEQ ID NO: 1551796 - RNA, 16 nt, Pseudomonas aeruginosa PA01
agcugucggcccgcgc

SEQ ID NO: 1551797 - RNA, 14 nt, Pseudomonas aeruginosa PA01
agcugucgcccucg

SEQ ID NO: 1551798 - RNA, 22 nt, Pseudomonas aeruginosa PA01
agcugucgcccucgcggagcug

SEQ ID NO: 1551799 - RNA, 17 nt, Pseudomonas aeruginosa PA01
agcuguuggccaaccag

SEQ ID NO: 1551800 - RNA, 14 nt, Pseudomonas aeruginosa PA01
agcuguugcuccaa

SEQ ID NO: 1551801 - RNA, 17 nt, Pseudomonas aeruginosa PA01
agcuguagcggcuugca

SEQ ID NO: 1551802 - RNA, 12 nt, Pseudomonas aeruginosa PA01
agcugcgccgcc

SEQ ID NO: 1551803 - RNA, 18 nt, Pseudomonas aeruginosa PA01
agcugcgccugcagcucg

SEQ ID NO: 1551804 - RNA, 13 nt, Pseudomonas aeruginosa PA01
agcugccuuccag

SEQ ID NO: 1551805 - RNA, 16 nt, Pseudomonas aeruginosa PA01
agcugccuuccagcag

SEQ ID NO: 1551806 - RNA, 21 nt, Pseudomonas aeruginosa PA01
agcuggaagucguccagcagg

SEQ ID NO: 1551807 - RNA, 23 nt, Pseudomonas aeruginosa PA01
agcuggacgacgcuggccugccg

SEQ ID NO: 1551808 - RNA, 21 nt, Pseudomonas aeruginosa PA01
agcuggagcagcagcgccgcg

SEQ ID NO: 1551809 - RNA, 19 nt, Pseudomonas aeruginosa PA01
agcuggauccgugccaggc

SEQ ID NO: 1551810 - RNA, 20 nt, Pseudomonas aeruginosa PA01
agcuggaucggcaggcuggc

SEQ ID NO: 1551811 - RNA, 21 nt, Pseudomonas aeruginosa PA01
agcuggggcuguugcugggcu

SEQ ID NO: 1551812 - RNA, 22 nt, Pseudomonas aeruginosa PA01
agcuggggcuguugcugggcua

SEQ ID NO: 1551813 - RNA, 16 nt, Pseudomonas aeruginosa PA01
agcuucaaccguggcu

SEQ ID NO: 1551814 - RNA, 17 nt, Pseudomonas aeruginosa PA01
agcuucgcuggguuuuc

SEQ ID NO: 1551815 - RNA, 22 nt, Pseudomonas aeruginosa PA01
agcuucgccggguguuuuuccu

SEQ ID NO: 1551816 - RNA, 13 nt, Pseudomonas aeruginosa PA01
agcuucugcaggg

SEQ ID NO: 1551817 - RNA, 23 nt, Pseudomonas aeruginosa PA01
agcuucucuuucaccuggucgcc

SEQ ID NO: 1551818 - RNA, 12 nt, Pseudomonas aeruginosa PA01
agcuucuugccu

SEQ ID NO: 1551819 - RNA, 16 nt, Pseudomonas aeruginosa PA01
agcuucuugccuucca

SEQ ID NO: 1551820 - RNA, 18 nt, Pseudomonas aeruginosa PA01
agcuuguugcgcaggcga

SEQ ID NO: 1551821 - RNA, 17 nt, Pseudomonas aeruginosa PA01
agcuuguuggccagcag

SEQ ID NO: 1551822 - RNA, 14 nt, Pseudomonas aeruginosa PA01
agcuuugcagggcg

SEQ ID NO: 1551823 - RNA, 20 nt, Pseudomonas aeruginosa PA01
agcuugcaauccgugcgccg

SEQ ID NO: 1551824 - RNA, 13 nt, Pseudomonas aeruginosa PA01
agcuugcccucag

SEQ ID NO: 1551825 - RNA, 14 nt, Pseudomonas aeruginosa PA01
agcuugcgccagag

SEQ ID NO: 1551826 - RNA, 21 nt, Pseudomonas aeruginosa PA01
agcuugcgccagagcaggcgg

SEQ ID NO: 1551827 - RNA, 13 nt, Pseudomonas aeruginosa PA01
agcuugccgcugc

SEQ ID NO: 1551828 - RNA, 13 nt, Pseudomonas aeruginosa PA01
agcuugccuucca

SEQ ID NO: 1551829 - RNA, 17 nt, Pseudomonas aeruginosa PA01
agcuugccuuccaggcu

SEQ ID NO: 1551830 - RNA, 19 nt, Pseudomonas aeruginosa PA01
agcuugccgaagauaccca

SEQ ID NO: 1551831 - RNA, 19 nt, Pseudomonas aeruginosa PA01
agcuugccgcaggucuugu

SEQ ID NO: 1551832 - RNA, 12 nt, Pseudomonas aeruginosa PA01
agcuuggcccug

SEQ ID NO: 1551833 - RNA, 20 nt, Pseudomonas aeruginosa PA01
agcuugguggugauccaggc

SEQ ID NO: 1551834 - RNA, 19 nt, Pseudomonas aeruginosa PA01
agcuugucggccuugguca

SEQ ID NO: 1551835 - RNA, 19 nt, Pseudomonas aeruginosa PA01
agcuugugggcaugcucgg

SEQ ID NO: 1551836 - RNA, 18 nt, Pseudomonas aeruginosa PA01
agcuuguggucguggcgg

SEQ ID NO: 1551837 - RNA, 19 nt, Pseudomonas aeruginosa PA01
agcuuguccagggcgcccu

SEQ ID NO: 1551838 - RNA, 20 nt, Pseudomonas aeruginosa PA01
agcuuguccagggcgcccuu

SEQ ID NO: 1551839 - RNA, 19 nt, Pseudomonas aeruginosa PA01
agcuuguccgccggaaugu

SEQ ID NO: 1551840 - RNA, 13 nt, Pseudomonas aeruginosa PA01
agcuuguccacgc

SEQ ID NO: 1551841 - RNA, 16 nt, Pseudomonas aeruginosa PA01
agcuugggauggccag

SEQ ID NO: 1551842 - RNA, 17 nt, Pseudomonas aeruginosa PA01
agcuugggauggccagc

SEQ ID NO: 1551843 - RNA, 15 nt, Pseudomonas aeruginosa PA01
aggacguccuggccg

SEQ ID NO: 1551844 - RNA, 19 nt, Pseudomonas aeruginosa PA01
aggaccuugucgcgcacca

SEQ ID NO: 1551845 - RNA, 23 nt, Pseudomonas aeruginosa PA01
aggaccuuccgccagcaggcgcg

SEQ ID NO: 1551846 - RNA, 19 nt, Pseudomonas aeruginosa PA01
aggaccucgaagcuggcca

SEQ ID NO: 1551847 - RNA, 12 nt, Pseudomonas aeruginosa PA01
aggaccuggccg

SEQ ID NO: 1551848 - RNA, 14 nt, Pseudomonas aeruginosa PA01
aggaccagcccguu

SEQ ID NO: 1551849 - RNA, 22 nt, Pseudomonas aeruginosa PA01
aggaccgacuccaugaaacggu

SEQ ID NO: 1551850 - RNA, 19 nt, Pseudomonas aeruginosa PA01
aggacaggucgcggaagug

SEQ ID NO: 1551851 - RNA, 16 nt, Pseudomonas aeruginosa PA01
aggacagggccaggcc

SEQ ID NO: 1551852 - RNA, 22 nt, Pseudomonas aeruginosa PA01
aggacagggccaggccgagcaa

SEQ ID NO: 1551853 - RNA, 18 nt, Pseudomonas aeruginosa PA01
aggagcaucggcgcggcc

SEQ ID NO: 1551854 - RNA, 18 nt, Pseudomonas aeruginosa PA01
aggagacucagcgcgaca

SEQ ID NO: 1551855 - RNA, 21 nt, Pseudomonas aeruginosa PA01
aggagagggucagcaggcugc

SEQ ID NO: 1551856 - RNA, 16 nt, Pseudomonas aeruginosa PA01
aggagaaccuggccaa

SEQ ID NO: 1551857 - RNA, 23 nt, Pseudomonas aeruginosa PA01
aggacugcccgcgucccaucggg

SEQ ID NO: 1551858 - RNA, 12 nt, Pseudomonas aeruginosa PA01
aggauagccggc

SEQ ID NO: 1551859 - RNA, 15 nt, Pseudomonas aeruginosa PA01
aggaucgacagcagc

SEQ ID NO: 1551860 - RNA, 20 nt, Pseudomonas aeruginosa PA01
aggaucgacagcagcgccag

SEQ ID NO: 1551861 - RNA, 14 nt, Pseudomonas aeruginosa PA01
aggaucgagcccug

SEQ ID NO: 1551862 - RNA, 13 nt, Pseudomonas aeruginosa PA01
aggaucgccagca

SEQ ID NO: 1551863 - RNA, 15 nt, Pseudomonas aeruginosa PA01
aggaucgccagcaau

SEQ ID NO: 1551864 - RNA, 16 nt, Pseudomonas aeruginosa PA01
aggaucgccagcaauu

SEQ ID NO: 1551865 - RNA, 22 nt, Pseudomonas aeruginosa PA01
aggaucgccgcgaccugcucgu

SEQ ID NO: 1551866 - RNA, 14 nt, Pseudomonas aeruginosa PA01
aggaucgccgggcu

SEQ ID NO: 1551867 - RNA, 15 nt, Pseudomonas aeruginosa PA01
aggaucgccuccacc

SEQ ID NO: 1551868 - RNA, 12 nt, Pseudomonas aeruginosa PA01
aggaucacgcag

SEQ ID NO: 1551869 - RNA, 15 nt, Pseudomonas aeruginosa PA01
aggaucacgcagcag

SEQ ID NO: 1551870 - RNA, 14 nt, Pseudomonas aeruginosa PA01
aggaucagucccuu

SEQ ID NO: 1551871 - RNA, 23 nt, Pseudomonas aeruginosa PA01
aggaucagguugaagagcagcac

SEQ ID NO: 1551872 - RNA, 17 nt, Pseudomonas aeruginosa PA01
aggauaucgcccagggc

SEQ ID NO: 1551873 - RNA, 20 nt, Pseudomonas aeruginosa PA01
aggagggaacgucuggccag

SEQ ID NO: 1551874 - RNA, 15 nt, Pseudomonas aeruginosa PA01
aggagggaaugacua

SEQ ID NO: 1551875 - RNA, 15 nt, Pseudomonas aeruginosa PA01
aggaggauacggcgc

SEQ ID NO: 1551876 - RNA, 19 nt, Pseudomonas aeruginosa PA01
aggaggaaauacagcaccc

SEQ ID NO: 1551877 - RNA, 17 nt, Pseudomonas aeruginosa PA01
aggagccguagggcgca

SEQ ID NO: 1551878 - RNA, 22 nt, Pseudomonas aeruginosa PA01
aggagccugcgugagcugggca

SEQ ID NO: 1551879 - RNA, 23 nt, Pseudomonas aeruginosa PA01
aggagcgccgcgcagcgcggcgc

SEQ ID NO: 1551880 - RNA, 15 nt, Pseudomonas aeruginosa PA01
aggagccggccaggc

SEQ ID NO: 1551881 - RNA, 19 nt, Pseudomonas aeruginosa PA01
aggagccaucgcuccagcg

SEQ ID NO: 1551882 - RNA, 21 nt, Pseudomonas aeruginosa PA01
aggagccaucgcuccagcgaa

SEQ ID NO: 1551883 - RNA, 15 nt, Pseudomonas aeruginosa PA01
aggagcggacucaua

SEQ ID NO: 1551884 - RNA, 20 nt, Pseudomonas aeruginosa PA01
aggagugugggacaggaaga

SEQ ID NO: 1551885 - RNA, 16 nt, Pseudomonas aeruginosa PA01
aggagguuggucugcu

SEQ ID NO: 1551886 - RNA, 17 nt, Pseudomonas aeruginosa PA01
aggagguuggucugcuc

SEQ ID NO: 1551887 - RNA, 22 nt, Pseudomonas aeruginosa PA01
aggagggcugcuguccagcgcu

SEQ ID NO: 1551888 - RNA, 21 nt, Pseudomonas aeruginosa PA01
aggaacauccgcggccccggc

SEQ ID NO: 1551889 - RNA, 13 nt, Pseudomonas aeruginosa PA01
aggaacacccaga

SEQ ID NO: 1551890 - RNA, 14 nt, Pseudomonas aeruginosa PA01
aggaacagcgagag

SEQ ID NO: 1551891 - RNA, 17 nt, Pseudomonas aeruginosa PA01
aggaaccgacgcgcagg

SEQ ID NO: 1551892 - RNA, 18 nt, Pseudomonas aeruginosa PA01
aggaaccgacgcgcagga

SEQ ID NO: 1551893 - RNA, 22 nt, Pseudomonas aeruginosa PA01
aggaacgcccgcggcagcagcc

SEQ ID NO: 1551894 - RNA, 15 nt, Pseudomonas aeruginosa PA01
aggaacgugcggccu

SEQ ID NO: 1551895 - RNA, 16 nt, Pseudomonas aeruginosa PA01
aggaacuggaagccug

SEQ ID NO: 1551896 - RNA, 16 nt, Pseudomonas aeruginosa PA01
aggaaaacgcucaggc

SEQ ID NO: 1551897 - RNA, 22 nt, Pseudomonas aeruginosa PA01
aggaaaaagacaaaauucuccc

SEQ ID NO: 1551898 - RNA, 15 nt, Pseudomonas aeruginosa PA01
aggaauuccuggccg

SEQ ID NO: 1551899 - RNA, 19 nt, Pseudomonas aeruginosa PA01
aggaaucgacccagccgca

SEQ ID NO: 1551900 - RNA, 12 nt, Pseudomonas aeruginosa PA01
aggaagccgacc

SEQ ID NO: 1551901 - RNA, 17 nt, Pseudomonas aeruginosa PA01
aggaagccgaccggcgc

SEQ ID NO: 1551902 - RNA, 17 nt, Pseudomonas aeruginosa PA01
aggaagcucggcagcac

SEQ ID NO: 1551903 - RNA, 19 nt, Pseudomonas aeruginosa PA01
aggaagcugacgaacaucg

SEQ ID NO: 1551904 - RNA, 13 nt, Pseudomonas aeruginosa PA01
aggaagagcaggc

SEQ ID NO: 1551905 - RNA, 17 nt, Pseudomonas aeruginosa PA01
aggaagagcccgccacg

SEQ ID NO: 1551906 - RNA, 15 nt, Pseudomonas aeruginosa PA01
aggaaggccagcagg

SEQ ID NO: 1551907 - RNA, 21 nt, Pseudomonas aeruginosa PA01
aggaaggccaggucgcccacc

SEQ ID NO: 1551908 - RNA, 22 nt, Pseudomonas aeruginosa PA01
aggaaggccuggaacaccaggc

SEQ ID NO: 1551909 - RNA, 19 nt, Pseudomonas aeruginosa PA01
aggaaggcgccggcauugc

SEQ ID NO: 1551910 - RNA, 19 nt, Pseudomonas aeruginosa PA01
aggaaggcgcgcaccagcg

SEQ ID NO: 1551911 - RNA, 20 nt, Pseudomonas aeruginosa PA01
aggaaguugcgcagcaacug

SEQ ID NO: 1551912 - RNA, 18 nt, Pseudomonas aeruginosa PA01
aggaaguucacguaggag

SEQ ID NO: 1551913 - RNA, 13 nt, Pseudomonas aeruginosa PA01
aggccaggcccca

SEQ ID NO: 1551914 - RNA, 20 nt, Pseudomonas aeruginosa PA01
aggccaggcgauacgcggcc

SEQ ID NO: 1551915 - RNA, 12 nt, Pseudomonas aeruginosa PA01
aggccaggcgca

SEQ ID NO: 1551916 - RNA, 18 nt, Pseudomonas aeruginosa PA01
aggccagggcggcgccga

SEQ ID NO: 1551917 - RNA, 20 nt, Pseudomonas aeruginosa PA01
aggccaucgaaaucgcccac

SEQ ID NO: 1551918 - RNA, 13 nt, Pseudomonas aeruginosa PA01
aggccaugagguu

SEQ ID NO: 1551919 - RNA, 18 nt, Pseudomonas aeruginosa PA01
aggccaugagguuggcca

SEQ ID NO: 1551920 - RNA, 21 nt, Pseudomonas aeruginosa PA01
aggccaugaucaucgccugcu

SEQ ID NO: 1551921 - RNA, 22 nt, Pseudomonas aeruginosa PA01
aggccagcagguagccugcggc

SEQ ID NO: 1551922 - RNA, 17 nt, Pseudomonas aeruginosa PA01
aggccagcgccagguug

SEQ ID NO: 1551923 - RNA, 17 nt, Pseudomonas aeruginosa PA01
aggccaccugcgggugg

SEQ ID NO: 1551924 - RNA, 14 nt, Pseudomonas aeruginosa PA01
aggccacggccgcu

SEQ ID NO: 1551925 - RNA, 21 nt, Pseudomonas aeruginosa PA01
aggccaccggauugucgaugu

SEQ ID NO: 1551926 - RNA, 16 nt, Pseudomonas aeruginosa PA01
aggccgagcugcucga

SEQ ID NO: 1551927 - RNA, 15 nt, Pseudomonas aeruginosa PA01
aggccgacgaacagc

SEQ ID NO: 1551928 - RNA, 18 nt, Pseudomonas aeruginosa PA01
aggccgacgaacagccag

SEQ ID NO: 1551929 - RNA, 19 nt, Pseudomonas aeruginosa PA01
aggccgacgaacagccaga

SEQ ID NO: 1551930 - RNA, 20 nt, Pseudomonas aeruginosa PA01
aggccgacgaagaccuugaa

SEQ ID NO: 1551931 - RNA, 19 nt, Pseudomonas aeruginosa PA01
aggccgaccucggcgguca

SEQ ID NO: 1551932 - RNA, 14 nt, Pseudomonas aeruginosa PA01
aggccgaccagcag

SEQ ID NO: 1551933 - RNA, 22 nt, Pseudomonas aeruginosa PA01
aggccgaccagcagggccagca

SEQ ID NO: 1551934 - RNA, 19 nt, Pseudomonas aeruginosa PA01
aggccgaagaggcccucgg

SEQ ID NO: 1551935 - RNA, 16 nt, Pseudomonas aeruginosa PA01
aggccgaagccgccgg

SEQ ID NO: 1551936 - RNA, 16 nt, Pseudomonas aeruginosa PA01
aggccgaaggccagga

SEQ ID NO: 1551937 - RNA, 12 nt, Pseudomonas aeruginosa PA01
aggcccugcagc

SEQ ID NO: 1551938 - RNA, 19 nt, Pseudomonas aeruginosa PA01
aggcccgguugagauccug

SEQ ID NO: 1551939 - RNA, 16 nt, Pseudomonas aeruginosa PA01
aggcccuugaacaggc

SEQ ID NO: 1551940 - RNA, 20 nt, Pseudomonas aeruginosa PA01
aggcccuugaacaggcuggc

SEQ ID NO: 1551941 - RNA, 19 nt, Pseudomonas aeruginosa PA01
aggcccugcugcagggccu

SEQ ID NO: 1551942 - RNA, 18 nt, Pseudomonas aeruginosa PA01
aggcccggccgccugccu

SEQ ID NO: 1551943 - RNA, 18 nt, Pseudomonas aeruginosa PA01
aggcccauuucguagccc

SEQ ID NO: 1551944 - RNA, 22 nt, Pseudomonas aeruginosa PA01
aggcccaucauguagacgaugc

SEQ ID NO: 1551945 - RNA, 24 nt, Pseudomonas aeruginosa PA01
aggcagucccagaaggccagggca

SEQ ID NO: 1551946 - RNA, 22 nt, Pseudomonas aeruginosa PA01
aggcaguccuugagcgccagca

SEQ ID NO: 1551947 - RNA, 14 nt, Pseudomonas aeruginosa PA01
aggcauccagcacc

SEQ ID NO: 1551948 - RNA, 18 nt, Pseudomonas aeruginosa PA01
aggcagccggccaugcug

SEQ ID NO: 1551949 - RNA, 20 nt, Pseudomonas aeruginosa PA01
aggcagccggccaugcuggc

SEQ ID NO: 1551950 - RNA, 15 nt, Pseudomonas aeruginosa PA01
aggcaggccugggca

SEQ ID NO: 1551951 - RNA, 11 nt, Pseudomonas aeruginosa PA01
aggcaggcgcg

SEQ ID NO: 1551952 - RNA, 22 nt, Pseudomonas aeruginosa PA01
aggcaugguggaucgacugcau

SEQ ID NO: 1551953 - RNA, 14 nt, Pseudomonas aeruginosa PA01
aggcaugcggcccc

SEQ ID NO: 1551954 - RNA, 23 nt, Pseudomonas aeruginosa PA01
aggcaugcggccccggcgcucgc

SEQ ID NO: 1551955 - RNA, 12 nt, Pseudomonas aeruginosa PA01
aggcaugcccag

SEQ ID NO: 1551956 - RNA, 22 nt, Pseudomonas aeruginosa PA01
aggcauugcacaacgggugcug

SEQ ID NO: 1551957 - RNA, 17 nt, Pseudomonas aeruginosa PA01
aggauggucaggccggc

SEQ ID NO: 1551958 - RNA, 23 nt, Pseudomonas aeruginosa PA01
aggaugggcgaagccggcggcgc

SEQ ID NO: 1551959 - RNA, 17 nt, Pseudomonas aeruginosa PA01
aggauguccgggugaug

SEQ ID NO: 1551960 - RNA, 20 nt, Pseudomonas aeruginosa PA01
aggaugucggcgaacuggcc

SEQ ID NO: 1551961 - RNA, 21 nt, Pseudomonas aeruginosa PA01
aggaugucgggaguucgaauc

SEQ ID NO: 1551962 - RNA, 16 nt, Pseudomonas aeruginosa PA01
aggaugaucagggcac

SEQ ID NO: 1551963 - RNA, 18 nt, Pseudomonas aeruginosa PA01
aggaucgcucccaggcuc

SEQ ID NO: 1551964 - RNA, 20 nt, Pseudomonas aeruginosa PA01
aggaucuccaacuggcggcu

SEQ ID NO: 1551965 - RNA, 22 nt, Pseudomonas aeruginosa PA01
aggaucuucuccgauuccugcg

SEQ ID NO: 1551966 - RNA, 18 nt, Pseudomonas aeruginosa PA01
aggaucuugcgcccggcg

SEQ ID NO: 1551967 - RNA, 16 nt, Pseudomonas aeruginosa PA01
aggaugcaaccgcccu

SEQ ID NO: 1551968 - RNA, 19 nt, Pseudomonas aeruginosa PA01
aggauuuccgcgcccggcu

SEQ ID NO: 1551969 - RNA, 20 nt, Pseudomonas aeruginosa PA01
aggauucagcaggaauucgg

SEQ ID NO: 1551970 - RNA, 16 nt, Pseudomonas aeruginosa PA01
aggauguucgccgagg

SEQ ID NO: 1551971 - RNA, 14 nt, Pseudomonas aeruginosa PA01
aggcacgcugccag

SEQ ID NO: 1551972 - RNA, 21 nt, Pseudomonas aeruginosa PA01
aggcacgcugccagcaggccg

SEQ ID NO: 1551973 - RNA, 21 nt, Pseudomonas aeruginosa PA01
aggcagaccugcagcaggauc

SEQ ID NO: 1551974 - RNA, 22 nt, Pseudomonas aeruginosa PA01
aggcagaccugcagcaggauca

SEQ ID NO: 1551975 - RNA, 13 nt, Pseudomonas aeruginosa PA01
aggcacaggaccc

SEQ ID NO: 1551976 - RNA, 14 nt, Pseudomonas aeruginosa PA01
aggcacaggacccu

SEQ ID NO: 1551977 - RNA, 19 nt, Pseudomonas aeruginosa PA01
aggcaccguaggccaggca

SEQ ID NO: 1551978 - RNA, 22 nt, Pseudomonas aeruginosa PA01
aggcaccaccgccgccagcaac

SEQ ID NO: 1551979 - RNA, 23 nt, Pseudomonas aeruginosa PA01
aggcaccaccgccgccagcaacg

SEQ ID NO: 1551980 - RNA, 23 nt, Pseudomonas aeruginosa PA01
aggcaagcgcaugaggcuggcca

SEQ ID NO: 1551981 - RNA, 19 nt, Pseudomonas aeruginosa PA01
aggcaaggucgucucagac

SEQ ID NO: 1551982 - RNA, 16 nt, Pseudomonas aeruginosa PA01
aggcaaucugcccggc

SEQ ID NO: 1551983 - RNA, 17 nt, Pseudomonas aeruginosa PA01
aggcaaucugcccggca

SEQ ID NO: 1551984 - RNA, 18 nt, Pseudomonas aeruginosa PA01
aggcaacaccaucggccc

SEQ ID NO: 1551985 - RNA, 17 nt, Pseudomonas aeruginosa PA01
aggcaaagcgcgggcug

SEQ ID NO: 1551986 - RNA, 23 nt, Pseudomonas aeruginosa PA01
aggcaaagcgcgggcugccccuc

SEQ ID NO: 1551987 - RNA, 16 nt, Pseudomonas aeruginosa PA01
aggcaaccggguaccu

SEQ ID NO: 1551988 - RNA, 13 nt, Pseudomonas aeruginosa PA01
auaaagcuggacc

SEQ ID NO: 1551989 - RNA, 13 nt, Pseudomonas aeruginosa PA01
auaaaaagccccg

SEQ ID NO: 1551990 - RNA, 20 nt, Pseudomonas aeruginosa PA01
auaacucagcaucagugcuc

SEQ ID NO: 1551991 - RNA, 14 nt, Pseudomonas aeruginosa PA01
auaaccuccuaaau

SEQ ID NO: 1551992 - RNA, 19 nt, Pseudomonas aeruginosa PA01
agugaccgcgcgccauggc

SEQ ID NO: 1551993 - RNA, 15 nt, Pseudomonas aeruginosa PA01
agucuuucagcuuca

SEQ ID NO: 1551994 - RNA, 19 nt, Pseudomonas aeruginosa PA01
aguccggguugacccagag

SEQ ID NO: 1551995 - RNA, 18 nt, Pseudomonas aeruginosa PA01
aguccggguugagcaccc

SEQ ID NO: 1551996 - RNA, 20 nt, Pseudomonas aeruginosa PA01
aguccgcgcgcgcgcuccuc

SEQ ID NO: 1551997 - RNA, 15 nt, Pseudomonas aeruginosa PA01
aguacccgcugguaa

SEQ ID NO: 1551998 - RNA, 16 nt, Pseudomonas aeruginosa PA01
aguccuuguccagggc

SEQ ID NO: 1551999 - RNA, 22 nt, Pseudomonas aeruginosa PA01
agucgccgguucaguucagccg

SEQ ID NO: 1552000 - RNA, 16 nt, Pseudomonas aeruginosa PA01
agucgcgcagcgccuc

SEQ ID NO: 1552001 - RNA, 21 nt, Pseudomonas aeruginosa PA01
agucgcgcccagugcccggca

SEQ ID NO: 1552002 - RNA, 18 nt, Pseudomonas aeruginosa PA01
agucguucccggccuggc

SEQ ID NO: 1552003 - RNA, 16 nt, Pseudomonas aeruginosa PA01
aguggaucggcccuuc

SEQ ID NO: 1552004 - RNA, 19 nt, Pseudomonas aeruginosa PA01
aguggaucggcccuucgac

SEQ ID NO: 1552005 - RNA, 14 nt, Pseudomonas aeruginosa PA01
aguggaugugcugg

SEQ ID NO: 1552006 - RNA, 17 nt, Pseudomonas aeruginosa PA01
aguggaagccguggcgg

SEQ ID NO: 1552007 - RNA, 18 nt, Pseudomonas aeruginosa PA01
agugcucgaucaggcugu

SEQ ID NO: 1552008 - RNA, 14 nt, Pseudomonas aeruginosa PA01
agugcuccggggcg

SEQ ID NO: 1552009 - RNA, 13 nt, Pseudomonas aeruginosa PA01
agugcuccucguc

SEQ ID NO: 1552010 - RNA, 16 nt, Pseudomonas aeruginosa PA01
agugcgccgcagcgca

SEQ ID NO: 1552011 - RNA, 14 nt, Pseudomonas aeruginosa PA01
agugcgcagcagcg

SEQ ID NO: 1552012 - RNA, 12 nt, Pseudomonas aeruginosa PA01
agugcgccggca

SEQ ID NO: 1552013 - RNA, 21 nt, Pseudomonas aeruginosa PA01
agugcgccggcaucgccaugg

SEQ ID NO: 1552014 - RNA, 15 nt, Pseudomonas aeruginosa PA01
agugcagcuccaccg

SEQ ID NO: 1552015 - RNA, 18 nt, Pseudomonas aeruginosa PA01
agugccugcaccacgcag

SEQ ID NO: 1552016 - RNA, 17 nt, Pseudomonas aeruginosa PA01
agugcagcgagucgccg

SEQ ID NO: 1552017 - RNA, 17 nt, Pseudomonas aeruginosa PA01
aguggguaggccaggca

SEQ ID NO: 1552018 - RNA, 19 nt, Pseudomonas aeruginosa PA01
agugggucgaugcccucgc

SEQ ID NO: 1552019 - RNA, 18 nt, Pseudomonas aeruginosa PA01
agugggucgccguggugg

SEQ ID NO: 1552020 - RNA, 14 nt, Pseudomonas aeruginosa PA01
aguuccacgaagaa

SEQ ID NO: 1552021 - RNA, 17 nt, Pseudomonas aeruginosa PA01
aguuccacgaagaacgc

SEQ ID NO: 1552022 - RNA, 18 nt, Pseudomonas aeruginosa PA01
aguucguccaucgccagg

SEQ ID NO: 1552023 - RNA, 14 nt, Pseudomonas aeruginosa PA01
aguucuucagcagc

SEQ ID NO: 1552024 - RNA, 18 nt, Pseudomonas aeruginosa PA01
aguucugggcggccaggu

SEQ ID NO: 1552025 - RNA, 16 nt, Pseudomonas aeruginosa PA01
aguucggcgagcaggu

SEQ ID NO: 1552026 - RNA, 19 nt, Pseudomonas aeruginosa PA01
aguucggcguuguccaggc

SEQ ID NO: 1552027 - RNA, 14 nt, Pseudomonas aeruginosa PA01
aguucgacccaugc

SEQ ID NO: 1552028 - RNA, 15 nt, Pseudomonas aeruginosa PA01
aguuccuucuugacc

SEQ ID NO: 1552029 - RNA, 23 nt, Pseudomonas aeruginosa PA01
aguuccuucuugacccgcugcac

SEQ ID NO: 1552030 - RNA, 23 nt, Pseudomonas aeruginosa PA01
aguuacgcgcagcgguaguucag

SEQ ID NO: 1552031 - RNA, 13 nt, Pseudomonas aeruginosa PA01
aguguggcggcgu

SEQ ID NO: 1552032 - RNA, 20 nt, Pseudomonas aeruginosa PA01
agugugccgcccugcucuug

SEQ ID NO: 1552033 - RNA, 17 nt, Pseudomonas aeruginosa PA01
agugugccggccaugca

SEQ ID NO: 1552034 - RNA, 21 nt, Pseudomonas aeruginosa PA01
aguugcugaucaggccgagga

SEQ ID NO: 1552035 - RNA, 13 nt, Pseudomonas aeruginosa PA01
aguuggccgggca

SEQ ID NO: 1552036 - RNA, 18 nt, Pseudomonas aeruginosa PA01
aguugacccgccccugcu

SEQ ID NO: 1552037 - RNA, 11 nt, Pseudomonas aeruginosa PA01
aguugcaacag

SEQ ID NO: 1552038 - RNA, 21 nt, Pseudomonas aeruginosa PA01
aguugcucgcuccgagcaggc

SEQ ID NO: 1552039 - RNA, 19 nt, Pseudomonas aeruginosa PA01
aguuucucggucgccgcca

SEQ ID NO: 1552040 - RNA, 22 nt, Pseudomonas aeruginosa PA01
aguuucuucgcgugggccaggg

SEQ ID NO: 1552041 - RNA, 14 nt, Pseudomonas aeruginosa PA01
aucacggcgccccg

SEQ ID NO: 1552042 - RNA, 14 nt, Pseudomonas aeruginosa PA01
aucacguacggcgc

SEQ ID NO: 1552043 - RNA, 15 nt, Pseudomonas aeruginosa PA01
aucacgauggccggc

SEQ ID NO: 1552044 - RNA, 22 nt, Pseudomonas aeruginosa PA01
aucacgauggccggcagcagcg

SEQ ID NO: 1552045 - RNA, 19 nt, Pseudomonas aeruginosa PA01
aucaccuugucgcaccagc

SEQ ID NO: 1552046 - RNA, 19 nt, Pseudomonas aeruginosa PA01
aucaccuugcccucgcgga

SEQ ID NO: 1552047 - RNA, 13 nt, Pseudomonas aeruginosa PA01
aucaccuuccucg

SEQ ID NO: 1552048 - RNA, 20 nt, Pseudomonas aeruginosa PA01
aucaccuuaguuaucacaac

SEQ ID NO: 1552049 - RNA, 12 nt, Pseudomonas aeruginosa PA01
aucacucccugc

SEQ ID NO: 1552050 - RNA, 15 nt, Pseudomonas aeruginosa PA01
aucacucgccgccgu

SEQ ID NO: 1552051 - RNA, 20 nt, Pseudomonas aeruginosa PA01
aucacguugaacacaucgac

SEQ ID NO: 1552052 - RNA, 18 nt, Pseudomonas aeruginosa PA01
aucacgucgcgcaccugg

SEQ ID NO: 1552053 - RNA, 20 nt, Pseudomonas aeruginosa PA01
aucaccccgcaaccgcagac

SEQ ID NO: 1552054 - RNA, 20 nt, Pseudomonas aeruginosa PA01
aucaccaggacccagaugau

SEQ ID NO: 1552055 - RNA, 16 nt, Pseudomonas aeruginosa PA01
aucaccagcgccaggc

SEQ ID NO: 1552056 - RNA, 13 nt, Pseudomonas aeruginosa PA01
aucaccgcggcgc

SEQ ID NO: 1552057 - RNA, 15 nt, Pseudomonas aeruginosa PA01
aucaccgccaccuug

SEQ ID NO: 1552058 - RNA, 14 nt, Pseudomonas aeruginosa PA01
aucaccuccuguuc

SEQ ID NO: 1552059 - RNA, 20 nt, Pseudomonas aeruginosa PA01
aucaccggcuggcccuccau

SEQ ID NO: 1552060 - RNA, 18 nt, Pseudomonas aeruginosa PA01
aucaccacucgccagcgc

SEQ ID NO: 1552061 - RNA, 14 nt, Pseudomonas aeruginosa PA01
aucaccagccacug

SEQ ID NO: 1552062 - RNA, 14 nt, Pseudomonas aeruginosa PA01
aucaccaccagcgc

SEQ ID NO: 1552063 - RNA, 16 nt, Pseudomonas aeruginosa PA01
aucaccaccuggaugg

SEQ ID NO: 1552064 - RNA, 17 nt, Pseudomonas aeruginosa PA01
aucaccaccuggauggu

SEQ ID NO: 1552065 - RNA, 16 nt, Pseudomonas aeruginosa PA01
aucagcagcagcgcca

SEQ ID NO: 1552066 - RNA, 22 nt, Pseudomonas aeruginosa PA01
aucagcagcagcgccaugcugu

SEQ ID NO: 1552067 - RNA, 20 nt, Pseudomonas aeruginosa PA01
aucagcacgucguccagcgc

SEQ ID NO: 1552068 - RNA, 18 nt, Pseudomonas aeruginosa PA01
aucagcaccgccaccagc

SEQ ID NO: 1552069 - RNA, 21 nt, Pseudomonas aeruginosa PA01
aucagcacgaaagccaugccc

SEQ ID NO: 1552070 - RNA, 19 nt, Pseudomonas aeruginosa PA01
aucagccccucggccagga

SEQ ID NO: 1552071 - RNA, 16 nt, Pseudomonas aeruginosa PA01
aucagccgcaggcaga

SEQ ID NO: 1552072 - RNA, 13 nt, Pseudomonas aeruginosa PA01
aucagcgaaaugg

SEQ ID NO: 1552073 - RNA, 14 nt, Pseudomonas aeruginosa PA01
aucagcgccagggc

SEQ ID NO: 1552074 - RNA, 16 nt, Pseudomonas aeruginosa PA01
aucagcgccagggcau

SEQ ID NO: 1552075 - RNA, 18 nt, Pseudomonas aeruginosa PA01
aucagcgcuccagaugcu

SEQ ID NO: 1552076 - RNA, 18 nt, Pseudomonas aeruginosa PA01
aucagcgggccuuuucuu

SEQ ID NO: 1552077 - RNA, 21 nt, Pseudomonas aeruginosa PA01
aucagcgggccuuuucuuugg

SEQ ID NO: 1552078 - RNA, 13 nt, Pseudomonas aeruginosa PA01
aucagaacgaugc

SEQ ID NO: 1552079 - RNA, 18 nt, Pseudomonas aeruginosa PA01
auauucaagacgaaaaag

SEQ ID NO: 1552080 - RNA, 14 nt, Pseudomonas aeruginosa PA01
aucaaaaccagccu

SEQ ID NO: 1552081 - RNA, 13 nt, Pseudomonas aeruginosa PA01
aucacaacggaag

SEQ ID NO: 1552082 - RNA, 21 nt, Pseudomonas aeruginosa PA01
aucacaacggaagauggcuaa

SEQ ID NO: 1552083 - RNA, 17 nt, Pseudomonas aeruginosa PA01
auacugcacgcccaggc

SEQ ID NO: 1552084 - RNA, 20 nt, Pseudomonas aeruginosa PA01
auacgucuucgauggcggcc

SEQ ID NO: 1552085 - RNA, 12 nt, Pseudomonas aeruginosa PA01
auacucaugcag

SEQ ID NO: 1552086 - RNA, 17 nt, Pseudomonas aeruginosa PA01
auacucaugcaggcguc

SEQ ID NO: 1552087 - RNA, 22 nt, Pseudomonas aeruginosa PA01
auacggcaggguagccacgccg

SEQ ID NO: 1552088 - RNA, 21 nt, Pseudomonas aeruginosa PA01
auaccggcguugaacugcccg

SEQ ID NO: 1552089 - RNA, 16 nt, Pseudomonas aeruginosa PA01
auaccgcuggccaggu

SEQ ID NO: 1552090 - RNA, 18 nt, Pseudomonas aeruginosa PA01
auagcgggucaugagguu

SEQ ID NO: 1552091 - RNA, 17 nt, Pseudomonas aeruginosa PA01
auagcucauggccaggu

SEQ ID NO: 1552092 - RNA, 20 nt, Pseudomonas aeruginosa PA01
auagcucagucgguagagca

SEQ ID NO: 1552093 - RNA, 18 nt, Pseudomonas aeruginosa PA01
auaucgcaggccaggccc

SEQ ID NO: 1552094 - RNA, 15 nt, Pseudomonas aeruginosa PA01
auaggucaugcccag

SEQ ID NO: 1552095 - RNA, 12 nt, Pseudomonas aeruginosa PA01
auagggcggcgc

SEQ ID NO: 1552096 - RNA, 14 nt, Pseudomonas aeruginosa PA01
auaggcgccagccu

SEQ ID NO: 1552097 - RNA, 20 nt, Pseudomonas aeruginosa PA01
auaggagccugcgugagcug

SEQ ID NO: 1552098 - RNA, 16 nt, Pseudomonas aeruginosa PA01
auagugcggccaggcg

SEQ ID NO: 1552099 - RNA, 13 nt, Pseudomonas aeruginosa PA01
auagugcugggcg

SEQ ID NO: 1552100 - RNA, 19 nt, Pseudomonas aeruginosa PA01
auucaccgagcguuuuugg

SEQ ID NO: 1552101 - RNA, 18 nt, Pseudomonas aeruginosa PA01
auuaccccgcccacucuu

SEQ ID NO: 1552102 - RNA, 22 nt, Pseudomonas aeruginosa PA01
auuagaggaacccaaucacaac

SEQ ID NO: 1552103 - RNA, 15 nt, Pseudomonas aeruginosa PA01
auuacuugcccacgc

SEQ ID NO: 1552104 - RNA, 21 nt, Pseudomonas aeruginosa PA01
auuauauaggguuucucgcuc

SEQ ID NO: 1552105 - RNA, 19 nt, Pseudomonas aeruginosa PA01
auguugcggcccagcggca

SEQ ID NO: 1552106 - RNA, 14 nt, Pseudomonas aeruginosa PA01
auguugcgcagggu

SEQ ID NO: 1552107 - RNA, 18 nt, Pseudomonas aeruginosa PA01
auguugcgcagggugccc

SEQ ID NO: 1552108 - RNA, 19 nt, Pseudomonas aeruginosa PA01
auguuguucgcgcaccuug

SEQ ID NO: 1552109 - RNA, 15 nt, Pseudomonas aeruginosa PA01
auguuguugcccacc

SEQ ID NO: 1552110 - RNA, 17 nt, Pseudomonas aeruginosa PA01
auguuggccuugagcag

SEQ ID NO: 1552111 - RNA, 12 nt, Pseudomonas aeruginosa PA01
auuaagugccuc

SEQ ID NO: 1552112 - RNA, 14 nt, Pseudomonas aeruginosa PA01
auggugugcagcag

SEQ ID NO: 1552113 - RNA, 14 nt, Pseudomonas aeruginosa PA01
auggucggccaggu

SEQ ID NO: 1552114 - RNA, 16 nt, Pseudomonas aeruginosa PA01
auggucgggcaggugg

SEQ ID NO: 1552115 - RNA, 13 nt, Pseudomonas aeruginosa PA01
auggguucccagc

SEQ ID NO: 1552116 - RNA, 22 nt, Pseudomonas aeruginosa PA01
auggguucccagcagcaacagc

SEQ ID NO: 1552117 - RNA, 18 nt, Pseudomonas aeruginosa PA01
augggcgcguucucccug

SEQ ID NO: 1552118 - RNA, 23 nt, Pseudomonas aeruginosa PA01
auggcugacccgcugcuggaugg

SEQ ID NO: 1552119 - RNA, 20 nt, Pseudomonas aeruginosa PA01
augggaaccucggcaggcug

SEQ ID NO: 1552120 - RNA, 19 nt, Pseudomonas aeruginosa PA01
augggaacgaguugggcga

SEQ ID NO: 1552121 - RNA, 22 nt, Pseudomonas aeruginosa PA01
augggcacgccgguggccaggc

SEQ ID NO: 1552122 - RNA, 22 nt, Pseudomonas aeruginosa PA01
auggcggcauugagcgccagca

SEQ ID NO: 1552123 - RNA, 21 nt, Pseudomonas aeruginosa PA01
auggccacgcucucgaacagc

SEQ ID NO: 1552124 - RNA, 23 nt, Pseudomonas aeruginosa PA01
auggccacgcucucgaacagcag

SEQ ID NO: 1552125 - RNA, 14 nt, Pseudomonas aeruginosa PA01
auggccagccagga

SEQ ID NO: 1552126 - RNA, 17 nt, Pseudomonas aeruginosa PA01
auggcggacgaucacuc

SEQ ID NO: 1552127 - RNA, 22 nt, Pseudomonas aeruginosa PA01
auggcggacgaucacucccugc

SEQ ID NO: 1552128 - RNA, 13 nt, Pseudomonas aeruginosa PA01
auggcgcugccaa

SEQ ID NO: 1552129 - RNA, 17 nt, Pseudomonas aeruginosa PA01
auggcgcggugggccuu

SEQ ID NO: 1552130 - RNA, 22 nt, Pseudomonas aeruginosa PA01
augcgcaacgggacgccaggcg

SEQ ID NO: 1552131 - RNA, 20 nt, Pseudomonas aeruginosa PA01
augcgcaacgggcggcggga

SEQ ID NO: 1552132 - RNA, 15 nt, Pseudomonas aeruginosa PA01
auggcacgcagggcu

SEQ ID NO: 1552133 - RNA, 16 nt, Pseudomonas aeruginosa PA01
auggcagcaggcacag

SEQ ID NO: 1552134 - RNA, 20 nt, Pseudomonas aeruginosa PA01
auguccaccgccgccagcaa

SEQ ID NO: 1552135 - RNA, 23 nt, Pseudomonas aeruginosa PA01
auguaggacaggccgacguccau

SEQ ID NO: 1552136 - RNA, 13 nt, Pseudomonas aeruginosa PA01
augguuucuuccc

SEQ ID NO: 1552137 - RNA, 17 nt, Pseudomonas aeruginosa PA01
augguuucgugccauuc

SEQ ID NO: 1552138 - RNA, 13 nt, Pseudomonas aeruginosa PA01
augucgaccuggg

SEQ ID NO: 1552139 - RNA, 17 nt, Pseudomonas aeruginosa PA01
auguccugccgcaggcg

SEQ ID NO: 1552140 - RNA, 22 nt, Pseudomonas aeruginosa PA01
auguccuggaucggcagcucgc

SEQ ID NO: 1552141 - RNA, 12 nt, Pseudomonas aeruginosa PA01
auguccugggcc

SEQ ID NO: 1552142 - RNA, 13 nt, Pseudomonas aeruginosa PA01
auguccugggcca

SEQ ID NO: 1552143 - RNA, 19 nt, Pseudomonas aeruginosa PA01
auguccugggccaccuggc

SEQ ID NO: 1552144 - RNA, 14 nt, Pseudomonas aeruginosa PA01
auguggcgcagcau

SEQ ID NO: 1552145 - RNA, 12 nt, Pseudomonas aeruginosa PA01
augugcaccagc

SEQ ID NO: 1552146 - RNA, 23 nt, Pseudomonas aeruginosa PA01
augugcaguucgaccuccaggcc

SEQ ID NO: 1552147 - RNA, 17 nt, Pseudomonas aeruginosa PA01
aucuccgcgccacgcgc

SEQ ID NO: 1552148 - RNA, 15 nt, Pseudomonas aeruginosa PA01
aucuccuguggauaa

SEQ ID NO: 1552149 - RNA, 20 nt, Pseudomonas aeruginosa PA01
aucuccugguagaacuccuu

SEQ ID NO: 1552150 - RNA, 15 nt, Pseudomonas aeruginosa PA01
aucucgaagaccagc

SEQ ID NO: 1552151 - RNA, 20 nt, Pseudomonas aeruginosa PA01
aucucgcccaguaccgccac

SEQ ID NO: 1552152 - RNA, 22 nt, Pseudomonas aeruginosa PA01
aucucgaugaccuugccgcgaa

SEQ ID NO: 1552153 - RNA, 20 nt, Pseudomonas aeruginosa PA01
aucucgauggugaacgccag

SEQ ID NO: 1552154 - RNA, 20 nt, Pseudomonas aeruginosa PA01
aucuacuuaggcucacacgc

SEQ ID NO: 1552155 - RNA, 15 nt, Pseudomonas aeruginosa PA01
aucucgugggccagc

SEQ ID NO: 1552156 - RNA, 17 nt, Pseudomonas aeruginosa PA01
aucucuacuaccgccag

SEQ ID NO: 1552157 - RNA, 20 nt, Pseudomonas aeruginosa PA01
aucucgguguccaccaccag

SEQ ID NO: 1552158 - RNA, 21 nt, Pseudomonas aeruginosa PA01
aucucgguguccaccaccagc

SEQ ID NO: 1552159 - RNA, 17 nt, Pseudomonas aeruginosa PA01
aucucgcguuccagcac

SEQ ID NO: 1552160 - RNA, 13 nt, Pseudomonas aeruginosa PA01
aucucggccaggc

SEQ ID NO: 1552161 - RNA, 21 nt, Pseudomonas aeruginosa PA01
aucucuuuuuaagagaaugcg

SEQ ID NO: 1552162 - RNA, 15 nt, Pseudomonas aeruginosa PA01
aucugcgagcgcaca

SEQ ID NO: 1552163 - RNA, 14 nt, Pseudomonas aeruginosa PA01
aucugcgccaggug

SEQ ID NO: 1552164 - RNA, 21 nt, Pseudomonas aeruginosa PA01
aucugcggguugccgcagagc

SEQ ID NO: 1552165 - RNA, 16 nt, Pseudomonas aeruginosa PA01
aucugcccggccaugc

SEQ ID NO: 1552166 - RNA, 17 nt, Pseudomonas aeruginosa PA01
aucugcaccgcccagcc

SEQ ID NO: 1552167 - RNA, 19 nt, Pseudomonas aeruginosa PA01
aucugcaccgcccagccga

SEQ ID NO: 1552168 - RNA, 20 nt, Pseudomonas aeruginosa PA01
aucggccgggauacagcagc

SEQ ID NO: 1552169 - RNA, 21 nt, Pseudomonas aeruginosa PA01
aucggccgggauacagcagcc

SEQ ID NO: 1552170 - RNA, 14 nt, Pseudomonas aeruginosa PA01
aucggccccaccug

SEQ ID NO: 1552171 - RNA, 12 nt, Pseudomonas aeruginosa PA01
aucggcccuucg

SEQ ID NO: 1552172 - RNA, 16 nt, Pseudomonas aeruginosa PA01
aucggccgacagagcg

SEQ ID NO: 1552173 - RNA, 17 nt, Pseudomonas aeruginosa PA01
aucggccgccagugcau

SEQ ID NO: 1552174 - RNA, 18 nt, Pseudomonas aeruginosa PA01
aucggguaguaguggaag

SEQ ID NO: 1552175 - RNA, 13 nt, Pseudomonas aeruginosa PA01
aucggugagguag

SEQ ID NO: 1552176 - RNA, 15 nt, Pseudomonas aeruginosa PA01
aucggucgcgccccc

SEQ ID NO: 1552177 - RNA, 16 nt, Pseudomonas aeruginosa PA01
aucgcgugggccacca

SEQ ID NO: 1552178 - RNA, 20 nt, Pseudomonas aeruginosa PA01
aucgcguccgguaugccgau

SEQ ID NO: 1552179 - RNA, 23 nt, Pseudomonas aeruginosa PA01
aucggccaccgaaucgaugcugu

SEQ ID NO: 1552180 - RNA, 21 nt, Pseudomonas aeruginosa PA01
aucggugcuuugcauggccug

SEQ ID NO: 1552181 - RNA, 19 nt, Pseudomonas aeruginosa PA01
aucgucgaagggccauugu

SEQ ID NO: 1552182 - RNA, 15 nt, Pseudomonas aeruginosa PA01
aucgucgccaagccc

SEQ ID NO: 1552183 - RNA, 21 nt, Pseudomonas aeruginosa PA01
aucguccugccggugcucggc

SEQ ID NO: 1552184 - RNA, 18 nt, Pseudomonas aeruginosa PA01
aucagcuucuucagcagc

SEQ ID NO: 1552185 - RNA, 23 nt, Pseudomonas aeruginosa PA01
aucagcuucuucagcagcgggcg

SEQ ID NO: 1552186 - RNA, 17 nt, Pseudomonas aeruginosa PA01
aucagcucgaucagccc

SEQ ID NO: 1552187 - RNA, 16 nt, Pseudomonas aeruginosa PA01
aucagcucguugcccg

SEQ ID NO: 1552188 - RNA, 19 nt, Pseudomonas aeruginosa PA01
aucgauaacaccaggagcg

SEQ ID NO: 1552189 - RNA, 12 nt, Pseudomonas aeruginosa PA01
aucgagcugcuc

SEQ ID NO: 1552190 - RNA, 19 nt, Pseudomonas aeruginosa PA01
aucgagcgcgcccaggucc

SEQ ID NO: 1552191 - RNA, 23 nt, Pseudomonas aeruginosa PA01
aucgaggaauuccggcagcgacu

SEQ ID NO: 1552192 - RNA, 13 nt, Pseudomonas aeruginosa PA01
aucgaggccaggc

SEQ ID NO: 1552193 - RNA, 11 nt, Pseudomonas aeruginosa PA01
aucgagcagcg

SEQ ID NO: 1552194 - RNA, 17 nt, Pseudomonas aeruginosa PA01
aucgagcagcggcgcca

SEQ ID NO: 1552195 - RNA, 19 nt, Pseudomonas aeruginosa PA01
aucgaggccgcccagcgca

SEQ ID NO: 1552196 - RNA, 16 nt, Pseudomonas aeruginosa PA01
aucgcgcaacggcagc

SEQ ID NO: 1552197 - RNA, 14 nt, Pseudomonas aeruginosa PA01
aucgccgucaccgc

SEQ ID NO: 1552198 - RNA, 16 nt, Pseudomonas aeruginosa PA01
aucgcgaucuaccugc

SEQ ID NO: 1552199 - RNA, 18 nt, Pseudomonas aeruginosa PA01
aucgccguccuggagaac

SEQ ID NO: 1552200 - RNA, 15 nt, Pseudomonas aeruginosa PA01
aucgcgccgagcugg

SEQ ID NO: 1552201 - RNA, 20 nt, Pseudomonas aeruginosa PA01
aucgcgccgagcuggcgcgc

SEQ ID NO: 1552202 - RNA, 20 nt, Pseudomonas aeruginosa PA01
aucgcgccgccgaagccgac

SEQ ID NO: 1552203 - RNA, 21 nt, Pseudomonas aeruginosa PA01
aucgcacggucguccugcgga

SEQ ID NO: 1552204 - RNA, 14 nt, Pseudomonas aeruginosa PA01
aucgcagcgcgguc

SEQ ID NO: 1552205 - RNA, 15 nt, Pseudomonas aeruginosa PA01
aucgcauuguugcgg

SEQ ID NO: 1552206 - RNA, 16 nt, Pseudomonas aeruginosa PA01
aucgcaucggcgaccu

SEQ ID NO: 1552207 - RNA, 23 nt, Pseudomonas aeruginosa PA01
aucgcauaggugggaacgaaacg

SEQ ID NO: 1552208 - RNA, 19 nt, Pseudomonas aeruginosa PA01
aucgccggguugccgcugg

SEQ ID NO: 1552209 - RNA, 20 nt, Pseudomonas aeruginosa PA01
aucgccggguugccgcuggc

SEQ ID NO: 1552210 - RNA, 23 nt, Pseudomonas aeruginosa PA01
aucgcccggcagcaggccgccgc

SEQ ID NO: 1552211 - RNA, 13 nt, Pseudomonas aeruginosa PA01
aucgcccgcagcc

SEQ ID NO: 1552212 - RNA, 20 nt, Pseudomonas aeruginosa PA01
aucgcccgcagccacaggcg

SEQ ID NO: 1552213 - RNA, 18 nt, Pseudomonas aeruginosa PA01
aucgcccgcaguuccucg

SEQ ID NO: 1552214 - RNA, 11 nt, Pseudomonas aeruginosa PA01
aucgcccauga

SEQ ID NO: 1552215 - RNA, 18 nt, Pseudomonas aeruginosa PA01
aucgcccaccaggucgcc

SEQ ID NO: 1552216 - RNA, 16 nt, Pseudomonas aeruginosa PA01
aucuugaucugcaugc

SEQ ID NO: 1552217 - RNA, 21 nt, Pseudomonas aeruginosa PA01
aucuggguccuggugaucauc

SEQ ID NO: 1552218 - RNA, 13 nt, Pseudomonas aeruginosa PA01
augaaagccagca

SEQ ID NO: 1552219 - RNA, 13 nt, Pseudomonas aeruginosa PA01
aucuuuuccugcu

SEQ ID NO: 1552220 - RNA, 18 nt, Pseudomonas aeruginosa PA01
augaagaucaucuggguc

SEQ ID NO: 1552221 - RNA, 19 nt, Pseudomonas aeruginosa PA01
augaaggaaaccggccagc

SEQ ID NO: 1552222 - RNA, 18 nt, Pseudomonas aeruginosa PA01
augaagcgcugcugggcg

SEQ ID NO: 1552223 - RNA, 12 nt, Pseudomonas aeruginosa PA01
augaagccgcga

SEQ ID NO: 1552224 - RNA, 16 nt, Pseudomonas aeruginosa PA01
augaaauagcucugcc

SEQ ID NO: 1552225 - RNA, 13 nt, Pseudomonas aeruginosa PA01
augaccaggcuga

SEQ ID NO: 1552226 - RNA, 13 nt, Pseudomonas aeruginosa PA01
augagauccgcca

SEQ ID NO: 1552227 - RNA, 15 nt, Pseudomonas aeruginosa PA01
augagaggugggccg

SEQ ID NO: 1552228 - RNA, 17 nt, Pseudomonas aeruginosa PA01
augaccagagccgccga

SEQ ID NO: 1552229 - RNA, 19 nt, Pseudomonas aeruginosa PA01
augaccagcgcaucggcgc

SEQ ID NO: 1552230 - RNA, 13 nt, Pseudomonas aeruginosa PA01
augaaugccuuga

SEQ ID NO: 1552231 - RNA, 18 nt, Pseudomonas aeruginosa PA01
augaaugccuugaggccu

SEQ ID NO: 1552232 - RNA, 14 nt, Pseudomonas aeruginosa PA01
augaguugcagggc

SEQ ID NO: 1552233 - RNA, 15 nt, Pseudomonas aeruginosa PA01
augaguugcagggcu

SEQ ID NO: 1552234 - RNA, 16 nt, Pseudomonas aeruginosa PA01
augaguugcagggcuu

SEQ ID NO: 1552235 - RNA, 18 nt, Pseudomonas aeruginosa PA01
augcaguucguugagcag

SEQ ID NO: 1552236 - RNA, 18 nt, Pseudomonas aeruginosa PA01
augcagucccgccaggcg

SEQ ID NO: 1552237 - RNA, 13 nt, Pseudomonas aeruginosa PA01
augcagucggcac

SEQ ID NO: 1552238 - RNA, 20 nt, Pseudomonas aeruginosa PA01
augccaaguugccuggcagg

SEQ ID NO: 1552239 - RNA, 12 nt, Pseudomonas aeruginosa PA01
augccaggagaa

SEQ ID NO: 1552240 - RNA, 13 nt, Pseudomonas aeruginosa PA01
augcaggccaggg

SEQ ID NO: 1552241 - RNA, 20 nt, Pseudomonas aeruginosa PA01
augcaggagaugcacgaugg

SEQ ID NO: 1552242 - RNA, 15 nt, Pseudomonas aeruginosa PA01
augcccgccagcagg

SEQ ID NO: 1552243 - RNA, 15 nt, Pseudomonas aeruginosa PA01
augcccgcgccuggg

SEQ ID NO: 1552244 - RNA, 17 nt, Pseudomonas aeruginosa PA01
augcccgcgccugggcc

SEQ ID NO: 1552245 - RNA, 14 nt, Pseudomonas aeruginosa PA01
augcccgccccgca

SEQ ID NO: 1552246 - RNA, 13 nt, Pseudomonas aeruginosa PA01
augcccagggcca

SEQ ID NO: 1552247 - RNA, 16 nt, Pseudomonas aeruginosa PA01
augcccagggccagca

SEQ ID NO: 1552248 - RNA, 20 nt, Pseudomonas aeruginosa PA01
augcccagggccagcagcgg

SEQ ID NO: 1552249 - RNA, 18 nt, Pseudomonas aeruginosa PA01
augcccaccugaacgcgc

SEQ ID NO: 1552250 - RNA, 15 nt, Pseudomonas aeruginosa PA01
augccaucuuccugu

SEQ ID NO: 1552251 - RNA, 15 nt, Pseudomonas aeruginosa PA01
augccgcacaggcug

SEQ ID NO: 1552252 - RNA, 15 nt, Pseudomonas aeruginosa PA01
augccgcaccccauc

SEQ ID NO: 1552253 - RNA, 11 nt, Pseudomonas aeruginosa PA01
augccgagcau

SEQ ID NO: 1552254 - RNA, 15 nt, Pseudomonas aeruginosa PA01
augccgagcaucagc

SEQ ID NO: 1552255 - RNA, 14 nt, Pseudomonas aeruginosa PA01
augccgcaggaacc

SEQ ID NO: 1552256 - RNA, 13 nt, Pseudomonas aeruginosa PA01
augccgcccagca

SEQ ID NO: 1552257 - RNA, 15 nt, Pseudomonas aeruginosa PA01
augccgcccagcacc

SEQ ID NO: 1552258 - RNA, 20 nt, Pseudomonas aeruginosa PA01
augccgccgaccucggccgc

SEQ ID NO: 1552259 - RNA, 14 nt, Pseudomonas aeruginosa PA01
augccgcccuccau

SEQ ID NO: 1552260 - RNA, 14 nt, Pseudomonas aeruginosa PA01
augcccugccggcg

SEQ ID NO: 1552261 - RNA, 23 nt, Pseudomonas aeruginosa PA01
augcccugcucuuccagcgggcg

SEQ ID NO: 1552262 - RNA, 19 nt, Pseudomonas aeruginosa PA01
augcccggucaccacccag

SEQ ID NO: 1552263 - RNA, 20 nt, Pseudomonas aeruginosa PA01
augcccggcugguugccagc

SEQ ID NO: 1552264 - RNA, 21 nt, Pseudomonas aeruginosa PA01
augcccggcugguugccagca

SEQ ID NO: 1552265 - RNA, 21 nt, Pseudomonas aeruginosa PA01
augcccgucgaccaucaccag

SEQ ID NO: 1552266 - RNA, 15 nt, Pseudomonas aeruginosa PA01
augcccuccugggcc

SEQ ID NO: 1552267 - RNA, 16 nt, Pseudomonas aeruginosa PA01
augcccuccugggccu

SEQ ID NO: 1552268 - RNA, 23 nt, Pseudomonas aeruginosa PA01
augcccucgcggcggcaggccag

SEQ ID NO: 1552269 - RNA, 20 nt, Pseudomonas aeruginosa PA01
augccuuucggggugcaggg

SEQ ID NO: 1552270 - RNA, 16 nt, Pseudomonas aeruginosa PA01
augccguucacuaucu

SEQ ID NO: 1552271 - RNA, 12 nt, Pseudomonas aeruginosa PA01
augccguucagc

SEQ ID NO: 1552272 - RNA, 17 nt, Pseudomonas aeruginosa PA01
augccguucaggccggc

SEQ ID NO: 1552273 - RNA, 15 nt, Pseudomonas aeruginosa PA01
augccucggcggcgg

SEQ ID NO: 1552274 - RNA, 19 nt, Pseudomonas aeruginosa PA01
augccgcgccggaaguggc

SEQ ID NO: 1552275 - RNA, 16 nt, Pseudomonas aeruginosa PA01
augccgcggacggcac

SEQ ID NO: 1552276 - RNA, 18 nt, Pseudomonas aeruginosa PA01
augccgcggcgauaggcg

SEQ ID NO: 1552277 - RNA, 15 nt, Pseudomonas aeruginosa PA01
augccgcgccaggcg

SEQ ID NO: 1552278 - RNA, 14 nt, Pseudomonas aeruginosa PA01
augccgcgagccag

SEQ ID NO: 1552279 - RNA, 16 nt, Pseudomonas aeruginosa PA01
augccgcgagccagcc

SEQ ID NO: 1552280 - RNA, 21 nt, Pseudomonas aeruginosa PA01
augccgcuagcccugcugcuc

SEQ ID NO: 1552281 - RNA, 13 nt, Pseudomonas aeruginosa PA01
augccggccggca

SEQ ID NO: 1552282 - RNA, 18 nt, Pseudomonas aeruginosa PA01
augccggccggggccggc

SEQ ID NO: 1552283 - RNA, 21 nt, Pseudomonas aeruginosa PA01
augccggaaagccuggccggc

SEQ ID NO: 1552284 - RNA, 23 nt, Pseudomonas aeruginosa PA01
augccguagacguagucggcagu

SEQ ID NO: 1552285 - RNA, 19 nt, Pseudomonas aeruginosa PA01
augccgucuucgaugaagg

SEQ ID NO: 1552286 - RNA, 22 nt, Pseudomonas aeruginosa PA01
augccgugccguggaccaacag

SEQ ID NO: 1552287 - RNA, 21 nt, Pseudomonas aeruginosa PA01
augccgguggcgcccagccag

SEQ ID NO: 1552288 - RNA, 20 nt, Pseudomonas aeruginosa PA01
augccggugggcuuucccug

SEQ ID NO: 1552289 - RNA, 14 nt, Pseudomonas aeruginosa PA01
augccgggguggag

SEQ ID NO: 1552290 - RNA, 23 nt, Pseudomonas aeruginosa PA01
augccgggguggaguaccaggcc

SEQ ID NO: 1552291 - RNA, 14 nt, Pseudomonas aeruginosa PA01
auucaggcuuccuc

SEQ ID NO: 1552292 - RNA, 16 nt, Pseudomonas aeruginosa PA01
auucagcaggaauucg

SEQ ID NO: 1552293 - RNA, 22 nt, Pseudomonas aeruginosa PA01
auucucgcgacccuggccgcgc

SEQ ID NO: 1552294 - RNA, 15 nt, Pseudomonas aeruginosa PA01
auugaaguggugaug

SEQ ID NO: 1552295 - RNA, 11 nt, Pseudomonas aeruginosa PA01
auugccgggcu

SEQ ID NO: 1552296 - RNA, 17 nt, Pseudomonas aeruginosa PA01
auugccgggcuuccugg

SEQ ID NO: 1552297 - RNA, 15 nt, Pseudomonas aeruginosa PA01
auugcccggccaggc

SEQ ID NO: 1552298 - RNA, 20 nt, Pseudomonas aeruginosa PA01
auugcccgguggccuccugc

SEQ ID NO: 1552299 - RNA, 20 nt, Pseudomonas aeruginosa PA01
auugagcgcgcccaggcagg

SEQ ID NO: 1552300 - RNA, 23 nt, Pseudomonas aeruginosa PA01
auuggagaugcucaggcgcugcu

SEQ ID NO: 1552301 - RNA, 18 nt, Pseudomonas aeruginosa PA01
auugcgagcgagcuugca

SEQ ID NO: 1552302 - RNA, 21 nt, Pseudomonas aeruginosa PA01
auugcgagcgagcuugcaauc

SEQ ID NO: 1552303 - RNA, 15 nt, Pseudomonas aeruginosa PA01
auuguuggcgcucgg

SEQ ID NO: 1552304 - RNA, 10 nt, Pseudomonas aeruginosa PA01
auuguugcgg

SEQ ID NO: 1552305 - RNA, 22 nt, Pseudomonas aeruginosa PA01
auuucuucggguagccaugcac

SEQ ID NO: 1552306 - RNA, 13 nt, Pseudomonas aeruginosa PA01
auuugcccggcga

SEQ ID NO: 1552307 - RNA, 11 nt, Pseudomonas aeruginosa PA01
auuugcgccuc

SEQ ID NO: 1552308 - RNA, 17 nt, Pseudomonas aeruginosa PA01
caaaaaugcccuuggcu

SEQ ID NO: 1552309 - RNA, 15 nt, Pseudomonas aeruginosa PA01
caaaaaaaccgcccc

SEQ ID NO: 1552310 - RNA, 12 nt, Pseudomonas aeruginosa PA01
caaaaaaagggg

SEQ ID NO: 1552311 - RNA, 22 nt, Pseudomonas aeruginosa PA01
caaucggugaacgagcccaggc

SEQ ID NO: 1552312 - RNA, 13 nt, Pseudomonas aeruginosa PA01
caauccgccgcuc

SEQ ID NO: 1552313 - RNA, 13 nt, Pseudomonas aeruginosa PA01
caaugccagcgcc

SEQ ID NO: 1552314 - RNA, 22 nt, Pseudomonas aeruginosa PA01
caaugccagcgccacgccgcug

SEQ ID NO: 1552315 - RNA, 15 nt, Pseudomonas aeruginosa PA01
caaugacggggauca

SEQ ID NO: 1552316 - RNA, 18 nt, Pseudomonas aeruginosa PA01
caaugccgcccuccauca

SEQ ID NO: 1552317 - RNA, 18 nt, Pseudomonas aeruginosa PA01
caaugccgcgucgaaguc

SEQ ID NO: 1552318 - RNA, 22 nt, Pseudomonas aeruginosa PA01
caaugccgucgaucuugcaauc

SEQ ID NO: 1552319 - RNA, 19 nt, Pseudomonas aeruginosa PA01
caauggccgggcuucuuca

SEQ ID NO: 1552320 - RNA, 21 nt, Pseudomonas aeruginosa PA01
caauggccgggcuucuucagg

SEQ ID NO: 1552321 - RNA, 13 nt, Pseudomonas aeruginosa PA01
caauggcgcagcc

SEQ ID NO: 1552322 - RNA, 16 nt, Pseudomonas aeruginosa PA01
caauggcgcagccgcu

SEQ ID NO: 1552323 - RNA, 18 nt, Pseudomonas aeruginosa PA01
caauggcggaauaacuca

SEQ ID NO: 1552324 - RNA, 12 nt, Pseudomonas aeruginosa PA01
caauggggcgcu

SEQ ID NO: 1552325 - RNA, 18 nt, Pseudomonas aeruginosa PA01
caauagccgggcuuuuuu

SEQ ID NO: 1552326 - RNA, 18 nt, Pseudomonas aeruginosa PA01
caagccguagaacgccag

SEQ ID NO: 1552327 - RNA, 19 nt, Pseudomonas aeruginosa PA01
caagccauuccaacuggcg

SEQ ID NO: 1552328 - RNA, 13 nt, Pseudomonas aeruginosa PA01
caagcccuggugg

SEQ ID NO: 1552329 - RNA, 16 nt, Pseudomonas aeruginosa PA01
caagcauucuggaugc

SEQ ID NO: 1552330 - RNA, 16 nt, Pseudomonas aeruginosa PA01
caaggaacuggaagcc

SEQ ID NO: 1552331 - RNA, 15 nt, Pseudomonas aeruginosa PA01
caaggaccugcugcc

SEQ ID NO: 1552332 - RNA, 19 nt, Pseudomonas aeruginosa PA01
caaggagcgcgagcggcag

SEQ ID NO: 1552333 - RNA, 16 nt, Pseudomonas aeruginosa PA01
caagcgucgccggccg

SEQ ID NO: 1552334 - RNA, 21 nt, Pseudomonas aeruginosa PA01
caagcgguuauucgccccagc

SEQ ID NO: 1552335 - RNA, 23 nt, Pseudomonas aeruginosa PA01
caagcgguuauucgcccuaccgc

SEQ ID NO: 1552336 - RNA, 12 nt, Pseudomonas aeruginosa PA01
caagccuccagc

SEQ ID NO: 1552337 - RNA, 14 nt, Pseudomonas aeruginosa PA01
caagccuccagcgc

SEQ ID NO: 1552338 - RNA, 23 nt, Pseudomonas aeruginosa PA01
caagguacggggcugcggccucg

SEQ ID NO: 1552339 - RNA, 20 nt, Pseudomonas aeruginosa PA01
caagguguggccgagccccg

SEQ ID NO: 1552340 - RNA, 20 nt, Pseudomonas aeruginosa PA01
caaggcgacgcucuucagcg

SEQ ID NO: 1552341 - RNA, 18 nt, Pseudomonas aeruginosa PA01
caaggccgccaggccucg

SEQ ID NO: 1552342 - RNA, 16 nt, Pseudomonas aeruginosa PA01
caagggccugcucagc

SEQ ID NO: 1552343 - RNA, 18 nt, Pseudomonas aeruginosa PA01
caaagccuggagcagggc

SEQ ID NO: 1552344 - RNA, 23 nt, Pseudomonas aeruginosa PA01
caaagaaaaggcccgcugauugc

SEQ ID NO: 1552345 - RNA, 16 nt, Pseudomonas aeruginosa PA01
caaagcccgcuccgca

SEQ ID NO: 1552346 - RNA, 23 nt, Pseudomonas aeruginosa PA01
caacaggcaaagaccgaccagua

SEQ ID NO: 1552347 - RNA, 15 nt, Pseudomonas aeruginosa PA01
caacaggacccagcc

SEQ ID NO: 1552348 - RNA, 19 nt, Pseudomonas aeruginosa PA01
caacaggacccagccauug

SEQ ID NO: 1552349 - RNA, 17 nt, Pseudomonas aeruginosa PA01
caacacggauagcaccg

SEQ ID NO: 1552350 - RNA, 14 nt, Pseudomonas aeruginosa PA01
caacaccagcgccg

SEQ ID NO: 1552351 - RNA, 16 nt, Pseudomonas aeruginosa PA01
caacacaugcaggcuc

SEQ ID NO: 1552352 - RNA, 11 nt, Pseudomonas aeruginosa PA01
caacugaccug

SEQ ID NO: 1552353 - RNA, 23 nt, Pseudomonas aeruginosa PA01
caacugauagucgacggaacagg

SEQ ID NO: 1552354 - RNA, 21 nt, Pseudomonas aeruginosa PA01
caacugcgccagccgacuggc

SEQ ID NO: 1552355 - RNA, 15 nt, Pseudomonas aeruginosa PA01
caacugcgcccccag

SEQ ID NO: 1552356 - RNA, 14 nt, Pseudomonas aeruginosa PA01
caacugccaaccgc

SEQ ID NO: 1552357 - RNA, 16 nt, Pseudomonas aeruginosa PA01
caacugccgcccgcuc

SEQ ID NO: 1552358 - RNA, 19 nt, Pseudomonas aeruginosa PA01
caacugccgcccgcucaag

SEQ ID NO: 1552359 - RNA, 23 nt, Pseudomonas aeruginosa PA01
caacugcucgggcgucuccugcc

SEQ ID NO: 1552360 - RNA, 23 nt, Pseudomonas aeruginosa PA01
caacugcucgaacugcuccuggg

SEQ ID NO: 1552361 - RNA, 17 nt, Pseudomonas aeruginosa PA01
caacuggcgcaacugca

SEQ ID NO: 1552362 - RNA, 16 nt, Pseudomonas aeruginosa PA01
caacugcuuaccuugc

SEQ ID NO: 1552363 - RNA, 23 nt, Pseudomonas aeruginosa PA01
caacugcuuaccuugccggugcg

SEQ ID NO: 1552364 - RNA, 23 nt, Pseudomonas aeruginosa PA01
caacugcuucaggcgcgcggcca

SEQ ID NO: 1552365 - RNA, 23 nt, Pseudomonas aeruginosa PA01
caacuggacgaaggccuccucgu

SEQ ID NO: 1552366 - RNA, 20 nt, Pseudomonas aeruginosa PA01
caacugcuugccgagcuggg

SEQ ID NO: 1552367 - RNA, 14 nt, Pseudomonas aeruginosa PA01
caacugguccugag

SEQ ID NO: 1552368 - RNA, 23 nt, Pseudomonas aeruginosa PA01
caacugguccugaggcucccagg

SEQ ID NO: 1552369 - RNA, 19 nt, Pseudomonas aeruginosa PA01
caacuggucgccgcagguc

SEQ ID NO: 1552370 - RNA, 18 nt, Pseudomonas aeruginosa PA01
caacugguuggccgccug

SEQ ID NO: 1552371 - RNA, 14 nt, Pseudomonas aeruginosa PA01
caacgccgccaacu

SEQ ID NO: 1552372 - RNA, 19 nt, Pseudomonas aeruginosa PA01
caacgcggcgucagggucg

SEQ ID NO: 1552373 - RNA, 14 nt, Pseudomonas aeruginosa PA01
caacgcccgcgagc

SEQ ID NO: 1552374 - RNA, 16 nt, Pseudomonas aeruginosa PA01
caacgccaccgcgcgc

SEQ ID NO: 1552375 - RNA, 13 nt, Pseudomonas aeruginosa PA01
caacgccagcagg

SEQ ID NO: 1552376 - RNA, 14 nt, Pseudomonas aeruginosa PA01
caaccucuccccag

SEQ ID NO: 1552377 - RNA, 16 nt, Pseudomonas aeruginosa PA01
caaccucuccccagac

SEQ ID NO: 1552378 - RNA, 21 nt, Pseudomonas aeruginosa PA01
caaccucuccccagacccucu

SEQ ID NO: 1552379 - RNA, 20 nt, Pseudomonas aeruginosa PA01
caacggcgaccgcuggacca

SEQ ID NO: 1552380 - RNA, 13 nt, Pseudomonas aeruginosa PA01
caacggcgggccg

SEQ ID NO: 1552381 - RNA, 17 nt, Pseudomonas aeruginosa PA01
caacggcguguccaggg

SEQ ID NO: 1552382 - RNA, 14 nt, Pseudomonas aeruginosa PA01
caacggcuccuuga

SEQ ID NO: 1552383 - RNA, 18 nt, Pseudomonas aeruginosa PA01
caacagggcauuggccau

SEQ ID NO: 1552384 - RNA, 14 nt, Pseudomonas aeruginosa PA01
caaccagcaccgca

SEQ ID NO: 1552385 - RNA, 22 nt, Pseudomonas aeruginosa PA01
caaccagcaccgcaagggugcu

SEQ ID NO: 1552386 - RNA, 23 nt, Pseudomonas aeruginosa PA01
caaccaguaggcguggucuuccu

SEQ ID NO: 1552387 - RNA, 17 nt, Pseudomonas aeruginosa PA01
caaccaccaugcggcua

SEQ ID NO: 1552388 - RNA, 19 nt, Pseudomonas aeruginosa PA01
caaccgcccgagcuuugcg

SEQ ID NO: 1552389 - RNA, 23 nt, Pseudomonas aeruginosa PA01
caacccuucauuucuacuucccu

SEQ ID NO: 1552390 - RNA, 16 nt, Pseudomonas aeruginosa PA01
caaccgggcagcagcc

SEQ ID NO: 1552391 - RNA, 17 nt, Pseudomonas aeruginosa PA01
caaccgguuucccucga

SEQ ID NO: 1552392 - RNA, 20 nt, Pseudomonas aeruginosa PA01
caaccggcguccccuuccuc

SEQ ID NO: 1552393 - RNA, 23 nt, Pseudomonas aeruginosa PA01
caacccgcccggcucaacugcuu

SEQ ID NO: 1552394 - RNA, 16 nt, Pseudomonas aeruginosa PA01
caacccggcgcuggcc

SEQ ID NO: 1552395 - RNA, 17 nt, Pseudomonas aeruginosa PA01
caaccaugguuuccgcc

SEQ ID NO: 1552396 - RNA, 20 nt, Pseudomonas aeruginosa PA01
caaccaugguuuccgccgga

SEQ ID NO: 1552397 - RNA, 21 nt, Pseudomonas aeruginosa PA01
cagcgcguucaccccgcccuu

SEQ ID NO: 1552398 - RNA, 20 nt, Pseudomonas aeruginosa PA01
cagcgcuacgcaggcccuug

SEQ ID NO: 1552399 - RNA, 17 nt, Pseudomonas aeruginosa PA01
cagcggaaucgcgcccu

SEQ ID NO: 1552400 - RNA, 18 nt, Pseudomonas aeruginosa PA01
cagcggaacgaaggacag

SEQ ID NO: 1552401 - RNA, 20 nt, Pseudomonas aeruginosa PA01
cagcggaacuugcgccgacc

SEQ ID NO: 1552402 - RNA, 20 nt, Pseudomonas aeruginosa PA01
cagcgcuugaacgcgcgccu

SEQ ID NO: 1552403 - RNA, 17 nt, Pseudomonas aeruginosa PA01
cagcggaaaugcucgcc

SEQ ID NO: 1552404 - RNA, 21 nt, Pseudomonas aeruginosa PA01
cagcgcuuccaccgccugccc

SEQ ID NO: 1552405 - RNA, 19 nt, Pseudomonas aeruginosa PA01
cagcgcuuccucgggcagc

SEQ ID NO: 1552406 - RNA, 16 nt, Pseudomonas aeruginosa PA01
cagcgcuuccuugccc

SEQ ID NO: 1552407 - RNA, 16 nt, Pseudomonas aeruginosa PA01
cagcgcuucggcggcu

SEQ ID NO: 1552408 - RNA, 19 nt, Pseudomonas aeruginosa PA01
cagcgcuucggcuccagca

SEQ ID NO: 1552409 - RNA, 18 nt, Pseudomonas aeruginosa PA01
cagcgcuucucggcagcg

SEQ ID NO: 1552410 - RNA, 18 nt, Pseudomonas aeruginosa PA01
cagcgcuuuucaggaugu

SEQ ID NO: 1552411 - RNA, 19 nt, Pseudomonas aeruginosa PA01
cagcggauccggguggaga

SEQ ID NO: 1552412 - RNA, 22 nt, Pseudomonas aeruginosa PA01
cagcggcacgcucuggccguuc

SEQ ID NO: 1552413 - RNA, 23 nt, Pseudomonas aeruginosa PA01
cagcggcacggucauggccagcu

SEQ ID NO: 1552414 - RNA, 22 nt, Pseudomonas aeruginosa PA01
cagcggcacuucccgcccccuc

SEQ ID NO: 1552415 - RNA, 21 nt, Pseudomonas aeruginosa PA01
cagcggcagaucggugcgggc

SEQ ID NO: 1552416 - RNA, 22 nt, Pseudomonas aeruginosa PA01
cagcggcagaucggugcgggca

SEQ ID NO: 1552417 - RNA, 18 nt, Pseudomonas aeruginosa PA01
cagcggcacccggcuggg

SEQ ID NO: 1552418 - RNA, 15 nt, Pseudomonas aeruginosa PA01
cagcggcaccagcac

SEQ ID NO: 1552419 - RNA, 19 nt, Pseudomonas aeruginosa PA01
cagcggcauccgccgcugg

SEQ ID NO: 1552420 - RNA, 19 nt, Pseudomonas aeruginosa PA01
cagcggcaggcacgcugcc

SEQ ID NO: 1552421 - RNA, 14 nt, Pseudomonas aeruginosa PA01
cagcggcaggccac

SEQ ID NO: 1552422 - RNA, 13 nt, Pseudomonas aeruginosa PA01
cagcggcagggcg

SEQ ID NO: 1552423 - RNA, 16 nt, Pseudomonas aeruginosa PA01
cagcggcagggcggcg

SEQ ID NO: 1552424 - RNA, 23 nt, Pseudomonas aeruginosa PA01
cagcggcagccccuugcgcucug

SEQ ID NO: 1552425 - RNA, 14 nt, Pseudomonas aeruginosa PA01
cagcggcagcggcu

SEQ ID NO: 1552426 - RNA, 13 nt, Pseudomonas aeruginosa PA01
cagcggcccagcg

SEQ ID NO: 1552427 - RNA, 15 nt, Pseudomonas aeruginosa PA01
cagcggcccagcgcc

SEQ ID NO: 1552428 - RNA, 17 nt, Pseudomonas aeruginosa PA01
cagcggcccagcgcccc

SEQ ID NO: 1552429 - RNA, 17 nt, Pseudomonas aeruginosa PA01
cagcggcccgagcaggc

SEQ ID NO: 1552430 - RNA, 21 nt, Pseudomonas aeruginosa PA01
cagcggcccgagggucgccuu

SEQ ID NO: 1552431 - RNA, 21 nt, Pseudomonas aeruginosa PA01
cagcggcauucgaacggcuca

SEQ ID NO: 1552432 - RNA, 13 nt, Pseudomonas aeruginosa PA01
cagcggcaugccc

SEQ ID NO: 1552433 - RNA, 16 nt, Pseudomonas aeruginosa PA01
cagcgcgcccggcgcc

SEQ ID NO: 1552434 - RNA, 23 nt, Pseudomonas aeruginosa PA01
cagcgcgccgccgaggugcggcu

SEQ ID NO: 1552435 - RNA, 14 nt, Pseudomonas aeruginosa PA01
cagcgcgccccggc

SEQ ID NO: 1552436 - RNA, 18 nt, Pseudomonas aeruginosa PA01
cagcgcgccgagccaggu

SEQ ID NO: 1552437 - RNA, 22 nt, Pseudomonas aeruginosa PA01
cagcgcgagggggccucggcca

SEQ ID NO: 1552438 - RNA, 18 nt, Pseudomonas aeruginosa PA01
cagcgcgauacccuggcc

SEQ ID NO: 1552439 - RNA, 15 nt, Pseudomonas aeruginosa PA01
cagcgccuugaccuc

SEQ ID NO: 1552440 - RNA, 21 nt, Pseudomonas aeruginosa PA01
cagcgccuuuucggcacucag

SEQ ID NO: 1552441 - RNA, 18 nt, Pseudomonas aeruginosa PA01
cagcgccuguuccagggc

SEQ ID NO: 1552442 - RNA, 22 nt, Pseudomonas aeruginosa PA01
cagcgccuguuccagggccugc

SEQ ID NO: 1552443 - RNA, 22 nt, Pseudomonas aeruginosa PA01
cagcgccucgcgggucugcgcc

SEQ ID NO: 1552444 - RNA, 18 nt, Pseudomonas aeruginosa PA01
cagcgcggcgccccaggc

SEQ ID NO: 1552445 - RNA, 14 nt, Pseudomonas aeruginosa PA01
cagcgcggcgcgcu

SEQ ID NO: 1552446 - RNA, 12 nt, Pseudomonas aeruginosa PA01
cagcgcggcgcu

SEQ ID NO: 1552447 - RNA, 17 nt, Pseudomonas aeruginosa PA01
cagcgcggcggcggcca

SEQ ID NO: 1552448 - RNA, 23 nt, Pseudomonas aeruginosa PA01
cagcgcguagcuuuccgcggcgu

SEQ ID NO: 1552449 - RNA, 16 nt, Pseudomonas aeruginosa PA01
cagcgcggugagcagg

SEQ ID NO: 1552450 - RNA, 13 nt, Pseudomonas aeruginosa PA01
cagcgcgggggcu

SEQ ID NO: 1552451 - RNA, 12 nt, Pseudomonas aeruginosa PA01
cagcgcgcgcug

SEQ ID NO: 1552452 - RNA, 15 nt, Pseudomonas aeruginosa PA01
cagcgcggccgccgc

SEQ ID NO: 1552453 - RNA, 20 nt, Pseudomonas aeruginosa PA01
cagcgcggagcguccaccag

SEQ ID NO: 1552454 - RNA, 20 nt, Pseudomonas aeruginosa PA01
cagcgcgcucggccuggugc

SEQ ID NO: 1552455 - RNA, 22 nt, Pseudomonas aeruginosa PA01
cagcgcgcguagcgugccgcca

SEQ ID NO: 1552456 - RNA, 21 nt, Pseudomonas aeruginosa PA01
cagcgcgcgucggucaggaca

SEQ ID NO: 1552457 - RNA, 17 nt, Pseudomonas aeruginosa PA01
cagcgaguugaccuugg

SEQ ID NO: 1552458 - RNA, 23 nt, Pseudomonas aeruginosa PA01
cagcgaucgccgccauugacgaa

SEQ ID NO: 1552459 - RNA, 16 nt, Pseudomonas aeruginosa PA01
cagcgcaccgcccugc

SEQ ID NO: 1552460 - RNA, 19 nt, Pseudomonas aeruginosa PA01
cagcgcaccuacuaccgcu

SEQ ID NO: 1552461 - RNA, 22 nt, Pseudomonas aeruginosa PA01
cagcgcaccuacuaccgcuggg

SEQ ID NO: 1552462 - RNA, 17 nt, Pseudomonas aeruginosa PA01
cagcgcaagucggccug

SEQ ID NO: 1552463 - RNA, 23 nt, Pseudomonas aeruginosa PA01
cagcgccaccagcagggccaggc

SEQ ID NO: 1552464 - RNA, 19 nt, Pseudomonas aeruginosa PA01
cagcgccaccagcaugccc

SEQ ID NO: 1552465 - RNA, 12 nt, Pseudomonas aeruginosa PA01
cagcgccaccag

SEQ ID NO: 1552466 - RNA, 16 nt, Pseudomonas aeruginosa PA01
cagcgcagccugcugg

SEQ ID NO: 1552467 - RNA, 17 nt, Pseudomonas aeruginosa PA01
cagcgcagccugcuggc

SEQ ID NO: 1552468 - RNA, 14 nt, Pseudomonas aeruginosa PA01
cagcgcagcgaaga

SEQ ID NO: 1552469 - RNA, 16 nt, Pseudomonas aeruginosa PA01
cagcgcagcgaagauc

SEQ ID NO: 1552470 - RNA, 18 nt, Pseudomonas aeruginosa PA01
cagcgcauaggccugggc

SEQ ID NO: 1552471 - RNA, 21 nt, Pseudomonas aeruginosa PA01
cagcgccaguuggacgcggcc

SEQ ID NO: 1552472 - RNA, 15 nt, Pseudomonas aeruginosa PA01
cagcgccagggccca

SEQ ID NO: 1552473 - RNA, 24 nt, Pseudomonas aeruginosa PA01
cagcgccaugcuguugccguggcg

SEQ ID NO: 1552474 - RNA, 21 nt, Pseudomonas aeruginosa PA01
cagcgccauggggaucaccgg

SEQ ID NO: 1552475 - RNA, 17 nt, Pseudomonas aeruginosa PA01
cagcgccaugcucuuca

SEQ ID NO: 1552476 - RNA, 19 nt, Pseudomonas aeruginosa PA01
cagcgccaucaggcccuug

SEQ ID NO: 1552477 - RNA, 14 nt, Pseudomonas aeruginosa PA01
cagcgcccaggugc

SEQ ID NO: 1552478 - RNA, 19 nt, Pseudomonas aeruginosa PA01
cagcgccccaccaggcucg

SEQ ID NO: 1552479 - RNA, 14 nt, Pseudomonas aeruginosa PA01
cagcgccccagcac

SEQ ID NO: 1552480 - RNA, 16 nt, Pseudomonas aeruginosa PA01
cagcgccccagcaccu

SEQ ID NO: 1552481 - RNA, 12 nt, Pseudomonas aeruginosa PA01
cagcgccccgcc

SEQ ID NO: 1552482 - RNA, 19 nt, Pseudomonas aeruginosa PA01
cagcgccacggcgcggaac

SEQ ID NO: 1552483 - RNA, 14 nt, Pseudomonas aeruginosa PA01
cagcgccacuucca

SEQ ID NO: 1552484 - RNA, 13 nt, Pseudomonas aeruginosa PA01
cagcgccagcagg

SEQ ID NO: 1552485 - RNA, 15 nt, Pseudomonas aeruginosa PA01
cagcgccagcaaccc

SEQ ID NO: 1552486 - RNA, 15 nt, Pseudomonas aeruginosa PA01
cagcgccaggcgcgg

SEQ ID NO: 1552487 - RNA, 15 nt, Pseudomonas aeruginosa PA01
cagcgccaggaagcc

SEQ ID NO: 1552488 - RNA, 13 nt, Pseudomonas aeruginosa PA01
cagcgccaggagc

SEQ ID NO: 1552489 - RNA, 15 nt, Pseudomonas aeruginosa PA01
cagcgccaggagcag

SEQ ID NO: 1552490 - RNA, 17 nt, Pseudomonas aeruginosa PA01
cagcgccaggagcaggg

SEQ ID NO: 1552491 - RNA, 20 nt, Pseudomonas aeruginosa PA01
cagcgccagcagguacagca

SEQ ID NO: 1552492 - RNA, 13 nt, Pseudomonas aeruginosa PA01
cagcgccagccag

SEQ ID NO: 1552493 - RNA, 14 nt, Pseudomonas aeruginosa PA01
cagcgccagccagg

SEQ ID NO: 1552494 - RNA, 15 nt, Pseudomonas aeruginosa PA01
cagcgccggcggcgc

SEQ ID NO: 1552495 - RNA, 20 nt, Pseudomonas aeruginosa PA01
cagcgccggcggcgcgucca

SEQ ID NO: 1552496 - RNA, 20 nt, Pseudomonas aeruginosa PA01
cagcgccgggugaccgugcg

SEQ ID NO: 1552497 - RNA, 18 nt, Pseudomonas aeruginosa PA01
cagcgccgguagcggcgc

SEQ ID NO: 1552498 - RNA, 15 nt, Pseudomonas aeruginosa PA01
cagcgccgcgcggca

SEQ ID NO: 1552499 - RNA, 17 nt, Pseudomonas aeruginosa PA01
cagcgccgcgcggcaac

SEQ ID NO: 1552500 - RNA, 14 nt, Pseudomonas aeruginosa PA01
cagcgccgcgcugc

SEQ ID NO: 1552501 - RNA, 16 nt, Pseudomonas aeruginosa PA01
cagcgccgcgcugcgu

SEQ ID NO: 1552502 - RNA, 14 nt, Pseudomonas aeruginosa PA01
cagcgccgcggugu

SEQ ID NO: 1552503 - RNA, 22 nt, Pseudomonas aeruginosa PA01
cagcgccgucaccagcagcccc

SEQ ID NO: 1552504 - RNA, 15 nt, Pseudomonas aeruginosa PA01
cagcgccggccaggg

SEQ ID NO: 1552505 - RNA, 20 nt, Pseudomonas aeruginosa PA01
cagcgccguucacgccuggc

SEQ ID NO: 1552506 - RNA, 19 nt, Pseudomonas aeruginosa PA01
cagcgccguugccgaugcc

SEQ ID NO: 1552507 - RNA, 18 nt, Pseudomonas aeruginosa PA01
cagcgccguugcggcagc

SEQ ID NO: 1552508 - RNA, 13 nt, Pseudomonas aeruginosa PA01
cagcgccuccagc

SEQ ID NO: 1552509 - RNA, 14 nt, Pseudomonas aeruginosa PA01
cagcgccuccagcg

SEQ ID NO: 1552510 - RNA, 15 nt, Pseudomonas aeruginosa PA01
cagcgccuccagcgu

SEQ ID NO: 1552511 - RNA, 23 nt, Pseudomonas aeruginosa PA01
cagcgccuccagcgucugccgcu

SEQ ID NO: 1552512 - RNA, 14 nt, Pseudomonas aeruginosa PA01
cagcgccuccucua

SEQ ID NO: 1552513 - RNA, 14 nt, Pseudomonas aeruginosa PA01
cagcgccucccggg

SEQ ID NO: 1552514 - RNA, 17 nt, Pseudomonas aeruginosa PA01
cagcgccucccgggccu

SEQ ID NO: 1552515 - RNA, 22 nt, Pseudomonas aeruginosa PA01
cagcgccucccgggccucucga

SEQ ID NO: 1552516 - RNA, 20 nt, Pseudomonas aeruginosa PA01
cagcgccgcauuggccaggc

SEQ ID NO: 1552517 - RNA, 15 nt, Pseudomonas aeruginosa PA01
cagcgccccucccag

SEQ ID NO: 1552518 - RNA, 17 nt, Pseudomonas aeruginosa PA01
cagcgccgccucgcugg

SEQ ID NO: 1552519 - RNA, 13 nt, Pseudomonas aeruginosa PA01
cagcgccgcgaac

SEQ ID NO: 1552520 - RNA, 14 nt, Pseudomonas aeruginosa PA01
cagcgccgccgggc

SEQ ID NO: 1552521 - RNA, 15 nt, Pseudomonas aeruginosa PA01
cagcgccgccgcguc

SEQ ID NO: 1552522 - RNA, 17 nt, Pseudomonas aeruginosa PA01
cagcgccgccaguucgc

SEQ ID NO: 1552523 - RNA, 13 nt, Pseudomonas aeruginosa PA01
cagcgccgccagc

SEQ ID NO: 1552524 - RNA, 16 nt, Pseudomonas aeruginosa PA01
cagcgccgccagcagg

SEQ ID NO: 1552525 - RNA, 16 nt, Pseudomonas aeruginosa PA01
cagcgccgccaggcag

SEQ ID NO: 1552526 - RNA, 16 nt, Pseudomonas aeruginosa PA01
cagccucaagccucgc

SEQ ID NO: 1552527 - RNA, 14 nt, Pseudomonas aeruginosa PA01
cagccucacccugc

SEQ ID NO: 1552528 - RNA, 19 nt, Pseudomonas aeruginosa PA01
cagccucacccugcugggc

SEQ ID NO: 1552529 - RNA, 20 nt, Pseudomonas aeruginosa PA01
cagccucacccugcugggcg

SEQ ID NO: 1552530 - RNA, 23 nt, Pseudomonas aeruginosa PA01
cagccucgcgcucggcggccucg

SEQ ID NO: 1552531 - RNA, 18 nt, Pseudomonas aeruginosa PA01
cagccguccagcuugagg

SEQ ID NO: 1552532 - RNA, 22 nt, Pseudomonas aeruginosa PA01
cagccgguggucuucagcacau

SEQ ID NO: 1552533 - RNA, 20 nt, Pseudomonas aeruginosa PA01
cagccggugaaacggaucac

SEQ ID NO: 1552534 - RNA, 21 nt, Pseudomonas aeruginosa PA01
cagccgucgucguccaccgag

SEQ ID NO: 1552535 - RNA, 14 nt, Pseudomonas aeruginosa PA01
cagccguggcaggc

SEQ ID NO: 1552536 - RNA, 22 nt, Pseudomonas aeruginosa PA01
cagccugacguugccgcgcggg

SEQ ID NO: 1552537 - RNA, 23 nt, Pseudomonas aeruginosa PA01
cagccugacguugccgcgcgggc

SEQ ID NO: 1552538 - RNA, 11 nt, Pseudomonas aeruginosa PA01
cagccuggggu

SEQ ID NO: 1552539 - RNA, 16 nt, Pseudomonas aeruginosa PA01
cagccuucgagccacu

SEQ ID NO: 1552540 - RNA, 20 nt, Pseudomonas aeruginosa PA01
cagccuuggccacggcaucg

SEQ ID NO: 1552541 - RNA, 16 nt, Pseudomonas aeruginosa PA01
cagcgaccaccaccag

SEQ ID NO: 1552542 - RNA, 22 nt, Pseudomonas aeruginosa PA01
cagcgaauagcguugacgcagu

SEQ ID NO: 1552543 - RNA, 20 nt, Pseudomonas aeruginosa PA01
cagcgaaauggucaccauga

SEQ ID NO: 1552544 - RNA, 15 nt, Pseudomonas aeruginosa PA01
cagcgaacccaggcc

SEQ ID NO: 1552545 - RNA, 13 nt, Pseudomonas aeruginosa PA01
cagcgaacgccgc

SEQ ID NO: 1552546 - RNA, 22 nt, Pseudomonas aeruginosa PA01
cagcgagacccgguacuccucc

SEQ ID NO: 1552547 - RNA, 23 nt, Pseudomonas aeruginosa PA01
cagcgagacccgguacuccucca

SEQ ID NO: 1552548 - RNA, 16 nt, Pseudomonas aeruginosa PA01
cagcgagaacagcucc

SEQ ID NO: 1552549 - RNA, 22 nt, Pseudomonas aeruginosa PA01
cagcgagaacuugccggcgcca

SEQ ID NO: 1552550 - RNA, 19 nt, Pseudomonas aeruginosa PA01
cagcgagcggucggccaug

SEQ ID NO: 1552551 - RNA, 19 nt, Pseudomonas aeruginosa PA01
cagcgagcuucgccgcgca

SEQ ID NO: 1552552 - RNA, 18 nt, Pseudomonas aeruginosa PA01
cagcgaggagccuuucac

SEQ ID NO: 1552553 - RNA, 16 nt, Pseudomonas aeruginosa PA01
cagcgaggcccgcgcc

SEQ ID NO: 1552554 - RNA, 14 nt, Pseudomonas aeruginosa PA01
cagcgaggcgggcg

SEQ ID NO: 1552555 - RNA, 16 nt, Pseudomonas aeruginosa PA01
cagcgagucgacccag

SEQ ID NO: 1552556 - RNA, 19 nt, Pseudomonas aeruginosa PA01
cagcgaggggaagaucucc

SEQ ID NO: 1552557 - RNA, 21 nt, Pseudomonas aeruginosa PA01
cagcgagugcugaacaucagg

SEQ ID NO: 1552558 - RNA, 16 nt, Pseudomonas aeruginosa PA01
cagcgacuccagccag

SEQ ID NO: 1552559 - RNA, 19 nt, Pseudomonas aeruginosa PA01
cagcgacucgaugcgcagc

SEQ ID NO: 1552560 - RNA, 16 nt, Pseudomonas aeruginosa PA01
cagcgacuggcccugg

SEQ ID NO: 1552561 - RNA, 16 nt, Pseudomonas aeruginosa PA01
cagcgacucuucaaca

SEQ ID NO: 1552562 - RNA, 17 nt, Pseudomonas aeruginosa PA01
cagcgaccugacccgcu

SEQ ID NO: 1552563 - RNA, 17 nt, Pseudomonas aeruginosa PA01
cagcgacgcgacauccu

SEQ ID NO: 1552564 - RNA, 23 nt, Pseudomonas aeruginosa PA01
cagcgacgcgacauccuccaccg

SEQ ID NO: 1552565 - RNA, 20 nt, Pseudomonas aeruginosa PA01
cagccggcaagcgugccccg

SEQ ID NO: 1552566 - RNA, 22 nt, Pseudomonas aeruginosa PA01
cagccgcgugcgcgccgccggg

SEQ ID NO: 1552567 - RNA, 17 nt, Pseudomonas aeruginosa PA01
cagccgcguugucccug

SEQ ID NO: 1552568 - RNA, 13 nt, Pseudomonas aeruginosa PA01
cagccgcuccagg

SEQ ID NO: 1552569 - RNA, 14 nt, Pseudomonas aeruginosa PA01
cagccgcuccagga

SEQ ID NO: 1552570 - RNA, 13 nt, Pseudomonas aeruginosa PA01
cagccgcugcagg

SEQ ID NO: 1552571 - RNA, 13 nt, Pseudomonas aeruginosa PA01
cagccggccuugc

SEQ ID NO: 1552572 - RNA, 13 nt, Pseudomonas aeruginosa PA01
cagccggccgcgu

SEQ ID NO: 1552573 - RNA, 23 nt, Pseudomonas aeruginosa PA01
cagccggccgcgucgcccaggcc

SEQ ID NO: 1552574 - RNA, 12 nt, Pseudomonas aeruginosa PA01
cagccggcgccg

SEQ ID NO: 1552575 - RNA, 18 nt, Pseudomonas aeruginosa PA01
cagccgggaucuccucga

SEQ ID NO: 1552576 - RNA, 18 nt, Pseudomonas aeruginosa PA01
cagccgguaggggccgac

SEQ ID NO: 1552577 - RNA, 19 nt, Pseudomonas aeruginosa PA01
cagccgcgccagugccugc

SEQ ID NO: 1552578 - RNA, 13 nt, Pseudomonas aeruginosa PA01
cagccgcgcgcug

SEQ ID NO: 1552579 - RNA, 18 nt, Pseudomonas aeruginosa PA01
cagccgcccuggcucugg

SEQ ID NO: 1552580 - RNA, 13 nt, Pseudomonas aeruginosa PA01
cagccgccccacc

SEQ ID NO: 1552581 - RNA, 19 nt, Pseudomonas aeruginosa PA01
cagccgccccaccaccauc

SEQ ID NO: 1552582 - RNA, 21 nt, Pseudomonas aeruginosa PA01
cagccgccuugcucgacccgg

SEQ ID NO: 1552583 - RNA, 15 nt, Pseudomonas aeruginosa PA01
cagccgcaggaugcc

SEQ ID NO: 1552584 - RNA, 20 nt, Pseudomonas aeruginosa PA01
cagccgcaggaugccgccug

SEQ ID NO: 1552585 - RNA, 21 nt, Pseudomonas aeruginosa PA01
cagccgcaggaugccgccugc

SEQ ID NO: 1552586 - RNA, 14 nt, Pseudomonas aeruginosa PA01
cagccgcaggcaga

SEQ ID NO: 1552587 - RNA, 22 nt, Pseudomonas aeruginosa PA01
cagccgcagcggcaugcccugc

SEQ ID NO: 1552588 - RNA, 14 nt, Pseudomonas aeruginosa PA01
cagccgcacccuca

SEQ ID NO: 1552589 - RNA, 13 nt, Pseudomonas aeruginosa PA01
cagccgagccccc

SEQ ID NO: 1552590 - RNA, 14 nt, Pseudomonas aeruginosa PA01
cagccgccaggacg

SEQ ID NO: 1552591 - RNA, 16 nt, Pseudomonas aeruginosa PA01
cagccgccaggacggc

SEQ ID NO: 1552592 - RNA, 19 nt, Pseudomonas aeruginosa PA01
cagcccuugcaaccgccgc

SEQ ID NO: 1552593 - RNA, 22 nt, Pseudomonas aeruginosa PA01
cagccgaccaccuucaggcugc

SEQ ID NO: 1552594 - RNA, 15 nt, Pseudomonas aeruginosa PA01
cagccgacgcgcagc

SEQ ID NO: 1552595 - RNA, 13 nt, Pseudomonas aeruginosa PA01
cagccgacuggcg

SEQ ID NO: 1552596 - RNA, 21 nt, Pseudomonas aeruginosa PA01
cagccgaggugguauugcagc

SEQ ID NO: 1552597 - RNA, 13 nt, Pseudomonas aeruginosa PA01
cagcccucgccca

SEQ ID NO: 1552598 - RNA, 15 nt, Pseudomonas aeruginosa PA01
cagcccucgcccagg

SEQ ID NO: 1552599 - RNA, 16 nt, Pseudomonas aeruginosa PA01
cagcccucgcccaggu

SEQ ID NO: 1552600 - RNA, 14 nt, Pseudomonas aeruginosa PA01
cagcccucggcccg

SEQ ID NO: 1552601 - RNA, 16 nt, Pseudomonas aeruginosa PA01
cagcccgucggccucg

SEQ ID NO: 1552602 - RNA, 15 nt, Pseudomonas aeruginosa PA01
cagcccgucgcgcgc

SEQ ID NO: 1552603 - RNA, 17 nt, Pseudomonas aeruginosa PA01
cagcccgucgcgcgccg

SEQ ID NO: 1552604 - RNA, 19 nt, Pseudomonas aeruginosa PA01
cagcccuaggcgacccggc

SEQ ID NO: 1552605 - RNA, 19 nt, Pseudomonas aeruginosa PA01
cagcccuuucagcggcugc

SEQ ID NO: 1552606 - RNA, 19 nt, Pseudomonas aeruginosa PA01
cagcccuggcguggccggc

SEQ ID NO: 1552607 - RNA, 15 nt, Pseudomonas aeruginosa PA01
cagcccggcggcggc

SEQ ID NO: 1552608 - RNA, 19 nt, Pseudomonas aeruginosa PA01
cagcccgguccguccagcg

SEQ ID NO: 1552609 - RNA, 18 nt, Pseudomonas aeruginosa PA01
cagcccggccauccuggc

SEQ ID NO: 1552610 - RNA, 14 nt, Pseudomonas aeruginosa PA01
cagcccgccgugcg

SEQ ID NO: 1552611 - RNA, 22 nt, Pseudomonas aeruginosa PA01
cagcccgcgcgacagcucuggg

SEQ ID NO: 1552612 - RNA, 23 nt, Pseudomonas aeruginosa PA01
cagcccgcgcgacagcucugggg

SEQ ID NO: 1552613 - RNA, 23 nt, Pseudomonas aeruginosa PA01
cagcccgcgcucggccgccuggc

SEQ ID NO: 1552614 - RNA, 14 nt, Pseudomonas aeruginosa PA01
cagcacgaugcaca

SEQ ID NO: 1552615 - RNA, 19 nt, Pseudomonas aeruginosa PA01
cagcacgaugcacaggcgu

SEQ ID NO: 1552616 - RNA, 22 nt, Pseudomonas aeruginosa PA01
cagcacgcccaguugcgccgcc

SEQ ID NO: 1552617 - RNA, 13 nt, Pseudomonas aeruginosa PA01
cagcaccuugugc

SEQ ID NO: 1552618 - RNA, 16 nt, Pseudomonas aeruginosa PA01
cagcaccuugugcugc

SEQ ID NO: 1552619 - RNA, 17 nt, Pseudomonas aeruginosa PA01
cagcacgaaagccaugc

SEQ ID NO: 1552620 - RNA, 22 nt, Pseudomonas aeruginosa PA01
cagcacgaaagccaugcccaga

SEQ ID NO: 1552621 - RNA, 14 nt, Pseudomonas aeruginosa PA01
cagcaccuggacga

SEQ ID NO: 1552622 - RNA, 15 nt, Pseudomonas aeruginosa PA01
cagcaccugcgccga

SEQ ID NO: 1552623 - RNA, 22 nt, Pseudomonas aeruginosa PA01
cagcaccugcgggcugcgugcc

SEQ ID NO: 1552624 - RNA, 20 nt, Pseudomonas aeruginosa PA01
cagcaccguggucagcacca

SEQ ID NO: 1552625 - RNA, 17 nt, Pseudomonas aeruginosa PA01
cagcaccucccccagcg

SEQ ID NO: 1552626 - RNA, 15 nt, Pseudomonas aeruginosa PA01
cagcaccggcggcgc

SEQ ID NO: 1552627 - RNA, 16 nt, Pseudomonas aeruginosa PA01
cagcaccguggcgcca

SEQ ID NO: 1552628 - RNA, 22 nt, Pseudomonas aeruginosa PA01
cagcaccguggcgccauccucc

SEQ ID NO: 1552629 - RNA, 22 nt, Pseudomonas aeruginosa PA01
cagcaccggcuuguugcgcucc

SEQ ID NO: 1552630 - RNA, 14 nt, Pseudomonas aeruginosa PA01
cagcaccgagcagg

SEQ ID NO: 1552631 - RNA, 18 nt, Pseudomonas aeruginosa PA01
cagcaccgagcaggcacc

SEQ ID NO: 1552632 - RNA, 14 nt, Pseudomonas aeruginosa PA01
cagcaccgagcuga

SEQ ID NO: 1552633 - RNA, 17 nt, Pseudomonas aeruginosa PA01
cagcacccgguagccga

SEQ ID NO: 1552634 - RNA, 17 nt, Pseudomonas aeruginosa PA01
cagcacccggucggccu

SEQ ID NO: 1552635 - RNA, 13 nt, Pseudomonas aeruginosa PA01
cagcaccgccacc

SEQ ID NO: 1552636 - RNA, 17 nt, Pseudomonas aeruginosa PA01
cagcaccgccaccagcg

SEQ ID NO: 1552637 - RNA, 16 nt, Pseudomonas aeruginosa PA01
cagcaccgccugcaac

SEQ ID NO: 1552638 - RNA, 16 nt, Pseudomonas aeruginosa PA01
cagcaccgccuggucg

SEQ ID NO: 1552639 - RNA, 18 nt, Pseudomonas aeruginosa PA01
cagcaccgcgagcaugcu

SEQ ID NO: 1552640 - RNA, 20 nt, Pseudomonas aeruginosa PA01
cagcacccccagcaggccag

SEQ ID NO: 1552641 - RNA, 14 nt, Pseudomonas aeruginosa PA01
cagcaccaggcugg

SEQ ID NO: 1552642 - RNA, 13 nt, Pseudomonas aeruginosa PA01
cagcaccaguccc

SEQ ID NO: 1552643 - RNA, 19 nt, Pseudomonas aeruginosa PA01
cagcaccagucccuggccg

SEQ ID NO: 1552644 - RNA, 12 nt, Pseudomonas aeruginosa PA01
cagcaccaucag

SEQ ID NO: 1552645 - RNA, 21 nt, Pseudomonas aeruginosa PA01
cagcaccaucagccagcccag

SEQ ID NO: 1552646 - RNA, 15 nt, Pseudomonas aeruginosa PA01
cagcacuuccugaag

SEQ ID NO: 1552647 - RNA, 16 nt, Pseudomonas aeruginosa PA01
cagcagcaacagcgcc

SEQ ID NO: 1552648 - RNA, 19 nt, Pseudomonas aeruginosa PA01
cagcagcaacagcgccgcg

SEQ ID NO: 1552649 - RNA, 12 nt, Pseudomonas aeruginosa PA01
cagcagcaccau

SEQ ID NO: 1552650 - RNA, 14 nt, Pseudomonas aeruginosa PA01
cagcagcaccauca

SEQ ID NO: 1552651 - RNA, 14 nt, Pseudomonas aeruginosa PA01
cagcagcaccgcgc

SEQ ID NO: 1552652 - RNA, 16 nt, Pseudomonas aeruginosa PA01
cagcacgcccugggac

SEQ ID NO: 1552653 - RNA, 17 nt, Pseudomonas aeruginosa PA01
cagcacgcguccgacca

SEQ ID NO: 1552654 - RNA, 19 nt, Pseudomonas aeruginosa PA01
cagcacgcucaggcagcga

SEQ ID NO: 1552655 - RNA, 14 nt, Pseudomonas aeruginosa PA01
cagcacgcuggcgu

SEQ ID NO: 1552656 - RNA, 21 nt, Pseudomonas aeruginosa PA01
cagcacggcgaauucgucgcc

SEQ ID NO: 1552657 - RNA, 15 nt, Pseudomonas aeruginosa PA01
cagcacggcgcaggg

SEQ ID NO: 1552658 - RNA, 20 nt, Pseudomonas aeruginosa PA01
cagcacggcgauacccaggc

SEQ ID NO: 1552659 - RNA, 14 nt, Pseudomonas aeruginosa PA01
cagcacgguacacg

SEQ ID NO: 1552660 - RNA, 16 nt, Pseudomonas aeruginosa PA01
cagcacgguguugugg

SEQ ID NO: 1552661 - RNA, 20 nt, Pseudomonas aeruginosa PA01
cagcacgucgauauccagcg

SEQ ID NO: 1552662 - RNA, 18 nt, Pseudomonas aeruginosa PA01
cagcacgucguccagcgc

SEQ ID NO: 1552663 - RNA, 20 nt, Pseudomonas aeruginosa PA01
cagcacgucguccagcgccg

SEQ ID NO: 1552664 - RNA, 21 nt, Pseudomonas aeruginosa PA01
cagcacgucguccagcgccga

SEQ ID NO: 1552665 - RNA, 20 nt, Pseudomonas aeruginosa PA01
cagcacguugccauccagcg

SEQ ID NO: 1552666 - RNA, 15 nt, Pseudomonas aeruginosa PA01
cagcagccccgaggc

SEQ ID NO: 1552667 - RNA, 15 nt, Pseudomonas aeruginosa PA01
cagcagcgccacgcu

SEQ ID NO: 1552668 - RNA, 16 nt, Pseudomonas aeruginosa PA01
cagcagcgcaccaucc

SEQ ID NO: 1552669 - RNA, 14 nt, Pseudomonas aeruginosa PA01
cagcagcgccagca

SEQ ID NO: 1552670 - RNA, 14 nt, Pseudomonas aeruginosa PA01
cagcagcgccaggg

SEQ ID NO: 1552671 - RNA, 14 nt, Pseudomonas aeruginosa PA01
cagcagcgccagua

SEQ ID NO: 1552672 - RNA, 13 nt, Pseudomonas aeruginosa PA01
cagcagcacgccc

SEQ ID NO: 1552673 - RNA, 13 nt, Pseudomonas aeruginosa PA01
cagcagcagcgcc

SEQ ID NO: 1552674 - RNA, 14 nt, Pseudomonas aeruginosa PA01
cagcagcagcgcca

SEQ ID NO: 1552675 - RNA, 23 nt, Pseudomonas aeruginosa PA01
cagcagcaggccggcgaccagcg

SEQ ID NO: 1552676 - RNA, 13 nt, Pseudomonas aeruginosa PA01
cagcagcaugccg

SEQ ID NO: 1552677 - RNA, 18 nt, Pseudomonas aeruginosa PA01
cagcagccaaggaugcgc

SEQ ID NO: 1552678 - RNA, 22 nt, Pseudomonas aeruginosa PA01
cagcagccaaggaugcgccagc

SEQ ID NO: 1552679 - RNA, 15 nt, Pseudomonas aeruginosa PA01
cagcagcgccgcgaa

SEQ ID NO: 1552680 - RNA, 11 nt, Pseudomonas aeruginosa PA01
cagcagcgccu

SEQ ID NO: 1552681 - RNA, 16 nt, Pseudomonas aeruginosa PA01
cagcagcgcugaucac

SEQ ID NO: 1552682 - RNA, 17 nt, Pseudomonas aeruginosa PA01
cagcagcggcaccagca

SEQ ID NO: 1552683 - RNA, 19 nt, Pseudomonas aeruginosa PA01
cagcagcgucgcgucggcc

SEQ ID NO: 1552684 - RNA, 17 nt, Pseudomonas aeruginosa PA01
cagcagcgguacggucg

SEQ ID NO: 1552685 - RNA, 16 nt, Pseudomonas aeruginosa PA01
cagcagcgguaggcgc

SEQ ID NO: 1552686 - RNA, 16 nt, Pseudomonas aeruginosa PA01
cagcagcggcggcgcc

SEQ ID NO: 1552687 - RNA, 18 nt, Pseudomonas aeruginosa PA01
cagcagcggcucacgccc

SEQ ID NO: 1552688 - RNA, 23 nt, Pseudomonas aeruginosa PA01
cagcagcggcucacgccccagcg

SEQ ID NO: 1552689 - RNA, 14 nt, Pseudomonas aeruginosa PA01
cagcagcggcagcc

SEQ ID NO: 1552690 - RNA, 17 nt, Pseudomonas aeruginosa PA01
cagcagcggcagccacu

SEQ ID NO: 1552691 - RNA, 23 nt, Pseudomonas aeruginosa PA01
cagcagcggcgacaccgccagca

SEQ ID NO: 1552692 - RNA, 22 nt, Pseudomonas aeruginosa PA01
cagcaggaagcugacgaacauc

SEQ ID NO: 1552693 - RNA, 17 nt, Pseudomonas aeruginosa PA01
cagcaggaaaagcggaa

SEQ ID NO: 1552694 - RNA, 14 nt, Pseudomonas aeruginosa PA01
cagcaggaugcagu

SEQ ID NO: 1552695 - RNA, 13 nt, Pseudomonas aeruginosa PA01
cagcaggaugcug

SEQ ID NO: 1552696 - RNA, 18 nt, Pseudomonas aeruginosa PA01
cagcaggaugcugcacag

SEQ ID NO: 1552697 - RNA, 22 nt, Pseudomonas aeruginosa PA01
cagcaggaugcugcacagccau

SEQ ID NO: 1552698 - RNA, 17 nt, Pseudomonas aeruginosa PA01
cagcaggauccaggugc

SEQ ID NO: 1552699 - RNA, 23 nt, Pseudomonas aeruginosa PA01
cagcaggauccaggugcgcggca

SEQ ID NO: 1552700 - RNA, 23 nt, Pseudomonas aeruginosa PA01
cagcaggaucgagcccuggucga

SEQ ID NO: 1552701 - RNA, 14 nt, Pseudomonas aeruginosa PA01
cagcagcucgacuu

SEQ ID NO: 1552702 - RNA, 17 nt, Pseudomonas aeruginosa PA01
cagcagggcgucggcgu

SEQ ID NO: 1552703 - RNA, 20 nt, Pseudomonas aeruginosa PA01
cagcagggcgucggcgugcu

SEQ ID NO: 1552704 - RNA, 14 nt, Pseudomonas aeruginosa PA01
cagcaggguaccgc

SEQ ID NO: 1552705 - RNA, 17 nt, Pseudomonas aeruginosa PA01
cagcaggguaccgcugg

SEQ ID NO: 1552706 - RNA, 17 nt, Pseudomonas aeruginosa PA01
cagcagggucagcagcg

SEQ ID NO: 1552707 - RNA, 19 nt, Pseudomonas aeruginosa PA01
cagcagggucagcagcgcc

SEQ ID NO: 1552708 - RNA, 11 nt, Pseudomonas aeruginosa PA01
cagcagggucu

SEQ ID NO: 1552709 - RNA, 22 nt, Pseudomonas aeruginosa PA01
cagcaggcugccguugcggccc

SEQ ID NO: 1552710 - RNA, 23 nt, Pseudomonas aeruginosa PA01
cagcaggcuguacagcaggagcg

SEQ ID NO: 1552711 - RNA, 14 nt, Pseudomonas aeruginosa PA01
cagcaggagcagcu

SEQ ID NO: 1552712 - RNA, 19 nt, Pseudomonas aeruginosa PA01
cagcaggcgcucgcugcgu

SEQ ID NO: 1552713 - RNA, 17 nt, Pseudomonas aeruginosa PA01
cagcagggccagcagcg

SEQ ID NO: 1552714 - RNA, 20 nt, Pseudomonas aeruginosa PA01
cagcagggccagcagcgcug

SEQ ID NO: 1552715 - RNA, 17 nt, Pseudomonas aeruginosa PA01
cagcagggccagccaga

SEQ ID NO: 1552716 - RNA, 16 nt, Pseudomonas aeruginosa PA01
cagcagggccagcgcc

SEQ ID NO: 1552717 - RNA, 14 nt, Pseudomonas aeruginosa PA01
cagcagggccaggc

SEQ ID NO: 1552718 - RNA, 20 nt, Pseudomonas aeruginosa PA01
cagcagggccgccgagguca

SEQ ID NO: 1552719 - RNA, 15 nt, Pseudomonas aeruginosa PA01
cagcaggcaggcaug

SEQ ID NO: 1552720 - RNA, 22 nt, Pseudomonas aeruginosa PA01
cagcaggcaggcgcgggucauc

SEQ ID NO: 1552721 - RNA, 20 nt, Pseudomonas aeruginosa PA01
cagcaggccgaaggccagga

SEQ ID NO: 1552722 - RNA, 23 nt, Pseudomonas aeruginosa PA01
cagcaggccgaucaccagcgcca

SEQ ID NO: 1552723 - RNA, 15 nt, Pseudomonas aeruginosa PA01
cagcaggcgcgcccu

SEQ ID NO: 1552724 - RNA, 17 nt, Pseudomonas aeruginosa PA01
cagcaggcgcagcagcg

SEQ ID NO: 1552725 - RNA, 14 nt, Pseudomonas aeruginosa PA01
cagcaggcgccgcg

SEQ ID NO: 1552726 - RNA, 14 nt, Pseudomonas aeruginosa PA01
cagcaggcgccggc

SEQ ID NO: 1552727 - RNA, 16 nt, Pseudomonas aeruginosa PA01
cagcaggcgccggcgg

SEQ ID NO: 1552728 - RNA, 14 nt, Pseudomonas aeruginosa PA01
cagcaggcgggcga

SEQ ID NO: 1552729 - RNA, 17 nt, Pseudomonas aeruginosa PA01
cagcaggcgggcgaagu

SEQ ID NO: 1552730 - RNA, 21 nt, Pseudomonas aeruginosa PA01
cagcaggcucaucgcccgccc

SEQ ID NO: 1552731 - RNA, 19 nt, Pseudomonas aeruginosa PA01
cagcaggcucaugcccagc

SEQ ID NO: 1552732 - RNA, 13 nt, Pseudomonas aeruginosa PA01
cagcaggucgcgc

SEQ ID NO: 1552733 - RNA, 20 nt, Pseudomonas aeruginosa PA01
cagcagguggucgaugggcg

SEQ ID NO: 1552734 - RNA, 19 nt, Pseudomonas aeruginosa PA01
cagcaggucggccugcugc

SEQ ID NO: 1552735 - RNA, 23 nt, Pseudomonas aeruginosa PA01
cagcaggucggccugcugcucga

SEQ ID NO: 1552736 - RNA, 18 nt, Pseudomonas aeruginosa PA01
cagcaggucucaccgccc

SEQ ID NO: 1552737 - RNA, 19 nt, Pseudomonas aeruginosa PA01
cagcaggucuuccaccgcg

SEQ ID NO: 1552738 - RNA, 15 nt, Pseudomonas aeruginosa PA01
cagcagguagccugc

SEQ ID NO: 1552739 - RNA, 20 nt, Pseudomonas aeruginosa PA01
cagcagguagugcggcgggc

SEQ ID NO: 1552740 - RNA, 14 nt, Pseudomonas aeruginosa PA01
cagcagguacagca

SEQ ID NO: 1552741 - RNA, 17 nt, Pseudomonas aeruginosa PA01
cagcagguacagcagcu

SEQ ID NO: 1552742 - RNA, 18 nt, Pseudomonas aeruginosa PA01
cagcagguagacgcaggu

SEQ ID NO: 1552743 - RNA, 17 nt, Pseudomonas aeruginosa PA01
cagcagguuggucugcu

SEQ ID NO: 1552744 - RNA, 17 nt, Pseudomonas aeruginosa PA01
cagcagguuccuccugg

SEQ ID NO: 1552745 - RNA, 13 nt, Pseudomonas aeruginosa PA01
cagcagguugacc

SEQ ID NO: 1552746 - RNA, 17 nt, Pseudomonas aeruginosa PA01
cagcagguugaccccgc

SEQ ID NO: 1552747 - RNA, 20 nt, Pseudomonas aeruginosa PA01
cagcagguugaccccgcggc

SEQ ID NO: 1552748 - RNA, 20 nt, Pseudomonas aeruginosa PA01
cagcagucgcacagccaggg

SEQ ID NO: 1552749 - RNA, 16 nt, Pseudomonas aeruginosa PA01
cagcagucgcagcucg

SEQ ID NO: 1552750 - RNA, 22 nt, Pseudomonas aeruginosa PA01
cagcagucguugacggugcugu

SEQ ID NO: 1552751 - RNA, 16 nt, Pseudomonas aeruginosa PA01
cagcaguuccaggcgu

SEQ ID NO: 1552752 - RNA, 21 nt, Pseudomonas aeruginosa PA01
cagcaguucgucgccacgccc

SEQ ID NO: 1552753 - RNA, 21 nt, Pseudomonas aeruginosa PA01
cagcaguagugcgacgcagca

SEQ ID NO: 1552754 - RNA, 12 nt, Pseudomonas aeruginosa PA01
cagccagcagcc

SEQ ID NO: 1552755 - RNA, 16 nt, Pseudomonas aeruginosa PA01
cagccagcagcccggc

SEQ ID NO: 1552756 - RNA, 12 nt, Pseudomonas aeruginosa PA01
cagccagcccag

SEQ ID NO: 1552757 - RNA, 16 nt, Pseudomonas aeruginosa PA01
cagccagccgagcaac

SEQ ID NO: 1552758 - RNA, 16 nt, Pseudomonas aeruginosa PA01
cagccagagcuccagg

SEQ ID NO: 1552759 - RNA, 15 nt, Pseudomonas aeruginosa PA01
cagccagaggucgag

SEQ ID NO: 1552760 - RNA, 19 nt, Pseudomonas aeruginosa PA01
cagccagaggucgagcugg

SEQ ID NO: 1552761 - RNA, 20 nt, Pseudomonas aeruginosa PA01
cagccagaccggcagcgccg

SEQ ID NO: 1552762 - RNA, 23 nt, Pseudomonas aeruginosa PA01
cagccagaccggcagcgccgcca

SEQ ID NO: 1552763 - RNA, 23 nt, Pseudomonas aeruginosa PA01
cagccacuguccaugaaugccuu

SEQ ID NO: 1552764 - RNA, 20 nt, Pseudomonas aeruginosa PA01
cagccagacguccggcaggu

SEQ ID NO: 1552765 - RNA, 11 nt, Pseudomonas aeruginosa PA01
cagccagagcc

SEQ ID NO: 1552766 - RNA, 18 nt, Pseudomonas aeruginosa PA01
cagccacgaagccucuuc

SEQ ID NO: 1552767 - RNA, 18 nt, Pseudomonas aeruginosa PA01
cagccacgggcgccagcg

SEQ ID NO: 1552768 - RNA, 18 nt, Pseudomonas aeruginosa PA01
cagccacggacgcgcagg

SEQ ID NO: 1552769 - RNA, 20 nt, Pseudomonas aeruginosa PA01
cagccacggcacacgucggc

SEQ ID NO: 1552770 - RNA, 21 nt, Pseudomonas aeruginosa PA01
cagccacucggccaggcgcca

SEQ ID NO: 1552771 - RNA, 16 nt, Pseudomonas aeruginosa PA01
cagccacugccgccuc

SEQ ID NO: 1552772 - RNA, 15 nt, Pseudomonas aeruginosa PA01
cagccacugcuuggc

SEQ ID NO: 1552773 - RNA, 18 nt, Pseudomonas aeruginosa PA01
cagccagcuucagccgac

SEQ ID NO: 1552774 - RNA, 22 nt, Pseudomonas aeruginosa PA01
cagccaggcccgguugagaucc

SEQ ID NO: 1552775 - RNA, 16 nt, Pseudomonas aeruginosa PA01
cagccaggccuugugc

SEQ ID NO: 1552776 - RNA, 23 nt, Pseudomonas aeruginosa PA01
cagccaggccuugugcgccagcu

SEQ ID NO: 1552777 - RNA, 14 nt, Pseudomonas aeruginosa PA01
cagccagccgucgu

SEQ ID NO: 1552778 - RNA, 20 nt, Pseudomonas aeruginosa PA01
cagccagccggcgaagggca

SEQ ID NO: 1552779 - RNA, 21 nt, Pseudomonas aeruginosa PA01
cagccagccggcgaagggcag

SEQ ID NO: 1552780 - RNA, 14 nt, Pseudomonas aeruginosa PA01
cagccagccgccuu

SEQ ID NO: 1552781 - RNA, 21 nt, Pseudomonas aeruginosa PA01
cagccagcgguugagcagggc

SEQ ID NO: 1552782 - RNA, 13 nt, Pseudomonas aeruginosa PA01
cagccagugcaug

SEQ ID NO: 1552783 - RNA, 14 nt, Pseudomonas aeruginosa PA01
cagccagucggcgg

SEQ ID NO: 1552784 - RNA, 22 nt, Pseudomonas aeruginosa PA01
cagccaguaguccuccgcgccc

SEQ ID NO: 1552785 - RNA, 16 nt, Pseudomonas aeruginosa PA01
cagccaguagucuucc

SEQ ID NO: 1552786 - RNA, 15 nt, Pseudomonas aeruginosa PA01
cagccaggcuggcug

SEQ ID NO: 1552787 - RNA, 14 nt, Pseudomonas aeruginosa PA01
cagccaggcggcca

SEQ ID NO: 1552788 - RNA, 16 nt, Pseudomonas aeruginosa PA01
cagccagggccgcgag

SEQ ID NO: 1552789 - RNA, 17 nt, Pseudomonas aeruginosa PA01
cagccagggccgcgaga

SEQ ID NO: 1552790 - RNA, 13 nt, Pseudomonas aeruginosa PA01
cagccccggcccg

SEQ ID NO: 1552791 - RNA, 17 nt, Pseudomonas aeruginosa PA01
cagccccucggccagga

SEQ ID NO: 1552792 - RNA, 15 nt, Pseudomonas aeruginosa PA01
cagcccccccagcac

SEQ ID NO: 1552793 - RNA, 15 nt, Pseudomonas aeruginosa PA01
cagccccaggcgcgg

SEQ ID NO: 1552794 - RNA, 14 nt, Pseudomonas aeruginosa PA01
cagcccccucgccc

SEQ ID NO: 1552795 - RNA, 21 nt, Pseudomonas aeruginosa PA01
cagcccccucgcccucgaagc

SEQ ID NO: 1552796 - RNA, 12 nt, Pseudomonas aeruginosa PA01
cagccccagccu

SEQ ID NO: 1552797 - RNA, 14 nt, Pseudomonas aeruginosa PA01
cagcccagcggcgc

SEQ ID NO: 1552798 - RNA, 12 nt, Pseudomonas aeruginosa PA01
cagcccauacac

SEQ ID NO: 1552799 - RNA, 12 nt, Pseudomonas aeruginosa PA01
cagcccagggcg

SEQ ID NO: 1552800 - RNA, 15 nt, Pseudomonas aeruginosa PA01
cagcccagugcuggc

SEQ ID NO: 1552801 - RNA, 21 nt, Pseudomonas aeruginosa PA01
cagccauggcuggugcgggug

SEQ ID NO: 1552802 - RNA, 15 nt, Pseudomonas aeruginosa PA01
cagccaugugcuccu

SEQ ID NO: 1552803 - RNA, 18 nt, Pseudomonas aeruginosa PA01
cagccaugugcuccuuga

SEQ ID NO: 1552804 - RNA, 18 nt, Pseudomonas aeruginosa PA01
cagccauugagcgcgccc

SEQ ID NO: 1552805 - RNA, 21 nt, Pseudomonas aeruginosa PA01
cagccauugagcgcgcccagg

SEQ ID NO: 1552806 - RNA, 22 nt, Pseudomonas aeruginosa PA01
cagccauugagcgcgcccaggc

SEQ ID NO: 1552807 - RNA, 14 nt, Pseudomonas aeruginosa PA01
cagcccaggcgccg

SEQ ID NO: 1552808 - RNA, 14 nt, Pseudomonas aeruginosa PA01
cagcccagccgcuc

SEQ ID NO: 1552809 - RNA, 12 nt, Pseudomonas aeruginosa PA01
cagcccagccgc

SEQ ID NO: 1552810 - RNA, 16 nt, Pseudomonas aeruginosa PA01
cagcccacccccggcc

SEQ ID NO: 1552811 - RNA, 16 nt, Pseudomonas aeruginosa PA01
cagcaucgccggcagc

SEQ ID NO: 1552812 - RNA, 19 nt, Pseudomonas aeruginosa PA01
cagcaucgccggcagcgcc

SEQ ID NO: 1552813 - RNA, 13 nt, Pseudomonas aeruginosa PA01
cagcaucggaccg

SEQ ID NO: 1552814 - RNA, 17 nt, Pseudomonas aeruginosa PA01
cagcaucucggugcgcc

SEQ ID NO: 1552815 - RNA, 20 nt, Pseudomonas aeruginosa PA01
cagcaucucggugcgcccca

SEQ ID NO: 1552816 - RNA, 23 nt, Pseudomonas aeruginosa PA01
cagcaucucggugcgccccaggu

SEQ ID NO: 1552817 - RNA, 22 nt, Pseudomonas aeruginosa PA01
cagcaucugcugguccuggcgc

SEQ ID NO: 1552818 - RNA, 12 nt, Pseudomonas aeruginosa PA01
cagcaugcccag

SEQ ID NO: 1552819 - RNA, 19 nt, Pseudomonas aeruginosa PA01
cagcaucagugcucaucau

SEQ ID NO: 1552820 - RNA, 22 nt, Pseudomonas aeruginosa PA01
cagcaucaugaucugguagacc

SEQ ID NO: 1552821 - RNA, 21 nt, Pseudomonas aeruginosa PA01
cagcaucaccuugcggaaccc

SEQ ID NO: 1552822 - RNA, 14 nt, Pseudomonas aeruginosa PA01
cagcaucagcagga

SEQ ID NO: 1552823 - RNA, 18 nt, Pseudomonas aeruginosa PA01
cagcauguccugcaggcu

SEQ ID NO: 1552824 - RNA, 22 nt, Pseudomonas aeruginosa PA01
cagcauggcgaagcucggccgc

SEQ ID NO: 1552825 - RNA, 23 nt, Pseudomonas aeruginosa PA01
cagcaugggauggcgcgguccgc

SEQ ID NO: 1552826 - RNA, 13 nt, Pseudomonas aeruginosa PA01
cagcauggggcgg

SEQ ID NO: 1552827 - RNA, 14 nt, Pseudomonas aeruginosa PA01
cagccacagagguc

SEQ ID NO: 1552828 - RNA, 14 nt, Pseudomonas aeruginosa PA01
cagccaaccgucgc

SEQ ID NO: 1552829 - RNA, 16 nt, Pseudomonas aeruginosa PA01
cagccaagccaccagc

SEQ ID NO: 1552830 - RNA, 22 nt, Pseudomonas aeruginosa PA01
cagccaaggaugcgccagcggc

SEQ ID NO: 1552831 - RNA, 18 nt, Pseudomonas aeruginosa PA01
cagaugcgcgucgccgaa

SEQ ID NO: 1552832 - RNA, 17 nt, Pseudomonas aeruginosa PA01
cagaugcuugcacaccu

SEQ ID NO: 1552833 - RNA, 14 nt, Pseudomonas aeruginosa PA01
cagaugcuccaggg

SEQ ID NO: 1552834 - RNA, 19 nt, Pseudomonas aeruginosa PA01
cagaugcuccagggagcgc

SEQ ID NO: 1552835 - RNA, 16 nt, Pseudomonas aeruginosa PA01
cagaugaucgccaccg

SEQ ID NO: 1552836 - RNA, 12 nt, Pseudomonas aeruginosa PA01
cagaucucccug

SEQ ID NO: 1552837 - RNA, 16 nt, Pseudomonas aeruginosa PA01
cagaucgucuuucucg

SEQ ID NO: 1552838 - RNA, 14 nt, Pseudomonas aeruginosa PA01
cagaucgccagcgc

SEQ ID NO: 1552839 - RNA, 16 nt, Pseudomonas aeruginosa PA01
cagaucgccagcgcca

SEQ ID NO: 1552840 - RNA, 21 nt, Pseudomonas aeruginosa PA01
cagaucgccagcgccagcagg

SEQ ID NO: 1552841 - RNA, 17 nt, Pseudomonas aeruginosa PA01
cagaucggcgcgcaggg

SEQ ID NO: 1552842 - RNA, 23 nt, Pseudomonas aeruginosa PA01
cagaucggcgcgcagggccagca

SEQ ID NO: 1552843 - RNA, 14 nt, Pseudomonas aeruginosa PA01
cagaucgcggcgca

SEQ ID NO: 1552844 - RNA, 13 nt, Pseudomonas aeruginosa PA01
cagaucgccaccc

SEQ ID NO: 1552845 - RNA, 14 nt, Pseudomonas aeruginosa PA01
cagauguccaggca

SEQ ID NO: 1552846 - RNA, 13 nt, Pseudomonas aeruginosa PA01
cagcaaacccggg

SEQ ID NO: 1552847 - RNA, 17 nt, Pseudomonas aeruginosa PA01
cagcaauuccgcagccu

SEQ ID NO: 1552848 - RNA, 17 nt, Pseudomonas aeruginosa PA01
cagcaaugccagcgcca

SEQ ID NO: 1552849 - RNA, 13 nt, Pseudomonas aeruginosa PA01
cagcaaugcccag

SEQ ID NO: 1552850 - RNA, 15 nt, Pseudomonas aeruginosa PA01
cagcaaugcccagcg

SEQ ID NO: 1552851 - RNA, 20 nt, Pseudomonas aeruginosa PA01
cagcaaugcccagcgcaggc

SEQ ID NO: 1552852 - RNA, 19 nt, Pseudomonas aeruginosa PA01
cagcaaugcccgcgccugg

SEQ ID NO: 1552853 - RNA, 21 nt, Pseudomonas aeruginosa PA01
cagcaaugcccgcgccugggc

SEQ ID NO: 1552854 - RNA, 15 nt, Pseudomonas aeruginosa PA01
cagcacauagagggu

SEQ ID NO: 1552855 - RNA, 22 nt, Pseudomonas aeruginosa PA01
cagcacauagagggucagccgg

SEQ ID NO: 1552856 - RNA, 14 nt, Pseudomonas aeruginosa PA01
cagcacaugccacg

SEQ ID NO: 1552857 - RNA, 12 nt, Pseudomonas aeruginosa PA01
cagcaccaccuc

SEQ ID NO: 1552858 - RNA, 16 nt, Pseudomonas aeruginosa PA01
cagcaccaccucgcca

SEQ ID NO: 1552859 - RNA, 16 nt, Pseudomonas aeruginosa PA01
cagcaccagcacgccc

SEQ ID NO: 1552860 - RNA, 15 nt, Pseudomonas aeruginosa PA01
cagcaccagcaggag

SEQ ID NO: 1552861 - RNA, 19 nt, Pseudomonas aeruginosa PA01
cagcaccaggaagccccag

SEQ ID NO: 1552862 - RNA, 18 nt, Pseudomonas aeruginosa PA01
cagcaccaggccaucgaa

SEQ ID NO: 1552863 - RNA, 17 nt, Pseudomonas aeruginosa PA01
cagcaacgccgccccca

SEQ ID NO: 1552864 - RNA, 23 nt, Pseudomonas aeruginosa PA01
cagcaacgccgcccccagcgcgc

SEQ ID NO: 1552865 - RNA, 18 nt, Pseudomonas aeruginosa PA01
cagcaacgccuucugcaa

SEQ ID NO: 1552866 - RNA, 23 nt, Pseudomonas aeruginosa PA01
cagcaacaggcaaagaccgacca

SEQ ID NO: 1552867 - RNA, 16 nt, Pseudomonas aeruginosa PA01
cagcaacagcgccgcg

SEQ ID NO: 1552868 - RNA, 20 nt, Pseudomonas aeruginosa PA01
cagcaacagcgccgcgcgcu

SEQ ID NO: 1552869 - RNA, 13 nt, Pseudomonas aeruginosa PA01
cagcaacaccgcg

SEQ ID NO: 1552870 - RNA, 19 nt, Pseudomonas aeruginosa PA01
cagcaaagcgcagguagcg

SEQ ID NO: 1552871 - RNA, 17 nt, Pseudomonas aeruginosa PA01
cagcaaacgggacaggu

SEQ ID NO: 1552872 - RNA, 17 nt, Pseudomonas aeruginosa PA01
cagcaacgugaagcccu

SEQ ID NO: 1552873 - RNA, 17 nt, Pseudomonas aeruginosa PA01
cagcaacggcaucgcuc

SEQ ID NO: 1552874 - RNA, 13 nt, Pseudomonas aeruginosa PA01
cagcaacggcucc

SEQ ID NO: 1552875 - RNA, 16 nt, Pseudomonas aeruginosa PA01
cagagcggccaggucg

SEQ ID NO: 1552876 - RNA, 12 nt, Pseudomonas aeruginosa PA01
cagagcgcugcc

SEQ ID NO: 1552877 - RNA, 21 nt, Pseudomonas aeruginosa PA01
cagagcggccggcgcggcgcg

SEQ ID NO: 1552878 - RNA, 20 nt, Pseudomonas aeruginosa PA01
cagagcuccagggcugccac

SEQ ID NO: 1552879 - RNA, 17 nt, Pseudomonas aeruginosa PA01
cagaggcgaccagccgg

SEQ ID NO: 1552880 - RNA, 16 nt, Pseudomonas aeruginosa PA01
cagaggcauucaucac

SEQ ID NO: 1552881 - RNA, 22 nt, Pseudomonas aeruginosa PA01
cagagcuggaagucguccagca

SEQ ID NO: 1552882 - RNA, 13 nt, Pseudomonas aeruginosa PA01
cagaggaaggcgc

SEQ ID NO: 1552883 - RNA, 16 nt, Pseudomonas aeruginosa PA01
cagagggugaggcgca

SEQ ID NO: 1552884 - RNA, 15 nt, Pseudomonas aeruginosa PA01
cagagggcguccugc

SEQ ID NO: 1552885 - RNA, 16 nt, Pseudomonas aeruginosa PA01
cagaggcugcgcucca

SEQ ID NO: 1552886 - RNA, 16 nt, Pseudomonas aeruginosa PA01
cagaguccaugcucag

SEQ ID NO: 1552887 - RNA, 18 nt, Pseudomonas aeruginosa PA01
cagagucgcaccgggagg

SEQ ID NO: 1552888 - RNA, 19 nt, Pseudomonas aeruginosa PA01
cagaguugccuguccagcu

SEQ ID NO: 1552889 - RNA, 14 nt, Pseudomonas aeruginosa PA01
cagagugcgcagca

SEQ ID NO: 1552890 - RNA, 15 nt, Pseudomonas aeruginosa PA01
cagagugcgcagcag

SEQ ID NO: 1552891 - RNA, 22 nt, Pseudomonas aeruginosa PA01
cagaguuucucggucgccgcca

SEQ ID NO: 1552892 - RNA, 19 nt, Pseudomonas aeruginosa PA01
cagauaaagcuggaccacc

SEQ ID NO: 1552893 - RNA, 18 nt, Pseudomonas aeruginosa PA01
cagauauccagggccagg

SEQ ID NO: 1552894 - RNA, 19 nt, Pseudomonas aeruginosa PA01
cagauauccagggccagga

SEQ ID NO: 1552895 - RNA, 20 nt, Pseudomonas aeruginosa PA01
cagaucaccaccaccgucug

SEQ ID NO: 1552896 - RNA, 20 nt, Pseudomonas aeruginosa PA01
cagaucaucgcacggucguc

SEQ ID NO: 1552897 - RNA, 16 nt, Pseudomonas aeruginosa PA01
cagacgaucagcggcc

SEQ ID NO: 1552898 - RNA, 17 nt, Pseudomonas aeruginosa PA01
cagacgaucuccugcug

SEQ ID NO: 1552899 - RNA, 14 nt, Pseudomonas aeruginosa PA01
cagacgaucuggca

SEQ ID NO: 1552900 - RNA, 11 nt, Pseudomonas aeruginosa PA01
cagaccuuccu

SEQ ID NO: 1552901 - RNA, 23 nt, Pseudomonas aeruginosa PA01
cagaccugcaauuccaccggcug

SEQ ID NO: 1552902 - RNA, 13 nt, Pseudomonas aeruginosa PA01
cagaccugcagca

SEQ ID NO: 1552903 - RNA, 15 nt, Pseudomonas aeruginosa PA01
cagaccugcagcagg

SEQ ID NO: 1552904 - RNA, 20 nt, Pseudomonas aeruginosa PA01
cagaccugcagcaggaucag

SEQ ID NO: 1552905 - RNA, 16 nt, Pseudomonas aeruginosa PA01
cagaccugccgcccgg

SEQ ID NO: 1552906 - RNA, 22 nt, Pseudomonas aeruginosa PA01
cagaccugccgcccggccaggc

SEQ ID NO: 1552907 - RNA, 15 nt, Pseudomonas aeruginosa PA01
cagacgcagcagcuc

SEQ ID NO: 1552908 - RNA, 19 nt, Pseudomonas aeruginosa PA01
cagacgcagcagcucgucc

SEQ ID NO: 1552909 - RNA, 16 nt, Pseudomonas aeruginosa PA01
cagacgcagccguugg

SEQ ID NO: 1552910 - RNA, 20 nt, Pseudomonas aeruginosa PA01
cagacgauugaccucccgcg

SEQ ID NO: 1552911 - RNA, 23 nt, Pseudomonas aeruginosa PA01
cagacgauugaccucccgcgcca

SEQ ID NO: 1552912 - RNA, 13 nt, Pseudomonas aeruginosa PA01
cagacgcuccuug

SEQ ID NO: 1552913 - RNA, 17 nt, Pseudomonas aeruginosa PA01
cagacuccggcgcagcc

SEQ ID NO: 1552914 - RNA, 17 nt, Pseudomonas aeruginosa PA01
cagacgguucagcagcg

SEQ ID NO: 1552915 - RNA, 21 nt, Pseudomonas aeruginosa PA01
cagacgguucagcagcggcac

SEQ ID NO: 1552916 - RNA, 16 nt, Pseudomonas aeruginosa PA01
cagacguccagcgcca

SEQ ID NO: 1552917 - RNA, 18 nt, Pseudomonas aeruginosa PA01
cagacguccagcgccacu

SEQ ID NO: 1552918 - RNA, 13 nt, Pseudomonas aeruginosa PA01
cagagcagagucg

SEQ ID NO: 1552919 - RNA, 16 nt, Pseudomonas aeruginosa PA01
cagagcagcaccagca

SEQ ID NO: 1552920 - RNA, 15 nt, Pseudomonas aeruginosa PA01
cagagcccgucgaag

SEQ ID NO: 1552921 - RNA, 23 nt, Pseudomonas aeruginosa PA01
cagagcccgucgaagccaggcac

SEQ ID NO: 1552922 - RNA, 14 nt, Pseudomonas aeruginosa PA01
cagagccgccgaac

SEQ ID NO: 1552923 - RNA, 19 nt, Pseudomonas aeruginosa PA01
cagagccgcucggcgggua

SEQ ID NO: 1552924 - RNA, 13 nt, Pseudomonas aeruginosa PA01
cagagcaucaccc

SEQ ID NO: 1552925 - RNA, 16 nt, Pseudomonas aeruginosa PA01
cagagcaucacccgcg

SEQ ID NO: 1552926 - RNA, 13 nt, Pseudomonas aeruginosa PA01
cagagccagccgc

SEQ ID NO: 1552927 - RNA, 18 nt, Pseudomonas aeruginosa PA01
cagagccagccgcagccc

SEQ ID NO: 1552928 - RNA, 15 nt, Pseudomonas aeruginosa PA01
cagagccagccgcga

SEQ ID NO: 1552929 - RNA, 15 nt, Pseudomonas aeruginosa PA01
cagagaaaaggccgc

SEQ ID NO: 1552930 - RNA, 20 nt, Pseudomonas aeruginosa PA01
cagacuucgccgugcuccuc

SEQ ID NO: 1552931 - RNA, 19 nt, Pseudomonas aeruginosa PA01
cagacaggccagcucgccc

SEQ ID NO: 1552932 - RNA, 17 nt, Pseudomonas aeruginosa PA01
cagacaggccuccagca

SEQ ID NO: 1552933 - RNA, 17 nt, Pseudomonas aeruginosa PA01
cagacacgccucaaggc

SEQ ID NO: 1552934 - RNA, 13 nt, Pseudomonas aeruginosa PA01
cagacacaaaaaa

SEQ ID NO: 1552935 - RNA, 14 nt, Pseudomonas aeruginosa PA01
cagacacaaaaaac

SEQ ID NO: 1552936 - RNA, 13 nt, Pseudomonas aeruginosa PA01
cagaccagcagcg

SEQ ID NO: 1552937 - RNA, 12 nt, Pseudomonas aeruginosa PA01
cagaccagcagg

SEQ ID NO: 1552938 - RNA, 16 nt, Pseudomonas aeruginosa PA01
cagaccagccccaguc

SEQ ID NO: 1552939 - RNA, 13 nt, Pseudomonas aeruginosa PA01
cagaccagcccug

SEQ ID NO: 1552940 - RNA, 21 nt, Pseudomonas aeruginosa PA01
cagaccaggccgagcaggaag

SEQ ID NO: 1552941 - RNA, 16 nt, Pseudomonas aeruginosa PA01
cagacccaggugcgca

SEQ ID NO: 1552942 - RNA, 23 nt, Pseudomonas aeruginosa PA01
cagacccaggugcgcaggcgcuc

SEQ ID NO: 1552943 - RNA, 15 nt, Pseudomonas aeruginosa PA01
cagaccucgagcagg

SEQ ID NO: 1552944 - RNA, 16 nt, Pseudomonas aeruginosa PA01
cagaccucgagcaggc

SEQ ID NO: 1552945 - RNA, 12 nt, Pseudomonas aeruginosa PA01
cagaccuccagg

SEQ ID NO: 1552946 - RNA, 18 nt, Pseudomonas aeruginosa PA01
cagaccgacccucaugga

SEQ ID NO: 1552947 - RNA, 22 nt, Pseudomonas aeruginosa PA01
cagaaugugccgguagcuggcc

SEQ ID NO: 1552948 - RNA, 17 nt, Pseudomonas aeruginosa PA01
cagaauuccagcagguc

SEQ ID NO: 1552949 - RNA, 20 nt, Pseudomonas aeruginosa PA01
cagaaguauuucaaccaggc

SEQ ID NO: 1552950 - RNA, 13 nt, Pseudomonas aeruginosa PA01
cagaaggccaggg

SEQ ID NO: 1552951 - RNA, 20 nt, Pseudomonas aeruginosa PA01
cagaagaucgccugcuggcc

SEQ ID NO: 1552952 - RNA, 23 nt, Pseudomonas aeruginosa PA01
cagaacugccgggccagcuccag

SEQ ID NO: 1552953 - RNA, 13 nt, Pseudomonas aeruginosa PA01
cagaagacgccca

SEQ ID NO: 1552954 - RNA, 23 nt, Pseudomonas aeruginosa PA01
cagaacgaaaaaggcgcgccggu

SEQ ID NO: 1552955 - RNA, 20 nt, Pseudomonas aeruginosa PA01
cagaacgcguaggggaccac

SEQ ID NO: 1552956 - RNA, 21 nt, Pseudomonas aeruginosa PA01
cagaacgcguaggggaccacc

SEQ ID NO: 1552957 - RNA, 15 nt, Pseudomonas aeruginosa PA01
cagaaccgccagcag

SEQ ID NO: 1552958 - RNA, 15 nt, Pseudomonas aeruginosa PA01
cagaaagccucaggc

SEQ ID NO: 1552959 - RNA, 13 nt, Pseudomonas aeruginosa PA01
cagaacacccggg

SEQ ID NO: 1552960 - RNA, 16 nt, Pseudomonas aeruginosa PA01
cacugccaggagcacg

SEQ ID NO: 1552961 - RNA, 17 nt, Pseudomonas aeruginosa PA01
cacugccgccucagcga

SEQ ID NO: 1552962 - RNA, 12 nt, Pseudomonas aeruginosa PA01
cacugcgcgcca

SEQ ID NO: 1552963 - RNA, 16 nt, Pseudomonas aeruginosa PA01
cacugcgccaugccgu

SEQ ID NO: 1552964 - RNA, 17 nt, Pseudomonas aeruginosa PA01
cacugcaacacuuccuu

SEQ ID NO: 1552965 - RNA, 17 nt, Pseudomonas aeruginosa PA01
caauguccgagcagguc

SEQ ID NO: 1552966 - RNA, 20 nt, Pseudomonas aeruginosa PA01
cacugguggcgaacagcacc

SEQ ID NO: 1552967 - RNA, 22 nt, Pseudomonas aeruginosa PA01
cacugucucgccgaugcccggg

SEQ ID NO: 1552968 - RNA, 13 nt, Pseudomonas aeruginosa PA01
cacugcuuggcca

SEQ ID NO: 1552969 - RNA, 17 nt, Pseudomonas aeruginosa PA01
cacugcuuggccaggcg

SEQ ID NO: 1552970 - RNA, 22 nt, Pseudomonas aeruginosa PA01
cacugcguggguagccauggcg

SEQ ID NO: 1552971 - RNA, 23 nt, Pseudomonas aeruginosa PA01
cacugcguggguagccauggcgg

SEQ ID NO: 1552972 - RNA, 13 nt, Pseudomonas aeruginosa PA01
cacugcgggccgu

SEQ ID NO: 1552973 - RNA, 14 nt, Pseudomonas aeruginosa PA01
cacuggcggaccgc

SEQ ID NO: 1552974 - RNA, 19 nt, Pseudomonas aeruginosa PA01
cacuggcggaccgccucga

SEQ ID NO: 1552975 - RNA, 16 nt, Pseudomonas aeruginosa PA01
cacuugaacaccgugg

SEQ ID NO: 1552976 - RNA, 15 nt, Pseudomonas aeruginosa PA01
cacuugaggaagugc

SEQ ID NO: 1552977 - RNA, 16 nt, Pseudomonas aeruginosa PA01
cacuucguccggccgc

SEQ ID NO: 1552978 - RNA, 12 nt, Pseudomonas aeruginosa PA01
cacuuccuugcg

SEQ ID NO: 1552979 - RNA, 13 nt, Pseudomonas aeruginosa PA01
cacuucggcgcgc

SEQ ID NO: 1552980 - RNA, 20 nt, Pseudomonas aeruginosa PA01
cacuuccgucacgcccugcc

SEQ ID NO: 1552981 - RNA, 19 nt, Pseudomonas aeruginosa PA01
cacuuccucguggggccag

SEQ ID NO: 1552982 - RNA, 16 nt, Pseudomonas aeruginosa PA01
cacuucgaccaguacg

SEQ ID NO: 1552983 - RNA, 23 nt, Pseudomonas aeruginosa PA01
cacuuccggcccggccaggcgau

SEQ ID NO: 1552984 - RNA, 19 nt, Pseudomonas aeruginosa PA01
cacuucccaggugcccugg

SEQ ID NO: 1552985 - RNA, 13 nt, Pseudomonas aeruginosa PA01
cacuugugguggg

SEQ ID NO: 1552986 - RNA, 16 nt, Pseudomonas aeruginosa PA01
caggcagcagagcgcc

SEQ ID NO: 1552987 - RNA, 17 nt, Pseudomonas aeruginosa PA01
caggcagcgcgcggcca

SEQ ID NO: 1552988 - RNA, 14 nt, Pseudomonas aeruginosa PA01
caggcagcgcgcgu

SEQ ID NO: 1552989 - RNA, 11 nt, Pseudomonas aeruginosa PA01
caggcagcgcc

SEQ ID NO: 1552990 - RNA, 13 nt, Pseudomonas aeruginosa PA01
caggcagcgccgc

SEQ ID NO: 1552991 - RNA, 15 nt, Pseudomonas aeruginosa PA01
caggcagcgccgccc

SEQ ID NO: 1552992 - RNA, 18 nt, Pseudomonas aeruginosa PA01
caggcaggcggucagcgc

SEQ ID NO: 1552993 - RNA, 14 nt, Pseudomonas aeruginosa PA01
caggcaggcgcggg

SEQ ID NO: 1552994 - RNA, 15 nt, Pseudomonas aeruginosa PA01
caggcaggcgcgggu

SEQ ID NO: 1552995 - RNA, 16 nt, Pseudomonas aeruginosa PA01
caggcaggccgggcug

SEQ ID NO: 1552996 - RNA, 19 nt, Pseudomonas aeruginosa PA01
caggcaggccgggcuggcc

SEQ ID NO: 1552997 - RNA, 20 nt, Pseudomonas aeruginosa PA01
caggcaggccgggcuggcca

SEQ ID NO: 1552998 - RNA, 16 nt, Pseudomonas aeruginosa PA01
caggcaggccugggca

SEQ ID NO: 1552999 - RNA, 17 nt, Pseudomonas aeruginosa PA01
caggcaggcgaugaccg

SEQ ID NO: 1553000 - RNA, 13 nt, Pseudomonas aeruginosa PA01
caggcagucccag

SEQ ID NO: 1553001 - RNA, 20 nt, Pseudomonas aeruginosa PA01
caggcaguccuugagcgcca

SEQ ID NO: 1553002 - RNA, 21 nt, Pseudomonas aeruginosa PA01
caggcaguccuugagcgccag

SEQ ID NO: 1553003 - RNA, 23 nt, Pseudomonas aeruginosa PA01
caggcaguccuugagcgccagca

SEQ ID NO: 1553004 - RNA, 15 nt, Pseudomonas aeruginosa PA01
caggcaguggcgcca

SEQ ID NO: 1553005 - RNA, 16 nt, Pseudomonas aeruginosa PA01
caggcagugccgggcg

SEQ ID NO: 1553006 - RNA, 17 nt, Pseudomonas aeruginosa PA01
caggcagugccgggcgu

SEQ ID NO: 1553007 - RNA, 14 nt, Pseudomonas aeruginosa PA01
caggccgagcaccg

SEQ ID NO: 1553008 - RNA, 19 nt, Pseudomonas aeruginosa PA01
caggccgagcccgagugcg

SEQ ID NO: 1553009 - RNA, 15 nt, Pseudomonas aeruginosa PA01
caggccgaaggccag

SEQ ID NO: 1553010 - RNA, 17 nt, Pseudomonas aeruginosa PA01
caggccgaaggccagga

SEQ ID NO: 1553011 - RNA, 18 nt, Pseudomonas aeruginosa PA01
caggccgacagcggcugg

SEQ ID NO: 1553012 - RNA, 17 nt, Pseudomonas aeruginosa PA01
caggccgaccagcgccg

SEQ ID NO: 1553013 - RNA, 20 nt, Pseudomonas aeruginosa PA01
caggccgagcgccagggcca

SEQ ID NO: 1553014 - RNA, 17 nt, Pseudomonas aeruginosa PA01
caggccgagcgcgccgc

SEQ ID NO: 1553015 - RNA, 18 nt, Pseudomonas aeruginosa PA01
caggccgagcgcgccgcc

SEQ ID NO: 1553016 - RNA, 17 nt, Pseudomonas aeruginosa PA01
caggccgaggaugcucg

SEQ ID NO: 1553017 - RNA, 20 nt, Pseudomonas aeruginosa PA01
caggccgagggcugccgccc

SEQ ID NO: 1553018 - RNA, 22 nt, Pseudomonas aeruginosa PA01
caggccgagggcugccgcccgg

SEQ ID NO: 1553019 - RNA, 24 nt, Pseudomonas aeruginosa PA01
caggccgagguuuccaguugcagg

SEQ ID NO: 1553020 - RNA, 23 nt, Pseudomonas aeruginosa PA01
caggccgaguccgcgcgcgcgcu

SEQ ID NO: 1553021 - RNA, 20 nt, Pseudomonas aeruginosa PA01
caggccgaucaccagcgcca

SEQ ID NO: 1553022 - RNA, 23 nt, Pseudomonas aeruginosa PA01
caggccgaucaccagcgccaggc

SEQ ID NO: 1553023 - RNA, 20 nt, Pseudomonas aeruginosa PA01
caggccgaucucguggaccc

SEQ ID NO: 1553024 - RNA, 16 nt, Pseudomonas aeruginosa PA01
caggccgaucaggaaa

SEQ ID NO: 1553025 - RNA, 13 nt, Pseudomonas aeruginosa PA01
caggccgcgcagc

SEQ ID NO: 1553026 - RNA, 17 nt, Pseudomonas aeruginosa PA01
caggccgcgcgauggcc

SEQ ID NO: 1553027 - RNA, 18 nt, Pseudomonas aeruginosa PA01
caggccgcugccgccgcg

SEQ ID NO: 1553028 - RNA, 16 nt, Pseudomonas aeruginosa PA01
caggccgcugccuguc

SEQ ID NO: 1553029 - RNA, 21 nt, Pseudomonas aeruginosa PA01
caggccgcggggaggaagcuc

SEQ ID NO: 1553030 - RNA, 17 nt, Pseudomonas aeruginosa PA01
caggccgcccaggacaa

SEQ ID NO: 1553031 - RNA, 18 nt, Pseudomonas aeruginosa PA01
caggccgauggccccggc

SEQ ID NO: 1553032 - RNA, 12 nt, Pseudomonas aeruginosa PA01
caggccgccaug

SEQ ID NO: 1553033 - RNA, 22 nt, Pseudomonas aeruginosa PA01
caggccgcccuugaccccaccg

SEQ ID NO: 1553034 - RNA, 18 nt, Pseudomonas aeruginosa PA01
caggccgccgagugugcc

SEQ ID NO: 1553035 - RNA, 21 nt, Pseudomonas aeruginosa PA01
caggccgccgauccaggaacc

SEQ ID NO: 1553036 - RNA, 16 nt, Pseudomonas aeruginosa PA01
caggccggcuaaccgc

SEQ ID NO: 1553037 - RNA, 19 nt, Pseudomonas aeruginosa PA01
caggccgggcggacgcugg

SEQ ID NO: 1553038 - RNA, 19 nt, Pseudomonas aeruginosa PA01
caggccgggcggcggcgcu

SEQ ID NO: 1553039 - RNA, 15 nt, Pseudomonas aeruginosa PA01
caggccgggcuggcc

SEQ ID NO: 1553040 - RNA, 14 nt, Pseudomonas aeruginosa PA01
caggccgggcaggc

SEQ ID NO: 1553041 - RNA, 22 nt, Pseudomonas aeruginosa PA01
caggccggugaucucgcggcgc

SEQ ID NO: 1553042 - RNA, 22 nt, Pseudomonas aeruginosa PA01
caggccguagaccaccagcagc

SEQ ID NO: 1553043 - RNA, 23 nt, Pseudomonas aeruginosa PA01
caggccguagaccaccagcagca

SEQ ID NO: 1553044 - RNA, 15 nt, Pseudomonas aeruginosa PA01
caggccggcgagcca

SEQ ID NO: 1553045 - RNA, 15 nt, Pseudomonas aeruginosa PA01
caggccggccagccu

SEQ ID NO: 1553046 - RNA, 16 nt, Pseudomonas aeruginosa PA01
caggccggccuccagc

SEQ ID NO: 1553047 - RNA, 17 nt, Pseudomonas aeruginosa PA01
caggccggccuccagcg

SEQ ID NO: 1553048 - RNA, 19 nt, Pseudomonas aeruginosa PA01
caggccggccuccagcgcc

SEQ ID NO: 1553049 - RNA, 23 nt, Pseudomonas aeruginosa PA01
caggccggcgccuugcgccaggc

SEQ ID NO: 1553050 - RNA, 19 nt, Pseudomonas aeruginosa PA01
caggccggcgcgauccugg

SEQ ID NO: 1553051 - RNA, 23 nt, Pseudomonas aeruginosa PA01
caggccggcgcgauccuggcggc

SEQ ID NO: 1553052 - RNA, 15 nt, Pseudomonas aeruginosa PA01
caggccggcgccgcc

SEQ ID NO: 1553053 - RNA, 18 nt, Pseudomonas aeruginosa PA01
caggcggggucagagggu

SEQ ID NO: 1553054 - RNA, 22 nt, Pseudomonas aeruginosa PA01
caggcgggcgaaguagaagcgc

SEQ ID NO: 1553055 - RNA, 16 nt, Pseudomonas aeruginosa PA01
caggcgcuccagggca

SEQ ID NO: 1553056 - RNA, 16 nt, Pseudomonas aeruginosa PA01
caggcgugggccagcc

SEQ ID NO: 1553057 - RNA, 22 nt, Pseudomonas aeruginosa PA01
caggcgugggccagcccagaac

SEQ ID NO: 1553058 - RNA, 16 nt, Pseudomonas aeruginosa PA01
caggcgguagcgccgc

SEQ ID NO: 1553059 - RNA, 20 nt, Pseudomonas aeruginosa PA01
caggcgguagcgccgcgcca

SEQ ID NO: 1553060 - RNA, 17 nt, Pseudomonas aeruginosa PA01
caggcgcuccuccagcg

SEQ ID NO: 1553061 - RNA, 21 nt, Pseudomonas aeruginosa PA01
caggcgcuccuccagcgccgc

SEQ ID NO: 1553062 - RNA, 20 nt, Pseudomonas aeruginosa PA01
caggcgcuccuugagcagcu

SEQ ID NO: 1553063 - RNA, 22 nt, Pseudomonas aeruginosa PA01
caggcguucgucguggccauag

SEQ ID NO: 1553064 - RNA, 21 nt, Pseudomonas aeruginosa PA01
caggcguugcagugcgccgca

SEQ ID NO: 1553065 - RNA, 15 nt, Pseudomonas aeruginosa PA01
caggcguggggcgaa

SEQ ID NO: 1553066 - RNA, 17 nt, Pseudomonas aeruginosa PA01
caggcguuauccgccgc

SEQ ID NO: 1553067 - RNA, 15 nt, Pseudomonas aeruginosa PA01
caggcguuccaccag

SEQ ID NO: 1553068 - RNA, 16 nt, Pseudomonas aeruginosa PA01
caggcguuccaccagg

SEQ ID NO: 1553069 - RNA, 20 nt, Pseudomonas aeruginosa PA01
caggcgcgaacgcucccagc

SEQ ID NO: 1553070 - RNA, 14 nt, Pseudomonas aeruginosa PA01
caggcgcgccaggc

SEQ ID NO: 1553071 - RNA, 17 nt, Pseudomonas aeruginosa PA01
caggcgcgcggccagcg

SEQ ID NO: 1553072 - RNA, 21 nt, Pseudomonas aeruginosa PA01
caggcgcuccgggcuccacca

SEQ ID NO: 1553073 - RNA, 19 nt, Pseudomonas aeruginosa PA01
caggcgcgcuggaugcccu

SEQ ID NO: 1553074 - RNA, 15 nt, Pseudomonas aeruginosa PA01
caggcgcggcgccuu

SEQ ID NO: 1553075 - RNA, 16 nt, Pseudomonas aeruginosa PA01
caggcgcggcgccuuc

SEQ ID NO: 1553076 - RNA, 18 nt, Pseudomonas aeruginosa PA01
caggcgcgucgcggccuc

SEQ ID NO: 1553077 - RNA, 16 nt, Pseudomonas aeruginosa PA01
caggcgcgucuccagc

SEQ ID NO: 1553078 - RNA, 22 nt, Pseudomonas aeruginosa PA01
caggcgccagguagugccgccc

SEQ ID NO: 1553079 - RNA, 17 nt, Pseudomonas aeruginosa PA01
caggcgcaugcccaggg

SEQ ID NO: 1553080 - RNA, 13 nt, Pseudomonas aeruginosa PA01
caggcgcauggcg

SEQ ID NO: 1553081 - RNA, 16 nt, Pseudomonas aeruginosa PA01
caggcgcaggggcgag

SEQ ID NO: 1553082 - RNA, 13 nt, Pseudomonas aeruginosa PA01
caggcgcccaggc

SEQ ID NO: 1553083 - RNA, 14 nt, Pseudomonas aeruginosa PA01
caggcgcccaggca

SEQ ID NO: 1553084 - RNA, 15 nt, Pseudomonas aeruginosa PA01
caggcgcccaggcag

SEQ ID NO: 1553085 - RNA, 18 nt, Pseudomonas aeruginosa PA01
caggcgcccgguggaggu

SEQ ID NO: 1553086 - RNA, 14 nt, Pseudomonas aeruginosa PA01
caggcgccggacca

SEQ ID NO: 1553087 - RNA, 14 nt, Pseudomonas aeruginosa PA01
caggcgccggccuc

SEQ ID NO: 1553088 - RNA, 19 nt, Pseudomonas aeruginosa PA01
caggcgccgaugcccaggc

SEQ ID NO: 1553089 - RNA, 22 nt, Pseudomonas aeruginosa PA01
caggccgugggccggcgcgccg

SEQ ID NO: 1553090 - RNA, 18 nt, Pseudomonas aeruginosa PA01
caggguaccgaaacaggg

SEQ ID NO: 1553091 - RNA, 22 nt, Pseudomonas aeruginosa PA01
caggguacuucgugccacaggc

SEQ ID NO: 1553092 - RNA, 20 nt, Pseudomonas aeruginosa PA01
caggguagcgccgcgggcca

SEQ ID NO: 1553093 - RNA, 24 nt, Pseudomonas aeruginosa PA01
caggguagcgccgcgggccagccg

SEQ ID NO: 1553094 - RNA, 16 nt, Pseudomonas aeruginosa PA01
cagggguucgaguccc

SEQ ID NO: 1553095 - RNA, 17 nt, Pseudomonas aeruginosa PA01
cagggucggcaccugca

SEQ ID NO: 1553096 - RNA, 14 nt, Pseudomonas aeruginosa PA01
cagggucgggccgc

SEQ ID NO: 1553097 - RNA, 21 nt, Pseudomonas aeruginosa PA01
cagggucuccaggaccaguuc

SEQ ID NO: 1553098 - RNA, 16 nt, Pseudomonas aeruginosa PA01
cagggucagucgagca

SEQ ID NO: 1553099 - RNA, 16 nt, Pseudomonas aeruginosa PA01
cagggucaugaugccu

SEQ ID NO: 1553100 - RNA, 18 nt, Pseudomonas aeruginosa PA01
cagggucagcagcgccag

SEQ ID NO: 1553101 - RNA, 16 nt, Pseudomonas aeruginosa PA01
cagggucagcucgaca

SEQ ID NO: 1553102 - RNA, 18 nt, Pseudomonas aeruginosa PA01
cagggucacgccgcggcu

SEQ ID NO: 1553103 - RNA, 20 nt, Pseudomonas aeruginosa PA01
caggguauuuuccagcaggc

SEQ ID NO: 1553104 - RNA, 18 nt, Pseudomonas aeruginosa PA01
cagggugcugaccuucac

SEQ ID NO: 1553105 - RNA, 16 nt, Pseudomonas aeruginosa PA01
caggguggcgcgcacc

SEQ ID NO: 1553106 - RNA, 20 nt, Pseudomonas aeruginosa PA01
caggguggcgcgcaccaccu

SEQ ID NO: 1553107 - RNA, 23 nt, Pseudomonas aeruginosa PA01
caggguggcgcgcaccaccuggc

SEQ ID NO: 1553108 - RNA, 18 nt, Pseudomonas aeruginosa PA01
caggguggcggcggcgag

SEQ ID NO: 1553109 - RNA, 22 nt, Pseudomonas aeruginosa PA01
caggguggcguuuucccaggug

SEQ ID NO: 1553110 - RNA, 23 nt, Pseudomonas aeruginosa PA01
cagggugcgauggaugcgcggca

SEQ ID NO: 1553111 - RNA, 16 nt, Pseudomonas aeruginosa PA01
cagggucgccagcagg

SEQ ID NO: 1553112 - RNA, 13 nt, Pseudomonas aeruginosa PA01
caggggcgcgccg

SEQ ID NO: 1553113 - RNA, 17 nt, Pseudomonas aeruginosa PA01
caggggcuagucgcgca

SEQ ID NO: 1553114 - RNA, 14 nt, Pseudomonas aeruginosa PA01
caggggucaggccg

SEQ ID NO: 1553115 - RNA, 22 nt, Pseudomonas aeruginosa PA01
caggggucgacgcagggcggcg

SEQ ID NO: 1553116 - RNA, 16 nt, Pseudomonas aeruginosa PA01
cagggcuugcgcgcca

SEQ ID NO: 1553117 - RNA, 20 nt, Pseudomonas aeruginosa PA01
cagggcuugcgcgccaccag

SEQ ID NO: 1553118 - RNA, 18 nt, Pseudomonas aeruginosa PA01
caggggcauguccaccgc

SEQ ID NO: 1553119 - RNA, 19 nt, Pseudomonas aeruginosa PA01
caggggcauguccaccgcc

SEQ ID NO: 1553120 - RNA, 21 nt, Pseudomonas aeruginosa PA01
cagggcggcgccgaacagggc

SEQ ID NO: 1553121 - RNA, 22 nt, Pseudomonas aeruginosa PA01
cagggcggcgccuggagcagaa

SEQ ID NO: 1553122 - RNA, 18 nt, Pseudomonas aeruginosa PA01
cagggcguagcggaagcc

SEQ ID NO: 1553123 - RNA, 21 nt, Pseudomonas aeruginosa PA01
cagggcguagcggaagccguc

SEQ ID NO: 1553124 - RNA, 20 nt, Pseudomonas aeruginosa PA01
cagggcugcuguugccaggg

SEQ ID NO: 1553125 - RNA, 15 nt, Pseudomonas aeruginosa PA01
cagggcuucccaggc

SEQ ID NO: 1553126 - RNA, 16 nt, Pseudomonas aeruginosa PA01
cagggcuucccaggcc

SEQ ID NO: 1553127 - RNA, 17 nt, Pseudomonas aeruginosa PA01
cagggcuucccaggcca

SEQ ID NO: 1553128 - RNA, 16 nt, Pseudomonas aeruginosa PA01
cagggcuucgcgcaga

SEQ ID NO: 1553129 - RNA, 16 nt, Pseudomonas aeruginosa PA01
cagggcugccaccgag

SEQ ID NO: 1553130 - RNA, 21 nt, Pseudomonas aeruginosa PA01
cagggcguggucggcggccuc

SEQ ID NO: 1553131 - RNA, 17 nt, Pseudomonas aeruginosa PA01
cagggcguucuucaccc

SEQ ID NO: 1553132 - RNA, 14 nt, Pseudomonas aeruginosa PA01
cagggcggcgcgga

SEQ ID NO: 1553133 - RNA, 18 nt, Pseudomonas aeruginosa PA01
cagggcgucggcgugcug

SEQ ID NO: 1553134 - RNA, 22 nt, Pseudomonas aeruginosa PA01
cagggcgucgucgaggcugucg

SEQ ID NO: 1553135 - RNA, 22 nt, Pseudomonas aeruginosa PA01
cagggcagggaguccgccagcc

SEQ ID NO: 1553136 - RNA, 22 nt, Pseudomonas aeruginosa PA01
cagggcauuggccaucagcgcc

SEQ ID NO: 1553137 - RNA, 23 nt, Pseudomonas aeruginosa PA01
cagggcauuggccaucagcgccg

SEQ ID NO: 1553138 - RNA, 23 nt, Pseudomonas aeruginosa PA01
cagggcauguuccuccagagugc

SEQ ID NO: 1553139 - RNA, 14 nt, Pseudomonas aeruginosa PA01
cagggcauggguca

SEQ ID NO: 1553140 - RNA, 15 nt, Pseudomonas aeruginosa PA01
cagggcaacgccagg

SEQ ID NO: 1553141 - RNA, 12 nt, Pseudomonas aeruginosa PA01
cagggagaacag

SEQ ID NO: 1553142 - RNA, 13 nt, Pseudomonas aeruginosa PA01
cagggagaacagc

SEQ ID NO: 1553143 - RNA, 18 nt, Pseudomonas aeruginosa PA01
cagggagaacagcagggu

SEQ ID NO: 1553144 - RNA, 14 nt, Pseudomonas aeruginosa PA01
cagggcaccacgga

SEQ ID NO: 1553145 - RNA, 21 nt, Pseudomonas aeruginosa PA01
cagggcaccgccgaggaacau

SEQ ID NO: 1553146 - RNA, 19 nt, Pseudomonas aeruginosa PA01
caggcucaguucggccagc

SEQ ID NO: 1553147 - RNA, 23 nt, Pseudomonas aeruginosa PA01
caggcucagggucucgcgggcgu

SEQ ID NO: 1553148 - RNA, 12 nt, Pseudomonas aeruginosa PA01
cagggaaaucag

SEQ ID NO: 1553149 - RNA, 20 nt, Pseudomonas aeruginosa PA01
caggcucgaacgguggcccc

SEQ ID NO: 1553150 - RNA, 11 nt, Pseudomonas aeruginosa PA01
caggcucgaca

SEQ ID NO: 1553151 - RNA, 20 nt, Pseudomonas aeruginosa PA01
cagggaauggaugcgcggca

SEQ ID NO: 1553152 - RNA, 17 nt, Pseudomonas aeruginosa PA01
cagggaagcgcgcgcca

SEQ ID NO: 1553153 - RNA, 21 nt, Pseudomonas aeruginosa PA01
cagggccggaugccaccgcuc

SEQ ID NO: 1553154 - RNA, 14 nt, Pseudomonas aeruginosa PA01
cagggccucgccac

SEQ ID NO: 1553155 - RNA, 14 nt, Pseudomonas aeruginosa PA01
cagggccucggggc

SEQ ID NO: 1553156 - RNA, 13 nt, Pseudomonas aeruginosa PA01
cagggccuugcug

SEQ ID NO: 1553157 - RNA, 21 nt, Pseudomonas aeruginosa PA01
cagggcgaagucggcgcgcca

SEQ ID NO: 1553158 - RNA, 18 nt, Pseudomonas aeruginosa PA01
cagggcgaauaccagugc

SEQ ID NO: 1553159 - RNA, 14 nt, Pseudomonas aeruginosa PA01
cagggcgaaggcca

SEQ ID NO: 1553160 - RNA, 15 nt, Pseudomonas aeruginosa PA01
cagggcgaaggccac

SEQ ID NO: 1553161 - RNA, 18 nt, Pseudomonas aeruginosa PA01
cagggcgaaggccaccau

SEQ ID NO: 1553162 - RNA, 18 nt, Pseudomonas aeruginosa PA01
cagggcgaaggucugccc

SEQ ID NO: 1553163 - RNA, 20 nt, Pseudomonas aeruginosa PA01
cagggcgccgaucaggcgua

SEQ ID NO: 1553164 - RNA, 23 nt, Pseudomonas aeruginosa PA01
cagggcgcgaaguagcgggagau

SEQ ID NO: 1553165 - RNA, 21 nt, Pseudomonas aeruginosa PA01
cagggcgcugccgaucagcca

SEQ ID NO: 1553166 - RNA, 15 nt, Pseudomonas aeruginosa PA01
cagggcgaggaucac

SEQ ID NO: 1553167 - RNA, 15 nt, Pseudomonas aeruginosa PA01
cagggcgaggccgcu

SEQ ID NO: 1553168 - RNA, 22 nt, Pseudomonas aeruginosa PA01
cagggcgacgccgaugcucggu

SEQ ID NO: 1553169 - RNA, 18 nt, Pseudomonas aeruginosa PA01
cagggcgaugaacaccgc

SEQ ID NO: 1553170 - RNA, 14 nt, Pseudomonas aeruginosa PA01
cagggccaggauga

SEQ ID NO: 1553171 - RNA, 11 nt, Pseudomonas aeruginosa PA01
cagggccaggc

SEQ ID NO: 1553172 - RNA, 15 nt, Pseudomonas aeruginosa PA01
cagggccagcgccug

SEQ ID NO: 1553173 - RNA, 17 nt, Pseudomonas aeruginosa PA01
cagggccagcgccuggc

SEQ ID NO: 1553174 - RNA, 15 nt, Pseudomonas aeruginosa PA01
cagggccagcggaac

SEQ ID NO: 1553175 - RNA, 13 nt, Pseudomonas aeruginosa PA01
cagggccagcagc

SEQ ID NO: 1553176 - RNA, 18 nt, Pseudomonas aeruginosa PA01
cagggcccacagugccag

SEQ ID NO: 1553177 - RNA, 17 nt, Pseudomonas aeruginosa PA01
cagggcccagagcagca

SEQ ID NO: 1553178 - RNA, 13 nt, Pseudomonas aeruginosa PA01
cagggccagggaa

SEQ ID NO: 1553179 - RNA, 18 nt, Pseudomonas aeruginosa PA01
cagggccagggaaaucag

SEQ ID NO: 1553180 - RNA, 18 nt, Pseudomonas aeruginosa PA01
cagggccagggcggcggc

SEQ ID NO: 1553181 - RNA, 13 nt, Pseudomonas aeruginosa PA01
cagggccaggccg

SEQ ID NO: 1553182 - RNA, 22 nt, Pseudomonas aeruginosa PA01
cagggccaggccgagcgcgccg

SEQ ID NO: 1553183 - RNA, 16 nt, Pseudomonas aeruginosa PA01
cagggccgccagccgc

SEQ ID NO: 1553184 - RNA, 17 nt, Pseudomonas aeruginosa PA01
cagggccgccagccgcc

SEQ ID NO: 1553185 - RNA, 23 nt, Pseudomonas aeruginosa PA01
cagggccgccagccgccaggacg

SEQ ID NO: 1553186 - RNA, 16 nt, Pseudomonas aeruginosa PA01
cagggccgagcgcagc

SEQ ID NO: 1553187 - RNA, 20 nt, Pseudomonas aeruginosa PA01
cagggccgagcgcagcgcca

SEQ ID NO: 1553188 - RNA, 21 nt, Pseudomonas aeruginosa PA01
cagcuccggcagcagggucag

SEQ ID NO: 1553189 - RNA, 16 nt, Pseudomonas aeruginosa PA01
cagcuccgccugaccg

SEQ ID NO: 1553190 - RNA, 14 nt, Pseudomonas aeruginosa PA01
cagcuccccguccc

SEQ ID NO: 1553191 - RNA, 13 nt, Pseudomonas aeruginosa PA01
cagcucgcccgcc

SEQ ID NO: 1553192 - RNA, 15 nt, Pseudomonas aeruginosa PA01
cagcucgcccgccuc

SEQ ID NO: 1553193 - RNA, 16 nt, Pseudomonas aeruginosa PA01
cagcucgccgcgcucc

SEQ ID NO: 1553194 - RNA, 18 nt, Pseudomonas aeruginosa PA01
cagcucgccgcuacccag

SEQ ID NO: 1553195 - RNA, 14 nt, Pseudomonas aeruginosa PA01
cagcucgccggcgu

SEQ ID NO: 1553196 - RNA, 20 nt, Pseudomonas aeruginosa PA01
cagcuccgucuguucggcca

SEQ ID NO: 1553197 - RNA, 12 nt, Pseudomonas aeruginosa PA01
cagcuccuccag

SEQ ID NO: 1553198 - RNA, 13 nt, Pseudomonas aeruginosa PA01
cagcuccuccagc

SEQ ID NO: 1553199 - RNA, 14 nt, Pseudomonas aeruginosa PA01
cagcuccuccagcg

SEQ ID NO: 1553200 - RNA, 14 nt, Pseudomonas aeruginosa PA01
cagcuccaccaggc

SEQ ID NO: 1553201 - RNA, 15 nt, Pseudomonas aeruginosa PA01
cagcuccaccaggcc

SEQ ID NO: 1553202 - RNA, 15 nt, Pseudomonas aeruginosa PA01
cagcuccaccgaugg

SEQ ID NO: 1553203 - RNA, 13 nt, Pseudomonas aeruginosa PA01
cagcuccagcagu

SEQ ID NO: 1553204 - RNA, 17 nt, Pseudomonas aeruginosa PA01
cagcuccagcgcccagg

SEQ ID NO: 1553205 - RNA, 18 nt, Pseudomonas aeruginosa PA01
cagcuccagcgcccaggu

SEQ ID NO: 1553206 - RNA, 20 nt, Pseudomonas aeruginosa PA01
cagcuccagcgcccaggugc

SEQ ID NO: 1553207 - RNA, 20 nt, Pseudomonas aeruginosa PA01
cagcuccaggccgcgggucu

SEQ ID NO: 1553208 - RNA, 12 nt, Pseudomonas aeruginosa PA01
cagcuccagcgg

SEQ ID NO: 1553209 - RNA, 22 nt, Pseudomonas aeruginosa PA01
cagcuccagcggaaucgcgccc

SEQ ID NO: 1553210 - RNA, 18 nt, Pseudomonas aeruginosa PA01
cagcuccauguccgaacg

SEQ ID NO: 1553211 - RNA, 20 nt, Pseudomonas aeruginosa PA01
cagcucauucguaaugagaa

SEQ ID NO: 1553212 - RNA, 21 nt, Pseudomonas aeruginosa PA01
cagcggcuccucggccugggc

SEQ ID NO: 1553213 - RNA, 19 nt, Pseudomonas aeruginosa PA01
cagcggcucacgccccagc

SEQ ID NO: 1553214 - RNA, 19 nt, Pseudomonas aeruginosa PA01
cagcggcuggccgucgacc

SEQ ID NO: 1553215 - RNA, 20 nt, Pseudomonas aeruginosa PA01
cagcggccuucgacgaugcg

SEQ ID NO: 1553216 - RNA, 15 nt, Pseudomonas aeruginosa PA01
cagcggcgacaccgc

SEQ ID NO: 1553217 - RNA, 14 nt, Pseudomonas aeruginosa PA01
cagcggcgcagccu

SEQ ID NO: 1553218 - RNA, 13 nt, Pseudomonas aeruginosa PA01
cagcggcgagcag

SEQ ID NO: 1553219 - RNA, 15 nt, Pseudomonas aeruginosa PA01
cagcggcgagcaggc

SEQ ID NO: 1553220 - RNA, 15 nt, Pseudomonas aeruginosa PA01
cagcggccgagcagg

SEQ ID NO: 1553221 - RNA, 15 nt, Pseudomonas aeruginosa PA01
cagcggcgccgaggg

SEQ ID NO: 1553222 - RNA, 23 nt, Pseudomonas aeruginosa PA01
cagcggcgcggcguaccagccgc

SEQ ID NO: 1553223 - RNA, 23 nt, Pseudomonas aeruginosa PA01
cagcggcggauacaggcgcagca

SEQ ID NO: 1553224 - RNA, 15 nt, Pseudomonas aeruginosa PA01
cagcggcgcgucgcu

SEQ ID NO: 1553225 - RNA, 16 nt, Pseudomonas aeruginosa PA01
cagcggcgcuuuccac

SEQ ID NO: 1553226 - RNA, 16 nt, Pseudomonas aeruginosa PA01
cagcuguccgcgccgc

SEQ ID NO: 1553227 - RNA, 17 nt, Pseudomonas aeruginosa PA01
cagcuguccgcgccgcg

SEQ ID NO: 1553228 - RNA, 13 nt, Pseudomonas aeruginosa PA01
cagcuucuugccu

SEQ ID NO: 1553229 - RNA, 18 nt, Pseudomonas aeruginosa PA01
cagcuucuugccuuccac

SEQ ID NO: 1553230 - RNA, 21 nt, Pseudomonas aeruginosa PA01
cagcuucagccgaccguccgc

SEQ ID NO: 1553231 - RNA, 13 nt, Pseudomonas aeruginosa PA01
cagcuucagggug

SEQ ID NO: 1553232 - RNA, 20 nt, Pseudomonas aeruginosa PA01
cagcucgcgguaggccagcu

SEQ ID NO: 1553233 - RNA, 21 nt, Pseudomonas aeruginosa PA01
cagcucggacaagggccagag

SEQ ID NO: 1553234 - RNA, 20 nt, Pseudomonas aeruginosa PA01
cagcucggccgagggcagcc

SEQ ID NO: 1553235 - RNA, 22 nt, Pseudomonas aeruginosa PA01
cagcucggcgaguaaccaccgc

SEQ ID NO: 1553236 - RNA, 18 nt, Pseudomonas aeruginosa PA01
cagcucguccaggcaagc

SEQ ID NO: 1553237 - RNA, 22 nt, Pseudomonas aeruginosa PA01
cagcucggcgcccuggccgcca

SEQ ID NO: 1553238 - RNA, 17 nt, Pseudomonas aeruginosa PA01
cagcucgucgcccuuca

SEQ ID NO: 1553239 - RNA, 15 nt, Pseudomonas aeruginosa PA01
cagcucguggcuggc

SEQ ID NO: 1553240 - RNA, 21 nt, Pseudomonas aeruginosa PA01
cagcucguggcuggcgccgcg

SEQ ID NO: 1553241 - RNA, 15 nt, Pseudomonas aeruginosa PA01
cagcucguccuuggu

SEQ ID NO: 1553242 - RNA, 13 nt, Pseudomonas aeruginosa PA01
cagcuggcgacgg

SEQ ID NO: 1553243 - RNA, 22 nt, Pseudomonas aeruginosa PA01
cagcuggauccgugccaggcgc

SEQ ID NO: 1553244 - RNA, 23 nt, Pseudomonas aeruginosa PA01
cagcuggauccgugccaggcgcu

SEQ ID NO: 1553245 - RNA, 18 nt, Pseudomonas aeruginosa PA01
caggacaacgacagcccc

SEQ ID NO: 1553246 - RNA, 20 nt, Pseudomonas aeruginosa PA01
caggacaacgacagccccgg

SEQ ID NO: 1553247 - RNA, 21 nt, Pseudomonas aeruginosa PA01
caggacaacgacagccccggc

SEQ ID NO: 1553248 - RNA, 13 nt, Pseudomonas aeruginosa PA01
caggacagcacgc

SEQ ID NO: 1553249 - RNA, 15 nt, Pseudomonas aeruginosa PA01
caggaauccuccgcc

SEQ ID NO: 1553250 - RNA, 19 nt, Pseudomonas aeruginosa PA01
caggaaucgacccagccgc

SEQ ID NO: 1553251 - RNA, 23 nt, Pseudomonas aeruginosa PA01
caggacgaugaucaccaggaccc

SEQ ID NO: 1553252 - RNA, 17 nt, Pseudomonas aeruginosa PA01
caggacgagcguccgcc

SEQ ID NO: 1553253 - RNA, 21 nt, Pseudomonas aeruginosa PA01
caggacgagcguccgccgccg

SEQ ID NO: 1553254 - RNA, 17 nt, Pseudomonas aeruginosa PA01
caggaccuugucgcgca

SEQ ID NO: 1553255 - RNA, 18 nt, Pseudomonas aeruginosa PA01
caggaccuucagauacuc

SEQ ID NO: 1553256 - RNA, 16 nt, Pseudomonas aeruginosa PA01
caggaccuuccgccag

SEQ ID NO: 1553257 - RNA, 20 nt, Pseudomonas aeruginosa PA01
caggaccuuccgccagcagg

SEQ ID NO: 1553258 - RNA, 17 nt, Pseudomonas aeruginosa PA01
caggaccucgaagcugg

SEQ ID NO: 1553259 - RNA, 19 nt, Pseudomonas aeruginosa PA01
caggaccucgaagcuggcc

SEQ ID NO: 1553260 - RNA, 20 nt, Pseudomonas aeruginosa PA01
caggaccucgaagcuggcca

SEQ ID NO: 1553261 - RNA, 16 nt, Pseudomonas aeruginosa PA01
caggaccucgggcgag

SEQ ID NO: 1553262 - RNA, 22 nt, Pseudomonas aeruginosa PA01
caggaccagacgcggauuggcc

SEQ ID NO: 1553263 - RNA, 18 nt, Pseudomonas aeruginosa PA01
caggaccaugucgcacug

SEQ ID NO: 1553264 - RNA, 23 nt, Pseudomonas aeruginosa PA01
caggaccaugucgcacuggucgg

SEQ ID NO: 1553265 - RNA, 16 nt, Pseudomonas aeruginosa PA01
caggaccgccauggcg

SEQ ID NO: 1553266 - RNA, 14 nt, Pseudomonas aeruginosa PA01
caggaccggcaggu

SEQ ID NO: 1553267 - RNA, 13 nt, Pseudomonas aeruginosa PA01
caggaaccggcca

SEQ ID NO: 1553268 - RNA, 21 nt, Pseudomonas aeruginosa PA01
caggaacgcccgcggcagcag

SEQ ID NO: 1553269 - RNA, 22 nt, Pseudomonas aeruginosa PA01
caggaacgcccgcggcagcagc

SEQ ID NO: 1553270 - RNA, 15 nt, Pseudomonas aeruginosa PA01
caggaacgcccuugu

SEQ ID NO: 1553271 - RNA, 23 nt, Pseudomonas aeruginosa PA01
cagcuugacgaucuucugcaccc

SEQ ID NO: 1553272 - RNA, 22 nt, Pseudomonas aeruginosa PA01
cagcuugccgcaggucuugucg

SEQ ID NO: 1553273 - RNA, 17 nt, Pseudomonas aeruginosa PA01
caggaaggccuggaaca

SEQ ID NO: 1553274 - RNA, 17 nt, Pseudomonas aeruginosa PA01
caggaagcgucgugcgc

SEQ ID NO: 1553275 - RNA, 20 nt, Pseudomonas aeruginosa PA01
caggaagcucggcagcacgc

SEQ ID NO: 1553276 - RNA, 17 nt, Pseudomonas aeruginosa PA01
caggaagccgcgcccca

SEQ ID NO: 1553277 - RNA, 23 nt, Pseudomonas aeruginosa PA01
caggaagcgcgggaauucuuccg

SEQ ID NO: 1553278 - RNA, 13 nt, Pseudomonas aeruginosa PA01
caggaagcgccgg

SEQ ID NO: 1553279 - RNA, 19 nt, Pseudomonas aeruginosa PA01
caggaagcgccgggccgca

SEQ ID NO: 1553280 - RNA, 19 nt, Pseudomonas aeruginosa PA01
caggacgcuccugcgccgg

SEQ ID NO: 1553281 - RNA, 13 nt, Pseudomonas aeruginosa PA01
caggacggcaggg

SEQ ID NO: 1553282 - RNA, 15 nt, Pseudomonas aeruginosa PA01
caggacggcaggguc

SEQ ID NO: 1553283 - RNA, 15 nt, Pseudomonas aeruginosa PA01
caggagcaucggcgc

SEQ ID NO: 1553284 - RNA, 18 nt, Pseudomonas aeruginosa PA01
caggagcaugaaggucga

SEQ ID NO: 1553285 - RNA, 15 nt, Pseudomonas aeruginosa PA01
caggagaagcgccuc

SEQ ID NO: 1553286 - RNA, 16 nt, Pseudomonas aeruginosa PA01
caggaucgaacuggcc

SEQ ID NO: 1553287 - RNA, 17 nt, Pseudomonas aeruginosa PA01
caggaucgacagcagcg

SEQ ID NO: 1553288 - RNA, 15 nt, Pseudomonas aeruginosa PA01
caggagggcugcugu

SEQ ID NO: 1553289 - RNA, 17 nt, Pseudomonas aeruginosa PA01
caggagcgccagcacca

SEQ ID NO: 1553290 - RNA, 15 nt, Pseudomonas aeruginosa PA01
caggagcgccgcgca

SEQ ID NO: 1553291 - RNA, 20 nt, Pseudomonas aeruginosa PA01
caggagcguugcgggcaggu

SEQ ID NO: 1553292 - RNA, 20 nt, Pseudomonas aeruginosa PA01
caggaggcccacgggcggcc

SEQ ID NO: 1553293 - RNA, 17 nt, Pseudomonas aeruginosa PA01
caggauguccuuguucg

SEQ ID NO: 1553294 - RNA, 16 nt, Pseudomonas aeruginosa PA01
caggauguggccgucg

SEQ ID NO: 1553295 - RNA, 21 nt, Pseudomonas aeruginosa PA01
caggaucggcgcccagcacca

SEQ ID NO: 1553296 - RNA, 20 nt, Pseudomonas aeruginosa PA01
caggaguuucaucucggcgc

SEQ ID NO: 1553297 - RNA, 21 nt, Pseudomonas aeruginosa PA01
caggaucugcugcaacauggc

SEQ ID NO: 1553298 - RNA, 22 nt, Pseudomonas aeruginosa PA01
caggaucugcugcaacauggcg

SEQ ID NO: 1553299 - RNA, 21 nt, Pseudomonas aeruginosa PA01
caggauguucgccgaggggcg

SEQ ID NO: 1553300 - RNA, 19 nt, Pseudomonas aeruginosa PA01
caggauguugaacaggcuc

SEQ ID NO: 1553301 - RNA, 18 nt, Pseudomonas aeruginosa PA01
caggauguugacgauggc

SEQ ID NO: 1553302 - RNA, 19 nt, Pseudomonas aeruginosa PA01
caggauguugacgauggcc

SEQ ID NO: 1553303 - RNA, 21 nt, Pseudomonas aeruginosa PA01
caggauguugacgauggccca

SEQ ID NO: 1553304 - RNA, 23 nt, Pseudomonas aeruginosa PA01
caggauguugacgauggcccaga

SEQ ID NO: 1553305 - RNA, 19 nt, Pseudomonas aeruginosa PA01
caggcagaccagcgcaagc

SEQ ID NO: 1553306 - RNA, 17 nt, Pseudomonas aeruginosa PA01
caggcagaccugcagca

SEQ ID NO: 1553307 - RNA, 15 nt, Pseudomonas aeruginosa PA01
cagucggccaggcgc

SEQ ID NO: 1553308 - RNA, 15 nt, Pseudomonas aeruginosa PA01
cagucgggcucagaa

SEQ ID NO: 1553309 - RNA, 14 nt, Pseudomonas aeruginosa PA01
cagucggggcaggc

SEQ ID NO: 1553310 - RNA, 15 nt, Pseudomonas aeruginosa PA01
cagucggccguugcg

SEQ ID NO: 1553311 - RNA, 20 nt, Pseudomonas aeruginosa PA01
cagucggccguugcgggcga

SEQ ID NO: 1553312 - RNA, 19 nt, Pseudomonas aeruginosa PA01
cagucguagcgcaguugcc

SEQ ID NO: 1553313 - RNA, 18 nt, Pseudomonas aeruginosa PA01
cagucgguagaaauccuc

SEQ ID NO: 1553314 - RNA, 21 nt, Pseudomonas aeruginosa PA01
cagucgucguccagcgggccc

SEQ ID NO: 1553315 - RNA, 21 nt, Pseudomonas aeruginosa PA01
caguccuggcgguagcccggc

SEQ ID NO: 1553316 - RNA, 19 nt, Pseudomonas aeruginosa PA01
cagucgagacgccagccgc

SEQ ID NO: 1553317 - RNA, 18 nt, Pseudomonas aeruginosa PA01
cagucgaaaaccggcggg

SEQ ID NO: 1553318 - RNA, 20 nt, Pseudomonas aeruginosa PA01
cagucgaugacgaggcccgc

SEQ ID NO: 1553319 - RNA, 21 nt, Pseudomonas aeruginosa PA01
cagucgaccgucgccacgcuc

SEQ ID NO: 1553320 - RNA, 12 nt, Pseudomonas aeruginosa PA01
cagucgcccgcu

SEQ ID NO: 1553321 - RNA, 16 nt, Pseudomonas aeruginosa PA01
cagucgcccccaccgc

SEQ ID NO: 1553322 - RNA, 18 nt, Pseudomonas aeruginosa PA01
cagucgcccccaccgccc

SEQ ID NO: 1553323 - RNA, 16 nt, Pseudomonas aeruginosa PA01
cagucaggaucggcgc

SEQ ID NO: 1553324 - RNA, 22 nt, Pseudomonas aeruginosa PA01
caguggaauucgaugaaauagc

SEQ ID NO: 1553325 - RNA, 14 nt, Pseudomonas aeruginosa PA01
cagugcaucggccg

SEQ ID NO: 1553326 - RNA, 23 nt, Pseudomonas aeruginosa PA01
cagugacauccucccugcccgcu

SEQ ID NO: 1553327 - RNA, 21 nt, Pseudomonas aeruginosa PA01
caguaguccuccgcgcccagg

SEQ ID NO: 1553328 - RNA, 22 nt, Pseudomonas aeruginosa PA01
caguaguccuccgcgcccaggc

SEQ ID NO: 1553329 - RNA, 16 nt, Pseudomonas aeruginosa PA01
caguagagauguacag

SEQ ID NO: 1553330 - RNA, 20 nt, Pseudomonas aeruginosa PA01
caguacucuggccauagaaa

SEQ ID NO: 1553331 - RNA, 16 nt, Pseudomonas aeruginosa PA01
caguaccggcagcgcc

SEQ ID NO: 1553332 - RNA, 18 nt, Pseudomonas aeruginosa PA01
caguacccgcugguaauc

SEQ ID NO: 1553333 - RNA, 18 nt, Pseudomonas aeruginosa PA01
caguacagcucggcgccc

SEQ ID NO: 1553334 - RNA, 15 nt, Pseudomonas aeruginosa PA01
caguaccagcaaugc

SEQ ID NO: 1553335 - RNA, 13 nt, Pseudomonas aeruginosa PA01
cagguuggccugg

SEQ ID NO: 1553336 - RNA, 20 nt, Pseudomonas aeruginosa PA01
cagguugcuggcgaggaaca

SEQ ID NO: 1553337 - RNA, 22 nt, Pseudomonas aeruginosa PA01
cagguugcgcuggcgcagcagc

SEQ ID NO: 1553338 - RNA, 13 nt, Pseudomonas aeruginosa PA01
cagguugcccggc

SEQ ID NO: 1553339 - RNA, 23 nt, Pseudomonas aeruginosa PA01
cagguguucggccccggccaggu

SEQ ID NO: 1553340 - RNA, 20 nt, Pseudomonas aeruginosa PA01
cagguguucggcggcgugca

SEQ ID NO: 1553341 - RNA, 18 nt, Pseudomonas aeruginosa PA01
cagguggucgaucuccuc

SEQ ID NO: 1553342 - RNA, 23 nt, Pseudomonas aeruginosa PA01
caggugguggcggaucugcucga

SEQ ID NO: 1553343 - RNA, 20 nt, Pseudomonas aeruginosa PA01
caggugggucacgucggcgu

SEQ ID NO: 1553344 - RNA, 13 nt, Pseudomonas aeruginosa PA01
caggguuggaaga

SEQ ID NO: 1553345 - RNA, 13 nt, Pseudomonas aeruginosa PA01
caggguugggcga

SEQ ID NO: 1553346 - RNA, 16 nt, Pseudomonas aeruginosa PA01
caggguuuccagcagc

SEQ ID NO: 1553347 - RNA, 17 nt, Pseudomonas aeruginosa PA01
caggguucggggaacag

SEQ ID NO: 1553348 - RNA, 16 nt, Pseudomonas aeruginosa PA01
cagguggcaggccugg

SEQ ID NO: 1553349 - RNA, 17 nt, Pseudomonas aeruginosa PA01
cagguggaucgcggcgu

SEQ ID NO: 1553350 - RNA, 13 nt, Pseudomonas aeruginosa PA01
cagguggaagcgc

SEQ ID NO: 1553351 - RNA, 16 nt, Pseudomonas aeruginosa PA01
cagguggcuggccaug

SEQ ID NO: 1553352 - RNA, 13 nt, Pseudomonas aeruginosa PA01
cagguggcuuucc

SEQ ID NO: 1553353 - RNA, 15 nt, Pseudomonas aeruginosa PA01
caggugggccacuuc

SEQ ID NO: 1553354 - RNA, 21 nt, Pseudomonas aeruginosa PA01
caggugcguacuuggcccggc

SEQ ID NO: 1553355 - RNA, 20 nt, Pseudomonas aeruginosa PA01
caggugcuggucguggucca

SEQ ID NO: 1553356 - RNA, 21 nt, Pseudomonas aeruginosa PA01
caggugcugguggcccugggc

SEQ ID NO: 1553357 - RNA, 22 nt, Pseudomonas aeruginosa PA01
caggugcuuggcuucgagcugc

SEQ ID NO: 1553358 - RNA, 17 nt, Pseudomonas aeruginosa PA01
caggugcgccgagcgcu

SEQ ID NO: 1553359 - RNA, 17 nt, Pseudomonas aeruginosa PA01
caggugcggcugggugu

SEQ ID NO: 1553360 - RNA, 19 nt, Pseudomonas aeruginosa PA01
caguugagucgcgcgcgcu

SEQ ID NO: 1553361 - RNA, 14 nt, Pseudomonas aeruginosa PA01
caguugagcugugg

SEQ ID NO: 1553362 - RNA, 18 nt, Pseudomonas aeruginosa PA01
caguucugggcggccagg

SEQ ID NO: 1553363 - RNA, 17 nt, Pseudomonas aeruginosa PA01
caguucucgcagcaggc

SEQ ID NO: 1553364 - RNA, 15 nt, Pseudomonas aeruginosa PA01
caguugccaggagga

SEQ ID NO: 1553365 - RNA, 18 nt, Pseudomonas aeruginosa PA01
caguuggacgcggccugg

SEQ ID NO: 1553366 - RNA, 12 nt, Pseudomonas aeruginosa PA01
caguugccucug

SEQ ID NO: 1553367 - RNA, 16 nt, Pseudomonas aeruginosa PA01
caguugccucugugcg

SEQ ID NO: 1553368 - RNA, 13 nt, Pseudomonas aeruginosa PA01
caguugcagggau

SEQ ID NO: 1553369 - RNA, 20 nt, Pseudomonas aeruginosa PA01
caguugcaacagcgcggcgg

SEQ ID NO: 1553370 - RNA, 13 nt, Pseudomonas aeruginosa PA01
caguugggccagg

SEQ ID NO: 1553371 - RNA, 15 nt, Pseudomonas aeruginosa PA01
cauacuccgccgcuu

SEQ ID NO: 1553372 - RNA, 13 nt, Pseudomonas aeruginosa PA01
cauaccuccagcc

SEQ ID NO: 1553373 - RNA, 15 nt, Pseudomonas aeruginosa PA01
caugcgggagagcgc

SEQ ID NO: 1553374 - RNA, 13 nt, Pseudomonas aeruginosa PA01
caugcggcuacuc

SEQ ID NO: 1553375 - RNA, 23 nt, Pseudomonas aeruginosa PA01
caugcgcugguagcgcuccagcu

SEQ ID NO: 1553376 - RNA, 13 nt, Pseudomonas aeruginosa PA01
caugcggccccgg

SEQ ID NO: 1553377 - RNA, 19 nt, Pseudomonas aeruginosa PA01
caugcggcaggccuuccac

SEQ ID NO: 1553378 - RNA, 13 nt, Pseudomonas aeruginosa PA01
cauggagcaacag

SEQ ID NO: 1553379 - RNA, 14 nt, Pseudomonas aeruginosa PA01
cauggagcaacagc

SEQ ID NO: 1553380 - RNA, 17 nt, Pseudomonas aeruginosa PA01
cauggagacggcccgcc

SEQ ID NO: 1553381 - RNA, 18 nt, Pseudomonas aeruginosa PA01
cauggagacggcccgccc

SEQ ID NO: 1553382 - RNA, 22 nt, Pseudomonas aeruginosa PA01
cauggaaaccccggccuggcgc

SEQ ID NO: 1553383 - RNA, 15 nt, Pseudomonas aeruginosa PA01
cauggaacagcagcc

SEQ ID NO: 1553384 - RNA, 18 nt, Pseudomonas aeruginosa PA01
cauggaacagcagccagg

SEQ ID NO: 1553385 - RNA, 22 nt, Pseudomonas aeruginosa PA01
caugcuugccgguuuguugcag

SEQ ID NO: 1553386 - RNA, 15 nt, Pseudomonas aeruginosa PA01
caugggcgcgcgccg

SEQ ID NO: 1553387 - RNA, 12 nt, Pseudomonas aeruginosa PA01
caugggccgcgc

SEQ ID NO: 1553388 - RNA, 19 nt, Pseudomonas aeruginosa PA01
caugggccgcgcagaucgc

SEQ ID NO: 1553389 - RNA, 23 nt, Pseudomonas aeruginosa PA01
caugggcacgccgguggccaggc

SEQ ID NO: 1553390 - RNA, 16 nt, Pseudomonas aeruginosa PA01
caugggcauccugccg

SEQ ID NO: 1553391 - RNA, 19 nt, Pseudomonas aeruginosa PA01
caugggcauccugccgccu

SEQ ID NO: 1553392 - RNA, 13 nt, Pseudomonas aeruginosa PA01
cauggcuggcgcu

SEQ ID NO: 1553393 - RNA, 20 nt, Pseudomonas aeruginosa PA01
cauggcuguagcucugcugg

SEQ ID NO: 1553394 - RNA, 20 nt, Pseudomonas aeruginosa PA01
caugggaaccucggcaggcu

SEQ ID NO: 1553395 - RNA, 24 nt, Pseudomonas aeruginosa PA01
caugggacaaacgauugcggcaga

SEQ ID NO: 1553396 - RNA, 18 nt, Pseudomonas aeruginosa PA01
cauggcaccgucaagggc

SEQ ID NO: 1553397 - RNA, 17 nt, Pseudomonas aeruginosa PA01
cauggaucaccgccaag

SEQ ID NO: 1553398 - RNA, 16 nt, Pseudomonas aeruginosa PA01
caugccuagcacccgg

SEQ ID NO: 1553399 - RNA, 22 nt, Pseudomonas aeruginosa PA01
caugccugcuuucccugcugcg

SEQ ID NO: 1553400 - RNA, 11 nt, Pseudomonas aeruginosa PA01
caugcgcggcg

SEQ ID NO: 1553401 - RNA, 12 nt, Pseudomonas aeruginosa PA01
caugccuccgac

SEQ ID NO: 1553402 - RNA, 18 nt, Pseudomonas aeruginosa PA01
caugccgugggcgccgcc

SEQ ID NO: 1553403 - RNA, 15 nt, Pseudomonas aeruginosa PA01
caugccguugggcca

SEQ ID NO: 1553404 - RNA, 18 nt, Pseudomonas aeruginosa PA01
caugccguugggccaggg

SEQ ID NO: 1553405 - RNA, 20 nt, Pseudomonas aeruginosa PA01
caugccguugggccagggcc

SEQ ID NO: 1553406 - RNA, 18 nt, Pseudomonas aeruginosa PA01
caugcccuuguccggccc

SEQ ID NO: 1553407 - RNA, 13 nt, Pseudomonas aeruginosa PA01
caugcccuugucg

SEQ ID NO: 1553408 - RNA, 21 nt, Pseudomonas aeruginosa PA01
caugcccuugucgcccuucuu

SEQ ID NO: 1553409 - RNA, 19 nt, Pseudomonas aeruginosa PA01
caugccguagaucaggacg

SEQ ID NO: 1553410 - RNA, 20 nt, Pseudomonas aeruginosa PA01
caugccggggaaccacaccu

SEQ ID NO: 1553411 - RNA, 13 nt, Pseudomonas aeruginosa PA01
caugccggggucc

SEQ ID NO: 1553412 - RNA, 15 nt, Pseudomonas aeruginosa PA01
caugcccggccuggc

SEQ ID NO: 1553413 - RNA, 13 nt, Pseudomonas aeruginosa PA01
caugcccgccccg

SEQ ID NO: 1553414 - RNA, 16 nt, Pseudomonas aeruginosa PA01
caugcccgccccgcac

SEQ ID NO: 1553415 - RNA, 20 nt, Pseudomonas aeruginosa PA01
caugaaaaagcccggccugg

SEQ ID NO: 1553416 - RNA, 13 nt, Pseudomonas aeruginosa PA01
caugcaccaccug

SEQ ID NO: 1553417 - RNA, 14 nt, Pseudomonas aeruginosa PA01
caugcaccaggccg

SEQ ID NO: 1553418 - RNA, 18 nt, Pseudomonas aeruginosa PA01
caugcaccaggccgccau

SEQ ID NO: 1553419 - RNA, 15 nt, Pseudomonas aeruginosa PA01
caugcccagcuuggc

SEQ ID NO: 1553420 - RNA, 10 nt, Pseudomonas aeruginosa PA01
caugcccagg

SEQ ID NO: 1553421 - RNA, 14 nt, Pseudomonas aeruginosa PA01
caugcccaggcucg

SEQ ID NO: 1553422 - RNA, 13 nt, Pseudomonas aeruginosa PA01
caugcccagggcc

SEQ ID NO: 1553423 - RNA, 19 nt, Pseudomonas aeruginosa PA01
caugcccagggccagcagc

SEQ ID NO: 1553424 - RNA, 20 nt, Pseudomonas aeruginosa PA01
caugcccagggccagcagcg

SEQ ID NO: 1553425 - RNA, 16 nt, Pseudomonas aeruginosa PA01
cauggugggcgccgcu

SEQ ID NO: 1553426 - RNA, 16 nt, Pseudomonas aeruginosa PA01
caugguggaucgacug

SEQ ID NO: 1553427 - RNA, 18 nt, Pseudomonas aeruginosa PA01
cauggucuuuccuuucac

SEQ ID NO: 1553428 - RNA, 17 nt, Pseudomonas aeruginosa PA01
cauggugcccagcaggc

SEQ ID NO: 1553429 - RNA, 20 nt, Pseudomonas aeruginosa PA01
cauggucgagaaggcugccg

SEQ ID NO: 1553430 - RNA, 14 nt, Pseudomonas aeruginosa PA01
cauggucggccagg

SEQ ID NO: 1553431 - RNA, 20 nt, Pseudomonas aeruginosa PA01
cauggugaagcccaccacca

SEQ ID NO: 1553432 - RNA, 18 nt, Pseudomonas aeruginosa PA01
cauggucucgcugaccca

SEQ ID NO: 1553433 - RNA, 21 nt, Pseudomonas aeruginosa PA01
cauuagaggaacccaaucaca

SEQ ID NO: 1553434 - RNA, 19 nt, Pseudomonas aeruginosa PA01
cauuacuugcccacgcaga

SEQ ID NO: 1553435 - RNA, 15 nt, Pseudomonas aeruginosa PA01
cauucguccagccgc

SEQ ID NO: 1553436 - RNA, 16 nt, Pseudomonas aeruginosa PA01
cauucucucuucagca

SEQ ID NO: 1553437 - RNA, 22 nt, Pseudomonas aeruginosa PA01
cauucucucuucagcaggggga

SEQ ID NO: 1553438 - RNA, 14 nt, Pseudomonas aeruginosa PA01
cauucgucgccgcu

SEQ ID NO: 1553439 - RNA, 19 nt, Pseudomonas aeruginosa PA01
cauuagcgucgcgcggcca

SEQ ID NO: 1553440 - RNA, 19 nt, Pseudomonas aeruginosa PA01
cauugaaggccgacaccuc

SEQ ID NO: 1553441 - RNA, 19 nt, Pseudomonas aeruginosa PA01
cauugcacaacgggugcug

SEQ ID NO: 1553442 - RNA, 20 nt, Pseudomonas aeruginosa PA01
cauugcacuuccacuccagg

SEQ ID NO: 1553443 - RNA, 13 nt, Pseudomonas aeruginosa PA01
cauugcgccgccg

SEQ ID NO: 1553444 - RNA, 23 nt, Pseudomonas aeruginosa PA01
cauugcgccgccggcuccuugcg

SEQ ID NO: 1553445 - RNA, 20 nt, Pseudomonas aeruginosa PA01
cauugccgggcuuccuggcc

SEQ ID NO: 1553446 - RNA, 19 nt, Pseudomonas aeruginosa PA01
caucaacgagccgagcagg

SEQ ID NO: 1553447 - RNA, 16 nt, Pseudomonas aeruginosa PA01
caucauccacagcgug

SEQ ID NO: 1553448 - RNA, 18 nt, Pseudomonas aeruginosa PA01
caucaugccgagcaucag

SEQ ID NO: 1553449 - RNA, 14 nt, Pseudomonas aeruginosa PA01
caucaggucggcgc

SEQ ID NO: 1553450 - RNA, 17 nt, Pseudomonas aeruginosa PA01
caucaggucggcgcgca

SEQ ID NO: 1553451 - RNA, 13 nt, Pseudomonas aeruginosa PA01
caucaggucgguc

SEQ ID NO: 1553452 - RNA, 13 nt, Pseudomonas aeruginosa PA01
caucaggcucagg

SEQ ID NO: 1553453 - RNA, 13 nt, Pseudomonas aeruginosa PA01
caucaggcugcug

SEQ ID NO: 1553454 - RNA, 19 nt, Pseudomonas aeruginosa PA01
caucaggccgcggcccugc

SEQ ID NO: 1553455 - RNA, 21 nt, Pseudomonas aeruginosa PA01
caucaggcgcuugcucuccac

SEQ ID NO: 1553456 - RNA, 18 nt, Pseudomonas aeruginosa PA01
caucaguugcgcgcgggu

SEQ ID NO: 1553457 - RNA, 21 nt, Pseudomonas aeruginosa PA01
caucaguagcgggcauccagc

SEQ ID NO: 1553458 - RNA, 18 nt, Pseudomonas aeruginosa PA01
caucagccuggccagcgu

SEQ ID NO: 1553459 - RNA, 19 nt, Pseudomonas aeruginosa PA01
caucagcgacagcauggcc

SEQ ID NO: 1553460 - RNA, 20 nt, Pseudomonas aeruginosa PA01
caucacccgguucucgcccc

SEQ ID NO: 1553461 - RNA, 20 nt, Pseudomonas aeruginosa PA01
caucaccuucgccagcaggc

SEQ ID NO: 1553462 - RNA, 15 nt, Pseudomonas aeruginosa PA01
caucggugccggcag

SEQ ID NO: 1553463 - RNA, 21 nt, Pseudomonas aeruginosa PA01
caucgguauucaucggcggca

SEQ ID NO: 1553464 - RNA, 18 nt, Pseudomonas aeruginosa PA01
caucgguggugugauccu

SEQ ID NO: 1553465 - RNA, 23 nt, Pseudomonas aeruginosa PA01
caucgguggugugauccugcugg

SEQ ID NO: 1553466 - RNA, 14 nt, Pseudomonas aeruginosa PA01
caucggggcugcuc

SEQ ID NO: 1553467 - RNA, 22 nt, Pseudomonas aeruginosa PA01
caucggguugaucgacgccagc

SEQ ID NO: 1553468 - RNA, 18 nt, Pseudomonas aeruginosa PA01
caucugcaccacguucgg

SEQ ID NO: 1553469 - RNA, 22 nt, Pseudomonas aeruginosa PA01
caucugcacgucguagcccuuc

SEQ ID NO: 1553470 - RNA, 21 nt, Pseudomonas aeruginosa PA01
caucugccuuacaagcagagg

SEQ ID NO: 1553471 - RNA, 14 nt, Pseudomonas aeruginosa PA01
caucucgaagcaga

SEQ ID NO: 1553472 - RNA, 23 nt, Pseudomonas aeruginosa PA01
caucucgauggugaacgccaggc

SEQ ID NO: 1553473 - RNA, 13 nt, Pseudomonas aeruginosa PA01
caucucgcggcgg

SEQ ID NO: 1553474 - RNA, 12 nt, Pseudomonas aeruginosa PA01
caucuggguccu

SEQ ID NO: 1553475 - RNA, 20 nt, Pseudomonas aeruginosa PA01
caucugggucuucagcuugg

SEQ ID NO: 1553476 - RNA, 12 nt, Pseudomonas aeruginosa PA01
caucuggcugcg

SEQ ID NO: 1553477 - RNA, 20 nt, Pseudomonas aeruginosa PA01
caucuucucgaagcgcgccu

SEQ ID NO: 1553478 - RNA, 17 nt, Pseudomonas aeruginosa PA01
caucggcgucggcuggu

SEQ ID NO: 1553479 - RNA, 20 nt, Pseudomonas aeruginosa PA01
caucggcggauaacgccgcu

SEQ ID NO: 1553480 - RNA, 15 nt, Pseudomonas aeruginosa PA01
caucggcgccgcgca

SEQ ID NO: 1553481 - RNA, 13 nt, Pseudomonas aeruginosa PA01
caucgcguagggc

SEQ ID NO: 1553482 - RNA, 23 nt, Pseudomonas aeruginosa PA01
caucgcguagggcgacggcgcuu

SEQ ID NO: 1553483 - RNA, 23 nt, Pseudomonas aeruginosa PA01
caucgcguagggcgcauaaccgc

SEQ ID NO: 1553484 - RNA, 21 nt, Pseudomonas aeruginosa PA01
caucgcguagguggcgccgcc

SEQ ID NO: 1553485 - RNA, 15 nt, Pseudomonas aeruginosa PA01
caucgcccggcgcuu

SEQ ID NO: 1553486 - RNA, 14 nt, Pseudomonas aeruginosa PA01
caucgccugggccg

SEQ ID NO: 1553487 - RNA, 18 nt, Pseudomonas aeruginosa PA01
caucgagaacaggugggu

SEQ ID NO: 1553488 - RNA, 13 nt, Pseudomonas aeruginosa PA01
caucgagcaggua

SEQ ID NO: 1553489 - RNA, 15 nt, Pseudomonas aeruginosa PA01
caucgagcaguucca

SEQ ID NO: 1553490 - RNA, 23 nt, Pseudomonas aeruginosa PA01
caucgaggccaggccgagcgcca

SEQ ID NO: 1553491 - RNA, 14 nt, Pseudomonas aeruginosa PA01
caucgaggccgccc

SEQ ID NO: 1553492 - RNA, 15 nt, Pseudomonas aeruginosa PA01
caucgaggccggcau

SEQ ID NO: 1553493 - RNA, 14 nt, Pseudomonas aeruginosa PA01
caucgagcggcggc

SEQ ID NO: 1553494 - RNA, 15 nt, Pseudomonas aeruginosa PA01
caucgaccagcagcg

SEQ ID NO: 1553495 - RNA, 15 nt, Pseudomonas aeruginosa PA01
caucgaccagggccg

SEQ ID NO: 1553496 - RNA, 14 nt, Pseudomonas aeruginosa PA01
caucgccagggucu

SEQ ID NO: 1553497 - RNA, 19 nt, Pseudomonas aeruginosa PA01
caucgcccauugccgggcu

SEQ ID NO: 1553498 - RNA, 23 nt, Pseudomonas aeruginosa PA01
caucgcccgcagccacaggcgcc

SEQ ID NO: 1553499 - RNA, 22 nt, Pseudomonas aeruginosa PA01
cauccgugcgaacacaccgacc

SEQ ID NO: 1553500 - RNA, 15 nt, Pseudomonas aeruginosa PA01
cauccgggcggcggg

SEQ ID NO: 1553501 - RNA, 21 nt, Pseudomonas aeruginosa PA01
cauccggguccagcggccgcg

SEQ ID NO: 1553502 - RNA, 23 nt, Pseudomonas aeruginosa PA01
cauccggaguucgcccgccccau

SEQ ID NO: 1553503 - RNA, 14 nt, Pseudomonas aeruginosa PA01
cauccgcguggcga

SEQ ID NO: 1553504 - RNA, 20 nt, Pseudomonas aeruginosa PA01
cauccgcugguagcccaggc

SEQ ID NO: 1553505 - RNA, 23 nt, Pseudomonas aeruginosa PA01
cauccgcugguagcccaggccga

SEQ ID NO: 1553506 - RNA, 12 nt, Pseudomonas aeruginosa PA01
cauccgccgcug

SEQ ID NO: 1553507 - RNA, 15 nt, Pseudomonas aeruginosa PA01
cauccgcccugcguc

SEQ ID NO: 1553508 - RNA, 23 nt, Pseudomonas aeruginosa PA01
caucgacagggucgucuggguca

SEQ ID NO: 1553509 - RNA, 19 nt, Pseudomonas aeruginosa PA01
cauccuuggucagggugcc

SEQ ID NO: 1553510 - RNA, 15 nt, Pseudomonas aeruginosa PA01
caucgaaaucgccca

SEQ ID NO: 1553511 - RNA, 22 nt, Pseudomonas aeruginosa PA01
cauccugaugaaucgccucccu

SEQ ID NO: 1553512 - RNA, 16 nt, Pseudomonas aeruginosa PA01
cauccucgccgcuggc

SEQ ID NO: 1553513 - RNA, 20 nt, Pseudomonas aeruginosa PA01
cauccucgccgcuggcgcug

SEQ ID NO: 1553514 - RNA, 13 nt, Pseudomonas aeruginosa PA01
cauccucccugcc

SEQ ID NO: 1553515 - RNA, 16 nt, Pseudomonas aeruginosa PA01
cauccucccugcccgc

SEQ ID NO: 1553516 - RNA, 19 nt, Pseudomonas aeruginosa PA01
cauccuccgaggccaccac

SEQ ID NO: 1553517 - RNA, 21 nt, Pseudomonas aeruginosa PA01
cauccuccaccguuccgaccc

SEQ ID NO: 1553518 - RNA, 12 nt, Pseudomonas aeruginosa PA01
ccgcccagcagc

SEQ ID NO: 1553519 - RNA, 21 nt, Pseudomonas aeruginosa PA01
ccgcccgccguccuccagcaa

SEQ ID NO: 1553520 - RNA, 13 nt, Pseudomonas aeruginosa PA01
ccgcccagcagca

SEQ ID NO: 1553521 - RNA, 15 nt, Pseudomonas aeruginosa PA01
ccgccaucgaccagg

SEQ ID NO: 1553522 - RNA, 21 nt, Pseudomonas aeruginosa PA01
ccgccaucaccagcggcgagc

SEQ ID NO: 1553523 - RNA, 21 nt, Pseudomonas aeruginosa PA01
ccgccauagagugcccaggcg

SEQ ID NO: 1553524 - RNA, 16 nt, Pseudomonas aeruginosa PA01
ccgccagugcagccgu

SEQ ID NO: 1553525 - RNA, 12 nt, Pseudomonas aeruginosa PA01
ccgccgauccag

SEQ ID NO: 1553526 - RNA, 16 nt, Pseudomonas aeruginosa PA01
ccgccgaucagcgcgc

SEQ ID NO: 1553527 - RNA, 20 nt, Pseudomonas aeruginosa PA01
ccgccgaggaagccgaccgg

SEQ ID NO: 1553528 - RNA, 17 nt, Pseudomonas aeruginosa PA01
ccgccgagggcgccagg

SEQ ID NO: 1553529 - RNA, 20 nt, Pseudomonas aeruginosa PA01
ccgccgagcguugggccucg

SEQ ID NO: 1553530 - RNA, 15 nt, Pseudomonas aeruginosa PA01
ccgccgaacaugccg

SEQ ID NO: 1553531 - RNA, 16 nt, Pseudomonas aeruginosa PA01
ccgcccuuggcggcgc

SEQ ID NO: 1553532 - RNA, 21 nt, Pseudomonas aeruginosa PA01
ccgcccuuuuucgucgccagc

SEQ ID NO: 1553533 - RNA, 22 nt, Pseudomonas aeruginosa PA01
ccgcccuuuuucgucgccagcc

SEQ ID NO: 1553534 - RNA, 21 nt, Pseudomonas aeruginosa PA01
ccgcccuucgaacccgcccuc

SEQ ID NO: 1553535 - RNA, 21 nt, Pseudomonas aeruginosa PA01
ccgcccuggcucugggccaug

SEQ ID NO: 1553536 - RNA, 22 nt, Pseudomonas aeruginosa PA01
ccgcccuguucgucuggcgccu

SEQ ID NO: 1553537 - RNA, 13 nt, Pseudomonas aeruginosa PA01
ccgcccggcgcca

SEQ ID NO: 1553538 - RNA, 14 nt, Pseudomonas aeruginosa PA01
ccgcccgcgccucc

SEQ ID NO: 1553539 - RNA, 16 nt, Pseudomonas aeruginosa PA01
ccgcccgcgccuccag

SEQ ID NO: 1553540 - RNA, 22 nt, Pseudomonas aeruginosa PA01
ccgcccgcggaccgggcggcgc

SEQ ID NO: 1553541 - RNA, 16 nt, Pseudomonas aeruginosa PA01
ccgcccggccaggcca

SEQ ID NO: 1553542 - RNA, 18 nt, Pseudomonas aeruginosa PA01
ccgcccggccaggccacg

SEQ ID NO: 1553543 - RNA, 20 nt, Pseudomonas aeruginosa PA01
ccgcccgcucaagggcuggc

SEQ ID NO: 1553544 - RNA, 16 nt, Pseudomonas aeruginosa PA01
ccgcccggcaccaccg

SEQ ID NO: 1553545 - RNA, 16 nt, Pseudomonas aeruginosa PA01
ccgccaccgccaccgc

SEQ ID NO: 1553546 - RNA, 20 nt, Pseudomonas aeruginosa PA01
ccgccaccgccggaaccugu

SEQ ID NO: 1553547 - RNA, 15 nt, Pseudomonas aeruginosa PA01
ccgccaccgccaccg

SEQ ID NO: 1553548 - RNA, 23 nt, Pseudomonas aeruginosa PA01
ccgccacgccgauaccggccucg

SEQ ID NO: 1553549 - RNA, 20 nt, Pseudomonas aeruginosa PA01
ccgccacgcuugucguggcg

SEQ ID NO: 1553550 - RNA, 14 nt, Pseudomonas aeruginosa PA01
ccgccaccuggcgg

SEQ ID NO: 1553551 - RNA, 16 nt, Pseudomonas aeruginosa PA01
ccgccaccuggcgggc

SEQ ID NO: 1553552 - RNA, 23 nt, Pseudomonas aeruginosa PA01
ccgccagcaacaguugccgcagc

SEQ ID NO: 1553553 - RNA, 12 nt, Pseudomonas aeruginosa PA01
ccgccagcaacg

SEQ ID NO: 1553554 - RNA, 16 nt, Pseudomonas aeruginosa PA01
ccgccagguggcgggc

SEQ ID NO: 1553555 - RNA, 20 nt, Pseudomonas aeruginosa PA01
ccgccagguccaggcucagc

SEQ ID NO: 1553556 - RNA, 20 nt, Pseudomonas aeruginosa PA01
ccgccaggcagaccaggccg

SEQ ID NO: 1553557 - RNA, 13 nt, Pseudomonas aeruginosa PA01
ccgccaggaccuc

SEQ ID NO: 1553558 - RNA, 14 nt, Pseudomonas aeruginosa PA01
ccgccaggccgacc

SEQ ID NO: 1553559 - RNA, 16 nt, Pseudomonas aeruginosa PA01
ccgccaggccgacccg

SEQ ID NO: 1553560 - RNA, 17 nt, Pseudomonas aeruginosa PA01
ccgccaggccgacccgc

SEQ ID NO: 1553561 - RNA, 12 nt, Pseudomonas aeruginosa PA01
ccgccaggccgc

SEQ ID NO: 1553562 - RNA, 14 nt, Pseudomonas aeruginosa PA01
ccgccaggccgcgc

SEQ ID NO: 1553563 - RNA, 17 nt, Pseudomonas aeruginosa PA01
ccgccaggccgcgcagu

SEQ ID NO: 1553564 - RNA, 17 nt, Pseudomonas aeruginosa PA01
ccgccaggccuuccaga

SEQ ID NO: 1553565 - RNA, 14 nt, Pseudomonas aeruginosa PA01
ccgccaggcgcagc

SEQ ID NO: 1553566 - RNA, 19 nt, Pseudomonas aeruginosa PA01
ccgccaggcgcgucuccag

SEQ ID NO: 1553567 - RNA, 16 nt, Pseudomonas aeruginosa PA01
ccgccagcgucgccgc

SEQ ID NO: 1553568 - RNA, 23 nt, Pseudomonas aeruginosa PA01
ccgccagcucauggagcaacagc

SEQ ID NO: 1553569 - RNA, 19 nt, Pseudomonas aeruginosa PA01
ccgccagcucgcuguccag

SEQ ID NO: 1553570 - RNA, 22 nt, Pseudomonas aeruginosa PA01
ccgccagcaggucggccugcug

SEQ ID NO: 1553571 - RNA, 22 nt, Pseudomonas aeruginosa PA01
ccgccagcaggccgaaggccag

SEQ ID NO: 1553572 - RNA, 16 nt, Pseudomonas aeruginosa PA01
ccgccagcaggcgccg

SEQ ID NO: 1553573 - RNA, 16 nt, Pseudomonas aeruginosa PA01
ccgccagcaggcgcgg

SEQ ID NO: 1553574 - RNA, 11 nt, Pseudomonas aeruginosa PA01
ccgccagccag

SEQ ID NO: 1553575 - RNA, 12 nt, Pseudomonas aeruginosa PA01
ccgccagccagc

SEQ ID NO: 1553576 - RNA, 15 nt, Pseudomonas aeruginosa PA01
ccgccagcgcggcgc

SEQ ID NO: 1553577 - RNA, 15 nt, Pseudomonas aeruginosa PA01
ccgcaccgccagcgu

SEQ ID NO: 1553578 - RNA, 15 nt, Pseudomonas aeruginosa PA01
ccgcaccggcgcgcc

SEQ ID NO: 1553579 - RNA, 16 nt, Pseudomonas aeruginosa PA01
ccgcaccggcgcgccg

SEQ ID NO: 1553580 - RNA, 22 nt, Pseudomonas aeruginosa PA01
ccgcaccggcgcgccggacagg

SEQ ID NO: 1553581 - RNA, 15 nt, Pseudomonas aeruginosa PA01
ccgcaauccgaccgg

SEQ ID NO: 1553582 - RNA, 14 nt, Pseudomonas aeruginosa PA01
ccgauggacaggcu

SEQ ID NO: 1553583 - RNA, 15 nt, Pseudomonas aeruginosa PA01
ccgauggcgccgccg

SEQ ID NO: 1553584 - RNA, 15 nt, Pseudomonas aeruginosa PA01
ccgauggcgccgcga

SEQ ID NO: 1553585 - RNA, 15 nt, Pseudomonas aeruginosa PA01
ccgcagccguggcgc

SEQ ID NO: 1553586 - RNA, 22 nt, Pseudomonas aeruginosa PA01
ccgcagcgaucagcaccagcgg

SEQ ID NO: 1553587 - RNA, 19 nt, Pseudomonas aeruginosa PA01
ccgcagcgccacuuccagc

SEQ ID NO: 1553588 - RNA, 19 nt, Pseudomonas aeruginosa PA01
ccgcagcgccucccgggcc

SEQ ID NO: 1553589 - RNA, 21 nt, Pseudomonas aeruginosa PA01
ccgcagcggcaugcccugccg

SEQ ID NO: 1553590 - RNA, 14 nt, Pseudomonas aeruginosa PA01
ccgcagcggcagcg

SEQ ID NO: 1553591 - RNA, 19 nt, Pseudomonas aeruginosa PA01
ccgcagcggcagcggcucg

SEQ ID NO: 1553592 - RNA, 23 nt, Pseudomonas aeruginosa PA01
ccgcagcaagucgaacaggcccu

SEQ ID NO: 1553593 - RNA, 15 nt, Pseudomonas aeruginosa PA01
ccgcagacuccggcg

SEQ ID NO: 1553594 - RNA, 19 nt, Pseudomonas aeruginosa PA01
ccgcagacuccggcgcagc

SEQ ID NO: 1553595 - RNA, 23 nt, Pseudomonas aeruginosa PA01
ccgcagacuccggcgcagcccag

SEQ ID NO: 1553596 - RNA, 20 nt, Pseudomonas aeruginosa PA01
ccgcagaccagcgaaccgcc

SEQ ID NO: 1553597 - RNA, 13 nt, Pseudomonas aeruginosa PA01
ccgcaccuggugg

SEQ ID NO: 1553598 - RNA, 14 nt, Pseudomonas aeruginosa PA01
ccgcaccuggugga

SEQ ID NO: 1553599 - RNA, 17 nt, Pseudomonas aeruginosa PA01
ccgcaccuugcccugca

SEQ ID NO: 1553600 - RNA, 15 nt, Pseudomonas aeruginosa PA01
ccgccacagaucgcc

SEQ ID NO: 1553601 - RNA, 18 nt, Pseudomonas aeruginosa PA01
ccgccacagaucgccagc

SEQ ID NO: 1553602 - RNA, 17 nt, Pseudomonas aeruginosa PA01
ccgccaccacgaucagg

SEQ ID NO: 1553603 - RNA, 15 nt, Pseudomonas aeruginosa PA01
ccgccaccagcgagu

SEQ ID NO: 1553604 - RNA, 24 nt, Pseudomonas aeruginosa PA01
ccgccaccagcgagucgacccagg

SEQ ID NO: 1553605 - RNA, 15 nt, Pseudomonas aeruginosa PA01
ccgccaacguccucg

SEQ ID NO: 1553606 - RNA, 13 nt, Pseudomonas aeruginosa PA01
ccgccaaggcggg

SEQ ID NO: 1553607 - RNA, 17 nt, Pseudomonas aeruginosa PA01
ccgcagcggcuguugcc

SEQ ID NO: 1553608 - RNA, 20 nt, Pseudomonas aeruginosa PA01
ccgcauaggucaugcccagg

SEQ ID NO: 1553609 - RNA, 22 nt, Pseudomonas aeruginosa PA01
ccgcauaggucaugcccaggcc

SEQ ID NO: 1553610 - RNA, 14 nt, Pseudomonas aeruginosa PA01
ccgcaucgccaccg

SEQ ID NO: 1553611 - RNA, 21 nt, Pseudomonas aeruginosa PA01
ccgcaucgaccuugcccucgg

SEQ ID NO: 1553612 - RNA, 16 nt, Pseudomonas aeruginosa PA01
ccgcaucgaggccgcc

SEQ ID NO: 1553613 - RNA, 19 nt, Pseudomonas aeruginosa PA01
ccgcauccuccacccccgc

SEQ ID NO: 1553614 - RNA, 23 nt, Pseudomonas aeruginosa PA01
ccgcaucgcugaccucgagcugg

SEQ ID NO: 1553615 - RNA, 12 nt, Pseudomonas aeruginosa PA01
ccgcaucggcca

SEQ ID NO: 1553616 - RNA, 21 nt, Pseudomonas aeruginosa PA01
ccgcaucggccaccuucgccc

SEQ ID NO: 1553617 - RNA, 17 nt, Pseudomonas aeruginosa PA01
ccgcaucuccccaccaa

SEQ ID NO: 1553618 - RNA, 16 nt, Pseudomonas aeruginosa PA01
ccgcauugacccgggu

SEQ ID NO: 1553619 - RNA, 21 nt, Pseudomonas aeruginosa PA01
ccgcauugacccgggugccuu

SEQ ID NO: 1553620 - RNA, 22 nt, Pseudomonas aeruginosa PA01
ccgcaugccagggccuugcuga

SEQ ID NO: 1553621 - RNA, 22 nt, Pseudomonas aeruginosa PA01
cccucgcggaucugcuccugca

SEQ ID NO: 1553622 - RNA, 22 nt, Pseudomonas aeruginosa PA01
cccucgcggcggcaggccagcu

SEQ ID NO: 1553623 - RNA, 22 nt, Pseudomonas aeruginosa PA01
cccucggcccggagccaacgcc

SEQ ID NO: 1553624 - RNA, 20 nt, Pseudomonas aeruginosa PA01
cccucgcuccaacgcaggcg

SEQ ID NO: 1553625 - RNA, 23 nt, Pseudomonas aeruginosa PA01
cccucggccaggcauuccuccag

SEQ ID NO: 1553626 - RNA, 18 nt, Pseudomonas aeruginosa PA01
cccuugcucccgccgcuc

SEQ ID NO: 1553627 - RNA, 16 nt, Pseudomonas aeruginosa PA01
cccucgcagccggcgg

SEQ ID NO: 1553628 - RNA, 22 nt, Pseudomonas aeruginosa PA01
cccucgauguaggccucggccu

SEQ ID NO: 1553629 - RNA, 14 nt, Pseudomonas aeruginosa PA01
cccucgccgaccgc

SEQ ID NO: 1553630 - RNA, 22 nt, Pseudomonas aeruginosa PA01
cccuuguggccgaucuccuggu

SEQ ID NO: 1553631 - RNA, 14 nt, Pseudomonas aeruginosa PA01
cccuuguccggccc

SEQ ID NO: 1553632 - RNA, 13 nt, Pseudomonas aeruginosa PA01
cccuuggccagcg

SEQ ID NO: 1553633 - RNA, 17 nt, Pseudomonas aeruginosa PA01
cccuuggcgucgcggcu

SEQ ID NO: 1553634 - RNA, 20 nt, Pseudomonas aeruginosa PA01
cccuuucgaacugcaugucg

SEQ ID NO: 1553635 - RNA, 18 nt, Pseudomonas aeruginosa PA01
cccuuucacaugcuugcu

SEQ ID NO: 1553636 - RNA, 21 nt, Pseudomonas aeruginosa PA01
ccgaacaccugcaucaccagg

SEQ ID NO: 1553637 - RNA, 22 nt, Pseudomonas aeruginosa PA01
ccgaacaccugcaucaccaggc

SEQ ID NO: 1553638 - RNA, 15 nt, Pseudomonas aeruginosa PA01
ccgaacugcagggcg

SEQ ID NO: 1553639 - RNA, 16 nt, Pseudomonas aeruginosa PA01
ccgaacuccgagcagg

SEQ ID NO: 1553640 - RNA, 19 nt, Pseudomonas aeruginosa PA01
ccgaaagaaacaacgaagu

SEQ ID NO: 1553641 - RNA, 17 nt, Pseudomonas aeruginosa PA01
cccuuuuccaccggccg

SEQ ID NO: 1553642 - RNA, 21 nt, Pseudomonas aeruginosa PA01
ccgacaggucggccggcagcu

SEQ ID NO: 1553643 - RNA, 21 nt, Pseudomonas aeruginosa PA01
ccgacaucggagugcaugccg

SEQ ID NO: 1553644 - RNA, 11 nt, Pseudomonas aeruginosa PA01
ccgacacgugu

SEQ ID NO: 1553645 - RNA, 14 nt, Pseudomonas aeruginosa PA01
ccgacagagcggcc

SEQ ID NO: 1553646 - RNA, 19 nt, Pseudomonas aeruginosa PA01
ccgacagagcggccggcgc

SEQ ID NO: 1553647 - RNA, 16 nt, Pseudomonas aeruginosa PA01
ccgacaggcagcgccg

SEQ ID NO: 1553648 - RNA, 19 nt, Pseudomonas aeruginosa PA01
ccgacaggcagcgccgccc

SEQ ID NO: 1553649 - RNA, 18 nt, Pseudomonas aeruginosa PA01
ccgaccagguccgccacu

SEQ ID NO: 1553650 - RNA, 13 nt, Pseudomonas aeruginosa PA01
ccgaccagcgccg

SEQ ID NO: 1553651 - RNA, 20 nt, Pseudomonas aeruginosa PA01
ccgaccacuucggcgguggg

SEQ ID NO: 1553652 - RNA, 20 nt, Pseudomonas aeruginosa PA01
ccgaccacaugggcgaccgg

SEQ ID NO: 1553653 - RNA, 13 nt, Pseudomonas aeruginosa PA01
ccgaaggccagga

SEQ ID NO: 1553654 - RNA, 13 nt, Pseudomonas aeruginosa PA01
ccgaaggccaggc

SEQ ID NO: 1553655 - RNA, 15 nt, Pseudomonas aeruginosa PA01
ccgaaggcaacagcc

SEQ ID NO: 1553656 - RNA, 20 nt, Pseudomonas aeruginosa PA01
ccgaaggcaacagcccgcgc

SEQ ID NO: 1553657 - RNA, 18 nt, Pseudomonas aeruginosa PA01
ccgaagccgcuggcauuc

SEQ ID NO: 1553658 - RNA, 15 nt, Pseudomonas aeruginosa PA01
ccgaaggcgucgggc

SEQ ID NO: 1553659 - RNA, 16 nt, Pseudomonas aeruginosa PA01
ccgaaggcgugggcgc

SEQ ID NO: 1553660 - RNA, 18 nt, Pseudomonas aeruginosa PA01
ccgaagggaaacaccagg

SEQ ID NO: 1553661 - RNA, 21 nt, Pseudomonas aeruginosa PA01
ccgaagggaaacaccaggccg

SEQ ID NO: 1553662 - RNA, 13 nt, Pseudomonas aeruginosa PA01
ccgaagggccgca

SEQ ID NO: 1553663 - RNA, 17 nt, Pseudomonas aeruginosa PA01
ccgacaagccuccagcg

SEQ ID NO: 1553664 - RNA, 22 nt, Pseudomonas aeruginosa PA01
ccgacaaggagcgcgagcggca

SEQ ID NO: 1553665 - RNA, 21 nt, Pseudomonas aeruginosa PA01
ccgacaacgaaaagagccgcg

SEQ ID NO: 1553666 - RNA, 23 nt, Pseudomonas aeruginosa PA01
ccgacaacgaaaagagccgcgcc

SEQ ID NO: 1553667 - RNA, 15 nt, Pseudomonas aeruginosa PA01
ccgacacccgcgccg

SEQ ID NO: 1553668 - RNA, 16 nt, Pseudomonas aeruginosa PA01
ccgacacccgcgccgc

SEQ ID NO: 1553669 - RNA, 20 nt, Pseudomonas aeruginosa PA01
ccgaccgcgcgccugcaacg

SEQ ID NO: 1553670 - RNA, 14 nt, Pseudomonas aeruginosa PA01
ccgaccggacuccg

SEQ ID NO: 1553671 - RNA, 16 nt, Pseudomonas aeruginosa PA01
ccgaccgcaccgccag

SEQ ID NO: 1553672 - RNA, 17 nt, Pseudomonas aeruginosa PA01
ccgaccgcaccgccagc

SEQ ID NO: 1553673 - RNA, 12 nt, Pseudomonas aeruginosa PA01
ccgaccgccagg

SEQ ID NO: 1553674 - RNA, 17 nt, Pseudomonas aeruginosa PA01
ccgacccgcuccggacu

SEQ ID NO: 1553675 - RNA, 20 nt, Pseudomonas aeruginosa PA01
ccgaccccacgccggccggc

SEQ ID NO: 1553676 - RNA, 14 nt, Pseudomonas aeruginosa PA01
ccgacgcucgcggc

SEQ ID NO: 1553677 - RNA, 21 nt, Pseudomonas aeruginosa PA01
ccgaccgguuccagcggccgc

SEQ ID NO: 1553678 - RNA, 18 nt, Pseudomonas aeruginosa PA01
ccgaccucggcggucagg

SEQ ID NO: 1553679 - RNA, 18 nt, Pseudomonas aeruginosa PA01
ccgaccucggccgccagg

SEQ ID NO: 1553680 - RNA, 18 nt, Pseudomonas aeruginosa PA01
ccgacggacguccuccug

SEQ ID NO: 1553681 - RNA, 23 nt, Pseudomonas aeruginosa PA01
ccgacggagucggugugaccuuc

SEQ ID NO: 1553682 - RNA, 13 nt, Pseudomonas aeruginosa PA01
ccgacggcgcgcu

SEQ ID NO: 1553683 - RNA, 13 nt, Pseudomonas aeruginosa PA01
ccgagcaggauga

SEQ ID NO: 1553684 - RNA, 15 nt, Pseudomonas aeruginosa PA01
ccgagcagcggacgc

SEQ ID NO: 1553685 - RNA, 13 nt, Pseudomonas aeruginosa PA01
ccgagcagcggcg

SEQ ID NO: 1553686 - RNA, 14 nt, Pseudomonas aeruginosa PA01
ccgagcagcggcgc

SEQ ID NO: 1553687 - RNA, 15 nt, Pseudomonas aeruginosa PA01
ccgagcgcgccgccg

SEQ ID NO: 1553688 - RNA, 18 nt, Pseudomonas aeruginosa PA01
ccgagcccgagugcgccc

SEQ ID NO: 1553689 - RNA, 19 nt, Pseudomonas aeruginosa PA01
ccgagcaugcgcggcagga

SEQ ID NO: 1553690 - RNA, 21 nt, Pseudomonas aeruginosa PA01
ccgagcccccauaccgccucg

SEQ ID NO: 1553691 - RNA, 18 nt, Pseudomonas aeruginosa PA01
ccgagcccccggcgccca

SEQ ID NO: 1553692 - RNA, 19 nt, Pseudomonas aeruginosa PA01
ccgacucuccgcgccgcgg

SEQ ID NO: 1553693 - RNA, 19 nt, Pseudomonas aeruginosa PA01
ccgacuuccaggcgcaggc

SEQ ID NO: 1553694 - RNA, 22 nt, Pseudomonas aeruginosa PA01
ccgacugcgaaaaagaacgccc

SEQ ID NO: 1553695 - RNA, 19 nt, Pseudomonas aeruginosa PA01
ccgaggcagccgucgguga

SEQ ID NO: 1553696 - RNA, 13 nt, Pseudomonas aeruginosa PA01
ccgaggccaccac

SEQ ID NO: 1553697 - RNA, 14 nt, Pseudomonas aeruginosa PA01
ccgaggccaccacu

SEQ ID NO: 1553698 - RNA, 15 nt, Pseudomonas aeruginosa PA01
ccgaggccaccacuu

SEQ ID NO: 1553699 - RNA, 21 nt, Pseudomonas aeruginosa PA01
ccgacugucgugccuccagcc

SEQ ID NO: 1553700 - RNA, 23 nt, Pseudomonas aeruginosa PA01
ccgagcguugggccucgcugcgc

SEQ ID NO: 1553701 - RNA, 21 nt, Pseudomonas aeruginosa PA01
ccgaggucggcgaacagggug

SEQ ID NO: 1553702 - RNA, 21 nt, Pseudomonas aeruginosa PA01
ccgaggucgucgcugagcagu

SEQ ID NO: 1553703 - RNA, 15 nt, Pseudomonas aeruginosa PA01
ccgaggucgccgcca

SEQ ID NO: 1553704 - RNA, 17 nt, Pseudomonas aeruginosa PA01
ccgaggucgccgccagc

SEQ ID NO: 1553705 - RNA, 16 nt, Pseudomonas aeruginosa PA01
ccgaggucgcgggcca

SEQ ID NO: 1553706 - RNA, 21 nt, Pseudomonas aeruginosa PA01
ccgaggucgcgggccaggccc

SEQ ID NO: 1553707 - RNA, 12 nt, Pseudomonas aeruginosa PA01
ccgaggccggcg

SEQ ID NO: 1553708 - RNA, 18 nt, Pseudomonas aeruginosa PA01
ccgaggcgaucgccgcgg

SEQ ID NO: 1553709 - RNA, 19 nt, Pseudomonas aeruginosa PA01
ccgagucccuugcggcaga

SEQ ID NO: 1553710 - RNA, 19 nt, Pseudomonas aeruginosa PA01
ccgaguccgcgcgcgcgcu

SEQ ID NO: 1553711 - RNA, 15 nt, Pseudomonas aeruginosa PA01
ccgaggugucgccgc

SEQ ID NO: 1553712 - RNA, 17 nt, Pseudomonas aeruginosa PA01
ccgaggugucgccgcgg

SEQ ID NO: 1553713 - RNA, 16 nt, Pseudomonas aeruginosa PA01
ccgaggucuuggccag

SEQ ID NO: 1553714 - RNA, 15 nt, Pseudomonas aeruginosa PA01
ccgaguccugcugcg

SEQ ID NO: 1553715 - RNA, 22 nt, Pseudomonas aeruginosa PA01
ccgauauaggggaugccuucgg

SEQ ID NO: 1553716 - RNA, 21 nt, Pseudomonas aeruginosa PA01
ccgaucccggcggcgacccag

SEQ ID NO: 1553717 - RNA, 19 nt, Pseudomonas aeruginosa PA01
ccgaucccgacgcccucca

SEQ ID NO: 1553718 - RNA, 21 nt, Pseudomonas aeruginosa PA01
ccgauccgcgaauagggcggc

SEQ ID NO: 1553719 - RNA, 12 nt, Pseudomonas aeruginosa PA01
ccgauccuccug

SEQ ID NO: 1553720 - RNA, 17 nt, Pseudomonas aeruginosa PA01
ccgaucgagcggcccgc

SEQ ID NO: 1553721 - RNA, 16 nt, Pseudomonas aeruginosa PA01
ccgaucgaagaaggcu

SEQ ID NO: 1553722 - RNA, 23 nt, Pseudomonas aeruginosa PA01
ccgaugcgccgacgccaccagcc

SEQ ID NO: 1553723 - RNA, 13 nt, Pseudomonas aeruginosa PA01
ccgaucgccgcgc

SEQ ID NO: 1553724 - RNA, 22 nt, Pseudomonas aeruginosa PA01
ccgaugcgguagucgcugcugg

SEQ ID NO: 1553725 - RNA, 19 nt, Pseudomonas aeruginosa PA01
ccgaugcugaucacccgcc

SEQ ID NO: 1553726 - RNA, 18 nt, Pseudomonas aeruginosa PA01
ccgaugcuguucagcagg

SEQ ID NO: 1553727 - RNA, 20 nt, Pseudomonas aeruginosa PA01
ccgaugcucgcgccagcccc

SEQ ID NO: 1553728 - RNA, 12 nt, Pseudomonas aeruginosa PA01
ccgcuccagcgc

SEQ ID NO: 1553729 - RNA, 15 nt, Pseudomonas aeruginosa PA01
ccgcuccagcgccuc

SEQ ID NO: 1553730 - RNA, 21 nt, Pseudomonas aeruginosa PA01
ccgcuccagcgccucgaccag

SEQ ID NO: 1553731 - RNA, 17 nt, Pseudomonas aeruginosa PA01
ccgcuagggcgcccucg

SEQ ID NO: 1553732 - RNA, 13 nt, Pseudomonas aeruginosa PA01
ccgcuagcccugc

SEQ ID NO: 1553733 - RNA, 17 nt, Pseudomonas aeruginosa PA01
ccgcuagcccugcugcu

SEQ ID NO: 1553734 - RNA, 12 nt, Pseudomonas aeruginosa PA01
ccgcuacccugc

SEQ ID NO: 1553735 - RNA, 17 nt, Pseudomonas aeruginosa PA01
ccgcgugggcuucgccg

SEQ ID NO: 1553736 - RNA, 21 nt, Pseudomonas aeruginosa PA01
ccgcgugggcuucgccgccgc

SEQ ID NO: 1553737 - RNA, 14 nt, Pseudomonas aeruginosa PA01
ccgcgugccgccgg

SEQ ID NO: 1553738 - RNA, 18 nt, Pseudomonas aeruginosa PA01
ccgcgugcgcgcccucgg

SEQ ID NO: 1553739 - RNA, 17 nt, Pseudomonas aeruginosa PA01
ccgcgugcgcgccgccg

SEQ ID NO: 1553740 - RNA, 18 nt, Pseudomonas aeruginosa PA01
ccgcgugcgcgccgccgg

SEQ ID NO: 1553741 - RNA, 20 nt, Pseudomonas aeruginosa PA01
ccgcgucgggaaaggccgcc

SEQ ID NO: 1553742 - RNA, 15 nt, Pseudomonas aeruginosa PA01
ccgcgucgccuucgg

SEQ ID NO: 1553743 - RNA, 18 nt, Pseudomonas aeruginosa PA01
ccgcgguuggcgccucgc

SEQ ID NO: 1553744 - RNA, 17 nt, Pseudomonas aeruginosa PA01
ccgcggccccggcgucu

SEQ ID NO: 1553745 - RNA, 18 nt, Pseudomonas aeruginosa PA01
ccgcggcccugcgccgca

SEQ ID NO: 1553746 - RNA, 19 nt, Pseudomonas aeruginosa PA01
ccgcggcccugcucgccgg

SEQ ID NO: 1553747 - RNA, 20 nt, Pseudomonas aeruginosa PA01
ccgcggcccugcucgccggc

SEQ ID NO: 1553748 - RNA, 22 nt, Pseudomonas aeruginosa PA01
ccgcggccggcaggccgauggc

SEQ ID NO: 1553749 - RNA, 18 nt, Pseudomonas aeruginosa PA01
ccgcggccggcuucagca

SEQ ID NO: 1553750 - RNA, 16 nt, Pseudomonas aeruginosa PA01
ccgcggaucaccuggc

SEQ ID NO: 1553751 - RNA, 22 nt, Pseudomonas aeruginosa PA01
ccgcggaucgcgccgucgcugg

SEQ ID NO: 1553752 - RNA, 18 nt, Pseudomonas aeruginosa PA01
ccgcggcaaugcggcgau

SEQ ID NO: 1553753 - RNA, 15 nt, Pseudomonas aeruginosa PA01
ccgcggaugacgggc

SEQ ID NO: 1553754 - RNA, 18 nt, Pseudomonas aeruginosa PA01
ccgcggaugacgggcgaa

SEQ ID NO: 1553755 - RNA, 12 nt, Pseudomonas aeruginosa PA01
ccgcggucgggc

SEQ ID NO: 1553756 - RNA, 24 nt, Pseudomonas aeruginosa PA01
ccgcggucuucgcguuggcggugc

SEQ ID NO: 1553757 - RNA, 15 nt, Pseudomonas aeruginosa PA01
ccgcggugucggugc

SEQ ID NO: 1553758 - RNA, 20 nt, Pseudomonas aeruginosa PA01
ccgcggugggcuccagcggg

SEQ ID NO: 1553759 - RNA, 17 nt, Pseudomonas aeruginosa PA01
ccgcggucgaugucgcg

SEQ ID NO: 1553760 - RNA, 23 nt, Pseudomonas aeruginosa PA01
ccgcggcgagguugcccacggcc

SEQ ID NO: 1553761 - RNA, 18 nt, Pseudomonas aeruginosa PA01
ccgcggcgauaggcgcgc

SEQ ID NO: 1553762 - RNA, 22 nt, Pseudomonas aeruginosa PA01
ccgcggcgaacaucauccacag

SEQ ID NO: 1553763 - RNA, 20 nt, Pseudomonas aeruginosa PA01
ccgcugaucaguaccggcag

SEQ ID NO: 1553764 - RNA, 21 nt, Pseudomonas aeruginosa PA01
ccgcugcaaaaaagcgcgccc

SEQ ID NO: 1553765 - RNA, 19 nt, Pseudomonas aeruginosa PA01
ccgcugacggucugccagc

SEQ ID NO: 1553766 - RNA, 19 nt, Pseudomonas aeruginosa PA01
ccgcugaggauguagccgg

SEQ ID NO: 1553767 - RNA, 16 nt, Pseudomonas aeruginosa PA01
ccgcuccgcggccggc

SEQ ID NO: 1553768 - RNA, 14 nt, Pseudomonas aeruginosa PA01
ccgcuccggcgccg

SEQ ID NO: 1553769 - RNA, 15 nt, Pseudomonas aeruginosa PA01
ccgcuccggcgccga

SEQ ID NO: 1553770 - RNA, 16 nt, Pseudomonas aeruginosa PA01
ccgcuccggcgccgag

SEQ ID NO: 1553771 - RNA, 19 nt, Pseudomonas aeruginosa PA01
ccgcuccaggaucgccucc

SEQ ID NO: 1553772 - RNA, 23 nt, Pseudomonas aeruginosa PA01
ccgcucgcgguuauccgccgccg

SEQ ID NO: 1553773 - RNA, 23 nt, Pseudomonas aeruginosa PA01
ccgcucgcgguuauccgccgccu

SEQ ID NO: 1553774 - RNA, 23 nt, Pseudomonas aeruginosa PA01
ccgcucgcguccgcaguucgccc

SEQ ID NO: 1553775 - RNA, 15 nt, Pseudomonas aeruginosa PA01
ccgcuccuggcaggc

SEQ ID NO: 1553776 - RNA, 16 nt, Pseudomonas aeruginosa PA01
ccgcuccuggcaggcu

SEQ ID NO: 1553777 - RNA, 22 nt, Pseudomonas aeruginosa PA01
ccgcucgaugcccgccagcagg

SEQ ID NO: 1553778 - RNA, 21 nt, Pseudomonas aeruginosa PA01
ccgcucgagggcgaccgccag

SEQ ID NO: 1553779 - RNA, 21 nt, Pseudomonas aeruginosa PA01
ccgcucgaguucgcgcggguc

SEQ ID NO: 1553780 - RNA, 18 nt, Pseudomonas aeruginosa PA01
ccgcugucuaucugcgcc

SEQ ID NO: 1553781 - RNA, 17 nt, Pseudomonas aeruginosa PA01
ccgcuguccgccgccgc

SEQ ID NO: 1553782 - RNA, 19 nt, Pseudomonas aeruginosa PA01
ccgcugucgucuucggcca

SEQ ID NO: 1553783 - RNA, 15 nt, Pseudomonas aeruginosa PA01
ccgcuguggaaguac

SEQ ID NO: 1553784 - RNA, 15 nt, Pseudomonas aeruginosa PA01
ccgcuucggcggggc

SEQ ID NO: 1553785 - RNA, 19 nt, Pseudomonas aeruginosa PA01
ccgcugguagcccaggccg

SEQ ID NO: 1553786 - RNA, 13 nt, Pseudomonas aeruginosa PA01
ccgcugguccagc

SEQ ID NO: 1553787 - RNA, 23 nt, Pseudomonas aeruginosa PA01
ccgcugcgcugccagcgccgccg

SEQ ID NO: 1553788 - RNA, 21 nt, Pseudomonas aeruginosa PA01
ccgcugcggcugcagggccag

SEQ ID NO: 1553789 - RNA, 15 nt, Pseudomonas aeruginosa PA01
ccgcugcgccgccgu

SEQ ID NO: 1553790 - RNA, 14 nt, Pseudomonas aeruginosa PA01
ccgcugcgcgcagu

SEQ ID NO: 1553791 - RNA, 18 nt, Pseudomonas aeruginosa PA01
ccgcugcgcgcaguucag

SEQ ID NO: 1553792 - RNA, 14 nt, Pseudomonas aeruginosa PA01
ccgcugcgcggguc

SEQ ID NO: 1553793 - RNA, 15 nt, Pseudomonas aeruginosa PA01
ccgcugcgcaggccg

SEQ ID NO: 1553794 - RNA, 21 nt, Pseudomonas aeruginosa PA01
ccgcuggggaccgcaccuggu

SEQ ID NO: 1553795 - RNA, 13 nt, Pseudomonas aeruginosa PA01
ccgcugggccacg

SEQ ID NO: 1553796 - RNA, 15 nt, Pseudomonas aeruginosa PA01
ccgcugcgucgucgc

SEQ ID NO: 1553797 - RNA, 12 nt, Pseudomonas aeruginosa PA01
ccgcgaccucgu

SEQ ID NO: 1553798 - RNA, 20 nt, Pseudomonas aeruginosa PA01
ccgcgauggcucgcggcgcu

SEQ ID NO: 1553799 - RNA, 22 nt, Pseudomonas aeruginosa PA01
ccgcgauggcucgcggcgcucg

SEQ ID NO: 1553800 - RNA, 17 nt, Pseudomonas aeruginosa PA01
ccgcgauguccccggcc

SEQ ID NO: 1553801 - RNA, 17 nt, Pseudomonas aeruginosa PA01
ccgcgcaaaccggcagc

SEQ ID NO: 1553802 - RNA, 22 nt, Pseudomonas aeruginosa PA01
ccgcgauauucgcccuacgaaa

SEQ ID NO: 1553803 - RNA, 18 nt, Pseudomonas aeruginosa PA01
ccgcgaagcccagcgccg

SEQ ID NO: 1553804 - RNA, 17 nt, Pseudomonas aeruginosa PA01
ccgcgaagcgacggcgc

SEQ ID NO: 1553805 - RNA, 16 nt, Pseudomonas aeruginosa PA01
ccgcgaaauggcagaa

SEQ ID NO: 1553806 - RNA, 19 nt, Pseudomonas aeruginosa PA01
ccgcgaccgaagccgcgca

SEQ ID NO: 1553807 - RNA, 21 nt, Pseudomonas aeruginosa PA01
ccgcgaccgaagccgcgcagc

SEQ ID NO: 1553808 - RNA, 14 nt, Pseudomonas aeruginosa PA01
ccgcgacaggaugg

SEQ ID NO: 1553809 - RNA, 12 nt, Pseudomonas aeruginosa PA01
ccgcgaaugcuc

SEQ ID NO: 1553810 - RNA, 23 nt, Pseudomonas aeruginosa PA01
ccgcgaauggcagcaggcacagg

SEQ ID NO: 1553811 - RNA, 13 nt, Pseudomonas aeruginosa PA01
ccgccugguccag

SEQ ID NO: 1553812 - RNA, 21 nt, Pseudomonas aeruginosa PA01
ccgccuuucugcccggcuucg

SEQ ID NO: 1553813 - RNA, 18 nt, Pseudomonas aeruginosa PA01
ccgccugcggauagccaa

SEQ ID NO: 1553814 - RNA, 16 nt, Pseudomonas aeruginosa PA01
ccgccugcucggccug

SEQ ID NO: 1553815 - RNA, 14 nt, Pseudomonas aeruginosa PA01
ccgccugcgucagc

SEQ ID NO: 1553816 - RNA, 17 nt, Pseudomonas aeruginosa PA01
ccgccuggagcaguuuc

SEQ ID NO: 1553817 - RNA, 18 nt, Pseudomonas aeruginosa PA01
ccgccuggccggccagcc

SEQ ID NO: 1553818 - RNA, 21 nt, Pseudomonas aeruginosa PA01
ccgccuggcgcauggcgcucu

SEQ ID NO: 1553819 - RNA, 18 nt, Pseudomonas aeruginosa PA01
ccgccugggccgccucgc

SEQ ID NO: 1553820 - RNA, 19 nt, Pseudomonas aeruginosa PA01
ccgccugggcggucggcuc

SEQ ID NO: 1553821 - RNA, 20 nt, Pseudomonas aeruginosa PA01
ccgccuggguggcgacgaag

SEQ ID NO: 1553822 - RNA, 16 nt, Pseudomonas aeruginosa PA01
ccgccgccgcgccggc

SEQ ID NO: 1553823 - RNA, 15 nt, Pseudomonas aeruginosa PA01
ccgccgccgcggcgc

SEQ ID NO: 1553824 - RNA, 14 nt, Pseudomonas aeruginosa PA01
ccgccgccggccug

SEQ ID NO: 1553825 - RNA, 16 nt, Pseudomonas aeruginosa PA01
ccgccgccgugaucuc

SEQ ID NO: 1553826 - RNA, 13 nt, Pseudomonas aeruginosa PA01
ccgccgccgucga

SEQ ID NO: 1553827 - RNA, 23 nt, Pseudomonas aeruginosa PA01
ccgcgcuuggccuugccguccag

SEQ ID NO: 1553828 - RNA, 19 nt, Pseudomonas aeruginosa PA01
ccgcgcugucggccucgac

SEQ ID NO: 1553829 - RNA, 23 nt, Pseudomonas aeruginosa PA01
ccgcgcuucuucgacuaccuggg

SEQ ID NO: 1553830 - RNA, 23 nt, Pseudomonas aeruginosa PA01
ccgcgcuugccgucgcggaagcc

SEQ ID NO: 1553831 - RNA, 19 nt, Pseudomonas aeruginosa PA01
ccgcgcugcaggcgguagc

SEQ ID NO: 1553832 - RNA, 14 nt, Pseudomonas aeruginosa PA01
ccgcgcugcgccag

SEQ ID NO: 1553833 - RNA, 15 nt, Pseudomonas aeruginosa PA01
ccgcggagcaccgcg

SEQ ID NO: 1553834 - RNA, 22 nt, Pseudomonas aeruginosa PA01
ccgcggagcaccgcgccuucca

SEQ ID NO: 1553835 - RNA, 16 nt, Pseudomonas aeruginosa PA01
ccgcggaaaacgccgc

SEQ ID NO: 1553836 - RNA, 19 nt, Pseudomonas aeruginosa PA01
ccgcgcucggaucaggcgg

SEQ ID NO: 1553837 - RNA, 22 nt, Pseudomonas aeruginosa PA01
ccgcgcguaggcuuggucgggc

SEQ ID NO: 1553838 - RNA, 19 nt, Pseudomonas aeruginosa PA01
ccgcgccagcaggcgcagc

SEQ ID NO: 1553839 - RNA, 20 nt, Pseudomonas aeruginosa PA01
ccgcgccagccacucccggc

SEQ ID NO: 1553840 - RNA, 22 nt, Pseudomonas aeruginosa PA01
ccgcgccagccacucccggccc

SEQ ID NO: 1553841 - RNA, 13 nt, Pseudomonas aeruginosa PA01
ccgcgccagcgcc

SEQ ID NO: 1553842 - RNA, 15 nt, Pseudomonas aeruginosa PA01
ccgcgccagcgccgc

SEQ ID NO: 1553843 - RNA, 18 nt, Pseudomonas aeruginosa PA01
ccgcgccagcgccgccag

SEQ ID NO: 1553844 - RNA, 13 nt, Pseudomonas aeruginosa PA01
ccgcgccaggcgc

SEQ ID NO: 1553845 - RNA, 16 nt, Pseudomonas aeruginosa PA01
ccgcgcgauggccggc

SEQ ID NO: 1553846 - RNA, 21 nt, Pseudomonas aeruginosa PA01
ccgcgcgauggccggcggaga

SEQ ID NO: 1553847 - RNA, 23 nt, Pseudomonas aeruginosa PA01
ccgcgcauggagacggcccgccc

SEQ ID NO: 1553848 - RNA, 16 nt, Pseudomonas aeruginosa PA01
ccgcgcaggcggucgg

SEQ ID NO: 1553849 - RNA, 19 nt, Pseudomonas aeruginosa PA01
ccgcgcagcuugccuucca

SEQ ID NO: 1553850 - RNA, 12 nt, Pseudomonas aeruginosa PA01
ccgcgcaggaag

SEQ ID NO: 1553851 - RNA, 20 nt, Pseudomonas aeruginosa PA01
ccgcgcaguuccuucaccgg

SEQ ID NO: 1553852 - RNA, 23 nt, Pseudomonas aeruginosa PA01
ccgcgcaugaaaaagccgcccac

SEQ ID NO: 1553853 - RNA, 24 nt, Pseudomonas aeruginosa PA01
ccgcgcaugaaaaagccgcccacg

SEQ ID NO: 1553854 - RNA, 15 nt, Pseudomonas aeruginosa PA01
ccgcgcgccugcaac

SEQ ID NO: 1553855 - RNA, 14 nt, Pseudomonas aeruginosa PA01
ccgcgcgccuggcu

SEQ ID NO: 1553856 - RNA, 17 nt, Pseudomonas aeruginosa PA01
ccgcgcgccuggcuggc

SEQ ID NO: 1553857 - RNA, 19 nt, Pseudomonas aeruginosa PA01
ccgcgcgccuggcuggcca

SEQ ID NO: 1553858 - RNA, 17 nt, Pseudomonas aeruginosa PA01
ccgcgcgcgcgcuccuc

SEQ ID NO: 1553859 - RNA, 23 nt, Pseudomonas aeruginosa PA01
ccgcgcgggccggcgauggccca

SEQ ID NO: 1553860 - RNA, 18 nt, Pseudomonas aeruginosa PA01
ccgcgcggcgcccugccg

SEQ ID NO: 1553861 - RNA, 22 nt, Pseudomonas aeruginosa PA01
ccggccuggcgcgcgcgccagg

SEQ ID NO: 1553862 - RNA, 21 nt, Pseudomonas aeruginosa PA01
ccggccuucaccgcgccgcgc

SEQ ID NO: 1553863 - RNA, 21 nt, Pseudomonas aeruginosa PA01
ccggccugcgcgcaccaggcc

SEQ ID NO: 1553864 - RNA, 17 nt, Pseudomonas aeruginosa PA01
ccggccugucacgccgg

SEQ ID NO: 1553865 - RNA, 21 nt, Pseudomonas aeruginosa PA01
ccggcgaacagccagcgguug

SEQ ID NO: 1553866 - RNA, 22 nt, Pseudomonas aeruginosa PA01
ccggcgaacagcgcuuccuggg

SEQ ID NO: 1553867 - RNA, 14 nt, Pseudomonas aeruginosa PA01
ccggcgaaccaggc

SEQ ID NO: 1553868 - RNA, 20 nt, Pseudomonas aeruginosa PA01
ccggcgaggcguuccaggug

SEQ ID NO: 1553869 - RNA, 13 nt, Pseudomonas aeruginosa PA01
ccggcgaccaccg

SEQ ID NO: 1553870 - RNA, 14 nt, Pseudomonas aeruginosa PA01
ccggcgaccaccgc

SEQ ID NO: 1553871 - RNA, 14 nt, Pseudomonas aeruginosa PA01
ccggccuccagcgc

SEQ ID NO: 1553872 - RNA, 17 nt, Pseudomonas aeruginosa PA01
ccggccuccagcgccuc

SEQ ID NO: 1553873 - RNA, 14 nt, Pseudomonas aeruginosa PA01
ccggccucaagcaa

SEQ ID NO: 1553874 - RNA, 16 nt, Pseudomonas aeruginosa PA01
ccggccucaagcaagc

SEQ ID NO: 1553875 - RNA, 16 nt, Pseudomonas aeruginosa PA01
ccggccucggcggcgc

SEQ ID NO: 1553876 - RNA, 20 nt, Pseudomonas aeruginosa PA01
ccggccgucccagucggcgu

SEQ ID NO: 1553877 - RNA, 23 nt, Pseudomonas aeruginosa PA01
ccggccgcuggaugccgaccacg

SEQ ID NO: 1553878 - RNA, 12 nt, Pseudomonas aeruginosa PA01
ccggccgaugga

SEQ ID NO: 1553879 - RNA, 18 nt, Pseudomonas aeruginosa PA01
ccggcgcagcccagccgc

SEQ ID NO: 1553880 - RNA, 17 nt, Pseudomonas aeruginosa PA01
ccggcgcaucagcgccg

SEQ ID NO: 1553881 - RNA, 16 nt, Pseudomonas aeruginosa PA01
ccggcgccaccccgcc

SEQ ID NO: 1553882 - RNA, 16 nt, Pseudomonas aeruginosa PA01
ccggcgaugcccaggc

SEQ ID NO: 1553883 - RNA, 18 nt, Pseudomonas aeruginosa PA01
ccggcgaugcccaggccg

SEQ ID NO: 1553884 - RNA, 20 nt, Pseudomonas aeruginosa PA01
ccggcgaugcccaggccgcc

SEQ ID NO: 1553885 - RNA, 16 nt, Pseudomonas aeruginosa PA01
ccggcgaugccgccca

SEQ ID NO: 1553886 - RNA, 21 nt, Pseudomonas aeruginosa PA01
ccggcgaugcucagcgccggc

SEQ ID NO: 1553887 - RNA, 14 nt, Pseudomonas aeruginosa PA01
ccggcgauggccca

SEQ ID NO: 1553888 - RNA, 21 nt, Pseudomonas aeruginosa PA01
ccggcgauggccgccugcagg

SEQ ID NO: 1553889 - RNA, 14 nt, Pseudomonas aeruginosa PA01
ccggcgccaucgau

SEQ ID NO: 1553890 - RNA, 14 nt, Pseudomonas aeruginosa PA01
ccggcgccccggcc

SEQ ID NO: 1553891 - RNA, 22 nt, Pseudomonas aeruginosa PA01
ccggcgccgcagggugcggcug

SEQ ID NO: 1553892 - RNA, 13 nt, Pseudomonas aeruginosa PA01
ccggcgcccggcg

SEQ ID NO: 1553893 - RNA, 13 nt, Pseudomonas aeruginosa PA01
ccggcgcccuggg

SEQ ID NO: 1553894 - RNA, 16 nt, Pseudomonas aeruginosa PA01
ccggcgcccugggcgc

SEQ ID NO: 1553895 - RNA, 14 nt, Pseudomonas aeruginosa PA01
ccggcgcccuucga

SEQ ID NO: 1553896 - RNA, 21 nt, Pseudomonas aeruginosa PA01
ccggcgccgccccguuggcgc

SEQ ID NO: 1553897 - RNA, 12 nt, Pseudomonas aeruginosa PA01
ccggcgccgccu

SEQ ID NO: 1553898 - RNA, 15 nt, Pseudomonas aeruginosa PA01
ccggcgccgccucgg

SEQ ID NO: 1553899 - RNA, 21 nt, Pseudomonas aeruginosa PA01
ccggcgccgccucgggcagcc

SEQ ID NO: 1553900 - RNA, 13 nt, Pseudomonas aeruginosa PA01
ccggcgccgccgg

SEQ ID NO: 1553901 - RNA, 19 nt, Pseudomonas aeruginosa PA01
ccggcgcggcgcagcggcg

SEQ ID NO: 1553902 - RNA, 18 nt, Pseudomonas aeruginosa PA01
ccggcgcgggcggccucg

SEQ ID NO: 1553903 - RNA, 21 nt, Pseudomonas aeruginosa PA01
ccggcgcuccacagcugccag

SEQ ID NO: 1553904 - RNA, 17 nt, Pseudomonas aeruginosa PA01
ccggcgcuggccgcgcg

SEQ ID NO: 1553905 - RNA, 22 nt, Pseudomonas aeruginosa PA01
ccggcgcuggccgcgcgaccgc

SEQ ID NO: 1553906 - RNA, 23 nt, Pseudomonas aeruginosa PA01
ccggcgccggcaggaacgcccgc

SEQ ID NO: 1553907 - RNA, 12 nt, Pseudomonas aeruginosa PA01
ccggcgccgcgg

SEQ ID NO: 1553908 - RNA, 12 nt, Pseudomonas aeruginosa PA01
ccggcgccgucg

SEQ ID NO: 1553909 - RNA, 18 nt, Pseudomonas aeruginosa PA01
ccggcgccuugcgccagg

SEQ ID NO: 1553910 - RNA, 16 nt, Pseudomonas aeruginosa PA01
ccggcgcgaccgucgg

SEQ ID NO: 1553911 - RNA, 21 nt, Pseudomonas aeruginosa PA01
ccggcgcgacgcuccaggugc

SEQ ID NO: 1553912 - RNA, 19 nt, Pseudomonas aeruginosa PA01
ccggcgcgcacggucuugg

SEQ ID NO: 1553913 - RNA, 16 nt, Pseudomonas aeruginosa PA01
ccggcgcgccccugcg

SEQ ID NO: 1553914 - RNA, 23 nt, Pseudomonas aeruginosa PA01
ccggcgcggacgauggucgccgc

SEQ ID NO: 1553915 - RNA, 21 nt, Pseudomonas aeruginosa PA01
ccggcgcgccguucuuguuga

SEQ ID NO: 1553916 - RNA, 22 nt, Pseudomonas aeruginosa PA01
ccggaugcuccagguucggcgc

SEQ ID NO: 1553917 - RNA, 13 nt, Pseudomonas aeruginosa PA01
ccggaggcgcaca

SEQ ID NO: 1553918 - RNA, 14 nt, Pseudomonas aeruginosa PA01
ccggaggggcggcc

SEQ ID NO: 1553919 - RNA, 15 nt, Pseudomonas aeruginosa PA01
ccggacgcaccagca

SEQ ID NO: 1553920 - RNA, 20 nt, Pseudomonas aeruginosa PA01
ccggagcgcgaaagcgcccc

SEQ ID NO: 1553921 - RNA, 22 nt, Pseudomonas aeruginosa PA01
ccggagcggcugccgaggcuga

SEQ ID NO: 1553922 - RNA, 18 nt, Pseudomonas aeruginosa PA01
ccggagcuuugcagggcg

SEQ ID NO: 1553923 - RNA, 13 nt, Pseudomonas aeruginosa PA01
ccggagccaccgg

SEQ ID NO: 1553924 - RNA, 22 nt, Pseudomonas aeruginosa PA01
ccggagccaccgggaucuggcc

SEQ ID NO: 1553925 - RNA, 13 nt, Pseudomonas aeruginosa PA01
ccgcuugccagcc

SEQ ID NO: 1553926 - RNA, 12 nt, Pseudomonas aeruginosa PA01
ccgcuugcgccg

SEQ ID NO: 1553927 - RNA, 15 nt, Pseudomonas aeruginosa PA01
ccgcuugcgccgccu

SEQ ID NO: 1553928 - RNA, 22 nt, Pseudomonas aeruginosa PA01
ccgcuucggcugcugcugcggc

SEQ ID NO: 1553929 - RNA, 12 nt, Pseudomonas aeruginosa PA01
ccgcuucuuccc

SEQ ID NO: 1553930 - RNA, 17 nt, Pseudomonas aeruginosa PA01
ccggaccagaucggcgc

SEQ ID NO: 1553931 - RNA, 15 nt, Pseudomonas aeruginosa PA01
ccggaccgggcggca

SEQ ID NO: 1553932 - RNA, 23 nt, Pseudomonas aeruginosa PA01
ccggcccggagaucgccgcgccg

SEQ ID NO: 1553933 - RNA, 14 nt, Pseudomonas aeruginosa PA01
ccggcccggccagg

SEQ ID NO: 1553934 - RNA, 15 nt, Pseudomonas aeruginosa PA01
ccggcccggccaggc

SEQ ID NO: 1553935 - RNA, 15 nt, Pseudomonas aeruginosa PA01
ccggcccggccaggu

SEQ ID NO: 1553936 - RNA, 15 nt, Pseudomonas aeruginosa PA01
ccggcccggccaucc

SEQ ID NO: 1553937 - RNA, 15 nt, Pseudomonas aeruginosa PA01
ccggccccugggccg

SEQ ID NO: 1553938 - RNA, 15 nt, Pseudomonas aeruginosa PA01
ccggccgaccaggug

SEQ ID NO: 1553939 - RNA, 18 nt, Pseudomonas aeruginosa PA01
ccggccgaccaggugcug

SEQ ID NO: 1553940 - RNA, 14 nt, Pseudomonas aeruginosa PA01
ccggccccaccagc

SEQ ID NO: 1553941 - RNA, 13 nt, Pseudomonas aeruginosa PA01
ccggcccaggccg

SEQ ID NO: 1553942 - RNA, 18 nt, Pseudomonas aeruginosa PA01
ccggcccgcgccgccucg

SEQ ID NO: 1553943 - RNA, 17 nt, Pseudomonas aeruginosa PA01
ccggccacucgcagccg

SEQ ID NO: 1553944 - RNA, 21 nt, Pseudomonas aeruginosa PA01
ccggccacucgcagccgcgcu

SEQ ID NO: 1553945 - RNA, 11 nt, Pseudomonas aeruginosa PA01
ccggccagcca

SEQ ID NO: 1553946 - RNA, 21 nt, Pseudomonas aeruginosa PA01
ccggccagccgcgccagugcc

SEQ ID NO: 1553947 - RNA, 12 nt, Pseudomonas aeruginosa PA01
ccggccagcccg

SEQ ID NO: 1553948 - RNA, 15 nt, Pseudomonas aeruginosa PA01
ccggccagcccggcc

SEQ ID NO: 1553949 - RNA, 16 nt, Pseudomonas aeruginosa PA01
ccggccauuccuucca

SEQ ID NO: 1553950 - RNA, 18 nt, Pseudomonas aeruginosa PA01
ccggccauuccuuccagg

SEQ ID NO: 1553951 - RNA, 19 nt, Pseudomonas aeruginosa PA01
ccggccauuccuuccaggg

SEQ ID NO: 1553952 - RNA, 13 nt, Pseudomonas aeruginosa PA01
ccggcccagcagg

SEQ ID NO: 1553953 - RNA, 16 nt, Pseudomonas aeruginosa PA01
ccggcccagcaggccg

SEQ ID NO: 1553954 - RNA, 22 nt, Pseudomonas aeruginosa PA01
ccggccacgcgaccagcgccag

SEQ ID NO: 1553955 - RNA, 10 nt, Pseudomonas aeruginosa PA01
ccggcauccc

SEQ ID NO: 1553956 - RNA, 18 nt, Pseudomonas aeruginosa PA01
ccggcagggucacgccgg

SEQ ID NO: 1553957 - RNA, 14 nt, Pseudomonas aeruginosa PA01
ccggcaggucgggc

SEQ ID NO: 1553958 - RNA, 16 nt, Pseudomonas aeruginosa PA01
ccggcaaacgccgcca

SEQ ID NO: 1553959 - RNA, 15 nt, Pseudomonas aeruginosa PA01
ccggcaacaguucug

SEQ ID NO: 1553960 - RNA, 22 nt, Pseudomonas aeruginosa PA01
ccggcaacaguucugccgcaga

SEQ ID NO: 1553961 - RNA, 14 nt, Pseudomonas aeruginosa PA01
ccggcaccagcagu

SEQ ID NO: 1553962 - RNA, 22 nt, Pseudomonas aeruginosa PA01
ccguuggcgaacuucaggccgg

SEQ ID NO: 1553963 - RNA, 13 nt, Pseudomonas aeruginosa PA01
ccguugggccagg

SEQ ID NO: 1553964 - RNA, 14 nt, Pseudomonas aeruginosa PA01
ccguuguggcaggc

SEQ ID NO: 1553965 - RNA, 21 nt, Pseudomonas aeruginosa PA01
ccguugagcaccucgaccugg

SEQ ID NO: 1553966 - RNA, 16 nt, Pseudomonas aeruginosa PA01
ccguugaccugguugc

SEQ ID NO: 1553967 - RNA, 19 nt, Pseudomonas aeruginosa PA01
ccguugaacucggcgccca

SEQ ID NO: 1553968 - RNA, 23 nt, Pseudomonas aeruginosa PA01
ccguugaagcagacguagggcug

SEQ ID NO: 1553969 - RNA, 21 nt, Pseudomonas aeruginosa PA01
ccguucugccgcagcgccucc

SEQ ID NO: 1553970 - RNA, 23 nt, Pseudomonas aeruginosa PA01
ccguucugccgcagcgccucccg

SEQ ID NO: 1553971 - RNA, 16 nt, Pseudomonas aeruginosa PA01
ccguucggcgcccagg

SEQ ID NO: 1553972 - RNA, 17 nt, Pseudomonas aeruginosa PA01
ccguucggcgcccaggu

SEQ ID NO: 1553973 - RNA, 22 nt, Pseudomonas aeruginosa PA01
ccgugggaguccagguacacca

SEQ ID NO: 1553974 - RNA, 17 nt, Pseudomonas aeruginosa PA01
ccgugggaucgccacgc

SEQ ID NO: 1553975 - RNA, 13 nt, Pseudomonas aeruginosa PA01
ccgugggccggcg

SEQ ID NO: 1553976 - RNA, 16 nt, Pseudomonas aeruginosa PA01
ccgugggccggcgcgc

SEQ ID NO: 1553977 - RNA, 20 nt, Pseudomonas aeruginosa PA01
ccguggcucggcggcaggcu

SEQ ID NO: 1553978 - RNA, 17 nt, Pseudomonas aeruginosa PA01
ccguggcugugcuggcc

SEQ ID NO: 1553979 - RNA, 19 nt, Pseudomonas aeruginosa PA01
ccguguugaucgccgcgcc

SEQ ID NO: 1553980 - RNA, 23 nt, Pseudomonas aeruginosa PA01
ccguguugaucgccgcgccgccg

SEQ ID NO: 1553981 - RNA, 20 nt, Pseudomonas aeruginosa PA01
ccguggcgacgaugcgcccc

SEQ ID NO: 1553982 - RNA, 23 nt, Pseudomonas aeruginosa PA01
ccguggcgacgaugcgccccagc

SEQ ID NO: 1553983 - RNA, 18 nt, Pseudomonas aeruginosa PA01
ccguggcgacgcagcacg

SEQ ID NO: 1553984 - RNA, 14 nt, Pseudomonas aeruginosa PA01
ccguggcggcgcgc

SEQ ID NO: 1553985 - RNA, 18 nt, Pseudomonas aeruginosa PA01
ccguggcggccgccgcgc

SEQ ID NO: 1553986 - RNA, 15 nt, Pseudomonas aeruginosa PA01
ccguggcgggccagc

SEQ ID NO: 1553987 - RNA, 18 nt, Pseudomonas aeruginosa PA01
ccguggcgggccagcagg

SEQ ID NO: 1553988 - RNA, 23 nt, Pseudomonas aeruginosa PA01
ccguggcgggccagcaggcgcuc

SEQ ID NO: 1553989 - RNA, 13 nt, Pseudomonas aeruginosa PA01
ccguggcgccggc

SEQ ID NO: 1553990 - RNA, 17 nt, Pseudomonas aeruginosa PA01
ccguggcgccccaggcg

SEQ ID NO: 1553991 - RNA, 18 nt, Pseudomonas aeruginosa PA01
ccguggcgccccaggcgg

SEQ ID NO: 1553992 - RNA, 13 nt, Pseudomonas aeruginosa PA01
ccguccgggcacg

SEQ ID NO: 1553993 - RNA, 17 nt, Pseudomonas aeruginosa PA01
ccguccuacgcgaccgg

SEQ ID NO: 1553994 - RNA, 23 nt, Pseudomonas aeruginosa PA01
ccguccucgggaugcaguucguu

SEQ ID NO: 1553995 - RNA, 15 nt, Pseudomonas aeruginosa PA01
ccguccuucaggacg

SEQ ID NO: 1553996 - RNA, 21 nt, Pseudomonas aeruginosa PA01
ccguccuucggccgcaccagg

SEQ ID NO: 1553997 - RNA, 21 nt, Pseudomonas aeruginosa PA01
ccguccucgucgaggucgagg

SEQ ID NO: 1553998 - RNA, 13 nt, Pseudomonas aeruginosa PA01
ccgucgcccuggu

SEQ ID NO: 1553999 - RNA, 21 nt, Pseudomonas aeruginosa PA01
ccgugcaucaccggcagcagc

SEQ ID NO: 1554000 - RNA, 15 nt, Pseudomonas aeruginosa PA01
ccgugcagggucagg

SEQ ID NO: 1554001 - RNA, 14 nt, Pseudomonas aeruginosa PA01
ccgugaggcgcgcg

SEQ ID NO: 1554002 - RNA, 16 nt, Pseudomonas aeruginosa PA01
ccgugaugcccagcgg

SEQ ID NO: 1554003 - RNA, 14 nt, Pseudomonas aeruginosa PA01
ccuagggucggcgu

SEQ ID NO: 1554004 - RNA, 15 nt, Pseudomonas aeruginosa PA01
ccuacuaccgcuggg

SEQ ID NO: 1554005 - RNA, 23 nt, Pseudomonas aeruginosa PA01
ccuacugggcguggcggccgccg

SEQ ID NO: 1554006 - RNA, 15 nt, Pseudomonas aeruginosa PA01
ccucaacgaccgccc

SEQ ID NO: 1554007 - RNA, 16 nt, Pseudomonas aeruginosa PA01
ccucaacgaccgccca

SEQ ID NO: 1554008 - RNA, 18 nt, Pseudomonas aeruginosa PA01
ccucaacgaccgcccagg

SEQ ID NO: 1554009 - RNA, 21 nt, Pseudomonas aeruginosa PA01
ccucaacgaccgcccaggcug

SEQ ID NO: 1554010 - RNA, 23 nt, Pseudomonas aeruginosa PA01
ccucaccccacgggcgacccagg

SEQ ID NO: 1554011 - RNA, 14 nt, Pseudomonas aeruginosa PA01
ccucacccugcugg

SEQ ID NO: 1554012 - RNA, 15 nt, Pseudomonas aeruginosa PA01
ccucacccugcuggg

SEQ ID NO: 1554013 - RNA, 16 nt, Pseudomonas aeruginosa PA01
ccucacaccaccagca

SEQ ID NO: 1554014 - RNA, 15 nt, Pseudomonas aeruginosa PA01
ccucaagucuccagc

SEQ ID NO: 1554015 - RNA, 16 nt, Pseudomonas aeruginosa PA01
ccucaagucuccagcg

SEQ ID NO: 1554016 - RNA, 19 nt, Pseudomonas aeruginosa PA01
ccucagagucgcaccggga

SEQ ID NO: 1554017 - RNA, 19 nt, Pseudomonas aeruginosa PA01
ccgggcaacugaucagccg

SEQ ID NO: 1554018 - RNA, 20 nt, Pseudomonas aeruginosa PA01
ccggcgcugucucgccagcc

SEQ ID NO: 1554019 - RNA, 15 nt, Pseudomonas aeruginosa PA01
ccgggaucagcggcg

SEQ ID NO: 1554020 - RNA, 21 nt, Pseudomonas aeruginosa PA01
ccgggaucagcggcggggcca

SEQ ID NO: 1554021 - RNA, 16 nt, Pseudomonas aeruginosa PA01
ccggcggacaaccacc

SEQ ID NO: 1554022 - RNA, 14 nt, Pseudomonas aeruginosa PA01
ccgggaucugccgg

SEQ ID NO: 1554023 - RNA, 17 nt, Pseudomonas aeruginosa PA01
ccgggaugaacccggcu

SEQ ID NO: 1554024 - RNA, 17 nt, Pseudomonas aeruginosa PA01
ccgggaugaacugcagc

SEQ ID NO: 1554025 - RNA, 21 nt, Pseudomonas aeruginosa PA01
ccgggaugaagaucaucuggg

SEQ ID NO: 1554026 - RNA, 20 nt, Pseudomonas aeruginosa PA01
ccgggcaccccgagcggcgc

SEQ ID NO: 1554027 - RNA, 20 nt, Pseudomonas aeruginosa PA01
ccgggcacgcauagcgcgcu

SEQ ID NO: 1554028 - RNA, 21 nt, Pseudomonas aeruginosa PA01
ccgggcacgcauagcgcgcug

SEQ ID NO: 1554029 - RNA, 15 nt, Pseudomonas aeruginosa PA01
ccgggccggccaggg

SEQ ID NO: 1554030 - RNA, 20 nt, Pseudomonas aeruginosa PA01
ccgggccgcaucgcgggcgu

SEQ ID NO: 1554031 - RNA, 17 nt, Pseudomonas aeruginosa PA01
ccgggccgcagcgcagc

SEQ ID NO: 1554032 - RNA, 15 nt, Pseudomonas aeruginosa PA01
ccgggcagugcgccc

SEQ ID NO: 1554033 - RNA, 15 nt, Pseudomonas aeruginosa PA01
ccgggcaucaugccg

SEQ ID NO: 1554034 - RNA, 14 nt, Pseudomonas aeruginosa PA01
ccgggguccgccgg

SEQ ID NO: 1554035 - RNA, 21 nt, Pseudomonas aeruginosa PA01
ccgggguggaguaccaggcca

SEQ ID NO: 1554036 - RNA, 16 nt, Pseudomonas aeruginosa PA01
ccgggguauggccuuc

SEQ ID NO: 1554037 - RNA, 15 nt, Pseudomonas aeruginosa PA01
ccgggcgcggcuggu

SEQ ID NO: 1554038 - RNA, 23 nt, Pseudomonas aeruginosa PA01
ccgggcgcgcgccucagcggcug

SEQ ID NO: 1554039 - RNA, 19 nt, Pseudomonas aeruginosa PA01
ccggggcgugcaggccgcc

SEQ ID NO: 1554040 - RNA, 21 nt, Pseudomonas aeruginosa PA01
ccgggcgcaacccugcccagu

SEQ ID NO: 1554041 - RNA, 22 nt, Pseudomonas aeruginosa PA01
ccgggcgccaccgauagcggcg

SEQ ID NO: 1554042 - RNA, 15 nt, Pseudomonas aeruginosa PA01
ccgggcgaccugcuc

SEQ ID NO: 1554043 - RNA, 20 nt, Pseudomonas aeruginosa PA01
ccgggccuuucuuuucugcc

SEQ ID NO: 1554044 - RNA, 19 nt, Pseudomonas aeruginosa PA01
ccgggcgagucgaucaggu

SEQ ID NO: 1554045 - RNA, 17 nt, Pseudomonas aeruginosa PA01
ccgggccuccuggcggc

SEQ ID NO: 1554046 - RNA, 14 nt, Pseudomonas aeruginosa PA01
ccgggccgucgggc

SEQ ID NO: 1554047 - RNA, 13 nt, Pseudomonas aeruginosa PA01
ccgguacccguac

SEQ ID NO: 1554048 - RNA, 21 nt, Pseudomonas aeruginosa PA01
ccgguaaugacgaucucgaug

SEQ ID NO: 1554049 - RNA, 18 nt, Pseudomonas aeruginosa PA01
ccgguacgcucaccacca

SEQ ID NO: 1554050 - RNA, 15 nt, Pseudomonas aeruginosa PA01
ccgggugaccgugcg

SEQ ID NO: 1554051 - RNA, 16 nt, Pseudomonas aeruginosa PA01
ccgggugacggcguuc

SEQ ID NO: 1554052 - RNA, 14 nt, Pseudomonas aeruginosa PA01
ccgggugccuuccg

SEQ ID NO: 1554053 - RNA, 19 nt, Pseudomonas aeruginosa PA01
ccggguggagaggcgugcu

SEQ ID NO: 1554054 - RNA, 20 nt, Pseudomonas aeruginosa PA01
ccgggucgaugggccguagg

SEQ ID NO: 1554055 - RNA, 15 nt, Pseudomonas aeruginosa PA01
ccgggucgccgcagc

SEQ ID NO: 1554056 - RNA, 22 nt, Pseudomonas aeruginosa PA01
ccggguccaccgcggccucgcu

SEQ ID NO: 1554057 - RNA, 15 nt, Pseudomonas aeruginosa PA01
ccgggucaugccgcc

SEQ ID NO: 1554058 - RNA, 15 nt, Pseudomonas aeruginosa PA01
ccggguccugcagau

SEQ ID NO: 1554059 - RNA, 17 nt, Pseudomonas aeruginosa PA01
ccggguccagcggccgc

SEQ ID NO: 1554060 - RNA, 14 nt, Pseudomonas aeruginosa PA01
ccgggucgcugccc

SEQ ID NO: 1554061 - RNA, 16 nt, Pseudomonas aeruginosa PA01
ccgggucgucagcagg

SEQ ID NO: 1554062 - RNA, 18 nt, Pseudomonas aeruginosa PA01
ccgggucgucggucggcc

SEQ ID NO: 1554063 - RNA, 21 nt, Pseudomonas aeruginosa PA01
ccgggucgucggucggccagg

SEQ ID NO: 1554064 - RNA, 15 nt, Pseudomonas aeruginosa PA01
ccggucuagccgggc

SEQ ID NO: 1554065 - RNA, 19 nt, Pseudomonas aeruginosa PA01
ccggucuucacgccuugcu

SEQ ID NO: 1554066 - RNA, 18 nt, Pseudomonas aeruginosa PA01
ccggucucagccggcgcu

SEQ ID NO: 1554067 - RNA, 13 nt, Pseudomonas aeruginosa PA01
ccggucugcugcg

SEQ ID NO: 1554068 - RNA, 21 nt, Pseudomonas aeruginosa PA01
ccggucaggccgaucaccacc

SEQ ID NO: 1554069 - RNA, 20 nt, Pseudomonas aeruginosa PA01
ccggucagcuucgccgcccu

SEQ ID NO: 1554070 - RNA, 16 nt, Pseudomonas aeruginosa PA01
ccgguagacgccuccc

SEQ ID NO: 1554071 - RNA, 15 nt, Pseudomonas aeruginosa PA01
ccgguagcgcgccug

SEQ ID NO: 1554072 - RNA, 17 nt, Pseudomonas aeruginosa PA01
ccgguagcgcgccugcu

SEQ ID NO: 1554073 - RNA, 21 nt, Pseudomonas aeruginosa PA01
ccgguaggagcgagagcgcug

SEQ ID NO: 1554074 - RNA, 16 nt, Pseudomonas aeruginosa PA01
ccgguggucuucagca

SEQ ID NO: 1554075 - RNA, 13 nt, Pseudomonas aeruginosa PA01
ccgguggcgccca

SEQ ID NO: 1554076 - RNA, 17 nt, Pseudomonas aeruginosa PA01
ccgguggcgcccagcca

SEQ ID NO: 1554077 - RNA, 14 nt, Pseudomonas aeruginosa PA01
ccgguggccuccug

SEQ ID NO: 1554078 - RNA, 18 nt, Pseudomonas aeruginosa PA01
ccgguggcgguugcgguu

SEQ ID NO: 1554079 - RNA, 16 nt, Pseudomonas aeruginosa PA01
ccggugcgaaccggcc

SEQ ID NO: 1554080 - RNA, 13 nt, Pseudomonas aeruginosa PA01
ccggugccggcgg

SEQ ID NO: 1554081 - RNA, 16 nt, Pseudomonas aeruginosa PA01
ccggugcuggcgagca

SEQ ID NO: 1554082 - RNA, 19 nt, Pseudomonas aeruginosa PA01
ccgguugcuggcacagguc

SEQ ID NO: 1554083 - RNA, 15 nt, Pseudomonas aeruginosa PA01
ccgguugcggcgccg

SEQ ID NO: 1554084 - RNA, 19 nt, Pseudomonas aeruginosa PA01
ccgguugagauccuggccg

SEQ ID NO: 1554085 - RNA, 17 nt, Pseudomonas aeruginosa PA01
ccgguuuccgcagcgcu

SEQ ID NO: 1554086 - RNA, 22 nt, Pseudomonas aeruginosa PA01
ccgguuggcuacccgcagggcu

SEQ ID NO: 1554087 - RNA, 16 nt, Pseudomonas aeruginosa PA01
ccgguugugcgcccgu

SEQ ID NO: 1554088 - RNA, 18 nt, Pseudomonas aeruginosa PA01
ccgguuucgccaguucuc

SEQ ID NO: 1554089 - RNA, 19 nt, Pseudomonas aeruginosa PA01
ccgguuaucgaggcgucgg

SEQ ID NO: 1554090 - RNA, 17 nt, Pseudomonas aeruginosa PA01
ccgguucccgcagcgau

SEQ ID NO: 1554091 - RNA, 17 nt, Pseudomonas aeruginosa PA01
ccgguucgcaggccagg

SEQ ID NO: 1554092 - RNA, 18 nt, Pseudomonas aeruginosa PA01
ccgguucgcaggccaggc

SEQ ID NO: 1554093 - RNA, 20 nt, Pseudomonas aeruginosa PA01
ccgguucgcaggccaggcgc

SEQ ID NO: 1554094 - RNA, 23 nt, Pseudomonas aeruginosa PA01
ccguaccaagcgagacgccgccc

SEQ ID NO: 1554095 - RNA, 18 nt, Pseudomonas aeruginosa PA01
ccguacagcaggcaggca

SEQ ID NO: 1554096 - RNA, 16 nt, Pseudomonas aeruginosa PA01
ccgucaaugcggccug

SEQ ID NO: 1554097 - RNA, 20 nt, Pseudomonas aeruginosa PA01
ccgucaaugcggccugcaac

SEQ ID NO: 1554098 - RNA, 23 nt, Pseudomonas aeruginosa PA01
ccgucaaugcggccugcaacgcc

SEQ ID NO: 1554099 - RNA, 18 nt, Pseudomonas aeruginosa PA01
ccgucaccuguucggcgc

SEQ ID NO: 1554100 - RNA, 12 nt, Pseudomonas aeruginosa PA01
ccgucauggugc

SEQ ID NO: 1554101 - RNA, 20 nt, Pseudomonas aeruginosa PA01
ccgucaugcacuucgaccag

SEQ ID NO: 1554102 - RNA, 14 nt, Pseudomonas aeruginosa PA01
ccgucacggccucc

SEQ ID NO: 1554103 - RNA, 20 nt, Pseudomonas aeruginosa PA01
ccgucacggcgaaaccggcc

SEQ ID NO: 1554104 - RNA, 18 nt, Pseudomonas aeruginosa PA01
ccguccgccagguccagg

SEQ ID NO: 1554105 - RNA, 16 nt, Pseudomonas aeruginosa PA01
ccguccgcccaguucg

SEQ ID NO: 1554106 - RNA, 21 nt, Pseudomonas aeruginosa PA01
ccguccgcgaugcguuccagg

SEQ ID NO: 1554107 - RNA, 16 nt, Pseudomonas aeruginosa PA01
ccgucccggaguucca

SEQ ID NO: 1554108 - RNA, 17 nt, Pseudomonas aeruginosa PA01
ccgucccggaguuccag

SEQ ID NO: 1554109 - RNA, 17 nt, Pseudomonas aeruginosa PA01
ccguccaggcugccgcc

SEQ ID NO: 1554110 - RNA, 17 nt, Pseudomonas aeruginosa PA01
ccgucccacaggccggc

SEQ ID NO: 1554111 - RNA, 20 nt, Pseudomonas aeruginosa PA01
ccucuuccgcgcugaccugg

SEQ ID NO: 1554112 - RNA, 20 nt, Pseudomonas aeruginosa PA01
ccucuuccuggaccuccgcc

SEQ ID NO: 1554113 - RNA, 22 nt, Pseudomonas aeruginosa PA01
ccucuuccuggaccuccgccag

SEQ ID NO: 1554114 - RNA, 19 nt, Pseudomonas aeruginosa PA01
ccugaccgcgagcgccgcc

SEQ ID NO: 1554115 - RNA, 16 nt, Pseudomonas aeruginosa PA01
ccugagaucagcgccc

SEQ ID NO: 1554116 - RNA, 12 nt, Pseudomonas aeruginosa PA01
ccugagcagggu

SEQ ID NO: 1554117 - RNA, 14 nt, Pseudomonas aeruginosa PA01
ccugagcuggccca

SEQ ID NO: 1554118 - RNA, 14 nt, Pseudomonas aeruginosa PA01
ccugaggcucccag

SEQ ID NO: 1554119 - RNA, 15 nt, Pseudomonas aeruginosa PA01
ccugaggcucccagg

SEQ ID NO: 1554120 - RNA, 18 nt, Pseudomonas aeruginosa PA01
ccugaggcucccaggugg

SEQ ID NO: 1554121 - RNA, 21 nt, Pseudomonas aeruginosa PA01
ccugagccugucgauuucccc

SEQ ID NO: 1554122 - RNA, 23 nt, Pseudomonas aeruginosa PA01
ccugagugcgccauauuucgaag

SEQ ID NO: 1554123 - RNA, 13 nt, Pseudomonas aeruginosa PA01
ccugaucaucugg

SEQ ID NO: 1554124 - RNA, 15 nt, Pseudomonas aeruginosa PA01
ccugaucaucugggc

SEQ ID NO: 1554125 - RNA, 21 nt, Pseudomonas aeruginosa PA01
ccugcaacaggacccagccau

SEQ ID NO: 1554126 - RNA, 18 nt, Pseudomonas aeruginosa PA01
ccugcaacgcccgcgagc

SEQ ID NO: 1554127 - RNA, 15 nt, Pseudomonas aeruginosa PA01
ccugcaacgccgcca

SEQ ID NO: 1554128 - RNA, 20 nt, Pseudomonas aeruginosa PA01
ccugcaacgccgccaacugg

SEQ ID NO: 1554129 - RNA, 20 nt, Pseudomonas aeruginosa PA01
ccugcaggcucagcaccuug

SEQ ID NO: 1554130 - RNA, 20 nt, Pseudomonas aeruginosa PA01
ccugcaggaaggcuuccggc

SEQ ID NO: 1554131 - RNA, 16 nt, Pseudomonas aeruginosa PA01
ccugcaggacccgcga

SEQ ID NO: 1554132 - RNA, 19 nt, Pseudomonas aeruginosa PA01
ccucguccagcaggacguc

SEQ ID NO: 1554133 - RNA, 21 nt, Pseudomonas aeruginosa PA01
ccucguccagcaggcccagcc

SEQ ID NO: 1554134 - RNA, 20 nt, Pseudomonas aeruginosa PA01
ccucguccaguucagggcca

SEQ ID NO: 1554135 - RNA, 15 nt, Pseudomonas aeruginosa PA01
ccucguaggccgacu

SEQ ID NO: 1554136 - RNA, 19 nt, Pseudomonas aeruginosa PA01
ccucggcgaacuccgccag

SEQ ID NO: 1554137 - RNA, 18 nt, Pseudomonas aeruginosa PA01
ccucgucgacgcucagca

SEQ ID NO: 1554138 - RNA, 19 nt, Pseudomonas aeruginosa PA01
ccucgucgacgcucagcac

SEQ ID NO: 1554139 - RNA, 15 nt, Pseudomonas aeruginosa PA01
ccucgucgagcagcg

SEQ ID NO: 1554140 - RNA, 22 nt, Pseudomonas aeruginosa PA01
ccucgucgagcagcgcgcggcu

SEQ ID NO: 1554141 - RNA, 22 nt, Pseudomonas aeruginosa PA01
ccucgucgauacgcaucugcuc

SEQ ID NO: 1554142 - RNA, 15 nt, Pseudomonas aeruginosa PA01
ccucgucgcaccugu

SEQ ID NO: 1554143 - RNA, 20 nt, Pseudomonas aeruginosa PA01
ccucgucgcaccuguuccag

SEQ ID NO: 1554144 - RNA, 22 nt, Pseudomonas aeruginosa PA01
ccucgucgccaugcggcaggcc

SEQ ID NO: 1554145 - RNA, 18 nt, Pseudomonas aeruginosa PA01
ccucgucgcgccaggcga

SEQ ID NO: 1554146 - RNA, 18 nt, Pseudomonas aeruginosa PA01
ccucggccagcgccgccg

SEQ ID NO: 1554147 - RNA, 20 nt, Pseudomonas aeruginosa PA01
ccucggccagccagggcagc

SEQ ID NO: 1554148 - RNA, 14 nt, Pseudomonas aeruginosa PA01
ccucggccaggcau

SEQ ID NO: 1554149 - RNA, 18 nt, Pseudomonas aeruginosa PA01
ccucggcagcgcuggcga

SEQ ID NO: 1554150 - RNA, 23 nt, Pseudomonas aeruginosa PA01
ccucggcauccaguucguucugg

SEQ ID NO: 1554151 - RNA, 22 nt, Pseudomonas aeruginosa PA01
ccucggauaugccgcucagcgg

SEQ ID NO: 1554152 - RNA, 17 nt, Pseudomonas aeruginosa PA01
ccucggagucaggcucc

SEQ ID NO: 1554153 - RNA, 15 nt, Pseudomonas aeruginosa PA01
ccucggccuugcugg

SEQ ID NO: 1554154 - RNA, 23 nt, Pseudomonas aeruginosa PA01
ccucggcgaucacccggcgaagc

SEQ ID NO: 1554155 - RNA, 19 nt, Pseudomonas aeruginosa PA01
ccucggccgccaggcgcgu

SEQ ID NO: 1554156 - RNA, 13 nt, Pseudomonas aeruginosa PA01
ccucggccgccag

SEQ ID NO: 1554157 - RNA, 21 nt, Pseudomonas aeruginosa PA01
ccucggcccggagccaacgcc

SEQ ID NO: 1554158 - RNA, 13 nt, Pseudomonas aeruginosa PA01
ccucugcguucug

SEQ ID NO: 1554159 - RNA, 14 nt, Pseudomonas aeruginosa PA01
ccucuaaggaaaaa

SEQ ID NO: 1554160 - RNA, 22 nt, Pseudomonas aeruginosa PA01
ccucgccgaucuccuccgcccc

SEQ ID NO: 1554161 - RNA, 23 nt, Pseudomonas aeruginosa PA01
ccucgccgaucuccuccgccccg

SEQ ID NO: 1554162 - RNA, 16 nt, Pseudomonas aeruginosa PA01
ccucgccgccgaccgg

SEQ ID NO: 1554163 - RNA, 15 nt, Pseudomonas aeruginosa PA01
ccucgccguacagca

SEQ ID NO: 1554164 - RNA, 15 nt, Pseudomonas aeruginosa PA01
ccucgccugcggcgc

SEQ ID NO: 1554165 - RNA, 14 nt, Pseudomonas aeruginosa PA01
ccucgcgacugcug

SEQ ID NO: 1554166 - RNA, 19 nt, Pseudomonas aeruginosa PA01
ccucgcucgcuacagccgg

SEQ ID NO: 1554167 - RNA, 21 nt, Pseudomonas aeruginosa PA01
ccucgcugccuggggacggca

SEQ ID NO: 1554168 - RNA, 18 nt, Pseudomonas aeruginosa PA01
ccucggagaacagcagcg

SEQ ID NO: 1554169 - RNA, 14 nt, Pseudomonas aeruginosa PA01
ccucgccaaccagg

SEQ ID NO: 1554170 - RNA, 16 nt, Pseudomonas aeruginosa PA01
ccucgccaaccaggaa

SEQ ID NO: 1554171 - RNA, 19 nt, Pseudomonas aeruginosa PA01
ccucgccaaccaggaaggc

SEQ ID NO: 1554172 - RNA, 16 nt, Pseudomonas aeruginosa PA01
ccucgccaggcuggcu

SEQ ID NO: 1554173 - RNA, 14 nt, Pseudomonas aeruginosa PA01
ccucgcccucgcuc

SEQ ID NO: 1554174 - RNA, 17 nt, Pseudomonas aeruginosa PA01
ccucgcccaucgccagg

SEQ ID NO: 1554175 - RNA, 22 nt, Pseudomonas aeruginosa PA01
ccucgcaauugaucauccagga

SEQ ID NO: 1554176 - RNA, 16 nt, Pseudomonas aeruginosa PA01
ccucgcagagcgccag

SEQ ID NO: 1554177 - RNA, 20 nt, Pseudomonas aeruginosa PA01
ccucgcagagcgccagccag

SEQ ID NO: 1554178 - RNA, 20 nt, Pseudomonas aeruginosa PA01
ccucgauggcguguucgucg

SEQ ID NO: 1554179 - RNA, 13 nt, Pseudomonas aeruginosa PA01
ccucagcucuguc

SEQ ID NO: 1554180 - RNA, 17 nt, Pseudomonas aeruginosa PA01
ccucagccucacccugc

SEQ ID NO: 1554181 - RNA, 16 nt, Pseudomonas aeruginosa PA01
ccucagcagcgccgcc

SEQ ID NO: 1554182 - RNA, 18 nt, Pseudomonas aeruginosa PA01
ccucaggauagccggcgc

SEQ ID NO: 1554183 - RNA, 14 nt, Pseudomonas aeruginosa PA01
ccucaggcgccgcu

SEQ ID NO: 1554184 - RNA, 14 nt, Pseudomonas aeruginosa PA01
ccucaggucggcgc

SEQ ID NO: 1554185 - RNA, 22 nt, Pseudomonas aeruginosa PA01
ccucaguuuucuaaccggcguc

SEQ ID NO: 1554186 - RNA, 15 nt, Pseudomonas aeruginosa PA01
ccucagugcgggcag

SEQ ID NO: 1554187 - RNA, 23 nt, Pseudomonas aeruginosa PA01
ccucgaugaacagugcgcccgug

SEQ ID NO: 1554188 - RNA, 20 nt, Pseudomonas aeruginosa PA01
ccucgaugagcaugccgcag

SEQ ID NO: 1554189 - RNA, 16 nt, Pseudomonas aeruginosa PA01
ccucgaugcccgccuc

SEQ ID NO: 1554190 - RNA, 23 nt, Pseudomonas aeruginosa PA01
ccucgaugcccgccucgcgcaac

SEQ ID NO: 1554191 - RNA, 17 nt, Pseudomonas aeruginosa PA01
ccucgauccgcuccagc

SEQ ID NO: 1554192 - RNA, 13 nt, Pseudomonas aeruginosa PA01
ccucgaucacccg

SEQ ID NO: 1554193 - RNA, 19 nt, Pseudomonas aeruginosa PA01
ccucgaggucggccuggcu

SEQ ID NO: 1554194 - RNA, 19 nt, Pseudomonas aeruginosa PA01
ccugguuguaggcgccgcc

SEQ ID NO: 1554195 - RNA, 16 nt, Pseudomonas aeruginosa PA01
ccuguuccuccgccag

SEQ ID NO: 1554196 - RNA, 16 nt, Pseudomonas aeruginosa PA01
ccuguucgaaguucuc

SEQ ID NO: 1554197 - RNA, 19 nt, Pseudomonas aeruginosa PA01
ccuguucgaaguucuccag

SEQ ID NO: 1554198 - RNA, 23 nt, Pseudomonas aeruginosa PA01
ccuguucgucuggcgccuggccu

SEQ ID NO: 1554199 - RNA, 13 nt, Pseudomonas aeruginosa PA01
ccuguuucggguc

SEQ ID NO: 1554200 - RNA, 22 nt, Pseudomonas aeruginosa PA01
ccuguuucugcuguggagccgg

SEQ ID NO: 1554201 - RNA, 22 nt, Pseudomonas aeruginosa PA01
ccuucaccggcggaugacguuc

SEQ ID NO: 1554202 - RNA, 15 nt, Pseudomonas aeruginosa PA01
ccuucaaaacgcauc

SEQ ID NO: 1554203 - RNA, 20 nt, Pseudomonas aeruginosa PA01
ccuucagguaaggcaccacc

SEQ ID NO: 1554204 - RNA, 19 nt, Pseudomonas aeruginosa PA01
ccuucaggcgggcucuuug

SEQ ID NO: 1554205 - RNA, 13 nt, Pseudomonas aeruginosa PA01
ccuucagccccag

SEQ ID NO: 1554206 - RNA, 21 nt, Pseudomonas aeruginosa PA01
ccuucagcgggucgagccagg

SEQ ID NO: 1554207 - RNA, 13 nt, Pseudomonas aeruginosa PA01
ccuucagcgccag

SEQ ID NO: 1554208 - RNA, 17 nt, Pseudomonas aeruginosa PA01
ccuucagcgccgccagg

SEQ ID NO: 1554209 - RNA, 16 nt, Pseudomonas aeruginosa PA01
ccuucagcgccuccag

SEQ ID NO: 1554210 - RNA, 20 nt, Pseudomonas aeruginosa PA01
ccuucagauacuccagcagc

SEQ ID NO: 1554211 - RNA, 21 nt, Pseudomonas aeruginosa PA01
ccuuaguuaucacaaccuuuc

SEQ ID NO: 1554212 - RNA, 20 nt, Pseudomonas aeruginosa PA01
ccuggaacuggucggggcgc

SEQ ID NO: 1554213 - RNA, 13 nt, Pseudomonas aeruginosa PA01
ccuggaaccgcuc

SEQ ID NO: 1554214 - RNA, 16 nt, Pseudomonas aeruginosa PA01
ccuggaaggcgcuggg

SEQ ID NO: 1554215 - RNA, 14 nt, Pseudomonas aeruginosa PA01
ccuggaagaacagg

SEQ ID NO: 1554216 - RNA, 15 nt, Pseudomonas aeruginosa PA01
ccuggaagaacaggc

SEQ ID NO: 1554217 - RNA, 19 nt, Pseudomonas aeruginosa PA01
ccuggaagaauggcguggc

SEQ ID NO: 1554218 - RNA, 21 nt, Pseudomonas aeruginosa PA01
ccuggaagaauggcguggcuu

SEQ ID NO: 1554219 - RNA, 12 nt, Pseudomonas aeruginosa PA01
ccugcuugcagg

SEQ ID NO: 1554220 - RNA, 13 nt, Pseudomonas aeruginosa PA01
ccugcuugcagga

SEQ ID NO: 1554221 - RNA, 14 nt, Pseudomonas aeruginosa PA01
ccugcuucagcccg

SEQ ID NO: 1554222 - RNA, 22 nt, Pseudomonas aeruginosa PA01
ccugcuucagguagugcaacac

SEQ ID NO: 1554223 - RNA, 14 nt, Pseudomonas aeruginosa PA01
ccugcuugaccuug

SEQ ID NO: 1554224 - RNA, 15 nt, Pseudomonas aeruginosa PA01
ccugcugcugcucag

SEQ ID NO: 1554225 - RNA, 21 nt, Pseudomonas aeruginosa PA01
ccugcugcugcucagcgcgcu

SEQ ID NO: 1554226 - RNA, 17 nt, Pseudomonas aeruginosa PA01
ccugcugcucgaccgcc

SEQ ID NO: 1554227 - RNA, 20 nt, Pseudomonas aeruginosa PA01
ccugcugcucgaccgccugc

SEQ ID NO: 1554228 - RNA, 21 nt, Pseudomonas aeruginosa PA01
ccugcugcgggcgcugcaugg

SEQ ID NO: 1554229 - RNA, 19 nt, Pseudomonas aeruginosa PA01
ccugcucgcgcaccgcggc

SEQ ID NO: 1554230 - RNA, 12 nt, Pseudomonas aeruginosa PA01
ccugcugguuga

SEQ ID NO: 1554231 - RNA, 23 nt, Pseudomonas aeruginosa PA01
ccugcuggcgaauuuccugcugg

SEQ ID NO: 1554232 - RNA, 17 nt, Pseudomonas aeruginosa PA01
ccugcuggcugcccagu

SEQ ID NO: 1554233 - RNA, 13 nt, Pseudomonas aeruginosa PA01
ccugccagcgggc

SEQ ID NO: 1554234 - RNA, 16 nt, Pseudomonas aeruginosa PA01
ccugccagcgggcgcc

SEQ ID NO: 1554235 - RNA, 13 nt, Pseudomonas aeruginosa PA01
ccugccagaggau

SEQ ID NO: 1554236 - RNA, 12 nt, Pseudomonas aeruginosa PA01
ccugccaggcgg

SEQ ID NO: 1554237 - RNA, 13 nt, Pseudomonas aeruginosa PA01
ccugcucgaucca

SEQ ID NO: 1554238 - RNA, 17 nt, Pseudomonas aeruginosa PA01
ccugcucgauccagccg

SEQ ID NO: 1554239 - RNA, 18 nt, Pseudomonas aeruginosa PA01
ccugcucgauccagccgg

SEQ ID NO: 1554240 - RNA, 20 nt, Pseudomonas aeruginosa PA01
ccugcucgauccagccggca

SEQ ID NO: 1554241 - RNA, 19 nt, Pseudomonas aeruginosa PA01
ccugcuccucggcagcgcu

SEQ ID NO: 1554242 - RNA, 22 nt, Pseudomonas aeruginosa PA01
ccugcuccuccgacgcccccca

SEQ ID NO: 1554243 - RNA, 14 nt, Pseudomonas aeruginosa PA01
ccugcuccagcgga

SEQ ID NO: 1554244 - RNA, 18 nt, Pseudomonas aeruginosa PA01
ccugcucccuggcggaua

SEQ ID NO: 1554245 - RNA, 11 nt, Pseudomonas aeruginosa PA01
ccugcucagcg

SEQ ID NO: 1554246 - RNA, 22 nt, Pseudomonas aeruginosa PA01
ccugcucagcggcccagcgccc

SEQ ID NO: 1554247 - RNA, 12 nt, Pseudomonas aeruginosa PA01
ccugcucagcgu

SEQ ID NO: 1554248 - RNA, 20 nt, Pseudomonas aeruginosa PA01
ccugcucagcguccucagcc

SEQ ID NO: 1554249 - RNA, 12 nt, Pseudomonas aeruginosa PA01
ccuggccgcgca

SEQ ID NO: 1554250 - RNA, 16 nt, Pseudomonas aeruginosa PA01
ccuggccgccaaaguu

SEQ ID NO: 1554251 - RNA, 23 nt, Pseudomonas aeruginosa PA01
ccuggccgacccgcagcggcgcu

SEQ ID NO: 1554252 - RNA, 23 nt, Pseudomonas aeruginosa PA01
ccuggccgaucagcuuggccuug

SEQ ID NO: 1554253 - RNA, 22 nt, Pseudomonas aeruginosa PA01
ccuggcccuggauaucugggcc

SEQ ID NO: 1554254 - RNA, 23 nt, Pseudomonas aeruginosa PA01
ccuggcccuggauaucugggcca

SEQ ID NO: 1554255 - RNA, 19 nt, Pseudomonas aeruginosa PA01
ccuggaauucaggcuuccu

SEQ ID NO: 1554256 - RNA, 18 nt, Pseudomonas aeruginosa PA01
ccuggaccccgcccuagc

SEQ ID NO: 1554257 - RNA, 13 nt, Pseudomonas aeruginosa PA01
ccuggccacccuu

SEQ ID NO: 1554258 - RNA, 14 nt, Pseudomonas aeruginosa PA01
ccuggccacccuug

SEQ ID NO: 1554259 - RNA, 16 nt, Pseudomonas aeruginosa PA01
ccuggacccgggccuc

SEQ ID NO: 1554260 - RNA, 17 nt, Pseudomonas aeruginosa PA01
ccuggacccgggccucc

SEQ ID NO: 1554261 - RNA, 19 nt, Pseudomonas aeruginosa PA01
ccuggacccgggccuccug

SEQ ID NO: 1554262 - RNA, 23 nt, Pseudomonas aeruginosa PA01
ccuggccggcgaccuuguccagg

SEQ ID NO: 1554263 - RNA, 21 nt, Pseudomonas aeruginosa PA01
ccuggccggcgauggccgccu

SEQ ID NO: 1554264 - RNA, 13 nt, Pseudomonas aeruginosa PA01
ccuggccgcugcc

SEQ ID NO: 1554265 - RNA, 18 nt, Pseudomonas aeruginosa PA01
ccuggccgcugccgcucu

SEQ ID NO: 1554266 - RNA, 14 nt, Pseudomonas aeruginosa PA01
ccuggccggccucg

SEQ ID NO: 1554267 - RNA, 15 nt, Pseudomonas aeruginosa PA01
ccuggccuuggccac

SEQ ID NO: 1554268 - RNA, 17 nt, Pseudomonas aeruginosa PA01
ccuggccgucggccugc

SEQ ID NO: 1554269 - RNA, 22 nt, Pseudomonas aeruginosa PA01
ccuggcgaguggcgaagccagc

SEQ ID NO: 1554270 - RNA, 17 nt, Pseudomonas aeruginosa PA01
ccuggcgaucaggccaa

SEQ ID NO: 1554271 - RNA, 22 nt, Pseudomonas aeruginosa PA01
ccuggcgcagcggcagcgccag

SEQ ID NO: 1554272 - RNA, 19 nt, Pseudomonas aeruginosa PA01
ccuggcgcgagaagccagc

SEQ ID NO: 1554273 - RNA, 23 nt, Pseudomonas aeruginosa PA01
ccuggcgcgucggccgcucggcc

SEQ ID NO: 1554274 - RNA, 21 nt, Pseudomonas aeruginosa PA01
ccuggcgcucgaagcuccagc

SEQ ID NO: 1554275 - RNA, 24 nt, Pseudomonas aeruginosa PA01
ccuggcgcucgaagcuccagcgug

SEQ ID NO: 1554276 - RNA, 21 nt, Pseudomonas aeruginosa PA01
ccuggcgcugaacaagcccug

SEQ ID NO: 1554277 - RNA, 22 nt, Pseudomonas aeruginosa PA01
ccuggugcacggcgacccgccg

SEQ ID NO: 1554278 - RNA, 16 nt, Pseudomonas aeruginosa PA01
ccugguggaacagccg

SEQ ID NO: 1554279 - RNA, 19 nt, Pseudomonas aeruginosa PA01
ccuggucgauauagcccug

SEQ ID NO: 1554280 - RNA, 23 nt, Pseudomonas aeruginosa PA01
ccuggucggcgcggcgcuccagg

SEQ ID NO: 1554281 - RNA, 14 nt, Pseudomonas aeruginosa PA01
ccuggcuggccagc

SEQ ID NO: 1554282 - RNA, 15 nt, Pseudomonas aeruginosa PA01
ccuggcuggccagca

SEQ ID NO: 1554283 - RNA, 19 nt, Pseudomonas aeruginosa PA01
ccuggcuggccagcaggcu

SEQ ID NO: 1554284 - RNA, 20 nt, Pseudomonas aeruginosa PA01
ccuggcuggccagcaggcug

SEQ ID NO: 1554285 - RNA, 18 nt, Pseudomonas aeruginosa PA01
ccuggcucuguuccucgg

SEQ ID NO: 1554286 - RNA, 18 nt, Pseudomonas aeruginosa PA01
ccugguccaaccgggcau

SEQ ID NO: 1554287 - RNA, 22 nt, Pseudomonas aeruginosa PA01
ccugguccaaccgggcaucgcc

SEQ ID NO: 1554288 - RNA, 18 nt, Pseudomonas aeruginosa PA01
ccugggauggggcugccg

SEQ ID NO: 1554289 - RNA, 19 nt, Pseudomonas aeruginosa PA01
ccuggcuuuccagggccug

SEQ ID NO: 1554290 - RNA, 13 nt, Pseudomonas aeruginosa PA01
ccugggagccgcc

SEQ ID NO: 1554291 - RNA, 14 nt, Pseudomonas aeruginosa PA01
ccacucggcgugcc

SEQ ID NO: 1554292 - RNA, 23 nt, Pseudomonas aeruginosa PA01
ccacucggugcagaugaccagcg

SEQ ID NO: 1554293 - RNA, 16 nt, Pseudomonas aeruginosa PA01
ccacuccuccgccugc

SEQ ID NO: 1554294 - RNA, 23 nt, Pseudomonas aeruginosa PA01
ccacuaucuucgauugcuacagc

SEQ ID NO: 1554295 - RNA, 14 nt, Pseudomonas aeruginosa PA01
ccacuccguccagu

SEQ ID NO: 1554296 - RNA, 16 nt, Pseudomonas aeruginosa PA01
ccacuccggcaggcgc

SEQ ID NO: 1554297 - RNA, 14 nt, Pseudomonas aeruginosa PA01
ccacucccaugcca

SEQ ID NO: 1554298 - RNA, 11 nt, Pseudomonas aeruginosa PA01
ccacuccagcc

SEQ ID NO: 1554299 - RNA, 14 nt, Pseudomonas aeruginosa PA01
ccacguacuccagc

SEQ ID NO: 1554300 - RNA, 16 nt, Pseudomonas aeruginosa PA01
ccacguugcaguccag

SEQ ID NO: 1554301 - RNA, 14 nt, Pseudomonas aeruginosa PA01
ccacuaccgccgag

SEQ ID NO: 1554302 - RNA, 15 nt, Pseudomonas aeruginosa PA01
ccacgcucagccgug

SEQ ID NO: 1554303 - RNA, 20 nt, Pseudomonas aeruginosa PA01
ccacuuccggcccggccagg

SEQ ID NO: 1554304 - RNA, 22 nt, Pseudomonas aeruginosa PA01
ccacuucggcgguggggccgcc

SEQ ID NO: 1554305 - RNA, 23 nt, Pseudomonas aeruginosa PA01
ccacuucggcgguggggccgccg

SEQ ID NO: 1554306 - RNA, 20 nt, Pseudomonas aeruginosa PA01
ccacuucguccggccgcccg

SEQ ID NO: 1554307 - RNA, 21 nt, Pseudomonas aeruginosa PA01
ccacuucguccggccgcccga

SEQ ID NO: 1554308 - RNA, 15 nt, Pseudomonas aeruginosa PA01
ccacuuccagcuugc

SEQ ID NO: 1554309 - RNA, 12 nt, Pseudomonas aeruginosa PA01
ccacuuccaggu

SEQ ID NO: 1554310 - RNA, 21 nt, Pseudomonas aeruginosa PA01
ccacuugccgccgccggaggg

SEQ ID NO: 1554311 - RNA, 17 nt, Pseudomonas aeruginosa PA01
ccacugcuuggccaggc

SEQ ID NO: 1554312 - RNA, 17 nt, Pseudomonas aeruginosa PA01
ccacgcagagcggcagg

SEQ ID NO: 1554313 - RNA, 15 nt, Pseudomonas aeruginosa PA01
ccacgcaggccagcg

SEQ ID NO: 1554314 - RNA, 19 nt, Pseudomonas aeruginosa PA01
ccacgcaggccagcgccag

SEQ ID NO: 1554315 - RNA, 19 nt, Pseudomonas aeruginosa PA01
ccacgcaccaccaggucga

SEQ ID NO: 1554316 - RNA, 19 nt, Pseudomonas aeruginosa PA01
ccacgcaccagcucccggc

SEQ ID NO: 1554317 - RNA, 18 nt, Pseudomonas aeruginosa PA01
ccacgcgaccagcgccag

SEQ ID NO: 1554318 - RNA, 21 nt, Pseudomonas aeruginosa PA01
ccacgccgcuggcguuguugc

SEQ ID NO: 1554319 - RNA, 23 nt, Pseudomonas aeruginosa PA01
ccacgccgcugucguccagcggg

SEQ ID NO: 1554320 - RNA, 18 nt, Pseudomonas aeruginosa PA01
ccacgccgauaccggccu

SEQ ID NO: 1554321 - RNA, 16 nt, Pseudomonas aeruginosa PA01
ccaccggucaaaucgu

SEQ ID NO: 1554322 - RNA, 19 nt, Pseudomonas aeruginosa PA01
ccaccugcaugcuuuugaa

SEQ ID NO: 1554323 - RNA, 16 nt, Pseudomonas aeruginosa PA01
ccaccugaacgcgccc

SEQ ID NO: 1554324 - RNA, 20 nt, Pseudomonas aeruginosa PA01
ccaccugaacgcgcccggcc

SEQ ID NO: 1554325 - RNA, 15 nt, Pseudomonas aeruginosa PA01
ccacgaccgcgucca

SEQ ID NO: 1554326 - RNA, 18 nt, Pseudomonas aeruginosa PA01
ccacgacccgcucuuccu

SEQ ID NO: 1554327 - RNA, 15 nt, Pseudomonas aeruginosa PA01
ccacgacccugcugg

SEQ ID NO: 1554328 - RNA, 17 nt, Pseudomonas aeruginosa PA01
ccacgaacugcauggcc

SEQ ID NO: 1554329 - RNA, 16 nt, Pseudomonas aeruginosa PA01
ccaccuguagcagggu

SEQ ID NO: 1554330 - RNA, 13 nt, Pseudomonas aeruginosa PA01
ccaaaaaaagccc

SEQ ID NO: 1554331 - RNA, 15 nt, Pseudomonas aeruginosa PA01
ccacccgcagccccg

SEQ ID NO: 1554332 - RNA, 13 nt, Pseudomonas aeruginosa PA01
ccacccgcagccg

SEQ ID NO: 1554333 - RNA, 16 nt, Pseudomonas aeruginosa PA01
ccacccggccauggcg

SEQ ID NO: 1554334 - RNA, 21 nt, Pseudomonas aeruginosa PA01
ccacccggcgguccgccgcgg

SEQ ID NO: 1554335 - RNA, 19 nt, Pseudomonas aeruginosa PA01
ccacccgucccgcgcgccg

SEQ ID NO: 1554336 - RNA, 20 nt, Pseudomonas aeruginosa PA01
ccacccguucgccggccucc

SEQ ID NO: 1554337 - RNA, 18 nt, Pseudomonas aeruginosa PA01
ccacccggcugcaugccg

SEQ ID NO: 1554338 - RNA, 15 nt, Pseudomonas aeruginosa PA01
ccaccgaguggcgca

SEQ ID NO: 1554339 - RNA, 14 nt, Pseudomonas aeruginosa PA01
ccaccgccgccagc

SEQ ID NO: 1554340 - RNA, 19 nt, Pseudomonas aeruginosa PA01
ccaccgccgccagcaacag

SEQ ID NO: 1554341 - RNA, 12 nt, Pseudomonas aeruginosa PA01
ccaccgccgcca

SEQ ID NO: 1554342 - RNA, 16 nt, Pseudomonas aeruginosa PA01
ccaccgccagcaccca

SEQ ID NO: 1554343 - RNA, 12 nt, Pseudomonas aeruginosa PA01
ccaccgcccccg

SEQ ID NO: 1554344 - RNA, 14 nt, Pseudomonas aeruginosa PA01
ccaccgccugcccc

SEQ ID NO: 1554345 - RNA, 20 nt, Pseudomonas aeruginosa PA01
ccaccgcgaauccgcggccc

SEQ ID NO: 1554346 - RNA, 12 nt, Pseudomonas aeruginosa PA01
ccaccggcuggc

SEQ ID NO: 1554347 - RNA, 18 nt, Pseudomonas aeruginosa PA01
ccaccgcuuucagcgccg

SEQ ID NO: 1554348 - RNA, 21 nt, Pseudomonas aeruginosa PA01
ccaccggcacgccauccuccg

SEQ ID NO: 1554349 - RNA, 13 nt, Pseudomonas aeruginosa PA01
ccaccggacccgg

SEQ ID NO: 1554350 - RNA, 20 nt, Pseudomonas aeruginosa PA01
ccaccggaccgggcgccucg

SEQ ID NO: 1554351 - RNA, 15 nt, Pseudomonas aeruginosa PA01
ccagcccggcguggg

SEQ ID NO: 1554352 - RNA, 15 nt, Pseudomonas aeruginosa PA01
ccagccccagauggg

SEQ ID NO: 1554353 - RNA, 14 nt, Pseudomonas aeruginosa PA01
ccagcccggccucg

SEQ ID NO: 1554354 - RNA, 13 nt, Pseudomonas aeruginosa PA01
ccagcccggcggc

SEQ ID NO: 1554355 - RNA, 17 nt, Pseudomonas aeruginosa PA01
ccagcccgguucagcgg

SEQ ID NO: 1554356 - RNA, 23 nt, Pseudomonas aeruginosa PA01
ccagcccgguucagcgggacagc

SEQ ID NO: 1554357 - RNA, 15 nt, Pseudomonas aeruginosa PA01
ccagcccggccaucc

SEQ ID NO: 1554358 - RNA, 18 nt, Pseudomonas aeruginosa PA01
ccagccgcgccagugccu

SEQ ID NO: 1554359 - RNA, 13 nt, Pseudomonas aeruginosa PA01
ccagccgcagccc

SEQ ID NO: 1554360 - RNA, 15 nt, Pseudomonas aeruginosa PA01
ccagccgaggcagcc

SEQ ID NO: 1554361 - RNA, 18 nt, Pseudomonas aeruginosa PA01
ccagccgcuagcgguagc

SEQ ID NO: 1554362 - RNA, 16 nt, Pseudomonas aeruginosa PA01
ccagccgcgcgccgca

SEQ ID NO: 1554363 - RNA, 17 nt, Pseudomonas aeruginosa PA01
ccagccgcggaucaccu

SEQ ID NO: 1554364 - RNA, 14 nt, Pseudomonas aeruginosa PA01
ccagcccagugcug

SEQ ID NO: 1554365 - RNA, 16 nt, Pseudomonas aeruginosa PA01
ccagcccagaacagca

SEQ ID NO: 1554366 - RNA, 19 nt, Pseudomonas aeruginosa PA01
ccagccauugagcgcgccc

SEQ ID NO: 1554367 - RNA, 18 nt, Pseudomonas aeruginosa PA01
ccagcagguagccagggg

SEQ ID NO: 1554368 - RNA, 16 nt, Pseudomonas aeruginosa PA01
ccagcagguagccugc

SEQ ID NO: 1554369 - RNA, 18 nt, Pseudomonas aeruginosa PA01
ccagcagguacagcgacu

SEQ ID NO: 1554370 - RNA, 14 nt, Pseudomonas aeruginosa PA01
ccagcaggucgcgc

SEQ ID NO: 1554371 - RNA, 16 nt, Pseudomonas aeruginosa PA01
ccagcaggucggcagc

SEQ ID NO: 1554372 - RNA, 17 nt, Pseudomonas aeruginosa PA01
ccagcaggucggcagcg

SEQ ID NO: 1554373 - RNA, 18 nt, Pseudomonas aeruginosa PA01
ccagcaggucggcagcgu

SEQ ID NO: 1554374 - RNA, 20 nt, Pseudomonas aeruginosa PA01
ccagcaggucggccugcugc

SEQ ID NO: 1554375 - RNA, 14 nt, Pseudomonas aeruginosa PA01
ccagcagguggcgc

SEQ ID NO: 1554376 - RNA, 16 nt, Pseudomonas aeruginosa PA01
ccagcagucgcacagc

SEQ ID NO: 1554377 - RNA, 16 nt, Pseudomonas aeruginosa PA01
ccagcagucgcggccc

SEQ ID NO: 1554378 - RNA, 20 nt, Pseudomonas aeruginosa PA01
ccagcagucgcggcccuggu

SEQ ID NO: 1554379 - RNA, 22 nt, Pseudomonas aeruginosa PA01
ccagcaguucgucgccacgccc

SEQ ID NO: 1554380 - RNA, 17 nt, Pseudomonas aeruginosa PA01
ccagcauaaccccuuug

SEQ ID NO: 1554381 - RNA, 15 nt, Pseudomonas aeruginosa PA01
ccagccguggcaggc

SEQ ID NO: 1554382 - RNA, 23 nt, Pseudomonas aeruginosa PA01
ccagccggccgcgucgcccaggc

SEQ ID NO: 1554383 - RNA, 24 nt, Pseudomonas aeruginosa PA01
ccagccggccgcgucgcccaggcc

SEQ ID NO: 1554384 - RNA, 23 nt, Pseudomonas aeruginosa PA01
ccagccggccuugcuuugcgccu

SEQ ID NO: 1554385 - RNA, 14 nt, Pseudomonas aeruginosa PA01
ccagccggucccgg

SEQ ID NO: 1554386 - RNA, 17 nt, Pseudomonas aeruginosa PA01
ccagccggucccgggcu

SEQ ID NO: 1554387 - RNA, 14 nt, Pseudomonas aeruginosa PA01
ccagccuggccagc

SEQ ID NO: 1554388 - RNA, 13 nt, Pseudomonas aeruginosa PA01
ccagccugcagcc

SEQ ID NO: 1554389 - RNA, 20 nt, Pseudomonas aeruginosa PA01
ccagccucggcagggcgccc

SEQ ID NO: 1554390 - RNA, 24 nt, Pseudomonas aeruginosa PA01
ccagccucggcagggcgcccgccc

SEQ ID NO: 1554391 - RNA, 20 nt, Pseudomonas aeruginosa PA01
ccagcgaaccgccggccucg

SEQ ID NO: 1554392 - RNA, 17 nt, Pseudomonas aeruginosa PA01
ccagccuucccggcgcu

SEQ ID NO: 1554393 - RNA, 13 nt, Pseudomonas aeruginosa PA01
ccagccuuccucg

SEQ ID NO: 1554394 - RNA, 16 nt, Pseudomonas aeruginosa PA01
ccagccuugagccuug

SEQ ID NO: 1554395 - RNA, 23 nt, Pseudomonas aeruginosa PA01
ccagccuugagccuugccccguu

SEQ ID NO: 1554396 - RNA, 18 nt, Pseudomonas aeruginosa PA01
ccagcgaccgucgaacca

SEQ ID NO: 1554397 - RNA, 13 nt, Pseudomonas aeruginosa PA01
ccagcgacucgcu

SEQ ID NO: 1554398 - RNA, 23 nt, Pseudomonas aeruginosa PA01
ccagcgaauggacaggcgccccu

SEQ ID NO: 1554399 - RNA, 15 nt, Pseudomonas aeruginosa PA01
ccagcgaacccaggc

SEQ ID NO: 1554400 - RNA, 17 nt, Pseudomonas aeruginosa PA01
ccagcgaacccaggccg

SEQ ID NO: 1554401 - RNA, 22 nt, Pseudomonas aeruginosa PA01
ccagcgaagcuucuucggcagc

SEQ ID NO: 1554402 - RNA, 15 nt, Pseudomonas aeruginosa PA01
ccagcgaagugcgcu

SEQ ID NO: 1554403 - RNA, 23 nt, Pseudomonas aeruginosa PA01
ccagcgcaccuacuaccgcuggg

SEQ ID NO: 1554404 - RNA, 14 nt, Pseudomonas aeruginosa PA01
ccagcgaggagccu

SEQ ID NO: 1554405 - RNA, 16 nt, Pseudomonas aeruginosa PA01
ccagcaggcccagcca

SEQ ID NO: 1554406 - RNA, 15 nt, Pseudomonas aeruginosa PA01
ccagcaggccgagcc

SEQ ID NO: 1554407 - RNA, 17 nt, Pseudomonas aeruginosa PA01
ccagcaggccggccagc

SEQ ID NO: 1554408 - RNA, 22 nt, Pseudomonas aeruginosa PA01
ccagcaggaugcugcacagcca

SEQ ID NO: 1554409 - RNA, 21 nt, Pseudomonas aeruginosa PA01
ccagcaggaucgacagcagcg

SEQ ID NO: 1554410 - RNA, 20 nt, Pseudomonas aeruginosa PA01
ccagcaggaucgagcccugg

SEQ ID NO: 1554411 - RNA, 15 nt, Pseudomonas aeruginosa PA01
ccagcaggcaggcau

SEQ ID NO: 1554412 - RNA, 20 nt, Pseudomonas aeruginosa PA01
ccagcagggccagccagagc

SEQ ID NO: 1554413 - RNA, 22 nt, Pseudomonas aeruginosa PA01
ccagcagggccagccagagcca

SEQ ID NO: 1554414 - RNA, 15 nt, Pseudomonas aeruginosa PA01
ccagcagggccgccg

SEQ ID NO: 1554415 - RNA, 18 nt, Pseudomonas aeruginosa PA01
ccagcagggucgccuggg

SEQ ID NO: 1554416 - RNA, 12 nt, Pseudomonas aeruginosa PA01
ccagcagggugg

SEQ ID NO: 1554417 - RNA, 21 nt, Pseudomonas aeruginosa PA01
ccagcaggcgcagcagcgacu

SEQ ID NO: 1554418 - RNA, 17 nt, Pseudomonas aeruginosa PA01
ccagcaggcgccggcgg

SEQ ID NO: 1554419 - RNA, 23 nt, Pseudomonas aeruginosa PA01
ccagcaggcgccggcggaucagc

SEQ ID NO: 1554420 - RNA, 23 nt, Pseudomonas aeruginosa PA01
ccagcaggcucaugcccagcuuc

SEQ ID NO: 1554421 - RNA, 12 nt, Pseudomonas aeruginosa PA01
ccagcagcuccg

SEQ ID NO: 1554422 - RNA, 20 nt, Pseudomonas aeruginosa PA01
ccagcaggaagccgaccacu

SEQ ID NO: 1554423 - RNA, 21 nt, Pseudomonas aeruginosa PA01
ccagcaggaccuggccguugg

SEQ ID NO: 1554424 - RNA, 21 nt, Pseudomonas aeruginosa PA01
ccagcaggaaaacgcucaggc

SEQ ID NO: 1554425 - RNA, 13 nt, Pseudomonas aeruginosa PA01
ccagcagcaggcc

SEQ ID NO: 1554426 - RNA, 23 nt, Pseudomonas aeruginosa PA01
ccagcagcggcucacgccccagc

SEQ ID NO: 1554427 - RNA, 15 nt, Pseudomonas aeruginosa PA01
ccagcagcggcagcc

SEQ ID NO: 1554428 - RNA, 14 nt, Pseudomonas aeruginosa PA01
ccagcagcaggccg

SEQ ID NO: 1554429 - RNA, 18 nt, Pseudomonas aeruginosa PA01
ccagcacgcuggcgagga

SEQ ID NO: 1554430 - RNA, 22 nt, Pseudomonas aeruginosa PA01
ccagcacgcuggcgaggacgcc

SEQ ID NO: 1554431 - RNA, 21 nt, Pseudomonas aeruginosa PA01
ccagcagcaacuccagagcca

SEQ ID NO: 1554432 - RNA, 18 nt, Pseudomonas aeruginosa PA01
ccagcagcaacagcgccg

SEQ ID NO: 1554433 - RNA, 22 nt, Pseudomonas aeruginosa PA01
ccagcagcaacagcgccgcgcg

SEQ ID NO: 1554434 - RNA, 22 nt, Pseudomonas aeruginosa PA01
ccagcagcaccaucagccagcc

SEQ ID NO: 1554435 - RNA, 16 nt, Pseudomonas aeruginosa PA01
ccagcaccggcggcgc

SEQ ID NO: 1554436 - RNA, 16 nt, Pseudomonas aeruginosa PA01
ccagcaccuucaccgu

SEQ ID NO: 1554437 - RNA, 16 nt, Pseudomonas aeruginosa PA01
ccagcaccuggcagug

SEQ ID NO: 1554438 - RNA, 15 nt, Pseudomonas aeruginosa PA01
ccagcaccuccccca

SEQ ID NO: 1554439 - RNA, 19 nt, Pseudomonas aeruginosa PA01
ccagcaccucccccagcgg

SEQ ID NO: 1554440 - RNA, 14 nt, Pseudomonas aeruginosa PA01
ccagcaccacccgg

SEQ ID NO: 1554441 - RNA, 19 nt, Pseudomonas aeruginosa PA01
ccagcaccacccggccgcg

SEQ ID NO: 1554442 - RNA, 18 nt, Pseudomonas aeruginosa PA01
ccagagugcgcagcagcg

SEQ ID NO: 1554443 - RNA, 19 nt, Pseudomonas aeruginosa PA01
ccagagugcgcagcagcgu

SEQ ID NO: 1554444 - RNA, 18 nt, Pseudomonas aeruginosa PA01
ccagaguccaugcucagg

SEQ ID NO: 1554445 - RNA, 19 nt, Pseudomonas aeruginosa PA01
ccagauagugcggccaggc

SEQ ID NO: 1554446 - RNA, 21 nt, Pseudomonas aeruginosa PA01
ccagauagugcggccaggcgu

SEQ ID NO: 1554447 - RNA, 13 nt, Pseudomonas aeruginosa PA01
ccagaucaccacc

SEQ ID NO: 1554448 - RNA, 15 nt, Pseudomonas aeruginosa PA01
ccagaugcuggagcu

SEQ ID NO: 1554449 - RNA, 19 nt, Pseudomonas aeruginosa PA01
ccagauccgggaaggccug

SEQ ID NO: 1554450 - RNA, 19 nt, Pseudomonas aeruginosa PA01
ccagaucauguagagcagg

SEQ ID NO: 1554451 - RNA, 15 nt, Pseudomonas aeruginosa PA01
ccauacaccaggccg

SEQ ID NO: 1554452 - RNA, 12 nt, Pseudomonas aeruginosa PA01
ccaucaggaugc

SEQ ID NO: 1554453 - RNA, 11 nt, Pseudomonas aeruginosa PA01
ccaucagcucc

SEQ ID NO: 1554454 - RNA, 22 nt, Pseudomonas aeruginosa PA01
ccaucagcuccacgucggcccg

SEQ ID NO: 1554455 - RNA, 14 nt, Pseudomonas aeruginosa PA01
ccaucagcgccagg

SEQ ID NO: 1554456 - RNA, 12 nt, Pseudomonas aeruginosa PA01
ccaucagcgccg

SEQ ID NO: 1554457 - RNA, 11 nt, Pseudomonas aeruginosa PA01
ccaucaggccc

SEQ ID NO: 1554458 - RNA, 14 nt, Pseudomonas aeruginosa PA01
ccaucagcaccagg

SEQ ID NO: 1554459 - RNA, 23 nt, Pseudomonas aeruginosa PA01
ccaucagcaccaggaagccccag

SEQ ID NO: 1554460 - RNA, 17 nt, Pseudomonas aeruginosa PA01
ccaucagccagcccagu

SEQ ID NO: 1554461 - RNA, 17 nt, Pseudomonas aeruginosa PA01
ccaucgaucagcagcgc

SEQ ID NO: 1554462 - RNA, 15 nt, Pseudomonas aeruginosa PA01
ccaucgaugcucauc

SEQ ID NO: 1554463 - RNA, 16 nt, Pseudomonas aeruginosa PA01
ccaucgauggucacug

SEQ ID NO: 1554464 - RNA, 17 nt, Pseudomonas aeruginosa PA01
ccaucgcaggcagcgcg

SEQ ID NO: 1554465 - RNA, 12 nt, Pseudomonas aeruginosa PA01
ccaucggcccca

SEQ ID NO: 1554466 - RNA, 17 nt, Pseudomonas aeruginosa PA01
ccauccggaguucgccc

SEQ ID NO: 1554467 - RNA, 21 nt, Pseudomonas aeruginosa PA01
ccaucgacucggugcguagcg

SEQ ID NO: 1554468 - RNA, 14 nt, Pseudomonas aeruginosa PA01
ccauccgccuucuu

SEQ ID NO: 1554469 - RNA, 19 nt, Pseudomonas aeruginosa PA01
ccauccgcgccgaccagcc

SEQ ID NO: 1554470 - RNA, 16 nt, Pseudomonas aeruginosa PA01
ccaucccucuaucaca

SEQ ID NO: 1554471 - RNA, 14 nt, Pseudomonas aeruginosa PA01
ccauccccgccucg

SEQ ID NO: 1554472 - RNA, 22 nt, Pseudomonas aeruginosa PA01
ccaucagggcgaaagccuucau

SEQ ID NO: 1554473 - RNA, 18 nt, Pseudomonas aeruginosa PA01
ccaucagugacauccucc

SEQ ID NO: 1554474 - RNA, 16 nt, Pseudomonas aeruginosa PA01
ccaguucuucgccgcc

SEQ ID NO: 1554475 - RNA, 20 nt, Pseudomonas aeruginosa PA01
ccaguucuucgccgcccgcg

SEQ ID NO: 1554476 - RNA, 22 nt, Pseudomonas aeruginosa PA01
ccaguucuucgccgcccgcgcc

SEQ ID NO: 1554477 - RNA, 15 nt, Pseudomonas aeruginosa PA01
ccaguugccgagcuu

SEQ ID NO: 1554478 - RNA, 15 nt, Pseudomonas aeruginosa PA01
ccaguugcugggcga

SEQ ID NO: 1554479 - RNA, 15 nt, Pseudomonas aeruginosa PA01
ccagugcaccgccgg

SEQ ID NO: 1554480 - RNA, 21 nt, Pseudomonas aeruginosa PA01
ccaguucgcgcaggaccuggc

SEQ ID NO: 1554481 - RNA, 20 nt, Pseudomonas aeruginosa PA01
ccaguucgcugccgccgcgc

SEQ ID NO: 1554482 - RNA, 21 nt, Pseudomonas aeruginosa PA01
ccaguucgcugccgccgcgcu

SEQ ID NO: 1554483 - RNA, 18 nt, Pseudomonas aeruginosa PA01
ccaguucgccgccgcgcu

SEQ ID NO: 1554484 - RNA, 17 nt, Pseudomonas aeruginosa PA01
ccaguucgccggccagc

SEQ ID NO: 1554485 - RNA, 13 nt, Pseudomonas aeruginosa PA01
ccagugccucccg

SEQ ID NO: 1554486 - RNA, 20 nt, Pseudomonas aeruginosa PA01
ccaguagcggaagcacggcu

SEQ ID NO: 1554487 - RNA, 17 nt, Pseudomonas aeruginosa PA01
ccagucauugcgcuccg

SEQ ID NO: 1554488 - RNA, 18 nt, Pseudomonas aeruginosa PA01
ccaggucgaucagcagca

SEQ ID NO: 1554489 - RNA, 23 nt, Pseudomonas aeruginosa PA01
ccaggucgaucagcagcagcgcc

SEQ ID NO: 1554490 - RNA, 13 nt, Pseudomonas aeruginosa PA01
ccaggucgauccc

SEQ ID NO: 1554491 - RNA, 23 nt, Pseudomonas aeruginosa PA01
ccaggucgauccugaccccggcc

SEQ ID NO: 1554492 - RNA, 19 nt, Pseudomonas aeruginosa PA01
ccagguccgccugguccag

SEQ ID NO: 1554493 - RNA, 18 nt, Pseudomonas aeruginosa PA01
ccaggucgccgcacaccg

SEQ ID NO: 1554494 - RNA, 18 nt, Pseudomonas aeruginosa PA01
ccaggucgcccaccuugc

SEQ ID NO: 1554495 - RNA, 19 nt, Pseudomonas aeruginosa PA01
ccaggucgcccaccuugcg

SEQ ID NO: 1554496 - RNA, 20 nt, Pseudomonas aeruginosa PA01
ccaggucgcccugcagcgcg

SEQ ID NO: 1554497 - RNA, 17 nt, Pseudomonas aeruginosa PA01
ccaggucgcgcagggcc

SEQ ID NO: 1554498 - RNA, 20 nt, Pseudomonas aeruginosa PA01
ccaggucgcuguccuccagc

SEQ ID NO: 1554499 - RNA, 12 nt, Pseudomonas aeruginosa PA01
ccaggucggcgg

SEQ ID NO: 1554500 - RNA, 14 nt, Pseudomonas aeruginosa PA01
ccaggucggcggca

SEQ ID NO: 1554501 - RNA, 20 nt, Pseudomonas aeruginosa PA01
ccaggucggucggcggcggu

SEQ ID NO: 1554502 - RNA, 19 nt, Pseudomonas aeruginosa PA01
ccaggucguugcgccggcc

SEQ ID NO: 1554503 - RNA, 21 nt, Pseudomonas aeruginosa PA01
ccaguccggcaccgcucugca

SEQ ID NO: 1554504 - RNA, 14 nt, Pseudomonas aeruginosa PA01
ccaguccggcagca

SEQ ID NO: 1554505 - RNA, 23 nt, Pseudomonas aeruginosa PA01
ccaggcguauucggcgaccagcc

SEQ ID NO: 1554506 - RNA, 22 nt, Pseudomonas aeruginosa PA01
ccaggcgucgcgccagcaccgu

SEQ ID NO: 1554507 - RNA, 16 nt, Pseudomonas aeruginosa PA01
ccaggcucgccccggc

SEQ ID NO: 1554508 - RNA, 15 nt, Pseudomonas aeruginosa PA01
ccaggcucgccgcca

SEQ ID NO: 1554509 - RNA, 16 nt, Pseudomonas aeruginosa PA01
ccaggcucgccgccag

SEQ ID NO: 1554510 - RNA, 20 nt, Pseudomonas aeruginosa PA01
ccaggcucgccgccagcagg

SEQ ID NO: 1554511 - RNA, 22 nt, Pseudomonas aeruginosa PA01
ccaggcgcugcguuccuguucg

SEQ ID NO: 1554512 - RNA, 22 nt, Pseudomonas aeruginosa PA01
ccaggcggcaagggcgucuggg

SEQ ID NO: 1554513 - RNA, 20 nt, Pseudomonas aeruginosa PA01
ccaggcggggucagagggug

SEQ ID NO: 1554514 - RNA, 19 nt, Pseudomonas aeruginosa PA01
ccaggcgguuguucagcgg

SEQ ID NO: 1554515 - RNA, 16 nt, Pseudomonas aeruginosa PA01
ccaggcgguccagcca

SEQ ID NO: 1554516 - RNA, 19 nt, Pseudomonas aeruginosa PA01
ccaggccgccgaagaacuc

SEQ ID NO: 1554517 - RNA, 21 nt, Pseudomonas aeruginosa PA01
ccaggccgccgauccaggaac

SEQ ID NO: 1554518 - RNA, 14 nt, Pseudomonas aeruginosa PA01
ccaggccgccggcg

SEQ ID NO: 1554519 - RNA, 20 nt, Pseudomonas aeruginosa PA01
ccaggccgccaugcucggcc

SEQ ID NO: 1554520 - RNA, 21 nt, Pseudomonas aeruginosa PA01
ccaggccgccaugcucggcca

SEQ ID NO: 1554521 - RNA, 20 nt, Pseudomonas aeruginosa PA01
ccaggccgacccgcaggccg

SEQ ID NO: 1554522 - RNA, 14 nt, Pseudomonas aeruginosa PA01
ccaggccgagcagg

SEQ ID NO: 1554523 - RNA, 18 nt, Pseudomonas aeruginosa PA01
ccaggccgagcaggaaga

SEQ ID NO: 1554524 - RNA, 14 nt, Pseudomonas aeruginosa PA01
ccaggccgagcgcg

SEQ ID NO: 1554525 - RNA, 17 nt, Pseudomonas aeruginosa PA01
ccaggccgagcgcgccg

SEQ ID NO: 1554526 - RNA, 17 nt, Pseudomonas aeruginosa PA01
ccaggccgaucgccucg

SEQ ID NO: 1554527 - RNA, 16 nt, Pseudomonas aeruginosa PA01
ccaggccgcaagcggu

SEQ ID NO: 1554528 - RNA, 17 nt, Pseudomonas aeruginosa PA01
ccaggccggagccgcgu

SEQ ID NO: 1554529 - RNA, 20 nt, Pseudomonas aeruginosa PA01
ccaggccguagaccaccagc

SEQ ID NO: 1554530 - RNA, 16 nt, Pseudomonas aeruginosa PA01
ccaggcgcucgcgcug

SEQ ID NO: 1554531 - RNA, 17 nt, Pseudomonas aeruginosa PA01
ccaggcgcucggcggcg

SEQ ID NO: 1554532 - RNA, 13 nt, Pseudomonas aeruginosa PA01
ccaggcgcuccuc

SEQ ID NO: 1554533 - RNA, 21 nt, Pseudomonas aeruginosa PA01
ccaggcgcuccuccagcgccg

SEQ ID NO: 1554534 - RNA, 22 nt, Pseudomonas aeruginosa PA01
ccaggcgcuccuccagcgccgc

SEQ ID NO: 1554535 - RNA, 14 nt, Pseudomonas aeruginosa PA01
ccaggccggcggcc

SEQ ID NO: 1554536 - RNA, 18 nt, Pseudomonas aeruginosa PA01
ccagggugaucacaccga

SEQ ID NO: 1554537 - RNA, 22 nt, Pseudomonas aeruginosa PA01
ccagguagucgcccagcgccug

SEQ ID NO: 1554538 - RNA, 19 nt, Pseudomonas aeruginosa PA01
ccagguagugccgcccuug

SEQ ID NO: 1554539 - RNA, 14 nt, Pseudomonas aeruginosa PA01
ccagguccgcaccg

SEQ ID NO: 1554540 - RNA, 21 nt, Pseudomonas aeruginosa PA01
ccaggucgagguucuccaggc

SEQ ID NO: 1554541 - RNA, 19 nt, Pseudomonas aeruginosa PA01
ccagguccggcagcgccuu

SEQ ID NO: 1554542 - RNA, 18 nt, Pseudomonas aeruginosa PA01
ccaggucaugcccuggcc

SEQ ID NO: 1554543 - RNA, 24 nt, Pseudomonas aeruginosa PA01
ccaggucaugcccuggccgacgcu

SEQ ID NO: 1554544 - RNA, 22 nt, Pseudomonas aeruginosa PA01
ccaggggcauguccaccgccgc

SEQ ID NO: 1554545 - RNA, 22 nt, Pseudomonas aeruginosa PA01
ccaggcuggccuuggccaugcc

SEQ ID NO: 1554546 - RNA, 14 nt, Pseudomonas aeruginosa PA01
ccaggcugacccgg

SEQ ID NO: 1554547 - RNA, 14 nt, Pseudomonas aeruginosa PA01
ccaggcugccgccg

SEQ ID NO: 1554548 - RNA, 14 nt, Pseudomonas aeruginosa PA01
ccaggcugccgccu

SEQ ID NO: 1554549 - RNA, 14 nt, Pseudomonas aeruginosa PA01
ccaggcugccggcc

SEQ ID NO: 1554550 - RNA, 20 nt, Pseudomonas aeruginosa PA01
ccaggcugccggccagguag

SEQ ID NO: 1554551 - RNA, 15 nt, Pseudomonas aeruginosa PA01
ccagggucacgccgc

SEQ ID NO: 1554552 - RNA, 17 nt, Pseudomonas aeruginosa PA01
ccagggucacgccgcgg

SEQ ID NO: 1554553 - RNA, 19 nt, Pseudomonas aeruginosa PA01
ccagggucacgccgcggcu

SEQ ID NO: 1554554 - RNA, 15 nt, Pseudomonas aeruginosa PA01
ccagggucagcuggc

SEQ ID NO: 1554555 - RNA, 20 nt, Pseudomonas aeruginosa PA01
ccagggucggcaccgagccg

SEQ ID NO: 1554556 - RNA, 20 nt, Pseudomonas aeruginosa PA01
ccagggucggcaccugcaga

SEQ ID NO: 1554557 - RNA, 23 nt, Pseudomonas aeruginosa PA01
ccaggguaccguugcgcaggcgu

SEQ ID NO: 1554558 - RNA, 17 nt, Pseudomonas aeruginosa PA01
ccaggguagcgccgcgg

SEQ ID NO: 1554559 - RNA, 17 nt, Pseudomonas aeruginosa PA01
ccagggucgccagcagg

SEQ ID NO: 1554560 - RNA, 19 nt, Pseudomonas aeruginosa PA01
ccagggucgccagcaggua

SEQ ID NO: 1554561 - RNA, 18 nt, Pseudomonas aeruginosa PA01
ccagggucgggccgcgcu

SEQ ID NO: 1554562 - RNA, 20 nt, Pseudomonas aeruginosa PA01
ccagggucgguucgcggcgc

SEQ ID NO: 1554563 - RNA, 20 nt, Pseudomonas aeruginosa PA01
ccaggauuucuccugcgguc

SEQ ID NO: 1554564 - RNA, 19 nt, Pseudomonas aeruginosa PA01
ccaggaugcccugcucuuc

SEQ ID NO: 1554565 - RNA, 17 nt, Pseudomonas aeruginosa PA01
ccaggaugcaaccgccc

SEQ ID NO: 1554566 - RNA, 12 nt, Pseudomonas aeruginosa PA01
ccaggccaacca

SEQ ID NO: 1554567 - RNA, 14 nt, Pseudomonas aeruginosa PA01
ccaggccaaccacc

SEQ ID NO: 1554568 - RNA, 18 nt, Pseudomonas aeruginosa PA01
ccaggccauagcgcgccg

SEQ ID NO: 1554569 - RNA, 13 nt, Pseudomonas aeruginosa PA01
ccaggcccacgcc

SEQ ID NO: 1554570 - RNA, 13 nt, Pseudomonas aeruginosa PA01
ccaggccaggugg

SEQ ID NO: 1554571 - RNA, 15 nt, Pseudomonas aeruginosa PA01
ccaggccagcgggcu

SEQ ID NO: 1554572 - RNA, 17 nt, Pseudomonas aeruginosa PA01
ccaggcccuuggucagg

SEQ ID NO: 1554573 - RNA, 23 nt, Pseudomonas aeruginosa PA01
ccaggcccugcuccuccaggcuc

SEQ ID NO: 1554574 - RNA, 16 nt, Pseudomonas aeruginosa PA01
ccaggccgaaggccug

SEQ ID NO: 1554575 - RNA, 18 nt, Pseudomonas aeruginosa PA01
ccaggccgacagcggcug

SEQ ID NO: 1554576 - RNA, 17 nt, Pseudomonas aeruginosa PA01
ccaggcccggcgcugcu

SEQ ID NO: 1554577 - RNA, 12 nt, Pseudomonas aeruginosa PA01
ccaggcccgccg

SEQ ID NO: 1554578 - RNA, 15 nt, Pseudomonas aeruginosa PA01
ccaggcccgccgcgg

SEQ ID NO: 1554579 - RNA, 15 nt, Pseudomonas aeruginosa PA01
ccaggccccaggccg

SEQ ID NO: 1554580 - RNA, 18 nt, Pseudomonas aeruginosa PA01
ccaggaagccgcgcccca

SEQ ID NO: 1554581 - RNA, 20 nt, Pseudomonas aeruginosa PA01
ccaggaagccgcgccccagc

SEQ ID NO: 1554582 - RNA, 22 nt, Pseudomonas aeruginosa PA01
ccaggaagcgucgugcgccggc

SEQ ID NO: 1554583 - RNA, 19 nt, Pseudomonas aeruginosa PA01
ccaggaagcucggcagcac

SEQ ID NO: 1554584 - RNA, 21 nt, Pseudomonas aeruginosa PA01
ccaggaaggaaugcugccacc

SEQ ID NO: 1554585 - RNA, 20 nt, Pseudomonas aeruginosa PA01
ccaggacaauggacaagcgu

SEQ ID NO: 1554586 - RNA, 11 nt, Pseudomonas aeruginosa PA01
ccaggacaccc

SEQ ID NO: 1554587 - RNA, 18 nt, Pseudomonas aeruginosa PA01
ccaggacaacgacagccc

SEQ ID NO: 1554588 - RNA, 16 nt, Pseudomonas aeruginosa PA01
ccaggaccagcgccug

SEQ ID NO: 1554589 - RNA, 19 nt, Pseudomonas aeruginosa PA01
ccaggaccaguucgccgcc

SEQ ID NO: 1554590 - RNA, 20 nt, Pseudomonas aeruginosa PA01
ccaggaccaguucgccgccg

SEQ ID NO: 1554591 - RNA, 18 nt, Pseudomonas aeruginosa PA01
ccaggaccauuugcgccu

SEQ ID NO: 1554592 - RNA, 14 nt, Pseudomonas aeruginosa PA01
ccaggaccuccugc

SEQ ID NO: 1554593 - RNA, 17 nt, Pseudomonas aeruginosa PA01
ccagcugccagugcucg

SEQ ID NO: 1554594 - RNA, 13 nt, Pseudomonas aeruginosa PA01
ccagcugcgccug

SEQ ID NO: 1554595 - RNA, 17 nt, Pseudomonas aeruginosa PA01
ccagcucggccggcagg

SEQ ID NO: 1554596 - RNA, 19 nt, Pseudomonas aeruginosa PA01
ccagcucggccggcaggcu

SEQ ID NO: 1554597 - RNA, 13 nt, Pseudomonas aeruginosa PA01
ccagcucggccug

SEQ ID NO: 1554598 - RNA, 15 nt, Pseudomonas aeruginosa PA01
ccagcucggcgagga

SEQ ID NO: 1554599 - RNA, 15 nt, Pseudomonas aeruginosa PA01
ccagcgcgucggcac

SEQ ID NO: 1554600 - RNA, 19 nt, Pseudomonas aeruginosa PA01
ccagcgcgucgaccaccgc

SEQ ID NO: 1554601 - RNA, 14 nt, Pseudomonas aeruginosa PA01
ccagcgcggcucgg

SEQ ID NO: 1554602 - RNA, 18 nt, Pseudomonas aeruginosa PA01
ccagcgcgguguuguagu

SEQ ID NO: 1554603 - RNA, 18 nt, Pseudomonas aeruginosa PA01
ccagcgcggugcgcgcca

SEQ ID NO: 1554604 - RNA, 18 nt, Pseudomonas aeruginosa PA01
ccagcgcggccgccgccg

SEQ ID NO: 1554605 - RNA, 17 nt, Pseudomonas aeruginosa PA01
ccagcgcggcggacagg

SEQ ID NO: 1554606 - RNA, 19 nt, Pseudomonas aeruginosa PA01
ccagcgcggcgccccaggc

SEQ ID NO: 1554607 - RNA, 14 nt, Pseudomonas aeruginosa PA01
ccagcgcgcccggc

SEQ ID NO: 1554608 - RNA, 14 nt, Pseudomonas aeruginosa PA01
ccagcgccugcugc

SEQ ID NO: 1554609 - RNA, 21 nt, Pseudomonas aeruginosa PA01
ccagcgccgcauuggccaggc

SEQ ID NO: 1554610 - RNA, 22 nt, Pseudomonas aeruginosa PA01
ccagcgccgcauuggccaggcc

SEQ ID NO: 1554611 - RNA, 12 nt, Pseudomonas aeruginosa PA01
ccagcgccgcca

SEQ ID NO: 1554612 - RNA, 13 nt, Pseudomonas aeruginosa PA01
ccagcgccgccac

SEQ ID NO: 1554613 - RNA, 17 nt, Pseudomonas aeruginosa PA01
ccagcgccgccugcugg

SEQ ID NO: 1554614 - RNA, 19 nt, Pseudomonas aeruginosa PA01
ccagcgccgccugcuggcu

SEQ ID NO: 1554615 - RNA, 12 nt, Pseudomonas aeruginosa PA01
ccagcgccgccg

SEQ ID NO: 1554616 - RNA, 17 nt, Pseudomonas aeruginosa PA01
ccagcgccgccagcagg

SEQ ID NO: 1554617 - RNA, 19 nt, Pseudomonas aeruginosa PA01
ccagcgccgccaggcagac

SEQ ID NO: 1554618 - RNA, 16 nt, Pseudomonas aeruginosa PA01
ccagcgccggcggcgc

SEQ ID NO: 1554619 - RNA, 13 nt, Pseudomonas aeruginosa PA01
ccagcgccgcggc

SEQ ID NO: 1554620 - RNA, 15 nt, Pseudomonas aeruginosa PA01
ccagcgccacuucca

SEQ ID NO: 1554621 - RNA, 17 nt, Pseudomonas aeruginosa PA01
ccagcgccaccagcagg

SEQ ID NO: 1554622 - RNA, 19 nt, Pseudomonas aeruginosa PA01
ccagcgccaccagcagggc

SEQ ID NO: 1554623 - RNA, 14 nt, Pseudomonas aeruginosa PA01
ccagcgccagguug

SEQ ID NO: 1554624 - RNA, 23 nt, Pseudomonas aeruginosa PA01
ccagcgccagguuggccuggccc

SEQ ID NO: 1554625 - RNA, 17 nt, Pseudomonas aeruginosa PA01
ccagcgccaggagcagg

SEQ ID NO: 1554626 - RNA, 14 nt, Pseudomonas aeruginosa PA01
ccagcgccagcagg

SEQ ID NO: 1554627 - RNA, 14 nt, Pseudomonas aeruginosa PA01
ccagcgccacgccg

SEQ ID NO: 1554628 - RNA, 14 nt, Pseudomonas aeruginosa PA01
ccagcgccaggccg

SEQ ID NO: 1554629 - RNA, 16 nt, Pseudomonas aeruginosa PA01
ccagcgccaggccgcc

SEQ ID NO: 1554630 - RNA, 13 nt, Pseudomonas aeruginosa PA01
ccagcgcccaggu

SEQ ID NO: 1554631 - RNA, 14 nt, Pseudomonas aeruginosa PA01
ccagcgcccaggug

SEQ ID NO: 1554632 - RNA, 16 nt, Pseudomonas aeruginosa PA01
ccagcgcccguagcac

SEQ ID NO: 1554633 - RNA, 22 nt, Pseudomonas aeruginosa PA01
ccagcgccgagacgaucagcag

SEQ ID NO: 1554634 - RNA, 15 nt, Pseudomonas aeruginosa PA01
ccagcucgcccgccu

SEQ ID NO: 1554635 - RNA, 17 nt, Pseudomonas aeruginosa PA01
ccagcucgcccgccucg

SEQ ID NO: 1554636 - RNA, 11 nt, Pseudomonas aeruginosa PA01
ccagcucgccg

SEQ ID NO: 1554637 - RNA, 17 nt, Pseudomonas aeruginosa PA01
ccagcucgaagccgccg

SEQ ID NO: 1554638 - RNA, 14 nt, Pseudomonas aeruginosa PA01
ccagcucgccgcgc

SEQ ID NO: 1554639 - RNA, 15 nt, Pseudomonas aeruginosa PA01
ccagcucgccgcgcu

SEQ ID NO: 1554640 - RNA, 18 nt, Pseudomonas aeruginosa PA01
ccagcucgccgcgcucca

SEQ ID NO: 1554641 - RNA, 13 nt, Pseudomonas aeruginosa PA01
ccagcuccuccag

SEQ ID NO: 1554642 - RNA, 14 nt, Pseudomonas aeruginosa PA01
ccagcuccuccagc

SEQ ID NO: 1554643 - RNA, 21 nt, Pseudomonas aeruginosa PA01
ccagcguuucgaagccgccgc

SEQ ID NO: 1554644 - RNA, 17 nt, Pseudomonas aeruginosa PA01
ccagcgucgccaggccg

SEQ ID NO: 1554645 - RNA, 17 nt, Pseudomonas aeruginosa PA01
ccagcguccuucggcgc

SEQ ID NO: 1554646 - RNA, 18 nt, Pseudomonas aeruginosa PA01
ccagcgucgccgccgcgg

SEQ ID NO: 1554647 - RNA, 20 nt, Pseudomonas aeruginosa PA01
ccagcgucgcgcgugccccg

SEQ ID NO: 1554648 - RNA, 14 nt, Pseudomonas aeruginosa PA01
ccagcguuguccuc

SEQ ID NO: 1554649 - RNA, 20 nt, Pseudomonas aeruginosa PA01
ccagcggaacgaaggacagg

SEQ ID NO: 1554650 - RNA, 20 nt, Pseudomonas aeruginosa PA01
ccagcgcuucggcggcuucg

SEQ ID NO: 1554651 - RNA, 19 nt, Pseudomonas aeruginosa PA01
ccagcgcuuccaccgccug

SEQ ID NO: 1554652 - RNA, 20 nt, Pseudomonas aeruginosa PA01
ccagcgcuuccaccgccugc

SEQ ID NO: 1554653 - RNA, 23 nt, Pseudomonas aeruginosa PA01
ccagcgcuuccaccgccugcccc

SEQ ID NO: 1554654 - RNA, 20 nt, Pseudomonas aeruginosa PA01
ccagcgcuugaacgcgcgcc

SEQ ID NO: 1554655 - RNA, 18 nt, Pseudomonas aeruginosa PA01
ccagcgcuccuugcgcca

SEQ ID NO: 1554656 - RNA, 22 nt, Pseudomonas aeruginosa PA01
ccagcgcuccuugcgccaggcc

SEQ ID NO: 1554657 - RNA, 12 nt, Pseudomonas aeruginosa PA01
ccagcgcgugca

SEQ ID NO: 1554658 - RNA, 15 nt, Pseudomonas aeruginosa PA01
ccagcggcuggcuga

SEQ ID NO: 1554659 - RNA, 16 nt, Pseudomonas aeruginosa PA01
ccagcggcacuucccg

SEQ ID NO: 1554660 - RNA, 19 nt, Pseudomonas aeruginosa PA01
ccagcggcuccucggccug

SEQ ID NO: 1554661 - RNA, 15 nt, Pseudomonas aeruginosa PA01
ccagcgggguggcgc

SEQ ID NO: 1554662 - RNA, 12 nt, Pseudomonas aeruginosa PA01
ccagcggguaga

SEQ ID NO: 1554663 - RNA, 18 nt, Pseudomonas aeruginosa PA01
ccagcgguaccagcagcg

SEQ ID NO: 1554664 - RNA, 19 nt, Pseudomonas aeruginosa PA01
ccagcgguacccgccggcc

SEQ ID NO: 1554665 - RNA, 16 nt, Pseudomonas aeruginosa PA01
ccagcgguacguagcg

SEQ ID NO: 1554666 - RNA, 14 nt, Pseudomonas aeruginosa PA01
cccgaacgccgacc

SEQ ID NO: 1554667 - RNA, 21 nt, Pseudomonas aeruginosa PA01
ccccuuuuucaugcgcgggcc

SEQ ID NO: 1554668 - RNA, 20 nt, Pseudomonas aeruginosa PA01
ccccuuuuuucagccuguca

SEQ ID NO: 1554669 - RNA, 17 nt, Pseudomonas aeruginosa PA01
cccgaagguguccgccc

SEQ ID NO: 1554670 - RNA, 14 nt, Pseudomonas aeruginosa PA01
cccgaacgggcccu

SEQ ID NO: 1554671 - RNA, 18 nt, Pseudomonas aeruginosa PA01
cccgaccgguuccagcgg

SEQ ID NO: 1554672 - RNA, 17 nt, Pseudomonas aeruginosa PA01
cccgacaggcagcgccg

SEQ ID NO: 1554673 - RNA, 22 nt, Pseudomonas aeruginosa PA01
cccgacaggcagcgccgcccac

SEQ ID NO: 1554674 - RNA, 12 nt, Pseudomonas aeruginosa PA01
cccgaccuucuc

SEQ ID NO: 1554675 - RNA, 14 nt, Pseudomonas aeruginosa PA01
cccgacugcagcgg

SEQ ID NO: 1554676 - RNA, 17 nt, Pseudomonas aeruginosa PA01
ccccuucggucgcgccc

SEQ ID NO: 1554677 - RNA, 12 nt, Pseudomonas aeruginosa PA01
ccccugccgccc

SEQ ID NO: 1554678 - RNA, 13 nt, Pseudomonas aeruginosa PA01
ccccugccgcccu

SEQ ID NO: 1554679 - RNA, 14 nt, Pseudomonas aeruginosa PA01
ccccugccgcccuc

SEQ ID NO: 1554680 - RNA, 11 nt, Pseudomonas aeruginosa PA01
ccccugccgcg

SEQ ID NO: 1554681 - RNA, 18 nt, Pseudomonas aeruginosa PA01
ccccucggcuaaccgccu

SEQ ID NO: 1554682 - RNA, 17 nt, Pseudomonas aeruginosa PA01
ccccugcaugccggccg

SEQ ID NO: 1554683 - RNA, 22 nt, Pseudomonas aeruginosa PA01
ccccgccggggcgugcaggccg

SEQ ID NO: 1554684 - RNA, 19 nt, Pseudomonas aeruginosa PA01
ccccgccgggagcggccgu

SEQ ID NO: 1554685 - RNA, 18 nt, Pseudomonas aeruginosa PA01
ccccgcuccgcucagucg

SEQ ID NO: 1554686 - RNA, 17 nt, Pseudomonas aeruginosa PA01
ccccgcuacccugcccc

SEQ ID NO: 1554687 - RNA, 17 nt, Pseudomonas aeruginosa PA01
cccgauaggcgccggcg

SEQ ID NO: 1554688 - RNA, 14 nt, Pseudomonas aeruginosa PA01
cccgagugcgccca

SEQ ID NO: 1554689 - RNA, 21 nt, Pseudomonas aeruginosa PA01
cccgagugcgcccagcagcag

SEQ ID NO: 1554690 - RNA, 15 nt, Pseudomonas aeruginosa PA01
cccgaggcgacgccc

SEQ ID NO: 1554691 - RNA, 16 nt, Pseudomonas aeruginosa PA01
cccgagcuuugcgcag

SEQ ID NO: 1554692 - RNA, 19 nt, Pseudomonas aeruginosa PA01
cccgagcuuugcgcagcca

SEQ ID NO: 1554693 - RNA, 13 nt, Pseudomonas aeruginosa PA01
cccgagcggcgcg

SEQ ID NO: 1554694 - RNA, 16 nt, Pseudomonas aeruginosa PA01
cccgcaauccgaccgg

SEQ ID NO: 1554695 - RNA, 18 nt, Pseudomonas aeruginosa PA01
cccgcaaggugcgggccg

SEQ ID NO: 1554696 - RNA, 18 nt, Pseudomonas aeruginosa PA01
cccgcaccagccggcgcu

SEQ ID NO: 1554697 - RNA, 21 nt, Pseudomonas aeruginosa PA01
cccgcaaccgcagacuccggc

SEQ ID NO: 1554698 - RNA, 19 nt, Pseudomonas aeruginosa PA01
cccgcaaccgcugccgccg

SEQ ID NO: 1554699 - RNA, 15 nt, Pseudomonas aeruginosa PA01
cccgaugccgcgccg

SEQ ID NO: 1554700 - RNA, 13 nt, Pseudomonas aeruginosa PA01
ccccaacccggcc

SEQ ID NO: 1554701 - RNA, 15 nt, Pseudomonas aeruginosa PA01
ccccacccgucccgc

SEQ ID NO: 1554702 - RNA, 22 nt, Pseudomonas aeruginosa PA01
cccauguagaccaccagcgugg

SEQ ID NO: 1554703 - RNA, 16 nt, Pseudomonas aeruginosa PA01
cccauuacguuguagu

SEQ ID NO: 1554704 - RNA, 21 nt, Pseudomonas aeruginosa PA01
cccaugugcuugaccgccgcc

SEQ ID NO: 1554705 - RNA, 16 nt, Pseudomonas aeruginosa PA01
cccaugcccgccccgc

SEQ ID NO: 1554706 - RNA, 22 nt, Pseudomonas aeruginosa PA01
cccaugccgcaagcuccccgcc

SEQ ID NO: 1554707 - RNA, 16 nt, Pseudomonas aeruginosa PA01
cccaggucggcgggca

SEQ ID NO: 1554708 - RNA, 18 nt, Pseudomonas aeruginosa PA01
cccaugccgcuagcccug

SEQ ID NO: 1554709 - RNA, 19 nt, Pseudomonas aeruginosa PA01
cccaugccgcuagcccugc

SEQ ID NO: 1554710 - RNA, 20 nt, Pseudomonas aeruginosa PA01
cccaugccgcuagcccugcu

SEQ ID NO: 1554711 - RNA, 17 nt, Pseudomonas aeruginosa PA01
ccccgccacuuccagca

SEQ ID NO: 1554712 - RNA, 12 nt, Pseudomonas aeruginosa PA01
ccccgccgccag

SEQ ID NO: 1554713 - RNA, 13 nt, Pseudomonas aeruginosa PA01
ccccgcccuagcg

SEQ ID NO: 1554714 - RNA, 15 nt, Pseudomonas aeruginosa PA01
ccccgcaaccgcugc

SEQ ID NO: 1554715 - RNA, 11 nt, Pseudomonas aeruginosa PA01
ccccgcagccg

SEQ ID NO: 1554716 - RNA, 13 nt, Pseudomonas aeruginosa PA01
cccccgccccuca

SEQ ID NO: 1554717 - RNA, 18 nt, Pseudomonas aeruginosa PA01
cccccgccccucacuccg

SEQ ID NO: 1554718 - RNA, 12 nt, Pseudomonas aeruginosa PA01
ccccccacccgu

SEQ ID NO: 1554719 - RNA, 13 nt, Pseudomonas aeruginosa PA01
ccccccuacgaaa

SEQ ID NO: 1554720 - RNA, 19 nt, Pseudomonas aeruginosa PA01
cccccgcaaccgcugccgc

SEQ ID NO: 1554721 - RNA, 16 nt, Pseudomonas aeruginosa PA01
cccccauaccgccucg

SEQ ID NO: 1554722 - RNA, 14 nt, Pseudomonas aeruginosa PA01
cccccaucgcccgc

SEQ ID NO: 1554723 - RNA, 17 nt, Pseudomonas aeruginosa PA01
cccccaucgcccgcagc

SEQ ID NO: 1554724 - RNA, 12 nt, Pseudomonas aeruginosa PA01
cccccagcgccc

SEQ ID NO: 1554725 - RNA, 15 nt, Pseudomonas aeruginosa PA01
cccccacccgucccg

SEQ ID NO: 1554726 - RNA, 14 nt, Pseudomonas aeruginosa PA01
cccccaccgggcca

SEQ ID NO: 1554727 - RNA, 16 nt, Pseudomonas aeruginosa PA01
ccccagcaccucgccg

SEQ ID NO: 1554728 - RNA, 12 nt, Pseudomonas aeruginosa PA01
ccccagcaccug

SEQ ID NO: 1554729 - RNA, 18 nt, Pseudomonas aeruginosa PA01
ccccagacccucucccug

SEQ ID NO: 1554730 - RNA, 16 nt, Pseudomonas aeruginosa PA01
ccccagagcccgccga

SEQ ID NO: 1554731 - RNA, 20 nt, Pseudomonas aeruginosa PA01
ccccagaagccccagagccc

SEQ ID NO: 1554732 - RNA, 18 nt, Pseudomonas aeruginosa PA01
cccaggcagaucgcgccg

SEQ ID NO: 1554733 - RNA, 17 nt, Pseudomonas aeruginosa PA01
cccagcguuguccucgg

SEQ ID NO: 1554734 - RNA, 22 nt, Pseudomonas aeruginosa PA01
cccagcguuguccucggcggcu

SEQ ID NO: 1554735 - RNA, 14 nt, Pseudomonas aeruginosa PA01
cccagcucagcagg

SEQ ID NO: 1554736 - RNA, 20 nt, Pseudomonas aeruginosa PA01
cccagcgcuuccucgggcag

SEQ ID NO: 1554737 - RNA, 17 nt, Pseudomonas aeruginosa PA01
cccagcguggccagcga

SEQ ID NO: 1554738 - RNA, 13 nt, Pseudomonas aeruginosa PA01
cccagcguucggc

SEQ ID NO: 1554739 - RNA, 14 nt, Pseudomonas aeruginosa PA01
cccaggggcacguc

SEQ ID NO: 1554740 - RNA, 19 nt, Pseudomonas aeruginosa PA01
cccagggugacgcucuuca

SEQ ID NO: 1554741 - RNA, 19 nt, Pseudomonas aeruginosa PA01
cccagguagcgcugcgcca

SEQ ID NO: 1554742 - RNA, 13 nt, Pseudomonas aeruginosa PA01
cccagggcguggu

SEQ ID NO: 1554743 - RNA, 14 nt, Pseudomonas aeruginosa PA01
cccagggccagcgg

SEQ ID NO: 1554744 - RNA, 18 nt, Pseudomonas aeruginosa PA01
cccagggcccagagcagc

SEQ ID NO: 1554745 - RNA, 15 nt, Pseudomonas aeruginosa PA01
cccaggccacgccca

SEQ ID NO: 1554746 - RNA, 18 nt, Pseudomonas aeruginosa PA01
cccaggccacgcccaugc

SEQ ID NO: 1554747 - RNA, 13 nt, Pseudomonas aeruginosa PA01
cccaggcaggcga

SEQ ID NO: 1554748 - RNA, 14 nt, Pseudomonas aeruginosa PA01
cccaggcccagccg

SEQ ID NO: 1554749 - RNA, 15 nt, Pseudomonas aeruginosa PA01
cccaggcccagccgg

SEQ ID NO: 1554750 - RNA, 23 nt, Pseudomonas aeruginosa PA01
cccagcggcaggcacgcugccag

SEQ ID NO: 1554751 - RNA, 12 nt, Pseudomonas aeruginosa PA01
cccagcggcgcc

SEQ ID NO: 1554752 - RNA, 13 nt, Pseudomonas aeruginosa PA01
cccagcggcgcca

SEQ ID NO: 1554753 - RNA, 13 nt, Pseudomonas aeruginosa PA01
cccagcggcgccu

SEQ ID NO: 1554754 - RNA, 13 nt, Pseudomonas aeruginosa PA01
cccagcgccgccu

SEQ ID NO: 1554755 - RNA, 23 nt, Pseudomonas aeruginosa PA01
cccagcgccgccugcuggcugcc

SEQ ID NO: 1554756 - RNA, 13 nt, Pseudomonas aeruginosa PA01
cccagcgcggcgc

SEQ ID NO: 1554757 - RNA, 12 nt, Pseudomonas aeruginosa PA01
cccagcgccccg

SEQ ID NO: 1554758 - RNA, 13 nt, Pseudomonas aeruginosa PA01
cccagcgccgcca

SEQ ID NO: 1554759 - RNA, 16 nt, Pseudomonas aeruginosa PA01
cccagcgccgccagca

SEQ ID NO: 1554760 - RNA, 14 nt, Pseudomonas aeruginosa PA01
cccagcgccugcaa

SEQ ID NO: 1554761 - RNA, 12 nt, Pseudomonas aeruginosa PA01
cccagcgccugg

SEQ ID NO: 1554762 - RNA, 15 nt, Pseudomonas aeruginosa PA01
cccagcgccugggcc

SEQ ID NO: 1554763 - RNA, 17 nt, Pseudomonas aeruginosa PA01
cccagcgccugggccgc

SEQ ID NO: 1554764 - RNA, 17 nt, Pseudomonas aeruginosa PA01
cccagcgcaucgcgcac

SEQ ID NO: 1554765 - RNA, 18 nt, Pseudomonas aeruginosa PA01
cccagcgcagccugcugg

SEQ ID NO: 1554766 - RNA, 19 nt, Pseudomonas aeruginosa PA01
cccagcgcagccugcuggc

SEQ ID NO: 1554767 - RNA, 12 nt, Pseudomonas aeruginosa PA01
cccagcgagccg

SEQ ID NO: 1554768 - RNA, 20 nt, Pseudomonas aeruginosa PA01
cccagcgagccgagcauguc

SEQ ID NO: 1554769 - RNA, 22 nt, Pseudomonas aeruginosa PA01
cccagcgagccgaucaccagca

SEQ ID NO: 1554770 - RNA, 13 nt, Pseudomonas aeruginosa PA01
cccacgggcggcc

SEQ ID NO: 1554771 - RNA, 19 nt, Pseudomonas aeruginosa PA01
cccacggccaggcccacgc

SEQ ID NO: 1554772 - RNA, 17 nt, Pseudomonas aeruginosa PA01
cccacggcgccuuccca

SEQ ID NO: 1554773 - RNA, 13 nt, Pseudomonas aeruginosa PA01
cccagcagcacca

SEQ ID NO: 1554774 - RNA, 21 nt, Pseudomonas aeruginosa PA01
cccagcagcaccaucagccag

SEQ ID NO: 1554775 - RNA, 21 nt, Pseudomonas aeruginosa PA01
cccagcagcaacagcgccgcg

SEQ ID NO: 1554776 - RNA, 19 nt, Pseudomonas aeruginosa PA01
cccagcacgccgagcaacg

SEQ ID NO: 1554777 - RNA, 14 nt, Pseudomonas aeruginosa PA01
cccagcaccucgcc

SEQ ID NO: 1554778 - RNA, 23 nt, Pseudomonas aeruginosa PA01
cccagccgugggcguagagccug

SEQ ID NO: 1554779 - RNA, 20 nt, Pseudomonas aeruginosa PA01
cccagccucggcagggcgcc

SEQ ID NO: 1554780 - RNA, 13 nt, Pseudomonas aeruginosa PA01
cccagccuugcug

SEQ ID NO: 1554781 - RNA, 17 nt, Pseudomonas aeruginosa PA01
cccagcgaagcuucuuc

SEQ ID NO: 1554782 - RNA, 14 nt, Pseudomonas aeruginosa PA01
cccagccgcggccg

SEQ ID NO: 1554783 - RNA, 14 nt, Pseudomonas aeruginosa PA01
cccagccgcggcgc

SEQ ID NO: 1554784 - RNA, 18 nt, Pseudomonas aeruginosa PA01
cccagccgaggcagccgu

SEQ ID NO: 1554785 - RNA, 17 nt, Pseudomonas aeruginosa PA01
cccagccgcacgccccu

SEQ ID NO: 1554786 - RNA, 18 nt, Pseudomonas aeruginosa PA01
cccagcagggccagccag

SEQ ID NO: 1554787 - RNA, 15 nt, Pseudomonas aeruginosa PA01
cccagcaggccggcc

SEQ ID NO: 1554788 - RNA, 12 nt, Pseudomonas aeruginosa PA01
cccagcaggcgc

SEQ ID NO: 1554789 - RNA, 14 nt, Pseudomonas aeruginosa PA01
cccagcaggcgcgc

SEQ ID NO: 1554790 - RNA, 16 nt, Pseudomonas aeruginosa PA01
cccagcaggcgcgccc

SEQ ID NO: 1554791 - RNA, 13 nt, Pseudomonas aeruginosa PA01
cccagcaggcugc

SEQ ID NO: 1554792 - RNA, 14 nt, Pseudomonas aeruginosa PA01
cccagcccggccau

SEQ ID NO: 1554793 - RNA, 12 nt, Pseudomonas aeruginosa PA01
cccagcccgccu

SEQ ID NO: 1554794 - RNA, 21 nt, Pseudomonas aeruginosa PA01
cccagcccgccuuccagcuug

SEQ ID NO: 1554795 - RNA, 14 nt, Pseudomonas aeruginosa PA01
cccaaccuucuccc

SEQ ID NO: 1554796 - RNA, 19 nt, Pseudomonas aeruginosa PA01
cccaacagucgucgcgcag

SEQ ID NO: 1554797 - RNA, 22 nt, Pseudomonas aeruginosa PA01
cccacggaggccuucgccgacc

SEQ ID NO: 1554798 - RNA, 19 nt, Pseudomonas aeruginosa PA01
cccacgccuugcagcaccg

SEQ ID NO: 1554799 - RNA, 21 nt, Pseudomonas aeruginosa PA01
cccaccgcgggggucggaugc

SEQ ID NO: 1554800 - RNA, 13 nt, Pseudomonas aeruginosa PA01
cccaccaccagga

SEQ ID NO: 1554801 - RNA, 18 nt, Pseudomonas aeruginosa PA01
ccauuucguagcccaggc

SEQ ID NO: 1554802 - RNA, 11 nt, Pseudomonas aeruginosa PA01
ccauugccgcg

SEQ ID NO: 1554803 - RNA, 14 nt, Pseudomonas aeruginosa PA01
ccaucuuuuccugc

SEQ ID NO: 1554804 - RNA, 13 nt, Pseudomonas aeruginosa PA01
ccauugcccggcc

SEQ ID NO: 1554805 - RNA, 21 nt, Pseudomonas aeruginosa PA01
ccauugcagguaguccagcca

SEQ ID NO: 1554806 - RNA, 13 nt, Pseudomonas aeruginosa PA01
cccggcgccgccc

SEQ ID NO: 1554807 - RNA, 14 nt, Pseudomonas aeruginosa PA01
cccggcgccgcccu

SEQ ID NO: 1554808 - RNA, 21 nt, Pseudomonas aeruginosa PA01
cccggcgcgacgcuccaggug

SEQ ID NO: 1554809 - RNA, 13 nt, Pseudomonas aeruginosa PA01
cccggcgcggcgg

SEQ ID NO: 1554810 - RNA, 18 nt, Pseudomonas aeruginosa PA01
cccggcgcggcgcagcca

SEQ ID NO: 1554811 - RNA, 19 nt, Pseudomonas aeruginosa PA01
cccggcgcggcgcagccag

SEQ ID NO: 1554812 - RNA, 22 nt, Pseudomonas aeruginosa PA01
cccggcggcgacccagaccugc

SEQ ID NO: 1554813 - RNA, 12 nt, Pseudomonas aeruginosa PA01
cccggcggcgcg

SEQ ID NO: 1554814 - RNA, 22 nt, Pseudomonas aeruginosa PA01
cccggcggcggcaccgacgccg

SEQ ID NO: 1554815 - RNA, 13 nt, Pseudomonas aeruginosa PA01
cccggcgcuucgc

SEQ ID NO: 1554816 - RNA, 17 nt, Pseudomonas aeruginosa PA01
cccggcgcuucgcgcag

SEQ ID NO: 1554817 - RNA, 23 nt, Pseudomonas aeruginosa PA01
cccggcggacaaccaccaugcgg

SEQ ID NO: 1554818 - RNA, 19 nt, Pseudomonas aeruginosa PA01
cccggcuaucgcuuucagc

SEQ ID NO: 1554819 - RNA, 23 nt, Pseudomonas aeruginosa PA01
cccggcuccagccgggcuccgcc

SEQ ID NO: 1554820 - RNA, 12 nt, Pseudomonas aeruginosa PA01
cccggcucgccg

SEQ ID NO: 1554821 - RNA, 21 nt, Pseudomonas aeruginosa PA01
cccggcugguugccagcagcg

SEQ ID NO: 1554822 - RNA, 17 nt, Pseudomonas aeruginosa PA01
cccggcuggcguaccuc

SEQ ID NO: 1554823 - RNA, 22 nt, Pseudomonas aeruginosa PA01
cccggcuggcguaccucgccag

SEQ ID NO: 1554824 - RNA, 16 nt, Pseudomonas aeruginosa PA01
cccggcugagcgccag

SEQ ID NO: 1554825 - RNA, 20 nt, Pseudomonas aeruginosa PA01
cccggcggguucagcccgcc

SEQ ID NO: 1554826 - RNA, 15 nt, Pseudomonas aeruginosa PA01
cccggcgguccgccg

SEQ ID NO: 1554827 - RNA, 13 nt, Pseudomonas aeruginosa PA01
cccggcgugagca

SEQ ID NO: 1554828 - RNA, 14 nt, Pseudomonas aeruginosa PA01
cccggccggcagga

SEQ ID NO: 1554829 - RNA, 15 nt, Pseudomonas aeruginosa PA01
cccggccuccaggcu

SEQ ID NO: 1554830 - RNA, 17 nt, Pseudomonas aeruginosa PA01
cccggccuccaggcugg

SEQ ID NO: 1554831 - RNA, 17 nt, Pseudomonas aeruginosa PA01
cccggccuccccggccc

SEQ ID NO: 1554832 - RNA, 13 nt, Pseudomonas aeruginosa PA01
cccggccucgccg

SEQ ID NO: 1554833 - RNA, 14 nt, Pseudomonas aeruginosa PA01
cccggccucgccgg

SEQ ID NO: 1554834 - RNA, 14 nt, Pseudomonas aeruginosa PA01
cccggccgccugcc

SEQ ID NO: 1554835 - RNA, 21 nt, Pseudomonas aeruginosa PA01
cccggcccggucagcuucgcc

SEQ ID NO: 1554836 - RNA, 22 nt, Pseudomonas aeruginosa PA01
cccggcccgcgccgccucgaug

SEQ ID NO: 1554837 - RNA, 20 nt, Pseudomonas aeruginosa PA01
cccggcgaacagcgcuuccu

SEQ ID NO: 1554838 - RNA, 12 nt, Pseudomonas aeruginosa PA01
cccggccuggcg

SEQ ID NO: 1554839 - RNA, 20 nt, Pseudomonas aeruginosa PA01
cccggccuggcgccgggguu

SEQ ID NO: 1554840 - RNA, 18 nt, Pseudomonas aeruginosa PA01
cccggccugguaggccuc

SEQ ID NO: 1554841 - RNA, 13 nt, Pseudomonas aeruginosa PA01
cccggcgcacgcc

SEQ ID NO: 1554842 - RNA, 14 nt, Pseudomonas aeruginosa PA01
cccggcgcacgccg

SEQ ID NO: 1554843 - RNA, 17 nt, Pseudomonas aeruginosa PA01
cccggcgcacgccggcc

SEQ ID NO: 1554844 - RNA, 14 nt, Pseudomonas aeruginosa PA01
cccggcgccacccc

SEQ ID NO: 1554845 - RNA, 18 nt, Pseudomonas aeruginosa PA01
cccggcgccaccccgccg

SEQ ID NO: 1554846 - RNA, 13 nt, Pseudomonas aeruginosa PA01
cccggcgccaccg

SEQ ID NO: 1554847 - RNA, 22 nt, Pseudomonas aeruginosa PA01
cccggcgccaccgauucgccgg

SEQ ID NO: 1554848 - RNA, 17 nt, Pseudomonas aeruginosa PA01
cccggcgccaccgcguu

SEQ ID NO: 1554849 - RNA, 19 nt, Pseudomonas aeruginosa PA01
cccggcgcccggcgcaugc

SEQ ID NO: 1554850 - RNA, 15 nt, Pseudomonas aeruginosa PA01
cccggcgccaggcug

SEQ ID NO: 1554851 - RNA, 13 nt, Pseudomonas aeruginosa PA01
cccggucgcgcug

SEQ ID NO: 1554852 - RNA, 19 nt, Pseudomonas aeruginosa PA01
cccgguccguccagcgcgc

SEQ ID NO: 1554853 - RNA, 18 nt, Pseudomonas aeruginosa PA01
cccgguccugcaacugga

SEQ ID NO: 1554854 - RNA, 15 nt, Pseudomonas aeruginosa PA01
cccggucaccaccca

SEQ ID NO: 1554855 - RNA, 19 nt, Pseudomonas aeruginosa PA01
cccggucagcuucgccgcc

SEQ ID NO: 1554856 - RNA, 20 nt, Pseudomonas aeruginosa PA01
cccggucagcuucgccgccc

SEQ ID NO: 1554857 - RNA, 14 nt, Pseudomonas aeruginosa PA01
cccggucacgccgg

SEQ ID NO: 1554858 - RNA, 24 nt, Pseudomonas aeruginosa PA01
cccgguacagccaacccucggaug

SEQ ID NO: 1554859 - RNA, 16 nt, Pseudomonas aeruginosa PA01
cccgguacagcgccug

SEQ ID NO: 1554860 - RNA, 18 nt, Pseudomonas aeruginosa PA01
cccgguacuccuccagca

SEQ ID NO: 1554861 - RNA, 18 nt, Pseudomonas aeruginosa PA01
cccgguagacgccuccca

SEQ ID NO: 1554862 - RNA, 16 nt, Pseudomonas aeruginosa PA01
cccgguauucagccag

SEQ ID NO: 1554863 - RNA, 15 nt, Pseudomonas aeruginosa PA01
cccggucucgcgcag

SEQ ID NO: 1554864 - RNA, 20 nt, Pseudomonas aeruginosa PA01
cccggucggccuguucgccc

SEQ ID NO: 1554865 - RNA, 16 nt, Pseudomonas aeruginosa PA01
cccgggccuccuggcg

SEQ ID NO: 1554866 - RNA, 14 nt, Pseudomonas aeruginosa PA01
cccgggcgccaccg

SEQ ID NO: 1554867 - RNA, 13 nt, Pseudomonas aeruginosa PA01
cccgggcccaagc

SEQ ID NO: 1554868 - RNA, 24 nt, Pseudomonas aeruginosa PA01
cccggcuuuuuucgcccgugccga

SEQ ID NO: 1554869 - RNA, 19 nt, Pseudomonas aeruginosa PA01
cccgggaaaccaccaggaa

SEQ ID NO: 1554870 - RNA, 16 nt, Pseudomonas aeruginosa PA01
cccggcuugccggcag

SEQ ID NO: 1554871 - RNA, 14 nt, Pseudomonas aeruginosa PA01
cccggguucugcuc

SEQ ID NO: 1554872 - RNA, 22 nt, Pseudomonas aeruginosa PA01
cccggguugagguagagcacgc

SEQ ID NO: 1554873 - RNA, 19 nt, Pseudomonas aeruginosa PA01
cccgggguugcccagcagg

SEQ ID NO: 1554874 - RNA, 16 nt, Pseudomonas aeruginosa PA01
cccgggucgcgcagcg

SEQ ID NO: 1554875 - RNA, 22 nt, Pseudomonas aeruginosa PA01
cccuccugcucgauccagccgg

SEQ ID NO: 1554876 - RNA, 23 nt, Pseudomonas aeruginosa PA01
cccuccugcucgauccagccggc

SEQ ID NO: 1554877 - RNA, 23 nt, Pseudomonas aeruginosa PA01
cccuccuggaaagaccggcgccc

SEQ ID NO: 1554878 - RNA, 12 nt, Pseudomonas aeruginosa PA01
cccuccugggcc

SEQ ID NO: 1554879 - RNA, 13 nt, Pseudomonas aeruginosa PA01
cccuccugggccu

SEQ ID NO: 1554880 - RNA, 13 nt, Pseudomonas aeruginosa PA01
cccuccuccagca

SEQ ID NO: 1554881 - RNA, 19 nt, Pseudomonas aeruginosa PA01
cccucgagcaccgcggucu

SEQ ID NO: 1554882 - RNA, 15 nt, Pseudomonas aeruginosa PA01
cccucgaccuggcuc

SEQ ID NO: 1554883 - RNA, 13 nt, Pseudomonas aeruginosa PA01
cccucagcggcgg

SEQ ID NO: 1554884 - RNA, 21 nt, Pseudomonas aeruginosa PA01
cccucaggggugcagcccugg

SEQ ID NO: 1554885 - RNA, 17 nt, Pseudomonas aeruginosa PA01
cccucagucgcccccac

SEQ ID NO: 1554886 - RNA, 23 nt, Pseudomonas aeruginosa PA01
cccucacuccgucuccagcaacc

SEQ ID NO: 1554887 - RNA, 14 nt, Pseudomonas aeruginosa PA01
cccuccaguuccug

SEQ ID NO: 1554888 - RNA, 22 nt, Pseudomonas aeruginosa PA01
cccuccaguuccugcuccuccg

SEQ ID NO: 1554889 - RNA, 20 nt, Pseudomonas aeruginosa PA01
cccuccauccagucuucgcc

SEQ ID NO: 1554890 - RNA, 22 nt, Pseudomonas aeruginosa PA01
cccuccauccagucuucgccgg

SEQ ID NO: 1554891 - RNA, 20 nt, Pseudomonas aeruginosa PA01
cccucauggaaaccccggcc

SEQ ID NO: 1554892 - RNA, 14 nt, Pseudomonas aeruginosa PA01
cccucacaccacca

SEQ ID NO: 1554893 - RNA, 16 nt, Pseudomonas aeruginosa PA01
cccucacaccaccagc

SEQ ID NO: 1554894 - RNA, 19 nt, Pseudomonas aeruginosa PA01
cccucacaccaccagcauc

SEQ ID NO: 1554895 - RNA, 19 nt, Pseudomonas aeruginosa PA01
cccuagggguucuccgggu

SEQ ID NO: 1554896 - RNA, 23 nt, Pseudomonas aeruginosa PA01
cccuaggguuccggucgggaugc

SEQ ID NO: 1554897 - RNA, 16 nt, Pseudomonas aeruginosa PA01
cccuagaccaacugcg

SEQ ID NO: 1554898 - RNA, 20 nt, Pseudomonas aeruginosa PA01
cccuacgaaagcgccuucug

SEQ ID NO: 1554899 - RNA, 19 nt, Pseudomonas aeruginosa PA01
cccuaccagcgcaaccggu

SEQ ID NO: 1554900 - RNA, 20 nt, Pseudomonas aeruginosa PA01
cccuacagcccccccagcac

SEQ ID NO: 1554901 - RNA, 18 nt, Pseudomonas aeruginosa PA01
cccguuguacccggcgga

SEQ ID NO: 1554902 - RNA, 22 nt, Pseudomonas aeruginosa PA01
cccguugccgagguguugugug

SEQ ID NO: 1554903 - RNA, 13 nt, Pseudomonas aeruginosa PA01
cccgugcgccgcg

SEQ ID NO: 1554904 - RNA, 22 nt, Pseudomonas aeruginosa PA01
cccgugcgccgcgggucaccag

SEQ ID NO: 1554905 - RNA, 15 nt, Pseudomonas aeruginosa PA01
cccgugcggcacgcu

SEQ ID NO: 1554906 - RNA, 14 nt, Pseudomonas aeruginosa PA01
cccguggcgacgca

SEQ ID NO: 1554907 - RNA, 12 nt, Pseudomonas aeruginosa PA01
cccguggcgggc

SEQ ID NO: 1554908 - RNA, 17 nt, Pseudomonas aeruginosa PA01
cccguggcgggccagca

SEQ ID NO: 1554909 - RNA, 23 nt, Pseudomonas aeruginosa PA01
cccgugggaucgccacgccggcg

SEQ ID NO: 1554910 - RNA, 17 nt, Pseudomonas aeruginosa PA01
cccgguugccuucgucg

SEQ ID NO: 1554911 - RNA, 21 nt, Pseudomonas aeruginosa PA01
cccgguugccuucgucgcugg

SEQ ID NO: 1554912 - RNA, 15 nt, Pseudomonas aeruginosa PA01
cccgguugaccccgc

SEQ ID NO: 1554913 - RNA, 18 nt, Pseudomonas aeruginosa PA01
cccgguugaccccgcggg

SEQ ID NO: 1554914 - RNA, 18 nt, Pseudomonas aeruginosa PA01
cccgguucucgccccagc

SEQ ID NO: 1554915 - RNA, 16 nt, Pseudomonas aeruginosa PA01
cccgguuacucgccgg

SEQ ID NO: 1554916 - RNA, 23 nt, Pseudomonas aeruginosa PA01
cccguagcacauggucuucccag

SEQ ID NO: 1554917 - RNA, 14 nt, Pseudomonas aeruginosa PA01
cccgguuuccgcag

SEQ ID NO: 1554918 - RNA, 22 nt, Pseudomonas aeruginosa PA01
cccgucaugaccagagccgccg

SEQ ID NO: 1554919 - RNA, 22 nt, Pseudomonas aeruginosa PA01
cccgucauugaaaacggcgccc

SEQ ID NO: 1554920 - RNA, 18 nt, Pseudomonas aeruginosa PA01
cccguccauuuucagcgg

SEQ ID NO: 1554921 - RNA, 15 nt, Pseudomonas aeruginosa PA01
cccguccagcgcuug

SEQ ID NO: 1554922 - RNA, 16 nt, Pseudomonas aeruginosa PA01
cccguccgcugcgcca

SEQ ID NO: 1554923 - RNA, 16 nt, Pseudomonas aeruginosa PA01
cccgcucaagggcugg

SEQ ID NO: 1554924 - RNA, 14 nt, Pseudomonas aeruginosa PA01
cccgcuccagccgg

SEQ ID NO: 1554925 - RNA, 11 nt, Pseudomonas aeruginosa PA01
cccgcucgccg

SEQ ID NO: 1554926 - RNA, 12 nt, Pseudomonas aeruginosa PA01
cccgcucgccgg

SEQ ID NO: 1554927 - RNA, 22 nt, Pseudomonas aeruginosa PA01
cccgcucgagggugucguagag

SEQ ID NO: 1554928 - RNA, 16 nt, Pseudomonas aeruginosa PA01
cccgcucccgcggccc

SEQ ID NO: 1554929 - RNA, 24 nt, Pseudomonas aeruginosa PA01
cccgcuccgucgcuucgcccgccg

SEQ ID NO: 1554930 - RNA, 23 nt, Pseudomonas aeruginosa PA01
cccgcugcaugugccaggccugg

SEQ ID NO: 1554931 - RNA, 15 nt, Pseudomonas aeruginosa PA01
cccgcugcgcugcca

SEQ ID NO: 1554932 - RNA, 15 nt, Pseudomonas aeruginosa PA01
cccgcugcaccagcu

SEQ ID NO: 1554933 - RNA, 17 nt, Pseudomonas aeruginosa PA01
cccgcuguccgccggcc

SEQ ID NO: 1554934 - RNA, 13 nt, Pseudomonas aeruginosa PA01
cccgcgcggcccu

SEQ ID NO: 1554935 - RNA, 13 nt, Pseudomonas aeruginosa PA01
cccgcgcucggcc

SEQ ID NO: 1554936 - RNA, 14 nt, Pseudomonas aeruginosa PA01
cccgcgcgggccga

SEQ ID NO: 1554937 - RNA, 16 nt, Pseudomonas aeruginosa PA01
cccgcggcccaagggc

SEQ ID NO: 1554938 - RNA, 22 nt, Pseudomonas aeruginosa PA01
cccgcggucacucggccucggc

SEQ ID NO: 1554939 - RNA, 20 nt, Pseudomonas aeruginosa PA01
cccgcguguucgaccggguu

SEQ ID NO: 1554940 - RNA, 15 nt, Pseudomonas aeruginosa PA01
cccgcuuuccccggc

SEQ ID NO: 1554941 - RNA, 20 nt, Pseudomonas aeruginosa PA01
cccgcuugccgucgaccugc

SEQ ID NO: 1554942 - RNA, 13 nt, Pseudomonas aeruginosa PA01
cccgcuugcgccg

SEQ ID NO: 1554943 - RNA, 16 nt, Pseudomonas aeruginosa PA01
cccgcuugcgccgccu

SEQ ID NO: 1554944 - RNA, 17 nt, Pseudomonas aeruginosa PA01
cccgcuugcgccgccuc

SEQ ID NO: 1554945 - RNA, 13 nt, Pseudomonas aeruginosa PA01
cccggaaugcaaa

SEQ ID NO: 1554946 - RNA, 12 nt, Pseudomonas aeruginosa PA01
cccggagccguu

SEQ ID NO: 1554947 - RNA, 22 nt, Pseudomonas aeruginosa PA01
cccggagcgcgaaagcgccccg

SEQ ID NO: 1554948 - RNA, 12 nt, Pseudomonas aeruginosa PA01
cccggaggcggc

SEQ ID NO: 1554949 - RNA, 12 nt, Pseudomonas aeruginosa PA01
cccggagccaac

SEQ ID NO: 1554950 - RNA, 19 nt, Pseudomonas aeruginosa PA01
cccggagaucgccgcgccg

SEQ ID NO: 1554951 - RNA, 16 nt, Pseudomonas aeruginosa PA01
cccggaguuccagcgg

SEQ ID NO: 1554952 - RNA, 17 nt, Pseudomonas aeruginosa PA01
cccggaccuuguccagg

SEQ ID NO: 1554953 - RNA, 17 nt, Pseudomonas aeruginosa PA01
cccggacgacgaaagaa

SEQ ID NO: 1554954 - RNA, 22 nt, Pseudomonas aeruginosa PA01
cccggacgggugcgcgccaccu

SEQ ID NO: 1554955 - RNA, 17 nt, Pseudomonas aeruginosa PA01
cccggcagggccagcgg

SEQ ID NO: 1554956 - RNA, 16 nt, Pseudomonas aeruginosa PA01
cccggccagcagcgcc

SEQ ID NO: 1554957 - RNA, 23 nt, Pseudomonas aeruginosa PA01
cccggccagcagcgccuccucua

SEQ ID NO: 1554958 - RNA, 14 nt, Pseudomonas aeruginosa PA01
cccggcaucgccgg

SEQ ID NO: 1554959 - RNA, 13 nt, Pseudomonas aeruginosa PA01
cccggccauccug

SEQ ID NO: 1554960 - RNA, 18 nt, Pseudomonas aeruginosa PA01
cccggccauuccuuccag

SEQ ID NO: 1554961 - RNA, 20 nt, Pseudomonas aeruginosa PA01
cccggccauuccuuccaggg

SEQ ID NO: 1554962 - RNA, 18 nt, Pseudomonas aeruginosa PA01
cccggcccaggccggguu

SEQ ID NO: 1554963 - RNA, 15 nt, Pseudomonas aeruginosa PA01
cccggcccauggcga

SEQ ID NO: 1554964 - RNA, 12 nt, Pseudomonas aeruginosa PA01
cccggcccaggc

SEQ ID NO: 1554965 - RNA, 14 nt, Pseudomonas aeruginosa PA01
cccggccaggccgc

SEQ ID NO: 1554966 - RNA, 16 nt, Pseudomonas aeruginosa PA01
cccggccaggccgccc

SEQ ID NO: 1554967 - RNA, 18 nt, Pseudomonas aeruginosa PA01
cccggccaggccgcccag

SEQ ID NO: 1554968 - RNA, 17 nt, Pseudomonas aeruginosa PA01
cccggccaggccacggc

SEQ ID NO: 1554969 - RNA, 19 nt, Pseudomonas aeruginosa PA01
cccggccaggccacggcgg

SEQ ID NO: 1554970 - RNA, 13 nt, Pseudomonas aeruginosa PA01
cccggccaggcga

SEQ ID NO: 1554971 - RNA, 13 nt, Pseudomonas aeruginosa PA01
cccggccaggcgc

SEQ ID NO: 1554972 - RNA, 20 nt, Pseudomonas aeruginosa PA01
cccggcaagggccugcucag

SEQ ID NO: 1554973 - RNA, 15 nt, Pseudomonas aeruginosa PA01
cccggcaauagccgg

SEQ ID NO: 1554974 - RNA, 19 nt, Pseudomonas aeruginosa PA01
cccggaucagcucgcguag

SEQ ID NO: 1554975 - RNA, 13 nt, Pseudomonas aeruginosa PA01
cccggcaccaggc

SEQ ID NO: 1554976 - RNA, 15 nt, Pseudomonas aeruginosa PA01
cccggcauaggcgcc

SEQ ID NO: 1554977 - RNA, 16 nt, Pseudomonas aeruginosa PA01
cccggcauaggcgcca

SEQ ID NO: 1554978 - RNA, 16 nt, Pseudomonas aeruginosa PA01
cccggcagcaggccgc

SEQ ID NO: 1554979 - RNA, 18 nt, Pseudomonas aeruginosa PA01
cccggcagcaggccgccg

SEQ ID NO: 1554980 - RNA, 13 nt, Pseudomonas aeruginosa PA01
cccgccaaggcgg

SEQ ID NO: 1554981 - RNA, 18 nt, Pseudomonas aeruginosa PA01
cccgccaagggcgccgcc

SEQ ID NO: 1554982 - RNA, 19 nt, Pseudomonas aeruginosa PA01
cccgccaagggcgccgccg

SEQ ID NO: 1554983 - RNA, 14 nt, Pseudomonas aeruginosa PA01
cccgcauccuccac

SEQ ID NO: 1554984 - RNA, 13 nt, Pseudomonas aeruginosa PA01
cccgccaccuggc

SEQ ID NO: 1554985 - RNA, 15 nt, Pseudomonas aeruginosa PA01
cccgccaccgacccu

SEQ ID NO: 1554986 - RNA, 17 nt, Pseudomonas aeruginosa PA01
cccgccacuuccagcac

SEQ ID NO: 1554987 - RNA, 14 nt, Pseudomonas aeruginosa PA01
cccgcagcggcgcu

SEQ ID NO: 1554988 - RNA, 17 nt, Pseudomonas aeruginosa PA01
cccgcagaucuuccccg

SEQ ID NO: 1554989 - RNA, 14 nt, Pseudomonas aeruginosa PA01
cccgcagccccgcc

SEQ ID NO: 1554990 - RNA, 19 nt, Pseudomonas aeruginosa PA01
cccgcaguuccucgccgcu

SEQ ID NO: 1554991 - RNA, 13 nt, Pseudomonas aeruginosa PA01
cccgcaguuccuu

SEQ ID NO: 1554992 - RNA, 16 nt, Pseudomonas aeruginosa PA01
cccgcaucgaggccgc

SEQ ID NO: 1554993 - RNA, 18 nt, Pseudomonas aeruginosa PA01
cccgcaucgaggccgccc

SEQ ID NO: 1554994 - RNA, 20 nt, Pseudomonas aeruginosa PA01
cccgcaucgaggccgcccag

SEQ ID NO: 1554995 - RNA, 20 nt, Pseudomonas aeruginosa PA01
cccgcccgccguccuccagc

SEQ ID NO: 1554996 - RNA, 13 nt, Pseudomonas aeruginosa PA01
cccgccccugcuc

SEQ ID NO: 1554997 - RNA, 22 nt, Pseudomonas aeruginosa PA01
cccgcccggcucaacugcuuac

SEQ ID NO: 1554998 - RNA, 18 nt, Pseudomonas aeruginosa PA01
cccgccgaccagcacggc

SEQ ID NO: 1554999 - RNA, 19 nt, Pseudomonas aeruginosa PA01
cccgcccuuggcggcgcca

SEQ ID NO: 1555000 - RNA, 19 nt, Pseudomonas aeruginosa PA01
cccgcccggucucagccgg

SEQ ID NO: 1555001 - RNA, 20 nt, Pseudomonas aeruginosa PA01
cccgcccggucucagccggc

SEQ ID NO: 1555002 - RNA, 20 nt, Pseudomonas aeruginosa PA01
cccgcgacaacggccguccc

SEQ ID NO: 1555003 - RNA, 20 nt, Pseudomonas aeruginosa PA01
cccgcgacucgagcaccacc

SEQ ID NO: 1555004 - RNA, 22 nt, Pseudomonas aeruginosa PA01
cccgcgcauggagacggcccgc

SEQ ID NO: 1555005 - RNA, 18 nt, Pseudomonas aeruginosa PA01
cccgcgccagcgccgcca

SEQ ID NO: 1555006 - RNA, 13 nt, Pseudomonas aeruginosa PA01
cccgcgccggcag

SEQ ID NO: 1555007 - RNA, 16 nt, Pseudomonas aeruginosa PA01
cccgcgccgccgcggc

SEQ ID NO: 1555008 - RNA, 12 nt, Pseudomonas aeruginosa PA01
cccgcgccgccg

SEQ ID NO: 1555009 - RNA, 22 nt, Pseudomonas aeruginosa PA01
cccgccgaggaagccgaccggc

SEQ ID NO: 1555010 - RNA, 18 nt, Pseudomonas aeruginosa PA01
cccgccgauauuggucac

SEQ ID NO: 1555011 - RNA, 16 nt, Pseudomonas aeruginosa PA01
cccgccgccaggcggc

SEQ ID NO: 1555012 - RNA, 19 nt, Pseudomonas aeruginosa PA01
cccgccgcgagcgccgccg

SEQ ID NO: 1555013 - RNA, 14 nt, Pseudomonas aeruginosa PA01
cccgccgcgccgcu

SEQ ID NO: 1555014 - RNA, 19 nt, Pseudomonas aeruginosa PA01
cccgccgcuggcggcaugc

SEQ ID NO: 1555015 - RNA, 13 nt, Pseudomonas aeruginosa PA01
cccgccggcgccc

SEQ ID NO: 1555016 - RNA, 15 nt, Pseudomonas aeruginosa PA01
cccgccggcgcgccc

SEQ ID NO: 1555017 - RNA, 16 nt, Pseudomonas aeruginosa PA01
cccgccggcgcgccca

SEQ ID NO: 1555018 - RNA, 12 nt, Pseudomonas aeruginosa PA01
cccgccggcgug

SEQ ID NO: 1555019 - RNA, 13 nt, Pseudomonas aeruginosa PA01
cccgccgugcgcu

SEQ ID NO: 1555020 - RNA, 17 nt, Pseudomonas aeruginosa PA01
cgguuggagcggaucac

SEQ ID NO: 1555021 - RNA, 18 nt, Pseudomonas aeruginosa PA01
cgguugcugcugcggggc

SEQ ID NO: 1555022 - RNA, 16 nt, Pseudomonas aeruginosa PA01
cgguugcugugcaccc

SEQ ID NO: 1555023 - RNA, 16 nt, Pseudomonas aeruginosa PA01
cgguuggccaggacca

SEQ ID NO: 1555024 - RNA, 22 nt, Pseudomonas aeruginosa PA01
cgguugucgaugcgcccgccgc

SEQ ID NO: 1555025 - RNA, 13 nt, Pseudomonas aeruginosa PA01
cgguuauccgccg

SEQ ID NO: 1555026 - RNA, 15 nt, Pseudomonas aeruginosa PA01
cgguuuccggccagg

SEQ ID NO: 1555027 - RNA, 16 nt, Pseudomonas aeruginosa PA01
cgguuuccggccaggc

SEQ ID NO: 1555028 - RNA, 20 nt, Pseudomonas aeruginosa PA01
cgguuucgaccggcgcgccu

SEQ ID NO: 1555029 - RNA, 14 nt, Pseudomonas aeruginosa PA01
cgguuuuccugccc

SEQ ID NO: 1555030 - RNA, 16 nt, Pseudomonas aeruginosa PA01
cgguuuuccugccccg

SEQ ID NO: 1555031 - RNA, 16 nt, Pseudomonas aeruginosa PA01
cggugugaccuucaac

SEQ ID NO: 1555032 - RNA, 14 nt, Pseudomonas aeruginosa PA01
cggugugacggccg

SEQ ID NO: 1555033 - RNA, 21 nt, Pseudomonas aeruginosa PA01
cggugucggccaacugggccu

SEQ ID NO: 1555034 - RNA, 12 nt, Pseudomonas aeruginosa PA01
cggugugcgcug

SEQ ID NO: 1555035 - RNA, 19 nt, Pseudomonas aeruginosa PA01
cgguguccaccaccagcag

SEQ ID NO: 1555036 - RNA, 15 nt, Pseudomonas aeruginosa PA01
cggugguaccgugcu

SEQ ID NO: 1555037 - RNA, 16 nt, Pseudomonas aeruginosa PA01
cgguggcccacuccag

SEQ ID NO: 1555038 - RNA, 14 nt, Pseudomonas aeruginosa PA01
cgguggccaggcuc

SEQ ID NO: 1555039 - RNA, 22 nt, Pseudomonas aeruginosa PA01
cgguggacugguugaccugcag

SEQ ID NO: 1555040 - RNA, 20 nt, Pseudomonas aeruginosa PA01
cgguggaggcgggcucacau

SEQ ID NO: 1555041 - RNA, 16 nt, Pseudomonas aeruginosa PA01
cggugcagccacccag

SEQ ID NO: 1555042 - RNA, 19 nt, Pseudomonas aeruginosa PA01
cggugcagccacccagcag

SEQ ID NO: 1555043 - RNA, 16 nt, Pseudomonas aeruginosa PA01
cggugcaccugggugc

SEQ ID NO: 1555044 - RNA, 15 nt, Pseudomonas aeruginosa PA01
cgggucggcacggcc

SEQ ID NO: 1555045 - RNA, 17 nt, Pseudomonas aeruginosa PA01
cgggucgcugcucaggg

SEQ ID NO: 1555046 - RNA, 14 nt, Pseudomonas aeruginosa PA01
cgggucgcgcagcg

SEQ ID NO: 1555047 - RNA, 16 nt, Pseudomonas aeruginosa PA01
cggucaccacuggaaa

SEQ ID NO: 1555048 - RNA, 22 nt, Pseudomonas aeruginosa PA01
cggguccugcagauaaagcugg

SEQ ID NO: 1555049 - RNA, 20 nt, Pseudomonas aeruginosa PA01
cggguauccgccgggccgcc

SEQ ID NO: 1555050 - RNA, 18 nt, Pseudomonas aeruginosa PA01
cgggucgacuucgcacca

SEQ ID NO: 1555051 - RNA, 19 nt, Pseudomonas aeruginosa PA01
cgggucgacaugcaggccg

SEQ ID NO: 1555052 - RNA, 24 nt, Pseudomonas aeruginosa PA01
cgggucgacaugcaggccggccuc

SEQ ID NO: 1555053 - RNA, 13 nt, Pseudomonas aeruginosa PA01
cgggucgcgcagc

SEQ ID NO: 1555054 - RNA, 16 nt, Pseudomonas aeruginosa PA01
cgggucgaggcugccg

SEQ ID NO: 1555055 - RNA, 12 nt, Pseudomonas aeruginosa PA01
cggucaggcugc

SEQ ID NO: 1555056 - RNA, 13 nt, Pseudomonas aeruginosa PA01
cggucaggcugcg

SEQ ID NO: 1555057 - RNA, 19 nt, Pseudomonas aeruginosa PA01
cggucaggguauagguggu

SEQ ID NO: 1555058 - RNA, 12 nt, Pseudomonas aeruginosa PA01
cggucagguacg

SEQ ID NO: 1555059 - RNA, 16 nt, Pseudomonas aeruginosa PA01
cggucacucggccucg

SEQ ID NO: 1555060 - RNA, 18 nt, Pseudomonas aeruginosa PA01
cggucacucggccucggc

SEQ ID NO: 1555061 - RNA, 19 nt, Pseudomonas aeruginosa PA01
cggucacucggccucggcg

SEQ ID NO: 1555062 - RNA, 22 nt, Pseudomonas aeruginosa PA01
cggucaggccgagcagcgccag

SEQ ID NO: 1555063 - RNA, 23 nt, Pseudomonas aeruginosa PA01
cgguccaacccauguggcgcagc

SEQ ID NO: 1555064 - RNA, 18 nt, Pseudomonas aeruginosa PA01
cggucaucgcgccgccga

SEQ ID NO: 1555065 - RNA, 23 nt, Pseudomonas aeruginosa PA01
cggucagguauucgccggccagg

SEQ ID NO: 1555066 - RNA, 15 nt, Pseudomonas aeruginosa PA01
cggucaugcccuugu

SEQ ID NO: 1555067 - RNA, 19 nt, Pseudomonas aeruginosa PA01
cgguccaggggccgaugcc

SEQ ID NO: 1555068 - RNA, 18 nt, Pseudomonas aeruginosa PA01
cgguccaggucaugcccu

SEQ ID NO: 1555069 - RNA, 17 nt, Pseudomonas aeruginosa PA01
cggucccaucagcaguc

SEQ ID NO: 1555070 - RNA, 21 nt, Pseudomonas aeruginosa PA01
cgguccagcgagcgggcgagg

SEQ ID NO: 1555071 - RNA, 13 nt, Pseudomonas aeruginosa PA01
cgguccagccaga

SEQ ID NO: 1555072 - RNA, 19 nt, Pseudomonas aeruginosa PA01
cgguccgcgguagcugcgc

SEQ ID NO: 1555073 - RNA, 20 nt, Pseudomonas aeruginosa PA01
cggucccuucgugggccugc

SEQ ID NO: 1555074 - RNA, 20 nt, Pseudomonas aeruginosa PA01
cggucccgggaaaccaccag

SEQ ID NO: 1555075 - RNA, 17 nt, Pseudomonas aeruginosa PA01
cgguccguccagcgcgc

SEQ ID NO: 1555076 - RNA, 23 nt, Pseudomonas aeruginosa PA01
cgguccucgcccgucacuucacg

SEQ ID NO: 1555077 - RNA, 15 nt, Pseudomonas aeruginosa PA01
cgguccuuguccggg

SEQ ID NO: 1555078 - RNA, 13 nt, Pseudomonas aeruginosa PA01
cggucggccaggc

SEQ ID NO: 1555079 - RNA, 15 nt, Pseudomonas aeruginosa PA01
cggucggccaggcgg

SEQ ID NO: 1555080 - RNA, 15 nt, Pseudomonas aeruginosa PA01
cggucggccaggacg

SEQ ID NO: 1555081 - RNA, 18 nt, Pseudomonas aeruginosa PA01
cggucgcgccccgccagg

SEQ ID NO: 1555082 - RNA, 20 nt, Pseudomonas aeruginosa PA01
cggucgcugaccagcccggc

SEQ ID NO: 1555083 - RNA, 13 nt, Pseudomonas aeruginosa PA01
cggucggcucagc

SEQ ID NO: 1555084 - RNA, 20 nt, Pseudomonas aeruginosa PA01
cggucgagguugcgcggcag

SEQ ID NO: 1555085 - RNA, 18 nt, Pseudomonas aeruginosa PA01
cggucgaaccccuucccc

SEQ ID NO: 1555086 - RNA, 20 nt, Pseudomonas aeruginosa PA01
cggucgaacugaccaccagg

SEQ ID NO: 1555087 - RNA, 14 nt, Pseudomonas aeruginosa PA01
cggucgagcagcgc

SEQ ID NO: 1555088 - RNA, 18 nt, Pseudomonas aeruginosa PA01
cggucgagcagcgccgcg

SEQ ID NO: 1555089 - RNA, 16 nt, Pseudomonas aeruginosa PA01
cggucgauguccuggg

SEQ ID NO: 1555090 - RNA, 18 nt, Pseudomonas aeruginosa PA01
cggucgauguccugggcc

SEQ ID NO: 1555091 - RNA, 18 nt, Pseudomonas aeruginosa PA01
cggucgcaccgccagcag

SEQ ID NO: 1555092 - RNA, 14 nt, Pseudomonas aeruginosa PA01
cggucgccgccagc

SEQ ID NO: 1555093 - RNA, 17 nt, Pseudomonas aeruginosa PA01
cggucgccggcgcgcac

SEQ ID NO: 1555094 - RNA, 18 nt, Pseudomonas aeruginosa PA01
cggucgcccucggccagg

SEQ ID NO: 1555095 - RNA, 19 nt, Pseudomonas aeruginosa PA01
cggucgcccucggccaggc

SEQ ID NO: 1555096 - RNA, 15 nt, Pseudomonas aeruginosa PA01
cggugacgucgagga

SEQ ID NO: 1555097 - RNA, 15 nt, Pseudomonas aeruginosa PA01
cggugaugcgucgca

SEQ ID NO: 1555098 - RNA, 19 nt, Pseudomonas aeruginosa PA01
cggucucgaucggcccggg

SEQ ID NO: 1555099 - RNA, 20 nt, Pseudomonas aeruginosa PA01
cggucucgaucggcccgggc

SEQ ID NO: 1555100 - RNA, 18 nt, Pseudomonas aeruginosa PA01
cggucucgaacgccaggc

SEQ ID NO: 1555101 - RNA, 14 nt, Pseudomonas aeruginosa PA01
cggucgugcagcag

SEQ ID NO: 1555102 - RNA, 18 nt, Pseudomonas aeruginosa PA01
cggucgugcagcagcgcc

SEQ ID NO: 1555103 - RNA, 17 nt, Pseudomonas aeruginosa PA01
cggucuagcgccccggc

SEQ ID NO: 1555104 - RNA, 20 nt, Pseudomonas aeruginosa PA01
cggucuagcgccccggccgc

SEQ ID NO: 1555105 - RNA, 23 nt, Pseudomonas aeruginosa PA01
cggucuagcgccccggccgcgcc

SEQ ID NO: 1555106 - RNA, 16 nt, Pseudomonas aeruginosa PA01
cguagccggcgcggcg

SEQ ID NO: 1555107 - RNA, 22 nt, Pseudomonas aeruginosa PA01
cguagccgucgaacagcagcuc

SEQ ID NO: 1555108 - RNA, 21 nt, Pseudomonas aeruginosa PA01
cguagccgucguagcgcagcg

SEQ ID NO: 1555109 - RNA, 15 nt, Pseudomonas aeruginosa PA01
cguagggcgacgccc

SEQ ID NO: 1555110 - RNA, 15 nt, Pseudomonas aeruginosa PA01
cguagggcuggacgu

SEQ ID NO: 1555111 - RNA, 18 nt, Pseudomonas aeruginosa PA01
cguaggccgucgcugccg

SEQ ID NO: 1555112 - RNA, 18 nt, Pseudomonas aeruginosa PA01
cguaggccacuucccggc

SEQ ID NO: 1555113 - RNA, 18 nt, Pseudomonas aeruginosa PA01
cguaggagccggccaggc

SEQ ID NO: 1555114 - RNA, 13 nt, Pseudomonas aeruginosa PA01
cguagcccauggu

SEQ ID NO: 1555115 - RNA, 19 nt, Pseudomonas aeruginosa PA01
cguagcccuucuccgccag

SEQ ID NO: 1555116 - RNA, 23 nt, Pseudomonas aeruginosa PA01
cguagcccccgccgcugaggcuc

SEQ ID NO: 1555117 - RNA, 15 nt, Pseudomonas aeruginosa PA01
cguagccgcgcgcca

SEQ ID NO: 1555118 - RNA, 21 nt, Pseudomonas aeruginosa PA01
cguagccgcgcgccagcaacg

SEQ ID NO: 1555119 - RNA, 19 nt, Pseudomonas aeruginosa PA01
cguagcagguccgcgccuc

SEQ ID NO: 1555120 - RNA, 15 nt, Pseudomonas aeruginosa PA01
cguagaacaccaccc

SEQ ID NO: 1555121 - RNA, 11 nt, Pseudomonas aeruginosa PA01
cguaacggcuu

SEQ ID NO: 1555122 - RNA, 16 nt, Pseudomonas aeruginosa PA01
cguagagcuugcugaa

SEQ ID NO: 1555123 - RNA, 21 nt, Pseudomonas aeruginosa PA01
cguagaggaucucgccacuga

SEQ ID NO: 1555124 - RNA, 20 nt, Pseudomonas aeruginosa PA01
cguagaggcuguagcgcucc

SEQ ID NO: 1555125 - RNA, 13 nt, Pseudomonas aeruginosa PA01
cguagaggggcuc

SEQ ID NO: 1555126 - RNA, 12 nt, Pseudomonas aeruginosa PA01
cguagagccugg

SEQ ID NO: 1555127 - RNA, 14 nt, Pseudomonas aeruginosa PA01
cguaucccagcgcg

SEQ ID NO: 1555128 - RNA, 19 nt, Pseudomonas aeruginosa PA01
cguaguugacccgccccug

SEQ ID NO: 1555129 - RNA, 14 nt, Pseudomonas aeruginosa PA01
cguaguugagcccc

SEQ ID NO: 1555130 - RNA, 19 nt, Pseudomonas aeruginosa PA01
cguaguugaugaagccgcg

SEQ ID NO: 1555131 - RNA, 15 nt, Pseudomonas aeruginosa PA01
cguagguggcgccgc

SEQ ID NO: 1555132 - RNA, 17 nt, Pseudomonas aeruginosa PA01
cguagguggcgccgccg

SEQ ID NO: 1555133 - RNA, 23 nt, Pseudomonas aeruginosa PA01
cguagguggauugcagcgucgac

SEQ ID NO: 1555134 - RNA, 16 nt, Pseudomonas aeruginosa PA01
cguagugcaucagccu

SEQ ID NO: 1555135 - RNA, 21 nt, Pseudomonas aeruginosa PA01
cguagugcugguagggcuucg

SEQ ID NO: 1555136 - RNA, 14 nt, Pseudomonas aeruginosa PA01
cguaguagugcccc

SEQ ID NO: 1555137 - RNA, 20 nt, Pseudomonas aeruginosa PA01
cguaucgaugcgcgcggcga

SEQ ID NO: 1555138 - RNA, 17 nt, Pseudomonas aeruginosa PA01
cguauggcgggccuugc

SEQ ID NO: 1555139 - RNA, 17 nt, Pseudomonas aeruginosa PA01
cguauucggcgaccagc

SEQ ID NO: 1555140 - RNA, 22 nt, Pseudomonas aeruginosa PA01
cguauucggcgaccagcccgcg

SEQ ID NO: 1555141 - RNA, 15 nt, Pseudomonas aeruginosa PA01
cgucagccgcggccg

SEQ ID NO: 1555142 - RNA, 19 nt, Pseudomonas aeruginosa PA01
cgucaggccuugcgcggcg

SEQ ID NO: 1555143 - RNA, 20 nt, Pseudomonas aeruginosa PA01
cgucaggccuugcgcggcgc

SEQ ID NO: 1555144 - RNA, 12 nt, Pseudomonas aeruginosa PA01
cgucagccaggc

SEQ ID NO: 1555145 - RNA, 22 nt, Pseudomonas aeruginosa PA01
cgucagcgagcuaucgccuccc

SEQ ID NO: 1555146 - RNA, 18 nt, Pseudomonas aeruginosa PA01
cgucaucgcugaccugga

SEQ ID NO: 1555147 - RNA, 18 nt, Pseudomonas aeruginosa PA01
cgucaugaccagagccgc

SEQ ID NO: 1555148 - RNA, 15 nt, Pseudomonas aeruginosa PA01
cgucaaccagcaccg

SEQ ID NO: 1555149 - RNA, 16 nt, Pseudomonas aeruginosa PA01
cgucacgcccugcccc

SEQ ID NO: 1555150 - RNA, 22 nt, Pseudomonas aeruginosa PA01
cgucacgccgaucccggcggcg

SEQ ID NO: 1555151 - RNA, 21 nt, Pseudomonas aeruginosa PA01
cgucacgaacggacaccuugg

SEQ ID NO: 1555152 - RNA, 21 nt, Pseudomonas aeruginosa PA01
cgucacgcggacccaguuggg

SEQ ID NO: 1555153 - RNA, 20 nt, Pseudomonas aeruginosa PA01
cgucacggauaggcggcgga

SEQ ID NO: 1555154 - RNA, 22 nt, Pseudomonas aeruginosa PA01
cgucacggcgugccgcaggccg

SEQ ID NO: 1555155 - RNA, 18 nt, Pseudomonas aeruginosa PA01
cgucacuggaacagcgcg

SEQ ID NO: 1555156 - RNA, 19 nt, Pseudomonas aeruginosa PA01
cgucacuguuuuccauggc

SEQ ID NO: 1555157 - RNA, 19 nt, Pseudomonas aeruginosa PA01
cgucaccagcagccccgag

SEQ ID NO: 1555158 - RNA, 18 nt, Pseudomonas aeruginosa PA01
cgucacccgcgccugcag

SEQ ID NO: 1555159 - RNA, 19 nt, Pseudomonas aeruginosa PA01
cgucacccgcgccugcagg

SEQ ID NO: 1555160 - RNA, 14 nt, Pseudomonas aeruginosa PA01
cggcgcguuccggg

SEQ ID NO: 1555161 - RNA, 17 nt, Pseudomonas aeruginosa PA01
cggcgcggcgcagccag

SEQ ID NO: 1555162 - RNA, 19 nt, Pseudomonas aeruginosa PA01
cggcgcguucacuccacga

SEQ ID NO: 1555163 - RNA, 19 nt, Pseudomonas aeruginosa PA01
cggcgcucacccacauggc

SEQ ID NO: 1555164 - RNA, 23 nt, Pseudomonas aeruginosa PA01
cggcgcuacgaaggcgugccgcu

SEQ ID NO: 1555165 - RNA, 14 nt, Pseudomonas aeruginosa PA01
cggcgcuccgccga

SEQ ID NO: 1555166 - RNA, 21 nt, Pseudomonas aeruginosa PA01
cggcgcucagucgagcauguc

SEQ ID NO: 1555167 - RNA, 19 nt, Pseudomonas aeruginosa PA01
cggcgcgcugaacuuuccc

SEQ ID NO: 1555168 - RNA, 17 nt, Pseudomonas aeruginosa PA01
cggcgcggccagcuucu

SEQ ID NO: 1555169 - RNA, 12 nt, Pseudomonas aeruginosa PA01
cggcgcggcgca

SEQ ID NO: 1555170 - RNA, 15 nt, Pseudomonas aeruginosa PA01
cggcgcggcgcucca

SEQ ID NO: 1555171 - RNA, 18 nt, Pseudomonas aeruginosa PA01
cggcgcggcgcuccaggc

SEQ ID NO: 1555172 - RNA, 19 nt, Pseudomonas aeruginosa PA01
cggcgcggacggccugcgc

SEQ ID NO: 1555173 - RNA, 22 nt, Pseudomonas aeruginosa PA01
cggcgcggacggccugcgcccu

SEQ ID NO: 1555174 - RNA, 23 nt, Pseudomonas aeruginosa PA01
cggcgcggagauccccuccucca

SEQ ID NO: 1555175 - RNA, 22 nt, Pseudomonas aeruginosa PA01
cggccugggccgaaggccaggc

SEQ ID NO: 1555176 - RNA, 20 nt, Pseudomonas aeruginosa PA01
cggccuggggcucggcuucc

SEQ ID NO: 1555177 - RNA, 20 nt, Pseudomonas aeruginosa PA01
cggccuggguacgcaccggc

SEQ ID NO: 1555178 - RNA, 14 nt, Pseudomonas aeruginosa PA01
cggccugguccggc

SEQ ID NO: 1555179 - RNA, 16 nt, Pseudomonas aeruginosa PA01
cggccugguuguaggc

SEQ ID NO: 1555180 - RNA, 21 nt, Pseudomonas aeruginosa PA01
cggccuucucgucgccgcccg

SEQ ID NO: 1555181 - RNA, 15 nt, Pseudomonas aeruginosa PA01
cggccuucggcagga

SEQ ID NO: 1555182 - RNA, 17 nt, Pseudomonas aeruginosa PA01
cggccuucacgcagcuc

SEQ ID NO: 1555183 - RNA, 21 nt, Pseudomonas aeruginosa PA01
cggccuguucgcccaaggcca

SEQ ID NO: 1555184 - RNA, 11 nt, Pseudomonas aeruginosa PA01
cggccugggcc

SEQ ID NO: 1555185 - RNA, 18 nt, Pseudomonas aeruginosa PA01
cggcggaucgaucagcag

SEQ ID NO: 1555186 - RNA, 21 nt, Pseudomonas aeruginosa PA01
cggcggaucgaucagcagcac

SEQ ID NO: 1555187 - RNA, 17 nt, Pseudomonas aeruginosa PA01
cggcggaugacguuccc

SEQ ID NO: 1555188 - RNA, 16 nt, Pseudomonas aeruginosa PA01
cggcggaugccggcgc

SEQ ID NO: 1555189 - RNA, 18 nt, Pseudomonas aeruginosa PA01
cggcggauaaccgcgagc

SEQ ID NO: 1555190 - RNA, 17 nt, Pseudomonas aeruginosa PA01
cggcggauaacgccugu

SEQ ID NO: 1555191 - RNA, 22 nt, Pseudomonas aeruginosa PA01
cggcggauaacgcuucgcagca

SEQ ID NO: 1555192 - RNA, 15 nt, Pseudomonas aeruginosa PA01
cggcggaccuccgcc

SEQ ID NO: 1555193 - RNA, 16 nt, Pseudomonas aeruginosa PA01
cggcggaauuccugcu

SEQ ID NO: 1555194 - RNA, 20 nt, Pseudomonas aeruginosa PA01
cggcggaagucgaagcagcc

SEQ ID NO: 1555195 - RNA, 12 nt, Pseudomonas aeruginosa PA01
cggcgcugaagg

SEQ ID NO: 1555196 - RNA, 20 nt, Pseudomonas aeruginosa PA01
cggcgcucuucagcacgccc

SEQ ID NO: 1555197 - RNA, 24 nt, Pseudomonas aeruginosa PA01
cggcggcaugggcauccugccgcc

SEQ ID NO: 1555198 - RNA, 19 nt, Pseudomonas aeruginosa PA01
cggcggauuacuccgccgg

SEQ ID NO: 1555199 - RNA, 21 nt, Pseudomonas aeruginosa PA01
cggcggauacaggcgcagcag

SEQ ID NO: 1555200 - RNA, 13 nt, Pseudomonas aeruginosa PA01
cggcggccagcag

SEQ ID NO: 1555201 - RNA, 14 nt, Pseudomonas aeruginosa PA01
cggcggccaggcgc

SEQ ID NO: 1555202 - RNA, 16 nt, Pseudomonas aeruginosa PA01
cggcggccaggcgcuc

SEQ ID NO: 1555203 - RNA, 15 nt, Pseudomonas aeruginosa PA01
cggcggccaggcggc

SEQ ID NO: 1555204 - RNA, 16 nt, Pseudomonas aeruginosa PA01
cggcggccaggcggcu

SEQ ID NO: 1555205 - RNA, 12 nt, Pseudomonas aeruginosa PA01
cggcggccaggg

SEQ ID NO: 1555206 - RNA, 14 nt, Pseudomonas aeruginosa PA01
cggcggccggcgca

SEQ ID NO: 1555207 - RNA, 14 nt, Pseudomonas aeruginosa PA01
cggcggccgggucg

SEQ ID NO: 1555208 - RNA, 13 nt, Pseudomonas aeruginosa PA01
cggcggccgucgc

SEQ ID NO: 1555209 - RNA, 17 nt, Pseudomonas aeruginosa PA01
cggcggcgugcaggccg

SEQ ID NO: 1555210 - RNA, 15 nt, Pseudomonas aeruginosa PA01
cggcggcucaggccg

SEQ ID NO: 1555211 - RNA, 17 nt, Pseudomonas aeruginosa PA01
cggcggcuccggcgcca

SEQ ID NO: 1555212 - RNA, 19 nt, Pseudomonas aeruginosa PA01
cggcggcuucagccagacc

SEQ ID NO: 1555213 - RNA, 14 nt, Pseudomonas aeruginosa PA01
cggcggcggcccgc

SEQ ID NO: 1555214 - RNA, 20 nt, Pseudomonas aeruginosa PA01
cggcggcggacgcaggccga

SEQ ID NO: 1555215 - RNA, 15 nt, Pseudomonas aeruginosa PA01
cggcggcggccugcu

SEQ ID NO: 1555216 - RNA, 14 nt, Pseudomonas aeruginosa PA01
cggcggcgcggguc

SEQ ID NO: 1555217 - RNA, 20 nt, Pseudomonas aeruginosa PA01
cggcggcgaugaucggcagc

SEQ ID NO: 1555218 - RNA, 15 nt, Pseudomonas aeruginosa PA01
cggcggcgccggcag

SEQ ID NO: 1555219 - RNA, 16 nt, Pseudomonas aeruginosa PA01
cggcggcgccggcagg

SEQ ID NO: 1555220 - RNA, 13 nt, Pseudomonas aeruginosa PA01
cggcggcgccggu

SEQ ID NO: 1555221 - RNA, 23 nt, Pseudomonas aeruginosa PA01
cggcggcgccggugaggcgcagc

SEQ ID NO: 1555222 - RNA, 20 nt, Pseudomonas aeruginosa PA01
cggcggccucgaggucggcc

SEQ ID NO: 1555223 - RNA, 13 nt, Pseudomonas aeruginosa PA01
cggcggccugcuc

SEQ ID NO: 1555224 - RNA, 23 nt, Pseudomonas aeruginosa PA01
cggcggccugccccgccggcgcu

SEQ ID NO: 1555225 - RNA, 19 nt, Pseudomonas aeruginosa PA01
cggcggccugcucgcgcag

SEQ ID NO: 1555226 - RNA, 20 nt, Pseudomonas aeruginosa PA01
cggcggccugcucgcgcagc

SEQ ID NO: 1555227 - RNA, 21 nt, Pseudomonas aeruginosa PA01
cggcggcgaauacguggggga

SEQ ID NO: 1555228 - RNA, 14 nt, Pseudomonas aeruginosa PA01
cggcggcgacccag

SEQ ID NO: 1555229 - RNA, 22 nt, Pseudomonas aeruginosa PA01
cggcggcgaccccgaucaccgg

SEQ ID NO: 1555230 - RNA, 14 nt, Pseudomonas aeruginosa PA01
cggcgggacggcgc

SEQ ID NO: 1555231 - RNA, 17 nt, Pseudomonas aeruginosa PA01
cggcgggaacgccgggc

SEQ ID NO: 1555232 - RNA, 17 nt, Pseudomonas aeruginosa PA01
cggcgggaaacgcagcg

SEQ ID NO: 1555233 - RNA, 13 nt, Pseudomonas aeruginosa PA01
cggcgggacgcgc

SEQ ID NO: 1555234 - RNA, 18 nt, Pseudomonas aeruginosa PA01
cggcggucaucgcgccgc

SEQ ID NO: 1555235 - RNA, 13 nt, Pseudomonas aeruginosa PA01
cggcggucagguu

SEQ ID NO: 1555236 - RNA, 20 nt, Pseudomonas aeruginosa PA01
cggcggucucgaacgccagg

SEQ ID NO: 1555237 - RNA, 16 nt, Pseudomonas aeruginosa PA01
cggcguggacccacgc

SEQ ID NO: 1555238 - RNA, 18 nt, Pseudomonas aeruginosa PA01
cggcguggcaccgcuucu

SEQ ID NO: 1555239 - RNA, 21 nt, Pseudomonas aeruginosa PA01
cggcguggccggcgaccagcu

SEQ ID NO: 1555240 - RNA, 13 nt, Pseudomonas aeruginosa PA01
cggcguggaaggc

SEQ ID NO: 1555241 - RNA, 15 nt, Pseudomonas aeruginosa PA01
cggcgugcugggucu

SEQ ID NO: 1555242 - RNA, 19 nt, Pseudomonas aeruginosa PA01
cggcgugcugggucuccuc

SEQ ID NO: 1555243 - RNA, 14 nt, Pseudomonas aeruginosa PA01
cggcgugccgggca

SEQ ID NO: 1555244 - RNA, 14 nt, Pseudomonas aeruginosa PA01
cggcgugccgggcc

SEQ ID NO: 1555245 - RNA, 23 nt, Pseudomonas aeruginosa PA01
cggcgugccguggcucggcggca

SEQ ID NO: 1555246 - RNA, 17 nt, Pseudomonas aeruginosa PA01
cggcguaccagccgcgg

SEQ ID NO: 1555247 - RNA, 23 nt, Pseudomonas aeruginosa PA01
cggcguacgaaccccgggccgcg

SEQ ID NO: 1555248 - RNA, 15 nt, Pseudomonas aeruginosa PA01
cggcguagcgcuggg

SEQ ID NO: 1555249 - RNA, 16 nt, Pseudomonas aeruginosa PA01
cggcguagcgcugggc

SEQ ID NO: 1555250 - RNA, 14 nt, Pseudomonas aeruginosa PA01
cggcguggcucgau

SEQ ID NO: 1555251 - RNA, 13 nt, Pseudomonas aeruginosa PA01
cggcuacucgugg

SEQ ID NO: 1555252 - RNA, 12 nt, Pseudomonas aeruginosa PA01
cggcuacccucu

SEQ ID NO: 1555253 - RNA, 14 nt, Pseudomonas aeruginosa PA01
cggcuacccucucc

SEQ ID NO: 1555254 - RNA, 16 nt, Pseudomonas aeruginosa PA01
cggcuacccucucccc

SEQ ID NO: 1555255 - RNA, 18 nt, Pseudomonas aeruginosa PA01
cggcuccggcgccaggcc

SEQ ID NO: 1555256 - RNA, 20 nt, Pseudomonas aeruginosa PA01
cggcuccucugccugcgccc

SEQ ID NO: 1555257 - RNA, 22 nt, Pseudomonas aeruginosa PA01
cggcuccgcgcacggaucgcgc

SEQ ID NO: 1555258 - RNA, 18 nt, Pseudomonas aeruginosa PA01
cggcucagccgaccaccu

SEQ ID NO: 1555259 - RNA, 15 nt, Pseudomonas aeruginosa PA01
cggcucagccgcugg

SEQ ID NO: 1555260 - RNA, 17 nt, Pseudomonas aeruginosa PA01
cggcucaggccgccgcg

SEQ ID NO: 1555261 - RNA, 15 nt, Pseudomonas aeruginosa PA01
cggcucgcccaugcg

SEQ ID NO: 1555262 - RNA, 18 nt, Pseudomonas aeruginosa PA01
cggcugcaacgccgcggg

SEQ ID NO: 1555263 - RNA, 15 nt, Pseudomonas aeruginosa PA01
cggcugcaacuucca

SEQ ID NO: 1555264 - RNA, 17 nt, Pseudomonas aeruginosa PA01
cggcugcauguccgcca

SEQ ID NO: 1555265 - RNA, 19 nt, Pseudomonas aeruginosa PA01
cggcugcauguccgccagu

SEQ ID NO: 1555266 - RNA, 19 nt, Pseudomonas aeruginosa PA01
cggcugcccaagggccugg

SEQ ID NO: 1555267 - RNA, 14 nt, Pseudomonas aeruginosa PA01
cggcuggcccucgg

SEQ ID NO: 1555268 - RNA, 21 nt, Pseudomonas aeruginosa PA01
cggcuggccgaggacccggcg

SEQ ID NO: 1555269 - RNA, 14 nt, Pseudomonas aeruginosa PA01
cggcugccgccagc

SEQ ID NO: 1555270 - RNA, 20 nt, Pseudomonas aeruginosa PA01
cggcugggugucgaccuccg

SEQ ID NO: 1555271 - RNA, 22 nt, Pseudomonas aeruginosa PA01
cggcuguagcggaucaggccca

SEQ ID NO: 1555272 - RNA, 13 nt, Pseudomonas aeruginosa PA01
cggcuggccgcgg

SEQ ID NO: 1555273 - RNA, 15 nt, Pseudomonas aeruginosa PA01
cggcuggccgccugg

SEQ ID NO: 1555274 - RNA, 21 nt, Pseudomonas aeruginosa PA01
cggcuggcgcuugccgcgccc

SEQ ID NO: 1555275 - RNA, 23 nt, Pseudomonas aeruginosa PA01
cggcuggcgcuugccgcgcccgg

SEQ ID NO: 1555276 - RNA, 20 nt, Pseudomonas aeruginosa PA01
cggcuggcggcucggcugcu

SEQ ID NO: 1555277 - RNA, 17 nt, Pseudomonas aeruginosa PA01
cggcuggcgcaggaccg

SEQ ID NO: 1555278 - RNA, 14 nt, Pseudomonas aeruginosa PA01
cggcuggcgccggu

SEQ ID NO: 1555279 - RNA, 21 nt, Pseudomonas aeruginosa PA01
cggcuggcgccggugcaugaa

SEQ ID NO: 1555280 - RNA, 17 nt, Pseudomonas aeruginosa PA01
cggcuggcgcgcgcgcu

SEQ ID NO: 1555281 - RNA, 13 nt, Pseudomonas aeruginosa PA01
cggcuggcugccc

SEQ ID NO: 1555282 - RNA, 14 nt, Pseudomonas aeruginosa PA01
cggcugggccagga

SEQ ID NO: 1555283 - RNA, 18 nt, Pseudomonas aeruginosa PA01
cggcugggccaggaucag

SEQ ID NO: 1555284 - RNA, 19 nt, Pseudomonas aeruginosa PA01
cggcuuuccucggccaugc

SEQ ID NO: 1555285 - RNA, 16 nt, Pseudomonas aeruginosa PA01
cggcuucgcagauguc

SEQ ID NO: 1555286 - RNA, 16 nt, Pseudomonas aeruginosa PA01
cggcuucgcccauggc

SEQ ID NO: 1555287 - RNA, 14 nt, Pseudomonas aeruginosa PA01
cggcuuguucagcu

SEQ ID NO: 1555288 - RNA, 22 nt, Pseudomonas aeruginosa PA01
cggcuucagccagaccggcagc

SEQ ID NO: 1555289 - RNA, 16 nt, Pseudomonas aeruginosa PA01
cggcuuccucgcccuc

SEQ ID NO: 1555290 - RNA, 12 nt, Pseudomonas aeruginosa PA01
cggcuuccuggg

SEQ ID NO: 1555291 - RNA, 15 nt, Pseudomonas aeruginosa PA01
cggcuuccugggcga

SEQ ID NO: 1555292 - RNA, 13 nt, Pseudomonas aeruginosa PA01
cggcugugaccga

SEQ ID NO: 1555293 - RNA, 15 nt, Pseudomonas aeruginosa PA01
cggcugugcagggca

SEQ ID NO: 1555294 - RNA, 21 nt, Pseudomonas aeruginosa PA01
cggcugugcucgaggaagcgc

SEQ ID NO: 1555295 - RNA, 21 nt, Pseudomonas aeruginosa PA01
cggcuguugccguucugugcg

SEQ ID NO: 1555296 - RNA, 15 nt, Pseudomonas aeruginosa PA01
cgggcgaagcgcagc

SEQ ID NO: 1555297 - RNA, 23 nt, Pseudomonas aeruginosa PA01
cgggccuguugagugggaugacg

SEQ ID NO: 1555298 - RNA, 23 nt, Pseudomonas aeruginosa PA01
cgggccuucgccuucggcgugca

SEQ ID NO: 1555299 - RNA, 22 nt, Pseudomonas aeruginosa PA01
cgggccuugaccaccgccaggc

SEQ ID NO: 1555300 - RNA, 20 nt, Pseudomonas aeruginosa PA01
cgggccuugcgaccaggucc

SEQ ID NO: 1555301 - RNA, 22 nt, Pseudomonas aeruginosa PA01
cgggcgagcgcagacgggugcu

SEQ ID NO: 1555302 - RNA, 20 nt, Pseudomonas aeruginosa PA01
cgggcgacgugggccugcuc

SEQ ID NO: 1555303 - RNA, 23 nt, Pseudomonas aeruginosa PA01
cgggcgaggcuaacgccgaggau

SEQ ID NO: 1555304 - RNA, 16 nt, Pseudomonas aeruginosa PA01
cgggcgagggcggcgc

SEQ ID NO: 1555305 - RNA, 20 nt, Pseudomonas aeruginosa PA01
cgggcgaggucgccacgcag

SEQ ID NO: 1555306 - RNA, 21 nt, Pseudomonas aeruginosa PA01
cgggcgaggucgccacgcagu

SEQ ID NO: 1555307 - RNA, 22 nt, Pseudomonas aeruginosa PA01
cgggcgaggucgccacgcaguu

SEQ ID NO: 1555308 - RNA, 19 nt, Pseudomonas aeruginosa PA01
cgggccgaucgagcggccc

SEQ ID NO: 1555309 - RNA, 16 nt, Pseudomonas aeruginosa PA01
cgggccgagggcugag

SEQ ID NO: 1555310 - RNA, 20 nt, Pseudomonas aeruginosa PA01
cgggccgaggucgcgggcca

SEQ ID NO: 1555311 - RNA, 23 nt, Pseudomonas aeruginosa PA01
cgggccgaggucgcgggccaggc

SEQ ID NO: 1555312 - RNA, 17 nt, Pseudomonas aeruginosa PA01
cgggccgcagcgcagcc

SEQ ID NO: 1555313 - RNA, 20 nt, Pseudomonas aeruginosa PA01
cgggccgccuugcgcagcaa

SEQ ID NO: 1555314 - RNA, 12 nt, Pseudomonas aeruginosa PA01
cgggccgcgcac

SEQ ID NO: 1555315 - RNA, 18 nt, Pseudomonas aeruginosa PA01
cgggccgcgcucggucca

SEQ ID NO: 1555316 - RNA, 19 nt, Pseudomonas aeruginosa PA01
cgggccggagcaggccaug

SEQ ID NO: 1555317 - RNA, 12 nt, Pseudomonas aeruginosa PA01
cgggccgggggc

SEQ ID NO: 1555318 - RNA, 22 nt, Pseudomonas aeruginosa PA01
cgggccgggggcggcgccuggu

SEQ ID NO: 1555319 - RNA, 13 nt, Pseudomonas aeruginosa PA01
cgggccgucgggc

SEQ ID NO: 1555320 - RNA, 15 nt, Pseudomonas aeruginosa PA01
cgggccguuggcuuc

SEQ ID NO: 1555321 - RNA, 20 nt, Pseudomonas aeruginosa PA01
cgggcaccgagucggcaacg

SEQ ID NO: 1555322 - RNA, 22 nt, Pseudomonas aeruginosa PA01
cgggcaccgagucggcaacgau

SEQ ID NO: 1555323 - RNA, 14 nt, Pseudomonas aeruginosa PA01
cgggcaccgccagc

SEQ ID NO: 1555324 - RNA, 18 nt, Pseudomonas aeruginosa PA01
cgggcaccgccagcccgc

SEQ ID NO: 1555325 - RNA, 19 nt, Pseudomonas aeruginosa PA01
cgggcaccgccagcccgcc

SEQ ID NO: 1555326 - RNA, 22 nt, Pseudomonas aeruginosa PA01
cgggaagcgaaccaggcaaugg

SEQ ID NO: 1555327 - RNA, 16 nt, Pseudomonas aeruginosa PA01
cgggaaggucggcagc

SEQ ID NO: 1555328 - RNA, 18 nt, Pseudomonas aeruginosa PA01
cgggaaggucggcagcag

SEQ ID NO: 1555329 - RNA, 15 nt, Pseudomonas aeruginosa PA01
cgggaaguaggccug

SEQ ID NO: 1555330 - RNA, 19 nt, Pseudomonas aeruginosa PA01
cgggaaguaggccuggccg

SEQ ID NO: 1555331 - RNA, 22 nt, Pseudomonas aeruginosa PA01
cgggaaguaggccuggccgccc

SEQ ID NO: 1555332 - RNA, 17 nt, Pseudomonas aeruginosa PA01
cgggaaguccgggcgcg

SEQ ID NO: 1555333 - RNA, 18 nt, Pseudomonas aeruginosa PA01
cgggaaggccugacgcaa

SEQ ID NO: 1555334 - RNA, 15 nt, Pseudomonas aeruginosa PA01
cgggaagucguuccc

SEQ ID NO: 1555335 - RNA, 15 nt, Pseudomonas aeruginosa PA01
cgggcaguuccaggc

SEQ ID NO: 1555336 - RNA, 16 nt, Pseudomonas aeruginosa PA01
cgggcaguccuggcgg

SEQ ID NO: 1555337 - RNA, 15 nt, Pseudomonas aeruginosa PA01
cgggcagggcagccg

SEQ ID NO: 1555338 - RNA, 21 nt, Pseudomonas aeruginosa PA01
cgggcauauggaucggccucg

SEQ ID NO: 1555339 - RNA, 14 nt, Pseudomonas aeruginosa PA01
cgggccagcaggcg

SEQ ID NO: 1555340 - RNA, 16 nt, Pseudomonas aeruginosa PA01
cgggccagcaggcgcu

SEQ ID NO: 1555341 - RNA, 16 nt, Pseudomonas aeruginosa PA01
cgggccagcuccagca

SEQ ID NO: 1555342 - RNA, 15 nt, Pseudomonas aeruginosa PA01
cgggccagcuccgcc

SEQ ID NO: 1555343 - RNA, 16 nt, Pseudomonas aeruginosa PA01
cgggccagcuccgccu

SEQ ID NO: 1555344 - RNA, 19 nt, Pseudomonas aeruginosa PA01
cgggcccaagccgagcggc

SEQ ID NO: 1555345 - RNA, 19 nt, Pseudomonas aeruginosa PA01
cgggcauccagcggacgcu

SEQ ID NO: 1555346 - RNA, 22 nt, Pseudomonas aeruginosa PA01
cgggcccugggccccggccggc

SEQ ID NO: 1555347 - RNA, 15 nt, Pseudomonas aeruginosa PA01
cgggcccgugcggca

SEQ ID NO: 1555348 - RNA, 18 nt, Pseudomonas aeruginosa PA01
cgggggucucguagcagc

SEQ ID NO: 1555349 - RNA, 12 nt, Pseudomonas aeruginosa PA01
cggggcgggccg

SEQ ID NO: 1555350 - RNA, 17 nt, Pseudomonas aeruginosa PA01
cggggcggcgucccggc

SEQ ID NO: 1555351 - RNA, 12 nt, Pseudomonas aeruginosa PA01
cggggcgcgccc

SEQ ID NO: 1555352 - RNA, 18 nt, Pseudomonas aeruginosa PA01
cggggcggcgcaucggcg

SEQ ID NO: 1555353 - RNA, 20 nt, Pseudomonas aeruginosa PA01
cggggcggccaaccucuccc

SEQ ID NO: 1555354 - RNA, 14 nt, Pseudomonas aeruginosa PA01
cggggcgcucgccc

SEQ ID NO: 1555355 - RNA, 18 nt, Pseudomonas aeruginosa PA01
cggggcgccuccagcggg

SEQ ID NO: 1555356 - RNA, 14 nt, Pseudomonas aeruginosa PA01
cggggcgcaccgcc

SEQ ID NO: 1555357 - RNA, 15 nt, Pseudomonas aeruginosa PA01
cggggcgcaccgccu

SEQ ID NO: 1555358 - RNA, 14 nt, Pseudomonas aeruginosa PA01
cgggcuucggcagc

SEQ ID NO: 1555359 - RNA, 14 nt, Pseudomonas aeruginosa PA01
cgggcuuuuucucg

SEQ ID NO: 1555360 - RNA, 20 nt, Pseudomonas aeruginosa PA01
cggggccugcugcgggcgcu

SEQ ID NO: 1555361 - RNA, 15 nt, Pseudomonas aeruginosa PA01
cgggcuucagcgccg

SEQ ID NO: 1555362 - RNA, 13 nt, Pseudomonas aeruginosa PA01
cgggcuugcaauc

SEQ ID NO: 1555363 - RNA, 13 nt, Pseudomonas aeruginosa PA01
cgggucaccaccg

SEQ ID NO: 1555364 - RNA, 18 nt, Pseudomonas aeruginosa PA01
cgggucaccagcgccggg

SEQ ID NO: 1555365 - RNA, 17 nt, Pseudomonas aeruginosa PA01
cggguagccaugcacac

SEQ ID NO: 1555366 - RNA, 17 nt, Pseudomonas aeruginosa PA01
cggguaguaguggaagc

SEQ ID NO: 1555367 - RNA, 14 nt, Pseudomonas aeruginosa PA01
cggguagcgccggu

SEQ ID NO: 1555368 - RNA, 17 nt, Pseudomonas aeruginosa PA01
cggguacuggcgcugcg

SEQ ID NO: 1555369 - RNA, 18 nt, Pseudomonas aeruginosa PA01
cggggucuggccggcgau

SEQ ID NO: 1555370 - RNA, 18 nt, Pseudomonas aeruginosa PA01
cggggugauuuacaggac

SEQ ID NO: 1555371 - RNA, 18 nt, Pseudomonas aeruginosa PA01
cgggguggaguaccaggc

SEQ ID NO: 1555372 - RNA, 19 nt, Pseudomonas aeruginosa PA01
cgggguggccgugcagccc

SEQ ID NO: 1555373 - RNA, 18 nt, Pseudomonas aeruginosa PA01
cggggucgggcagcuucu

SEQ ID NO: 1555374 - RNA, 22 nt, Pseudomonas aeruginosa PA01
cgggguagggguggccaggcgc

SEQ ID NO: 1555375 - RNA, 13 nt, Pseudomonas aeruginosa PA01
cggggucaggccg

SEQ ID NO: 1555376 - RNA, 21 nt, Pseudomonas aeruginosa PA01
cgggcguugcgcgccucgccc

SEQ ID NO: 1555377 - RNA, 22 nt, Pseudomonas aeruginosa PA01
cgggcguuggcuccgggccgag

SEQ ID NO: 1555378 - RNA, 19 nt, Pseudomonas aeruginosa PA01
cgggcguuuucguuggcgc

SEQ ID NO: 1555379 - RNA, 18 nt, Pseudomonas aeruginosa PA01
cgggcucacucccgucca

SEQ ID NO: 1555380 - RNA, 20 nt, Pseudomonas aeruginosa PA01
cgggcgggucuggcggaaca

SEQ ID NO: 1555381 - RNA, 22 nt, Pseudomonas aeruginosa PA01
cgggcguagcgcggcagcgcca

SEQ ID NO: 1555382 - RNA, 15 nt, Pseudomonas aeruginosa PA01
cgggcggucgaggcc

SEQ ID NO: 1555383 - RNA, 15 nt, Pseudomonas aeruginosa PA01
cgggcguggggcgaa

SEQ ID NO: 1555384 - RNA, 19 nt, Pseudomonas aeruginosa PA01
cgggcgugucgaggaaggc

SEQ ID NO: 1555385 - RNA, 16 nt, Pseudomonas aeruginosa PA01
cgggcgugcuccagca

SEQ ID NO: 1555386 - RNA, 18 nt, Pseudomonas aeruginosa PA01
cgggcgugcuccagcacc

SEQ ID NO: 1555387 - RNA, 13 nt, Pseudomonas aeruginosa PA01
cgggcgucggcgu

SEQ ID NO: 1555388 - RNA, 21 nt, Pseudomonas aeruginosa PA01
cgggcgucggcgucggcugcg

SEQ ID NO: 1555389 - RNA, 18 nt, Pseudomonas aeruginosa PA01
cgggcgucuccugccgcc

SEQ ID NO: 1555390 - RNA, 14 nt, Pseudomonas aeruginosa PA01
cgggcgccaccgau

SEQ ID NO: 1555391 - RNA, 17 nt, Pseudomonas aeruginosa PA01
cgggcgcccgccaaggc

SEQ ID NO: 1555392 - RNA, 22 nt, Pseudomonas aeruginosa PA01
cgggcgccgaugccggccggca

SEQ ID NO: 1555393 - RNA, 19 nt, Pseudomonas aeruginosa PA01
cgggcgccggaccagccgg

SEQ ID NO: 1555394 - RNA, 22 nt, Pseudomonas aeruginosa PA01
cgggcgccguggaucgcccggc

SEQ ID NO: 1555395 - RNA, 21 nt, Pseudomonas aeruginosa PA01
cgggcgccuuuuucauggccu

SEQ ID NO: 1555396 - RNA, 19 nt, Pseudomonas aeruginosa PA01
cgggcggaucagcucgauc

SEQ ID NO: 1555397 - RNA, 14 nt, Pseudomonas aeruginosa PA01
cgggcgcuuccggc

SEQ ID NO: 1555398 - RNA, 22 nt, Pseudomonas aeruginosa PA01
cgggcggaucgagcagcggcgc

SEQ ID NO: 1555399 - RNA, 24 nt, Pseudomonas aeruginosa PA01
cgggcggaucgagcagcggcgcca

SEQ ID NO: 1555400 - RNA, 14 nt, Pseudomonas aeruginosa PA01
cgggcggcaagggc

SEQ ID NO: 1555401 - RNA, 19 nt, Pseudomonas aeruginosa PA01
cgggcgcucuggccgcgcu

SEQ ID NO: 1555402 - RNA, 20 nt, Pseudomonas aeruginosa PA01
cgggcgcucuggccgcgcuc

SEQ ID NO: 1555403 - RNA, 23 nt, Pseudomonas aeruginosa PA01
cgggcggcuguagcggaucaggc

SEQ ID NO: 1555404 - RNA, 14 nt, Pseudomonas aeruginosa PA01
cgggcggcggcgcu

SEQ ID NO: 1555405 - RNA, 13 nt, Pseudomonas aeruginosa PA01
cgggcggccgacg

SEQ ID NO: 1555406 - RNA, 14 nt, Pseudomonas aeruginosa PA01
cgggcggcgcggcg

SEQ ID NO: 1555407 - RNA, 16 nt, Pseudomonas aeruginosa PA01
cgcucguugcgccgcu

SEQ ID NO: 1555408 - RNA, 12 nt, Pseudomonas aeruginosa PA01
cgcucucgguga

SEQ ID NO: 1555409 - RNA, 22 nt, Pseudomonas aeruginosa PA01
cgcucucggugaccaccaggcg

SEQ ID NO: 1555410 - RNA, 14 nt, Pseudomonas aeruginosa PA01
cgcucucgccgccu

SEQ ID NO: 1555411 - RNA, 16 nt, Pseudomonas aeruginosa PA01
cgcucggucagcuccc

SEQ ID NO: 1555412 - RNA, 22 nt, Pseudomonas aeruginosa PA01
cgcucggugccuucccagccga

SEQ ID NO: 1555413 - RNA, 16 nt, Pseudomonas aeruginosa PA01
cgcucguagccggcgc

SEQ ID NO: 1555414 - RNA, 21 nt, Pseudomonas aeruginosa PA01
cgcucguagccggcgcggcgc

SEQ ID NO: 1555415 - RNA, 20 nt, Pseudomonas aeruginosa PA01
cgcucguagguuuccggguc

SEQ ID NO: 1555416 - RNA, 19 nt, Pseudomonas aeruginosa PA01
cgcucggcgucguaacgga

SEQ ID NO: 1555417 - RNA, 17 nt, Pseudomonas aeruginosa PA01
cgcucggcggcgcgcag

SEQ ID NO: 1555418 - RNA, 19 nt, Pseudomonas aeruginosa PA01
cgcucggcggcgcgcagcg

SEQ ID NO: 1555419 - RNA, 15 nt, Pseudomonas aeruginosa PA01
cgcucggcguagccg

SEQ ID NO: 1555420 - RNA, 19 nt, Pseudomonas aeruginosa PA01
cgcucggcguagccggcga

SEQ ID NO: 1555421 - RNA, 22 nt, Pseudomonas aeruginosa PA01
cgcucggggauguccgccgccc

SEQ ID NO: 1555422 - RNA, 16 nt, Pseudomonas aeruginosa PA01
cgcucgggaucgccuc

SEQ ID NO: 1555423 - RNA, 18 nt, Pseudomonas aeruginosa PA01
cgcucggcuccagccagg

SEQ ID NO: 1555424 - RNA, 21 nt, Pseudomonas aeruginosa PA01
cgcucggcuccagccaggccc

SEQ ID NO: 1555425 - RNA, 13 nt, Pseudomonas aeruginosa PA01
cgcucggcggccu

SEQ ID NO: 1555426 - RNA, 16 nt, Pseudomonas aeruginosa PA01
cgcucaggcgcagcgu

SEQ ID NO: 1555427 - RNA, 20 nt, Pseudomonas aeruginosa PA01
cgcucaggcagcgaucgccg

SEQ ID NO: 1555428 - RNA, 15 nt, Pseudomonas aeruginosa PA01
cgcugcccggcgcga

SEQ ID NO: 1555429 - RNA, 22 nt, Pseudomonas aeruginosa PA01
cgcugcccggcgcgacgcucca

SEQ ID NO: 1555430 - RNA, 24 nt, Pseudomonas aeruginosa PA01
cgcugcccaucgccuccacggcgg

SEQ ID NO: 1555431 - RNA, 19 nt, Pseudomonas aeruginosa PA01
cgcugcccagcccgccuuc

SEQ ID NO: 1555432 - RNA, 15 nt, Pseudomonas aeruginosa PA01
cgcugccagcaggcc

SEQ ID NO: 1555433 - RNA, 15 nt, Pseudomonas aeruginosa PA01
cgcugaugaugccgc

SEQ ID NO: 1555434 - RNA, 21 nt, Pseudomonas aeruginosa PA01
cgcugaucaguaccggcagcg

SEQ ID NO: 1555435 - RNA, 21 nt, Pseudomonas aeruginosa PA01
cgcugaauaccaccgggccgu

SEQ ID NO: 1555436 - RNA, 22 nt, Pseudomonas aeruginosa PA01
cgcugaccaggucguggaaggc

SEQ ID NO: 1555437 - RNA, 24 nt, Pseudomonas aeruginosa PA01
cgcugacccaggcuucggcgcgcu

SEQ ID NO: 1555438 - RNA, 15 nt, Pseudomonas aeruginosa PA01
cgcugaccagcccgg

SEQ ID NO: 1555439 - RNA, 18 nt, Pseudomonas aeruginosa PA01
cgcugaccagcccggcgg

SEQ ID NO: 1555440 - RNA, 20 nt, Pseudomonas aeruginosa PA01
cgcugaccagcccggcggcg

SEQ ID NO: 1555441 - RNA, 13 nt, Pseudomonas aeruginosa PA01
cgcugaccgcucc

SEQ ID NO: 1555442 - RNA, 23 nt, Pseudomonas aeruginosa PA01
cgcugaggaucacgauggccggc

SEQ ID NO: 1555443 - RNA, 16 nt, Pseudomonas aeruginosa PA01
cgcugaggaucagcca

SEQ ID NO: 1555444 - RNA, 21 nt, Pseudomonas aeruginosa PA01
cgcugaggaucagccagccgg

SEQ ID NO: 1555445 - RNA, 15 nt, Pseudomonas aeruginosa PA01
cgcugaggaagagca

SEQ ID NO: 1555446 - RNA, 16 nt, Pseudomonas aeruginosa PA01
cgcugccgcaugcagu

SEQ ID NO: 1555447 - RNA, 18 nt, Pseudomonas aeruginosa PA01
cgcugcgccaggccguuc

SEQ ID NO: 1555448 - RNA, 23 nt, Pseudomonas aeruginosa PA01
cgcugcgccguuucgacgaugcu

SEQ ID NO: 1555449 - RNA, 13 nt, Pseudomonas aeruginosa PA01
cgcugcgcggcgu

SEQ ID NO: 1555450 - RNA, 15 nt, Pseudomonas aeruginosa PA01
cgcugcgccggcgcu

SEQ ID NO: 1555451 - RNA, 16 nt, Pseudomonas aeruginosa PA01
cgcugcgcguacaucc

SEQ ID NO: 1555452 - RNA, 15 nt, Pseudomonas aeruginosa PA01
cgcugcgcugccagc

SEQ ID NO: 1555453 - RNA, 18 nt, Pseudomonas aeruginosa PA01
cgcugcucgacggcacca

SEQ ID NO: 1555454 - RNA, 21 nt, Pseudomonas aeruginosa PA01
cgcugcucgauggccuugagg

SEQ ID NO: 1555455 - RNA, 19 nt, Pseudomonas aeruginosa PA01
cgcugcucgaccaccucgg

SEQ ID NO: 1555456 - RNA, 22 nt, Pseudomonas aeruginosa PA01
cgcugcuaggcuggaagccgcg

SEQ ID NO: 1555457 - RNA, 17 nt, Pseudomonas aeruginosa PA01
cgcugcggaagaaacug

SEQ ID NO: 1555458 - RNA, 14 nt, Pseudomonas aeruginosa PA01
cgcugcgggucauu

SEQ ID NO: 1555459 - RNA, 17 nt, Pseudomonas aeruginosa PA01
cgcugcgugccagggcu

SEQ ID NO: 1555460 - RNA, 16 nt, Pseudomonas aeruginosa PA01
cgcugcgugcgccgcu

SEQ ID NO: 1555461 - RNA, 20 nt, Pseudomonas aeruginosa PA01
cgcugcguggguagccgccc

SEQ ID NO: 1555462 - RNA, 21 nt, Pseudomonas aeruginosa PA01
cgcugcguggguagccgccca

SEQ ID NO: 1555463 - RNA, 16 nt, Pseudomonas aeruginosa PA01
cgcuggaaccggccgg

SEQ ID NO: 1555464 - RNA, 18 nt, Pseudomonas aeruginosa PA01
cgcuggaaccggccggca

SEQ ID NO: 1555465 - RNA, 17 nt, Pseudomonas aeruginosa PA01
cgcuggaccuggccggc

SEQ ID NO: 1555466 - RNA, 15 nt, Pseudomonas aeruginosa PA01
cgcuggcaccggcca

SEQ ID NO: 1555467 - RNA, 18 nt, Pseudomonas aeruginosa PA01
cgcuggcaccggccaggc

SEQ ID NO: 1555468 - RNA, 19 nt, Pseudomonas aeruginosa PA01
cgcuggaccaggcggccgg

SEQ ID NO: 1555469 - RNA, 16 nt, Pseudomonas aeruginosa PA01
cgcuggcgccgaugcu

SEQ ID NO: 1555470 - RNA, 22 nt, Pseudomonas aeruginosa PA01
cgcuggcgcugaccgcucccag

SEQ ID NO: 1555471 - RNA, 12 nt, Pseudomonas aeruginosa PA01
cgcuggccuggg

SEQ ID NO: 1555472 - RNA, 20 nt, Pseudomonas aeruginosa PA01
cgcuggccugggguagccgg

SEQ ID NO: 1555473 - RNA, 22 nt, Pseudomonas aeruginosa PA01
cgcuggccugggguagccggcc

SEQ ID NO: 1555474 - RNA, 21 nt, Pseudomonas aeruginosa PA01
cgcuggcgaagaaccacugga

SEQ ID NO: 1555475 - RNA, 23 nt, Pseudomonas aeruginosa PA01
cgcuggcgaucucggcgcgggca

SEQ ID NO: 1555476 - RNA, 16 nt, Pseudomonas aeruginosa PA01
cgcuggcgcagccgcu

SEQ ID NO: 1555477 - RNA, 15 nt, Pseudomonas aeruginosa PA01
cgcuggccugcagca

SEQ ID NO: 1555478 - RNA, 12 nt, Pseudomonas aeruginosa PA01
cgcuggccagcg

SEQ ID NO: 1555479 - RNA, 17 nt, Pseudomonas aeruginosa PA01
cgcuggccagcgcuucc

SEQ ID NO: 1555480 - RNA, 22 nt, Pseudomonas aeruginosa PA01
cgcuggccagcgcuuccaccgc

SEQ ID NO: 1555481 - RNA, 15 nt, Pseudomonas aeruginosa PA01
cgcuggcccaacagc

SEQ ID NO: 1555482 - RNA, 22 nt, Pseudomonas aeruginosa PA01
cgcuggccgagcugccgcaccg

SEQ ID NO: 1555483 - RNA, 22 nt, Pseudomonas aeruginosa PA01
cggaaaccugugcugcgcgccg

SEQ ID NO: 1555484 - RNA, 22 nt, Pseudomonas aeruginosa PA01
cggaaacccgugguccgccagc

SEQ ID NO: 1555485 - RNA, 21 nt, Pseudomonas aeruginosa PA01
cggaaaaucaaaaccagccuu

SEQ ID NO: 1555486 - RNA, 19 nt, Pseudomonas aeruginosa PA01
cggaaacccuuccagccgc

SEQ ID NO: 1555487 - RNA, 19 nt, Pseudomonas aeruginosa PA01
cggaaaagaagccgcgcaa

SEQ ID NO: 1555488 - RNA, 23 nt, Pseudomonas aeruginosa PA01
cggaaaagaagccgcgcaaggca

SEQ ID NO: 1555489 - RNA, 21 nt, Pseudomonas aeruginosa PA01
cggaaaacgccgcgaagccca

SEQ ID NO: 1555490 - RNA, 22 nt, Pseudomonas aeruginosa PA01
cgcuugagccauucggcuuccu

SEQ ID NO: 1555491 - RNA, 12 nt, Pseudomonas aeruginosa PA01
cgcuugagcccc

SEQ ID NO: 1555492 - RNA, 17 nt, Pseudomonas aeruginosa PA01
cgcuuagcgccagaacg

SEQ ID NO: 1555493 - RNA, 22 nt, Pseudomonas aeruginosa PA01
cgcuuguugaugguuucuuccc

SEQ ID NO: 1555494 - RNA, 14 nt, Pseudomonas aeruginosa PA01
cgcuugccagccgc

SEQ ID NO: 1555495 - RNA, 13 nt, Pseudomonas aeruginosa PA01
cgcuugcccaggu

SEQ ID NO: 1555496 - RNA, 11 nt, Pseudomonas aeruginosa PA01
cgcuugccgcg

SEQ ID NO: 1555497 - RNA, 12 nt, Pseudomonas aeruginosa PA01
cgcuugccgcgc

SEQ ID NO: 1555498 - RNA, 13 nt, Pseudomonas aeruginosa PA01
cgcuugccggccg

SEQ ID NO: 1555499 - RNA, 14 nt, Pseudomonas aeruginosa PA01
cgcuugccggccgc

SEQ ID NO: 1555500 - RNA, 15 nt, Pseudomonas aeruginosa PA01
cgcuugccggccgcc

SEQ ID NO: 1555501 - RNA, 20 nt, Pseudomonas aeruginosa PA01
cgcuggucguucucgcgcau

SEQ ID NO: 1555502 - RNA, 22 nt, Pseudomonas aeruginosa PA01
cgcuggucucuuccagcaugcu

SEQ ID NO: 1555503 - RNA, 23 nt, Pseudomonas aeruginosa PA01
cgcugguccagcacgcuggcgag

SEQ ID NO: 1555504 - RNA, 15 nt, Pseudomonas aeruginosa PA01
cgcugguccagcugg

SEQ ID NO: 1555505 - RNA, 21 nt, Pseudomonas aeruginosa PA01
cgcugguccagcuggcgcagc

SEQ ID NO: 1555506 - RNA, 16 nt, Pseudomonas aeruginosa PA01
cgcugguagcgcucca

SEQ ID NO: 1555507 - RNA, 19 nt, Pseudomonas aeruginosa PA01
cgcugguagcgcuccagcu

SEQ ID NO: 1555508 - RNA, 13 nt, Pseudomonas aeruginosa PA01
cgcuggugcugcu

SEQ ID NO: 1555509 - RNA, 13 nt, Pseudomonas aeruginosa PA01
cgcugggcagcac

SEQ ID NO: 1555510 - RNA, 12 nt, Pseudomonas aeruginosa PA01
cgcugggcgccu

SEQ ID NO: 1555511 - RNA, 19 nt, Pseudomonas aeruginosa PA01
cgcuggggaccgcaccugg

SEQ ID NO: 1555512 - RNA, 13 nt, Pseudomonas aeruginosa PA01
cgcuggcgggcgc

SEQ ID NO: 1555513 - RNA, 12 nt, Pseudomonas aeruginosa PA01
cgcuggcggccg

SEQ ID NO: 1555514 - RNA, 19 nt, Pseudomonas aeruginosa PA01
cgcuggcggcgacgaaggu

SEQ ID NO: 1555515 - RNA, 17 nt, Pseudomonas aeruginosa PA01
cgcuggcggcaugccgu

SEQ ID NO: 1555516 - RNA, 22 nt, Pseudomonas aeruginosa PA01
cgcuggcguuauucgcccuacc

SEQ ID NO: 1555517 - RNA, 14 nt, Pseudomonas aeruginosa PA01
cgcuguuccucguc

SEQ ID NO: 1555518 - RNA, 21 nt, Pseudomonas aeruginosa PA01
cgcugucaaucgcgcaacggc

SEQ ID NO: 1555519 - RNA, 10 nt, Pseudomonas aeruginosa PA01
cgcugucagg

SEQ ID NO: 1555520 - RNA, 14 nt, Pseudomonas aeruginosa PA01
cgcugucagggcuu

SEQ ID NO: 1555521 - RNA, 16 nt, Pseudomonas aeruginosa PA01
cgcuguccgccggccu

SEQ ID NO: 1555522 - RNA, 23 nt, Pseudomonas aeruginosa PA01
cgcuguacaagcgcaacgcgcgc

SEQ ID NO: 1555523 - RNA, 17 nt, Pseudomonas aeruginosa PA01
cgcuguaggcgagcagc

SEQ ID NO: 1555524 - RNA, 14 nt, Pseudomonas aeruginosa PA01
cgcuguagccggcg

SEQ ID NO: 1555525 - RNA, 14 nt, Pseudomonas aeruginosa PA01
cgcugucgcccggg

SEQ ID NO: 1555526 - RNA, 19 nt, Pseudomonas aeruginosa PA01
cgcugucgccggucaggcu

SEQ ID NO: 1555527 - RNA, 15 nt, Pseudomonas aeruginosa PA01
cgcugucgagcaggg

SEQ ID NO: 1555528 - RNA, 19 nt, Pseudomonas aeruginosa PA01
cgcuguccuccagcggcgg

SEQ ID NO: 1555529 - RNA, 15 nt, Pseudomonas aeruginosa PA01
cgcugugcggcagca

SEQ ID NO: 1555530 - RNA, 18 nt, Pseudomonas aeruginosa PA01
cgcugugcggcagcaggc

SEQ ID NO: 1555531 - RNA, 14 nt, Pseudomonas aeruginosa PA01
cgcggcccggcgcu

SEQ ID NO: 1555532 - RNA, 18 nt, Pseudomonas aeruginosa PA01
cgcggcccguccgcgcca

SEQ ID NO: 1555533 - RNA, 14 nt, Pseudomonas aeruginosa PA01
cgcggccgccgccg

SEQ ID NO: 1555534 - RNA, 13 nt, Pseudomonas aeruginosa PA01
cgcggccggcagg

SEQ ID NO: 1555535 - RNA, 22 nt, Pseudomonas aeruginosa PA01
cgcggccggccacgcgaccagc

SEQ ID NO: 1555536 - RNA, 15 nt, Pseudomonas aeruginosa PA01
cgcggccggcgccgc

SEQ ID NO: 1555537 - RNA, 16 nt, Pseudomonas aeruginosa PA01
cgcggccggcuucagc

SEQ ID NO: 1555538 - RNA, 18 nt, Pseudomonas aeruginosa PA01
cgcggccggcuucagcaa

SEQ ID NO: 1555539 - RNA, 18 nt, Pseudomonas aeruginosa PA01
cgcggcgauaggcgcgca

SEQ ID NO: 1555540 - RNA, 21 nt, Pseudomonas aeruginosa PA01
cgcggccugcagcgacuccag

SEQ ID NO: 1555541 - RNA, 20 nt, Pseudomonas aeruginosa PA01
cgcggccguuguccagggug

SEQ ID NO: 1555542 - RNA, 23 nt, Pseudomonas aeruginosa PA01
cgcggccguuguccagggugauc

SEQ ID NO: 1555543 - RNA, 16 nt, Pseudomonas aeruginosa PA01
cgcggauuggccgggc

SEQ ID NO: 1555544 - RNA, 20 nt, Pseudomonas aeruginosa PA01
cgcggaugucgggcucgacg

SEQ ID NO: 1555545 - RNA, 16 nt, Pseudomonas aeruginosa PA01
cgcggcauagcgcagc

SEQ ID NO: 1555546 - RNA, 20 nt, Pseudomonas aeruginosa PA01
cgcggcauagcgcagccgcu

SEQ ID NO: 1555547 - RNA, 13 nt, Pseudomonas aeruginosa PA01
cgcggcaggcggc

SEQ ID NO: 1555548 - RNA, 22 nt, Pseudomonas aeruginosa PA01
cgcggcagguggcuggccauga

SEQ ID NO: 1555549 - RNA, 20 nt, Pseudomonas aeruginosa PA01
cgcggcauagaugccggccu

SEQ ID NO: 1555550 - RNA, 19 nt, Pseudomonas aeruginosa PA01
cgcggaucguccgggcggu

SEQ ID NO: 1555551 - RNA, 18 nt, Pseudomonas aeruginosa PA01
cgcggaucugcuccugca

SEQ ID NO: 1555552 - RNA, 12 nt, Pseudomonas aeruginosa PA01
cgcgccggcagc

SEQ ID NO: 1555553 - RNA, 22 nt, Pseudomonas aeruginosa PA01
cgcgccgcgcuuggccuugccg

SEQ ID NO: 1555554 - RNA, 20 nt, Pseudomonas aeruginosa PA01
cgcgccggaugggcgagcug

SEQ ID NO: 1555555 - RNA, 20 nt, Pseudomonas aeruginosa PA01
cgcgccgcgucgccgccagc

SEQ ID NO: 1555556 - RNA, 23 nt, Pseudomonas aeruginosa PA01
cgcgccgcgucgccgccagcgcc

SEQ ID NO: 1555557 - RNA, 19 nt, Pseudomonas aeruginosa PA01
cgcggcgauggccgccagc

SEQ ID NO: 1555558 - RNA, 23 nt, Pseudomonas aeruginosa PA01
cgcggcgccagcgccccaccagg

SEQ ID NO: 1555559 - RNA, 18 nt, Pseudomonas aeruginosa PA01
cgcggcgcccugccgggc

SEQ ID NO: 1555560 - RNA, 20 nt, Pseudomonas aeruginosa PA01
cgcggcgccccaggcgccca

SEQ ID NO: 1555561 - RNA, 15 nt, Pseudomonas aeruginosa PA01
cgcggcgccccgucc

SEQ ID NO: 1555562 - RNA, 22 nt, Pseudomonas aeruginosa PA01
cgcggcgccuucagcgccgcca

SEQ ID NO: 1555563 - RNA, 13 nt, Pseudomonas aeruginosa PA01
cgcggcgccugcu

SEQ ID NO: 1555564 - RNA, 12 nt, Pseudomonas aeruginosa PA01
cgcggcgcgccu

SEQ ID NO: 1555565 - RNA, 12 nt, Pseudomonas aeruginosa PA01
cgcggcgcggcg

SEQ ID NO: 1555566 - RNA, 16 nt, Pseudomonas aeruginosa PA01
cgcggcuaucgaucac

SEQ ID NO: 1555567 - RNA, 22 nt, Pseudomonas aeruginosa PA01
cgcggcuaucgaucacugccug

SEQ ID NO: 1555568 - RNA, 20 nt, Pseudomonas aeruginosa PA01
cgcggcggacaggcagccgg

SEQ ID NO: 1555569 - RNA, 22 nt, Pseudomonas aeruginosa PA01
cgcggcggacaggcagccggcc

SEQ ID NO: 1555570 - RNA, 17 nt, Pseudomonas aeruginosa PA01
cgcggcgcuccaggcgg

SEQ ID NO: 1555571 - RNA, 21 nt, Pseudomonas aeruginosa PA01
cgcggcgcuuguagcccaggg

SEQ ID NO: 1555572 - RNA, 22 nt, Pseudomonas aeruginosa PA01
cgcggcuggccgccucgcgccg

SEQ ID NO: 1555573 - RNA, 14 nt, Pseudomonas aeruginosa PA01
cgcggcugcgcgcc

SEQ ID NO: 1555574 - RNA, 15 nt, Pseudomonas aeruginosa PA01
cgcggcugaaggccg

SEQ ID NO: 1555575 - RNA, 15 nt, Pseudomonas aeruginosa PA01
cgcggcugaugccgc

SEQ ID NO: 1555576 - RNA, 15 nt, Pseudomonas aeruginosa PA01
cgcggcucggcgggc

SEQ ID NO: 1555577 - RNA, 16 nt, Pseudomonas aeruginosa PA01
cgcggcucgggcggca

SEQ ID NO: 1555578 - RNA, 17 nt, Pseudomonas aeruginosa PA01
cgcggcucgggcggcaa

SEQ ID NO: 1555579 - RNA, 16 nt, Pseudomonas aeruginosa PA01
cgcggcucuggcgcag

SEQ ID NO: 1555580 - RNA, 18 nt, Pseudomonas aeruginosa PA01
cgcggguuuccgugcgcu

SEQ ID NO: 1555581 - RNA, 21 nt, Pseudomonas aeruginosa PA01
cgcggguucgagucccguccg

SEQ ID NO: 1555582 - RNA, 12 nt, Pseudomonas aeruginosa PA01
cgcgguaacgga

SEQ ID NO: 1555583 - RNA, 12 nt, Pseudomonas aeruginosa PA01
cgcgggucugcu

SEQ ID NO: 1555584 - RNA, 15 nt, Pseudomonas aeruginosa PA01
cgcgggucugcucgc

SEQ ID NO: 1555585 - RNA, 15 nt, Pseudomonas aeruginosa PA01
cgcgggucugcucgg

SEQ ID NO: 1555586 - RNA, 19 nt, Pseudomonas aeruginosa PA01
cgcgggucuucaggccgca

SEQ ID NO: 1555587 - RNA, 14 nt, Pseudomonas aeruginosa PA01
cgcgggucaccagc

SEQ ID NO: 1555588 - RNA, 23 nt, Pseudomonas aeruginosa PA01
cgcgggucaucggcccgacgccg

SEQ ID NO: 1555589 - RNA, 19 nt, Pseudomonas aeruginosa PA01
cgcgggucguacaccgcgc

SEQ ID NO: 1555590 - RNA, 22 nt, Pseudomonas aeruginosa PA01
cgcgggggcucggucgagcccc

SEQ ID NO: 1555591 - RNA, 20 nt, Pseudomonas aeruginosa PA01
cgcgggcaaccgcggcggcc

SEQ ID NO: 1555592 - RNA, 14 nt, Pseudomonas aeruginosa PA01
cgcgggccaggccc

SEQ ID NO: 1555593 - RNA, 17 nt, Pseudomonas aeruginosa PA01
cgcgggccaggcccuug

SEQ ID NO: 1555594 - RNA, 17 nt, Pseudomonas aeruginosa PA01
cgcgggccgacggcccu

SEQ ID NO: 1555595 - RNA, 17 nt, Pseudomonas aeruginosa PA01
cgcgggccuucaggcug

SEQ ID NO: 1555596 - RNA, 23 nt, Pseudomonas aeruginosa PA01
cgcgggccuucaggcugcgcgca

SEQ ID NO: 1555597 - RNA, 22 nt, Pseudomonas aeruginosa PA01
cgcgggcgauggcccguuccac

SEQ ID NO: 1555598 - RNA, 17 nt, Pseudomonas aeruginosa PA01
cgcgggcgacgaagccc

SEQ ID NO: 1555599 - RNA, 13 nt, Pseudomonas aeruginosa PA01
cgcggggcgcgcu

SEQ ID NO: 1555600 - RNA, 17 nt, Pseudomonas aeruginosa PA01
cgcgucgcgcgcggcau

SEQ ID NO: 1555601 - RNA, 21 nt, Pseudomonas aeruginosa PA01
cgcgugcuccgugucggcggc

SEQ ID NO: 1555602 - RNA, 13 nt, Pseudomonas aeruginosa PA01
cgcgugcgcgccc

SEQ ID NO: 1555603 - RNA, 16 nt, Pseudomonas aeruginosa PA01
cgcgugcgcgccgccg

SEQ ID NO: 1555604 - RNA, 19 nt, Pseudomonas aeruginosa PA01
cgcgugcgcugguaccugc

SEQ ID NO: 1555605 - RNA, 22 nt, Pseudomonas aeruginosa PA01
cgcgugcccgagaagccggggc

SEQ ID NO: 1555606 - RNA, 17 nt, Pseudomonas aeruginosa PA01
cgcuacguuccagggcc

SEQ ID NO: 1555607 - RNA, 17 nt, Pseudomonas aeruginosa PA01
cgcuaugcagcagguag

SEQ ID NO: 1555608 - RNA, 20 nt, Pseudomonas aeruginosa PA01
cgcuaucgccgccgcagccg

SEQ ID NO: 1555609 - RNA, 19 nt, Pseudomonas aeruginosa PA01
cgcuaucgcuggcgcagcc

SEQ ID NO: 1555610 - RNA, 17 nt, Pseudomonas aeruginosa PA01
cgcuauccgccgcuacu

SEQ ID NO: 1555611 - RNA, 22 nt, Pseudomonas aeruginosa PA01
cgcucacguagcccccgccgcu

SEQ ID NO: 1555612 - RNA, 14 nt, Pseudomonas aeruginosa PA01
cgcucagcgccgcu

SEQ ID NO: 1555613 - RNA, 14 nt, Pseudomonas aeruginosa PA01
cgcuaugggcaccg

SEQ ID NO: 1555614 - RNA, 18 nt, Pseudomonas aeruginosa PA01
cgcggucgagcagcgccg

SEQ ID NO: 1555615 - RNA, 16 nt, Pseudomonas aeruginosa PA01
cgcgguauucuccagc

SEQ ID NO: 1555616 - RNA, 16 nt, Pseudomonas aeruginosa PA01
cgcgguagcugcgcag

SEQ ID NO: 1555617 - RNA, 18 nt, Pseudomonas aeruginosa PA01
cgcgguagcugcgcaggg

SEQ ID NO: 1555618 - RNA, 22 nt, Pseudomonas aeruginosa PA01
cgcgguacccggcagggccagc

SEQ ID NO: 1555619 - RNA, 22 nt, Pseudomonas aeruginosa PA01
cgcggucaccagggucacgccg

SEQ ID NO: 1555620 - RNA, 23 nt, Pseudomonas aeruginosa PA01
cgcggucaccagggucacgccgc

SEQ ID NO: 1555621 - RNA, 16 nt, Pseudomonas aeruginosa PA01
cgcggucacucggccu

SEQ ID NO: 1555622 - RNA, 14 nt, Pseudomonas aeruginosa PA01
cgcgguaggccagc

SEQ ID NO: 1555623 - RNA, 17 nt, Pseudomonas aeruginosa PA01
cgcgguaggccagcucc

SEQ ID NO: 1555624 - RNA, 20 nt, Pseudomonas aeruginosa PA01
cgcggucgaugucgcggccc

SEQ ID NO: 1555625 - RNA, 15 nt, Pseudomonas aeruginosa PA01
cgcggucuuccgccg

SEQ ID NO: 1555626 - RNA, 14 nt, Pseudomonas aeruginosa PA01
cgcggugagcaggg

SEQ ID NO: 1555627 - RNA, 18 nt, Pseudomonas aeruginosa PA01
cgcgguuauccgccgccg

SEQ ID NO: 1555628 - RNA, 18 nt, Pseudomonas aeruginosa PA01
cgcgguuauccgccgcug

SEQ ID NO: 1555629 - RNA, 16 nt, Pseudomonas aeruginosa PA01
cgcgguuauccgccgg

SEQ ID NO: 1555630 - RNA, 21 nt, Pseudomonas aeruginosa PA01
cgcggugugcuuguccaccac

SEQ ID NO: 1555631 - RNA, 19 nt, Pseudomonas aeruginosa PA01
cgcgguucgaggacuucau

SEQ ID NO: 1555632 - RNA, 23 nt, Pseudomonas aeruginosa PA01
cgcgucaucaggcucaggccggg

SEQ ID NO: 1555633 - RNA, 21 nt, Pseudomonas aeruginosa PA01
cgcguccgcaguucgccccgc

SEQ ID NO: 1555634 - RNA, 17 nt, Pseudomonas aeruginosa PA01
cgcgucccugcacaggg

SEQ ID NO: 1555635 - RNA, 15 nt, Pseudomonas aeruginosa PA01
cgcguccuccuggag

SEQ ID NO: 1555636 - RNA, 21 nt, Pseudomonas aeruginosa PA01
cgcgucgcacccggcccaugg

SEQ ID NO: 1555637 - RNA, 13 nt, Pseudomonas aeruginosa PA01
cgcgucgcccagg

SEQ ID NO: 1555638 - RNA, 14 nt, Pseudomonas aeruginosa PA01
cgcgucgcccaggc

SEQ ID NO: 1555639 - RNA, 13 nt, Pseudomonas aeruginosa PA01
cgcgucgccgcca

SEQ ID NO: 1555640 - RNA, 17 nt, Pseudomonas aeruginosa PA01
cggccauugccgcgggc

SEQ ID NO: 1555641 - RNA, 22 nt, Pseudomonas aeruginosa PA01
cggcccacgcucagugcgccgg

SEQ ID NO: 1555642 - RNA, 23 nt, Pseudomonas aeruginosa PA01
cggcccacgcucagugcgccggg

SEQ ID NO: 1555643 - RNA, 18 nt, Pseudomonas aeruginosa PA01
cggccaguucgcggcgca

SEQ ID NO: 1555644 - RNA, 16 nt, Pseudomonas aeruginosa PA01
cggccauuccuuccag

SEQ ID NO: 1555645 - RNA, 17 nt, Pseudomonas aeruginosa PA01
cggccauugccgccaga

SEQ ID NO: 1555646 - RNA, 16 nt, Pseudomonas aeruginosa PA01
cggccaggucgcgggu

SEQ ID NO: 1555647 - RNA, 12 nt, Pseudomonas aeruginosa PA01
cggccagggucg

SEQ ID NO: 1555648 - RNA, 17 nt, Pseudomonas aeruginosa PA01
cggccagggucgccagc

SEQ ID NO: 1555649 - RNA, 19 nt, Pseudomonas aeruginosa PA01
cggccagcgcaucgaggcc

SEQ ID NO: 1555650 - RNA, 16 nt, Pseudomonas aeruginosa PA01
cggccagcgccacggc

SEQ ID NO: 1555651 - RNA, 16 nt, Pseudomonas aeruginosa PA01
cggcauccuguggcug

SEQ ID NO: 1555652 - RNA, 19 nt, Pseudomonas aeruginosa PA01
cggcaucgaccagggccgg

SEQ ID NO: 1555653 - RNA, 15 nt, Pseudomonas aeruginosa PA01
cggcauccagcaucc

SEQ ID NO: 1555654 - RNA, 15 nt, Pseudomonas aeruginosa PA01
cggcaucccgcccgg

SEQ ID NO: 1555655 - RNA, 17 nt, Pseudomonas aeruginosa PA01
cggcaucccgcccgguc

SEQ ID NO: 1555656 - RNA, 19 nt, Pseudomonas aeruginosa PA01
cggcauccgccgcugggga

SEQ ID NO: 1555657 - RNA, 14 nt, Pseudomonas aeruginosa PA01
cggccagcagcaug

SEQ ID NO: 1555658 - RNA, 12 nt, Pseudomonas aeruginosa PA01
cggccagcagca

SEQ ID NO: 1555659 - RNA, 14 nt, Pseudomonas aeruginosa PA01
cggccagcagcacg

SEQ ID NO: 1555660 - RNA, 20 nt, Pseudomonas aeruginosa PA01
cggccagcagcacggcgacg

SEQ ID NO: 1555661 - RNA, 16 nt, Pseudomonas aeruginosa PA01
cggcaucgccggggcu

SEQ ID NO: 1555662 - RNA, 14 nt, Pseudomonas aeruginosa PA01
cggcaucggagacc

SEQ ID NO: 1555663 - RNA, 21 nt, Pseudomonas aeruginosa PA01
cggccagccuggccagcgcuu

SEQ ID NO: 1555664 - RNA, 17 nt, Pseudomonas aeruginosa PA01
cggccagccuucccggc

SEQ ID NO: 1555665 - RNA, 14 nt, Pseudomonas aeruginosa PA01
cggccagccgcuag

SEQ ID NO: 1555666 - RNA, 20 nt, Pseudomonas aeruginosa PA01
cggccagcccccucgcccuc

SEQ ID NO: 1555667 - RNA, 13 nt, Pseudomonas aeruginosa PA01
cggccagcccggc

SEQ ID NO: 1555668 - RNA, 16 nt, Pseudomonas aeruginosa PA01
cggccagcccggccuc

SEQ ID NO: 1555669 - RNA, 14 nt, Pseudomonas aeruginosa PA01
cggccagccccugc

SEQ ID NO: 1555670 - RNA, 15 nt, Pseudomonas aeruginosa PA01
cggccagccagggca

SEQ ID NO: 1555671 - RNA, 14 nt, Pseudomonas aeruginosa PA01
cggccagcagcgcc

SEQ ID NO: 1555672 - RNA, 20 nt, Pseudomonas aeruginosa PA01
cggccagcagcgccuccucu

SEQ ID NO: 1555673 - RNA, 17 nt, Pseudomonas aeruginosa PA01
cggccagcaggaugcug

SEQ ID NO: 1555674 - RNA, 16 nt, Pseudomonas aeruginosa PA01
cggcccgacgccgccc

SEQ ID NO: 1555675 - RNA, 19 nt, Pseudomonas aeruginosa PA01
cggcccgacgccgcccggc

SEQ ID NO: 1555676 - RNA, 18 nt, Pseudomonas aeruginosa PA01
cggccccuucagcuccag

SEQ ID NO: 1555677 - RNA, 18 nt, Pseudomonas aeruginosa PA01
cggccccugggccggcuu

SEQ ID NO: 1555678 - RNA, 18 nt, Pseudomonas aeruginosa PA01
cggcccgagggcggcagg

SEQ ID NO: 1555679 - RNA, 21 nt, Pseudomonas aeruginosa PA01
cggcccgagggcggcaggggg

SEQ ID NO: 1555680 - RNA, 13 nt, Pseudomonas aeruginosa PA01
cggcccagcagcg

SEQ ID NO: 1555681 - RNA, 10 nt, Pseudomonas aeruginosa PA01
cggcccacca

SEQ ID NO: 1555682 - RNA, 13 nt, Pseudomonas aeruginosa PA01
cggcccgcagauc

SEQ ID NO: 1555683 - RNA, 14 nt, Pseudomonas aeruginosa PA01
cggcccgccucggc

SEQ ID NO: 1555684 - RNA, 13 nt, Pseudomonas aeruginosa PA01
cggcccgcgccgc

SEQ ID NO: 1555685 - RNA, 14 nt, Pseudomonas aeruginosa PA01
cggcccgcgccgcc

SEQ ID NO: 1555686 - RNA, 17 nt, Pseudomonas aeruginosa PA01
cggcccgccgccggggc

SEQ ID NO: 1555687 - RNA, 17 nt, Pseudomonas aeruginosa PA01
cggcccgcgcggcaacg

SEQ ID NO: 1555688 - RNA, 17 nt, Pseudomonas aeruginosa PA01
cggcccggagaccgugc

SEQ ID NO: 1555689 - RNA, 22 nt, Pseudomonas aeruginosa PA01
cggcccggagaccgugccgccg

SEQ ID NO: 1555690 - RNA, 23 nt, Pseudomonas aeruginosa PA01
cggcccggagaccgugccgccgg

SEQ ID NO: 1555691 - RNA, 14 nt, Pseudomonas aeruginosa PA01
cggcccggagcgcg

SEQ ID NO: 1555692 - RNA, 18 nt, Pseudomonas aeruginosa PA01
cggcccggagcgcgaggc

SEQ ID NO: 1555693 - RNA, 21 nt, Pseudomonas aeruginosa PA01
cggcccgguuuuccgcuucca

SEQ ID NO: 1555694 - RNA, 23 nt, Pseudomonas aeruginosa PA01
cggcccggucagcuucgccgccc

SEQ ID NO: 1555695 - RNA, 13 nt, Pseudomonas aeruginosa PA01
cggcccgggcgcc

SEQ ID NO: 1555696 - RNA, 19 nt, Pseudomonas aeruginosa PA01
cggcccgggucacggucag

SEQ ID NO: 1555697 - RNA, 22 nt, Pseudomonas aeruginosa PA01
cggcccgggucacggucagcuc

SEQ ID NO: 1555698 - RNA, 23 nt, Pseudomonas aeruginosa PA01
cggcccugggcguggcaaaaaug

SEQ ID NO: 1555699 - RNA, 17 nt, Pseudomonas aeruginosa PA01
cggcccuucacgagacc

SEQ ID NO: 1555700 - RNA, 17 nt, Pseudomonas aeruginosa PA01
cggcccuugucgccgcu

SEQ ID NO: 1555701 - RNA, 19 nt, Pseudomonas aeruginosa PA01
cggcccuugucgccgcugg

SEQ ID NO: 1555702 - RNA, 17 nt, Pseudomonas aeruginosa PA01
cggcccugcgccgcagc

SEQ ID NO: 1555703 - RNA, 18 nt, Pseudomonas aeruginosa PA01
cggccgaauccuccagcc

SEQ ID NO: 1555704 - RNA, 20 nt, Pseudomonas aeruginosa PA01
cggccgaauccuccagccgg

SEQ ID NO: 1555705 - RNA, 22 nt, Pseudomonas aeruginosa PA01
cggccgaauuccagcuugucca

SEQ ID NO: 1555706 - RNA, 23 nt, Pseudomonas aeruginosa PA01
cggccgacagagcggccggcgcg

SEQ ID NO: 1555707 - RNA, 18 nt, Pseudomonas aeruginosa PA01
cggccgagcaggcgcgcc

SEQ ID NO: 1555708 - RNA, 24 nt, Pseudomonas aeruginosa PA01
cggccgagcaggcgcgccaggccc

SEQ ID NO: 1555709 - RNA, 17 nt, Pseudomonas aeruginosa PA01
cggccgaguucgcgcag

SEQ ID NO: 1555710 - RNA, 22 nt, Pseudomonas aeruginosa PA01
cggccgauggaaaucggccacu

SEQ ID NO: 1555711 - RNA, 13 nt, Pseudomonas aeruginosa PA01
cggccgcaccagg

SEQ ID NO: 1555712 - RNA, 16 nt, Pseudomonas aeruginosa PA01
cggccgcaaccagccc

SEQ ID NO: 1555713 - RNA, 23 nt, Pseudomonas aeruginosa PA01
cggccgcuugaucuuguccugga

SEQ ID NO: 1555714 - RNA, 16 nt, Pseudomonas aeruginosa PA01
cggccgcugcgcaggc

SEQ ID NO: 1555715 - RNA, 19 nt, Pseudomonas aeruginosa PA01
cggccgcugcgcaggccga

SEQ ID NO: 1555716 - RNA, 22 nt, Pseudomonas aeruginosa PA01
cggccgcugccguugcaggccc

SEQ ID NO: 1555717 - RNA, 20 nt, Pseudomonas aeruginosa PA01
cggccggaggggaugugcuc

SEQ ID NO: 1555718 - RNA, 15 nt, Pseudomonas aeruginosa PA01
cggccggcagcuccg

SEQ ID NO: 1555719 - RNA, 19 nt, Pseudomonas aeruginosa PA01
cggccggcagcuccggcgg

SEQ ID NO: 1555720 - RNA, 14 nt, Pseudomonas aeruginosa PA01
cggccggcaggccg

SEQ ID NO: 1555721 - RNA, 15 nt, Pseudomonas aeruginosa PA01
cggccggcaggccga

SEQ ID NO: 1555722 - RNA, 15 nt, Pseudomonas aeruginosa PA01
cggccggcgcggcgc

SEQ ID NO: 1555723 - RNA, 14 nt, Pseudomonas aeruginosa PA01
cggccggcgccgcg

SEQ ID NO: 1555724 - RNA, 21 nt, Pseudomonas aeruginosa PA01
cggccggcgaccuuguccugc

SEQ ID NO: 1555725 - RNA, 13 nt, Pseudomonas aeruginosa PA01
cggccggcggccu

SEQ ID NO: 1555726 - RNA, 18 nt, Pseudomonas aeruginosa PA01
cggccggcuucagcaacu

SEQ ID NO: 1555727 - RNA, 13 nt, Pseudomonas aeruginosa PA01
cggccgccuggcg

SEQ ID NO: 1555728 - RNA, 21 nt, Pseudomonas aeruginosa PA01
cggccgccuuccucggccgcc

SEQ ID NO: 1555729 - RNA, 15 nt, Pseudomonas aeruginosa PA01
cggccgccugccuuc

SEQ ID NO: 1555730 - RNA, 20 nt, Pseudomonas aeruginosa PA01
cggccgcgagcgcggccggc

SEQ ID NO: 1555731 - RNA, 22 nt, Pseudomonas aeruginosa PA01
cggccgcgagcgcggccggcca

SEQ ID NO: 1555732 - RNA, 23 nt, Pseudomonas aeruginosa PA01
cggccgcgccuucagcgccagca

SEQ ID NO: 1555733 - RNA, 15 nt, Pseudomonas aeruginosa PA01
cggccgcggcuggca

SEQ ID NO: 1555734 - RNA, 21 nt, Pseudomonas aeruginosa PA01
cggccgcggcuggcaggugcc

SEQ ID NO: 1555735 - RNA, 23 nt, Pseudomonas aeruginosa PA01
cggccgccgaaaugcugcaggcc

SEQ ID NO: 1555736 - RNA, 14 nt, Pseudomonas aeruginosa PA01
cggccgccagggcg

SEQ ID NO: 1555737 - RNA, 15 nt, Pseudomonas aeruginosa PA01
cggccgccggcgccc

SEQ ID NO: 1555738 - RNA, 16 nt, Pseudomonas aeruginosa PA01
cggccgccgcgcagca

SEQ ID NO: 1555739 - RNA, 16 nt, Pseudomonas aeruginosa PA01
cggccgcccgagccgc

SEQ ID NO: 1555740 - RNA, 17 nt, Pseudomonas aeruginosa PA01
cggccgcccgagccgcu

SEQ ID NO: 1555741 - RNA, 12 nt, Pseudomonas aeruginosa PA01
cggccgccaggc

SEQ ID NO: 1555742 - RNA, 14 nt, Pseudomonas aeruginosa PA01
cggccgccaggcug

SEQ ID NO: 1555743 - RNA, 13 nt, Pseudomonas aeruginosa PA01
cggccgcaggcag

SEQ ID NO: 1555744 - RNA, 14 nt, Pseudomonas aeruginosa PA01
cggccugcgccgga

SEQ ID NO: 1555745 - RNA, 16 nt, Pseudomonas aeruginosa PA01
cggccugcgccggacc

SEQ ID NO: 1555746 - RNA, 23 nt, Pseudomonas aeruginosa PA01
cggccugcgcgcaccaggccucc

SEQ ID NO: 1555747 - RNA, 17 nt, Pseudomonas aeruginosa PA01
cggccugcucgcgcagc

SEQ ID NO: 1555748 - RNA, 15 nt, Pseudomonas aeruginosa PA01
cggccuggcgcgcgc

SEQ ID NO: 1555749 - RNA, 13 nt, Pseudomonas aeruginosa PA01
cggccuggcgucc

SEQ ID NO: 1555750 - RNA, 21 nt, Pseudomonas aeruginosa PA01
cggccuggcgcagcggcagcg

SEQ ID NO: 1555751 - RNA, 15 nt, Pseudomonas aeruginosa PA01
cggccuggcgccggg

SEQ ID NO: 1555752 - RNA, 21 nt, Pseudomonas aeruginosa PA01
cggccuggaucucggcggcca

SEQ ID NO: 1555753 - RNA, 22 nt, Pseudomonas aeruginosa PA01
cggccugcgucgcauccaccag

SEQ ID NO: 1555754 - RNA, 17 nt, Pseudomonas aeruginosa PA01
cggccugcugcgccggc

SEQ ID NO: 1555755 - RNA, 15 nt, Pseudomonas aeruginosa PA01
cggccuggaaccgcu

SEQ ID NO: 1555756 - RNA, 19 nt, Pseudomonas aeruginosa PA01
cggccugagcugccgcuuc

SEQ ID NO: 1555757 - RNA, 22 nt, Pseudomonas aeruginosa PA01
cggccugaucaucugggccauc

SEQ ID NO: 1555758 - RNA, 15 nt, Pseudomonas aeruginosa PA01
cggccugagccggcc

SEQ ID NO: 1555759 - RNA, 17 nt, Pseudomonas aeruginosa PA01
cggccugcaacacccag

SEQ ID NO: 1555760 - RNA, 22 nt, Pseudomonas aeruginosa PA01
cggccugcaacacccaggccug

SEQ ID NO: 1555761 - RNA, 19 nt, Pseudomonas aeruginosa PA01
cggccugcaccugcucggg

SEQ ID NO: 1555762 - RNA, 21 nt, Pseudomonas aeruginosa PA01
cggccugcaccugcucggggc

SEQ ID NO: 1555763 - RNA, 18 nt, Pseudomonas aeruginosa PA01
cggccucgcugccgccgc

SEQ ID NO: 1555764 - RNA, 19 nt, Pseudomonas aeruginosa PA01
cggccucgaucucguccuc

SEQ ID NO: 1555765 - RNA, 22 nt, Pseudomonas aeruginosa PA01
cggccucgcgcaacugcggggc

SEQ ID NO: 1555766 - RNA, 17 nt, Pseudomonas aeruginosa PA01
cggccucgcgugcgcug

SEQ ID NO: 1555767 - RNA, 22 nt, Pseudomonas aeruginosa PA01
cggccucaacgaccgcccaggc

SEQ ID NO: 1555768 - RNA, 12 nt, Pseudomonas aeruginosa PA01
cggccuccagca

SEQ ID NO: 1555769 - RNA, 15 nt, Pseudomonas aeruginosa PA01
cggccuccagcacuc

SEQ ID NO: 1555770 - RNA, 22 nt, Pseudomonas aeruginosa PA01
cggccuccagcacucgcuccuc

SEQ ID NO: 1555771 - RNA, 15 nt, Pseudomonas aeruginosa PA01
cggccuccgguggcg

SEQ ID NO: 1555772 - RNA, 17 nt, Pseudomonas aeruginosa PA01
cggccucgacgcagagc

SEQ ID NO: 1555773 - RNA, 20 nt, Pseudomonas aeruginosa PA01
cggccucgacgcagagcgcc

SEQ ID NO: 1555774 - RNA, 16 nt, Pseudomonas aeruginosa PA01
cggccguccugcggcc

SEQ ID NO: 1555775 - RNA, 21 nt, Pseudomonas aeruginosa PA01
cggccgucgcgcaccacccau

SEQ ID NO: 1555776 - RNA, 13 nt, Pseudomonas aeruginosa PA01
cggccgucggccu

SEQ ID NO: 1555777 - RNA, 18 nt, Pseudomonas aeruginosa PA01
cggccgguagucggggca

SEQ ID NO: 1555778 - RNA, 15 nt, Pseudomonas aeruginosa PA01
cggccggggucaggc

SEQ ID NO: 1555779 - RNA, 18 nt, Pseudomonas aeruginosa PA01
cggccggggucaggccga

SEQ ID NO: 1555780 - RNA, 17 nt, Pseudomonas aeruginosa PA01
cggccgucacggccucc

SEQ ID NO: 1555781 - RNA, 20 nt, Pseudomonas aeruginosa PA01
cggcagcgacuggaaacgca

SEQ ID NO: 1555782 - RNA, 11 nt, Pseudomonas aeruginosa PA01
cggcaggaccu

SEQ ID NO: 1555783 - RNA, 17 nt, Pseudomonas aeruginosa PA01
cggcaggaccucgggcg

SEQ ID NO: 1555784 - RNA, 15 nt, Pseudomonas aeruginosa PA01
cggcagcgcuggcga

SEQ ID NO: 1555785 - RNA, 15 nt, Pseudomonas aeruginosa PA01
cggcagcgagcgggu

SEQ ID NO: 1555786 - RNA, 18 nt, Pseudomonas aeruginosa PA01
cggcagcgagcgggucag

SEQ ID NO: 1555787 - RNA, 20 nt, Pseudomonas aeruginosa PA01
cggcagcgccaucaggcccu

SEQ ID NO: 1555788 - RNA, 15 nt, Pseudomonas aeruginosa PA01
cggcagcgccgccag

SEQ ID NO: 1555789 - RNA, 15 nt, Pseudomonas aeruginosa PA01
cggcagcgccgggca

SEQ ID NO: 1555790 - RNA, 15 nt, Pseudomonas aeruginosa PA01
cggcaggcggcggcg

SEQ ID NO: 1555791 - RNA, 18 nt, Pseudomonas aeruginosa PA01
cggcaggcucagcgcaug

SEQ ID NO: 1555792 - RNA, 16 nt, Pseudomonas aeruginosa PA01
cggcaggcgccggccg

SEQ ID NO: 1555793 - RNA, 17 nt, Pseudomonas aeruginosa PA01
cggcaggcgccggccgg

SEQ ID NO: 1555794 - RNA, 13 nt, Pseudomonas aeruginosa PA01
cggcaggccuucg

SEQ ID NO: 1555795 - RNA, 17 nt, Pseudomonas aeruginosa PA01
cggcaggccacggccgc

SEQ ID NO: 1555796 - RNA, 13 nt, Pseudomonas aeruginosa PA01
cggcaggccagca

SEQ ID NO: 1555797 - RNA, 17 nt, Pseudomonas aeruginosa PA01
cggcaggccagcaggua

SEQ ID NO: 1555798 - RNA, 21 nt, Pseudomonas aeruginosa PA01
cggcaggaucaggcucgagcc

SEQ ID NO: 1555799 - RNA, 10 nt, Pseudomonas aeruginosa PA01
cggcaggcaa

SEQ ID NO: 1555800 - RNA, 16 nt, Pseudomonas aeruginosa PA01
cggcaggcacgcugcc

SEQ ID NO: 1555801 - RNA, 11 nt, Pseudomonas aeruginosa PA01
cggcaggagca

SEQ ID NO: 1555802 - RNA, 13 nt, Pseudomonas aeruginosa PA01
cggcaggaacgcc

SEQ ID NO: 1555803 - RNA, 23 nt, Pseudomonas aeruginosa PA01
cggcaggaacgcccgcggcagca

SEQ ID NO: 1555804 - RNA, 20 nt, Pseudomonas aeruginosa PA01
cggcauagccgaacuccgcc

SEQ ID NO: 1555805 - RNA, 20 nt, Pseudomonas aeruginosa PA01
cggcauagaugccggccucg

SEQ ID NO: 1555806 - RNA, 16 nt, Pseudomonas aeruginosa PA01
cggcaucaccggcggg

SEQ ID NO: 1555807 - RNA, 20 nt, Pseudomonas aeruginosa PA01
cggcagggcgccgaccagcu

SEQ ID NO: 1555808 - RNA, 17 nt, Pseudomonas aeruginosa PA01
cggcagguagaccucga

SEQ ID NO: 1555809 - RNA, 21 nt, Pseudomonas aeruginosa PA01
cggcagguggcgggucggcgg

SEQ ID NO: 1555810 - RNA, 16 nt, Pseudomonas aeruginosa PA01
cggcagguggcuggcc

SEQ ID NO: 1555811 - RNA, 23 nt, Pseudomonas aeruginosa PA01
cggcagguggucguugcgcgcca

SEQ ID NO: 1555812 - RNA, 17 nt, Pseudomonas aeruginosa PA01
cggcagguucagcaggu

SEQ ID NO: 1555813 - RNA, 19 nt, Pseudomonas aeruginosa PA01
cggcagguugugguugggc

SEQ ID NO: 1555814 - RNA, 13 nt, Pseudomonas aeruginosa PA01
cggcagucgccgc

SEQ ID NO: 1555815 - RNA, 18 nt, Pseudomonas aeruginosa PA01
cggcagucccugccaggg

SEQ ID NO: 1555816 - RNA, 17 nt, Pseudomonas aeruginosa PA01
cggcaccaccagcgcgc

SEQ ID NO: 1555817 - RNA, 17 nt, Pseudomonas aeruginosa PA01
cggcaccacgugcagca

SEQ ID NO: 1555818 - RNA, 14 nt, Pseudomonas aeruginosa PA01
cggcaccaccaccg

SEQ ID NO: 1555819 - RNA, 13 nt, Pseudomonas aeruginosa PA01
cggcaccagggcu

SEQ ID NO: 1555820 - RNA, 13 nt, Pseudomonas aeruginosa PA01
cggcaccagcacg

SEQ ID NO: 1555821 - RNA, 19 nt, Pseudomonas aeruginosa PA01
cggcaccagcacguugcca

SEQ ID NO: 1555822 - RNA, 13 nt, Pseudomonas aeruginosa PA01
cggcaacaggucg

SEQ ID NO: 1555823 - RNA, 17 nt, Pseudomonas aeruginosa PA01
cggcaacaggucgaggg

SEQ ID NO: 1555824 - RNA, 14 nt, Pseudomonas aeruginosa PA01
cggcaaagccgcug

SEQ ID NO: 1555825 - RNA, 14 nt, Pseudomonas aeruginosa PA01
cggcacccggcugg

SEQ ID NO: 1555826 - RNA, 19 nt, Pseudomonas aeruginosa PA01
cggcacccucuuccgcgcu

SEQ ID NO: 1555827 - RNA, 22 nt, Pseudomonas aeruginosa PA01
cggcacccucuuccgcgcugac

SEQ ID NO: 1555828 - RNA, 17 nt, Pseudomonas aeruginosa PA01
cggcacccugaccgcga

SEQ ID NO: 1555829 - RNA, 19 nt, Pseudomonas aeruginosa PA01
cggcacgaccuucuccgac

SEQ ID NO: 1555830 - RNA, 21 nt, Pseudomonas aeruginosa PA01
cggcacgaaccauugcggccc

SEQ ID NO: 1555831 - RNA, 20 nt, Pseudomonas aeruginosa PA01
cggcaccuugcgaaaagccc

SEQ ID NO: 1555832 - RNA, 14 nt, Pseudomonas aeruginosa PA01
cggcaccugcagac

SEQ ID NO: 1555833 - RNA, 15 nt, Pseudomonas aeruginosa PA01
cggcaccugcagacg

SEQ ID NO: 1555834 - RNA, 15 nt, Pseudomonas aeruginosa PA01
cggcacuccggcaua

SEQ ID NO: 1555835 - RNA, 19 nt, Pseudomonas aeruginosa PA01
cggcacucggcgaccaccc

SEQ ID NO: 1555836 - RNA, 15 nt, Pseudomonas aeruginosa PA01
cggcacucgccgggc

SEQ ID NO: 1555837 - RNA, 16 nt, Pseudomonas aeruginosa PA01
cggcacucgccgggcg

SEQ ID NO: 1555838 - RNA, 19 nt, Pseudomonas aeruginosa PA01
cggcacgaugucgaccugg

SEQ ID NO: 1555839 - RNA, 13 nt, Pseudomonas aeruginosa PA01
cggcacuuccuug

SEQ ID NO: 1555840 - RNA, 21 nt, Pseudomonas aeruginosa PA01
cggcacuuccuuggugaucac

SEQ ID NO: 1555841 - RNA, 20 nt, Pseudomonas aeruginosa PA01
cggcacuguuccucagcccc

SEQ ID NO: 1555842 - RNA, 15 nt, Pseudomonas aeruginosa PA01
cggcagaagcuuucc

SEQ ID NO: 1555843 - RNA, 22 nt, Pseudomonas aeruginosa PA01
cggauugcguacgcccagcagc

SEQ ID NO: 1555844 - RNA, 19 nt, Pseudomonas aeruginosa PA01
cggcaaacgccgccaccaa

SEQ ID NO: 1555845 - RNA, 21 nt, Pseudomonas aeruginosa PA01
cggauugacgauggccagccc

SEQ ID NO: 1555846 - RNA, 23 nt, Pseudomonas aeruginosa PA01
cggauguaguccagcgccgcgcu

SEQ ID NO: 1555847 - RNA, 16 nt, Pseudomonas aeruginosa PA01
cggaugugcaggguca

SEQ ID NO: 1555848 - RNA, 19 nt, Pseudomonas aeruginosa PA01
cggauguucuucaccuugg

SEQ ID NO: 1555849 - RNA, 15 nt, Pseudomonas aeruginosa PA01
cggaugggcgacgac

SEQ ID NO: 1555850 - RNA, 20 nt, Pseudomonas aeruginosa PA01
cggauggcugacccgcugcu

SEQ ID NO: 1555851 - RNA, 19 nt, Pseudomonas aeruginosa PA01
cggaugcugacauccacca

SEQ ID NO: 1555852 - RNA, 23 nt, Pseudomonas aeruginosa PA01
cggaugcguugcucgcaccaggc

SEQ ID NO: 1555853 - RNA, 18 nt, Pseudomonas aeruginosa PA01
cggaugccggcgcugucu

SEQ ID NO: 1555854 - RNA, 21 nt, Pseudomonas aeruginosa PA01
cggaugccgggcgagucgauc

SEQ ID NO: 1555855 - RNA, 16 nt, Pseudomonas aeruginosa PA01
cggaugccgcgagcca

SEQ ID NO: 1555856 - RNA, 14 nt, Pseudomonas aeruginosa PA01
cggaugccgcacag

SEQ ID NO: 1555857 - RNA, 19 nt, Pseudomonas aeruginosa PA01
cggaugccgcacaggcugg

SEQ ID NO: 1555858 - RNA, 14 nt, Pseudomonas aeruginosa PA01
cggaucggcugacc

SEQ ID NO: 1555859 - RNA, 12 nt, Pseudomonas aeruginosa PA01
cggaucggucag

SEQ ID NO: 1555860 - RNA, 22 nt, Pseudomonas aeruginosa PA01
cggaucgguccccuccagguag

SEQ ID NO: 1555861 - RNA, 16 nt, Pseudomonas aeruginosa PA01
cggaucgucgcggcgc

SEQ ID NO: 1555862 - RNA, 22 nt, Pseudomonas aeruginosa PA01
cggaucuaaggggcggcucggc

SEQ ID NO: 1555863 - RNA, 19 nt, Pseudomonas aeruginosa PA01
cggaugcagucccgccagg

SEQ ID NO: 1555864 - RNA, 22 nt, Pseudomonas aeruginosa PA01
cggagaugugcgcggugacgac

SEQ ID NO: 1555865 - RNA, 13 nt, Pseudomonas aeruginosa PA01
cggaagaagcccu

SEQ ID NO: 1555866 - RNA, 14 nt, Pseudomonas aeruginosa PA01
cggagauccccucc

SEQ ID NO: 1555867 - RNA, 21 nt, Pseudomonas aeruginosa PA01
cggagauccccuccuccagca

SEQ ID NO: 1555868 - RNA, 14 nt, Pseudomonas aeruginosa PA01
cggaacuucgcaua

SEQ ID NO: 1555869 - RNA, 16 nt, Pseudomonas aeruginosa PA01
cggaacgucggccugg

SEQ ID NO: 1555870 - RNA, 19 nt, Pseudomonas aeruginosa PA01
cggaacgucggccugggug

SEQ ID NO: 1555871 - RNA, 20 nt, Pseudomonas aeruginosa PA01
cggauaacgcuucgcagcau

SEQ ID NO: 1555872 - RNA, 13 nt, Pseudomonas aeruginosa PA01
cggaucgccgccu

SEQ ID NO: 1555873 - RNA, 14 nt, Pseudomonas aeruginosa PA01
cggaucgccgccuu

SEQ ID NO: 1555874 - RNA, 14 nt, Pseudomonas aeruginosa PA01
cggaucgcccuggc

SEQ ID NO: 1555875 - RNA, 16 nt, Pseudomonas aeruginosa PA01
cggaucgaugcccggc

SEQ ID NO: 1555876 - RNA, 15 nt, Pseudomonas aeruginosa PA01
cggaucgcgcugggc

SEQ ID NO: 1555877 - RNA, 17 nt, Pseudomonas aeruginosa PA01
cggaucgcgucgcaggc

SEQ ID NO: 1555878 - RNA, 16 nt, Pseudomonas aeruginosa PA01
cggaucgaucagcagc

SEQ ID NO: 1555879 - RNA, 18 nt, Pseudomonas aeruginosa PA01
cggaucgaucagcagcac

SEQ ID NO: 1555880 - RNA, 17 nt, Pseudomonas aeruginosa PA01
cggaucgaucagcgagc

SEQ ID NO: 1555881 - RNA, 17 nt, Pseudomonas aeruginosa PA01
cggagcgaccggauggc

SEQ ID NO: 1555882 - RNA, 12 nt, Pseudomonas aeruginosa PA01
cggagccgucgg

SEQ ID NO: 1555883 - RNA, 15 nt, Pseudomonas aeruginosa PA01
cggagccgucggcuc

SEQ ID NO: 1555884 - RNA, 17 nt, Pseudomonas aeruginosa PA01
cggagccaacgcccggg

SEQ ID NO: 1555885 - RNA, 14 nt, Pseudomonas aeruginosa PA01
cggagcggcugccg

SEQ ID NO: 1555886 - RNA, 17 nt, Pseudomonas aeruginosa PA01
cggagcggcugccgagg

SEQ ID NO: 1555887 - RNA, 18 nt, Pseudomonas aeruginosa PA01
cggagcggcugccgaggc

SEQ ID NO: 1555888 - RNA, 20 nt, Pseudomonas aeruginosa PA01
cggagcugguacgcccccuc

SEQ ID NO: 1555889 - RNA, 23 nt, Pseudomonas aeruginosa PA01
cggagcgccacgcgagaagccgc

SEQ ID NO: 1555890 - RNA, 15 nt, Pseudomonas aeruginosa PA01
cgcaguagaugccgc

SEQ ID NO: 1555891 - RNA, 13 nt, Pseudomonas aeruginosa PA01
cgcaguacagcuc

SEQ ID NO: 1555892 - RNA, 14 nt, Pseudomonas aeruginosa PA01
cgcaguacccggcc

SEQ ID NO: 1555893 - RNA, 19 nt, Pseudomonas aeruginosa PA01
cgcagguucaucgccgcca

SEQ ID NO: 1555894 - RNA, 22 nt, Pseudomonas aeruginosa PA01
cgcagguugcgcuggcgcagca

SEQ ID NO: 1555895 - RNA, 19 nt, Pseudomonas aeruginosa PA01
cgcaguucgucgagggucu

SEQ ID NO: 1555896 - RNA, 22 nt, Pseudomonas aeruginosa PA01
cgcaguucgucuuccagcggcc

SEQ ID NO: 1555897 - RNA, 17 nt, Pseudomonas aeruginosa PA01
cgcagucccgcgcggcc

SEQ ID NO: 1555898 - RNA, 22 nt, Pseudomonas aeruginosa PA01
cgcaggcgcguugcuuccaggc

SEQ ID NO: 1555899 - RNA, 21 nt, Pseudomonas aeruginosa PA01
cgcaggcgcucgcgggccgcc

SEQ ID NO: 1555900 - RNA, 20 nt, Pseudomonas aeruginosa PA01
cgcaggcggaucgcccggcg

SEQ ID NO: 1555901 - RNA, 22 nt, Pseudomonas aeruginosa PA01
cgcaggcggacacgcaggcgcc

SEQ ID NO: 1555902 - RNA, 16 nt, Pseudomonas aeruginosa PA01
cgcaggugcaccgcgc

SEQ ID NO: 1555903 - RNA, 23 nt, Pseudomonas aeruginosa PA01
cgcaggcuuuccagcccggcgug

SEQ ID NO: 1555904 - RNA, 16 nt, Pseudomonas aeruginosa PA01
cgcaggcugcgggcga

SEQ ID NO: 1555905 - RNA, 23 nt, Pseudomonas aeruginosa PA01
cgcaggcuggccgagcgccgccu

SEQ ID NO: 1555906 - RNA, 20 nt, Pseudomonas aeruginosa PA01
cgcaggcugguaugcagcaa

SEQ ID NO: 1555907 - RNA, 22 nt, Pseudomonas aeruginosa PA01
cgcaggcugguaugcagcaacc

SEQ ID NO: 1555908 - RNA, 15 nt, Pseudomonas aeruginosa PA01
cgcaggcugucggcc

SEQ ID NO: 1555909 - RNA, 20 nt, Pseudomonas aeruginosa PA01
cgcaggcugucggccagccc

SEQ ID NO: 1555910 - RNA, 23 nt, Pseudomonas aeruginosa PA01
cgcaggacggauaacggcagccg

SEQ ID NO: 1555911 - RNA, 21 nt, Pseudomonas aeruginosa PA01
cgcagcggcucgugucgacuc

SEQ ID NO: 1555912 - RNA, 19 nt, Pseudomonas aeruginosa PA01
cgcagcgguaguucagucg

SEQ ID NO: 1555913 - RNA, 16 nt, Pseudomonas aeruginosa PA01
cgcagcuucugcaggg

SEQ ID NO: 1555914 - RNA, 18 nt, Pseudomonas aeruginosa PA01
cgcaggaaggcgaagccg

SEQ ID NO: 1555915 - RNA, 20 nt, Pseudomonas aeruginosa PA01
cgcagcgaucagcaccagcg

SEQ ID NO: 1555916 - RNA, 23 nt, Pseudomonas aeruginosa PA01
cgcagcgcaacgaaaagccgccc

SEQ ID NO: 1555917 - RNA, 15 nt, Pseudomonas aeruginosa PA01
cgcagcgcaagucgg

SEQ ID NO: 1555918 - RNA, 17 nt, Pseudomonas aeruginosa PA01
cgcagcggccguagcag

SEQ ID NO: 1555919 - RNA, 16 nt, Pseudomonas aeruginosa PA01
cgcagcggcagcgcca

SEQ ID NO: 1555920 - RNA, 20 nt, Pseudomonas aeruginosa PA01
cgcagcggcagcgccaggua

SEQ ID NO: 1555921 - RNA, 20 nt, Pseudomonas aeruginosa PA01
cgcagcggcaggccacggcc

SEQ ID NO: 1555922 - RNA, 13 nt, Pseudomonas aeruginosa PA01
cgcagcgcuccuu

SEQ ID NO: 1555923 - RNA, 20 nt, Pseudomonas aeruginosa PA01
cgcagcgcuccuuucccagc

SEQ ID NO: 1555924 - RNA, 18 nt, Pseudomonas aeruginosa PA01
cgcagccguuggccagca

SEQ ID NO: 1555925 - RNA, 14 nt, Pseudomonas aeruginosa PA01
cgcagccucgcgcu

SEQ ID NO: 1555926 - RNA, 15 nt, Pseudomonas aeruginosa PA01
cgcagccgcucggcc

SEQ ID NO: 1555927 - RNA, 18 nt, Pseudomonas aeruginosa PA01
cgcagccggcgaacaggu

SEQ ID NO: 1555928 - RNA, 13 nt, Pseudomonas aeruginosa PA01
cgcagccggcggc

SEQ ID NO: 1555929 - RNA, 14 nt, Pseudomonas aeruginosa PA01
cgcagccggcggcg

SEQ ID NO: 1555930 - RNA, 19 nt, Pseudomonas aeruginosa PA01
cgcagccgcaaggccaggg

SEQ ID NO: 1555931 - RNA, 17 nt, Pseudomonas aeruginosa PA01
cgcagccgcgcucggcc

SEQ ID NO: 1555932 - RNA, 13 nt, Pseudomonas aeruginosa PA01
cgcagcccuugca

SEQ ID NO: 1555933 - RNA, 13 nt, Pseudomonas aeruginosa PA01
cgcagccccgccg

SEQ ID NO: 1555934 - RNA, 16 nt, Pseudomonas aeruginosa PA01
cgcagccaggcgagga

SEQ ID NO: 1555935 - RNA, 21 nt, Pseudomonas aeruginosa PA01
cgcagccagagcuccagggcu

SEQ ID NO: 1555936 - RNA, 14 nt, Pseudomonas aeruginosa PA01
cgcagccacuggcg

SEQ ID NO: 1555937 - RNA, 19 nt, Pseudomonas aeruginosa PA01
cgcagcccaguucgcgcag

SEQ ID NO: 1555938 - RNA, 15 nt, Pseudomonas aeruginosa PA01
cgcagcccagccgcu

SEQ ID NO: 1555939 - RNA, 22 nt, Pseudomonas aeruginosa PA01
cgcagccauucgccgcgacgcu

SEQ ID NO: 1555940 - RNA, 21 nt, Pseudomonas aeruginosa PA01
cgcagccacccgcgggcagca

SEQ ID NO: 1555941 - RNA, 20 nt, Pseudomonas aeruginosa PA01
cgcagccacggcacacgucg

SEQ ID NO: 1555942 - RNA, 18 nt, Pseudomonas aeruginosa PA01
cgcagcaguaccuggcgg

SEQ ID NO: 1555943 - RNA, 14 nt, Pseudomonas aeruginosa PA01
cgcagcaggccgcu

SEQ ID NO: 1555944 - RNA, 16 nt, Pseudomonas aeruginosa PA01
cgcagcaggccgcugg

SEQ ID NO: 1555945 - RNA, 13 nt, Pseudomonas aeruginosa PA01
cgcagcagcgcca

SEQ ID NO: 1555946 - RNA, 13 nt, Pseudomonas aeruginosa PA01
cgcagcagcaggu

SEQ ID NO: 1555947 - RNA, 14 nt, Pseudomonas aeruginosa PA01
cgcagcagcucguc

SEQ ID NO: 1555948 - RNA, 13 nt, Pseudomonas aeruginosa PA01
cgcagcaggccgc

SEQ ID NO: 1555949 - RNA, 13 nt, Pseudomonas aeruginosa PA01
cgcacuuccaggc

SEQ ID NO: 1555950 - RNA, 13 nt, Pseudomonas aeruginosa PA01
cgcacuuccaggu

SEQ ID NO: 1555951 - RNA, 15 nt, Pseudomonas aeruginosa PA01
cgcacuuccucggcg

SEQ ID NO: 1555952 - RNA, 15 nt, Pseudomonas aeruginosa PA01
cgcacugguugaagc

SEQ ID NO: 1555953 - RNA, 22 nt, Pseudomonas aeruginosa PA01
cgcacuggucggccaguuccuu

SEQ ID NO: 1555954 - RNA, 14 nt, Pseudomonas aeruginosa PA01
cgcaccagcggguc

SEQ ID NO: 1555955 - RNA, 16 nt, Pseudomonas aeruginosa PA01
cgcaccagggccagga

SEQ ID NO: 1555956 - RNA, 17 nt, Pseudomonas aeruginosa PA01
cgcaccaggccaggcug

SEQ ID NO: 1555957 - RNA, 23 nt, Pseudomonas aeruginosa PA01
cgcaccauagcgagccgcgcugc

SEQ ID NO: 1555958 - RNA, 15 nt, Pseudomonas aeruginosa PA01
cgcaccauccgccgc

SEQ ID NO: 1555959 - RNA, 12 nt, Pseudomonas aeruginosa PA01
cgcaccaggugc

SEQ ID NO: 1555960 - RNA, 17 nt, Pseudomonas aeruginosa PA01
cgcacaguacgccuugc

SEQ ID NO: 1555961 - RNA, 13 nt, Pseudomonas aeruginosa PA01
cgcacagguagag

SEQ ID NO: 1555962 - RNA, 15 nt, Pseudomonas aeruginosa PA01
cgcaccacguagccg

SEQ ID NO: 1555963 - RNA, 14 nt, Pseudomonas aeruginosa PA01
cgcaccagcaggcc

SEQ ID NO: 1555964 - RNA, 16 nt, Pseudomonas aeruginosa PA01
cgcaccagcaggccga

SEQ ID NO: 1555965 - RNA, 14 nt, Pseudomonas aeruginosa PA01
cgcaccagccggcc

SEQ ID NO: 1555966 - RNA, 16 nt, Pseudomonas aeruginosa PA01
cgcaccagccggcgcu

SEQ ID NO: 1555967 - RNA, 21 nt, Pseudomonas aeruginosa PA01
cgcaccacugcaacacuuccu

SEQ ID NO: 1555968 - RNA, 13 nt, Pseudomonas aeruginosa PA01
cgcaccagcacuu

SEQ ID NO: 1555969 - RNA, 22 nt, Pseudomonas aeruginosa PA01
cgcaccucgucgagcagcgcgc

SEQ ID NO: 1555970 - RNA, 16 nt, Pseudomonas aeruginosa PA01
cgcaccucgaccgcgc

SEQ ID NO: 1555971 - RNA, 20 nt, Pseudomonas aeruginosa PA01
cgcaccucgaccgcgccggc

SEQ ID NO: 1555972 - RNA, 16 nt, Pseudomonas aeruginosa PA01
cgcaccuccucgggcg

SEQ ID NO: 1555973 - RNA, 15 nt, Pseudomonas aeruginosa PA01
cgcaccuacuaccgc

SEQ ID NO: 1555974 - RNA, 22 nt, Pseudomonas aeruginosa PA01
cgcaccuggcggucgccgccgg

SEQ ID NO: 1555975 - RNA, 22 nt, Pseudomonas aeruginosa PA01
cgcaccuuggcuugcagguagc

SEQ ID NO: 1555976 - RNA, 20 nt, Pseudomonas aeruginosa PA01
cgcaccugguggacacccug

SEQ ID NO: 1555977 - RNA, 22 nt, Pseudomonas aeruginosa PA01
cgcaccugguggacacccugcu

SEQ ID NO: 1555978 - RNA, 16 nt, Pseudomonas aeruginosa PA01
cgcacucauagcucag

SEQ ID NO: 1555979 - RNA, 14 nt, Pseudomonas aeruginosa PA01
cgcacggaggcgcu

SEQ ID NO: 1555980 - RNA, 23 nt, Pseudomonas aeruginosa PA01
cgcacggccugcaccugcucggg

SEQ ID NO: 1555981 - RNA, 23 nt, Pseudomonas aeruginosa PA01
cgcaacugcgccagccgacuggc

SEQ ID NO: 1555982 - RNA, 12 nt, Pseudomonas aeruginosa PA01
cgcaacugcggg

SEQ ID NO: 1555983 - RNA, 21 nt, Pseudomonas aeruginosa PA01
cgcaacugcggggcgcucagg

SEQ ID NO: 1555984 - RNA, 18 nt, Pseudomonas aeruginosa PA01
cgcaaguaccgccggcag

SEQ ID NO: 1555985 - RNA, 21 nt, Pseudomonas aeruginosa PA01
cgcaagugcccugggcgaaca

SEQ ID NO: 1555986 - RNA, 18 nt, Pseudomonas aeruginosa PA01
cgcaacaccuguaccuac

SEQ ID NO: 1555987 - RNA, 19 nt, Pseudomonas aeruginosa PA01
cgcaacaccuugcgcaccg

SEQ ID NO: 1555988 - RNA, 20 nt, Pseudomonas aeruginosa PA01
cgcaacgggacgccaggcgu

SEQ ID NO: 1555989 - RNA, 22 nt, Pseudomonas aeruginosa PA01
cgcaacgcgguuauccgccgcu

SEQ ID NO: 1555990 - RNA, 19 nt, Pseudomonas aeruginosa PA01
cgcaaacgccauccgccuu

SEQ ID NO: 1555991 - RNA, 18 nt, Pseudomonas aeruginosa PA01
cgaugguuucgugccauu

SEQ ID NO: 1555992 - RNA, 18 nt, Pseudomonas aeruginosa PA01
cgauguacggcaccacca

SEQ ID NO: 1555993 - RNA, 19 nt, Pseudomonas aeruginosa PA01
cgauggcgcgcuuuccggc

SEQ ID NO: 1555994 - RNA, 13 nt, Pseudomonas aeruginosa PA01
cgauggcgccgcg

SEQ ID NO: 1555995 - RNA, 19 nt, Pseudomonas aeruginosa PA01
cgauggcagccuuggccac

SEQ ID NO: 1555996 - RNA, 23 nt, Pseudomonas aeruginosa PA01
cgaugcguuugucgaccugcccc

SEQ ID NO: 1555997 - RNA, 13 nt, Pseudomonas aeruginosa PA01
cgaugcggcccgc

SEQ ID NO: 1555998 - RNA, 18 nt, Pseudomonas aeruginosa PA01
cgauggccaucagggucg

SEQ ID NO: 1555999 - RNA, 17 nt, Pseudomonas aeruginosa PA01
cgauggcccagaugauc

SEQ ID NO: 1556000 - RNA, 17 nt, Pseudomonas aeruginosa PA01
cgauggccgccagcagg

SEQ ID NO: 1556001 - RNA, 15 nt, Pseudomonas aeruginosa PA01
cgauggccggcagca

SEQ ID NO: 1556002 - RNA, 18 nt, Pseudomonas aeruginosa PA01
cgauggccggcagcagcg

SEQ ID NO: 1556003 - RNA, 13 nt, Pseudomonas aeruginosa PA01
cgauggccagcgc

SEQ ID NO: 1556004 - RNA, 12 nt, Pseudomonas aeruginosa PA01
cgauggccagcc

SEQ ID NO: 1556005 - RNA, 19 nt, Pseudomonas aeruginosa PA01
cgaugaucuccgcgccggg

SEQ ID NO: 1556006 - RNA, 17 nt, Pseudomonas aeruginosa PA01
cgaugaucuggccaccc

SEQ ID NO: 1556007 - RNA, 14 nt, Pseudomonas aeruginosa PA01
cgaugaggcugucc

SEQ ID NO: 1556008 - RNA, 20 nt, Pseudomonas aeruginosa PA01
cgaugauggucaacaccagc

SEQ ID NO: 1556009 - RNA, 16 nt, Pseudomonas aeruginosa PA01
cgaugaggucgcagcg

SEQ ID NO: 1556010 - RNA, 14 nt, Pseudomonas aeruginosa PA01
cgaugcccgccagc

SEQ ID NO: 1556011 - RNA, 19 nt, Pseudomonas aeruginosa PA01
cgaugcccgccagcaggcg

SEQ ID NO: 1556012 - RNA, 12 nt, Pseudomonas aeruginosa PA01
cgaugcccaggc

SEQ ID NO: 1556013 - RNA, 13 nt, Pseudomonas aeruginosa PA01
cgaucggcagggc

SEQ ID NO: 1556014 - RNA, 20 nt, Pseudomonas aeruginosa PA01
cgaucggcagggcgccgacc

SEQ ID NO: 1556015 - RNA, 22 nt, Pseudomonas aeruginosa PA01
cgaucucuacuaccgccagcgc

SEQ ID NO: 1556016 - RNA, 16 nt, Pseudomonas aeruginosa PA01
cgaucucggugggcuu

SEQ ID NO: 1556017 - RNA, 23 nt, Pseudomonas aeruginosa PA01
cgaucucgucgaagcgcaguacc

SEQ ID NO: 1556018 - RNA, 17 nt, Pseudomonas aeruginosa PA01
cgaucucauggucgggc

SEQ ID NO: 1556019 - RNA, 18 nt, Pseudomonas aeruginosa PA01
cgaucuccgccaggcggc

SEQ ID NO: 1556020 - RNA, 14 nt, Pseudomonas aeruginosa PA01
cgaucucccgcgau

SEQ ID NO: 1556021 - RNA, 15 nt, Pseudomonas aeruginosa PA01
cgaucucccgcgauu

SEQ ID NO: 1556022 - RNA, 20 nt, Pseudomonas aeruginosa PA01
cgaucucgaugaccuugccg

SEQ ID NO: 1556023 - RNA, 15 nt, Pseudomonas aeruginosa PA01
cgaucuccuccgccc

SEQ ID NO: 1556024 - RNA, 17 nt, Pseudomonas aeruginosa PA01
cgaucuccucgcgcagc

SEQ ID NO: 1556025 - RNA, 16 nt, Pseudomonas aeruginosa PA01
cgaucuccugccgcgg

SEQ ID NO: 1556026 - RNA, 16 nt, Pseudomonas aeruginosa PA01
cgaucuccugcugggc

SEQ ID NO: 1556027 - RNA, 20 nt, Pseudomonas aeruginosa PA01
cgaugagcaugccgcagacg

SEQ ID NO: 1556028 - RNA, 23 nt, Pseudomonas aeruginosa PA01
cgaugagccagccugcagccagc

SEQ ID NO: 1556029 - RNA, 19 nt, Pseudomonas aeruginosa PA01
cgaugaccuugccgcgaau

SEQ ID NO: 1556030 - RNA, 18 nt, Pseudomonas aeruginosa PA01
cgaugaccgccccggcag

SEQ ID NO: 1556031 - RNA, 19 nt, Pseudomonas aeruginosa PA01
cgaucuggcugcccaggcu

SEQ ID NO: 1556032 - RNA, 13 nt, Pseudomonas aeruginosa PA01
cgaucuucugcac

SEQ ID NO: 1556033 - RNA, 14 nt, Pseudomonas aeruginosa PA01
cgaugaacgcgcgg

SEQ ID NO: 1556034 - RNA, 18 nt, Pseudomonas aeruginosa PA01
cgaugaaagagcccgcgg

SEQ ID NO: 1556035 - RNA, 20 nt, Pseudomonas aeruginosa PA01
cgaucagcaccgccaccagc

SEQ ID NO: 1556036 - RNA, 15 nt, Pseudomonas aeruginosa PA01
cgaucagcagcgcca

SEQ ID NO: 1556037 - RNA, 12 nt, Pseudomonas aeruginosa PA01
cgaucagcagca

SEQ ID NO: 1556038 - RNA, 15 nt, Pseudomonas aeruginosa PA01
cgaucagcagcaccg

SEQ ID NO: 1556039 - RNA, 14 nt, Pseudomonas aeruginosa PA01
cgaucagcgcuucc

SEQ ID NO: 1556040 - RNA, 15 nt, Pseudomonas aeruginosa PA01
cgaucagcggcccga

SEQ ID NO: 1556041 - RNA, 10 nt, Pseudomonas aeruginosa PA01
cgaucagccg

SEQ ID NO: 1556042 - RNA, 16 nt, Pseudomonas aeruginosa PA01
cgaucaggccgaugcg

SEQ ID NO: 1556043 - RNA, 12 nt, Pseudomonas aeruginosa PA01
cgaucaggaaau

SEQ ID NO: 1556044 - RNA, 21 nt, Pseudomonas aeruginosa PA01
cgaucaggaaauaaccggcgu

SEQ ID NO: 1556045 - RNA, 22 nt, Pseudomonas aeruginosa PA01
cgaucaguggucgcagcuccag

SEQ ID NO: 1556046 - RNA, 23 nt, Pseudomonas aeruginosa PA01
cgaucagggccucgccacgcuuc

SEQ ID NO: 1556047 - RNA, 15 nt, Pseudomonas aeruginosa PA01
cgaucaggcgggcgu

SEQ ID NO: 1556048 - RNA, 15 nt, Pseudomonas aeruginosa PA01
cgaucagguccuggc

SEQ ID NO: 1556049 - RNA, 19 nt, Pseudomonas aeruginosa PA01
cgaucaggugcaggaacag

SEQ ID NO: 1556050 - RNA, 18 nt, Pseudomonas aeruginosa PA01
cgaucaugggggccagca

SEQ ID NO: 1556051 - RNA, 16 nt, Pseudomonas aeruginosa PA01
cgaucaucgccaccgg

SEQ ID NO: 1556052 - RNA, 15 nt, Pseudomonas aeruginosa PA01
cgaucauccagcccc

SEQ ID NO: 1556053 - RNA, 12 nt, Pseudomonas aeruginosa PA01
cgauccagaaga

SEQ ID NO: 1556054 - RNA, 21 nt, Pseudomonas aeruginosa PA01
cgaucgccucguucagcagca

SEQ ID NO: 1556055 - RNA, 20 nt, Pseudomonas aeruginosa PA01
cgaucgccagguggaagcgc

SEQ ID NO: 1556056 - RNA, 13 nt, Pseudomonas aeruginosa PA01
cgaucgccccguu

SEQ ID NO: 1556057 - RNA, 15 nt, Pseudomonas aeruginosa PA01
cgaucgaagaagcgc

SEQ ID NO: 1556058 - RNA, 22 nt, Pseudomonas aeruginosa PA01
cgaucgaagaagcgcaccaccu

SEQ ID NO: 1556059 - RNA, 14 nt, Pseudomonas aeruginosa PA01
cgaucgagcggccc

SEQ ID NO: 1556060 - RNA, 21 nt, Pseudomonas aeruginosa PA01
cgauccugaccccggccuggc

SEQ ID NO: 1556061 - RNA, 22 nt, Pseudomonas aeruginosa PA01
cgauccuccgccagccccaggc

SEQ ID NO: 1556062 - RNA, 12 nt, Pseudomonas aeruginosa PA01
cgauccagccgg

SEQ ID NO: 1556063 - RNA, 16 nt, Pseudomonas aeruginosa PA01
cgauccaggaaccggc

SEQ ID NO: 1556064 - RNA, 20 nt, Pseudomonas aeruginosa PA01
cgaucccgacgcccuccagc

SEQ ID NO: 1556065 - RNA, 14 nt, Pseudomonas aeruginosa PA01
cgaucccccgcccc

SEQ ID NO: 1556066 - RNA, 18 nt, Pseudomonas aeruginosa PA01
cgauccccaacccggcca

SEQ ID NO: 1556067 - RNA, 22 nt, Pseudomonas aeruginosa PA01
cgaucccggcggcgacccagac

SEQ ID NO: 1556068 - RNA, 14 nt, Pseudomonas aeruginosa PA01
cgaucccguagacc

SEQ ID NO: 1556069 - RNA, 14 nt, Pseudomonas aeruginosa PA01
ccuucaucccuucu

SEQ ID NO: 1556070 - RNA, 15 nt, Pseudomonas aeruginosa PA01
ccuucaucccuucuu

SEQ ID NO: 1556071 - RNA, 13 nt, Pseudomonas aeruginosa PA01
ccuucaucgccac

SEQ ID NO: 1556072 - RNA, 13 nt, Pseudomonas aeruginosa PA01
ccuucagcuccag

SEQ ID NO: 1556073 - RNA, 21 nt, Pseudomonas aeruginosa PA01
cgauaaacggcgcuuucauca

SEQ ID NO: 1556074 - RNA, 13 nt, Pseudomonas aeruginosa PA01
cgauacgcggccc

SEQ ID NO: 1556075 - RNA, 17 nt, Pseudomonas aeruginosa PA01
cgauaacaccaggagcg

SEQ ID NO: 1556076 - RNA, 21 nt, Pseudomonas aeruginosa PA01
cgauaacaccaggagcgccag

SEQ ID NO: 1556077 - RNA, 15 nt, Pseudomonas aeruginosa PA01
cgauauacaaagcau

SEQ ID NO: 1556078 - RNA, 16 nt, Pseudomonas aeruginosa PA01
cgauauaggcgacgau

SEQ ID NO: 1556079 - RNA, 18 nt, Pseudomonas aeruginosa PA01
cgauacucgugggccggu

SEQ ID NO: 1556080 - RNA, 17 nt, Pseudomonas aeruginosa PA01
cgauagaccaggaaggc

SEQ ID NO: 1556081 - RNA, 14 nt, Pseudomonas aeruginosa PA01
cgccccacagcggu

SEQ ID NO: 1556082 - RNA, 16 nt, Pseudomonas aeruginosa PA01
cgccccaccccagggu

SEQ ID NO: 1556083 - RNA, 22 nt, Pseudomonas aeruginosa PA01
cgccccagacccaggugcgcag

SEQ ID NO: 1556084 - RNA, 20 nt, Pseudomonas aeruginosa PA01
cgccccagaagccccagagc

SEQ ID NO: 1556085 - RNA, 17 nt, Pseudomonas aeruginosa PA01
cgcccauugccgggcuu

SEQ ID NO: 1556086 - RNA, 22 nt, Pseudomonas aeruginosa PA01
cgcccauguagaccaccagcgu

SEQ ID NO: 1556087 - RNA, 23 nt, Pseudomonas aeruginosa PA01
cgccccgcaaggugcgggccguc

SEQ ID NO: 1556088 - RNA, 18 nt, Pseudomonas aeruginosa PA01
cgccccgcaccagccagc

SEQ ID NO: 1556089 - RNA, 20 nt, Pseudomonas aeruginosa PA01
cgccccgcaccagccagccc

SEQ ID NO: 1556090 - RNA, 22 nt, Pseudomonas aeruginosa PA01
cgccccgcaccagccagcccgc

SEQ ID NO: 1556091 - RNA, 13 nt, Pseudomonas aeruginosa PA01
cgcccccuggccg

SEQ ID NO: 1556092 - RNA, 14 nt, Pseudomonas aeruginosa PA01
cgccccaggcgccc

SEQ ID NO: 1556093 - RNA, 15 nt, Pseudomonas aeruginosa PA01
cgccccagccucggc

SEQ ID NO: 1556094 - RNA, 12 nt, Pseudomonas aeruginosa PA01
cgccccagcgcc

SEQ ID NO: 1556095 - RNA, 13 nt, Pseudomonas aeruginosa PA01
cgccccagcgccu

SEQ ID NO: 1556096 - RNA, 18 nt, Pseudomonas aeruginosa PA01
cgccccagcgccugggcc

SEQ ID NO: 1556097 - RNA, 13 nt, Pseudomonas aeruginosa PA01
cgcccccagcgcc

SEQ ID NO: 1556098 - RNA, 14 nt, Pseudomonas aeruginosa PA01
cgcccccagcgccc

SEQ ID NO: 1556099 - RNA, 20 nt, Pseudomonas aeruginosa PA01
cgcccccagcgcgccgccga

SEQ ID NO: 1556100 - RNA, 19 nt, Pseudomonas aeruginosa PA01
cgccccggcccagccgcgg

SEQ ID NO: 1556101 - RNA, 13 nt, Pseudomonas aeruginosa PA01
cgccccggccgcg

SEQ ID NO: 1556102 - RNA, 19 nt, Pseudomonas aeruginosa PA01
cgccccggcgagcgagcgg

SEQ ID NO: 1556103 - RNA, 16 nt, Pseudomonas aeruginosa PA01
cgccccucacuccguc

SEQ ID NO: 1556104 - RNA, 20 nt, Pseudomonas aeruginosa PA01
cgccccgucuucacgacgaa

SEQ ID NO: 1556105 - RNA, 19 nt, Pseudomonas aeruginosa PA01
cgcccgagcuuugcgcagc

SEQ ID NO: 1556106 - RNA, 23 nt, Pseudomonas aeruginosa PA01
cgcccgagcuuugcgcagccacc

SEQ ID NO: 1556107 - RNA, 17 nt, Pseudomonas aeruginosa PA01
cgccccucccagccaca

SEQ ID NO: 1556108 - RNA, 22 nt, Pseudomonas aeruginosa PA01
cgcccgaccccacgccggccgg

SEQ ID NO: 1556109 - RNA, 22 nt, Pseudomonas aeruginosa PA01
cgcccggcuucggcggcgcgcu

SEQ ID NO: 1556110 - RNA, 19 nt, Pseudomonas aeruginosa PA01
cgcccggguugccguagcg

SEQ ID NO: 1556111 - RNA, 22 nt, Pseudomonas aeruginosa PA01
cgcccggcgcgaccgucggccg

SEQ ID NO: 1556112 - RNA, 13 nt, Pseudomonas aeruginosa PA01
cgcccggcgcccu

SEQ ID NO: 1556113 - RNA, 14 nt, Pseudomonas aeruginosa PA01
cgcccggcgccacc

SEQ ID NO: 1556114 - RNA, 16 nt, Pseudomonas aeruginosa PA01
cgcccggcgccacccc

SEQ ID NO: 1556115 - RNA, 14 nt, Pseudomonas aeruginosa PA01
cgcccggcgcucca

SEQ ID NO: 1556116 - RNA, 19 nt, Pseudomonas aeruginosa PA01
cgcccggcucgccgccggg

SEQ ID NO: 1556117 - RNA, 22 nt, Pseudomonas aeruginosa PA01
cgcccgcucaagggcuggcagg

SEQ ID NO: 1556118 - RNA, 19 nt, Pseudomonas aeruginosa PA01
cgcccgcuugcgccgccuc

SEQ ID NO: 1556119 - RNA, 21 nt, Pseudomonas aeruginosa PA01
cgcccggaaaaaaaagcccgc

SEQ ID NO: 1556120 - RNA, 17 nt, Pseudomonas aeruginosa PA01
cgcccggcagcggcugg

SEQ ID NO: 1556121 - RNA, 18 nt, Pseudomonas aeruginosa PA01
cgcccggcagcggcuggc

SEQ ID NO: 1556122 - RNA, 23 nt, Pseudomonas aeruginosa PA01
cgcccggccuccccggcccgcgc

SEQ ID NO: 1556123 - RNA, 13 nt, Pseudomonas aeruginosa PA01
cgcccggccuuca

SEQ ID NO: 1556124 - RNA, 23 nt, Pseudomonas aeruginosa PA01
cgcccggccuucaccgcgccgcg

SEQ ID NO: 1556125 - RNA, 21 nt, Pseudomonas aeruginosa PA01
cgcccggcgaacagcgcuucc

SEQ ID NO: 1556126 - RNA, 13 nt, Pseudomonas aeruginosa PA01
cgcccggccaggc

SEQ ID NO: 1556127 - RNA, 21 nt, Pseudomonas aeruginosa PA01
cgcccgcaguuccucgccgcu

SEQ ID NO: 1556128 - RNA, 14 nt, Pseudomonas aeruginosa PA01
cgcccgccgcgagc

SEQ ID NO: 1556129 - RNA, 13 nt, Pseudomonas aeruginosa PA01
cgcccgccgcgag

SEQ ID NO: 1556130 - RNA, 13 nt, Pseudomonas aeruginosa PA01
cgcccgccgccug

SEQ ID NO: 1556131 - RNA, 11 nt, Pseudomonas aeruginosa PA01
cgcccgcagcc

SEQ ID NO: 1556132 - RNA, 19 nt, Pseudomonas aeruginosa PA01
cgcccgccacggcgcgcuc

SEQ ID NO: 1556133 - RNA, 20 nt, Pseudomonas aeruginosa PA01
cgcccgccaagggcgccgcc

SEQ ID NO: 1556134 - RNA, 22 nt, Pseudomonas aeruginosa PA01
cgcccgccaagggcgccgccga

SEQ ID NO: 1556135 - RNA, 19 nt, Pseudomonas aeruginosa PA01
cgcccgcggaccgggcggc

SEQ ID NO: 1556136 - RNA, 13 nt, Pseudomonas aeruginosa PA01
cgcccgcggcagc

SEQ ID NO: 1556137 - RNA, 13 nt, Pseudomonas aeruginosa PA01
cgcccgcggcggc

SEQ ID NO: 1556138 - RNA, 19 nt, Pseudomonas aeruginosa PA01
cgcccgcggcggcgacgcu

SEQ ID NO: 1556139 - RNA, 12 nt, Pseudomonas aeruginosa PA01
cgcccgcggcgu

SEQ ID NO: 1556140 - RNA, 15 nt, Pseudomonas aeruginosa PA01
cgcccgcgggcagcu

SEQ ID NO: 1556141 - RNA, 12 nt, Pseudomonas aeruginosa PA01
cgcccgcccggc

SEQ ID NO: 1556142 - RNA, 23 nt, Pseudomonas aeruginosa PA01
cgcccgccuuguucgccagcacc

SEQ ID NO: 1556143 - RNA, 19 nt, Pseudomonas aeruginosa PA01
cgcccgcgagccguccugc

SEQ ID NO: 1556144 - RNA, 11 nt, Pseudomonas aeruginosa PA01
cgcccgcgcau

SEQ ID NO: 1556145 - RNA, 16 nt, Pseudomonas aeruginosa PA01
cgccaugacccgcggc

SEQ ID NO: 1556146 - RNA, 17 nt, Pseudomonas aeruginosa PA01
cgccaucgcucaccgga

SEQ ID NO: 1556147 - RNA, 18 nt, Pseudomonas aeruginosa PA01
cgccaucgcuuuccuggc

SEQ ID NO: 1556148 - RNA, 21 nt, Pseudomonas aeruginosa PA01
cgcccaacgucuucaggcgcu

SEQ ID NO: 1556149 - RNA, 15 nt, Pseudomonas aeruginosa PA01
cgcccaacccccugu

SEQ ID NO: 1556150 - RNA, 18 nt, Pseudomonas aeruginosa PA01
cgcccaaugcaucggccg

SEQ ID NO: 1556151 - RNA, 18 nt, Pseudomonas aeruginosa PA01
cgccaugcucggccagcu

SEQ ID NO: 1556152 - RNA, 23 nt, Pseudomonas aeruginosa PA01
cgccaugcuguugccguggcggc

SEQ ID NO: 1556153 - RNA, 23 nt, Pseudomonas aeruginosa PA01
cgccaugccguucaggccggcgc

SEQ ID NO: 1556154 - RNA, 18 nt, Pseudomonas aeruginosa PA01
cgccaugcgcccgcugaa

SEQ ID NO: 1556155 - RNA, 17 nt, Pseudomonas aeruginosa PA01
cgcccagcagggccagc

SEQ ID NO: 1556156 - RNA, 21 nt, Pseudomonas aeruginosa PA01
cgcccagcagcaggccggcga

SEQ ID NO: 1556157 - RNA, 12 nt, Pseudomonas aeruginosa PA01
cgcccagccaga

SEQ ID NO: 1556158 - RNA, 13 nt, Pseudomonas aeruginosa PA01
cgcccagccagag

SEQ ID NO: 1556159 - RNA, 14 nt, Pseudomonas aeruginosa PA01
cgcccagccagagc

SEQ ID NO: 1556160 - RNA, 15 nt, Pseudomonas aeruginosa PA01
cgcccagcgcagccu

SEQ ID NO: 1556161 - RNA, 19 nt, Pseudomonas aeruginosa PA01
cgcccagcgcagccugcug

SEQ ID NO: 1556162 - RNA, 15 nt, Pseudomonas aeruginosa PA01
cgcccagcaccacag

SEQ ID NO: 1556163 - RNA, 16 nt, Pseudomonas aeruginosa PA01
cgcccagcaccacagc

SEQ ID NO: 1556164 - RNA, 18 nt, Pseudomonas aeruginosa PA01
cgcccagaguucgcccag

SEQ ID NO: 1556165 - RNA, 15 nt, Pseudomonas aeruginosa PA01
cgcccagcagcacca

SEQ ID NO: 1556166 - RNA, 11 nt, Pseudomonas aeruginosa PA01
cgcccagcagc

SEQ ID NO: 1556167 - RNA, 18 nt, Pseudomonas aeruginosa PA01
cgcccagcaggcgcgccc

SEQ ID NO: 1556168 - RNA, 19 nt, Pseudomonas aeruginosa PA01
cgcccagcaggcgcgcccu

SEQ ID NO: 1556169 - RNA, 14 nt, Pseudomonas aeruginosa PA01
cgcccacgccuugc

SEQ ID NO: 1556170 - RNA, 11 nt, Pseudomonas aeruginosa PA01
cgcccacgggc

SEQ ID NO: 1556171 - RNA, 20 nt, Pseudomonas aeruginosa PA01
cgcccagggggccgggccga

SEQ ID NO: 1556172 - RNA, 18 nt, Pseudomonas aeruginosa PA01
cgcccagggcguggucgg

SEQ ID NO: 1556173 - RNA, 11 nt, Pseudomonas aeruginosa PA01
cgcccaggcug

SEQ ID NO: 1556174 - RNA, 18 nt, Pseudomonas aeruginosa PA01
cgcccaggcugccgccgc

SEQ ID NO: 1556175 - RNA, 20 nt, Pseudomonas aeruginosa PA01
cgcccaggugcgagucaccc

SEQ ID NO: 1556176 - RNA, 15 nt, Pseudomonas aeruginosa PA01
cgcccaggcgcaccu

SEQ ID NO: 1556177 - RNA, 22 nt, Pseudomonas aeruginosa PA01
cgcccaggacaacgacagcccc

SEQ ID NO: 1556178 - RNA, 12 nt, Pseudomonas aeruginosa PA01
cgcccagugguu

SEQ ID NO: 1556179 - RNA, 20 nt, Pseudomonas aeruginosa PA01
cgcccaguugcgccgccugc

SEQ ID NO: 1556180 - RNA, 17 nt, Pseudomonas aeruginosa PA01
cgcccaguugcgggccu

SEQ ID NO: 1556181 - RNA, 17 nt, Pseudomonas aeruginosa PA01
cgcccaguucgccggcc

SEQ ID NO: 1556182 - RNA, 20 nt, Pseudomonas aeruginosa PA01
cgcccaguucgccggccagc

SEQ ID NO: 1556183 - RNA, 18 nt, Pseudomonas aeruginosa PA01
cgcccaguucgcgcggag

SEQ ID NO: 1556184 - RNA, 15 nt, Pseudomonas aeruginosa PA01
cgcccaguccugggu

SEQ ID NO: 1556185 - RNA, 17 nt, Pseudomonas aeruginosa PA01
cgcccaguaccgccacg

SEQ ID NO: 1556186 - RNA, 20 nt, Pseudomonas aeruginosa PA01
cgcccaugccuugcagcgcc

SEQ ID NO: 1556187 - RNA, 14 nt, Pseudomonas aeruginosa PA01
cgcccaugcgcggc

SEQ ID NO: 1556188 - RNA, 16 nt, Pseudomonas aeruginosa PA01
cgcccaugcgcggcga

SEQ ID NO: 1556189 - RNA, 21 nt, Pseudomonas aeruginosa PA01
cgcccaugccgcccggccgcu

SEQ ID NO: 1556190 - RNA, 20 nt, Pseudomonas aeruginosa PA01
cgcccaugaaaaagccccgc

SEQ ID NO: 1556191 - RNA, 20 nt, Pseudomonas aeruginosa PA01
cgcccaucggcgucggcugg

SEQ ID NO: 1556192 - RNA, 16 nt, Pseudomonas aeruginosa PA01
cgcccaucgccagggu

SEQ ID NO: 1556193 - RNA, 18 nt, Pseudomonas aeruginosa PA01
cgccagccagagcagcgu

SEQ ID NO: 1556194 - RNA, 17 nt, Pseudomonas aeruginosa PA01
cgccagccagcgcggcu

SEQ ID NO: 1556195 - RNA, 18 nt, Pseudomonas aeruginosa PA01
cgccagcaggucgcgcug

SEQ ID NO: 1556196 - RNA, 19 nt, Pseudomonas aeruginosa PA01
cgccagcaggucggccugc

SEQ ID NO: 1556197 - RNA, 22 nt, Pseudomonas aeruginosa PA01
cgccagcaggucggccugcugc

SEQ ID NO: 1556198 - RNA, 17 nt, Pseudomonas aeruginosa PA01
cgccagcaggcgccggc

SEQ ID NO: 1556199 - RNA, 21 nt, Pseudomonas aeruginosa PA01
cgccagccccaggcgcggcgu

SEQ ID NO: 1556200 - RNA, 14 nt, Pseudomonas aeruginosa PA01
cgccaccuucccaa

SEQ ID NO: 1556201 - RNA, 22 nt, Pseudomonas aeruginosa PA01
cgccaccuugcgucccugggcc

SEQ ID NO: 1556202 - RNA, 17 nt, Pseudomonas aeruginosa PA01
cgccagcaggaucggag

SEQ ID NO: 1556203 - RNA, 14 nt, Pseudomonas aeruginosa PA01
cgccagcaccgugg

SEQ ID NO: 1556204 - RNA, 23 nt, Pseudomonas aeruginosa PA01
cgccagcaccguggucagcacca

SEQ ID NO: 1556205 - RNA, 16 nt, Pseudomonas aeruginosa PA01
cgccacgugcacgccg

SEQ ID NO: 1556206 - RNA, 22 nt, Pseudomonas aeruginosa PA01
cgccacugauaccgcuggccag

SEQ ID NO: 1556207 - RNA, 13 nt, Pseudomonas aeruginosa PA01
cgccacucggcgu

SEQ ID NO: 1556208 - RNA, 22 nt, Pseudomonas aeruginosa PA01
cgccacagaucgccagcucgcc

SEQ ID NO: 1556209 - RNA, 22 nt, Pseudomonas aeruginosa PA01
cgccacaggcguuauccgccgc

SEQ ID NO: 1556210 - RNA, 14 nt, Pseudomonas aeruginosa PA01
cgccaccugccccg

SEQ ID NO: 1556211 - RNA, 15 nt, Pseudomonas aeruginosa PA01
cgccaccugccccgg

SEQ ID NO: 1556212 - RNA, 16 nt, Pseudomonas aeruginosa PA01
cgccaccugccccggg

SEQ ID NO: 1556213 - RNA, 20 nt, Pseudomonas aeruginosa PA01
cgccaccugccccgggcgcc

SEQ ID NO: 1556214 - RNA, 13 nt, Pseudomonas aeruginosa PA01
cgccaccgcggau

SEQ ID NO: 1556215 - RNA, 15 nt, Pseudomonas aeruginosa PA01
cgccaccgcgcgccc

SEQ ID NO: 1556216 - RNA, 19 nt, Pseudomonas aeruginosa PA01
cgccaccgcguugacgcgg

SEQ ID NO: 1556217 - RNA, 20 nt, Pseudomonas aeruginosa PA01
cgccaccagcagggccaggc

SEQ ID NO: 1556218 - RNA, 14 nt, Pseudomonas aeruginosa PA01
cgccaccagccagg

SEQ ID NO: 1556219 - RNA, 13 nt, Pseudomonas aeruginosa PA01
cgccagucggccu

SEQ ID NO: 1556220 - RNA, 17 nt, Pseudomonas aeruginosa PA01
cgccagguggaagcgcg

SEQ ID NO: 1556221 - RNA, 13 nt, Pseudomonas aeruginosa PA01
cgccagguugcgc

SEQ ID NO: 1556222 - RNA, 22 nt, Pseudomonas aeruginosa PA01
cgccagguugcgcaaccagcgc

SEQ ID NO: 1556223 - RNA, 19 nt, Pseudomonas aeruginosa PA01
cgccagguuggccuggccc

SEQ ID NO: 1556224 - RNA, 16 nt, Pseudomonas aeruginosa PA01
cgccagguagccugga

SEQ ID NO: 1556225 - RNA, 20 nt, Pseudomonas aeruginosa PA01
cgccaggugcaggaagcgcc

SEQ ID NO: 1556226 - RNA, 23 nt, Pseudomonas aeruginosa PA01
cgccagguaauagccguugaggc

SEQ ID NO: 1556227 - RNA, 14 nt, Pseudomonas aeruginosa PA01
cgccagguccaggc

SEQ ID NO: 1556228 - RNA, 16 nt, Pseudomonas aeruginosa PA01
cgccagguccgccugg

SEQ ID NO: 1556229 - RNA, 23 nt, Pseudomonas aeruginosa PA01
cgccagguccgccugguccagca

SEQ ID NO: 1556230 - RNA, 16 nt, Pseudomonas aeruginosa PA01
cgccaggucgagggca

SEQ ID NO: 1556231 - RNA, 16 nt, Pseudomonas aeruginosa PA01
cgccagguaguccagc

SEQ ID NO: 1556232 - RNA, 20 nt, Pseudomonas aeruginosa PA01
cgccagggucagcucgacag

SEQ ID NO: 1556233 - RNA, 14 nt, Pseudomonas aeruginosa PA01
cgccagggccaggg

SEQ ID NO: 1556234 - RNA, 21 nt, Pseudomonas aeruginosa PA01
cgccagggccagggaaaucag

SEQ ID NO: 1556235 - RNA, 16 nt, Pseudomonas aeruginosa PA01
cgccagggacgcgcag

SEQ ID NO: 1556236 - RNA, 22 nt, Pseudomonas aeruginosa PA01
cgccagggacgcgcagcggcgc

SEQ ID NO: 1556237 - RNA, 15 nt, Pseudomonas aeruginosa PA01
cgccagggagcagga

SEQ ID NO: 1556238 - RNA, 23 nt, Pseudomonas aeruginosa PA01
cgccagggagcaggacgccgaac

SEQ ID NO: 1556239 - RNA, 20 nt, Pseudomonas aeruginosa PA01
cgccagggcgcucaccgagg

SEQ ID NO: 1556240 - RNA, 19 nt, Pseudomonas aeruginosa PA01
cgccagggggaucgcgaag

SEQ ID NO: 1556241 - RNA, 15 nt, Pseudomonas aeruginosa PA01
cgccauaggcggcgc

SEQ ID NO: 1556242 - RNA, 20 nt, Pseudomonas aeruginosa PA01
cgccauaggcggcgcagacg

SEQ ID NO: 1556243 - RNA, 22 nt, Pseudomonas aeruginosa PA01
cgccauaccggcaaggcggccu

SEQ ID NO: 1556244 - RNA, 18 nt, Pseudomonas aeruginosa PA01
cgccauaggccagcaccu

SEQ ID NO: 1556245 - RNA, 19 nt, Pseudomonas aeruginosa PA01
cgccauaggccagcaccuc

SEQ ID NO: 1556246 - RNA, 18 nt, Pseudomonas aeruginosa PA01
cgccaguucucgcagcag

SEQ ID NO: 1556247 - RNA, 22 nt, Pseudomonas aeruginosa PA01
cgccaguuccuucgccgaaagc

SEQ ID NO: 1556248 - RNA, 19 nt, Pseudomonas aeruginosa PA01
cgccaguucggccaucagc

SEQ ID NO: 1556249 - RNA, 21 nt, Pseudomonas aeruginosa PA01
cgccaguugcuugaucgccag

SEQ ID NO: 1556250 - RNA, 17 nt, Pseudomonas aeruginosa PA01
cgccaguuggacgcggc

SEQ ID NO: 1556251 - RNA, 13 nt, Pseudomonas aeruginosa PA01
cgccaguuccggc

SEQ ID NO: 1556252 - RNA, 23 nt, Pseudomonas aeruginosa PA01
cgccaguuccggggucagcgccu

SEQ ID NO: 1556253 - RNA, 24 nt, Pseudomonas aeruginosa PA01
cgccagugccugcaccacgcaggc

SEQ ID NO: 1556254 - RNA, 14 nt, Pseudomonas aeruginosa PA01
cgccaggccgccga

SEQ ID NO: 1556255 - RNA, 15 nt, Pseudomonas aeruginosa PA01
cgccaggccgcgcag

SEQ ID NO: 1556256 - RNA, 16 nt, Pseudomonas aeruginosa PA01
cgccaggcccggcgcu

SEQ ID NO: 1556257 - RNA, 19 nt, Pseudomonas aeruginosa PA01
cgccaggcccggcgcugcu

SEQ ID NO: 1556258 - RNA, 19 nt, Pseudomonas aeruginosa PA01
cgccaggcagaccugcagc

SEQ ID NO: 1556259 - RNA, 20 nt, Pseudomonas aeruginosa PA01
cgccaggcagaccugcagca

SEQ ID NO: 1556260 - RNA, 19 nt, Pseudomonas aeruginosa PA01
cgccaggcuuuccgccgag

SEQ ID NO: 1556261 - RNA, 17 nt, Pseudomonas aeruginosa PA01
cgccaggcgugcagacc

SEQ ID NO: 1556262 - RNA, 16 nt, Pseudomonas aeruginosa PA01
cgccaggcguuccagc

SEQ ID NO: 1556263 - RNA, 14 nt, Pseudomonas aeruginosa PA01
cgccaggcggccga

SEQ ID NO: 1556264 - RNA, 14 nt, Pseudomonas aeruginosa PA01
cgccaggcggccgc

SEQ ID NO: 1556265 - RNA, 13 nt, Pseudomonas aeruginosa PA01
cgccaggcgccga

SEQ ID NO: 1556266 - RNA, 22 nt, Pseudomonas aeruginosa PA01
cgccaggccguagaccaccagc

SEQ ID NO: 1556267 - RNA, 22 nt, Pseudomonas aeruginosa PA01
cgccaggcgcgguugccgcugc

SEQ ID NO: 1556268 - RNA, 21 nt, Pseudomonas aeruginosa PA01
cgccagcuaccggcaggguca

SEQ ID NO: 1556269 - RNA, 20 nt, Pseudomonas aeruginosa PA01
cgccagcucgaacagcaccg

SEQ ID NO: 1556270 - RNA, 17 nt, Pseudomonas aeruginosa PA01
cgccagcucgccgcgcu

SEQ ID NO: 1556271 - RNA, 23 nt, Pseudomonas aeruginosa PA01
cgccagcucggccggcaggcugu

SEQ ID NO: 1556272 - RNA, 18 nt, Pseudomonas aeruginosa PA01
cgccaggaacgccucugc

SEQ ID NO: 1556273 - RNA, 18 nt, Pseudomonas aeruginosa PA01
cgccaggaagccgcgccc

SEQ ID NO: 1556274 - RNA, 22 nt, Pseudomonas aeruginosa PA01
cgccaggaagccgcgccccagc

SEQ ID NO: 1556275 - RNA, 16 nt, Pseudomonas aeruginosa PA01
cgccaggacucgccau

SEQ ID NO: 1556276 - RNA, 18 nt, Pseudomonas aeruginosa PA01
cgccaggagcagggcgcc

SEQ ID NO: 1556277 - RNA, 15 nt, Pseudomonas aeruginosa PA01
cgccaggaucggcau

SEQ ID NO: 1556278 - RNA, 18 nt, Pseudomonas aeruginosa PA01
cgccaggaccauuugcgc

SEQ ID NO: 1556279 - RNA, 17 nt, Pseudomonas aeruginosa PA01
cgccaggaccuccugca

SEQ ID NO: 1556280 - RNA, 14 nt, Pseudomonas aeruginosa PA01
cgccaggaccucga

SEQ ID NO: 1556281 - RNA, 17 nt, Pseudomonas aeruginosa PA01
cgccagcgguacccgcc

SEQ ID NO: 1556282 - RNA, 19 nt, Pseudomonas aeruginosa PA01
cgccagcgguacccgccgg

SEQ ID NO: 1556283 - RNA, 15 nt, Pseudomonas aeruginosa PA01
cgccagcgguucagg

SEQ ID NO: 1556284 - RNA, 20 nt, Pseudomonas aeruginosa PA01
cgccagcggcgaucgccugg

SEQ ID NO: 1556285 - RNA, 21 nt, Pseudomonas aeruginosa PA01
cgccagcggcauucgaacggc

SEQ ID NO: 1556286 - RNA, 15 nt, Pseudomonas aeruginosa PA01
cgccagcgcggcgcu

SEQ ID NO: 1556287 - RNA, 23 nt, Pseudomonas aeruginosa PA01
cgccagcgccggccauugccgcc

SEQ ID NO: 1556288 - RNA, 16 nt, Pseudomonas aeruginosa PA01
cgccagcgccagcagg

SEQ ID NO: 1556289 - RNA, 15 nt, Pseudomonas aeruginosa PA01
cgccagcgccgccag

SEQ ID NO: 1556290 - RNA, 16 nt, Pseudomonas aeruginosa PA01
cgccagcgccacggcg

SEQ ID NO: 1556291 - RNA, 22 nt, Pseudomonas aeruginosa PA01
cgccgauguacggcaccaccac

SEQ ID NO: 1556292 - RNA, 12 nt, Pseudomonas aeruginosa PA01
cgccgaugcugu

SEQ ID NO: 1556293 - RNA, 20 nt, Pseudomonas aeruginosa PA01
cgccgaugucguagccgcgc

SEQ ID NO: 1556294 - RNA, 17 nt, Pseudomonas aeruginosa PA01
cgccgaugcgcuacggc

SEQ ID NO: 1556295 - RNA, 21 nt, Pseudomonas aeruginosa PA01
cgccgaugcgcuacggcauca

SEQ ID NO: 1556296 - RNA, 13 nt, Pseudomonas aeruginosa PA01
cgccgaucuccuc

SEQ ID NO: 1556297 - RNA, 17 nt, Pseudomonas aeruginosa PA01
cgccgaucuccuccgcc

SEQ ID NO: 1556298 - RNA, 17 nt, Pseudomonas aeruginosa PA01
cgccgaugaaagagccc

SEQ ID NO: 1556299 - RNA, 15 nt, Pseudomonas aeruginosa PA01
cgccgaucaccagga

SEQ ID NO: 1556300 - RNA, 13 nt, Pseudomonas aeruginosa PA01
cgccgaucccggc

SEQ ID NO: 1556301 - RNA, 16 nt, Pseudomonas aeruginosa PA01
cgccgaucccggcggc

SEQ ID NO: 1556302 - RNA, 12 nt, Pseudomonas aeruginosa PA01
cgccgaucaggc

SEQ ID NO: 1556303 - RNA, 22 nt, Pseudomonas aeruginosa PA01
cgccgaggaacauccgcggccc

SEQ ID NO: 1556304 - RNA, 18 nt, Pseudomonas aeruginosa PA01
cgccgaggaagccgaccg

SEQ ID NO: 1556305 - RNA, 22 nt, Pseudomonas aeruginosa PA01
cgccgaggaagccgaccggcgc

SEQ ID NO: 1556306 - RNA, 19 nt, Pseudomonas aeruginosa PA01
cgccgagcugaccaccagg

SEQ ID NO: 1556307 - RNA, 18 nt, Pseudomonas aeruginosa PA01
cgccgagcuggcgcgcgu

SEQ ID NO: 1556308 - RNA, 14 nt, Pseudomonas aeruginosa PA01
cgccgaggcggcgc

SEQ ID NO: 1556309 - RNA, 15 nt, Pseudomonas aeruginosa PA01
cgccgaggcggcgca

SEQ ID NO: 1556310 - RNA, 22 nt, Pseudomonas aeruginosa PA01
cgccgaggcccagcgacuccgc

SEQ ID NO: 1556311 - RNA, 22 nt, Pseudomonas aeruginosa PA01
cgccgagggcuguaaucgccgc

SEQ ID NO: 1556312 - RNA, 15 nt, Pseudomonas aeruginosa PA01
cgccgagggcgcggc

SEQ ID NO: 1556313 - RNA, 18 nt, Pseudomonas aeruginosa PA01
cgccgagggcgcggcgcc

SEQ ID NO: 1556314 - RNA, 18 nt, Pseudomonas aeruginosa PA01
cgccgagggcaagguagu

SEQ ID NO: 1556315 - RNA, 15 nt, Pseudomonas aeruginosa PA01
cgccgagguugcugc

SEQ ID NO: 1556316 - RNA, 16 nt, Pseudomonas aeruginosa PA01
cgccgccaacuggcug

SEQ ID NO: 1556317 - RNA, 21 nt, Pseudomonas aeruginosa PA01
cgccgccaccgccaccgccgg

SEQ ID NO: 1556318 - RNA, 15 nt, Pseudomonas aeruginosa PA01
cgccgcagggcccau

SEQ ID NO: 1556319 - RNA, 24 nt, Pseudomonas aeruginosa PA01
cgccgcauuggccaggccccaggc

SEQ ID NO: 1556320 - RNA, 17 nt, Pseudomonas aeruginosa PA01
cgccgauugcaugaccu

SEQ ID NO: 1556321 - RNA, 18 nt, Pseudomonas aeruginosa PA01
cgccgauugugcagggcc

SEQ ID NO: 1556322 - RNA, 16 nt, Pseudomonas aeruginosa PA01
cgccgcaaccgcccga

SEQ ID NO: 1556323 - RNA, 21 nt, Pseudomonas aeruginosa PA01
cgccgcaaguggcggcugaag

SEQ ID NO: 1556324 - RNA, 17 nt, Pseudomonas aeruginosa PA01
cgccgcacaccgcgcgc

SEQ ID NO: 1556325 - RNA, 21 nt, Pseudomonas aeruginosa PA01
cgccgcagcgcaagucggccu

SEQ ID NO: 1556326 - RNA, 16 nt, Pseudomonas aeruginosa PA01
cgccgcagcucggccu

SEQ ID NO: 1556327 - RNA, 14 nt, Pseudomonas aeruginosa PA01
cgccgcaccggcga

SEQ ID NO: 1556328 - RNA, 15 nt, Pseudomonas aeruginosa PA01
cgccgccgcgugggc

SEQ ID NO: 1556329 - RNA, 21 nt, Pseudomonas aeruginosa PA01
cgccgccgcgcuucaggcagu

SEQ ID NO: 1556330 - RNA, 13 nt, Pseudomonas aeruginosa PA01
cgccgccgcgcgc

SEQ ID NO: 1556331 - RNA, 13 nt, Pseudomonas aeruginosa PA01
cgccgccgcgccg

SEQ ID NO: 1556332 - RNA, 15 nt, Pseudomonas aeruginosa PA01
cgccgccgagcaggc

SEQ ID NO: 1556333 - RNA, 17 nt, Pseudomonas aeruginosa PA01
cgccgccgagcaggccc

SEQ ID NO: 1556334 - RNA, 14 nt, Pseudomonas aeruginosa PA01
cgccgccgagcgcc

SEQ ID NO: 1556335 - RNA, 14 nt, Pseudomonas aeruginosa PA01
cgccgccgagggca

SEQ ID NO: 1556336 - RNA, 16 nt, Pseudomonas aeruginosa PA01
cgccgccgucuuccuc

SEQ ID NO: 1556337 - RNA, 21 nt, Pseudomonas aeruginosa PA01
cgccgccgguaucccggcuga

SEQ ID NO: 1556338 - RNA, 21 nt, Pseudomonas aeruginosa PA01
cgccgccggugaacagguagc

SEQ ID NO: 1556339 - RNA, 19 nt, Pseudomonas aeruginosa PA01
cgccgccggugcaccaggc

SEQ ID NO: 1556340 - RNA, 13 nt, Pseudomonas aeruginosa PA01
cgccgccgggcuu

SEQ ID NO: 1556341 - RNA, 13 nt, Pseudomonas aeruginosa PA01
cgccgccgggcgu

SEQ ID NO: 1556342 - RNA, 18 nt, Pseudomonas aeruginosa PA01
cgccgccgggcgcgcgcc

SEQ ID NO: 1556343 - RNA, 14 nt, Pseudomonas aeruginosa PA01
cgccgccgggcgcc

SEQ ID NO: 1556344 - RNA, 21 nt, Pseudomonas aeruginosa PA01
cgccgccggcguuauccgccg

SEQ ID NO: 1556345 - RNA, 12 nt, Pseudomonas aeruginosa PA01
cgccgccggcga

SEQ ID NO: 1556346 - RNA, 15 nt, Pseudomonas aeruginosa PA01
cgccgccgaccgggc

SEQ ID NO: 1556347 - RNA, 21 nt, Pseudomonas aeruginosa PA01
cgccgccgacacccgcgccgc

SEQ ID NO: 1556348 - RNA, 14 nt, Pseudomonas aeruginosa PA01
cgccgcccggcagc

SEQ ID NO: 1556349 - RNA, 15 nt, Pseudomonas aeruginosa PA01
cgccgcccggcagcg

SEQ ID NO: 1556350 - RNA, 16 nt, Pseudomonas aeruginosa PA01
cgccgcccggcucgcc

SEQ ID NO: 1556351 - RNA, 17 nt, Pseudomonas aeruginosa PA01
cgccgcccgucgcgccg

SEQ ID NO: 1556352 - RNA, 18 nt, Pseudomonas aeruginosa PA01
cgccgcccgucgcgccgg

SEQ ID NO: 1556353 - RNA, 15 nt, Pseudomonas aeruginosa PA01
cgccgccccagcaac

SEQ ID NO: 1556354 - RNA, 15 nt, Pseudomonas aeruginosa PA01
cgccgcccccagcgc

SEQ ID NO: 1556355 - RNA, 13 nt, Pseudomonas aeruginosa PA01
cgccgcccagcag

SEQ ID NO: 1556356 - RNA, 14 nt, Pseudomonas aeruginosa PA01
cgccgcccagcagc

SEQ ID NO: 1556357 - RNA, 18 nt, Pseudomonas aeruginosa PA01
cgccgccaguucgcgcag

SEQ ID NO: 1556358 - RNA, 19 nt, Pseudomonas aeruginosa PA01
cgccgccaguucgcgcagg

SEQ ID NO: 1556359 - RNA, 13 nt, Pseudomonas aeruginosa PA01
cgccgccaggcag

SEQ ID NO: 1556360 - RNA, 23 nt, Pseudomonas aeruginosa PA01
cgccgccaggcaggccgggcugg

SEQ ID NO: 1556361 - RNA, 13 nt, Pseudomonas aeruginosa PA01
cgccgccaggccc

SEQ ID NO: 1556362 - RNA, 14 nt, Pseudomonas aeruginosa PA01
cgccgccagccaga

SEQ ID NO: 1556363 - RNA, 16 nt, Pseudomonas aeruginosa PA01
cgccgccagcaggauc

SEQ ID NO: 1556364 - RNA, 18 nt, Pseudomonas aeruginosa PA01
cgccgagcaacggcagca

SEQ ID NO: 1556365 - RNA, 12 nt, Pseudomonas aeruginosa PA01
cgccgagccccc

SEQ ID NO: 1556366 - RNA, 14 nt, Pseudomonas aeruginosa PA01
cgccgagcgccgcc

SEQ ID NO: 1556367 - RNA, 12 nt, Pseudomonas aeruginosa PA01
cgccgagcaccc

SEQ ID NO: 1556368 - RNA, 12 nt, Pseudomonas aeruginosa PA01
cgccgagcagcg

SEQ ID NO: 1556369 - RNA, 15 nt, Pseudomonas aeruginosa PA01
cgccgaccgcgcgcc

SEQ ID NO: 1556370 - RNA, 18 nt, Pseudomonas aeruginosa PA01
cgccgaccgcgcgccugc

SEQ ID NO: 1556371 - RNA, 17 nt, Pseudomonas aeruginosa PA01
cgccgaccggacuccgc

SEQ ID NO: 1556372 - RNA, 21 nt, Pseudomonas aeruginosa PA01
cgccgaccggacuccgcggag

SEQ ID NO: 1556373 - RNA, 15 nt, Pseudomonas aeruginosa PA01
cgccgaaaaauucag

SEQ ID NO: 1556374 - RNA, 20 nt, Pseudomonas aeruginosa PA01
cgccgaaaaauucagcgcag

SEQ ID NO: 1556375 - RNA, 20 nt, Pseudomonas aeruginosa PA01
cgcccuuuuucgucgccagc

SEQ ID NO: 1556376 - RNA, 18 nt, Pseudomonas aeruginosa PA01
cgccgaaauagcgcgccc

SEQ ID NO: 1556377 - RNA, 18 nt, Pseudomonas aeruginosa PA01
cgccgaacaugccgaaga

SEQ ID NO: 1556378 - RNA, 14 nt, Pseudomonas aeruginosa PA01
cgccgaacagccgc

SEQ ID NO: 1556379 - RNA, 16 nt, Pseudomonas aeruginosa PA01
cgccgaacagccgccc

SEQ ID NO: 1556380 - RNA, 23 nt, Pseudomonas aeruginosa PA01
cgccgaacagcaacaccgcgcag

SEQ ID NO: 1556381 - RNA, 23 nt, Pseudomonas aeruginosa PA01
cgccgaagccgacgccgagcagc

SEQ ID NO: 1556382 - RNA, 22 nt, Pseudomonas aeruginosa PA01
cgccgaagcggggcuuuuucca

SEQ ID NO: 1556383 - RNA, 15 nt, Pseudomonas aeruginosa PA01
cgccgaacggcagcu

SEQ ID NO: 1556384 - RNA, 20 nt, Pseudomonas aeruginosa PA01
cgccgaagauccgcuccagg

SEQ ID NO: 1556385 - RNA, 16 nt, Pseudomonas aeruginosa PA01
cgccgacccagagcgc

SEQ ID NO: 1556386 - RNA, 19 nt, Pseudomonas aeruginosa PA01
cgccgacccagagcgcgcc

SEQ ID NO: 1556387 - RNA, 21 nt, Pseudomonas aeruginosa PA01
cgccgacccagagcgcgcccu

SEQ ID NO: 1556388 - RNA, 13 nt, Pseudomonas aeruginosa PA01
cgccgaccagcac

SEQ ID NO: 1556389 - RNA, 16 nt, Pseudomonas aeruginosa PA01
cgccgaccagcacggc

SEQ ID NO: 1556390 - RNA, 19 nt, Pseudomonas aeruginosa PA01
cgccgaccagguccgccac

SEQ ID NO: 1556391 - RNA, 22 nt, Pseudomonas aeruginosa PA01
cgccgacaggucggccggcagc

SEQ ID NO: 1556392 - RNA, 18 nt, Pseudomonas aeruginosa PA01
cgccgacacccgcgccgc

SEQ ID NO: 1556393 - RNA, 15 nt, Pseudomonas aeruginosa PA01
cgccgaaguucuuca

SEQ ID NO: 1556394 - RNA, 16 nt, Pseudomonas aeruginosa PA01
cgcccucagcagcgcc

SEQ ID NO: 1556395 - RNA, 22 nt, Pseudomonas aeruginosa PA01
cgcccuacggaccggugccccg

SEQ ID NO: 1556396 - RNA, 17 nt, Pseudomonas aeruginosa PA01
cgcccuacuccaggggu

SEQ ID NO: 1556397 - RNA, 16 nt, Pseudomonas aeruginosa PA01
cgcccuaccgcccacc

SEQ ID NO: 1556398 - RNA, 21 nt, Pseudomonas aeruginosa PA01
cgcccuaccugucccggacga

SEQ ID NO: 1556399 - RNA, 14 nt, Pseudomonas aeruginosa PA01
cgcccuacgaaagc

SEQ ID NO: 1556400 - RNA, 15 nt, Pseudomonas aeruginosa PA01
cgcccuacgaaagcg

SEQ ID NO: 1556401 - RNA, 20 nt, Pseudomonas aeruginosa PA01
cgcccuacgccaccugagcg

SEQ ID NO: 1556402 - RNA, 12 nt, Pseudomonas aeruginosa PA01
cgcccuccauca

SEQ ID NO: 1556403 - RNA, 14 nt, Pseudomonas aeruginosa PA01
cgcccuccagcacc

SEQ ID NO: 1556404 - RNA, 15 nt, Pseudomonas aeruginosa PA01
cgcccuccagcaccg

SEQ ID NO: 1556405 - RNA, 14 nt, Pseudomonas aeruginosa PA01
cgcccucccgcgau

SEQ ID NO: 1556406 - RNA, 17 nt, Pseudomonas aeruginosa PA01
cgcccucgaagcccugc

SEQ ID NO: 1556407 - RNA, 13 nt, Pseudomonas aeruginosa PA01
cgcccucggcgcu

SEQ ID NO: 1556408 - RNA, 17 nt, Pseudomonas aeruginosa PA01
cgcccgucgcgccggcc

SEQ ID NO: 1556409 - RNA, 18 nt, Pseudomonas aeruginosa PA01
cgcccgucgcgccggcca

SEQ ID NO: 1556410 - RNA, 21 nt, Pseudomonas aeruginosa PA01
cgcccgucgcgccggccauuc

SEQ ID NO: 1556411 - RNA, 14 nt, Pseudomonas aeruginosa PA01
cgcccgucacuuca

SEQ ID NO: 1556412 - RNA, 15 nt, Pseudomonas aeruginosa PA01
cgcccgggccggggg

SEQ ID NO: 1556413 - RNA, 21 nt, Pseudomonas aeruginosa PA01
cgcccggucucagccggcgcu

SEQ ID NO: 1556414 - RNA, 15 nt, Pseudomonas aeruginosa PA01
cgcccgugccucggc

SEQ ID NO: 1556415 - RNA, 16 nt, Pseudomonas aeruginosa PA01
cgcccuugaacuugua

SEQ ID NO: 1556416 - RNA, 11 nt, Pseudomonas aeruginosa PA01
cgcccuugacc

SEQ ID NO: 1556417 - RNA, 20 nt, Pseudomonas aeruginosa PA01
cgcccuugaccagucccggc

SEQ ID NO: 1556418 - RNA, 16 nt, Pseudomonas aeruginosa PA01
cgcccuugcgccgcgg

SEQ ID NO: 1556419 - RNA, 19 nt, Pseudomonas aeruginosa PA01
cgcccuugcggcccgccuc

SEQ ID NO: 1556420 - RNA, 20 nt, Pseudomonas aeruginosa PA01
cgcccuugcugcccaguacc

SEQ ID NO: 1556421 - RNA, 15 nt, Pseudomonas aeruginosa PA01
cgcccuuggcggcgc

SEQ ID NO: 1556422 - RNA, 18 nt, Pseudomonas aeruginosa PA01
cgcccugguccaaccggg

SEQ ID NO: 1556423 - RNA, 20 nt, Pseudomonas aeruginosa PA01
cgcccuucgaacccgcccuc

SEQ ID NO: 1556424 - RNA, 21 nt, Pseudomonas aeruginosa PA01
cgcccuucgagaaacugcagg

SEQ ID NO: 1556425 - RNA, 18 nt, Pseudomonas aeruginosa PA01
cgcccugcaccuugggau

SEQ ID NO: 1556426 - RNA, 14 nt, Pseudomonas aeruginosa PA01
cgcccugcgccagc

SEQ ID NO: 1556427 - RNA, 16 nt, Pseudomonas aeruginosa PA01
cgcccugcccgguggg

SEQ ID NO: 1556428 - RNA, 12 nt, Pseudomonas aeruginosa PA01
cgcccugccggg

SEQ ID NO: 1556429 - RNA, 22 nt, Pseudomonas aeruginosa PA01
cgcccugccgggcucuucggag

SEQ ID NO: 1556430 - RNA, 23 nt, Pseudomonas aeruginosa PA01
cgcccugcacggauaccacccgc

SEQ ID NO: 1556431 - RNA, 15 nt, Pseudomonas aeruginosa PA01
cgcccugcaggccga

SEQ ID NO: 1556432 - RNA, 15 nt, Pseudomonas aeruginosa PA01
cgcccuggccucggc

SEQ ID NO: 1556433 - RNA, 15 nt, Pseudomonas aeruginosa PA01
cgcccuggcgccagc

SEQ ID NO: 1556434 - RNA, 20 nt, Pseudomonas aeruginosa PA01
cgcccuggagcggaaacccg

SEQ ID NO: 1556435 - RNA, 12 nt, Pseudomonas aeruginosa PA01
cgccgcgccgcu

SEQ ID NO: 1556436 - RNA, 17 nt, Pseudomonas aeruginosa PA01
cgccgcgcccggcgcca

SEQ ID NO: 1556437 - RNA, 12 nt, Pseudomonas aeruginosa PA01
cgccgcgcaggc

SEQ ID NO: 1556438 - RNA, 23 nt, Pseudomonas aeruginosa PA01
cgccgcgcaugaaaaagccgccc

SEQ ID NO: 1556439 - RNA, 22 nt, Pseudomonas aeruginosa PA01
cgccgcgauggcucgcggcgcu

SEQ ID NO: 1556440 - RNA, 23 nt, Pseudomonas aeruginosa PA01
cgccgcgcaccucgaccgcgccg

SEQ ID NO: 1556441 - RNA, 21 nt, Pseudomonas aeruginosa PA01
cgccgcgagcgaaacggcgcu

SEQ ID NO: 1556442 - RNA, 16 nt, Pseudomonas aeruginosa PA01
cgccgcgagcgccgcc

SEQ ID NO: 1556443 - RNA, 22 nt, Pseudomonas aeruginosa PA01
cgccgccucgcugggcgggcgu

SEQ ID NO: 1556444 - RNA, 18 nt, Pseudomonas aeruginosa PA01
cgccgccugcgccucggc

SEQ ID NO: 1556445 - RNA, 16 nt, Pseudomonas aeruginosa PA01
cgccgccugcucgccg

SEQ ID NO: 1556446 - RNA, 21 nt, Pseudomonas aeruginosa PA01
cgccgcggaaggcccgcgagc

SEQ ID NO: 1556447 - RNA, 16 nt, Pseudomonas aeruginosa PA01
cgccgcggcaccggcg

SEQ ID NO: 1556448 - RNA, 15 nt, Pseudomonas aeruginosa PA01
cgccgcggccagccc

SEQ ID NO: 1556449 - RNA, 17 nt, Pseudomonas aeruginosa PA01
cgccgcggccagccccc

SEQ ID NO: 1556450 - RNA, 18 nt, Pseudomonas aeruginosa PA01
cgccgcggccagcccccu

SEQ ID NO: 1556451 - RNA, 22 nt, Pseudomonas aeruginosa PA01
cgccgcggccagcccccucgcc

SEQ ID NO: 1556452 - RNA, 15 nt, Pseudomonas aeruginosa PA01
cgccgcggccggcga

SEQ ID NO: 1556453 - RNA, 12 nt, Pseudomonas aeruginosa PA01
cgccgcgccggc

SEQ ID NO: 1556454 - RNA, 20 nt, Pseudomonas aeruginosa PA01
cgccgcgccucgucgcgcca

SEQ ID NO: 1556455 - RNA, 23 nt, Pseudomonas aeruginosa PA01
cgccgcggaaaacgccgcgaagc

SEQ ID NO: 1556456 - RNA, 15 nt, Pseudomonas aeruginosa PA01
cgccgcgcugcaggc

SEQ ID NO: 1556457 - RNA, 17 nt, Pseudomonas aeruginosa PA01
cgccgcgggucugcucg

SEQ ID NO: 1556458 - RNA, 20 nt, Pseudomonas aeruginosa PA01
cgccgcggguuccucacggc

SEQ ID NO: 1556459 - RNA, 13 nt, Pseudomonas aeruginosa PA01
cgccgcgggcgcu

SEQ ID NO: 1556460 - RNA, 12 nt, Pseudomonas aeruginosa PA01
cgccgcgggcgu

SEQ ID NO: 1556461 - RNA, 21 nt, Pseudomonas aeruginosa PA01
cgccgcgggcguugcgcgccu

SEQ ID NO: 1556462 - RNA, 23 nt, Pseudomonas aeruginosa PA01
cgccgcggcgaccagcgcggucu

SEQ ID NO: 1556463 - RNA, 13 nt, Pseudomonas aeruginosa PA01
cgccgcggcggcg

SEQ ID NO: 1556464 - RNA, 23 nt, Pseudomonas aeruginosa PA01
cgccgcggcggcgugcaggccga

SEQ ID NO: 1556465 - RNA, 21 nt, Pseudomonas aeruginosa PA01
cgccggaagcuucaggcucgg

SEQ ID NO: 1556466 - RNA, 21 nt, Pseudomonas aeruginosa PA01
cgccggaagcuuccagcuugg

SEQ ID NO: 1556467 - RNA, 19 nt, Pseudomonas aeruginosa PA01
cgccggaaugacgagccgc

SEQ ID NO: 1556468 - RNA, 22 nt, Pseudomonas aeruginosa PA01
cgccggaccagaucggcgcgca

SEQ ID NO: 1556469 - RNA, 21 nt, Pseudomonas aeruginosa PA01
cgccggaaccugcaugucacc

SEQ ID NO: 1556470 - RNA, 20 nt, Pseudomonas aeruginosa PA01
cgccggacaggccacccgcc

SEQ ID NO: 1556471 - RNA, 23 nt, Pseudomonas aeruginosa PA01
cgccggacaggccacccgccucg

SEQ ID NO: 1556472 - RNA, 20 nt, Pseudomonas aeruginosa PA01
cgccgcuggccuggccaccc

SEQ ID NO: 1556473 - RNA, 15 nt, Pseudomonas aeruginosa PA01
cgccgcugggcagca

SEQ ID NO: 1556474 - RNA, 16 nt, Pseudomonas aeruginosa PA01
cgccgcuggcggcgcu

SEQ ID NO: 1556475 - RNA, 15 nt, Pseudomonas aeruginosa PA01
cgccgcuuccgccgg

SEQ ID NO: 1556476 - RNA, 20 nt, Pseudomonas aeruginosa PA01
cgccgcuaugggcaccgcgc

SEQ ID NO: 1556477 - RNA, 17 nt, Pseudomonas aeruginosa PA01
cgccgcucauccgcugg

SEQ ID NO: 1556478 - RNA, 16 nt, Pseudomonas aeruginosa PA01
cgccgcuacugcgcgg

SEQ ID NO: 1556479 - RNA, 18 nt, Pseudomonas aeruginosa PA01
cgccgcuacugcgcgggc

SEQ ID NO: 1556480 - RNA, 15 nt, Pseudomonas aeruginosa PA01
cgccgcuagggcgcc

SEQ ID NO: 1556481 - RNA, 23 nt, Pseudomonas aeruginosa PA01
cgccgcugaucaguaccggcagc

SEQ ID NO: 1556482 - RNA, 13 nt, Pseudomonas aeruginosa PA01
cgccgcugcaccg

SEQ ID NO: 1556483 - RNA, 23 nt, Pseudomonas aeruginosa PA01
cgccgcugaauaccaccgggccg

SEQ ID NO: 1556484 - RNA, 22 nt, Pseudomonas aeruginosa PA01
cgccgcugcgucgucgcggcgc

SEQ ID NO: 1556485 - RNA, 13 nt, Pseudomonas aeruginosa PA01
cgccgcucccggc

SEQ ID NO: 1556486 - RNA, 23 nt, Pseudomonas aeruginosa PA01
cgccgcucggcgagccgccgggc

SEQ ID NO: 1556487 - RNA, 14 nt, Pseudomonas aeruginosa PA01
cgccgcuccuccuc

SEQ ID NO: 1556488 - RNA, 14 nt, Pseudomonas aeruginosa PA01
cgccgcucgcgcac

SEQ ID NO: 1556489 - RNA, 19 nt, Pseudomonas aeruginosa PA01
cgccgcucuaucagggucu

SEQ ID NO: 1556490 - RNA, 18 nt, Pseudomonas aeruginosa PA01
cgccgcucugcccgaccg

SEQ ID NO: 1556491 - RNA, 12 nt, Pseudomonas aeruginosa PA01
cgccgcucugcu

SEQ ID NO: 1556492 - RNA, 14 nt, Pseudomonas aeruginosa PA01
cgccgcucugcugg

SEQ ID NO: 1556493 - RNA, 22 nt, Pseudomonas aeruginosa PA01
cgccgcucugcuggccgcccuu

SEQ ID NO: 1556494 - RNA, 15 nt, Pseudomonas aeruginosa PA01
cgccggcaggccuuc

SEQ ID NO: 1556495 - RNA, 15 nt, Pseudomonas aeruginosa PA01
cgccggcagcgccgc

SEQ ID NO: 1556496 - RNA, 14 nt, Pseudomonas aeruginosa PA01
cgccggccaccagg

SEQ ID NO: 1556497 - RNA, 18 nt, Pseudomonas aeruginosa PA01
cgccggcauuggcacccu

SEQ ID NO: 1556498 - RNA, 21 nt, Pseudomonas aeruginosa PA01
cgccggcauuggcacccugga

SEQ ID NO: 1556499 - RNA, 14 nt, Pseudomonas aeruginosa PA01
cgccggccagccgc

SEQ ID NO: 1556500 - RNA, 12 nt, Pseudomonas aeruginosa PA01
cgccggccagag

SEQ ID NO: 1556501 - RNA, 18 nt, Pseudomonas aeruginosa PA01
cgccggccagagcuucug

SEQ ID NO: 1556502 - RNA, 14 nt, Pseudomonas aeruginosa PA01
cgccggccagcacc

SEQ ID NO: 1556503 - RNA, 22 nt, Pseudomonas aeruginosa PA01
cgccggcccagcaggccggcca

SEQ ID NO: 1556504 - RNA, 14 nt, Pseudomonas aeruginosa PA01
cgccggagccaccg

SEQ ID NO: 1556505 - RNA, 14 nt, Pseudomonas aeruginosa PA01
cgccggacccugcc

SEQ ID NO: 1556506 - RNA, 19 nt, Pseudomonas aeruginosa PA01
cgccggacgcaccagcagg

SEQ ID NO: 1556507 - RNA, 22 nt, Pseudomonas aeruginosa PA01
cgccggagucguagcgcgcggc

SEQ ID NO: 1556508 - RNA, 23 nt, Pseudomonas aeruginosa PA01
cgccggagggaaugaagaagccc

SEQ ID NO: 1556509 - RNA, 19 nt, Pseudomonas aeruginosa PA01
cgccggaggggcggccgcc

SEQ ID NO: 1556510 - RNA, 21 nt, Pseudomonas aeruginosa PA01
cgccggaggggcggccgccga

SEQ ID NO: 1556511 - RNA, 17 nt, Pseudomonas aeruginosa PA01
cgccggggccuacugcu

SEQ ID NO: 1556512 - RNA, 16 nt, Pseudomonas aeruginosa PA01
cgccggggcgggccgc

SEQ ID NO: 1556513 - RNA, 20 nt, Pseudomonas aeruginosa PA01
cgccggggcgggccgcgccu

SEQ ID NO: 1556514 - RNA, 18 nt, Pseudomonas aeruginosa PA01
cgccgggguuuucuuuuu

SEQ ID NO: 1556515 - RNA, 21 nt, Pseudomonas aeruginosa PA01
cgccggguacagcgccacggc

SEQ ID NO: 1556516 - RNA, 22 nt, Pseudomonas aeruginosa PA01
cgccggguagcguuaucgccgg

SEQ ID NO: 1556517 - RNA, 14 nt, Pseudomonas aeruginosa PA01
cgccggguggaacg

SEQ ID NO: 1556518 - RNA, 17 nt, Pseudomonas aeruginosa PA01
cgccggguugcgccgca

SEQ ID NO: 1556519 - RNA, 17 nt, Pseudomonas aeruginosa PA01
cgccggucaaccgcggg

SEQ ID NO: 1556520 - RNA, 23 nt, Pseudomonas aeruginosa PA01
cgccggucgcgcucaggcgcagc

SEQ ID NO: 1556521 - RNA, 15 nt, Pseudomonas aeruginosa PA01
cgccggucgggcacu

SEQ ID NO: 1556522 - RNA, 15 nt, Pseudomonas aeruginosa PA01
cgccggucaggcugc

SEQ ID NO: 1556523 - RNA, 17 nt, Pseudomonas aeruginosa PA01
cgccggucaccacugga

SEQ ID NO: 1556524 - RNA, 21 nt, Pseudomonas aeruginosa PA01
cgccggucaccacuggaaacg

SEQ ID NO: 1556525 - RNA, 21 nt, Pseudomonas aeruginosa PA01
cgccggugccaggaccagccc

SEQ ID NO: 1556526 - RNA, 16 nt, Pseudomonas aeruginosa PA01
cgccggugacgcugcu

SEQ ID NO: 1556527 - RNA, 21 nt, Pseudomonas aeruginosa PA01
cgccggugacgcugcucacca

SEQ ID NO: 1556528 - RNA, 14 nt, Pseudomonas aeruginosa PA01
cgccggugcaugaa

SEQ ID NO: 1556529 - RNA, 18 nt, Pseudomonas aeruginosa PA01
cgccggugaucgagccgc

SEQ ID NO: 1556530 - RNA, 13 nt, Pseudomonas aeruginosa PA01
cgccggugaccca

SEQ ID NO: 1556531 - RNA, 20 nt, Pseudomonas aeruginosa PA01
cgccggugacccacuccggc

SEQ ID NO: 1556532 - RNA, 23 nt, Pseudomonas aeruginosa PA01
cgccggugacccacuccggcagg

SEQ ID NO: 1556533 - RNA, 17 nt, Pseudomonas aeruginosa PA01
cgccguacagcaggcag

SEQ ID NO: 1556534 - RNA, 24 nt, Pseudomonas aeruginosa PA01
cgccguacaggccaccgcgcagcu

SEQ ID NO: 1556535 - RNA, 13 nt, Pseudomonas aeruginosa PA01
cgccgguugcguc

SEQ ID NO: 1556536 - RNA, 15 nt, Pseudomonas aeruginosa PA01
cgccgguugcugcug

SEQ ID NO: 1556537 - RNA, 15 nt, Pseudomonas aeruginosa PA01
cgccgguggccaggc

SEQ ID NO: 1556538 - RNA, 14 nt, Pseudomonas aeruginosa PA01
cgccguccaccagc

SEQ ID NO: 1556539 - RNA, 18 nt, Pseudomonas aeruginosa PA01
cgccguccaccagccagc

SEQ ID NO: 1556540 - RNA, 16 nt, Pseudomonas aeruginosa PA01
cgccgucaucgagcag

SEQ ID NO: 1556541 - RNA, 20 nt, Pseudomonas aeruginosa PA01
cgccgucaccagcagccccg

SEQ ID NO: 1556542 - RNA, 15 nt, Pseudomonas aeruginosa PA01
cgccgucaccgcguu

SEQ ID NO: 1556543 - RNA, 13 nt, Pseudomonas aeruginosa PA01
cgccguaggccac

SEQ ID NO: 1556544 - RNA, 15 nt, Pseudomonas aeruginosa PA01
cgccguagcggccuc

SEQ ID NO: 1556545 - RNA, 13 nt, Pseudomonas aeruginosa PA01
cgccguagcgcag

SEQ ID NO: 1556546 - RNA, 20 nt, Pseudomonas aeruginosa PA01
cgccgggaauccccaguagc

SEQ ID NO: 1556547 - RNA, 16 nt, Pseudomonas aeruginosa PA01
cgccgggaaucgccag

SEQ ID NO: 1556548 - RNA, 20 nt, Pseudomonas aeruginosa PA01
cgccgggaugcucaccgcgc

SEQ ID NO: 1556549 - RNA, 20 nt, Pseudomonas aeruginosa PA01
cgccgggcaacgccaggccg

SEQ ID NO: 1556550 - RNA, 22 nt, Pseudomonas aeruginosa PA01
cgccgggcaacgccaggccgcu

SEQ ID NO: 1556551 - RNA, 13 nt, Pseudomonas aeruginosa PA01
cgccgggccgccu

SEQ ID NO: 1556552 - RNA, 18 nt, Pseudomonas aeruginosa PA01
cgccgggauuguugcggc

SEQ ID NO: 1556553 - RNA, 21 nt, Pseudomonas aeruginosa PA01
cgccgggauuguugcggcggg

SEQ ID NO: 1556554 - RNA, 22 nt, Pseudomonas aeruginosa PA01
cgccgggcauucgcagcggccc

SEQ ID NO: 1556555 - RNA, 20 nt, Pseudomonas aeruginosa PA01
cgccgggcggcgucgcggag

SEQ ID NO: 1556556 - RNA, 19 nt, Pseudomonas aeruginosa PA01
cgccgggcucacucccguc

SEQ ID NO: 1556557 - RNA, 14 nt, Pseudomonas aeruginosa PA01
cgccgggcucagcg

SEQ ID NO: 1556558 - RNA, 16 nt, Pseudomonas aeruginosa PA01
cgccggggaagcugcc

SEQ ID NO: 1556559 - RNA, 22 nt, Pseudomonas aeruginosa PA01
cgccggggaagcugccuuccag

SEQ ID NO: 1556560 - RNA, 15 nt, Pseudomonas aeruginosa PA01
cgccggcucgcccag

SEQ ID NO: 1556561 - RNA, 16 nt, Pseudomonas aeruginosa PA01
cgccggcguccuccuc

SEQ ID NO: 1556562 - RNA, 14 nt, Pseudomonas aeruginosa PA01
cgccggcucccugc

SEQ ID NO: 1556563 - RNA, 16 nt, Pseudomonas aeruginosa PA01
cgccggcgugccgacc

SEQ ID NO: 1556564 - RNA, 17 nt, Pseudomonas aeruginosa PA01
cgccggcggccagggcg

SEQ ID NO: 1556565 - RNA, 16 nt, Pseudomonas aeruginosa PA01
cgccggcggccugccc

SEQ ID NO: 1556566 - RNA, 23 nt, Pseudomonas aeruginosa PA01
cgccggccuggaucucggcggcc

SEQ ID NO: 1556567 - RNA, 18 nt, Pseudomonas aeruginosa PA01
cgccggcgaccgcgcgca

SEQ ID NO: 1556568 - RNA, 15 nt, Pseudomonas aeruginosa PA01
cgccggcgagccgcu

SEQ ID NO: 1556569 - RNA, 20 nt, Pseudomonas aeruginosa PA01
cgccggcgaggaucgcgcug

SEQ ID NO: 1556570 - RNA, 16 nt, Pseudomonas aeruginosa PA01
cgccggcgaucgccag

SEQ ID NO: 1556571 - RNA, 17 nt, Pseudomonas aeruginosa PA01
cgccggcgaucgccggc

SEQ ID NO: 1556572 - RNA, 12 nt, Pseudomonas aeruginosa PA01
cgccggcgcccu

SEQ ID NO: 1556573 - RNA, 13 nt, Pseudomonas aeruginosa PA01
cgccggcgccgcc

SEQ ID NO: 1556574 - RNA, 21 nt, Pseudomonas aeruginosa PA01
cgccggcggaucacaggcucu

SEQ ID NO: 1556575 - RNA, 23 nt, Pseudomonas aeruginosa PA01
cgccggcggaucacaggcucuuc

SEQ ID NO: 1556576 - RNA, 20 nt, Pseudomonas aeruginosa PA01
cgccggcggaucagcccgcu

SEQ ID NO: 1556577 - RNA, 17 nt, Pseudomonas aeruginosa PA01
cgccggcgcuccuccuc

SEQ ID NO: 1556578 - RNA, 20 nt, Pseudomonas aeruginosa PA01
cgccggcgcgcuugccgcug

SEQ ID NO: 1556579 - RNA, 23 nt, Pseudomonas aeruginosa PA01
cgccggcgcguucucugucggag

SEQ ID NO: 1556580 - RNA, 23 nt, Pseudomonas aeruginosa PA01
cgccggcgcgggcggccucgaug

SEQ ID NO: 1556581 - RNA, 16 nt, Pseudomonas aeruginosa PA01
cgccggcgccgccggg

SEQ ID NO: 1556582 - RNA, 22 nt, Pseudomonas aeruginosa PA01
cgccggcgccgccucgggcagc

SEQ ID NO: 1556583 - RNA, 17 nt, Pseudomonas aeruginosa PA01
cgccggcgcgcagggug

SEQ ID NO: 1556584 - RNA, 13 nt, Pseudomonas aeruginosa PA01
cgccggcgcgccc

SEQ ID NO: 1556585 - RNA, 15 nt, Pseudomonas aeruginosa PA01
cgccggccgggagcu

SEQ ID NO: 1556586 - RNA, 11 nt, Pseudomonas aeruginosa PA01
cgccggccucc

SEQ ID NO: 1556587 - RNA, 13 nt, Pseudomonas aeruginosa PA01
cgccggccucgca

SEQ ID NO: 1556588 - RNA, 11 nt, Pseudomonas aeruginosa PA01
cgccggccucu

SEQ ID NO: 1556589 - RNA, 17 nt, Pseudomonas aeruginosa PA01
cgccggccugcgcgcac

SEQ ID NO: 1556590 - RNA, 18 nt, Pseudomonas aeruginosa PA01
cgccggcccgugcccguc

SEQ ID NO: 1556591 - RNA, 17 nt, Pseudomonas aeruginosa PA01
cgcgcaaaccggcagca

SEQ ID NO: 1556592 - RNA, 15 nt, Pseudomonas aeruginosa PA01
cgcgcaaccagccgg

SEQ ID NO: 1556593 - RNA, 18 nt, Pseudomonas aeruginosa PA01
cgcgauggcucgcggcgc

SEQ ID NO: 1556594 - RNA, 23 nt, Pseudomonas aeruginosa PA01
cgcgaugguauggcggucggcca

SEQ ID NO: 1556595 - RNA, 15 nt, Pseudomonas aeruginosa PA01
cgcgcaaccguucca

SEQ ID NO: 1556596 - RNA, 19 nt, Pseudomonas aeruginosa PA01
cgcgcaacgccgacggcgu

SEQ ID NO: 1556597 - RNA, 22 nt, Pseudomonas aeruginosa PA01
cgcgcaacgccgacggcgugcc

SEQ ID NO: 1556598 - RNA, 23 nt, Pseudomonas aeruginosa PA01
cgcgcaacgcuuccagcaccucc

SEQ ID NO: 1556599 - RNA, 14 nt, Pseudomonas aeruginosa PA01
cgcgcaacggcagc

SEQ ID NO: 1556600 - RNA, 15 nt, Pseudomonas aeruginosa PA01
cgcgcaacggcagcg

SEQ ID NO: 1556601 - RNA, 16 nt, Pseudomonas aeruginosa PA01
cgcgcaagcgcccggc

SEQ ID NO: 1556602 - RNA, 19 nt, Pseudomonas aeruginosa PA01
cgcgcaacugcggggcgcu

SEQ ID NO: 1556603 - RNA, 21 nt, Pseudomonas aeruginosa PA01
cgcgcaagccagccaugugcu

SEQ ID NO: 1556604 - RNA, 21 nt, Pseudomonas aeruginosa PA01
cgcgcaccacccaucugccgg

SEQ ID NO: 1556605 - RNA, 12 nt, Pseudomonas aeruginosa PA01
cgcgcaccaccu

SEQ ID NO: 1556606 - RNA, 23 nt, Pseudomonas aeruginosa PA01
cgcgcaccaccuggcagguaucg

SEQ ID NO: 1556607 - RNA, 13 nt, Pseudomonas aeruginosa PA01
cgcgcaccagcac

SEQ ID NO: 1556608 - RNA, 18 nt, Pseudomonas aeruginosa PA01
cgcgcaccaggccuccca

SEQ ID NO: 1556609 - RNA, 15 nt, Pseudomonas aeruginosa PA01
cgcgcaccgcggcga

SEQ ID NO: 1556610 - RNA, 19 nt, Pseudomonas aeruginosa PA01
cgcgaggggcggagcagcc

SEQ ID NO: 1556611 - RNA, 13 nt, Pseudomonas aeruginosa PA01
cgcgaucaccgcg

SEQ ID NO: 1556612 - RNA, 14 nt, Pseudomonas aeruginosa PA01
cgcgauauccgcca

SEQ ID NO: 1556613 - RNA, 23 nt, Pseudomonas aeruginosa PA01
cgcgauauccgccaggcggagca

SEQ ID NO: 1556614 - RNA, 13 nt, Pseudomonas aeruginosa PA01
cgcgaugaugccg

SEQ ID NO: 1556615 - RNA, 15 nt, Pseudomonas aeruginosa PA01
cgcgauccgcgcggc

SEQ ID NO: 1556616 - RNA, 16 nt, Pseudomonas aeruginosa PA01
cgcgauccgcgcggca

SEQ ID NO: 1556617 - RNA, 15 nt, Pseudomonas aeruginosa PA01
cgcgauccuccgcca

SEQ ID NO: 1556618 - RNA, 15 nt, Pseudomonas aeruginosa PA01
cgcgaucccccgccc

SEQ ID NO: 1556619 - RNA, 21 nt, Pseudomonas aeruginosa PA01
cgcgaggccggccccaccagc

SEQ ID NO: 1556620 - RNA, 20 nt, Pseudomonas aeruginosa PA01
cgcgagcgcggccggccacg

SEQ ID NO: 1556621 - RNA, 12 nt, Pseudomonas aeruginosa PA01
cgcgagcuggcg

SEQ ID NO: 1556622 - RNA, 17 nt, Pseudomonas aeruginosa PA01
cgcgagcuggcgccguc

SEQ ID NO: 1556623 - RNA, 22 nt, Pseudomonas aeruginosa PA01
cgcgagccguccugcggccgca

SEQ ID NO: 1556624 - RNA, 13 nt, Pseudomonas aeruginosa PA01
cgcgagaagccgc

SEQ ID NO: 1556625 - RNA, 17 nt, Pseudomonas aeruginosa PA01
cgcgagaccccggcggc

SEQ ID NO: 1556626 - RNA, 17 nt, Pseudomonas aeruginosa PA01
cgcgacgcuccaggugc

SEQ ID NO: 1556627 - RNA, 19 nt, Pseudomonas aeruginosa PA01
cgcgacuuggacagcgucu

SEQ ID NO: 1556628 - RNA, 16 nt, Pseudomonas aeruginosa PA01
cgcgacugucgagcag

SEQ ID NO: 1556629 - RNA, 18 nt, Pseudomonas aeruginosa PA01
cgcgacugucgagcaggg

SEQ ID NO: 1556630 - RNA, 18 nt, Pseudomonas aeruginosa PA01
cgcgacucgaagcucuuc

SEQ ID NO: 1556631 - RNA, 15 nt, Pseudomonas aeruginosa PA01
cgcgacucggcugca

SEQ ID NO: 1556632 - RNA, 13 nt, Pseudomonas aeruginosa PA01
cgcgacugcugcu

SEQ ID NO: 1556633 - RNA, 14 nt, Pseudomonas aeruginosa PA01
cgcgacugcugcug

SEQ ID NO: 1556634 - RNA, 15 nt, Pseudomonas aeruginosa PA01
cgcgacacauggucg

SEQ ID NO: 1556635 - RNA, 14 nt, Pseudomonas aeruginosa PA01
cgcgacagauagca

SEQ ID NO: 1556636 - RNA, 15 nt, Pseudomonas aeruginosa PA01
cgcgacaucggcgau

SEQ ID NO: 1556637 - RNA, 13 nt, Pseudomonas aeruginosa PA01
cgcgacaggaugg

SEQ ID NO: 1556638 - RNA, 20 nt, Pseudomonas aeruginosa PA01
cgcgaccgaagccgcgcagc

SEQ ID NO: 1556639 - RNA, 20 nt, Pseudomonas aeruginosa PA01
cgcgaccgcccgccucaggc

SEQ ID NO: 1556640 - RNA, 15 nt, Pseudomonas aeruginosa PA01
cgcgacgaggcgcgg

SEQ ID NO: 1556641 - RNA, 18 nt, Pseudomonas aeruginosa PA01
cgcgacgaggcgcggcgg

SEQ ID NO: 1556642 - RNA, 20 nt, Pseudomonas aeruginosa PA01
cgcgacgaggcgcggcggag

SEQ ID NO: 1556643 - RNA, 18 nt, Pseudomonas aeruginosa PA01
cgcgcaucgaugccuugc

SEQ ID NO: 1556644 - RNA, 19 nt, Pseudomonas aeruginosa PA01
cgcgcaugaccuucagcac

SEQ ID NO: 1556645 - RNA, 19 nt, Pseudomonas aeruginosa PA01
cgcgcaugaucgccucggc

SEQ ID NO: 1556646 - RNA, 18 nt, Pseudomonas aeruginosa PA01
cgcgcauggcggcgaccg

SEQ ID NO: 1556647 - RNA, 20 nt, Pseudomonas aeruginosa PA01
cgcgcaggugcuuggcaccg

SEQ ID NO: 1556648 - RNA, 23 nt, Pseudomonas aeruginosa PA01
cgcgcagguucaucgccgccagg

SEQ ID NO: 1556649 - RNA, 20 nt, Pseudomonas aeruginosa PA01
cgcgcaguacgaucagccag

SEQ ID NO: 1556650 - RNA, 19 nt, Pseudomonas aeruginosa PA01
cgcgcaguagcuggaucug

SEQ ID NO: 1556651 - RNA, 17 nt, Pseudomonas aeruginosa PA01
cgcgcaguaggcgcugc

SEQ ID NO: 1556652 - RNA, 20 nt, Pseudomonas aeruginosa PA01
cgcgcagucccgcgcggccc

SEQ ID NO: 1556653 - RNA, 14 nt, Pseudomonas aeruginosa PA01
cgcgcagggccagc

SEQ ID NO: 1556654 - RNA, 19 nt, Pseudomonas aeruginosa PA01
cgcgcagggccagcaacag

SEQ ID NO: 1556655 - RNA, 18 nt, Pseudomonas aeruginosa PA01
cgcgcagggccagggcgg

SEQ ID NO: 1556656 - RNA, 22 nt, Pseudomonas aeruginosa PA01
cgcgcaguucgucuuccagcgg

SEQ ID NO: 1556657 - RNA, 21 nt, Pseudomonas aeruginosa PA01
cgcgccagcaggcgcagcagc

SEQ ID NO: 1556658 - RNA, 12 nt, Pseudomonas aeruginosa PA01
cgcgccagcagg

SEQ ID NO: 1556659 - RNA, 20 nt, Pseudomonas aeruginosa PA01
cgcgccagagaucgcccagc

SEQ ID NO: 1556660 - RNA, 15 nt, Pseudomonas aeruginosa PA01
cgcgccacgcaggaa

SEQ ID NO: 1556661 - RNA, 15 nt, Pseudomonas aeruginosa PA01
cgcgccacgcgcauc

SEQ ID NO: 1556662 - RNA, 20 nt, Pseudomonas aeruginosa PA01
cgcgccacggaaggccacgc

SEQ ID NO: 1556663 - RNA, 17 nt, Pseudomonas aeruginosa PA01
cgcgccaaggccgccag

SEQ ID NO: 1556664 - RNA, 21 nt, Pseudomonas aeruginosa PA01
cgcgccaaggccgccaggccu

SEQ ID NO: 1556665 - RNA, 20 nt, Pseudomonas aeruginosa PA01
cgcgccaagguuccagcccc

SEQ ID NO: 1556666 - RNA, 14 nt, Pseudomonas aeruginosa PA01
cgcgcaccuggcgg

SEQ ID NO: 1556667 - RNA, 16 nt, Pseudomonas aeruginosa PA01
cgcgcacgcuguagac

SEQ ID NO: 1556668 - RNA, 20 nt, Pseudomonas aeruginosa PA01
cgcgcagaugaucgccaccg

SEQ ID NO: 1556669 - RNA, 22 nt, Pseudomonas aeruginosa PA01
cgcgcagaugaucgccaccggg

SEQ ID NO: 1556670 - RNA, 20 nt, Pseudomonas aeruginosa PA01
cgcgcagaucgccgcguagc

SEQ ID NO: 1556671 - RNA, 16 nt, Pseudomonas aeruginosa PA01
cgcgcagaggcgcucc

SEQ ID NO: 1556672 - RNA, 19 nt, Pseudomonas aeruginosa PA01
cgcgcagaggcgcuccacc

SEQ ID NO: 1556673 - RNA, 16 nt, Pseudomonas aeruginosa PA01
cgcgcagcaacggcgc

SEQ ID NO: 1556674 - RNA, 17 nt, Pseudomonas aeruginosa PA01
cgcgcagcaggcggccc

SEQ ID NO: 1556675 - RNA, 15 nt, Pseudomonas aeruginosa PA01
cgcgcagcacuuccu

SEQ ID NO: 1556676 - RNA, 18 nt, Pseudomonas aeruginosa PA01
cgcgcaggcgggcggcgu

SEQ ID NO: 1556677 - RNA, 16 nt, Pseudomonas aeruginosa PA01
cgcgcaggaccuggcu

SEQ ID NO: 1556678 - RNA, 13 nt, Pseudomonas aeruginosa PA01
cgcgcagggcagc

SEQ ID NO: 1556679 - RNA, 15 nt, Pseudomonas aeruginosa PA01
cgcgcagcucggcca

SEQ ID NO: 1556680 - RNA, 16 nt, Pseudomonas aeruginosa PA01
cgcgcagcuccucggc

SEQ ID NO: 1556681 - RNA, 14 nt, Pseudomonas aeruginosa PA01
cgcgcagcuugccu

SEQ ID NO: 1556682 - RNA, 21 nt, Pseudomonas aeruginosa PA01
cgcgcagcuugccuuccaggc

SEQ ID NO: 1556683 - RNA, 20 nt, Pseudomonas aeruginosa PA01
cgcgcagcagguagugcggc

SEQ ID NO: 1556684 - RNA, 15 nt, Pseudomonas aeruginosa PA01
cgcgcagcaguaccu

SEQ ID NO: 1556685 - RNA, 14 nt, Pseudomonas aeruginosa PA01
cgcgcagccacugg

SEQ ID NO: 1556686 - RNA, 23 nt, Pseudomonas aeruginosa PA01
cgcgcagccacuggcggaccgcc

SEQ ID NO: 1556687 - RNA, 12 nt, Pseudomonas aeruginosa PA01
cgcgcagccagg

SEQ ID NO: 1556688 - RNA, 15 nt, Pseudomonas aeruginosa PA01
cgcgcagccaggcga

SEQ ID NO: 1556689 - RNA, 15 nt, Pseudomonas aeruginosa PA01
cgcgcagccaguugg

SEQ ID NO: 1556690 - RNA, 13 nt, Pseudomonas aeruginosa PA01
cgcgcagcggcgc

SEQ ID NO: 1556691 - RNA, 17 nt, Pseudomonas aeruginosa PA01
cgcgcagcgccuccagc

SEQ ID NO: 1556692 - RNA, 24 nt, Pseudomonas aeruginosa PA01
cgcgcagcgccuccagcgucugcc

SEQ ID NO: 1556693 - RNA, 15 nt, Pseudomonas aeruginosa PA01
cgcgccgccgcggcc

SEQ ID NO: 1556694 - RNA, 21 nt, Pseudomonas aeruginosa PA01
cgcgccgccgcggccagcccc

SEQ ID NO: 1556695 - RNA, 14 nt, Pseudomonas aeruginosa PA01
cgcgccgcccuggc

SEQ ID NO: 1556696 - RNA, 14 nt, Pseudomonas aeruginosa PA01
cgcgccgccgccgc

SEQ ID NO: 1556697 - RNA, 17 nt, Pseudomonas aeruginosa PA01
cgcgccgagccagguac

SEQ ID NO: 1556698 - RNA, 16 nt, Pseudomonas aeruginosa PA01
cgcgcccugcaggccg

SEQ ID NO: 1556699 - RNA, 22 nt, Pseudomonas aeruginosa PA01
cgcgcccucgcucguuccgcgg

SEQ ID NO: 1556700 - RNA, 13 nt, Pseudomonas aeruginosa PA01
cgcgccgacccag

SEQ ID NO: 1556701 - RNA, 15 nt, Pseudomonas aeruginosa PA01
cgcgccgacccagag

SEQ ID NO: 1556702 - RNA, 15 nt, Pseudomonas aeruginosa PA01
cgcgccgacagcacg

SEQ ID NO: 1556703 - RNA, 17 nt, Pseudomonas aeruginosa PA01
cgcgccgacaggcaucg

SEQ ID NO: 1556704 - RNA, 16 nt, Pseudomonas aeruginosa PA01
cgcgccgaccagccgc

SEQ ID NO: 1556705 - RNA, 17 nt, Pseudomonas aeruginosa PA01
cgcgcccacuccuccgc

SEQ ID NO: 1556706 - RNA, 20 nt, Pseudomonas aeruginosa PA01
cgcgcccacuccuccgccug

SEQ ID NO: 1556707 - RNA, 14 nt, Pseudomonas aeruginosa PA01
cgcgcccaggcugc

SEQ ID NO: 1556708 - RNA, 23 nt, Pseudomonas aeruginosa PA01
cgcgcccaggcccagcgcggcgc

SEQ ID NO: 1556709 - RNA, 21 nt, Pseudomonas aeruginosa PA01
cgcgccccagcggcaggcacg

SEQ ID NO: 1556710 - RNA, 18 nt, Pseudomonas aeruginosa PA01
cgcgcccccuggccguug

SEQ ID NO: 1556711 - RNA, 19 nt, Pseudomonas aeruginosa PA01
cgcgccccugcgcccaggg

SEQ ID NO: 1556712 - RNA, 13 nt, Pseudomonas aeruginosa PA01
cgcgccccggcga

SEQ ID NO: 1556713 - RNA, 19 nt, Pseudomonas aeruginosa PA01
cgcgccccggcgagcgagc

SEQ ID NO: 1556714 - RNA, 16 nt, Pseudomonas aeruginosa PA01
cgcgcccgccaggucg

SEQ ID NO: 1556715 - RNA, 20 nt, Pseudomonas aeruginosa PA01
cgcgcccgguguucaccgga

SEQ ID NO: 1556716 - RNA, 21 nt, Pseudomonas aeruginosa PA01
cgcgccagcacggcgcagggc

SEQ ID NO: 1556717 - RNA, 18 nt, Pseudomonas aeruginosa PA01
cgcgccauuccgcggcac

SEQ ID NO: 1556718 - RNA, 23 nt, Pseudomonas aeruginosa PA01
cgcgccaugcaagaacgccgacc

SEQ ID NO: 1556719 - RNA, 23 nt, Pseudomonas aeruginosa PA01
cgcgccaggucgagacgcgggcc

SEQ ID NO: 1556720 - RNA, 18 nt, Pseudomonas aeruginosa PA01
cgcgccaggcccacgccc

SEQ ID NO: 1556721 - RNA, 23 nt, Pseudomonas aeruginosa PA01
cgcgccagccaggaagagcccgc

SEQ ID NO: 1556722 - RNA, 16 nt, Pseudomonas aeruginosa PA01
cgcgccagccccaggc

SEQ ID NO: 1556723 - RNA, 12 nt, Pseudomonas aeruginosa PA01
cgccucccaggg

SEQ ID NO: 1556724 - RNA, 15 nt, Pseudomonas aeruginosa PA01
cgccuccggcacgcu

SEQ ID NO: 1556725 - RNA, 22 nt, Pseudomonas aeruginosa PA01
cgccuccggcacgcugccgccg

SEQ ID NO: 1556726 - RNA, 14 nt, Pseudomonas aeruginosa PA01
cgccuccugcggau

SEQ ID NO: 1556727 - RNA, 14 nt, Pseudomonas aeruginosa PA01
cgccuccaggcgcg

SEQ ID NO: 1556728 - RNA, 23 nt, Pseudomonas aeruginosa PA01
cgccuccaggaauccuccgccag

SEQ ID NO: 1556729 - RNA, 12 nt, Pseudomonas aeruginosa PA01
cgccuccacggc

SEQ ID NO: 1556730 - RNA, 11 nt, Pseudomonas aeruginosa PA01
cgccucagcgg

SEQ ID NO: 1556731 - RNA, 18 nt, Pseudomonas aeruginosa PA01
cgccucagcggcuggcga

SEQ ID NO: 1556732 - RNA, 12 nt, Pseudomonas aeruginosa PA01
cgccucgccggc

SEQ ID NO: 1556733 - RNA, 22 nt, Pseudomonas aeruginosa PA01
cgccucgccccagacccaggug

SEQ ID NO: 1556734 - RNA, 20 nt, Pseudomonas aeruginosa PA01
cgccucgcagagcgccagcc

SEQ ID NO: 1556735 - RNA, 15 nt, Pseudomonas aeruginosa PA01
cgccucgccaaccag

SEQ ID NO: 1556736 - RNA, 14 nt, Pseudomonas aeruginosa PA01
cgccucgccgcccg

SEQ ID NO: 1556737 - RNA, 15 nt, Pseudomonas aeruginosa PA01
cgccucgccgcccga

SEQ ID NO: 1556738 - RNA, 19 nt, Pseudomonas aeruginosa PA01
cgccucgaacauggccacc

SEQ ID NO: 1556739 - RNA, 23 nt, Pseudomonas aeruginosa PA01
cgccucgaccaucggcggcggcc

SEQ ID NO: 1556740 - RNA, 21 nt, Pseudomonas aeruginosa PA01
cgccucgaccagcgccgcggc

SEQ ID NO: 1556741 - RNA, 14 nt, Pseudomonas aeruginosa PA01
cgccucgaccuggc

SEQ ID NO: 1556742 - RNA, 22 nt, Pseudomonas aeruginosa PA01
cgccucgaucuucuuccccgcc

SEQ ID NO: 1556743 - RNA, 23 nt, Pseudomonas aeruginosa PA01
cgccucgaucagugcaucggccg

SEQ ID NO: 1556744 - RNA, 20 nt, Pseudomonas aeruginosa PA01
cgccucuucgcaggagucga

SEQ ID NO: 1556745 - RNA, 14 nt, Pseudomonas aeruginosa PA01
cgccucggcaucga

SEQ ID NO: 1556746 - RNA, 14 nt, Pseudomonas aeruginosa PA01
cgccucgcgggucu

SEQ ID NO: 1556747 - RNA, 19 nt, Pseudomonas aeruginosa PA01
cgccucgcgccgcgccagc

SEQ ID NO: 1556748 - RNA, 13 nt, Pseudomonas aeruginosa PA01
cgccucgggcagc

SEQ ID NO: 1556749 - RNA, 12 nt, Pseudomonas aeruginosa PA01
cgccucgggcca

SEQ ID NO: 1556750 - RNA, 15 nt, Pseudomonas aeruginosa PA01
cgccucguggaacag

SEQ ID NO: 1556751 - RNA, 17 nt, Pseudomonas aeruginosa PA01
cgccucguucagcagca

SEQ ID NO: 1556752 - RNA, 19 nt, Pseudomonas aeruginosa PA01
cgccucuaugaaccggggc

SEQ ID NO: 1556753 - RNA, 15 nt, Pseudomonas aeruginosa PA01
cgccucgucgcgcca

SEQ ID NO: 1556754 - RNA, 21 nt, Pseudomonas aeruginosa PA01
cgccguggcugugcuggccac

SEQ ID NO: 1556755 - RNA, 23 nt, Pseudomonas aeruginosa PA01
cgccguggcugugcuggccaccc

SEQ ID NO: 1556756 - RNA, 15 nt, Pseudomonas aeruginosa PA01
cgccgugggaacgcg

SEQ ID NO: 1556757 - RNA, 21 nt, Pseudomonas aeruginosa PA01
cgccgugcaucaccggcagca

SEQ ID NO: 1556758 - RNA, 18 nt, Pseudomonas aeruginosa PA01
cgccgugcgcuccgccag

SEQ ID NO: 1556759 - RNA, 12 nt, Pseudomonas aeruginosa PA01
cgccgucggcgg

SEQ ID NO: 1556760 - RNA, 18 nt, Pseudomonas aeruginosa PA01
cgccgugaggcgcgcgcc

SEQ ID NO: 1556761 - RNA, 19 nt, Pseudomonas aeruginosa PA01
cgccgugaggcgcgcgccg

SEQ ID NO: 1556762 - RNA, 15 nt, Pseudomonas aeruginosa PA01
cgccguccuccagca

SEQ ID NO: 1556763 - RNA, 21 nt, Pseudomonas aeruginosa PA01
cgccgucgagccagcccagcg

SEQ ID NO: 1556764 - RNA, 14 nt, Pseudomonas aeruginosa PA01
cgccgucgcgcucu

SEQ ID NO: 1556765 - RNA, 23 nt, Pseudomonas aeruginosa PA01
cgccuauccgugacgucggcggc

SEQ ID NO: 1556766 - RNA, 13 nt, Pseudomonas aeruginosa PA01
cgccuaccggggc

SEQ ID NO: 1556767 - RNA, 21 nt, Pseudomonas aeruginosa PA01
cgccguucucauugcgccgcc

SEQ ID NO: 1556768 - RNA, 23 nt, Pseudomonas aeruginosa PA01
cgccguucucauugcgccgccgg

SEQ ID NO: 1556769 - RNA, 14 nt, Pseudomonas aeruginosa PA01
cgccguucacgccu

SEQ ID NO: 1556770 - RNA, 14 nt, Pseudomonas aeruginosa PA01
cgccguucaggguc

SEQ ID NO: 1556771 - RNA, 23 nt, Pseudomonas aeruginosa PA01
cgccguuuuugcauuucagcgga

SEQ ID NO: 1556772 - RNA, 21 nt, Pseudomonas aeruginosa PA01
cgccguuggcgaggacuuucu

SEQ ID NO: 1556773 - RNA, 18 nt, Pseudomonas aeruginosa PA01
cgccugcgccucggcccu

SEQ ID NO: 1556774 - RNA, 21 nt, Pseudomonas aeruginosa PA01
cgccugcggauagccaaccag

SEQ ID NO: 1556775 - RNA, 18 nt, Pseudomonas aeruginosa PA01
cgccugcucgccgcugaa

SEQ ID NO: 1556776 - RNA, 19 nt, Pseudomonas aeruginosa PA01
cgccugcucgccgcugaag

SEQ ID NO: 1556777 - RNA, 14 nt, Pseudomonas aeruginosa PA01
cgccugcucggccu

SEQ ID NO: 1556778 - RNA, 21 nt, Pseudomonas aeruginosa PA01
cgccugcuggccggugccaua

SEQ ID NO: 1556779 - RNA, 13 nt, Pseudomonas aeruginosa PA01
cgccugcuggcug

SEQ ID NO: 1556780 - RNA, 12 nt, Pseudomonas aeruginosa PA01
cgccugcuugaa

SEQ ID NO: 1556781 - RNA, 22 nt, Pseudomonas aeruginosa PA01
cgccugcuucagcccggcacca

SEQ ID NO: 1556782 - RNA, 14 nt, Pseudomonas aeruginosa PA01
cgccugcuuuggga

SEQ ID NO: 1556783 - RNA, 14 nt, Pseudomonas aeruginosa PA01
cgccuggagcagaa

SEQ ID NO: 1556784 - RNA, 21 nt, Pseudomonas aeruginosa PA01
cgccuggagcagaaccgccag

SEQ ID NO: 1556785 - RNA, 18 nt, Pseudomonas aeruginosa PA01
cgccugcaacgccagcag

SEQ ID NO: 1556786 - RNA, 23 nt, Pseudomonas aeruginosa PA01
cgccugcaggucgaggcgcucca

SEQ ID NO: 1556787 - RNA, 19 nt, Pseudomonas aeruginosa PA01
cgccugcaggaaggcuucc

SEQ ID NO: 1556788 - RNA, 20 nt, Pseudomonas aeruginosa PA01
cgccugccaggcggggaugg

SEQ ID NO: 1556789 - RNA, 22 nt, Pseudomonas aeruginosa PA01
cgccugccccacuuccggcccg

SEQ ID NO: 1556790 - RNA, 17 nt, Pseudomonas aeruginosa PA01
cgccuguuccagggccu

SEQ ID NO: 1556791 - RNA, 21 nt, Pseudomonas aeruginosa PA01
cgccuguuccagggccugcuc

SEQ ID NO: 1556792 - RNA, 16 nt, Pseudomonas aeruginosa PA01
cgccugucgcuccggc

SEQ ID NO: 1556793 - RNA, 16 nt, Pseudomonas aeruginosa PA01
cgccuucagcgccagc

SEQ ID NO: 1556794 - RNA, 19 nt, Pseudomonas aeruginosa PA01
cgccuucagcgccuccagc

SEQ ID NO: 1556795 - RNA, 18 nt, Pseudomonas aeruginosa PA01
cgccuggcgugccgccag

SEQ ID NO: 1556796 - RNA, 19 nt, Pseudomonas aeruginosa PA01
cgccuggcgugccgccagg

SEQ ID NO: 1556797 - RNA, 23 nt, Pseudomonas aeruginosa PA01
cgccugggacggaacgucggccu

SEQ ID NO: 1556798 - RNA, 15 nt, Pseudomonas aeruginosa PA01
cgccuggccgcgcag

SEQ ID NO: 1556799 - RNA, 14 nt, Pseudomonas aeruginosa PA01
cgccuggccggcca

SEQ ID NO: 1556800 - RNA, 14 nt, Pseudomonas aeruginosa PA01
cgccuggguggcga

SEQ ID NO: 1556801 - RNA, 14 nt, Pseudomonas aeruginosa PA01
cgccugggccggcg

SEQ ID NO: 1556802 - RNA, 18 nt, Pseudomonas aeruginosa PA01
cgccugguccagcagguu

SEQ ID NO: 1556803 - RNA, 16 nt, Pseudomonas aeruginosa PA01
cgccuggucggcggcc

SEQ ID NO: 1556804 - RNA, 17 nt, Pseudomonas aeruginosa PA01
cgccuggucggcggccu

SEQ ID NO: 1556805 - RNA, 19 nt, Pseudomonas aeruginosa PA01
cgccuggucggggccggcg

SEQ ID NO: 1556806 - RNA, 15 nt, Pseudomonas aeruginosa PA01
cgccuuguuccaggc

SEQ ID NO: 1556807 - RNA, 17 nt, Pseudomonas aeruginosa PA01
cgccuuuuuucauccug

SEQ ID NO: 1556808 - RNA, 23 nt, Pseudomonas aeruginosa PA01
cgccuugcccuggccggcacccu

SEQ ID NO: 1556809 - RNA, 23 nt, Pseudomonas aeruginosa PA01
cgccuugguguagccgagcacgc

SEQ ID NO: 1556810 - RNA, 23 nt, Pseudomonas aeruginosa PA01
cgccuuggauaccagggugguga

SEQ ID NO: 1556811 - RNA, 22 nt, Pseudomonas aeruginosa PA01
cgccuugcguaccagcgcgcag

SEQ ID NO: 1556812 - RNA, 14 nt, Pseudomonas aeruginosa PA01
cgccuugcggcgcc

SEQ ID NO: 1556813 - RNA, 16 nt, Pseudomonas aeruginosa PA01
cgccuugagcggcgcc

SEQ ID NO: 1556814 - RNA, 20 nt, Pseudomonas aeruginosa PA01
cgccuugagcggcgcccugg

SEQ ID NO: 1556815 - RNA, 12 nt, Pseudomonas aeruginosa PA01
cgccuucccaga

SEQ ID NO: 1556816 - RNA, 15 nt, Pseudomonas aeruginosa PA01
cgccuucccggucga

SEQ ID NO: 1556817 - RNA, 19 nt, Pseudomonas aeruginosa PA01
cgccuucccggucgacggc

SEQ ID NO: 1556818 - RNA, 16 nt, Pseudomonas aeruginosa PA01
cgccuuccagcccuuc

SEQ ID NO: 1556819 - RNA, 17 nt, Pseudomonas aeruginosa PA01
cgccuuccagcccuucg

SEQ ID NO: 1556820 - RNA, 19 nt, Pseudomonas aeruginosa PA01
cgccuuccagcuugcgcca

SEQ ID NO: 1556821 - RNA, 23 nt, Pseudomonas aeruginosa PA01
cgccuuccaggcgugccuguucc

SEQ ID NO: 1556822 - RNA, 21 nt, Pseudomonas aeruginosa PA01
cgccuucgcguucgcuccggg

SEQ ID NO: 1556823 - RNA, 23 nt, Pseudomonas aeruginosa PA01
cgccuucggagaacagcgagacc

SEQ ID NO: 1556824 - RNA, 24 nt, Pseudomonas aeruginosa PA01
cgccuucggcaggaccucgggcga

SEQ ID NO: 1556825 - RNA, 13 nt, Pseudomonas aeruginosa PA01
cgccuucgcgggc

SEQ ID NO: 1556826 - RNA, 15 nt, Pseudomonas aeruginosa PA01
cgccuucgcgggcca

SEQ ID NO: 1556827 - RNA, 18 nt, Pseudomonas aeruginosa PA01
cgccuucgcgggccaggc

SEQ ID NO: 1556828 - RNA, 15 nt, Pseudomonas aeruginosa PA01
cgccuuccucggcga

SEQ ID NO: 1556829 - RNA, 14 nt, Pseudomonas aeruginosa PA01
cgccuuccugcuuc

SEQ ID NO: 1556830 - RNA, 16 nt, Pseudomonas aeruginosa PA01
cgccuuccuugaucca

SEQ ID NO: 1556831 - RNA, 18 nt, Pseudomonas aeruginosa PA01
cgccuucugcgugggcaa

SEQ ID NO: 1556832 - RNA, 14 nt, Pseudomonas aeruginosa PA01
cgccuucgggcgcc

SEQ ID NO: 1556833 - RNA, 15 nt, Pseudomonas aeruginosa PA01
cgccuucgggcgccu

SEQ ID NO: 1556834 - RNA, 17 nt, Pseudomonas aeruginosa PA01
cgccuucuuuucuuccg

SEQ ID NO: 1556835 - RNA, 20 nt, Pseudomonas aeruginosa PA01
cgccuugaccugcugggcca

SEQ ID NO: 1556836 - RNA, 16 nt, Pseudomonas aeruginosa PA01
cgcgaaaacucccggc

SEQ ID NO: 1556837 - RNA, 22 nt, Pseudomonas aeruginosa PA01
cgcgaacaguuccgacugcgag

SEQ ID NO: 1556838 - RNA, 16 nt, Pseudomonas aeruginosa PA01
cgcgaaccgcugguga

SEQ ID NO: 1556839 - RNA, 15 nt, Pseudomonas aeruginosa PA01
cgcgaacgguccugc

SEQ ID NO: 1556840 - RNA, 19 nt, Pseudomonas aeruginosa PA01
cgcgaacgguccugcggau

SEQ ID NO: 1556841 - RNA, 14 nt, Pseudomonas aeruginosa PA01
cgcgaaccagcagc

SEQ ID NO: 1556842 - RNA, 16 nt, Pseudomonas aeruginosa PA01
cgcgaagcccagcgcc

SEQ ID NO: 1556843 - RNA, 16 nt, Pseudomonas aeruginosa PA01
cgcgaagcgacggcgc

SEQ ID NO: 1556844 - RNA, 21 nt, Pseudomonas aeruginosa PA01
cgcgaaggcgccuuccaggcg

SEQ ID NO: 1556845 - RNA, 13 nt, Pseudomonas aeruginosa PA01
cgcgaaugcccgg

SEQ ID NO: 1556846 - RNA, 15 nt, Pseudomonas aeruginosa PA01
cgcgaauggcagcag

SEQ ID NO: 1556847 - RNA, 16 nt, Pseudomonas aeruginosa PA01
cgcgaauccgcggccc

SEQ ID NO: 1556848 - RNA, 22 nt, Pseudomonas aeruginosa PA01
cuugaagucccauugcaucugc

SEQ ID NO: 1556849 - RNA, 21 nt, Pseudomonas aeruginosa PA01
cuugacccgcaguuccuuggg

SEQ ID NO: 1556850 - RNA, 20 nt, Pseudomonas aeruginosa PA01
cuugacccgguacagcgccu

SEQ ID NO: 1556851 - RNA, 17 nt, Pseudomonas aeruginosa PA01
cuugacccucugguugg

SEQ ID NO: 1556852 - RNA, 19 nt, Pseudomonas aeruginosa PA01
cuugacgaugccguucagg

SEQ ID NO: 1556853 - RNA, 16 nt, Pseudomonas aeruginosa PA01
cuugaccuugcucuuc

SEQ ID NO: 1556854 - RNA, 20 nt, Pseudomonas aeruginosa PA01
cuugacggauaaaauccaca

SEQ ID NO: 1556855 - RNA, 17 nt, Pseudomonas aeruginosa PA01
cuugaccucgacgccga

SEQ ID NO: 1556856 - RNA, 14 nt, Pseudomonas aeruginosa PA01
cuugaccuucugca

SEQ ID NO: 1556857 - RNA, 23 nt, Pseudomonas aeruginosa PA01
cuucuccaccggaucgcccuggc

SEQ ID NO: 1556858 - RNA, 12 nt, Pseudomonas aeruginosa PA01
cuucuccagaau

SEQ ID NO: 1556859 - RNA, 20 nt, Pseudomonas aeruginosa PA01
cuucuccagaaucucccgca

SEQ ID NO: 1556860 - RNA, 21 nt, Pseudomonas aeruginosa PA01
cuucuccagguacagccgcag

SEQ ID NO: 1556861 - RNA, 15 nt, Pseudomonas aeruginosa PA01
cuugaaggcuuccug

SEQ ID NO: 1556862 - RNA, 23 nt, Pseudomonas aeruginosa PA01
cuugaucgcacggcgggacagga

SEQ ID NO: 1556863 - RNA, 15 nt, Pseudomonas aeruginosa PA01
cuugauccgcuccag

SEQ ID NO: 1556864 - RNA, 19 nt, Pseudomonas aeruginosa PA01
cuugaucagccgcaggcag

SEQ ID NO: 1556865 - RNA, 21 nt, Pseudomonas aeruginosa PA01
cuugaucagccgcaggcagaa

SEQ ID NO: 1556866 - RNA, 14 nt, Pseudomonas aeruginosa PA01
cuugagcacccggg

SEQ ID NO: 1556867 - RNA, 13 nt, Pseudomonas aeruginosa PA01
cuugacguucagg

SEQ ID NO: 1556868 - RNA, 16 nt, Pseudomonas aeruginosa PA01
cuugacguucaggcug

SEQ ID NO: 1556869 - RNA, 15 nt, Pseudomonas aeruginosa PA01
cuugcccucagggaa

SEQ ID NO: 1556870 - RNA, 17 nt, Pseudomonas aeruginosa PA01
cuugcccaacuccagcu

SEQ ID NO: 1556871 - RNA, 14 nt, Pseudomonas aeruginosa PA01
cuugccagccgcuu

SEQ ID NO: 1556872 - RNA, 14 nt, Pseudomonas aeruginosa PA01
cuugccagggcagg

SEQ ID NO: 1556873 - RNA, 19 nt, Pseudomonas aeruginosa PA01
cuugccauccuccagcacu

SEQ ID NO: 1556874 - RNA, 23 nt, Pseudomonas aeruginosa PA01
cuugcaguucagccacugccgcc

SEQ ID NO: 1556875 - RNA, 23 nt, Pseudomonas aeruginosa PA01
cuugccaagguguggccgagccc

SEQ ID NO: 1556876 - RNA, 15 nt, Pseudomonas aeruginosa PA01
cuuggcugcucgccu

SEQ ID NO: 1556877 - RNA, 12 nt, Pseudomonas aeruginosa PA01
cuuggcuuccug

SEQ ID NO: 1556878 - RNA, 14 nt, Pseudomonas aeruginosa PA01
cuuggcuuccuggc

SEQ ID NO: 1556879 - RNA, 17 nt, Pseudomonas aeruginosa PA01
cuuggugccgaccuuca

SEQ ID NO: 1556880 - RNA, 18 nt, Pseudomonas aeruginosa PA01
cuugguguagccgagcac

SEQ ID NO: 1556881 - RNA, 13 nt, Pseudomonas aeruginosa PA01
cuuggucgggcgc

SEQ ID NO: 1556882 - RNA, 22 nt, Pseudomonas aeruginosa PA01
cuuggucacgccguucaggguc

SEQ ID NO: 1556883 - RNA, 23 nt, Pseudomonas aeruginosa PA01
cuuggucagggucgagucggguc

SEQ ID NO: 1556884 - RNA, 13 nt, Pseudomonas aeruginosa PA01
cuuggucagggug

SEQ ID NO: 1556885 - RNA, 19 nt, Pseudomonas aeruginosa PA01
cuuggcacgaacccaggcg

SEQ ID NO: 1556886 - RNA, 15 nt, Pseudomonas aeruginosa PA01
cuugcuguugccgcu

SEQ ID NO: 1556887 - RNA, 14 nt, Pseudomonas aeruginosa PA01
cuuggcccuggccu

SEQ ID NO: 1556888 - RNA, 20 nt, Pseudomonas aeruginosa PA01
cuuggccagcagcaucggac

SEQ ID NO: 1556889 - RNA, 19 nt, Pseudomonas aeruginosa PA01
cuuggccagcccuuucagc

SEQ ID NO: 1556890 - RNA, 16 nt, Pseudomonas aeruginosa PA01
cuuggccagcgcggcg

SEQ ID NO: 1556891 - RNA, 15 nt, Pseudomonas aeruginosa PA01
cuuggccacguccuu

SEQ ID NO: 1556892 - RNA, 18 nt, Pseudomonas aeruginosa PA01
cuuggccacguccuuggu

SEQ ID NO: 1556893 - RNA, 16 nt, Pseudomonas aeruginosa PA01
cuuggcgaggcgcgcc

SEQ ID NO: 1556894 - RNA, 19 nt, Pseudomonas aeruginosa PA01
cuuggccuugccguccagc

SEQ ID NO: 1556895 - RNA, 18 nt, Pseudomonas aeruginosa PA01
cuugccgcgagcuuggcc

SEQ ID NO: 1556896 - RNA, 18 nt, Pseudomonas aeruginosa PA01
cuugccgcaggucuuguc

SEQ ID NO: 1556897 - RNA, 17 nt, Pseudomonas aeruginosa PA01
cuugccgcacaguugcg

SEQ ID NO: 1556898 - RNA, 19 nt, Pseudomonas aeruginosa PA01
cuugccgacaagccuccag

SEQ ID NO: 1556899 - RNA, 14 nt, Pseudomonas aeruginosa PA01
cuugccgagcgcga

SEQ ID NO: 1556900 - RNA, 14 nt, Pseudomonas aeruginosa PA01
cuugccgagcuggg

SEQ ID NO: 1556901 - RNA, 18 nt, Pseudomonas aeruginosa PA01
cuugccgcucaggcugug

SEQ ID NO: 1556902 - RNA, 19 nt, Pseudomonas aeruginosa PA01
cuugccgcucaggcugugc

SEQ ID NO: 1556903 - RNA, 13 nt, Pseudomonas aeruginosa PA01
cuugccuuccagg

SEQ ID NO: 1556904 - RNA, 16 nt, Pseudomonas aeruginosa PA01
cuugccuuccaggcug

SEQ ID NO: 1556905 - RNA, 20 nt, Pseudomonas aeruginosa PA01
cuugccgcgcccggccaggc

SEQ ID NO: 1556906 - RNA, 21 nt, Pseudomonas aeruginosa PA01
cuugcgcaccagggccaggag

SEQ ID NO: 1556907 - RNA, 18 nt, Pseudomonas aeruginosa PA01
cuugcgcaccgccugcag

SEQ ID NO: 1556908 - RNA, 16 nt, Pseudomonas aeruginosa PA01
cuugcgcaccgcgccg

SEQ ID NO: 1556909 - RNA, 16 nt, Pseudomonas aeruginosa PA01
cuugcgaaaagcccgc

SEQ ID NO: 1556910 - RNA, 19 nt, Pseudomonas aeruginosa PA01
cuugcgaccagguccggag

SEQ ID NO: 1556911 - RNA, 21 nt, Pseudomonas aeruginosa PA01
cuugcugccggcguccuugcc

SEQ ID NO: 1556912 - RNA, 22 nt, Pseudomonas aeruginosa PA01
cuugcuggcguucucggccagg

SEQ ID NO: 1556913 - RNA, 22 nt, Pseudomonas aeruginosa PA01
cuugucgcagcggccguagcag

SEQ ID NO: 1556914 - RNA, 15 nt, Pseudomonas aeruginosa PA01
cuugucgauggucag

SEQ ID NO: 1556915 - RNA, 12 nt, Pseudomonas aeruginosa PA01
cuuguccuuggc

SEQ ID NO: 1556916 - RNA, 15 nt, Pseudomonas aeruginosa PA01
cuuguccuuggccuc

SEQ ID NO: 1556917 - RNA, 21 nt, Pseudomonas aeruginosa PA01
cuuguccuggauaagccgcgc

SEQ ID NO: 1556918 - RNA, 12 nt, Pseudomonas aeruginosa PA01
cuuugccugaug

SEQ ID NO: 1556919 - RNA, 11 nt, Pseudomonas aeruginosa PA01
cuuugccugga

SEQ ID NO: 1556920 - RNA, 16 nt, Pseudomonas aeruginosa PA01
cuuugccuggaaaaag

SEQ ID NO: 1556921 - RNA, 14 nt, Pseudomonas aeruginosa PA01
cuuugggagcagga

SEQ ID NO: 1556922 - RNA, 18 nt, Pseudomonas aeruginosa PA01
cuuugaccuuggacuugu

SEQ ID NO: 1556923 - RNA, 20 nt, Pseudomonas aeruginosa PA01
cuuuccaccgccagcaccca

SEQ ID NO: 1556924 - RNA, 14 nt, Pseudomonas aeruginosa PA01
cuuucugcccggcu

SEQ ID NO: 1556925 - RNA, 16 nt, Pseudomonas aeruginosa PA01
cuuucugcccggcuuc

SEQ ID NO: 1556926 - RNA, 17 nt, Pseudomonas aeruginosa PA01
cuuagacccacugaaga

SEQ ID NO: 1556927 - RNA, 18 nt, Pseudomonas aeruginosa PA01
cuguucgaccaguugccc

SEQ ID NO: 1556928 - RNA, 21 nt, Pseudomonas aeruginosa PA01
cuguuccacgagagaaaugaa

SEQ ID NO: 1556929 - RNA, 20 nt, Pseudomonas aeruginosa PA01
cuguuccucagccccucgcc

SEQ ID NO: 1556930 - RNA, 13 nt, Pseudomonas aeruginosa PA01
cuguuccuccgcc

SEQ ID NO: 1556931 - RNA, 14 nt, Pseudomonas aeruginosa PA01
cuuauugaaauuaa

SEQ ID NO: 1556932 - RNA, 13 nt, Pseudomonas aeruginosa PA01
cuucaccgcgccg

SEQ ID NO: 1556933 - RNA, 17 nt, Pseudomonas aeruginosa PA01
cuucaccgcgccgcgcu

SEQ ID NO: 1556934 - RNA, 21 nt, Pseudomonas aeruginosa PA01
cuucaccgcgccgcgcuuggc

SEQ ID NO: 1556935 - RNA, 23 nt, Pseudomonas aeruginosa PA01
cuucaccgcgccgcgcuuggccu

SEQ ID NO: 1556936 - RNA, 16 nt, Pseudomonas aeruginosa PA01
cuucaccggcacgccc

SEQ ID NO: 1556937 - RNA, 16 nt, Pseudomonas aeruginosa PA01
cuucaccguucccagc

SEQ ID NO: 1556938 - RNA, 20 nt, Pseudomonas aeruginosa PA01
cuucacgacaggcggcgggc

SEQ ID NO: 1556939 - RNA, 23 nt, Pseudomonas aeruginosa PA01
cuucacucauccucgccgcuggc

SEQ ID NO: 1556940 - RNA, 13 nt, Pseudomonas aeruginosa PA01
cuucaaccacucc

SEQ ID NO: 1556941 - RNA, 15 nt, Pseudomonas aeruginosa PA01
cuucaaccacuccag

SEQ ID NO: 1556942 - RNA, 15 nt, Pseudomonas aeruginosa PA01
cuucgggagagcccg

SEQ ID NO: 1556943 - RNA, 20 nt, Pseudomonas aeruginosa PA01
cuucgggagagcccgggcgc

SEQ ID NO: 1556944 - RNA, 21 nt, Pseudomonas aeruginosa PA01
cuucgggagucaacgccuggc

SEQ ID NO: 1556945 - RNA, 18 nt, Pseudomonas aeruginosa PA01
cuucggcgugauccgcag

SEQ ID NO: 1556946 - RNA, 16 nt, Pseudomonas aeruginosa PA01
cuucggcgcgcggcag

SEQ ID NO: 1556947 - RNA, 18 nt, Pseudomonas aeruginosa PA01
cuucggcggcgccgguga

SEQ ID NO: 1556948 - RNA, 19 nt, Pseudomonas aeruginosa PA01
cuucggccgcaccaggaug

SEQ ID NO: 1556949 - RNA, 19 nt, Pseudomonas aeruginosa PA01
cuucggccaguucgagcag

SEQ ID NO: 1556950 - RNA, 12 nt, Pseudomonas aeruginosa PA01
cuucggcagccu

SEQ ID NO: 1556951 - RNA, 23 nt, Pseudomonas aeruginosa PA01
cuucggcaggaccucgggcgaga

SEQ ID NO: 1556952 - RNA, 21 nt, Pseudomonas aeruginosa PA01
cuucggcgcauagccaccgcc

SEQ ID NO: 1556953 - RNA, 13 nt, Pseudomonas aeruginosa PA01
cuucggauacauc

SEQ ID NO: 1556954 - RNA, 15 nt, Pseudomonas aeruginosa PA01
cuucggcaagcaccu

SEQ ID NO: 1556955 - RNA, 21 nt, Pseudomonas aeruginosa PA01
cuucggaggucgagcagaguu

SEQ ID NO: 1556956 - RNA, 16 nt, Pseudomonas aeruginosa PA01
cuucggacguaggacg

SEQ ID NO: 1556957 - RNA, 15 nt, Pseudomonas aeruginosa PA01
cuucgcuggaccagg

SEQ ID NO: 1556958 - RNA, 15 nt, Pseudomonas aeruginosa PA01
cuucgaucacccggu

SEQ ID NO: 1556959 - RNA, 19 nt, Pseudomonas aeruginosa PA01
cuucgcguucgcuccgggc

SEQ ID NO: 1556960 - RNA, 17 nt, Pseudomonas aeruginosa PA01
cuucgagcacuucccag

SEQ ID NO: 1556961 - RNA, 18 nt, Pseudomonas aeruginosa PA01
cuucgagcacuucccagg

SEQ ID NO: 1556962 - RNA, 17 nt, Pseudomonas aeruginosa PA01
cuucgaaccgcagaaga

SEQ ID NO: 1556963 - RNA, 14 nt, Pseudomonas aeruginosa PA01
cuucgaagaccccc

SEQ ID NO: 1556964 - RNA, 21 nt, Pseudomonas aeruginosa PA01
cuucgaagccgagcugccggg

SEQ ID NO: 1556965 - RNA, 20 nt, Pseudomonas aeruginosa PA01
cuucgacaugggccgcgcag

SEQ ID NO: 1556966 - RNA, 13 nt, Pseudomonas aeruginosa PA01
cuucuaccuggcg

SEQ ID NO: 1556967 - RNA, 13 nt, Pseudomonas aeruginosa PA01
cuucgucggcuuc

SEQ ID NO: 1556968 - RNA, 16 nt, Pseudomonas aeruginosa PA01
cuucguugccauagcc

SEQ ID NO: 1556969 - RNA, 19 nt, Pseudomonas aeruginosa PA01
cuucguugcgaugggugcc

SEQ ID NO: 1556970 - RNA, 13 nt, Pseudomonas aeruginosa PA01
cuucguuccugau

SEQ ID NO: 1556971 - RNA, 14 nt, Pseudomonas aeruginosa PA01
cuucgucgcgcagg

SEQ ID NO: 1556972 - RNA, 16 nt, Pseudomonas aeruginosa PA01
cuucgucgcgcuucag

SEQ ID NO: 1556973 - RNA, 15 nt, Pseudomonas aeruginosa PA01
cuucguccgccuggg

SEQ ID NO: 1556974 - RNA, 16 nt, Pseudomonas aeruginosa PA01
cuucguccugcugcug

SEQ ID NO: 1556975 - RNA, 14 nt, Pseudomonas aeruginosa PA01
cuucguccaggccg

SEQ ID NO: 1556976 - RNA, 21 nt, Pseudomonas aeruginosa PA01
cuucguccaugcucgccaccu

SEQ ID NO: 1556977 - RNA, 15 nt, Pseudomonas aeruginosa PA01
cuucccgcggcucca

SEQ ID NO: 1556978 - RNA, 21 nt, Pseudomonas aeruginosa PA01
cuucccgcggcuccagccgcu

SEQ ID NO: 1556979 - RNA, 20 nt, Pseudomonas aeruginosa PA01
cuuccccgccacuuccagca

SEQ ID NO: 1556980 - RNA, 16 nt, Pseudomonas aeruginosa PA01
cuuccagguacggccc

SEQ ID NO: 1556981 - RNA, 17 nt, Pseudomonas aeruginosa PA01
cuuccaggguuuccagc

SEQ ID NO: 1556982 - RNA, 18 nt, Pseudomonas aeruginosa PA01
cuuccaggguuuccagca

SEQ ID NO: 1556983 - RNA, 12 nt, Pseudomonas aeruginosa PA01
cuuccagcugcc

SEQ ID NO: 1556984 - RNA, 18 nt, Pseudomonas aeruginosa PA01
cuuccagcggccacggcg

SEQ ID NO: 1556985 - RNA, 14 nt, Pseudomonas aeruginosa PA01
cuuccagcgggcgg

SEQ ID NO: 1556986 - RNA, 12 nt, Pseudomonas aeruginosa PA01
cuuccaggcacc

SEQ ID NO: 1556987 - RNA, 19 nt, Pseudomonas aeruginosa PA01
cuuccaggcgugccuguuc

SEQ ID NO: 1556988 - RNA, 20 nt, Pseudomonas aeruginosa PA01
cuuccagcuugcgccagagc

SEQ ID NO: 1556989 - RNA, 22 nt, Pseudomonas aeruginosa PA01
cuuccagcuuggcacggccggc

SEQ ID NO: 1556990 - RNA, 16 nt, Pseudomonas aeruginosa PA01
cuucccugccggcggu

SEQ ID NO: 1556991 - RNA, 14 nt, Pseudomonas aeruginosa PA01
cuuccgucgucacc

SEQ ID NO: 1556992 - RNA, 17 nt, Pseudomonas aeruginosa PA01
cuuccuugcgcgggcaa

SEQ ID NO: 1556993 - RNA, 17 nt, Pseudomonas aeruginosa PA01
cuuccuugcccugggcg

SEQ ID NO: 1556994 - RNA, 19 nt, Pseudomonas aeruginosa PA01
cuuccuugcugaagcccag

SEQ ID NO: 1556995 - RNA, 20 nt, Pseudomonas aeruginosa PA01
cuuccuugcugaagcccagg

SEQ ID NO: 1556996 - RNA, 23 nt, Pseudomonas aeruginosa PA01
cuuccugggcuucguccgccugg

SEQ ID NO: 1556997 - RNA, 21 nt, Pseudomonas aeruginosa PA01
cuuccugggagaacuuuuccc

SEQ ID NO: 1556998 - RNA, 17 nt, Pseudomonas aeruginosa PA01
cuuccuggccgggaacc

SEQ ID NO: 1556999 - RNA, 19 nt, Pseudomonas aeruginosa PA01
cuuccugcugguugaccag

SEQ ID NO: 1557000 - RNA, 15 nt, Pseudomonas aeruginosa PA01
cuuccaccggcuugc

SEQ ID NO: 1557001 - RNA, 16 nt, Pseudomonas aeruginosa PA01
cuuccacuccaggcgg

SEQ ID NO: 1557002 - RNA, 18 nt, Pseudomonas aeruginosa PA01
cuuccaccgccugcccca

SEQ ID NO: 1557003 - RNA, 13 nt, Pseudomonas aeruginosa PA01
cuuccacuuccac

SEQ ID NO: 1557004 - RNA, 16 nt, Pseudomonas aeruginosa PA01
cuuccacuuccaccgg

SEQ ID NO: 1557005 - RNA, 14 nt, Pseudomonas aeruginosa PA01
cuuccagcacgccg

SEQ ID NO: 1557006 - RNA, 15 nt, Pseudomonas aeruginosa PA01
cuuccagcaccuccc

SEQ ID NO: 1557007 - RNA, 15 nt, Pseudomonas aeruginosa PA01
cuuccagccagcccu

SEQ ID NO: 1557008 - RNA, 14 nt, Pseudomonas aeruginosa PA01
cuuccagcaugcuc

SEQ ID NO: 1557009 - RNA, 11 nt, Pseudomonas aeruginosa PA01
cuuccagccgc

SEQ ID NO: 1557010 - RNA, 18 nt, Pseudomonas aeruginosa PA01
cuucacuuccagcugcca

SEQ ID NO: 1557011 - RNA, 20 nt, Pseudomonas aeruginosa PA01
cugcccaagggccugggcgc

SEQ ID NO: 1557012 - RNA, 21 nt, Pseudomonas aeruginosa PA01
cugccagcaggccgagcccga

SEQ ID NO: 1557013 - RNA, 20 nt, Pseudomonas aeruginosa PA01
cugccgauggucucucucug

SEQ ID NO: 1557014 - RNA, 14 nt, Pseudomonas aeruginosa PA01
cugccgcagcgccu

SEQ ID NO: 1557015 - RNA, 16 nt, Pseudomonas aeruginosa PA01
cugccgcagcgccucc

SEQ ID NO: 1557016 - RNA, 20 nt, Pseudomonas aeruginosa PA01
cugccgcagcgccucccggg

SEQ ID NO: 1557017 - RNA, 16 nt, Pseudomonas aeruginosa PA01
cugcccucgaccaggu

SEQ ID NO: 1557018 - RNA, 14 nt, Pseudomonas aeruginosa PA01
cugcccuggcgcgc

SEQ ID NO: 1557019 - RNA, 16 nt, Pseudomonas aeruginosa PA01
cugcccuggcgcgcgc

SEQ ID NO: 1557020 - RNA, 18 nt, Pseudomonas aeruginosa PA01
cugcccuggcgcgcgccc

SEQ ID NO: 1557021 - RNA, 15 nt, Pseudomonas aeruginosa PA01
cugccccucacacca

SEQ ID NO: 1557022 - RNA, 22 nt, Pseudomonas aeruginosa PA01
cugccccucacaccaccagcau

SEQ ID NO: 1557023 - RNA, 22 nt, Pseudomonas aeruginosa PA01
cugccccguagccaugcccggc

SEQ ID NO: 1557024 - RNA, 13 nt, Pseudomonas aeruginosa PA01
cugccccuugagc

SEQ ID NO: 1557025 - RNA, 23 nt, Pseudomonas aeruginosa PA01
cugccccuugagccaguccugga

SEQ ID NO: 1557026 - RNA, 23 nt, Pseudomonas aeruginosa PA01
cugcccgaccgguuccagcggcc

SEQ ID NO: 1557027 - RNA, 22 nt, Pseudomonas aeruginosa PA01
cugcccgacgaaguugcaggcc

SEQ ID NO: 1557028 - RNA, 23 nt, Pseudomonas aeruginosa PA01
cugcaggacgaagucgccggcau

SEQ ID NO: 1557029 - RNA, 20 nt, Pseudomonas aeruginosa PA01
cugcaggaaggcuuccggcu

SEQ ID NO: 1557030 - RNA, 14 nt, Pseudomonas aeruginosa PA01
cugcagcgcgcgcu

SEQ ID NO: 1557031 - RNA, 15 nt, Pseudomonas aeruginosa PA01
cugcagcgcgcgcug

SEQ ID NO: 1557032 - RNA, 19 nt, Pseudomonas aeruginosa PA01
cugcagcgccccagcaccu

SEQ ID NO: 1557033 - RNA, 20 nt, Pseudomonas aeruginosa PA01
cugcagcgacuccagccagg

SEQ ID NO: 1557034 - RNA, 22 nt, Pseudomonas aeruginosa PA01
cugcagcgacuccagccaggcg

SEQ ID NO: 1557035 - RNA, 16 nt, Pseudomonas aeruginosa PA01
cugcagccagcuucag

SEQ ID NO: 1557036 - RNA, 18 nt, Pseudomonas aeruginosa PA01
cugcagccagcuucagcc

SEQ ID NO: 1557037 - RNA, 14 nt, Pseudomonas aeruginosa PA01
cugcaugaccucca

SEQ ID NO: 1557038 - RNA, 15 nt, Pseudomonas aeruginosa PA01
cugcaucggcgcgcc

SEQ ID NO: 1557039 - RNA, 14 nt, Pseudomonas aeruginosa PA01
cugcaucggcucgg

SEQ ID NO: 1557040 - RNA, 19 nt, Pseudomonas aeruginosa PA01
cugcaugugccaggccugg

SEQ ID NO: 1557041 - RNA, 14 nt, Pseudomonas aeruginosa PA01
cugcauggccuugu

SEQ ID NO: 1557042 - RNA, 19 nt, Pseudomonas aeruginosa PA01
cugcaugcuuuugaacacc

SEQ ID NO: 1557043 - RNA, 20 nt, Pseudomonas aeruginosa PA01
cugcauguccgccaguuccg

SEQ ID NO: 1557044 - RNA, 16 nt, Pseudomonas aeruginosa PA01
cugccaacuggcgucc

SEQ ID NO: 1557045 - RNA, 14 nt, Pseudomonas aeruginosa PA01
cugccaaccgcgcu

SEQ ID NO: 1557046 - RNA, 13 nt, Pseudomonas aeruginosa PA01
cugcaccagcagg

SEQ ID NO: 1557047 - RNA, 22 nt, Pseudomonas aeruginosa PA01
cugcaccagccaguccggcagc

SEQ ID NO: 1557048 - RNA, 16 nt, Pseudomonas aeruginosa PA01
cugcacaugcaccacc

SEQ ID NO: 1557049 - RNA, 22 nt, Pseudomonas aeruginosa PA01
cugcacaugcaccaccugcuug

SEQ ID NO: 1557050 - RNA, 22 nt, Pseudomonas aeruginosa PA01
cugcacagguugacgaugcggc

SEQ ID NO: 1557051 - RNA, 19 nt, Pseudomonas aeruginosa PA01
cugcacagccauagcgccg

SEQ ID NO: 1557052 - RNA, 21 nt, Pseudomonas aeruginosa PA01
cugcaacacguagcgcagguc

SEQ ID NO: 1557053 - RNA, 18 nt, Pseudomonas aeruginosa PA01
cugcaacacccaggccug

SEQ ID NO: 1557054 - RNA, 22 nt, Pseudomonas aeruginosa PA01
cugcaacacccaggccugggug

SEQ ID NO: 1557055 - RNA, 15 nt, Pseudomonas aeruginosa PA01
cugcacgcccaggcg

SEQ ID NO: 1557056 - RNA, 19 nt, Pseudomonas aeruginosa PA01
cugcacgcacgcgccugcu

SEQ ID NO: 1557057 - RNA, 22 nt, Pseudomonas aeruginosa PA01
cugcaccgugcgcgcggccugu

SEQ ID NO: 1557058 - RNA, 19 nt, Pseudomonas aeruginosa PA01
cugcaccgcgcggaucccc

SEQ ID NO: 1557059 - RNA, 13 nt, Pseudomonas aeruginosa PA01
cugcaccuuggcc

SEQ ID NO: 1557060 - RNA, 14 nt, Pseudomonas aeruginosa PA01
cugcaccuuggcca

SEQ ID NO: 1557061 - RNA, 14 nt, Pseudomonas aeruginosa PA01
cugcacccuuggcg

SEQ ID NO: 1557062 - RNA, 21 nt, Pseudomonas aeruginosa PA01
cugcacccuuggcgcagguag

SEQ ID NO: 1557063 - RNA, 18 nt, Pseudomonas aeruginosa PA01
cugcaccacgcaggcgcg

SEQ ID NO: 1557064 - RNA, 18 nt, Pseudomonas aeruginosa PA01
cugaugccguucucccgc

SEQ ID NO: 1557065 - RNA, 18 nt, Pseudomonas aeruginosa PA01
cugagcgugacccgcgcu

SEQ ID NO: 1557066 - RNA, 20 nt, Pseudomonas aeruginosa PA01
cugagcgccucgaucgccuc

SEQ ID NO: 1557067 - RNA, 21 nt, Pseudomonas aeruginosa PA01
cugcgucagcgaggcgggcgc

SEQ ID NO: 1557068 - RNA, 16 nt, Pseudomonas aeruginosa PA01
cugcggcugcagggcc

SEQ ID NO: 1557069 - RNA, 18 nt, Pseudomonas aeruginosa PA01
cugcguaguugagcccca

SEQ ID NO: 1557070 - RNA, 17 nt, Pseudomonas aeruginosa PA01
cugcggcggucccagac

SEQ ID NO: 1557071 - RNA, 19 nt, Pseudomonas aeruginosa PA01
cugcggcggucccagacca

SEQ ID NO: 1557072 - RNA, 16 nt, Pseudomonas aeruginosa PA01
cugcggcggcaccacg

SEQ ID NO: 1557073 - RNA, 13 nt, Pseudomonas aeruginosa PA01
cugcggcggcagg

SEQ ID NO: 1557074 - RNA, 19 nt, Pseudomonas aeruginosa PA01
cugcggcccgagggcggca

SEQ ID NO: 1557075 - RNA, 15 nt, Pseudomonas aeruginosa PA01
cugcggccagcgcca

SEQ ID NO: 1557076 - RNA, 14 nt, Pseudomonas aeruginosa PA01
cugcggcaggcgcc

SEQ ID NO: 1557077 - RNA, 15 nt, Pseudomonas aeruginosa PA01
cugcggcaggcgcca

SEQ ID NO: 1557078 - RNA, 14 nt, Pseudomonas aeruginosa PA01
cugcgcugagcagg

SEQ ID NO: 1557079 - RNA, 19 nt, Pseudomonas aeruginosa PA01
cugcgccugcagcucggug

SEQ ID NO: 1557080 - RNA, 22 nt, Pseudomonas aeruginosa PA01
cugcgcguugcagcgccuguuc

SEQ ID NO: 1557081 - RNA, 14 nt, Pseudomonas aeruginosa PA01
cugcgcuccaggcg

SEQ ID NO: 1557082 - RNA, 24 nt, Pseudomonas aeruginosa PA01
cugcgcucggauuccagcgcggug

SEQ ID NO: 1557083 - RNA, 16 nt, Pseudomonas aeruginosa PA01
cugcgcuuccggcagc

SEQ ID NO: 1557084 - RNA, 17 nt, Pseudomonas aeruginosa PA01
cugcgcuuccggcagcc

SEQ ID NO: 1557085 - RNA, 19 nt, Pseudomonas aeruginosa PA01
cugcgcuuccggcagccag

SEQ ID NO: 1557086 - RNA, 21 nt, Pseudomonas aeruginosa PA01
cugcgccgccgucuugccgcu

SEQ ID NO: 1557087 - RNA, 22 nt, Pseudomonas aeruginosa PA01
cugcgccaugccguucaggccg

SEQ ID NO: 1557088 - RNA, 23 nt, Pseudomonas aeruginosa PA01
cugcgccaugccguucaggccgg

SEQ ID NO: 1557089 - RNA, 12 nt, Pseudomonas aeruginosa PA01
cugcgccgccuu

SEQ ID NO: 1557090 - RNA, 22 nt, Pseudomonas aeruginosa PA01
cugcgccgccuuucugcccggc

SEQ ID NO: 1557091 - RNA, 12 nt, Pseudomonas aeruginosa PA01
cugcgccuccuc

SEQ ID NO: 1557092 - RNA, 15 nt, Pseudomonas aeruginosa PA01
cugcgccucgcuggc

SEQ ID NO: 1557093 - RNA, 14 nt, Pseudomonas aeruginosa PA01
cugcgccucggccc

SEQ ID NO: 1557094 - RNA, 18 nt, Pseudomonas aeruginosa PA01
cugcgccucggcccuggc

SEQ ID NO: 1557095 - RNA, 13 nt, Pseudomonas aeruginosa PA01
cugcgccggcgcu

SEQ ID NO: 1557096 - RNA, 16 nt, Pseudomonas aeruginosa PA01
cugcgccggaccagau

SEQ ID NO: 1557097 - RNA, 13 nt, Pseudomonas aeruginosa PA01
cugcgcagaugcg

SEQ ID NO: 1557098 - RNA, 19 nt, Pseudomonas aeruginosa PA01
cugcgcaaggaacuggaag

SEQ ID NO: 1557099 - RNA, 18 nt, Pseudomonas aeruginosa PA01
cugcgaccgugaggcgca

SEQ ID NO: 1557100 - RNA, 19 nt, Pseudomonas aeruginosa PA01
cugcgacaugccgguuccc

SEQ ID NO: 1557101 - RNA, 19 nt, Pseudomonas aeruginosa PA01
cugcgaauugcgcuggaag

SEQ ID NO: 1557102 - RNA, 14 nt, Pseudomonas aeruginosa PA01
cugcgacaguucgc

SEQ ID NO: 1557103 - RNA, 23 nt, Pseudomonas aeruginosa PA01
cugcgaaccgagacccuggcgcu

SEQ ID NO: 1557104 - RNA, 21 nt, Pseudomonas aeruginosa PA01
cugcgaucagggccucgccac

SEQ ID NO: 1557105 - RNA, 15 nt, Pseudomonas aeruginosa PA01
cugccgccagcucau

SEQ ID NO: 1557106 - RNA, 14 nt, Pseudomonas aeruginosa PA01
cugccgccgcagag

SEQ ID NO: 1557107 - RNA, 16 nt, Pseudomonas aeruginosa PA01
cugccgccgcagagcc

SEQ ID NO: 1557108 - RNA, 20 nt, Pseudomonas aeruginosa PA01
cugccgccgucuccgccgcu

SEQ ID NO: 1557109 - RNA, 21 nt, Pseudomonas aeruginosa PA01
cugccuucgacguagaccugg

SEQ ID NO: 1557110 - RNA, 22 nt, Pseudomonas aeruginosa PA01
cugccuuacaagcagagggucg

SEQ ID NO: 1557111 - RNA, 21 nt, Pseudomonas aeruginosa PA01
cugccgcggaagugcgccggu

SEQ ID NO: 1557112 - RNA, 23 nt, Pseudomonas aeruginosa PA01
cugcugcuugcgccguggcacca

SEQ ID NO: 1557113 - RNA, 18 nt, Pseudomonas aeruginosa PA01
cugcuggacggcggacug

SEQ ID NO: 1557114 - RNA, 23 nt, Pseudomonas aeruginosa PA01
cugcuggccgcccuugcggcccg

SEQ ID NO: 1557115 - RNA, 12 nt, Pseudomonas aeruginosa PA01
cugcuggccacc

SEQ ID NO: 1557116 - RNA, 13 nt, Pseudomonas aeruginosa PA01
cugcuggccaccc

SEQ ID NO: 1557117 - RNA, 14 nt, Pseudomonas aeruginosa PA01
cugcuggccacccu

SEQ ID NO: 1557118 - RNA, 17 nt, Pseudomonas aeruginosa PA01
cugcuggccugggacgg

SEQ ID NO: 1557119 - RNA, 22 nt, Pseudomonas aeruginosa PA01
cugcugucgagggucugcucga

SEQ ID NO: 1557120 - RNA, 11 nt, Pseudomonas aeruginosa PA01
cugcugguuga

SEQ ID NO: 1557121 - RNA, 18 nt, Pseudomonas aeruginosa PA01
cugcugguugaccaggcc

SEQ ID NO: 1557122 - RNA, 15 nt, Pseudomonas aeruginosa PA01
cugcugguagcugcu

SEQ ID NO: 1557123 - RNA, 18 nt, Pseudomonas aeruginosa PA01
cugcugguccuggcgcga

SEQ ID NO: 1557124 - RNA, 15 nt, Pseudomonas aeruginosa PA01
cugcugggucaucga

SEQ ID NO: 1557125 - RNA, 15 nt, Pseudomonas aeruginosa PA01
cugcugggugaugca

SEQ ID NO: 1557126 - RNA, 13 nt, Pseudomonas aeruginosa PA01
cugcugcagggcc

SEQ ID NO: 1557127 - RNA, 19 nt, Pseudomonas aeruginosa PA01
cugcugagcagucgccugg

SEQ ID NO: 1557128 - RNA, 15 nt, Pseudomonas aeruginosa PA01
cugcugcccggcaua

SEQ ID NO: 1557129 - RNA, 20 nt, Pseudomonas aeruginosa PA01
cugcugcgggcgcugcaugg

SEQ ID NO: 1557130 - RNA, 16 nt, Pseudomonas aeruginosa PA01
cugcugcggggccgga

SEQ ID NO: 1557131 - RNA, 17 nt, Pseudomonas aeruginosa PA01
cugcugcgccuggccgc

SEQ ID NO: 1557132 - RNA, 12 nt, Pseudomonas aeruginosa PA01
cugcugccggcc

SEQ ID NO: 1557133 - RNA, 16 nt, Pseudomonas aeruginosa PA01
cugcugcgccuggccg

SEQ ID NO: 1557134 - RNA, 15 nt, Pseudomonas aeruginosa PA01
cugcugcgcgcacca

SEQ ID NO: 1557135 - RNA, 15 nt, Pseudomonas aeruginosa PA01
cugcugcugcucagc

SEQ ID NO: 1557136 - RNA, 22 nt, Pseudomonas aeruginosa PA01
cugcugaauucccgcuccaggc

SEQ ID NO: 1557137 - RNA, 20 nt, Pseudomonas aeruginosa PA01
cugcugaaaaacgccugggc

SEQ ID NO: 1557138 - RNA, 22 nt, Pseudomonas aeruginosa PA01
cugcugaaaaacgccugggcgu

SEQ ID NO: 1557139 - RNA, 20 nt, Pseudomonas aeruginosa PA01
cugcucuuucuugucgguca

SEQ ID NO: 1557140 - RNA, 16 nt, Pseudomonas aeruginosa PA01
cugcucguccaggccg

SEQ ID NO: 1557141 - RNA, 17 nt, Pseudomonas aeruginosa PA01
cugcucguccaggccgc

SEQ ID NO: 1557142 - RNA, 18 nt, Pseudomonas aeruginosa PA01
cugcucgucgaugcugcc

SEQ ID NO: 1557143 - RNA, 14 nt, Pseudomonas aeruginosa PA01
cugcucgggcgucu

SEQ ID NO: 1557144 - RNA, 20 nt, Pseudomonas aeruginosa PA01
cugcucgggcgucuccugcc

SEQ ID NO: 1557145 - RNA, 22 nt, Pseudomonas aeruginosa PA01
cugcucgggcgucuccugccgc

SEQ ID NO: 1557146 - RNA, 13 nt, Pseudomonas aeruginosa PA01
cugcucgcggcug

SEQ ID NO: 1557147 - RNA, 15 nt, Pseudomonas aeruginosa PA01
cugcucgcggcuggc

SEQ ID NO: 1557148 - RNA, 17 nt, Pseudomonas aeruginosa PA01
cugcucgcggcuggccg

SEQ ID NO: 1557149 - RNA, 19 nt, Pseudomonas aeruginosa PA01
cugcucgcggcuggccgcc

SEQ ID NO: 1557150 - RNA, 20 nt, Pseudomonas aeruginosa PA01
cugcucgcggcuggccgccu

SEQ ID NO: 1557151 - RNA, 13 nt, Pseudomonas aeruginosa PA01
cugcucggccugc

SEQ ID NO: 1557152 - RNA, 16 nt, Pseudomonas aeruginosa PA01
cugcucggcgcccugg

SEQ ID NO: 1557153 - RNA, 13 nt, Pseudomonas aeruginosa PA01
cugcucccuggcg

SEQ ID NO: 1557154 - RNA, 19 nt, Pseudomonas aeruginosa PA01
cugcuccagcagggccagc

SEQ ID NO: 1557155 - RNA, 14 nt, Pseudomonas aeruginosa PA01
cugcuccagcccgg

SEQ ID NO: 1557156 - RNA, 17 nt, Pseudomonas aeruginosa PA01
cugcgucgucgcggcgc

SEQ ID NO: 1557157 - RNA, 17 nt, Pseudomonas aeruginosa PA01
cugcucgauccagccgg

SEQ ID NO: 1557158 - RNA, 17 nt, Pseudomonas aeruginosa PA01
cugcucgauggccuuga

SEQ ID NO: 1557159 - RNA, 20 nt, Pseudomonas aeruginosa PA01
cugcucgauggcggccuggu

SEQ ID NO: 1557160 - RNA, 20 nt, Pseudomonas aeruginosa PA01
cugcucgaacugcuccuggg

SEQ ID NO: 1557161 - RNA, 14 nt, Pseudomonas aeruginosa PA01
cugcucgcagccgg

SEQ ID NO: 1557162 - RNA, 17 nt, Pseudomonas aeruginosa PA01
cugcucgccgcugaagu

SEQ ID NO: 1557163 - RNA, 20 nt, Pseudomonas aeruginosa PA01
cugcuccugaaggaccagcu

SEQ ID NO: 1557164 - RNA, 15 nt, Pseudomonas aeruginosa PA01
cugcuccucggcagc

SEQ ID NO: 1557165 - RNA, 13 nt, Pseudomonas aeruginosa PA01
cugcuccuccccg

SEQ ID NO: 1557166 - RNA, 20 nt, Pseudomonas aeruginosa PA01
cugcuccuccccguccuggc

SEQ ID NO: 1557167 - RNA, 16 nt, Pseudomonas aeruginosa PA01
cugcuccugcaggccc

SEQ ID NO: 1557168 - RNA, 22 nt, Pseudomonas aeruginosa PA01
cugcuccugcaggcccugccag

SEQ ID NO: 1557169 - RNA, 17 nt, Pseudomonas aeruginosa PA01
cugcucgaaagccucca

SEQ ID NO: 1557170 - RNA, 20 nt, Pseudomonas aeruginosa PA01
cugcucgaccaccucggcgu

SEQ ID NO: 1557171 - RNA, 16 nt, Pseudomonas aeruginosa PA01
cugcucgaccgccugc

SEQ ID NO: 1557172 - RNA, 22 nt, Pseudomonas aeruginosa PA01
cuggaugcagccggggcucagg

SEQ ID NO: 1557173 - RNA, 12 nt, Pseudomonas aeruginosa PA01
cuggaugcccuc

SEQ ID NO: 1557174 - RNA, 19 nt, Pseudomonas aeruginosa PA01
cuggaugcccuccugggcc

SEQ ID NO: 1557175 - RNA, 17 nt, Pseudomonas aeruginosa PA01
cuggaugucgcuggcca

SEQ ID NO: 1557176 - RNA, 14 nt, Pseudomonas aeruginosa PA01
cuggaugucggcga

SEQ ID NO: 1557177 - RNA, 16 nt, Pseudomonas aeruginosa PA01
cuggauggugcccggg

SEQ ID NO: 1557178 - RNA, 22 nt, Pseudomonas aeruginosa PA01
cuggaugaugguauccaggcgg

SEQ ID NO: 1557179 - RNA, 18 nt, Pseudomonas aeruginosa PA01
cuggaugaaacgggcgau

SEQ ID NO: 1557180 - RNA, 18 nt, Pseudomonas aeruginosa PA01
cuggaucggcaggcuggc

SEQ ID NO: 1557181 - RNA, 15 nt, Pseudomonas aeruginosa PA01
cuggaucugguggaa

SEQ ID NO: 1557182 - RNA, 17 nt, Pseudomonas aeruginosa PA01
cuggaucggccccaccu

SEQ ID NO: 1557183 - RNA, 18 nt, Pseudomonas aeruginosa PA01
cuggaucggccccaccug

SEQ ID NO: 1557184 - RNA, 23 nt, Pseudomonas aeruginosa PA01
cuggauguggcuauccuccaggc

SEQ ID NO: 1557185 - RNA, 14 nt, Pseudomonas aeruginosa PA01
cugcuucagcccgg

SEQ ID NO: 1557186 - RNA, 15 nt, Pseudomonas aeruginosa PA01
cugcuucagcccggc

SEQ ID NO: 1557187 - RNA, 14 nt, Pseudomonas aeruginosa PA01
cugcuucggcagcc

SEQ ID NO: 1557188 - RNA, 12 nt, Pseudomonas aeruginosa PA01
cugcuucaggcg

SEQ ID NO: 1557189 - RNA, 22 nt, Pseudomonas aeruginosa PA01
cugcuucagguagugcaacacc

SEQ ID NO: 1557190 - RNA, 16 nt, Pseudomonas aeruginosa PA01
cugcuucgaccagggc

SEQ ID NO: 1557191 - RNA, 19 nt, Pseudomonas aeruginosa PA01
cugcuucgaccagggcauc

SEQ ID NO: 1557192 - RNA, 23 nt, Pseudomonas aeruginosa PA01
cuggaucaggaagguccaggccc

SEQ ID NO: 1557193 - RNA, 14 nt, Pseudomonas aeruginosa PA01
cuggaucagcgccu

SEQ ID NO: 1557194 - RNA, 13 nt, Pseudomonas aeruginosa PA01
cuggauaucuggg

SEQ ID NO: 1557195 - RNA, 16 nt, Pseudomonas aeruginosa PA01
cuggauaucugggcca

SEQ ID NO: 1557196 - RNA, 18 nt, Pseudomonas aeruginosa PA01
cuggcgaaugccuucgac

SEQ ID NO: 1557197 - RNA, 16 nt, Pseudomonas aeruginosa PA01
cuggccgucccugacc

SEQ ID NO: 1557198 - RNA, 19 nt, Pseudomonas aeruginosa PA01
cuggccgucgacccgccuc

SEQ ID NO: 1557199 - RNA, 16 nt, Pseudomonas aeruginosa PA01
cuggcgaacggcuggu

SEQ ID NO: 1557200 - RNA, 22 nt, Pseudomonas aeruginosa PA01
cuggccgcgcgaccgcggcgcu

SEQ ID NO: 1557201 - RNA, 17 nt, Pseudomonas aeruginosa PA01
cuggccgcgcaggaaga

SEQ ID NO: 1557202 - RNA, 14 nt, Pseudomonas aeruginosa PA01
cuggccgcgcggcu

SEQ ID NO: 1557203 - RNA, 22 nt, Pseudomonas aeruginosa PA01
cuggccgcgcggcuugccggcg

SEQ ID NO: 1557204 - RNA, 18 nt, Pseudomonas aeruginosa PA01
cuggccggcacccugacc

SEQ ID NO: 1557205 - RNA, 16 nt, Pseudomonas aeruginosa PA01
cuggccggucguucgc

SEQ ID NO: 1557206 - RNA, 20 nt, Pseudomonas aeruginosa PA01
cuggccggcgaccuugucca

SEQ ID NO: 1557207 - RNA, 19 nt, Pseudomonas aeruginosa PA01
cuggccgggaaccagcaug

SEQ ID NO: 1557208 - RNA, 13 nt, Pseudomonas aeruginosa PA01
cuggccggcggcg

SEQ ID NO: 1557209 - RNA, 14 nt, Pseudomonas aeruginosa PA01
cuggccgcccaggu

SEQ ID NO: 1557210 - RNA, 16 nt, Pseudomonas aeruginosa PA01
cuggccgacccgcagc

SEQ ID NO: 1557211 - RNA, 23 nt, Pseudomonas aeruginosa PA01
cuggccgaucagcuuggccuuga

SEQ ID NO: 1557212 - RNA, 13 nt, Pseudomonas aeruginosa PA01
cuggccgccucgc

SEQ ID NO: 1557213 - RNA, 17 nt, Pseudomonas aeruginosa PA01
cuggccgagcgacuccg

SEQ ID NO: 1557214 - RNA, 20 nt, Pseudomonas aeruginosa PA01
cuggccgagcgccgccuggg

SEQ ID NO: 1557215 - RNA, 17 nt, Pseudomonas aeruginosa PA01
cuggccgagggcgcgca

SEQ ID NO: 1557216 - RNA, 19 nt, Pseudomonas aeruginosa PA01
cuggccgagggcgcgcagu

SEQ ID NO: 1557217 - RNA, 23 nt, Pseudomonas aeruginosa PA01
cuggccgaaauugaccagguacg

SEQ ID NO: 1557218 - RNA, 21 nt, Pseudomonas aeruginosa PA01
cuggccgaaguuguagaugau

SEQ ID NO: 1557219 - RNA, 15 nt, Pseudomonas aeruginosa PA01
cuggcccuggaccuc

SEQ ID NO: 1557220 - RNA, 12 nt, Pseudomonas aeruginosa PA01
cuggcccuggcg

SEQ ID NO: 1557221 - RNA, 20 nt, Pseudomonas aeruginosa PA01
cuggcccugguacagcgccu

SEQ ID NO: 1557222 - RNA, 22 nt, Pseudomonas aeruginosa PA01
cuggccagcaauacccgccgcu

SEQ ID NO: 1557223 - RNA, 18 nt, Pseudomonas aeruginosa PA01
cuggccagcaccaguccc

SEQ ID NO: 1557224 - RNA, 23 nt, Pseudomonas aeruginosa PA01
cuggccagcaccagucccuggcc

SEQ ID NO: 1557225 - RNA, 18 nt, Pseudomonas aeruginosa PA01
cuggccagaaggucgggg

SEQ ID NO: 1557226 - RNA, 19 nt, Pseudomonas aeruginosa PA01
cuggccagaaggucgggga

SEQ ID NO: 1557227 - RNA, 21 nt, Pseudomonas aeruginosa PA01
cuggccagaaggucggggaga

SEQ ID NO: 1557228 - RNA, 15 nt, Pseudomonas aeruginosa PA01
cuggccagcaggcug

SEQ ID NO: 1557229 - RNA, 18 nt, Pseudomonas aeruginosa PA01
cuggccagcaggcuggcg

SEQ ID NO: 1557230 - RNA, 23 nt, Pseudomonas aeruginosa PA01
cuggccagcaggcuggcggcauc

SEQ ID NO: 1557231 - RNA, 11 nt, Pseudomonas aeruginosa PA01
cuggccagcgu

SEQ ID NO: 1557232 - RNA, 14 nt, Pseudomonas aeruginosa PA01
cuggccagggcaug

SEQ ID NO: 1557233 - RNA, 17 nt, Pseudomonas aeruginosa PA01
cuggccaggcgcuccuc

SEQ ID NO: 1557234 - RNA, 18 nt, Pseudomonas aeruginosa PA01
cuggccaguugcaccgca

SEQ ID NO: 1557235 - RNA, 13 nt, Pseudomonas aeruginosa PA01
cuggcugcccagg

SEQ ID NO: 1557236 - RNA, 13 nt, Pseudomonas aeruginosa PA01
cuggcugcccagu

SEQ ID NO: 1557237 - RNA, 14 nt, Pseudomonas aeruginosa PA01
cuggcuggcagguu

SEQ ID NO: 1557238 - RNA, 20 nt, Pseudomonas aeruginosa PA01
cuggcuggaguagcugaagc

SEQ ID NO: 1557239 - RNA, 15 nt, Pseudomonas aeruginosa PA01
cuggcuggccagcag

SEQ ID NO: 1557240 - RNA, 19 nt, Pseudomonas aeruginosa PA01
cuggcucuugccgcgagcu

SEQ ID NO: 1557241 - RNA, 18 nt, Pseudomonas aeruginosa PA01
cuggcugaagacccugca

SEQ ID NO: 1557242 - RNA, 16 nt, Pseudomonas aeruginosa PA01
cuggcugaagccgggc

SEQ ID NO: 1557243 - RNA, 14 nt, Pseudomonas aeruginosa PA01
cuggcucugggcca

SEQ ID NO: 1557244 - RNA, 18 nt, Pseudomonas aeruginosa PA01
cuggcucuguuccucggc

SEQ ID NO: 1557245 - RNA, 19 nt, Pseudomonas aeruginosa PA01
cuggcucuguuccucggcg

SEQ ID NO: 1557246 - RNA, 18 nt, Pseudomonas aeruginosa PA01
cuggcugguaacgggcga

SEQ ID NO: 1557247 - RNA, 16 nt, Pseudomonas aeruginosa PA01
cuggcucaucucguug

SEQ ID NO: 1557248 - RNA, 15 nt, Pseudomonas aeruginosa PA01
cuggcucaggcacuc

SEQ ID NO: 1557249 - RNA, 21 nt, Pseudomonas aeruginosa PA01
cuggcucgaucggcagggcgc

SEQ ID NO: 1557250 - RNA, 14 nt, Pseudomonas aeruginosa PA01
cuggcgcagccagg

SEQ ID NO: 1557251 - RNA, 20 nt, Pseudomonas aeruginosa PA01
cuggcgcagccguucccggu

SEQ ID NO: 1557252 - RNA, 15 nt, Pseudomonas aeruginosa PA01
cuggcgacggcucug

SEQ ID NO: 1557253 - RNA, 12 nt, Pseudomonas aeruginosa PA01
cuggcgcaggcg

SEQ ID NO: 1557254 - RNA, 16 nt, Pseudomonas aeruginosa PA01
cuggcgcaggcggcgc

SEQ ID NO: 1557255 - RNA, 13 nt, Pseudomonas aeruginosa PA01
cuggcgcauggcg

SEQ ID NO: 1557256 - RNA, 15 nt, Pseudomonas aeruginosa PA01
cuggcgcauggcgcu

SEQ ID NO: 1557257 - RNA, 14 nt, Pseudomonas aeruginosa PA01
cuggcgcagcagca

SEQ ID NO: 1557258 - RNA, 15 nt, Pseudomonas aeruginosa PA01
cuggcgcagacaggc

SEQ ID NO: 1557259 - RNA, 22 nt, Pseudomonas aeruginosa PA01
cuggcgcagacaggccuccagc

SEQ ID NO: 1557260 - RNA, 13 nt, Pseudomonas aeruginosa PA01
cuggcgcacggcc

SEQ ID NO: 1557261 - RNA, 20 nt, Pseudomonas aeruginosa PA01
cuggcgcacggccugcaccu

SEQ ID NO: 1557262 - RNA, 14 nt, Pseudomonas aeruginosa PA01
cuggcgccaggccg

SEQ ID NO: 1557263 - RNA, 18 nt, Pseudomonas aeruginosa PA01
cuggcgcauagcggccau

SEQ ID NO: 1557264 - RNA, 20 nt, Pseudomonas aeruginosa PA01
cuggcgccgcgggucugcuc

SEQ ID NO: 1557265 - RNA, 17 nt, Pseudomonas aeruginosa PA01
cuggcgccgcuggcgug

SEQ ID NO: 1557266 - RNA, 20 nt, Pseudomonas aeruginosa PA01
cuggcgucgccuuccaccac

SEQ ID NO: 1557267 - RNA, 14 nt, Pseudomonas aeruginosa PA01
cugggacggcggcu

SEQ ID NO: 1557268 - RNA, 22 nt, Pseudomonas aeruginosa PA01
cugggagaacuuuucccagcgg

SEQ ID NO: 1557269 - RNA, 23 nt, Pseudomonas aeruginosa PA01
cugggacggcagccugggggucu

SEQ ID NO: 1557270 - RNA, 16 nt, Pseudomonas aeruginosa PA01
cugggcaagcugcacg

SEQ ID NO: 1557271 - RNA, 19 nt, Pseudomonas aeruginosa PA01
cugggcaagcugcacggcg

SEQ ID NO: 1557272 - RNA, 13 nt, Pseudomonas aeruginosa PA01
cuggguacaguga

SEQ ID NO: 1557273 - RNA, 18 nt, Pseudomonas aeruginosa PA01
cugggcguggcggccgcc

SEQ ID NO: 1557274 - RNA, 22 nt, Pseudomonas aeruginosa PA01
cugggcguacaggccccaggcg

SEQ ID NO: 1557275 - RNA, 17 nt, Pseudomonas aeruginosa PA01
cugggccccggccggca

SEQ ID NO: 1557276 - RNA, 15 nt, Pseudomonas aeruginosa PA01
cugggccaucgccgg

SEQ ID NO: 1557277 - RNA, 14 nt, Pseudomonas aeruginosa PA01
cugggccgaaggcc

SEQ ID NO: 1557278 - RNA, 18 nt, Pseudomonas aeruginosa PA01
cugggccgaaggccaggc

SEQ ID NO: 1557279 - RNA, 19 nt, Pseudomonas aeruginosa PA01
cugggccgaaggccaggcc

SEQ ID NO: 1557280 - RNA, 16 nt, Pseudomonas aeruginosa PA01
cugggccggcgccagc

SEQ ID NO: 1557281 - RNA, 14 nt, Pseudomonas aeruginosa PA01
cugggcggccaggu

SEQ ID NO: 1557282 - RNA, 17 nt, Pseudomonas aeruginosa PA01
cugggcggcgaccugcg

SEQ ID NO: 1557283 - RNA, 15 nt, Pseudomonas aeruginosa PA01
cugggcggcgggccc

SEQ ID NO: 1557284 - RNA, 19 nt, Pseudomonas aeruginosa PA01
cugguuggccgccuggcgc

SEQ ID NO: 1557285 - RNA, 16 nt, Pseudomonas aeruginosa PA01
cugguuggcgaggucg

SEQ ID NO: 1557286 - RNA, 17 nt, Pseudomonas aeruginosa PA01
cugguugaccaggccca

SEQ ID NO: 1557287 - RNA, 21 nt, Pseudomonas aeruginosa PA01
cugguucugguccaccagccc

SEQ ID NO: 1557288 - RNA, 18 nt, Pseudomonas aeruginosa PA01
cugguuccuggugucggg

SEQ ID NO: 1557289 - RNA, 18 nt, Pseudomonas aeruginosa PA01
cugggucacguggccgcc

SEQ ID NO: 1557290 - RNA, 21 nt, Pseudomonas aeruginosa PA01
cuggguagauuuacaagccca

SEQ ID NO: 1557291 - RNA, 19 nt, Pseudomonas aeruginosa PA01
cuggugcgcguccaucccu

SEQ ID NO: 1557292 - RNA, 20 nt, Pseudomonas aeruginosa PA01
cuggugcgcguccaucccug

SEQ ID NO: 1557293 - RNA, 19 nt, Pseudomonas aeruginosa PA01
cuggugcggcaccagccag

SEQ ID NO: 1557294 - RNA, 15 nt, Pseudomonas aeruginosa PA01
cuggugcggccgaug

SEQ ID NO: 1557295 - RNA, 17 nt, Pseudomonas aeruginosa PA01
cuggugcugcuccauca

SEQ ID NO: 1557296 - RNA, 13 nt, Pseudomonas aeruginosa PA01
cugguggaacagc

SEQ ID NO: 1557297 - RNA, 17 nt, Pseudomonas aeruginosa PA01
cugguggacacccugcu

SEQ ID NO: 1557298 - RNA, 18 nt, Pseudomonas aeruginosa PA01
cugguggcgaacagcacc

SEQ ID NO: 1557299 - RNA, 20 nt, Pseudomonas aeruginosa PA01
cugguggucaccgccagcgg

SEQ ID NO: 1557300 - RNA, 16 nt, Pseudomonas aeruginosa PA01
cuguccagucaccagg

SEQ ID NO: 1557301 - RNA, 17 nt, Pseudomonas aeruginosa PA01
cuguagcucugcuggcu

SEQ ID NO: 1557302 - RNA, 15 nt, Pseudomonas aeruginosa PA01
cuguagcggcuugca

SEQ ID NO: 1557303 - RNA, 13 nt, Pseudomonas aeruginosa PA01
cuguaggacaggu

SEQ ID NO: 1557304 - RNA, 18 nt, Pseudomonas aeruginosa PA01
cuguaggacagguucagg

SEQ ID NO: 1557305 - RNA, 19 nt, Pseudomonas aeruginosa PA01
cuguaggacagguucaggu

SEQ ID NO: 1557306 - RNA, 20 nt, Pseudomonas aeruginosa PA01
cuguaggacagguucagguc

SEQ ID NO: 1557307 - RNA, 14 nt, Pseudomonas aeruginosa PA01
cuguagaccagaua

SEQ ID NO: 1557308 - RNA, 14 nt, Pseudomonas aeruginosa PA01
cuguagcacaugug

SEQ ID NO: 1557309 - RNA, 17 nt, Pseudomonas aeruginosa PA01
cugucuuguccucaucg

SEQ ID NO: 1557310 - RNA, 20 nt, Pseudomonas aeruginosa PA01
cugucgacgcagccgggccg

SEQ ID NO: 1557311 - RNA, 15 nt, Pseudomonas aeruginosa PA01
cugucgaggccucgu

SEQ ID NO: 1557312 - RNA, 20 nt, Pseudomonas aeruginosa PA01
cuguccguugcgcagcacca

SEQ ID NO: 1557313 - RNA, 17 nt, Pseudomonas aeruginosa PA01
cugugaucaggcugucc

SEQ ID NO: 1557314 - RNA, 17 nt, Pseudomonas aeruginosa PA01
cugugcgaggcuggccu

SEQ ID NO: 1557315 - RNA, 15 nt, Pseudomonas aeruginosa PA01
cugugcggcgauguc

SEQ ID NO: 1557316 - RNA, 18 nt, Pseudomonas aeruginosa PA01
cugugcggugccgcgcag

SEQ ID NO: 1557317 - RNA, 15 nt, Pseudomonas aeruginosa PA01
cugugccgaggccgc

SEQ ID NO: 1557318 - RNA, 17 nt, Pseudomonas aeruginosa PA01
cugugccgaggccgccg

SEQ ID NO: 1557319 - RNA, 11 nt, Pseudomonas aeruginosa PA01
cuguggauaac

SEQ ID NO: 1557320 - RNA, 20 nt, Pseudomonas aeruginosa PA01
cuguggaauguccugccgca

SEQ ID NO: 1557321 - RNA, 14 nt, Pseudomonas aeruginosa PA01
cugugcuggccacc

SEQ ID NO: 1557322 - RNA, 18 nt, Pseudomonas aeruginosa PA01
cugugcuggccacccuug

SEQ ID NO: 1557323 - RNA, 13 nt, Pseudomonas aeruginosa PA01
cuccccgucccuc

SEQ ID NO: 1557324 - RNA, 19 nt, Pseudomonas aeruginosa PA01
cuccccgucccucagguag

SEQ ID NO: 1557325 - RNA, 20 nt, Pseudomonas aeruginosa PA01
cuccccuguggucaggcgcc

SEQ ID NO: 1557326 - RNA, 21 nt, Pseudomonas aeruginosa PA01
cuccccuguggucaggcgcca

SEQ ID NO: 1557327 - RNA, 13 nt, Pseudomonas aeruginosa PA01
cuccccucgcccu

SEQ ID NO: 1557328 - RNA, 17 nt, Pseudomonas aeruginosa PA01
cuccccugcuaagggag

SEQ ID NO: 1557329 - RNA, 14 nt, Pseudomonas aeruginosa PA01
cuccccguccuggc

SEQ ID NO: 1557330 - RNA, 16 nt, Pseudomonas aeruginosa PA01
cuccccgccgccaggc

SEQ ID NO: 1557331 - RNA, 19 nt, Pseudomonas aeruginosa PA01
cuccccgcucccgcggccc

SEQ ID NO: 1557332 - RNA, 17 nt, Pseudomonas aeruginosa PA01
cuccccggcccgcgccg

SEQ ID NO: 1557333 - RNA, 19 nt, Pseudomonas aeruginosa PA01
cuccccggcccgcgccgcc

SEQ ID NO: 1557334 - RNA, 16 nt, Pseudomonas aeruginosa PA01
cuccaccgcuccggcg

SEQ ID NO: 1557335 - RNA, 17 nt, Pseudomonas aeruginosa PA01
cuccacccguucgccgg

SEQ ID NO: 1557336 - RNA, 14 nt, Pseudomonas aeruginosa PA01
cuccaccgccaccu

SEQ ID NO: 1557337 - RNA, 14 nt, Pseudomonas aeruginosa PA01
cuccaccagcgccg

SEQ ID NO: 1557338 - RNA, 13 nt, Pseudomonas aeruginosa PA01
cuccacacccggu

SEQ ID NO: 1557339 - RNA, 16 nt, Pseudomonas aeruginosa PA01
cuccgaguccugcugc

SEQ ID NO: 1557340 - RNA, 15 nt, Pseudomonas aeruginosa PA01
cuccgagacgcugca

SEQ ID NO: 1557341 - RNA, 15 nt, Pseudomonas aeruginosa PA01
cucccguccagcgcu

SEQ ID NO: 1557342 - RNA, 22 nt, Pseudomonas aeruginosa PA01
cucccggcuugcugacgaugaa

SEQ ID NO: 1557343 - RNA, 15 nt, Pseudomonas aeruginosa PA01
cucccguaccagcgc

SEQ ID NO: 1557344 - RNA, 15 nt, Pseudomonas aeruginosa PA01
cuccgacuccugcaa

SEQ ID NO: 1557345 - RNA, 17 nt, Pseudomonas aeruginosa PA01
cucccuacgaugcuggc

SEQ ID NO: 1557346 - RNA, 17 nt, Pseudomonas aeruginosa PA01
cuccgucaaugcggccu

SEQ ID NO: 1557347 - RNA, 21 nt, Pseudomonas aeruginosa PA01
cuccgucaaugcggccugcaa

SEQ ID NO: 1557348 - RNA, 14 nt, Pseudomonas aeruginosa PA01
cuccgucuccagca

SEQ ID NO: 1557349 - RNA, 16 nt, Pseudomonas aeruginosa PA01
cuccgguucggcaagg

SEQ ID NO: 1557350 - RNA, 20 nt, Pseudomonas aeruginosa PA01
cuccguugaacucggcgccc

SEQ ID NO: 1557351 - RNA, 17 nt, Pseudomonas aeruginosa PA01
cuccgucuguucggcca

SEQ ID NO: 1557352 - RNA, 13 nt, Pseudomonas aeruginosa PA01
cuccggacgccga

SEQ ID NO: 1557353 - RNA, 23 nt, Pseudomonas aeruginosa PA01
cuccggaugcagauccagcggca

SEQ ID NO: 1557354 - RNA, 18 nt, Pseudomonas aeruginosa PA01
cuccggauggcugacccg

SEQ ID NO: 1557355 - RNA, 18 nt, Pseudomonas aeruginosa PA01
cuccggaacgccugcauc

SEQ ID NO: 1557356 - RNA, 15 nt, Pseudomonas aeruginosa PA01
cuccgcggccggcuu

SEQ ID NO: 1557357 - RNA, 18 nt, Pseudomonas aeruginosa PA01
cuccgcguguucgcggcu

SEQ ID NO: 1557358 - RNA, 21 nt, Pseudomonas aeruginosa PA01
cuccgcuaagcgucacuccca

SEQ ID NO: 1557359 - RNA, 15 nt, Pseudomonas aeruginosa PA01
cuccgcucugcuggc

SEQ ID NO: 1557360 - RNA, 18 nt, Pseudomonas aeruginosa PA01
cuccgcucugcuggccac

SEQ ID NO: 1557361 - RNA, 18 nt, Pseudomonas aeruginosa PA01
cuccuggagguagcugcg

SEQ ID NO: 1557362 - RNA, 20 nt, Pseudomonas aeruginosa PA01
cuccugcggcuggcgaacca

SEQ ID NO: 1557363 - RNA, 14 nt, Pseudomonas aeruginosa PA01
cuccugcugggcgu

SEQ ID NO: 1557364 - RNA, 22 nt, Pseudomonas aeruginosa PA01
cuccuccagcaggaccuggccg

SEQ ID NO: 1557365 - RNA, 15 nt, Pseudomonas aeruginosa PA01
cuccuccagccgcgg

SEQ ID NO: 1557366 - RNA, 14 nt, Pseudomonas aeruginosa PA01
cuccuccagcgccg

SEQ ID NO: 1557367 - RNA, 21 nt, Pseudomonas aeruginosa PA01
cuccuccagcgccgccaggcg

SEQ ID NO: 1557368 - RNA, 22 nt, Pseudomonas aeruginosa PA01
cuccuccgggcgugccaggagc

SEQ ID NO: 1557369 - RNA, 16 nt, Pseudomonas aeruginosa PA01
cuccuccaucucgugg

SEQ ID NO: 1557370 - RNA, 14 nt, Pseudomonas aeruginosa PA01
cuccuccgacgccc

SEQ ID NO: 1557371 - RNA, 13 nt, Pseudomonas aeruginosa PA01
cuccuccgccccg

SEQ ID NO: 1557372 - RNA, 15 nt, Pseudomonas aeruginosa PA01
cuccucccgccccuc

SEQ ID NO: 1557373 - RNA, 22 nt, Pseudomonas aeruginosa PA01
cuccucccgccccuccaguucc

SEQ ID NO: 1557374 - RNA, 18 nt, Pseudomonas aeruginosa PA01
cuccucguaggcguccug

SEQ ID NO: 1557375 - RNA, 15 nt, Pseudomonas aeruginosa PA01
cuccuccucgcucca

SEQ ID NO: 1557376 - RNA, 16 nt, Pseudomonas aeruginosa PA01
cuccuccuccaucucg

SEQ ID NO: 1557377 - RNA, 16 nt, Pseudomonas aeruginosa PA01
cuccuucgagccuggc

SEQ ID NO: 1557378 - RNA, 15 nt, Pseudomonas aeruginosa PA01
cuccuucaucuuggc

SEQ ID NO: 1557379 - RNA, 17 nt, Pseudomonas aeruginosa PA01
cuccuggggaaucugcg

SEQ ID NO: 1557380 - RNA, 18 nt, Pseudomonas aeruginosa PA01
cuccuggggaaucugcgc

SEQ ID NO: 1557381 - RNA, 23 nt, Pseudomonas aeruginosa PA01
cuccuggggaaucugcgccaggu

SEQ ID NO: 1557382 - RNA, 19 nt, Pseudomonas aeruginosa PA01
cuccugggccgacgcuucc

SEQ ID NO: 1557383 - RNA, 20 nt, Pseudomonas aeruginosa PA01
cuccuggcauggcuuuccag

SEQ ID NO: 1557384 - RNA, 19 nt, Pseudomonas aeruginosa PA01
cuccuugaaggcuuccugg

SEQ ID NO: 1557385 - RNA, 16 nt, Pseudomonas aeruginosa PA01
cuccuugcgccaggcc

SEQ ID NO: 1557386 - RNA, 17 nt, Pseudomonas aeruginosa PA01
cucgaaagccgccgccg

SEQ ID NO: 1557387 - RNA, 16 nt, Pseudomonas aeruginosa PA01
cucgaaguccugcagg

SEQ ID NO: 1557388 - RNA, 14 nt, Pseudomonas aeruginosa PA01
cucgaagcgcgccu

SEQ ID NO: 1557389 - RNA, 19 nt, Pseudomonas aeruginosa PA01
cucgacccuggcgccgacc

SEQ ID NO: 1557390 - RNA, 20 nt, Pseudomonas aeruginosa PA01
cucgacccuggcgccgaccu

SEQ ID NO: 1557391 - RNA, 22 nt, Pseudomonas aeruginosa PA01
cucgacccuggcgccgaccucc

SEQ ID NO: 1557392 - RNA, 15 nt, Pseudomonas aeruginosa PA01
cucgaccgcgccggc

SEQ ID NO: 1557393 - RNA, 16 nt, Pseudomonas aeruginosa PA01
cucgaccuggccacgc

SEQ ID NO: 1557394 - RNA, 19 nt, Pseudomonas aeruginosa PA01
cucgaccuggccacgcccg

SEQ ID NO: 1557395 - RNA, 12 nt, Pseudomonas aeruginosa PA01
cucgaccuggcu

SEQ ID NO: 1557396 - RNA, 19 nt, Pseudomonas aeruginosa PA01
cucgacgccgagccagccg

SEQ ID NO: 1557397 - RNA, 14 nt, Pseudomonas aeruginosa PA01
cucgacgcagagcg

SEQ ID NO: 1557398 - RNA, 14 nt, Pseudomonas aeruginosa PA01
cucgacgaucaggu

SEQ ID NO: 1557399 - RNA, 21 nt, Pseudomonas aeruginosa PA01
cucgacgaucaggugcaggaa

SEQ ID NO: 1557400 - RNA, 19 nt, Pseudomonas aeruginosa PA01
cucgacgauauccacgccg

SEQ ID NO: 1557401 - RNA, 18 nt, Pseudomonas aeruginosa PA01
cucgaagaacuccaucuc

SEQ ID NO: 1557402 - RNA, 21 nt, Pseudomonas aeruginosa PA01
cucgaauaaaaaaccggccaa

SEQ ID NO: 1557403 - RNA, 17 nt, Pseudomonas aeruginosa PA01
cucgaagcccagcgccu

SEQ ID NO: 1557404 - RNA, 14 nt, Pseudomonas aeruginosa PA01
cucgaagccgaggc

SEQ ID NO: 1557405 - RNA, 20 nt, Pseudomonas aeruginosa PA01
cucgaagcuccagcgugccc

SEQ ID NO: 1557406 - RNA, 13 nt, Pseudomonas aeruginosa PA01
cucgaaccggaaa

SEQ ID NO: 1557407 - RNA, 17 nt, Pseudomonas aeruginosa PA01
cucgaaccccuggcgcu

SEQ ID NO: 1557408 - RNA, 12 nt, Pseudomonas aeruginosa PA01
cucgaacauggc

SEQ ID NO: 1557409 - RNA, 19 nt, Pseudomonas aeruginosa PA01
cucgaacauggccaccgaa

SEQ ID NO: 1557410 - RNA, 21 nt, Pseudomonas aeruginosa PA01
cucgaacagcaccgagcaggc

SEQ ID NO: 1557411 - RNA, 14 nt, Pseudomonas aeruginosa PA01
cucgaacagcuccu

SEQ ID NO: 1557412 - RNA, 15 nt, Pseudomonas aeruginosa PA01
cucgaacagcuccuc

SEQ ID NO: 1557413 - RNA, 15 nt, Pseudomonas aeruginosa PA01
cucgaacaccaggcg

SEQ ID NO: 1557414 - RNA, 14 nt, Pseudomonas aeruginosa PA01
cucgccgccgggcg

SEQ ID NO: 1557415 - RNA, 18 nt, Pseudomonas aeruginosa PA01
cucgccgucaucgagcag

SEQ ID NO: 1557416 - RNA, 17 nt, Pseudomonas aeruginosa PA01
cucgccgcgcugcauga

SEQ ID NO: 1557417 - RNA, 14 nt, Pseudomonas aeruginosa PA01
cucgccgcgcucca

SEQ ID NO: 1557418 - RNA, 17 nt, Pseudomonas aeruginosa PA01
cucgccgaucuccuccg

SEQ ID NO: 1557419 - RNA, 21 nt, Pseudomonas aeruginosa PA01
cucgccgaucuccuccgcccc

SEQ ID NO: 1557420 - RNA, 14 nt, Pseudomonas aeruginosa PA01
cucgccgacuucca

SEQ ID NO: 1557421 - RNA, 18 nt, Pseudomonas aeruginosa PA01
cucgccgacuuccaggcg

SEQ ID NO: 1557422 - RNA, 17 nt, Pseudomonas aeruginosa PA01
cucgccgaugcccgggc

SEQ ID NO: 1557423 - RNA, 15 nt, Pseudomonas aeruginosa PA01
cucgccgccagcagg

SEQ ID NO: 1557424 - RNA, 13 nt, Pseudomonas aeruginosa PA01
cucgccccgccgg

SEQ ID NO: 1557425 - RNA, 15 nt, Pseudomonas aeruginosa PA01
cucgccccggcggcg

SEQ ID NO: 1557426 - RNA, 22 nt, Pseudomonas aeruginosa PA01
cucgcccuugaccagucccggc

SEQ ID NO: 1557427 - RNA, 21 nt, Pseudomonas aeruginosa PA01
cucgcccugcuuggccagcgc

SEQ ID NO: 1557428 - RNA, 18 nt, Pseudomonas aeruginosa PA01
cucgcagcaggcguucgg

SEQ ID NO: 1557429 - RNA, 16 nt, Pseudomonas aeruginosa PA01
cucgccccagacccag

SEQ ID NO: 1557430 - RNA, 21 nt, Pseudomonas aeruginosa PA01
cucgccccagacccaggugcg

SEQ ID NO: 1557431 - RNA, 19 nt, Pseudomonas aeruginosa PA01
cucgcaccaggccaggugg

SEQ ID NO: 1557432 - RNA, 13 nt, Pseudomonas aeruginosa PA01
cucgaugcccgcc

SEQ ID NO: 1557433 - RNA, 18 nt, Pseudomonas aeruginosa PA01
cucgaugcccgccagcag

SEQ ID NO: 1557434 - RNA, 15 nt, Pseudomonas aeruginosa PA01
cucgaucggcccggg

SEQ ID NO: 1557435 - RNA, 16 nt, Pseudomonas aeruginosa PA01
cucgaucggcccgggc

SEQ ID NO: 1557436 - RNA, 20 nt, Pseudomonas aeruginosa PA01
cucgaucggcccgggcgcca

SEQ ID NO: 1557437 - RNA, 23 nt, Pseudomonas aeruginosa PA01
cucgaucucauggucgggcaggu

SEQ ID NO: 1557438 - RNA, 18 nt, Pseudomonas aeruginosa PA01
cucgaucugucgcagcgg

SEQ ID NO: 1557439 - RNA, 21 nt, Pseudomonas aeruginosa PA01
cucgaugccaucgaggccagg

SEQ ID NO: 1557440 - RNA, 19 nt, Pseudomonas aeruginosa PA01
cucgaugagcaugccgcag

SEQ ID NO: 1557441 - RNA, 22 nt, Pseudomonas aeruginosa PA01
cucgagccgaacuccgguguca

SEQ ID NO: 1557442 - RNA, 16 nt, Pseudomonas aeruginosa PA01
cucgacgcugcccagc

SEQ ID NO: 1557443 - RNA, 22 nt, Pseudomonas aeruginosa PA01
cucgagggcgaccgccaggcgg

SEQ ID NO: 1557444 - RNA, 12 nt, Pseudomonas aeruginosa PA01
cucgaucgccuc

SEQ ID NO: 1557445 - RNA, 21 nt, Pseudomonas aeruginosa PA01
cucgaucgccucgggcgagcg

SEQ ID NO: 1557446 - RNA, 19 nt, Pseudomonas aeruginosa PA01
cucgaggccgagccggcau

SEQ ID NO: 1557447 - RNA, 19 nt, Pseudomonas aeruginosa PA01
cucggccugaucaucuggg

SEQ ID NO: 1557448 - RNA, 19 nt, Pseudomonas aeruginosa PA01
cucggccugcugcgccggc

SEQ ID NO: 1557449 - RNA, 20 nt, Pseudomonas aeruginosa PA01
cucggccuguaccgcuuccu

SEQ ID NO: 1557450 - RNA, 19 nt, Pseudomonas aeruginosa PA01
cucggcgaacuccgccagc

SEQ ID NO: 1557451 - RNA, 16 nt, Pseudomonas aeruginosa PA01
cucggcgacuucgcau

SEQ ID NO: 1557452 - RNA, 13 nt, Pseudomonas aeruginosa PA01
cucggcgagccgc

SEQ ID NO: 1557453 - RNA, 14 nt, Pseudomonas aeruginosa PA01
cucggccagcgccg

SEQ ID NO: 1557454 - RNA, 15 nt, Pseudomonas aeruginosa PA01
cucggccagccaggg

SEQ ID NO: 1557455 - RNA, 17 nt, Pseudomonas aeruginosa PA01
cucggccaacggccgcu

SEQ ID NO: 1557456 - RNA, 17 nt, Pseudomonas aeruginosa PA01
cucggcauucgacccgc

SEQ ID NO: 1557457 - RNA, 16 nt, Pseudomonas aeruginosa PA01
cucggcauccucgccc

SEQ ID NO: 1557458 - RNA, 20 nt, Pseudomonas aeruginosa PA01
cucggcauccucgccccgcc

SEQ ID NO: 1557459 - RNA, 16 nt, Pseudomonas aeruginosa PA01
cucgcgacccuggccg

SEQ ID NO: 1557460 - RNA, 19 nt, Pseudomonas aeruginosa PA01
cucgcgcaaccagccggag

SEQ ID NO: 1557461 - RNA, 21 nt, Pseudomonas aeruginosa PA01
cucggcaaucgcggggugauu

SEQ ID NO: 1557462 - RNA, 15 nt, Pseudomonas aeruginosa PA01
cucgggggugcccau

SEQ ID NO: 1557463 - RNA, 18 nt, Pseudomonas aeruginosa PA01
cucgguauggcugcugug

SEQ ID NO: 1557464 - RNA, 14 nt, Pseudomonas aeruginosa PA01
cucggcggccaggc

SEQ ID NO: 1557465 - RNA, 16 nt, Pseudomonas aeruginosa PA01
cucggcggcaggcugc

SEQ ID NO: 1557466 - RNA, 22 nt, Pseudomonas aeruginosa PA01
cucggcggcaggcugcgccgcu

SEQ ID NO: 1557467 - RNA, 20 nt, Pseudomonas aeruginosa PA01
cucggcgaucgccaggugga

SEQ ID NO: 1557468 - RNA, 22 nt, Pseudomonas aeruginosa PA01
cucggcgaggccggcgaucagc

SEQ ID NO: 1557469 - RNA, 15 nt, Pseudomonas aeruginosa PA01
cucggcgaggaacag

SEQ ID NO: 1557470 - RNA, 10 nt, Pseudomonas aeruginosa PA01
cucggcggcg

SEQ ID NO: 1557471 - RNA, 19 nt, Pseudomonas aeruginosa PA01
cucggcggcgcgaaccagc

SEQ ID NO: 1557472 - RNA, 22 nt, Pseudomonas aeruginosa PA01
cucggcggguauccgccgggcc

SEQ ID NO: 1557473 - RNA, 13 nt, Pseudomonas aeruginosa PA01
cucggcgggcugc

SEQ ID NO: 1557474 - RNA, 18 nt, Pseudomonas aeruginosa PA01
cucggcgggcugccgcgg

SEQ ID NO: 1557475 - RNA, 15 nt, Pseudomonas aeruginosa PA01
cucgucaucauccug

SEQ ID NO: 1557476 - RNA, 16 nt, Pseudomonas aeruginosa PA01
cucguccagcaggacg

SEQ ID NO: 1557477 - RNA, 20 nt, Pseudomonas aeruginosa PA01
cucguagcggucgugcagca

SEQ ID NO: 1557478 - RNA, 23 nt, Pseudomonas aeruginosa PA01
cucguagggguaggggucggccu

SEQ ID NO: 1557479 - RNA, 13 nt, Pseudomonas aeruginosa PA01
cucgguguagcug

SEQ ID NO: 1557480 - RNA, 18 nt, Pseudomonas aeruginosa PA01
cucggugccgucaugcac

SEQ ID NO: 1557481 - RNA, 15 nt, Pseudomonas aeruginosa PA01
cucggugcgccccag

SEQ ID NO: 1557482 - RNA, 17 nt, Pseudomonas aeruginosa PA01
cucggugcgccccaggu

SEQ ID NO: 1557483 - RNA, 18 nt, Pseudomonas aeruginosa PA01
cucggugcgccccaggug

SEQ ID NO: 1557484 - RNA, 15 nt, Pseudomonas aeruginosa PA01
cucggugccuuccca

SEQ ID NO: 1557485 - RNA, 17 nt, Pseudomonas aeruginosa PA01
cucguucgcccagaccu

SEQ ID NO: 1557486 - RNA, 14 nt, Pseudomonas aeruginosa PA01
cucguugcccggcu

SEQ ID NO: 1557487 - RNA, 21 nt, Pseudomonas aeruginosa PA01
cucguguuccggcaggaccuu

SEQ ID NO: 1557488 - RNA, 22 nt, Pseudomonas aeruginosa PA01
cucgucgucggagauagccucc

SEQ ID NO: 1557489 - RNA, 14 nt, Pseudomonas aeruginosa PA01
cucguggcgcgccg

SEQ ID NO: 1557490 - RNA, 14 nt, Pseudomonas aeruginosa PA01
cucugcguucugcu

SEQ ID NO: 1557491 - RNA, 16 nt, Pseudomonas aeruginosa PA01
cucugcuggccgcccu

SEQ ID NO: 1557492 - RNA, 16 nt, Pseudomonas aeruginosa PA01
cucugccugcgcccuc

SEQ ID NO: 1557493 - RNA, 15 nt, Pseudomonas aeruginosa PA01
cucuggccauagaaa

SEQ ID NO: 1557494 - RNA, 17 nt, Pseudomonas aeruginosa PA01
cucuggucaugacgggc

SEQ ID NO: 1557495 - RNA, 14 nt, Pseudomonas aeruginosa PA01
cucugguagcugcg

SEQ ID NO: 1557496 - RNA, 18 nt, Pseudomonas aeruginosa PA01
cucugguagcugcggccg

SEQ ID NO: 1557497 - RNA, 17 nt, Pseudomonas aeruginosa PA01
cucugggcauggcuggc

SEQ ID NO: 1557498 - RNA, 17 nt, Pseudomonas aeruginosa PA01
cucuggcugaagacccu

SEQ ID NO: 1557499 - RNA, 15 nt, Pseudomonas aeruginosa PA01
cucuggccguucucc

SEQ ID NO: 1557500 - RNA, 17 nt, Pseudomonas aeruginosa PA01
cucuggccguucuccag

SEQ ID NO: 1557501 - RNA, 15 nt, Pseudomonas aeruginosa PA01
cucuggccgcgcucc

SEQ ID NO: 1557502 - RNA, 17 nt, Pseudomonas aeruginosa PA01
cucuggccgcgcuccaa

SEQ ID NO: 1557503 - RNA, 23 nt, Pseudomonas aeruginosa PA01
cucugagggacacggcgaccugc

SEQ ID NO: 1557504 - RNA, 19 nt, Pseudomonas aeruginosa PA01
cucugcauggcaccgucaa

SEQ ID NO: 1557505 - RNA, 13 nt, Pseudomonas aeruginosa PA01
cucucgucagggg

SEQ ID NO: 1557506 - RNA, 15 nt, Pseudomonas aeruginosa PA01
cucucucgccucggc

SEQ ID NO: 1557507 - RNA, 18 nt, Pseudomonas aeruginosa PA01
cucucgcgcagcaggauc

SEQ ID NO: 1557508 - RNA, 13 nt, Pseudomonas aeruginosa PA01
cucucgccgcgcu

SEQ ID NO: 1557509 - RNA, 20 nt, Pseudomonas aeruginosa PA01
cucuccgucaaugcggccug

SEQ ID NO: 1557510 - RNA, 21 nt, Pseudomonas aeruginosa PA01
cucucgaacaccaggcgccag

SEQ ID NO: 1557511 - RNA, 14 nt, Pseudomonas aeruginosa PA01
cucucgaacagcag

SEQ ID NO: 1557512 - RNA, 16 nt, Pseudomonas aeruginosa PA01
cucucgaacagcagca

SEQ ID NO: 1557513 - RNA, 22 nt, Pseudomonas aeruginosa PA01
cucucgacuugaacagggucuu

SEQ ID NO: 1557514 - RNA, 23 nt, Pseudomonas aeruginosa PA01
cucucccgaggcgaucgccgcgg

SEQ ID NO: 1557515 - RNA, 21 nt, Pseudomonas aeruginosa PA01
cucuccccaaccuucucccuu

SEQ ID NO: 1557516 - RNA, 13 nt, Pseudomonas aeruginosa PA01
cucuccccagacc

SEQ ID NO: 1557517 - RNA, 15 nt, Pseudomonas aeruginosa PA01
cugaccguccuggcc

SEQ ID NO: 1557518 - RNA, 17 nt, Pseudomonas aeruginosa PA01
cugaccggccgcagcag

SEQ ID NO: 1557519 - RNA, 20 nt, Pseudomonas aeruginosa PA01
cugaccccggccuggcuggc

SEQ ID NO: 1557520 - RNA, 19 nt, Pseudomonas aeruginosa PA01
cugacccgcugcuggaugg

SEQ ID NO: 1557521 - RNA, 23 nt, Pseudomonas aeruginosa PA01
cugacccgcuguccgccggccuc

SEQ ID NO: 1557522 - RNA, 13 nt, Pseudomonas aeruginosa PA01
cugaccagcaggg

SEQ ID NO: 1557523 - RNA, 16 nt, Pseudomonas aeruginosa PA01
cugaccacgcagagcg

SEQ ID NO: 1557524 - RNA, 16 nt, Pseudomonas aeruginosa PA01
cugaaguccuggccga

SEQ ID NO: 1557525 - RNA, 19 nt, Pseudomonas aeruginosa PA01
cugaaguccuggccgagca

SEQ ID NO: 1557526 - RNA, 13 nt, Pseudomonas aeruginosa PA01
cugacggcaagga

SEQ ID NO: 1557527 - RNA, 19 nt, Pseudomonas aeruginosa PA01
cugacggcaaggaccugcu

SEQ ID NO: 1557528 - RNA, 20 nt, Pseudomonas aeruginosa PA01
cugacggcaaggaccugcug

SEQ ID NO: 1557529 - RNA, 15 nt, Pseudomonas aeruginosa PA01
cugacggcggaaggc

SEQ ID NO: 1557530 - RNA, 19 nt, Pseudomonas aeruginosa PA01
cugacgaaggcuggagcgc

SEQ ID NO: 1557531 - RNA, 17 nt, Pseudomonas aeruginosa PA01
cugaccucgagcuggac

SEQ ID NO: 1557532 - RNA, 17 nt, Pseudomonas aeruginosa PA01
cugacgaaguccuugug

SEQ ID NO: 1557533 - RNA, 16 nt, Pseudomonas aeruginosa PA01
cugacgcgcagcgccg

SEQ ID NO: 1557534 - RNA, 21 nt, Pseudomonas aeruginosa PA01
cugagaccuuccugccagcgc

SEQ ID NO: 1557535 - RNA, 19 nt, Pseudomonas aeruginosa PA01
cugagcaggccgacggcgc

SEQ ID NO: 1557536 - RNA, 22 nt, Pseudomonas aeruginosa PA01
cugagcaggccgacggcgcgcu

SEQ ID NO: 1557537 - RNA, 23 nt, Pseudomonas aeruginosa PA01
cugagcagggucaugccuagcac

SEQ ID NO: 1557538 - RNA, 15 nt, Pseudomonas aeruginosa PA01
cugagaucagcgccc

SEQ ID NO: 1557539 - RNA, 18 nt, Pseudomonas aeruginosa PA01
cugagccucuaaggaaaa

SEQ ID NO: 1557540 - RNA, 20 nt, Pseudomonas aeruginosa PA01
cugagccucuaaggaaaaac

SEQ ID NO: 1557541 - RNA, 19 nt, Pseudomonas aeruginosa PA01
cugagcgcauugacacgga

SEQ ID NO: 1557542 - RNA, 13 nt, Pseudomonas aeruginosa PA01
cucugucuccugu

SEQ ID NO: 1557543 - RNA, 19 nt, Pseudomonas aeruginosa PA01
cucuucaggcugucggcca

SEQ ID NO: 1557544 - RNA, 17 nt, Pseudomonas aeruginosa PA01
cucuuccuggaccuccg

SEQ ID NO: 1557545 - RNA, 16 nt, Pseudomonas aeruginosa PA01
cucuuucaccuggucg

SEQ ID NO: 1557546 - RNA, 16 nt, Pseudomonas aeruginosa PA01
cucuuguaagcauuaa

SEQ ID NO: 1557547 - RNA, 18 nt, Pseudomonas aeruginosa PA01
cucuucgccauccuugag

SEQ ID NO: 1557548 - RNA, 14 nt, Pseudomonas aeruginosa PA01
cucuucgucgguca

SEQ ID NO: 1557549 - RNA, 19 nt, Pseudomonas aeruginosa PA01
cucuugccgacaagccucc

SEQ ID NO: 1557550 - RNA, 21 nt, Pseudomonas aeruginosa PA01
cucuugccgcgagcuuggccc

SEQ ID NO: 1557551 - RNA, 12 nt, Pseudomonas aeruginosa PA01
cucuucuugauc

SEQ ID NO: 1557552 - RNA, 18 nt, Pseudomonas aeruginosa PA01
cugaaccgcgucaugcuc

SEQ ID NO: 1557553 - RNA, 11 nt, Pseudomonas aeruginosa PA01
cugaagaagcu

SEQ ID NO: 1557554 - RNA, 13 nt, Pseudomonas aeruginosa PA01
cugaagaagcugc

SEQ ID NO: 1557555 - RNA, 14 nt, Pseudomonas aeruginosa PA01
cugaagaagcugcc

SEQ ID NO: 1557556 - RNA, 14 nt, Pseudomonas aeruginosa PA01
cugaagacccugca

SEQ ID NO: 1557557 - RNA, 21 nt, Pseudomonas aeruginosa PA01
cugaacuggaucggccccacc

SEQ ID NO: 1557558 - RNA, 13 nt, Pseudomonas aeruginosa PA01
cugaagcccaggc

SEQ ID NO: 1557559 - RNA, 19 nt, Pseudomonas aeruginosa PA01
cugaagccccagcccaggg

SEQ ID NO: 1557560 - RNA, 20 nt, Pseudomonas aeruginosa PA01
cugaagccccaguccucgua

SEQ ID NO: 1557561 - RNA, 18 nt, Pseudomonas aeruginosa PA01
cugaaaaaaggggaugcc

SEQ ID NO: 1557562 - RNA, 16 nt, Pseudomonas aeruginosa PA01
cucuuuccgggucauu

SEQ ID NO: 1557563 - RNA, 21 nt, Pseudomonas aeruginosa PA01
cuacccgacaggcagcgccgc

SEQ ID NO: 1557564 - RNA, 15 nt, Pseudomonas aeruginosa PA01
cuaccccaggggucg

SEQ ID NO: 1557565 - RNA, 14 nt, Pseudomonas aeruginosa PA01
cuacucgcccgacc

SEQ ID NO: 1557566 - RNA, 15 nt, Pseudomonas aeruginosa PA01
cuacucgacgcugcc

SEQ ID NO: 1557567 - RNA, 23 nt, Pseudomonas aeruginosa PA01
cuacucgacgcugcccagcccgc

SEQ ID NO: 1557568 - RNA, 18 nt, Pseudomonas aeruginosa PA01
cuacuugaucagccgcag

SEQ ID NO: 1557569 - RNA, 18 nt, Pseudomonas aeruginosa PA01
cuacuucgccggguggaa

SEQ ID NO: 1557570 - RNA, 14 nt, Pseudomonas aeruginosa PA01
cuagacccugggcc

SEQ ID NO: 1557571 - RNA, 15 nt, Pseudomonas aeruginosa PA01
cuagacccugggcca

SEQ ID NO: 1557572 - RNA, 12 nt, Pseudomonas aeruginosa PA01
cuagucuuccug

SEQ ID NO: 1557573 - RNA, 18 nt, Pseudomonas aeruginosa PA01
cuauuccgccaccagcca

SEQ ID NO: 1557574 - RNA, 15 nt, Pseudomonas aeruginosa PA01
cuauucgcccagugg

SEQ ID NO: 1557575 - RNA, 15 nt, Pseudomonas aeruginosa PA01
cuauucccgccgcuc

SEQ ID NO: 1557576 - RNA, 12 nt, Pseudomonas aeruginosa PA01
cuaucgggccga

SEQ ID NO: 1557577 - RNA, 22 nt, Pseudomonas aeruginosa PA01
cuauguauucggcgguccaggg

SEQ ID NO: 1557578 - RNA, 12 nt, Pseudomonas aeruginosa PA01
cuaugcgccggg

SEQ ID NO: 1557579 - RNA, 21 nt, Pseudomonas aeruginosa PA01
cuaucaggugagggcgaccca

SEQ ID NO: 1557580 - RNA, 20 nt, Pseudomonas aeruginosa PA01
cuaucacacuguccagggcg

SEQ ID NO: 1557581 - RNA, 16 nt, Pseudomonas aeruginosa PA01
cucaccgcccugcgcg

SEQ ID NO: 1557582 - RNA, 14 nt, Pseudomonas aeruginosa PA01
cucacccugcuggg

SEQ ID NO: 1557583 - RNA, 16 nt, Pseudomonas aeruginosa PA01
cucacccugcugggcg

SEQ ID NO: 1557584 - RNA, 17 nt, Pseudomonas aeruginosa PA01
cucacccugcugggcgg

SEQ ID NO: 1557585 - RNA, 16 nt, Pseudomonas aeruginosa PA01
cucacccugucccauc

SEQ ID NO: 1557586 - RNA, 21 nt, Pseudomonas aeruginosa PA01
cucacggcgcgagaaaaacca

SEQ ID NO: 1557587 - RNA, 18 nt, Pseudomonas aeruginosa PA01
cucacguagcccccgccg

SEQ ID NO: 1557588 - RNA, 21 nt, Pseudomonas aeruginosa PA01
cucacgugaccguccagcgcg

SEQ ID NO: 1557589 - RNA, 12 nt, Pseudomonas aeruginosa PA01
cucacaccacca

SEQ ID NO: 1557590 - RNA, 16 nt, Pseudomonas aeruginosa PA01
cucaccccacgggcga

SEQ ID NO: 1557591 - RNA, 21 nt, Pseudomonas aeruginosa PA01
cucacagauauugaugcaagg

SEQ ID NO: 1557592 - RNA, 17 nt, Pseudomonas aeruginosa PA01
cucaaaagggugucggg

SEQ ID NO: 1557593 - RNA, 20 nt, Pseudomonas aeruginosa PA01
cucaacugcuuaccuugccg

SEQ ID NO: 1557594 - RNA, 17 nt, Pseudomonas aeruginosa PA01
cucaacugguuggccgc

SEQ ID NO: 1557595 - RNA, 19 nt, Pseudomonas aeruginosa PA01
cucaacugguuggccgccu

SEQ ID NO: 1557596 - RNA, 14 nt, Pseudomonas aeruginosa PA01
cucaacggcgugcc

SEQ ID NO: 1557597 - RNA, 19 nt, Pseudomonas aeruginosa PA01
cucaacggcgugccgggca

SEQ ID NO: 1557598 - RNA, 19 nt, Pseudomonas aeruginosa PA01
cucaacgggaccguccagg

SEQ ID NO: 1557599 - RNA, 17 nt, Pseudomonas aeruginosa PA01
cuccaauucgacgccga

SEQ ID NO: 1557600 - RNA, 12 nt, Pseudomonas aeruginosa PA01
cuccaacgcagg

SEQ ID NO: 1557601 - RNA, 18 nt, Pseudomonas aeruginosa PA01
cuccaacuggcggcuggg

SEQ ID NO: 1557602 - RNA, 17 nt, Pseudomonas aeruginosa PA01
cucauucggccagcgcg

SEQ ID NO: 1557603 - RNA, 14 nt, Pseudomonas aeruginosa PA01
cucaucccugugcg

SEQ ID NO: 1557604 - RNA, 17 nt, Pseudomonas aeruginosa PA01
cucaugaaaaagccccu

SEQ ID NO: 1557605 - RNA, 18 nt, Pseudomonas aeruginosa PA01
cucaugcgcguguugcgc

SEQ ID NO: 1557606 - RNA, 13 nt, Pseudomonas aeruginosa PA01
cucaugcaggccg

SEQ ID NO: 1557607 - RNA, 12 nt, Pseudomonas aeruginosa PA01
cucaugcccagc

SEQ ID NO: 1557608 - RNA, 15 nt, Pseudomonas aeruginosa PA01
cucaugcccagcuuc

SEQ ID NO: 1557609 - RNA, 16 nt, Pseudomonas aeruginosa PA01
cucacugcgagcacca

SEQ ID NO: 1557610 - RNA, 20 nt, Pseudomonas aeruginosa PA01
cucacugcgagcaccaugcc

SEQ ID NO: 1557611 - RNA, 12 nt, Pseudomonas aeruginosa PA01
cucagcgccggc

SEQ ID NO: 1557612 - RNA, 22 nt, Pseudomonas aeruginosa PA01
cucagcgcuucucggcagcgcu

SEQ ID NO: 1557613 - RNA, 13 nt, Pseudomonas aeruginosa PA01
cucagcggcccag

SEQ ID NO: 1557614 - RNA, 18 nt, Pseudomonas aeruginosa PA01
cucagcggcccagcgccc

SEQ ID NO: 1557615 - RNA, 22 nt, Pseudomonas aeruginosa PA01
cucagcggcccagcgccccgcc

SEQ ID NO: 1557616 - RNA, 22 nt, Pseudomonas aeruginosa PA01
cucagcgcgcucggccuggugc

SEQ ID NO: 1557617 - RNA, 20 nt, Pseudomonas aeruginosa PA01
cucagcggaacauuuccuug

SEQ ID NO: 1557618 - RNA, 21 nt, Pseudomonas aeruginosa PA01
cucaggcgcugcgcggccugc

SEQ ID NO: 1557619 - RNA, 21 nt, Pseudomonas aeruginosa PA01
cucaggcggccgaacuggaug

SEQ ID NO: 1557620 - RNA, 23 nt, Pseudomonas aeruginosa PA01
cucagucgcccccaccgcccccg

SEQ ID NO: 1557621 - RNA, 19 nt, Pseudomonas aeruginosa PA01
cucagucgaccgucgccac

SEQ ID NO: 1557622 - RNA, 12 nt, Pseudomonas aeruginosa PA01
cucagggcucca

SEQ ID NO: 1557623 - RNA, 15 nt, Pseudomonas aeruginosa PA01
cucagggccgcgccg

SEQ ID NO: 1557624 - RNA, 19 nt, Pseudomonas aeruginosa PA01
cucagggcgcgaaguagcg

SEQ ID NO: 1557625 - RNA, 13 nt, Pseudomonas aeruginosa PA01
cucaggcgcagcg

SEQ ID NO: 1557626 - RNA, 21 nt, Pseudomonas aeruginosa PA01
cucaggcgcagcguccugccc

SEQ ID NO: 1557627 - RNA, 21 nt, Pseudomonas aeruginosa PA01
cucaggcgccaggccucagaa

SEQ ID NO: 1557628 - RNA, 22 nt, Pseudomonas aeruginosa PA01
cucaggcgccgcugucuaucug

SEQ ID NO: 1557629 - RNA, 23 nt, Pseudomonas aeruginosa PA01
cucaggccgggcggaugaccugu

SEQ ID NO: 1557630 - RNA, 22 nt, Pseudomonas aeruginosa PA01
cucaggcagcgaucgccgccau

SEQ ID NO: 1557631 - RNA, 13 nt, Pseudomonas aeruginosa PA01
cucauaggucagg

SEQ ID NO: 1557632 - RNA, 15 nt, Pseudomonas aeruginosa PA01
cucauaggucaggua

SEQ ID NO: 1557633 - RNA, 14 nt, Pseudomonas aeruginosa PA01
cucauagcucagcu

SEQ ID NO: 1557634 - RNA, 18 nt, Pseudomonas aeruginosa PA01
cucagucgguagagcagu

SEQ ID NO: 1557635 - RNA, 20 nt, Pseudomonas aeruginosa PA01
cucagucgguagagcaguug

SEQ ID NO: 1557636 - RNA, 15 nt, Pseudomonas aeruginosa PA01
cucagucgugcaggu

SEQ ID NO: 1557637 - RNA, 16 nt, Pseudomonas aeruginosa PA01
cucagucgguagagca

SEQ ID NO: 1557638 - RNA, 20 nt, Pseudomonas aeruginosa PA01
cucagucgguagagcaaaug

SEQ ID NO: 1557639 - RNA, 16 nt, Pseudomonas aeruginosa PA01
cuaccauuagaggaac

SEQ ID NO: 1557640 - RNA, 22 nt, Pseudomonas aeruginosa PA01
cuaccauuagaggaacccaauc

SEQ ID NO: 1557641 - RNA, 20 nt, Pseudomonas aeruginosa PA01
cuaccagguucugccagagc

SEQ ID NO: 1557642 - RNA, 20 nt, Pseudomonas aeruginosa PA01
cuaccaccaccauuuccagc

SEQ ID NO: 1557643 - RNA, 15 nt, Pseudomonas aeruginosa PA01
cuacaaugauggccc

SEQ ID NO: 1557644 - RNA, 20 nt, Pseudomonas aeruginosa PA01
cuaaggggcggcucggcucc

SEQ ID NO: 1557645 - RNA, 14 nt, Pseudomonas aeruginosa PA01
cguugcucacgccg

SEQ ID NO: 1557646 - RNA, 16 nt, Pseudomonas aeruginosa PA01
cguugcgguagugccc

SEQ ID NO: 1557647 - RNA, 17 nt, Pseudomonas aeruginosa PA01
cguuguccucggcggcu

SEQ ID NO: 1557648 - RNA, 23 nt, Pseudomonas aeruginosa PA01
cguugucugggaguuccgcgcaa

SEQ ID NO: 1557649 - RNA, 14 nt, Pseudomonas aeruginosa PA01
cguugugccgccac

SEQ ID NO: 1557650 - RNA, 18 nt, Pseudomonas aeruginosa PA01
cguuuucaggcgacgccg

SEQ ID NO: 1557651 - RNA, 17 nt, Pseudomonas aeruginosa PA01
cguuuuucguuucaggu

SEQ ID NO: 1557652 - RNA, 22 nt, Pseudomonas aeruginosa PA01
cguugacgaucugcgagcgcac

SEQ ID NO: 1557653 - RNA, 13 nt, Pseudomonas aeruginosa PA01
cguugaucggcuu

SEQ ID NO: 1557654 - RNA, 20 nt, Pseudomonas aeruginosa PA01
cguugaucggcuugaaguga

SEQ ID NO: 1557655 - RNA, 20 nt, Pseudomonas aeruginosa PA01
cguugaucacgaacagcuug

SEQ ID NO: 1557656 - RNA, 23 nt, Pseudomonas aeruginosa PA01
cguucucgaucaucgccagcggc

SEQ ID NO: 1557657 - RNA, 14 nt, Pseudomonas aeruginosa PA01
cguucucggccagg

SEQ ID NO: 1557658 - RNA, 13 nt, Pseudomonas aeruginosa PA01
cguucuccagguc

SEQ ID NO: 1557659 - RNA, 19 nt, Pseudomonas aeruginosa PA01
cguugccgaccgagcagcg

SEQ ID NO: 1557660 - RNA, 11 nt, Pseudomonas aeruginosa PA01
cguugcccagc

SEQ ID NO: 1557661 - RNA, 22 nt, Pseudomonas aeruginosa PA01
cguugcagcgccuguuccaggg

SEQ ID NO: 1557662 - RNA, 23 nt, Pseudomonas aeruginosa PA01
cguugcaggcccagcuucuuggc

SEQ ID NO: 1557663 - RNA, 17 nt, Pseudomonas aeruginosa PA01
cguugcaguccaggccg

SEQ ID NO: 1557664 - RNA, 18 nt, Pseudomonas aeruginosa PA01
cguugcagugcgccgcag

SEQ ID NO: 1557665 - RNA, 18 nt, Pseudomonas aeruginosa PA01
cguugcgccggcccagca

SEQ ID NO: 1557666 - RNA, 19 nt, Pseudomonas aeruginosa PA01
cguugcgccucgccgcccg

SEQ ID NO: 1557667 - RNA, 13 nt, Pseudomonas aeruginosa PA01
cguugcgccgcag

SEQ ID NO: 1557668 - RNA, 19 nt, Pseudomonas aeruginosa PA01
cguugcgccagaccagccc

SEQ ID NO: 1557669 - RNA, 22 nt, Pseudomonas aeruginosa PA01
cguugcgccagaccagccccag

SEQ ID NO: 1557670 - RNA, 14 nt, Pseudomonas aeruginosa PA01
cguugcgccccggg

SEQ ID NO: 1557671 - RNA, 23 nt, Pseudomonas aeruginosa PA01
cguugcgccccgggucgcugcuc

SEQ ID NO: 1557672 - RNA, 20 nt, Pseudomonas aeruginosa PA01
cguugcgcaggggcgcggcg

SEQ ID NO: 1557673 - RNA, 16 nt, Pseudomonas aeruginosa PA01
cguugccggacuuccu

SEQ ID NO: 1557674 - RNA, 19 nt, Pseudomonas aeruginosa PA01
cguugccggacuuccuugc

SEQ ID NO: 1557675 - RNA, 19 nt, Pseudomonas aeruginosa PA01
cguugccgguacucgccgg

SEQ ID NO: 1557676 - RNA, 20 nt, Pseudomonas aeruginosa PA01
cguuccuucaacagcgaagc

SEQ ID NO: 1557677 - RNA, 20 nt, Pseudomonas aeruginosa PA01
cguucgaggguacuccuggc

SEQ ID NO: 1557678 - RNA, 16 nt, Pseudomonas aeruginosa PA01
cguucgaucuccucgc

SEQ ID NO: 1557679 - RNA, 21 nt, Pseudomonas aeruginosa PA01
cguuccuccucgccgccgacc

SEQ ID NO: 1557680 - RNA, 16 nt, Pseudomonas aeruginosa PA01
cguuccuggaagccga

SEQ ID NO: 1557681 - RNA, 17 nt, Pseudomonas aeruginosa PA01
cguucaugucggcuccu

SEQ ID NO: 1557682 - RNA, 14 nt, Pseudomonas aeruginosa PA01
cguuccaccaggcg

SEQ ID NO: 1557683 - RNA, 16 nt, Pseudomonas aeruginosa PA01
cguuccaccgccugga

SEQ ID NO: 1557684 - RNA, 15 nt, Pseudomonas aeruginosa PA01
cguuccggcgcagcg

SEQ ID NO: 1557685 - RNA, 21 nt, Pseudomonas aeruginosa PA01
cguucaugaaagccagcaaac

SEQ ID NO: 1557686 - RNA, 23 nt, Pseudomonas aeruginosa PA01
cguuauccgccgauacagcgcgc

SEQ ID NO: 1557687 - RNA, 17 nt, Pseudomonas aeruginosa PA01
cguucaggccggcgccg

SEQ ID NO: 1557688 - RNA, 21 nt, Pseudomonas aeruginosa PA01
cguucaggccggcgccgccga

SEQ ID NO: 1557689 - RNA, 15 nt, Pseudomonas aeruginosa PA01
cgucauggcgggcgu

SEQ ID NO: 1557690 - RNA, 12 nt, Pseudomonas aeruginosa PA01
cguccaccgcuu

SEQ ID NO: 1557691 - RNA, 15 nt, Pseudomonas aeruginosa PA01
cguccaccagcgccc

SEQ ID NO: 1557692 - RNA, 23 nt, Pseudomonas aeruginosa PA01
cguccaccauaaagcccacacgc

SEQ ID NO: 1557693 - RNA, 24 nt, Pseudomonas aeruginosa PA01
cguccaccauaaagcccacacgca

SEQ ID NO: 1557694 - RNA, 14 nt, Pseudomonas aeruginosa PA01
aaaaucaaggauuu

SEQ ID NO: 1557695 - RNA, 18 nt, Pseudomonas aeruginosa PA01
aaaacggggcuccccugg

SEQ ID NO: 1557696 - RNA, 18 nt, Pseudomonas aeruginosa PA01
aaaacggcaggcaaaaaa

SEQ ID NO: 1557697 - RNA, 12 nt, Pseudomonas aeruginosa PA01
aaaaauucagcg

SEQ ID NO: 1557698 - RNA, 15 nt, Pseudomonas aeruginosa PA01
aaaaaccaugcgguu

SEQ ID NO: 1557699 - RNA, 20 nt, Pseudomonas aeruginosa PA01
aaacgcauguucaugcgcug

SEQ ID NO: 1557700 - RNA, 18 nt, Pseudomonas aeruginosa PA01
aaacgcccaucuucaggc

SEQ ID NO: 1557701 - RNA, 20 nt, Pseudomonas aeruginosa PA01
aaaccuucgguggcgaccag

SEQ ID NO: 1557702 - RNA, 18 nt, Pseudomonas aeruginosa PA01
aaacggcaggccagcagg

SEQ ID NO: 1557703 - RNA, 19 nt, Pseudomonas aeruginosa PA01
aaacgcuuggcgaucacgg

SEQ ID NO: 1557704 - RNA, 16 nt, Pseudomonas aeruginosa PA01
aaacgcgccuccggca

SEQ ID NO: 1557705 - RNA, 18 nt, Pseudomonas aeruginosa PA01
aaacucgugcuccaccuc

SEQ ID NO: 1557706 - RNA, 19 nt, Pseudomonas aeruginosa PA01
aaacucacccuggcaccga

SEQ ID NO: 1557707 - RNA, 20 nt, Pseudomonas aeruginosa PA01
aaagcccggcauucgccggg

SEQ ID NO: 1557708 - RNA, 17 nt, Pseudomonas aeruginosa PA01
aaagccccgccaaggcg

SEQ ID NO: 1557709 - RNA, 20 nt, Pseudomonas aeruginosa PA01
aaagccccggcaucgccggg

SEQ ID NO: 1557710 - RNA, 14 nt, Pseudomonas aeruginosa PA01
aaagcccagguggc

SEQ ID NO: 1557711 - RNA, 18 nt, Pseudomonas aeruginosa PA01
aaaggggaugccauggca

SEQ ID NO: 1557712 - RNA, 11 nt, Pseudomonas aeruginosa PA01
aaaggggcccg

SEQ ID NO: 1557713 - RNA, 18 nt, Pseudomonas aeruginosa PA01
aaaggccgcguaagcggc

SEQ ID NO: 1557714 - RNA, 20 nt, Pseudomonas aeruginosa PA01
aaaggccaccagagccagcc

SEQ ID NO: 1557715 - RNA, 19 nt, Pseudomonas aeruginosa PA01
aaagggaugccgccggcau

SEQ ID NO: 1557716 - RNA, 17 nt, Pseudomonas aeruginosa PA01
aaauaggcgcugcggua

SEQ ID NO: 1557717 - RNA, 20 nt, Pseudomonas aeruginosa PA01
aaauagucgcgggccugggc

SEQ ID NO: 1557718 - RNA, 12 nt, Pseudomonas aeruginosa PA01
aaauagccggcg

SEQ ID NO: 1557719 - RNA, 13 nt, Pseudomonas aeruginosa PA01
aaauaaccggcgu

SEQ ID NO: 1557720 - RNA, 13 nt, Pseudomonas aeruginosa PA01
aaaucauccacag

SEQ ID NO: 1557721 - RNA, 15 nt, Pseudomonas aeruginosa PA01
aaaugaaaaaggccg

SEQ ID NO: 1557722 - RNA, 13 nt, Pseudomonas aeruginosa PA01
aaaugcucgugca

SEQ ID NO: 1557723 - RNA, 13 nt, Pseudomonas aeruginosa PA01
aaaugcugcaggc

SEQ ID NO: 1557724 - RNA, 15 nt, Pseudomonas aeruginosa PA01
aaaugccgcacccca

SEQ ID NO: 1557725 - RNA, 16 nt, Pseudomonas aeruginosa PA01
aaaugccgcaaacccc

SEQ ID NO: 1557726 - RNA, 13 nt, Pseudomonas aeruginosa PA01
aagugauccaggu

SEQ ID NO: 1557727 - RNA, 20 nt, Pseudomonas aeruginosa PA01
aagucuuucagcuucagggu

SEQ ID NO: 1557728 - RNA, 15 nt, Pseudomonas aeruginosa PA01
aaguugccgccgcug

SEQ ID NO: 1557729 - RNA, 16 nt, Pseudomonas aeruginosa PA01
aaguucuccagcaagc

SEQ ID NO: 1557730 - RNA, 15 nt, Pseudomonas aeruginosa PA01
aauagaaaagaauaa

SEQ ID NO: 1557731 - RNA, 20 nt, Pseudomonas aeruginosa PA01
aauaccgcgcgcgcaaggcc

SEQ ID NO: 1557732 - RNA, 11 nt, Pseudomonas aeruginosa PA01
aauaccgccag

SEQ ID NO: 1557733 - RNA, 14 nt, Pseudomonas aeruginosa PA01
aagcaacggcgaau

SEQ ID NO: 1557734 - RNA, 17 nt, Pseudomonas aeruginosa PA01
aagcaggcggaguagcc

SEQ ID NO: 1557735 - RNA, 16 nt, Pseudomonas aeruginosa PA01
aagcaguaguaccaau

SEQ ID NO: 1557736 - RNA, 17 nt, Pseudomonas aeruginosa PA01
aagcagacguagggcug

SEQ ID NO: 1557737 - RNA, 15 nt, Pseudomonas aeruginosa PA01
aagcagcccagcgcu

SEQ ID NO: 1557738 - RNA, 18 nt, Pseudomonas aeruginosa PA01
aagcaccgacacgcacuc

SEQ ID NO: 1557739 - RNA, 19 nt, Pseudomonas aeruginosa PA01
aagccccuggcgcugggcc

SEQ ID NO: 1557740 - RNA, 14 nt, Pseudomonas aeruginosa PA01
aagcccgccaggug

SEQ ID NO: 1557741 - RNA, 21 nt, Pseudomonas aeruginosa PA01
aagcccgccuugauggcgggc

SEQ ID NO: 1557742 - RNA, 12 nt, Pseudomonas aeruginosa PA01
aagcccagcagg

SEQ ID NO: 1557743 - RNA, 16 nt, Pseudomonas aeruginosa PA01
aagcccaggcgcucgg

SEQ ID NO: 1557744 - RNA, 20 nt, Pseudomonas aeruginosa PA01
aagcccagguggcaggccug

SEQ ID NO: 1557745 - RNA, 17 nt, Pseudomonas aeruginosa PA01
aagccaggaagcggcgg

SEQ ID NO: 1557746 - RNA, 12 nt, Pseudomonas aeruginosa PA01
aagccagccagg

SEQ ID NO: 1557747 - RNA, 18 nt, Pseudomonas aeruginosa PA01
aagcauucuggaugcagc

SEQ ID NO: 1557748 - RNA, 15 nt, Pseudomonas aeruginosa PA01
aaggugcccagggcg

SEQ ID NO: 1557749 - RNA, 23 nt, Pseudomonas aeruginosa PA01
aaggucugcgguauaggccuugg

SEQ ID NO: 1557750 - RNA, 17 nt, Pseudomonas aeruginosa PA01
aaggucgccgggcucac

SEQ ID NO: 1557751 - RNA, 16 nt, Pseudomonas aeruginosa PA01
aaggucggcagcagcu

SEQ ID NO: 1557752 - RNA, 13 nt, Pseudomonas aeruginosa PA01
aaggucggcgaag

SEQ ID NO: 1557753 - RNA, 24 nt, Pseudomonas aeruginosa PA01
aaggucgacaucgauaacaccagg

SEQ ID NO: 1557754 - RNA, 16 nt, Pseudomonas aeruginosa PA01
aaggucagcacgccuu

SEQ ID NO: 1557755 - RNA, 22 nt, Pseudomonas aeruginosa PA01
aaggucaccgaaaggcucuugg

SEQ ID NO: 1557756 - RNA, 18 nt, Pseudomonas aeruginosa PA01
aaggucaccgcucgccag

SEQ ID NO: 1557757 - RNA, 16 nt, Pseudomonas aeruginosa PA01
aagguagcggucgggu

SEQ ID NO: 1557758 - RNA, 13 nt, Pseudomonas aeruginosa PA01
aaggcgcuccccu

SEQ ID NO: 1557759 - RNA, 15 nt, Pseudomonas aeruginosa PA01
aaggcgcugaagcgg

SEQ ID NO: 1557760 - RNA, 17 nt, Pseudomonas aeruginosa PA01
aaggcgaucaucgccac

SEQ ID NO: 1557761 - RNA, 19 nt, Pseudomonas aeruginosa PA01
aaggcgaaacguccggcgu

SEQ ID NO: 1557762 - RNA, 20 nt, Pseudomonas aeruginosa PA01
aaggguuggccgcagcagcg

SEQ ID NO: 1557763 - RNA, 16 nt, Pseudomonas aeruginosa PA01
aagcggaagccgggaa

SEQ ID NO: 1557764 - RNA, 19 nt, Pseudomonas aeruginosa PA01
aagccgccgcccagcagca

SEQ ID NO: 1557765 - RNA, 21 nt, Pseudomonas aeruginosa PA01
aagccgaugaaauagccggcg

SEQ ID NO: 1557766 - RNA, 16 nt, Pseudomonas aeruginosa PA01
aagccgcgcagcacuu

SEQ ID NO: 1557767 - RNA, 22 nt, Pseudomonas aeruginosa PA01
aagccgcgccccagcggcaggc

SEQ ID NO: 1557768 - RNA, 13 nt, Pseudomonas aeruginosa PA01
aagccgcgcucgc

SEQ ID NO: 1557769 - RNA, 24 nt, Pseudomonas aeruginosa PA01
aagcgugggcggccggccaggucg

SEQ ID NO: 1557770 - RNA, 22 nt, Pseudomonas aeruginosa PA01
aagcucgcgcaagcgcccggcg

SEQ ID NO: 1557771 - RNA, 16 nt, Pseudomonas aeruginosa PA01
aagcugccuuccagca

SEQ ID NO: 1557772 - RNA, 17 nt, Pseudomonas aeruginosa PA01
aagcugccuuccagcag

SEQ ID NO: 1557773 - RNA, 21 nt, Pseudomonas aeruginosa PA01
aagcugccuuccagcaggucg

SEQ ID NO: 1557774 - RNA, 14 nt, Pseudomonas aeruginosa PA01
aagcugacgaacau

SEQ ID NO: 1557775 - RNA, 22 nt, Pseudomonas aeruginosa PA01
aagcugacgaacaucgccagcg

SEQ ID NO: 1557776 - RNA, 17 nt, Pseudomonas aeruginosa PA01
aagcuuuuccagcgcac

SEQ ID NO: 1557777 - RNA, 23 nt, Pseudomonas aeruginosa PA01
aagcuucaucgaggugcuugaca

SEQ ID NO: 1557778 - RNA, 11 nt, Pseudomonas aeruginosa PA01
aacgccaggca

SEQ ID NO: 1557779 - RNA, 11 nt, Pseudomonas aeruginosa PA01
aacgccaggcu

SEQ ID NO: 1557780 - RNA, 17 nt, Pseudomonas aeruginosa PA01
aacgccgauggcguuau

SEQ ID NO: 1557781 - RNA, 18 nt, Pseudomonas aeruginosa PA01
aacgccgccacgccgaua

SEQ ID NO: 1557782 - RNA, 17 nt, Pseudomonas aeruginosa PA01
aacgcccggcaucugcc

SEQ ID NO: 1557783 - RNA, 17 nt, Pseudomonas aeruginosa PA01
aacgcccgcggcagcag

SEQ ID NO: 1557784 - RNA, 18 nt, Pseudomonas aeruginosa PA01
aacgcccgcggcagcagc

SEQ ID NO: 1557785 - RNA, 14 nt, Pseudomonas aeruginosa PA01
aacgccagcaggcg

SEQ ID NO: 1557786 - RNA, 21 nt, Pseudomonas aeruginosa PA01
aaccggcgaugcucagcgccg

SEQ ID NO: 1557787 - RNA, 18 nt, Pseudomonas aeruginosa PA01
aaccggcaagcuccgcga

SEQ ID NO: 1557788 - RNA, 22 nt, Pseudomonas aeruginosa PA01
aacgccgcgaaauggcagaaca

SEQ ID NO: 1557789 - RNA, 20 nt, Pseudomonas aeruginosa PA01
aacgccgcgaagcccagcgc

SEQ ID NO: 1557790 - RNA, 13 nt, Pseudomonas aeruginosa PA01
aacgcuguagaau

SEQ ID NO: 1557791 - RNA, 15 nt, Pseudomonas aeruginosa PA01
aacgcuguagaaugc

SEQ ID NO: 1557792 - RNA, 21 nt, Pseudomonas aeruginosa PA01
aacgguaucggcuugccggcg

SEQ ID NO: 1557793 - RNA, 19 nt, Pseudomonas aeruginosa PA01
aacgguagcggaucagccg

SEQ ID NO: 1557794 - RNA, 16 nt, Pseudomonas aeruginosa PA01
aacggaaaaaggcgcc

SEQ ID NO: 1557795 - RNA, 23 nt, Pseudomonas aeruginosa PA01
aacguuuccaugcgguguuuccu

SEQ ID NO: 1557796 - RNA, 16 nt, Pseudomonas aeruginosa PA01
aacgucggccugggug

SEQ ID NO: 1557797 - RNA, 19 nt, Pseudomonas aeruginosa PA01
aacugcacgcccaucgcca

SEQ ID NO: 1557798 - RNA, 17 nt, Pseudomonas aeruginosa PA01
aacuggccagcaccagu

SEQ ID NO: 1557799 - RNA, 12 nt, Pseudomonas aeruginosa PA01
aacuggccaggg

SEQ ID NO: 1557800 - RNA, 15 nt, Pseudomonas aeruginosa PA01
aacucuugaucccgg

SEQ ID NO: 1557801 - RNA, 13 nt, Pseudomonas aeruginosa PA01
aacugggcgagca

SEQ ID NO: 1557802 - RNA, 20 nt, Pseudomonas aeruginosa PA01
aacugggcgagcaucuucuu

SEQ ID NO: 1557803 - RNA, 19 nt, Pseudomonas aeruginosa PA01
aacuggucgccgcaggucc

SEQ ID NO: 1557804 - RNA, 21 nt, Pseudomonas aeruginosa PA01
aacuuggcgcgcagggcaucg

SEQ ID NO: 1557805 - RNA, 23 nt, Pseudomonas aeruginosa PA01
aagaaaaggccgcguaagcggcc

SEQ ID NO: 1557806 - RNA, 18 nt, Pseudomonas aeruginosa PA01
aagaaacgguggaggcgu

SEQ ID NO: 1557807 - RNA, 13 nt, Pseudomonas aeruginosa PA01
aagaacggcccgc

SEQ ID NO: 1557808 - RNA, 23 nt, Pseudomonas aeruginosa PA01
aagaacguauuuccccaacauca

SEQ ID NO: 1557809 - RNA, 20 nt, Pseudomonas aeruginosa PA01
aagaagccgaucaccaccag

SEQ ID NO: 1557810 - RNA, 23 nt, Pseudomonas aeruginosa PA01
aagaagcugccccacaggcccug

SEQ ID NO: 1557811 - RNA, 16 nt, Pseudomonas aeruginosa PA01
aagaagcugccggcau

SEQ ID NO: 1557812 - RNA, 16 nt, Pseudomonas aeruginosa PA01
aagaaggcucaccggu

SEQ ID NO: 1557813 - RNA, 18 nt, Pseudomonas aeruginosa PA01
aacagccgcagcggcaug

SEQ ID NO: 1557814 - RNA, 13 nt, Pseudomonas aeruginosa PA01
aacagccgcccca

SEQ ID NO: 1557815 - RNA, 15 nt, Pseudomonas aeruginosa PA01
aacagcgagcccagg

SEQ ID NO: 1557816 - RNA, 14 nt, Pseudomonas aeruginosa PA01
aaccgaacaggcga

SEQ ID NO: 1557817 - RNA, 13 nt, Pseudomonas aeruginosa PA01
aacccucaggucg

SEQ ID NO: 1557818 - RNA, 21 nt, Pseudomonas aeruginosa PA01
aacccucggugcggccgagga

SEQ ID NO: 1557819 - RNA, 15 nt, Pseudomonas aeruginosa PA01
aacccugggaauggc

SEQ ID NO: 1557820 - RNA, 12 nt, Pseudomonas aeruginosa PA01
aaccgcgcucgg

SEQ ID NO: 1557821 - RNA, 19 nt, Pseudomonas aeruginosa PA01
aaccgcggcgcccucugcc

SEQ ID NO: 1557822 - RNA, 13 nt, Pseudomonas aeruginosa PA01
aaccgcugccgcc

SEQ ID NO: 1557823 - RNA, 22 nt, Pseudomonas aeruginosa PA01
aaccgccaucgauggucaggcu

SEQ ID NO: 1557824 - RNA, 19 nt, Pseudomonas aeruginosa PA01
aaccgauggccagggggcc

SEQ ID NO: 1557825 - RNA, 10 nt, Pseudomonas aeruginosa PA01
aaccgcaagc

SEQ ID NO: 1557826 - RNA, 17 nt, Pseudomonas aeruginosa PA01
aacccagacagcccucc

SEQ ID NO: 1557827 - RNA, 14 nt, Pseudomonas aeruginosa PA01
aacccggccaggcc

SEQ ID NO: 1557828 - RNA, 14 nt, Pseudomonas aeruginosa PA01
aacccggcccaggc

SEQ ID NO: 1557829 - RNA, 21 nt, Pseudomonas aeruginosa PA01
aacccgugguccgccagcagg

SEQ ID NO: 1557830 - RNA, 22 nt, Pseudomonas aeruginosa PA01
aacccgugguccgccagcaggc

SEQ ID NO: 1557831 - RNA, 13 nt, Pseudomonas aeruginosa PA01
aaccacuccagcg

SEQ ID NO: 1557832 - RNA, 14 nt, Pseudomonas aeruginosa PA01
aaccacuccgccac

SEQ ID NO: 1557833 - RNA, 21 nt, Pseudomonas aeruginosa PA01
aaccacuccgccacccgcucc

SEQ ID NO: 1557834 - RNA, 18 nt, Pseudomonas aeruginosa PA01
aacacacgcuucugcugg

SEQ ID NO: 1557835 - RNA, 23 nt, Pseudomonas aeruginosa PA01
aacaccacaaggugggcagcagc

SEQ ID NO: 1557836 - RNA, 22 nt, Pseudomonas aeruginosa PA01
aacaccagcgccgccaggcaga

SEQ ID NO: 1557837 - RNA, 11 nt, Pseudomonas aeruginosa PA01
aacaccaggcc

SEQ ID NO: 1557838 - RNA, 13 nt, Pseudomonas aeruginosa PA01
aacaccaggccga

SEQ ID NO: 1557839 - RNA, 22 nt, Pseudomonas aeruginosa PA01
aacaccaucggccccaccgcac

SEQ ID NO: 1557840 - RNA, 15 nt, Pseudomonas aeruginosa PA01
aacacccaggccugg

SEQ ID NO: 1557841 - RNA, 15 nt, Pseudomonas aeruginosa PA01
aacacucgugaauuc

SEQ ID NO: 1557842 - RNA, 17 nt, Pseudomonas aeruginosa PA01
aacagcagcggcaccag

SEQ ID NO: 1557843 - RNA, 10 nt, Pseudomonas aeruginosa PA01
aacagcagcu

SEQ ID NO: 1557844 - RNA, 17 nt, Pseudomonas aeruginosa PA01
aacagcagggucagggu

SEQ ID NO: 1557845 - RNA, 15 nt, Pseudomonas aeruginosa PA01
aacagcaaagcgcag

SEQ ID NO: 1557846 - RNA, 11 nt, Pseudomonas aeruginosa PA01
aacagcagcaa

SEQ ID NO: 1557847 - RNA, 17 nt, Pseudomonas aeruginosa PA01
aauggacaggcgccccu

SEQ ID NO: 1557848 - RNA, 11 nt, Pseudomonas aeruginosa PA01
aaugcgccccc

SEQ ID NO: 1557849 - RNA, 14 nt, Pseudomonas aeruginosa PA01
aaugcuugaaaauc

SEQ ID NO: 1557850 - RNA, 18 nt, Pseudomonas aeruginosa PA01
aaugcaacccgccgcuga

SEQ ID NO: 1557851 - RNA, 18 nt, Pseudomonas aeruginosa PA01
aauguccugccgcaggcg

SEQ ID NO: 1557852 - RNA, 24 nt, Pseudomonas aeruginosa PA01
aauugcaggcccggccgccugccu

SEQ ID NO: 1557853 - RNA, 15 nt, Pseudomonas aeruginosa PA01
aauugccgguagccg

SEQ ID NO: 1557854 - RNA, 15 nt, Pseudomonas aeruginosa PA01
aaucugcgccaggug

SEQ ID NO: 1557855 - RNA, 14 nt, Pseudomonas aeruginosa PA01
aaucgcgccaggcc

SEQ ID NO: 1557856 - RNA, 19 nt, Pseudomonas aeruginosa PA01
aauccgcauagugacccca

SEQ ID NO: 1557857 - RNA, 16 nt, Pseudomonas aeruginosa PA01
aauccuccagccggcg

SEQ ID NO: 1557858 - RNA, 13 nt, Pseudomonas aeruginosa PA01
aauccuugaucac

SEQ ID NO: 1557859 - RNA, 15 nt, Pseudomonas aeruginosa PA01
aaucgagcgccagga

SEQ ID NO: 1557860 - RNA, 19 nt, Pseudomonas aeruginosa PA01
acaaucccagcucgccgaa

SEQ ID NO: 1557861 - RNA, 14 nt, Pseudomonas aeruginosa PA01
acaagggccagagc

SEQ ID NO: 1557862 - RNA, 15 nt, Pseudomonas aeruginosa PA01
acaagggccagagca

SEQ ID NO: 1557863 - RNA, 23 nt, Pseudomonas aeruginosa PA01
acaagcguuaccggcagguggcc

SEQ ID NO: 1557864 - RNA, 16 nt, Pseudomonas aeruginosa PA01
acaagcgcaacgcgcg

SEQ ID NO: 1557865 - RNA, 15 nt, Pseudomonas aeruginosa PA01
acaacgacagccccg

SEQ ID NO: 1557866 - RNA, 20 nt, Pseudomonas aeruginosa PA01
acaccuuggugucgaugccg

SEQ ID NO: 1557867 - RNA, 15 nt, Pseudomonas aeruginosa PA01
acaccugcaacgccc

SEQ ID NO: 1557868 - RNA, 14 nt, Pseudomonas aeruginosa PA01
acacgcacucauag

SEQ ID NO: 1557869 - RNA, 19 nt, Pseudomonas aeruginosa PA01
acacgcacucauagcucag

SEQ ID NO: 1557870 - RNA, 12 nt, Pseudomonas aeruginosa PA01
acacgcccggca

SEQ ID NO: 1557871 - RNA, 14 nt, Pseudomonas aeruginosa PA01
acacgaauggcuuc

SEQ ID NO: 1557872 - RNA, 18 nt, Pseudomonas aeruginosa PA01
acacaaaaaaaccgcccc

SEQ ID NO: 1557873 - RNA, 14 nt, Pseudomonas aeruginosa PA01
acacaaaaaacccg

SEQ ID NO: 1557874 - RNA, 15 nt, Pseudomonas aeruginosa PA01
acacauggucggcca

SEQ ID NO: 1557875 - RNA, 18 nt, Pseudomonas aeruginosa PA01
acacauggucggccaggu

SEQ ID NO: 1557876 - RNA, 16 nt, Pseudomonas aeruginosa PA01
acaccgagcgcaguuc

SEQ ID NO: 1557877 - RNA, 21 nt, Pseudomonas aeruginosa PA01
acacccaggccuggguguugu

SEQ ID NO: 1557878 - RNA, 16 nt, Pseudomonas aeruginosa PA01
acaccccgucaacccu

SEQ ID NO: 1557879 - RNA, 14 nt, Pseudomonas aeruginosa PA01
acaccgccagcacc

SEQ ID NO: 1557880 - RNA, 15 nt, Pseudomonas aeruginosa PA01
acaccgccagcaccu

SEQ ID NO: 1557881 - RNA, 15 nt, Pseudomonas aeruginosa PA01
acaccaccagcauca

SEQ ID NO: 1557882 - RNA, 18 nt, Pseudomonas aeruginosa PA01
acaacccggcgcuggccg

SEQ ID NO: 1557883 - RNA, 15 nt, Pseudomonas aeruginosa PA01
acaucgucugcgcgg

SEQ ID NO: 1557884 - RNA, 15 nt, Pseudomonas aeruginosa PA01
acaugccgaagagcu

SEQ ID NO: 1557885 - RNA, 20 nt, Pseudomonas aeruginosa PA01
acauggucgagaaggcugcc

SEQ ID NO: 1557886 - RNA, 18 nt, Pseudomonas aeruginosa PA01
acaucauccacagcgugc

SEQ ID NO: 1557887 - RNA, 16 nt, Pseudomonas aeruginosa PA01
acauccggguccagcg

SEQ ID NO: 1557888 - RNA, 19 nt, Pseudomonas aeruginosa PA01
acagguucggcaggccuuc

SEQ ID NO: 1557889 - RNA, 17 nt, Pseudomonas aeruginosa PA01
acaggucggcgaaaucc

SEQ ID NO: 1557890 - RNA, 17 nt, Pseudomonas aeruginosa PA01
acaggucgguguugcgc

SEQ ID NO: 1557891 - RNA, 22 nt, Pseudomonas aeruginosa PA01
acaggucgacggcuuccagggu

SEQ ID NO: 1557892 - RNA, 22 nt, Pseudomonas aeruginosa PA01
acagguacucggcccgggccug

SEQ ID NO: 1557893 - RNA, 19 nt, Pseudomonas aeruginosa PA01
acagggcgucgucgaggcu

SEQ ID NO: 1557894 - RNA, 16 nt, Pseudomonas aeruginosa PA01
acagggcgagcagggc

SEQ ID NO: 1557895 - RNA, 17 nt, Pseudomonas aeruginosa PA01
acagggcgagcagggcg

SEQ ID NO: 1557896 - RNA, 18 nt, Pseudomonas aeruginosa PA01
acagggcgagcagggcgc

SEQ ID NO: 1557897 - RNA, 22 nt, Pseudomonas aeruginosa PA01
acagucgucgcgcagcuccucg

SEQ ID NO: 1557898 - RNA, 17 nt, Pseudomonas aeruginosa PA01
acagucgaugacgaggc

SEQ ID NO: 1557899 - RNA, 22 nt, Pseudomonas aeruginosa PA01
acaguuucauggugcccagcag

SEQ ID NO: 1557900 - RNA, 23 nt, Pseudomonas aeruginosa PA01
acaguuucauggugcccagcagg

SEQ ID NO: 1557901 - RNA, 13 nt, Pseudomonas aeruginosa PA01
acaguugagcugu

SEQ ID NO: 1557902 - RNA, 18 nt, Pseudomonas aeruginosa PA01
acaguugagcugugguug

SEQ ID NO: 1557903 - RNA, 14 nt, Pseudomonas aeruginosa PA01
acaguucaggcugg

SEQ ID NO: 1557904 - RNA, 15 nt, Pseudomonas aeruginosa PA01
acaguucaggcuggg

SEQ ID NO: 1557905 - RNA, 13 nt, Pseudomonas aeruginosa PA01
acagugccaggcu

SEQ ID NO: 1557906 - RNA, 19 nt, Pseudomonas aeruginosa PA01
acaguggguaggccaggca

SEQ ID NO: 1557907 - RNA, 16 nt, Pseudomonas aeruginosa PA01
acagcgccaccagcau

SEQ ID NO: 1557908 - RNA, 15 nt, Pseudomonas aeruginosa PA01
acagcgccagcggca

SEQ ID NO: 1557909 - RNA, 15 nt, Pseudomonas aeruginosa PA01
acagcgagaggggcg

SEQ ID NO: 1557910 - RNA, 16 nt, Pseudomonas aeruginosa PA01
acagcgagaggggcgc

SEQ ID NO: 1557911 - RNA, 18 nt, Pseudomonas aeruginosa PA01
acagcgagaggggcgcuc

SEQ ID NO: 1557912 - RNA, 21 nt, Pseudomonas aeruginosa PA01
acagcucaccccaggaaaaca

SEQ ID NO: 1557913 - RNA, 16 nt, Pseudomonas aeruginosa PA01
acaggcgucccauggc

SEQ ID NO: 1557914 - RNA, 17 nt, Pseudomonas aeruginosa PA01
acaggcgcuucagcucg

SEQ ID NO: 1557915 - RNA, 16 nt, Pseudomonas aeruginosa PA01
acaggcggcuguugcc

SEQ ID NO: 1557916 - RNA, 19 nt, Pseudomonas aeruginosa PA01
acaggcugugcgccaggcc

SEQ ID NO: 1557917 - RNA, 22 nt, Pseudomonas aeruginosa PA01
acaggcugugcgccaggccggu

SEQ ID NO: 1557918 - RNA, 13 nt, Pseudomonas aeruginosa PA01
acaggcuggccag

SEQ ID NO: 1557919 - RNA, 13 nt, Pseudomonas aeruginosa PA01
acaggcuggugcc

SEQ ID NO: 1557920 - RNA, 17 nt, Pseudomonas aeruginosa PA01
acagggaacacgcaacc

SEQ ID NO: 1557921 - RNA, 15 nt, Pseudomonas aeruginosa PA01
acaggcgcaugccau

SEQ ID NO: 1557922 - RNA, 12 nt, Pseudomonas aeruginosa PA01
acaggcgcgccu

SEQ ID NO: 1557923 - RNA, 14 nt, Pseudomonas aeruginosa PA01
acaggaagcgguag

SEQ ID NO: 1557924 - RNA, 18 nt, Pseudomonas aeruginosa PA01
acaggaagagcaggcgga

SEQ ID NO: 1557925 - RNA, 22 nt, Pseudomonas aeruginosa PA01
acagccugggcggcuuccugcu

SEQ ID NO: 1557926 - RNA, 15 nt, Pseudomonas aeruginosa PA01
acagccgguugcguu

SEQ ID NO: 1557927 - RNA, 18 nt, Pseudomonas aeruginosa PA01
acagccauagugcugggc

SEQ ID NO: 1557928 - RNA, 18 nt, Pseudomonas aeruginosa PA01
acagcaggucgugcugga

SEQ ID NO: 1557929 - RNA, 16 nt, Pseudomonas aeruginosa PA01
acagcagguagaccac

SEQ ID NO: 1557930 - RNA, 13 nt, Pseudomonas aeruginosa PA01
acagcaggcaggc

SEQ ID NO: 1557931 - RNA, 14 nt, Pseudomonas aeruginosa PA01
acagcaggcaggca

SEQ ID NO: 1557932 - RNA, 22 nt, Pseudomonas aeruginosa PA01
acagcaggagaagcgccucgcc

SEQ ID NO: 1557933 - RNA, 20 nt, Pseudomonas aeruginosa PA01
acagcaggagcgccaucagc

SEQ ID NO: 1557934 - RNA, 19 nt, Pseudomonas aeruginosa PA01
acacguagcgcaggucgcu

SEQ ID NO: 1557935 - RNA, 14 nt, Pseudomonas aeruginosa PA01
acagcagccaggcg

SEQ ID NO: 1557936 - RNA, 15 nt, Pseudomonas aeruginosa PA01
acagcagcggcacca

SEQ ID NO: 1557937 - RNA, 18 nt, Pseudomonas aeruginosa PA01
acagcagcggcaccagca

SEQ ID NO: 1557938 - RNA, 19 nt, Pseudomonas aeruginosa PA01
acagcagcggcaccagcac

SEQ ID NO: 1557939 - RNA, 16 nt, Pseudomonas aeruginosa PA01
agacgaaguuggcggc

SEQ ID NO: 1557940 - RNA, 13 nt, Pseudomonas aeruginosa PA01
agaccucgagcag

SEQ ID NO: 1557941 - RNA, 14 nt, Pseudomonas aeruginosa PA01
agaccucgcccauc

SEQ ID NO: 1557942 - RNA, 17 nt, Pseudomonas aeruginosa PA01
agacgccguccaccagc

SEQ ID NO: 1557943 - RNA, 19 nt, Pseudomonas aeruginosa PA01
agacgccguccaccagcca

SEQ ID NO: 1557944 - RNA, 17 nt, Pseudomonas aeruginosa PA01
agaauucgcguccacca

SEQ ID NO: 1557945 - RNA, 20 nt, Pseudomonas aeruginosa PA01
agaccggcagcgccgccagc

SEQ ID NO: 1557946 - RNA, 19 nt, Pseudomonas aeruginosa PA01
agaccggcuccagggcgaa

SEQ ID NO: 1557947 - RNA, 12 nt, Pseudomonas aeruginosa PA01
agacccugggcc

SEQ ID NO: 1557948 - RNA, 17 nt, Pseudomonas aeruginosa PA01
agacccugcacaucacc

SEQ ID NO: 1557949 - RNA, 22 nt, Pseudomonas aeruginosa PA01
agacggcccgcagaucuucccc

SEQ ID NO: 1557950 - RNA, 17 nt, Pseudomonas aeruginosa PA01
agacugucgcggggcuu

SEQ ID NO: 1557951 - RNA, 23 nt, Pseudomonas aeruginosa PA01
agacugucgcggggcuugcgccc

SEQ ID NO: 1557952 - RNA, 14 nt, Pseudomonas aeruginosa PA01
agacucuccagguc

SEQ ID NO: 1557953 - RNA, 15 nt, Pseudomonas aeruginosa PA01
agagcuccagggcug

SEQ ID NO: 1557954 - RNA, 16 nt, Pseudomonas aeruginosa PA01
agagcuccagggcugc

SEQ ID NO: 1557955 - RNA, 19 nt, Pseudomonas aeruginosa PA01
agagauauucccgcgacaa

SEQ ID NO: 1557956 - RNA, 18 nt, Pseudomonas aeruginosa PA01
agagacccgccagcggca

SEQ ID NO: 1557957 - RNA, 14 nt, Pseudomonas aeruginosa PA01
agagacugaacucg

SEQ ID NO: 1557958 - RNA, 18 nt, Pseudomonas aeruginosa PA01
agauggcuggucaggcug

SEQ ID NO: 1557959 - RNA, 16 nt, Pseudomonas aeruginosa PA01
agaugcucaggcgcug

SEQ ID NO: 1557960 - RNA, 22 nt, Pseudomonas aeruginosa PA01
agaugcuccagggagcgcucgc

SEQ ID NO: 1557961 - RNA, 16 nt, Pseudomonas aeruginosa PA01
agaugcaccggccacu

SEQ ID NO: 1557962 - RNA, 14 nt, Pseudomonas aeruginosa PA01
agaugcagcaggua

SEQ ID NO: 1557963 - RNA, 14 nt, Pseudomonas aeruginosa PA01
agauccgcuccagg

SEQ ID NO: 1557964 - RNA, 15 nt, Pseudomonas aeruginosa PA01
agauccgcuccaggc

SEQ ID NO: 1557965 - RNA, 15 nt, Pseudomonas aeruginosa PA01
agauccgccagcaga

SEQ ID NO: 1557966 - RNA, 15 nt, Pseudomonas aeruginosa PA01
agaucgagcgcgccc

SEQ ID NO: 1557967 - RNA, 15 nt, Pseudomonas aeruginosa PA01
agaucgcguccaggg

SEQ ID NO: 1557968 - RNA, 16 nt, Pseudomonas aeruginosa PA01
agaucgcguccagggu

SEQ ID NO: 1557969 - RNA, 20 nt, Pseudomonas aeruginosa PA01
agaucgccgcguagcgccag

SEQ ID NO: 1557970 - RNA, 13 nt, Pseudomonas aeruginosa PA01
agaucgcccgcag

SEQ ID NO: 1557971 - RNA, 16 nt, Pseudomonas aeruginosa PA01
agaucgccagcgccag

SEQ ID NO: 1557972 - RNA, 17 nt, Pseudomonas aeruginosa PA01
agaucggcagcaucagc

SEQ ID NO: 1557973 - RNA, 18 nt, Pseudomonas aeruginosa PA01
agaucggcggcgcggcgu

SEQ ID NO: 1557974 - RNA, 12 nt, Pseudomonas aeruginosa PA01
agaucggucacc

SEQ ID NO: 1557975 - RNA, 22 nt, Pseudomonas aeruginosa PA01
agaucuccacccguucgccggc

SEQ ID NO: 1557976 - RNA, 20 nt, Pseudomonas aeruginosa PA01
agaucugcaccgcccagccg

SEQ ID NO: 1557977 - RNA, 23 nt, Pseudomonas aeruginosa PA01
agaucugcaccgcccagccgagg

SEQ ID NO: 1557978 - RNA, 21 nt, Pseudomonas aeruginosa PA01
agaguuugccgaacugcaggg

SEQ ID NO: 1557979 - RNA, 16 nt, Pseudomonas aeruginosa PA01
agagugcgcagcagcg

SEQ ID NO: 1557980 - RNA, 17 nt, Pseudomonas aeruginosa PA01
agaguccuuguccaggg

SEQ ID NO: 1557981 - RNA, 16 nt, Pseudomonas aeruginosa PA01
agauacccagcgggca

SEQ ID NO: 1557982 - RNA, 19 nt, Pseudomonas aeruginosa PA01
agaacgaaggcuuguccuu

SEQ ID NO: 1557983 - RNA, 23 nt, Pseudomonas aeruginosa PA01
agaacguauuuccccaacaucaa

SEQ ID NO: 1557984 - RNA, 21 nt, Pseudomonas aeruginosa PA01
agaacgcggaaaccugcaacu

SEQ ID NO: 1557985 - RNA, 15 nt, Pseudomonas aeruginosa PA01
agaacuuuucccagc

SEQ ID NO: 1557986 - RNA, 21 nt, Pseudomonas aeruginosa PA01
agaacuuuucccagcggcugc

SEQ ID NO: 1557987 - RNA, 21 nt, Pseudomonas aeruginosa PA01
agaagaacggacgcgacgccu

SEQ ID NO: 1557988 - RNA, 20 nt, Pseudomonas aeruginosa PA01
agaaacgcuugagcuggcgc

SEQ ID NO: 1557989 - RNA, 19 nt, Pseudomonas aeruginosa PA01
agaaaugguggaccagcgc

SEQ ID NO: 1557990 - RNA, 21 nt, Pseudomonas aeruginosa PA01
agaaauccggcuggcgccggu

SEQ ID NO: 1557991 - RNA, 19 nt, Pseudomonas aeruginosa PA01
agaagucguccucgcccug

SEQ ID NO: 1557992 - RNA, 20 nt, Pseudomonas aeruginosa PA01
agaagccgcacuuccaggcg

SEQ ID NO: 1557993 - RNA, 20 nt, Pseudomonas aeruginosa PA01
agaagcgcgcgguacccagc

SEQ ID NO: 1557994 - RNA, 15 nt, Pseudomonas aeruginosa PA01
agaagccggccccug

SEQ ID NO: 1557995 - RNA, 18 nt, Pseudomonas aeruginosa PA01
agaaugccuucaccggcg

SEQ ID NO: 1557996 - RNA, 13 nt, Pseudomonas aeruginosa PA01
acuugcggcccac

SEQ ID NO: 1557997 - RNA, 18 nt, Pseudomonas aeruginosa PA01
acuugcgccgaccgcgcg

SEQ ID NO: 1557998 - RNA, 18 nt, Pseudomonas aeruginosa PA01
acuugccguccuucagga

SEQ ID NO: 1557999 - RNA, 14 nt, Pseudomonas aeruginosa PA01
acuugccggcgcca

SEQ ID NO: 1558000 - RNA, 21 nt, Pseudomonas aeruginosa PA01
acuugccggcgccaucgauca

SEQ ID NO: 1558001 - RNA, 15 nt, Pseudomonas aeruginosa PA01
acuugccagggcagg

SEQ ID NO: 1558002 - RNA, 14 nt, Pseudomonas aeruginosa PA01
acuuggccacgccu

SEQ ID NO: 1558003 - RNA, 23 nt, Pseudomonas aeruginosa PA01
acuuggcccggcguuucgccggg

SEQ ID NO: 1558004 - RNA, 13 nt, Pseudomonas aeruginosa PA01
acuuggcuucagc

SEQ ID NO: 1558005 - RNA, 15 nt, Pseudomonas aeruginosa PA01
acuugggcaucagcu

SEQ ID NO: 1558006 - RNA, 22 nt, Pseudomonas aeruginosa PA01
acuugggcaucagcucgucuuu

SEQ ID NO: 1558007 - RNA, 14 nt, Pseudomonas aeruginosa PA01
agccgaccaccuuc

SEQ ID NO: 1558008 - RNA, 20 nt, Pseudomonas aeruginosa PA01
agccgaccaccuucaggcug

SEQ ID NO: 1558009 - RNA, 20 nt, Pseudomonas aeruginosa PA01
agccgaagucggcguagugc

SEQ ID NO: 1558010 - RNA, 22 nt, Pseudomonas aeruginosa PA01
agccgaacaguucggcggugga

SEQ ID NO: 1558011 - RNA, 14 nt, Pseudomonas aeruginosa PA01
agcccucgaccugg

SEQ ID NO: 1558012 - RNA, 16 nt, Pseudomonas aeruginosa PA01
agccgcaaggccaggg

SEQ ID NO: 1558013 - RNA, 20 nt, Pseudomonas aeruginosa PA01
agccgcaaggccagggcggc

SEQ ID NO: 1558014 - RNA, 17 nt, Pseudomonas aeruginosa PA01
agccgauuacuuggcuu

SEQ ID NO: 1558015 - RNA, 23 nt, Pseudomonas aeruginosa PA01
agccgaugcucgcgccagcccca

SEQ ID NO: 1558016 - RNA, 20 nt, Pseudomonas aeruginosa PA01
agcccgcguccuccuggagg

SEQ ID NO: 1558017 - RNA, 17 nt, Pseudomonas aeruginosa PA01
agcccgcgcucggccgc

SEQ ID NO: 1558018 - RNA, 13 nt, Pseudomonas aeruginosa PA01
agcccgcuccgca

SEQ ID NO: 1558019 - RNA, 17 nt, Pseudomonas aeruginosa PA01
agccaggccuugugcgc

SEQ ID NO: 1558020 - RNA, 18 nt, Pseudomonas aeruginosa PA01
agccaggcgauggugcgc

SEQ ID NO: 1558021 - RNA, 13 nt, Pseudomonas aeruginosa PA01
agccaggcggcca

SEQ ID NO: 1558022 - RNA, 14 nt, Pseudomonas aeruginosa PA01
agccaggcgcucuc

SEQ ID NO: 1558023 - RNA, 21 nt, Pseudomonas aeruginosa PA01
agccagggcaacgccaggcug

SEQ ID NO: 1558024 - RNA, 17 nt, Pseudomonas aeruginosa PA01
agcccggccucgccggu

SEQ ID NO: 1558025 - RNA, 13 nt, Pseudomonas aeruginosa PA01
agcccggccaucc

SEQ ID NO: 1558026 - RNA, 16 nt, Pseudomonas aeruginosa PA01
agcccggcaggucgag

SEQ ID NO: 1558027 - RNA, 13 nt, Pseudomonas aeruginosa PA01
agccggccuugcu

SEQ ID NO: 1558028 - RNA, 19 nt, Pseudomonas aeruginosa PA01
agccggcgaaccaggcggc

SEQ ID NO: 1558029 - RNA, 21 nt, Pseudomonas aeruginosa PA01
agccggcgaaccaggcggccg

SEQ ID NO: 1558030 - RNA, 12 nt, Pseudomonas aeruginosa PA01
agccggcgccgu

SEQ ID NO: 1558031 - RNA, 13 nt, Pseudomonas aeruginosa PA01
agccggcgcgccc

SEQ ID NO: 1558032 - RNA, 21 nt, Pseudomonas aeruginosa PA01
agccggcgaucagcgcuucca

SEQ ID NO: 1558033 - RNA, 16 nt, Pseudomonas aeruginosa PA01
agccggcgauguucgc

SEQ ID NO: 1558034 - RNA, 21 nt, Pseudomonas aeruginosa PA01
agccggcgauguucgcccccu

SEQ ID NO: 1558035 - RNA, 12 nt, Pseudomonas aeruginosa PA01
agccggcaucca

SEQ ID NO: 1558036 - RNA, 20 nt, Pseudomonas aeruginosa PA01
agccgcuggcgucgaaugcg

SEQ ID NO: 1558037 - RNA, 18 nt, Pseudomonas aeruginosa PA01
agccgcugguccagcugg

SEQ ID NO: 1558038 - RNA, 22 nt, Pseudomonas aeruginosa PA01
agccggaaaacagcgagcccag

SEQ ID NO: 1558039 - RNA, 13 nt, Pseudomonas aeruginosa PA01
agccgcccaccgc

SEQ ID NO: 1558040 - RNA, 17 nt, Pseudomonas aeruginosa PA01
agccgccagugcagccg

SEQ ID NO: 1558041 - RNA, 14 nt, Pseudomonas aeruginosa PA01
agccgccugcggcg

SEQ ID NO: 1558042 - RNA, 18 nt, Pseudomonas aeruginosa PA01
agccgccuucgggcggcu

SEQ ID NO: 1558043 - RNA, 23 nt, Pseudomonas aeruginosa PA01
agccgcccuuuuccggauacaug

SEQ ID NO: 1558044 - RNA, 19 nt, Pseudomonas aeruginosa PA01
agccgccggggaagcugcc

SEQ ID NO: 1558045 - RNA, 12 nt, Pseudomonas aeruginosa PA01
agccgccgggac

SEQ ID NO: 1558046 - RNA, 16 nt, Pseudomonas aeruginosa PA01
agccgccgggcggcgu

SEQ ID NO: 1558047 - RNA, 18 nt, Pseudomonas aeruginosa PA01
agccgccgcccagcagca

SEQ ID NO: 1558048 - RNA, 15 nt, Pseudomonas aeruginosa PA01
agccgccgccgcgcc

SEQ ID NO: 1558049 - RNA, 19 nt, Pseudomonas aeruginosa PA01
agccgcgacggcugcuccg

SEQ ID NO: 1558050 - RNA, 21 nt, Pseudomonas aeruginosa PA01
agccgcgccggccgucccagu

SEQ ID NO: 1558051 - RNA, 14 nt, Pseudomonas aeruginosa PA01
agccgcggaucacc

SEQ ID NO: 1558052 - RNA, 22 nt, Pseudomonas aeruginosa PA01
agccgcgcguaggcuuggucgg

SEQ ID NO: 1558053 - RNA, 17 nt, Pseudomonas aeruginosa PA01
agccgcgguccaucccu

SEQ ID NO: 1558054 - RNA, 14 nt, Pseudomonas aeruginosa PA01
agccucacccugcu

SEQ ID NO: 1558055 - RNA, 22 nt, Pseudomonas aeruginosa PA01
agccucaggcgcugcgcggccu

SEQ ID NO: 1558056 - RNA, 20 nt, Pseudomonas aeruginosa PA01
agccucaguaccugcaaggc

SEQ ID NO: 1558057 - RNA, 14 nt, Pseudomonas aeruginosa PA01
agccucggcagggc

SEQ ID NO: 1558058 - RNA, 18 nt, Pseudomonas aeruginosa PA01
agccuccagcagcuccau

SEQ ID NO: 1558059 - RNA, 11 nt, Pseudomonas aeruginosa PA01
agccuccagcg

SEQ ID NO: 1558060 - RNA, 15 nt, Pseudomonas aeruginosa PA01
agccuccuccggcuc

SEQ ID NO: 1558061 - RNA, 15 nt, Pseudomonas aeruginosa PA01
agccuucgcccggcu

SEQ ID NO: 1558062 - RNA, 14 nt, Pseudomonas aeruginosa PA01
agccuucccggcgc

SEQ ID NO: 1558063 - RNA, 20 nt, Pseudomonas aeruginosa PA01
agccuugacccgcaguuccu

SEQ ID NO: 1558064 - RNA, 21 nt, Pseudomonas aeruginosa PA01
agccuugacccgcaguuccuu

SEQ ID NO: 1558065 - RNA, 18 nt, Pseudomonas aeruginosa PA01
agccuugcuggacuuccc

SEQ ID NO: 1558066 - RNA, 19 nt, Pseudomonas aeruginosa PA01
agccuugcuggacuucccg

SEQ ID NO: 1558067 - RNA, 16 nt, Pseudomonas aeruginosa PA01
agcgaaccgccggccu

SEQ ID NO: 1558068 - RNA, 16 nt, Pseudomonas aeruginosa PA01
agcgacagcaucugcu

SEQ ID NO: 1558069 - RNA, 16 nt, Pseudomonas aeruginosa PA01
agccggcuuccucgcc

SEQ ID NO: 1558070 - RNA, 19 nt, Pseudomonas aeruginosa PA01
agccgggaugaacccggcu

SEQ ID NO: 1558071 - RNA, 22 nt, Pseudomonas aeruginosa PA01
agccggcgcgcuuccuccagua

SEQ ID NO: 1558072 - RNA, 21 nt, Pseudomonas aeruginosa PA01
agccggcgcgcccggcgcccu

SEQ ID NO: 1558073 - RNA, 19 nt, Pseudomonas aeruginosa PA01
agccggcgcguucacucca

SEQ ID NO: 1558074 - RNA, 22 nt, Pseudomonas aeruginosa PA01
agccggcgcguucacuccacga

SEQ ID NO: 1558075 - RNA, 19 nt, Pseudomonas aeruginosa PA01
agccggcgcucggccaggu

SEQ ID NO: 1558076 - RNA, 19 nt, Pseudomonas aeruginosa PA01
agccggggccguucaggaa

SEQ ID NO: 1558077 - RNA, 21 nt, Pseudomonas aeruginosa PA01
agccgggguugaguugcaggc

SEQ ID NO: 1558078 - RNA, 23 nt, Pseudomonas aeruginosa PA01
agccgggguugaguugcaggccg

SEQ ID NO: 1558079 - RNA, 19 nt, Pseudomonas aeruginosa PA01
agccgguguagaucaggcu

SEQ ID NO: 1558080 - RNA, 15 nt, Pseudomonas aeruginosa PA01
agccgguaggggccg

SEQ ID NO: 1558081 - RNA, 21 nt, Pseudomonas aeruginosa PA01
agccgguagugcuucagguag

SEQ ID NO: 1558082 - RNA, 15 nt, Pseudomonas aeruginosa PA01
agccggucccgggcu

SEQ ID NO: 1558083 - RNA, 15 nt, Pseudomonas aeruginosa PA01
agccgucggugaucg

SEQ ID NO: 1558084 - RNA, 19 nt, Pseudomonas aeruginosa PA01
agccgucggugaucgagac

SEQ ID NO: 1558085 - RNA, 18 nt, Pseudomonas aeruginosa PA01
agccgucgaacagcagcu

SEQ ID NO: 1558086 - RNA, 22 nt, Pseudomonas aeruginosa PA01
agccguccgggucggucacgaa

SEQ ID NO: 1558087 - RNA, 12 nt, Pseudomonas aeruginosa PA01
agccguccugcg

SEQ ID NO: 1558088 - RNA, 16 nt, Pseudomonas aeruginosa PA01
agccguccugcggccg

SEQ ID NO: 1558089 - RNA, 20 nt, Pseudomonas aeruginosa PA01
agccguccugcggccgcaac

SEQ ID NO: 1558090 - RNA, 14 nt, Pseudomonas aeruginosa PA01
agccguuccaggcg

SEQ ID NO: 1558091 - RNA, 13 nt, Pseudomonas aeruginosa PA01
agccgugcagcag

SEQ ID NO: 1558092 - RNA, 18 nt, Pseudomonas aeruginosa PA01
agccguugugcagguacg

SEQ ID NO: 1558093 - RNA, 16 nt, Pseudomonas aeruginosa PA01
agccguuggccagcag

SEQ ID NO: 1558094 - RNA, 18 nt, Pseudomonas aeruginosa PA01
agccguuugugaaaggac

SEQ ID NO: 1558095 - RNA, 14 nt, Pseudomonas aeruginosa PA01
agcggcaggcacgc

SEQ ID NO: 1558096 - RNA, 16 nt, Pseudomonas aeruginosa PA01
agcggcacuucccgcc

SEQ ID NO: 1558097 - RNA, 22 nt, Pseudomonas aeruginosa PA01
agcggcagccacucggccaggc

SEQ ID NO: 1558098 - RNA, 15 nt, Pseudomonas aeruginosa PA01
agcggcaccagcacg

SEQ ID NO: 1558099 - RNA, 19 nt, Pseudomonas aeruginosa PA01
agcggcacgcucuggccgu

SEQ ID NO: 1558100 - RNA, 21 nt, Pseudomonas aeruginosa PA01
agcggcacggucauggccagc

SEQ ID NO: 1558101 - RNA, 23 nt, Pseudomonas aeruginosa PA01
agcggcaaggccaagucggccgc

SEQ ID NO: 1558102 - RNA, 22 nt, Pseudomonas aeruginosa PA01
agcggaguucgucaaccagcac

SEQ ID NO: 1558103 - RNA, 17 nt, Pseudomonas aeruginosa PA01
agcggauauccccccac

SEQ ID NO: 1558104 - RNA, 15 nt, Pseudomonas aeruginosa PA01
agcggaugcgcgaau

SEQ ID NO: 1558105 - RNA, 19 nt, Pseudomonas aeruginosa PA01
agcggauccggguggagag

SEQ ID NO: 1558106 - RNA, 14 nt, Pseudomonas aeruginosa PA01
agcggaagcccagc

SEQ ID NO: 1558107 - RNA, 14 nt, Pseudomonas aeruginosa PA01
agcggaagcccugc

SEQ ID NO: 1558108 - RNA, 15 nt, Pseudomonas aeruginosa PA01
agcggaagcccugcu

SEQ ID NO: 1558109 - RNA, 16 nt, Pseudomonas aeruginosa PA01
agcggaagcgcagcca

SEQ ID NO: 1558110 - RNA, 19 nt, Pseudomonas aeruginosa PA01
agcgcuuguagcagccgca

SEQ ID NO: 1558111 - RNA, 17 nt, Pseudomonas aeruginosa PA01
agcgcuuuucaggaugu

SEQ ID NO: 1558112 - RNA, 18 nt, Pseudomonas aeruginosa PA01
agcgcugguugacgaaca

SEQ ID NO: 1558113 - RNA, 14 nt, Pseudomonas aeruginosa PA01
agcgcuuccaccgc

SEQ ID NO: 1558114 - RNA, 21 nt, Pseudomonas aeruginosa PA01
agcgcuucccgcggcuccagc

SEQ ID NO: 1558115 - RNA, 16 nt, Pseudomonas aeruginosa PA01
agcgcugcucgaccac

SEQ ID NO: 1558116 - RNA, 15 nt, Pseudomonas aeruginosa PA01
agcgcugcgccaggc

SEQ ID NO: 1558117 - RNA, 13 nt, Pseudomonas aeruginosa PA01
agcggugggaaga

SEQ ID NO: 1558118 - RNA, 16 nt, Pseudomonas aeruginosa PA01
agcggucggguucuug

SEQ ID NO: 1558119 - RNA, 22 nt, Pseudomonas aeruginosa PA01
agcgguccucgggcaccagcac

SEQ ID NO: 1558120 - RNA, 14 nt, Pseudomonas aeruginosa PA01
agcggucgccggcg

SEQ ID NO: 1558121 - RNA, 13 nt, Pseudomonas aeruginosa PA01
agcggucgccggu

SEQ ID NO: 1558122 - RNA, 17 nt, Pseudomonas aeruginosa PA01
agcggcgacgccacccg

SEQ ID NO: 1558123 - RNA, 18 nt, Pseudomonas aeruginosa PA01
agcggcgacgccacccgc

SEQ ID NO: 1558124 - RNA, 13 nt, Pseudomonas aeruginosa PA01
agcggcagguggu

SEQ ID NO: 1558125 - RNA, 14 nt, Pseudomonas aeruginosa PA01
agcggcagggcggc

SEQ ID NO: 1558126 - RNA, 20 nt, Pseudomonas aeruginosa PA01
agcggguggcaacugccgcc

SEQ ID NO: 1558127 - RNA, 15 nt, Pseudomonas aeruginosa PA01
agcgguacccgccgg

SEQ ID NO: 1558128 - RNA, 14 nt, Pseudomonas aeruginosa PA01
agcgguagccguca

SEQ ID NO: 1558129 - RNA, 14 nt, Pseudomonas aeruginosa PA01
agcgguacaggcgg

SEQ ID NO: 1558130 - RNA, 14 nt, Pseudomonas aeruginosa PA01
agcgguaggcgcgu

SEQ ID NO: 1558131 - RNA, 19 nt, Pseudomonas aeruginosa PA01
agcgguagguguacccagg

SEQ ID NO: 1558132 - RNA, 22 nt, Pseudomonas aeruginosa PA01
agcgguagugggcgaggcgcuc

SEQ ID NO: 1558133 - RNA, 17 nt, Pseudomonas aeruginosa PA01
agcgggucgcggcuggc

SEQ ID NO: 1558134 - RNA, 23 nt, Pseudomonas aeruginosa PA01
agcgggugccgaagaccaccaug

SEQ ID NO: 1558135 - RNA, 13 nt, Pseudomonas aeruginosa PA01
agcgggucgagcc

SEQ ID NO: 1558136 - RNA, 19 nt, Pseudomonas aeruginosa PA01
agcgggucgagccaggcgu

SEQ ID NO: 1558137 - RNA, 18 nt, Pseudomonas aeruginosa PA01
agcggcgcuacgaaggcg

SEQ ID NO: 1558138 - RNA, 13 nt, Pseudomonas aeruginosa PA01
agcggcgcccugg

SEQ ID NO: 1558139 - RNA, 13 nt, Pseudomonas aeruginosa PA01
agcggcgccaggc

SEQ ID NO: 1558140 - RNA, 14 nt, Pseudomonas aeruginosa PA01
agcggcgccaggcg

SEQ ID NO: 1558141 - RNA, 13 nt, Pseudomonas aeruginosa PA01
agcgcaccgcccu

SEQ ID NO: 1558142 - RNA, 16 nt, Pseudomonas aeruginosa PA01
agcgcaccuacuaccg

SEQ ID NO: 1558143 - RNA, 16 nt, Pseudomonas aeruginosa PA01
agcgcagcgaagaucu

SEQ ID NO: 1558144 - RNA, 17 nt, Pseudomonas aeruginosa PA01
agcgcagcuccggcagc

SEQ ID NO: 1558145 - RNA, 15 nt, Pseudomonas aeruginosa PA01
agcgcaggugcaccg

SEQ ID NO: 1558146 - RNA, 16 nt, Pseudomonas aeruginosa PA01
agcgcaggugcaccgc

SEQ ID NO: 1558147 - RNA, 13 nt, Pseudomonas aeruginosa PA01
agcgcaggcggcu

SEQ ID NO: 1558148 - RNA, 20 nt, Pseudomonas aeruginosa PA01
agcgcaggccgccggcggcc

SEQ ID NO: 1558149 - RNA, 18 nt, Pseudomonas aeruginosa PA01
agcgcagacgggugcuga

SEQ ID NO: 1558150 - RNA, 15 nt, Pseudomonas aeruginosa PA01
agcgcauggcgaccu

SEQ ID NO: 1558151 - RNA, 18 nt, Pseudomonas aeruginosa PA01
agcgcaguugccaggagg

SEQ ID NO: 1558152 - RNA, 15 nt, Pseudomonas aeruginosa PA01
agcgccaccagcagg

SEQ ID NO: 1558153 - RNA, 20 nt, Pseudomonas aeruginosa PA01
agcgccaccagcagggccag

SEQ ID NO: 1558154 - RNA, 13 nt, Pseudomonas aeruginosa PA01
agcgccaccagca

SEQ ID NO: 1558155 - RNA, 21 nt, Pseudomonas aeruginosa PA01
agcgccccucccagccacaga

SEQ ID NO: 1558156 - RNA, 21 nt, Pseudomonas aeruginosa PA01
agcgcccgauaggcgccggcg

SEQ ID NO: 1558157 - RNA, 21 nt, Pseudomonas aeruginosa PA01
agcgccccgccuaccggggcg

SEQ ID NO: 1558158 - RNA, 19 nt, Pseudomonas aeruginosa PA01
agcgccaugcucuucaggc

SEQ ID NO: 1558159 - RNA, 17 nt, Pseudomonas aeruginosa PA01
agcgccaugacccgcgg

SEQ ID NO: 1558160 - RNA, 21 nt, Pseudomonas aeruginosa PA01
agcgcccggcacgcuccaggg

SEQ ID NO: 1558161 - RNA, 14 nt, Pseudomonas aeruginosa PA01
agcgccgccaggca

SEQ ID NO: 1558162 - RNA, 16 nt, Pseudomonas aeruginosa PA01
agcgccgccaggcaga

SEQ ID NO: 1558163 - RNA, 14 nt, Pseudomonas aeruginosa PA01
agcgccgccaggcc

SEQ ID NO: 1558164 - RNA, 13 nt, Pseudomonas aeruginosa PA01
agcgccgccagca

SEQ ID NO: 1558165 - RNA, 22 nt, Pseudomonas aeruginosa PA01
agcgccgccagcaggucggccu

SEQ ID NO: 1558166 - RNA, 15 nt, Pseudomonas aeruginosa PA01
agcgcgagugcagcg

SEQ ID NO: 1558167 - RNA, 22 nt, Pseudomonas aeruginosa PA01
agcgcgauacccuggccggccu

SEQ ID NO: 1558168 - RNA, 22 nt, Pseudomonas aeruginosa PA01
agcgcgauaucgcaggccaggc

SEQ ID NO: 1558169 - RNA, 23 nt, Pseudomonas aeruginosa PA01
agcgcgauaucgcaggccaggcc

SEQ ID NO: 1558170 - RNA, 19 nt, Pseudomonas aeruginosa PA01
agcgcgaucucuacuaccg

SEQ ID NO: 1558171 - RNA, 14 nt, Pseudomonas aeruginosa PA01
agcgccggcggccu

SEQ ID NO: 1558172 - RNA, 15 nt, Pseudomonas aeruginosa PA01
agcgccggcggccug

SEQ ID NO: 1558173 - RNA, 21 nt, Pseudomonas aeruginosa PA01
agcgccguucacgccuggcgg

SEQ ID NO: 1558174 - RNA, 22 nt, Pseudomonas aeruginosa PA01
agcgccguucacgccuggcggc

SEQ ID NO: 1558175 - RNA, 19 nt, Pseudomonas aeruginosa PA01
agcgccguugccgaugccg

SEQ ID NO: 1558176 - RNA, 20 nt, Pseudomonas aeruginosa PA01
agcgccggccauugccgcca

SEQ ID NO: 1558177 - RNA, 22 nt, Pseudomonas aeruginosa PA01
agcgccgguagcggcgcaccga

SEQ ID NO: 1558178 - RNA, 18 nt, Pseudomonas aeruginosa PA01
agcgccguacgcaccgcg

SEQ ID NO: 1558179 - RNA, 17 nt, Pseudomonas aeruginosa PA01
agcgccgucaccagcag

SEQ ID NO: 1558180 - RNA, 14 nt, Pseudomonas aeruginosa PA01
agcgccggcaccga

SEQ ID NO: 1558181 - RNA, 20 nt, Pseudomonas aeruginosa PA01
agcgccggcaccgaggagaa

SEQ ID NO: 1558182 - RNA, 20 nt, Pseudomonas aeruginosa PA01
agcgccgcuucuucccgccc

SEQ ID NO: 1558183 - RNA, 13 nt, Pseudomonas aeruginosa PA01
agcgccgcuccuc

SEQ ID NO: 1558184 - RNA, 13 nt, Pseudomonas aeruginosa PA01
agcgccgcggcgg

SEQ ID NO: 1558185 - RNA, 13 nt, Pseudomonas aeruginosa PA01
agcgccgcggcga

SEQ ID NO: 1558186 - RNA, 16 nt, Pseudomonas aeruginosa PA01
agcgccgcggcgacca

SEQ ID NO: 1558187 - RNA, 17 nt, Pseudomonas aeruginosa PA01
agcgccgccaggcgcgu

SEQ ID NO: 1558188 - RNA, 15 nt, Pseudomonas aeruginosa PA01
agcgccgccgguauc

SEQ ID NO: 1558189 - RNA, 13 nt, Pseudomonas aeruginosa PA01
agcgccgccucga

SEQ ID NO: 1558190 - RNA, 22 nt, Pseudomonas aeruginosa PA01
agcgccgccucgaaggccggca

SEQ ID NO: 1558191 - RNA, 14 nt, Pseudomonas aeruginosa PA01
agcgccgccucgcu

SEQ ID NO: 1558192 - RNA, 13 nt, Pseudomonas aeruginosa PA01
agcgccgccugcu

SEQ ID NO: 1558193 - RNA, 14 nt, Pseudomonas aeruginosa PA01
agcgcgcucggccu

SEQ ID NO: 1558194 - RNA, 20 nt, Pseudomonas aeruginosa PA01
agcgcggagcguccaccagc

SEQ ID NO: 1558195 - RNA, 15 nt, Pseudomonas aeruginosa PA01
agcgcggcggcggcc

SEQ ID NO: 1558196 - RNA, 19 nt, Pseudomonas aeruginosa PA01
agcgcggcggcggccagca

SEQ ID NO: 1558197 - RNA, 22 nt, Pseudomonas aeruginosa PA01
agcgcggcggcggccagcagca

SEQ ID NO: 1558198 - RNA, 23 nt, Pseudomonas aeruginosa PA01
agcgcggcggcggccagcagcac

SEQ ID NO: 1558199 - RNA, 23 nt, Pseudomonas aeruginosa PA01
agcgcggcggcggccgcaugccg

SEQ ID NO: 1558200 - RNA, 16 nt, Pseudomonas aeruginosa PA01
agcgcgcguuccaggu

SEQ ID NO: 1558201 - RNA, 23 nt, Pseudomonas aeruginosa PA01
agcgcgcguuccaggucgcugcu

SEQ ID NO: 1558202 - RNA, 22 nt, Pseudomonas aeruginosa PA01
agcgcucgccgucaucgagcag

SEQ ID NO: 1558203 - RNA, 21 nt, Pseudomonas aeruginosa PA01
agcgcuccucgcgcugcccgg

SEQ ID NO: 1558204 - RNA, 19 nt, Pseudomonas aeruginosa PA01
agcgcucgaacgccgcccg

SEQ ID NO: 1558205 - RNA, 15 nt, Pseudomonas aeruginosa PA01
agcgcucccagaccu

SEQ ID NO: 1558206 - RNA, 17 nt, Pseudomonas aeruginosa PA01
agcgcgucgaccaccgc

SEQ ID NO: 1558207 - RNA, 19 nt, Pseudomonas aeruginosa PA01
agcgcgggcugccccucac

SEQ ID NO: 1558208 - RNA, 12 nt, Pseudomonas aeruginosa PA01
agcagccgcagg

SEQ ID NO: 1558209 - RNA, 19 nt, Pseudomonas aeruginosa PA01
agcagccguauggccccuc

SEQ ID NO: 1558210 - RNA, 18 nt, Pseudomonas aeruginosa PA01
agcagacgcuccuuguag

SEQ ID NO: 1558211 - RNA, 12 nt, Pseudomonas aeruginosa PA01
agcagcccggcc

SEQ ID NO: 1558212 - RNA, 12 nt, Pseudomonas aeruginosa PA01
agcagguacagc

SEQ ID NO: 1558213 - RNA, 21 nt, Pseudomonas aeruginosa PA01
agcagguagccugcggccagc

SEQ ID NO: 1558214 - RNA, 12 nt, Pseudomonas aeruginosa PA01
agcaggucacgc

SEQ ID NO: 1558215 - RNA, 22 nt, Pseudomonas aeruginosa PA01
agcaggucacgcccugcaccuu

SEQ ID NO: 1558216 - RNA, 15 nt, Pseudomonas aeruginosa PA01
agcagggugaagcug

SEQ ID NO: 1558217 - RNA, 20 nt, Pseudomonas aeruginosa PA01
agcagggugaagcugcggcu

SEQ ID NO: 1558218 - RNA, 14 nt, Pseudomonas aeruginosa PA01
agcagggucagggc

SEQ ID NO: 1558219 - RNA, 15 nt, Pseudomonas aeruginosa PA01
agcagggucagggug

SEQ ID NO: 1558220 - RNA, 13 nt, Pseudomonas aeruginosa PA01
agcagggugcggg

SEQ ID NO: 1558221 - RNA, 14 nt, Pseudomonas aeruginosa PA01
agcaggguggccag

SEQ ID NO: 1558222 - RNA, 15 nt, Pseudomonas aeruginosa PA01
agcaggguaccgcug

SEQ ID NO: 1558223 - RNA, 16 nt, Pseudomonas aeruginosa PA01
agcagggggacgaaaa

SEQ ID NO: 1558224 - RNA, 15 nt, Pseudomonas aeruginosa PA01
agcagggcgaugccg

SEQ ID NO: 1558225 - RNA, 16 nt, Pseudomonas aeruginosa PA01
agcagggcgucggcgu

SEQ ID NO: 1558226 - RNA, 16 nt, Pseudomonas aeruginosa PA01
agcagggccgccgagg

SEQ ID NO: 1558227 - RNA, 17 nt, Pseudomonas aeruginosa PA01
agcagggccgccgaggu

SEQ ID NO: 1558228 - RNA, 18 nt, Pseudomonas aeruginosa PA01
agcagggccgccgagguc

SEQ ID NO: 1558229 - RNA, 14 nt, Pseudomonas aeruginosa PA01
agcagggccagcag

SEQ ID NO: 1558230 - RNA, 21 nt, Pseudomonas aeruginosa PA01
agcagggccagccagagccag

SEQ ID NO: 1558231 - RNA, 14 nt, Pseudomonas aeruginosa PA01
agcagggccaggcc

SEQ ID NO: 1558232 - RNA, 14 nt, Pseudomonas aeruginosa PA01
agcagguugcuggc

SEQ ID NO: 1558233 - RNA, 20 nt, Pseudomonas aeruginosa PA01
agcagguuccuccugggccg

SEQ ID NO: 1558234 - RNA, 20 nt, Pseudomonas aeruginosa PA01
agcagguggcgcacugccag

SEQ ID NO: 1558235 - RNA, 14 nt, Pseudomonas aeruginosa PA01
agcaggucgcggcc

SEQ ID NO: 1558236 - RNA, 23 nt, Pseudomonas aeruginosa PA01
agcaggucgcggccccagcacug

SEQ ID NO: 1558237 - RNA, 14 nt, Pseudomonas aeruginosa PA01
agcaggucgagcag

SEQ ID NO: 1558238 - RNA, 17 nt, Pseudomonas aeruginosa PA01
agcaggucgagcaguuc

SEQ ID NO: 1558239 - RNA, 20 nt, Pseudomonas aeruginosa PA01
agcaggucgagggcguccuu

SEQ ID NO: 1558240 - RNA, 14 nt, Pseudomonas aeruginosa PA01
agcaggucucaccg

SEQ ID NO: 1558241 - RNA, 13 nt, Pseudomonas aeruginosa PA01
agcaggucggccu

SEQ ID NO: 1558242 - RNA, 14 nt, Pseudomonas aeruginosa PA01
agccagcagcccgg

SEQ ID NO: 1558243 - RNA, 22 nt, Pseudomonas aeruginosa PA01
agccacuggcggaccgccucga

SEQ ID NO: 1558244 - RNA, 14 nt, Pseudomonas aeruginosa PA01
agccagccgagcaa

SEQ ID NO: 1558245 - RNA, 14 nt, Pseudomonas aeruginosa PA01
agccagccgcagcc

SEQ ID NO: 1558246 - RNA, 15 nt, Pseudomonas aeruginosa PA01
agccagccguggcag

SEQ ID NO: 1558247 - RNA, 11 nt, Pseudomonas aeruginosa PA01
agccagccgcg

SEQ ID NO: 1558248 - RNA, 16 nt, Pseudomonas aeruginosa PA01
agccagccgcggauca

SEQ ID NO: 1558249 - RNA, 17 nt, Pseudomonas aeruginosa PA01
agccacucggccaggcg

SEQ ID NO: 1558250 - RNA, 13 nt, Pseudomonas aeruginosa PA01
agccacaggcgcc

SEQ ID NO: 1558251 - RNA, 15 nt, Pseudomonas aeruginosa PA01
agcaucugccgggcg

SEQ ID NO: 1558252 - RNA, 15 nt, Pseudomonas aeruginosa PA01
agcaucuggcccggg

SEQ ID NO: 1558253 - RNA, 18 nt, Pseudomonas aeruginosa PA01
agcaucucggccaggccc

SEQ ID NO: 1558254 - RNA, 14 nt, Pseudomonas aeruginosa PA01
agcauucuggaugc

SEQ ID NO: 1558255 - RNA, 16 nt, Pseudomonas aeruginosa PA01
agcauucagcgcgccc

SEQ ID NO: 1558256 - RNA, 14 nt, Pseudomonas aeruginosa PA01
agcauuucuucacc

SEQ ID NO: 1558257 - RNA, 14 nt, Pseudomonas aeruginosa PA01
agcaccagucccug

SEQ ID NO: 1558258 - RNA, 15 nt, Pseudomonas aeruginosa PA01
agcaccagucccugg

SEQ ID NO: 1558259 - RNA, 18 nt, Pseudomonas aeruginosa PA01
agcaccagucccuggccg

SEQ ID NO: 1558260 - RNA, 13 nt, Pseudomonas aeruginosa PA01
agcaccaucagcc

SEQ ID NO: 1558261 - RNA, 15 nt, Pseudomonas aeruginosa PA01
agcaccaucagccag

SEQ ID NO: 1558262 - RNA, 18 nt, Pseudomonas aeruginosa PA01
agcaccaucagccagccc

SEQ ID NO: 1558263 - RNA, 19 nt, Pseudomonas aeruginosa PA01
agcaccaucagccagccca

SEQ ID NO: 1558264 - RNA, 23 nt, Pseudomonas aeruginosa PA01
agcaccaucagccagcccaguuc

SEQ ID NO: 1558265 - RNA, 13 nt, Pseudomonas aeruginosa PA01
agcaccaggcugg

SEQ ID NO: 1558266 - RNA, 16 nt, Pseudomonas aeruginosa PA01
agcaccagggccaggg

SEQ ID NO: 1558267 - RNA, 12 nt, Pseudomonas aeruginosa PA01
agcaccagcagg

SEQ ID NO: 1558268 - RNA, 13 nt, Pseudomonas aeruginosa PA01
agcaccagcacca

SEQ ID NO: 1558269 - RNA, 16 nt, Pseudomonas aeruginosa PA01
agcaccacgccgcugg

SEQ ID NO: 1558270 - RNA, 16 nt, Pseudomonas aeruginosa PA01
agcacccccagcaggc

SEQ ID NO: 1558271 - RNA, 22 nt, Pseudomonas aeruginosa PA01
agcacccccagcaggccagcca

SEQ ID NO: 1558272 - RNA, 17 nt, Pseudomonas aeruginosa PA01
agcaccccgaccacccu

SEQ ID NO: 1558273 - RNA, 18 nt, Pseudomonas aeruginosa PA01
agcaccccgagcccggcc

SEQ ID NO: 1558274 - RNA, 13 nt, Pseudomonas aeruginosa PA01
agcacccuggcca

SEQ ID NO: 1558275 - RNA, 18 nt, Pseudomonas aeruginosa PA01
agcacccuggccacgucc

SEQ ID NO: 1558276 - RNA, 12 nt, Pseudomonas aeruginosa PA01
agcacccgggcg

SEQ ID NO: 1558277 - RNA, 15 nt, Pseudomonas aeruginosa PA01
agcacagccccagcc

SEQ ID NO: 1558278 - RNA, 18 nt, Pseudomonas aeruginosa PA01
agcacagccccagccucg

SEQ ID NO: 1558279 - RNA, 19 nt, Pseudomonas aeruginosa PA01
agcacagccccagccucgg

SEQ ID NO: 1558280 - RNA, 20 nt, Pseudomonas aeruginosa PA01
agcacaugcggugcggccau

SEQ ID NO: 1558281 - RNA, 15 nt, Pseudomonas aeruginosa PA01
agcacgaugaggcgu

SEQ ID NO: 1558282 - RNA, 18 nt, Pseudomonas aeruginosa PA01
agcacgaugaggcguggg

SEQ ID NO: 1558283 - RNA, 16 nt, Pseudomonas aeruginosa PA01
agcacgauggcgagga

SEQ ID NO: 1558284 - RNA, 16 nt, Pseudomonas aeruginosa PA01
agcaccgcgccuucca

SEQ ID NO: 1558285 - RNA, 20 nt, Pseudomonas aeruginosa PA01
agcaccgagacgcccuggau

SEQ ID NO: 1558286 - RNA, 20 nt, Pseudomonas aeruginosa PA01
agcaccgauuuccccaaggc

SEQ ID NO: 1558287 - RNA, 16 nt, Pseudomonas aeruginosa PA01
agcaccgccugcaacu

SEQ ID NO: 1558288 - RNA, 16 nt, Pseudomonas aeruginosa PA01
agcacgcguccgacca

SEQ ID NO: 1558289 - RNA, 13 nt, Pseudomonas aeruginosa PA01
agcacgccgugca

SEQ ID NO: 1558290 - RNA, 20 nt, Pseudomonas aeruginosa PA01
agcacggcgaacaccgggcc

SEQ ID NO: 1558291 - RNA, 22 nt, Pseudomonas aeruginosa PA01
agcacggccucgcgugcgcugg

SEQ ID NO: 1558292 - RNA, 22 nt, Pseudomonas aeruginosa PA01
agcacggcgauacccaggccgu

SEQ ID NO: 1558293 - RNA, 17 nt, Pseudomonas aeruginosa PA01
agcacggugacacccug

SEQ ID NO: 1558294 - RNA, 19 nt, Pseudomonas aeruginosa PA01
agcacuucggcgcgcggca

SEQ ID NO: 1558295 - RNA, 20 nt, Pseudomonas aeruginosa PA01
agcacuucccaggugcccug

SEQ ID NO: 1558296 - RNA, 23 nt, Pseudomonas aeruginosa PA01
agcacuucccaggugcccuggaa

SEQ ID NO: 1558297 - RNA, 21 nt, Pseudomonas aeruginosa PA01
agcagaaguuguucgaugcgu

SEQ ID NO: 1558298 - RNA, 13 nt, Pseudomonas aeruginosa PA01
agcagaaccgcca

SEQ ID NO: 1558299 - RNA, 16 nt, Pseudomonas aeruginosa PA01
agcagaaccgccagca

SEQ ID NO: 1558300 - RNA, 18 nt, Pseudomonas aeruginosa PA01
agcagaaccgccagcagu

SEQ ID NO: 1558301 - RNA, 19 nt, Pseudomonas aeruginosa PA01
agcagaaccgccagcagug

SEQ ID NO: 1558302 - RNA, 19 nt, Pseudomonas aeruginosa PA01
agcaauugccgcugcacgc

SEQ ID NO: 1558303 - RNA, 14 nt, Pseudomonas aeruginosa PA01
agcaaugcccagcg

SEQ ID NO: 1558304 - RNA, 19 nt, Pseudomonas aeruginosa PA01
agcaacuggucgccgcagg

SEQ ID NO: 1558305 - RNA, 21 nt, Pseudomonas aeruginosa PA01
agauuauauaggguuucucgc

SEQ ID NO: 1558306 - RNA, 17 nt, Pseudomonas aeruginosa PA01
agcaagaguguucccuc

SEQ ID NO: 1558307 - RNA, 22 nt, Pseudomonas aeruginosa PA01
agcaagccguagaacgccagga

SEQ ID NO: 1558308 - RNA, 19 nt, Pseudomonas aeruginosa PA01
agcaagucgaacaggcccu

SEQ ID NO: 1558309 - RNA, 23 nt, Pseudomonas aeruginosa PA01
acguuccaccuggcgcagguaga

SEQ ID NO: 1558310 - RNA, 13 nt, Pseudomonas aeruginosa PA01
acucauagcucag

SEQ ID NO: 1558311 - RNA, 18 nt, Pseudomonas aeruginosa PA01
acucauagcucagcugga

SEQ ID NO: 1558312 - RNA, 14 nt, Pseudomonas aeruginosa PA01
acucaucaggcugc

SEQ ID NO: 1558313 - RNA, 20 nt, Pseudomonas aeruginosa PA01
acucauggccgcagcggcug

SEQ ID NO: 1558314 - RNA, 12 nt, Pseudomonas aeruginosa PA01
acucaugcaggc

SEQ ID NO: 1558315 - RNA, 15 nt, Pseudomonas aeruginosa PA01
acuccacacggaaca

SEQ ID NO: 1558316 - RNA, 15 nt, Pseudomonas aeruginosa PA01
acuccggaggcgcac

SEQ ID NO: 1558317 - RNA, 14 nt, Pseudomonas aeruginosa PA01
acuccugcaaacgg

SEQ ID NO: 1558318 - RNA, 15 nt, Pseudomonas aeruginosa PA01
acucgaugcgcagcu

SEQ ID NO: 1558319 - RNA, 13 nt, Pseudomonas aeruginosa PA01
acucgcccggcuc

SEQ ID NO: 1558320 - RNA, 14 nt, Pseudomonas aeruginosa PA01
acucgcagccgcgc

SEQ ID NO: 1558321 - RNA, 14 nt, Pseudomonas aeruginosa PA01
acuccgccagcacc

SEQ ID NO: 1558322 - RNA, 20 nt, Pseudomonas aeruginosa PA01
acuccgccgcuuccgccggc

SEQ ID NO: 1558323 - RNA, 14 nt, Pseudomonas aeruginosa PA01
acuccaggcggcgg

SEQ ID NO: 1558324 - RNA, 22 nt, Pseudomonas aeruginosa PA01
acuccagcucgacccgcccgcc

SEQ ID NO: 1558325 - RNA, 20 nt, Pseudomonas aeruginosa PA01
acugcguggguagccauggc

SEQ ID NO: 1558326 - RNA, 17 nt, Pseudomonas aeruginosa PA01
acugcccagcgccgcca

SEQ ID NO: 1558327 - RNA, 22 nt, Pseudomonas aeruginosa PA01
acugcccagcgccgccagcagg

SEQ ID NO: 1558328 - RNA, 19 nt, Pseudomonas aeruginosa PA01
acugcacgcccaggcgcuc

SEQ ID NO: 1558329 - RNA, 12 nt, Pseudomonas aeruginosa PA01
acugcagcuugu

SEQ ID NO: 1558330 - RNA, 23 nt, Pseudomonas aeruginosa PA01
acugcacgcccaucgccaccagc

SEQ ID NO: 1558331 - RNA, 12 nt, Pseudomonas aeruginosa PA01
acugaccaccag

SEQ ID NO: 1558332 - RNA, 21 nt, Pseudomonas aeruginosa PA01
acucgucgccccacagcggug

SEQ ID NO: 1558333 - RNA, 22 nt, Pseudomonas aeruginosa PA01
acucguagucgaucaggaacac

SEQ ID NO: 1558334 - RNA, 16 nt, Pseudomonas aeruginosa PA01
acucgugcuccaccuc

SEQ ID NO: 1558335 - RNA, 22 nt, Pseudomonas aeruginosa PA01
acugggcgauguccuggaucgg

SEQ ID NO: 1558336 - RNA, 17 nt, Pseudomonas aeruginosa PA01
acugguugaagcgggag

SEQ ID NO: 1558337 - RNA, 18 nt, Pseudomonas aeruginosa PA01
acuggucgcgcgcggcca

SEQ ID NO: 1558338 - RNA, 17 nt, Pseudomonas aeruginosa PA01
acuggucgcuccagccc

SEQ ID NO: 1558339 - RNA, 16 nt, Pseudomonas aeruginosa PA01
acugcuuggccaggcg

SEQ ID NO: 1558340 - RNA, 16 nt, Pseudomonas aeruginosa PA01
acugcuucaggcgcgc

SEQ ID NO: 1558341 - RNA, 17 nt, Pseudomonas aeruginosa PA01
acugcuucaggcgcgcg

SEQ ID NO: 1558342 - RNA, 21 nt, Pseudomonas aeruginosa PA01
acugcuucaggcgcgcggcca

SEQ ID NO: 1558343 - RNA, 23 nt, Pseudomonas aeruginosa PA01
acuggccagcaccagucccuggc

SEQ ID NO: 1558344 - RNA, 13 nt, Pseudomonas aeruginosa PA01
acuggcgauggau

SEQ ID NO: 1558345 - RNA, 16 nt, Pseudomonas aeruginosa PA01
acuggcggcugggcug

SEQ ID NO: 1558346 - RNA, 20 nt, Pseudomonas aeruginosa PA01
acuguuaaucauuggguccc

SEQ ID NO: 1558347 - RNA, 14 nt, Pseudomonas aeruginosa PA01
acuguaccgcucug

SEQ ID NO: 1558348 - RNA, 21 nt, Pseudomonas aeruginosa PA01
acgccgucgcgcucuuccuuc

SEQ ID NO: 1558349 - RNA, 18 nt, Pseudomonas aeruginosa PA01
acgccguccaccagccag

SEQ ID NO: 1558350 - RNA, 17 nt, Pseudomonas aeruginosa PA01
acgccgguggccaggcu

SEQ ID NO: 1558351 - RNA, 18 nt, Pseudomonas aeruginosa PA01
acgccgcgaaauggcaga

SEQ ID NO: 1558352 - RNA, 18 nt, Pseudomonas aeruginosa PA01
acgccgcgaagcccagcg

SEQ ID NO: 1558353 - RNA, 14 nt, Pseudomonas aeruginosa PA01
acgccgccccagcc

SEQ ID NO: 1558354 - RNA, 16 nt, Pseudomonas aeruginosa PA01
acgccgcugucgucca

SEQ ID NO: 1558355 - RNA, 14 nt, Pseudomonas aeruginosa PA01
acgccgcggaaggc

SEQ ID NO: 1558356 - RNA, 22 nt, Pseudomonas aeruginosa PA01
acgccgcgucccugcacaggga

SEQ ID NO: 1558357 - RNA, 14 nt, Pseudomonas aeruginosa PA01
acgccguucagggu

SEQ ID NO: 1558358 - RNA, 23 nt, Pseudomonas aeruginosa PA01
acgccguguaaguuaaugcuuac

SEQ ID NO: 1558359 - RNA, 15 nt, Pseudomonas aeruginosa PA01
acgccuugcccggcg

SEQ ID NO: 1558360 - RNA, 16 nt, Pseudomonas aeruginosa PA01
acgaucagcaggaugc

SEQ ID NO: 1558361 - RNA, 15 nt, Pseudomonas aeruginosa PA01
acgaucagccagggc

SEQ ID NO: 1558362 - RNA, 23 nt, Pseudomonas aeruginosa PA01
acgaucagccagggcaacgccag

SEQ ID NO: 1558363 - RNA, 21 nt, Pseudomonas aeruginosa PA01
acgcccagcagggccagccag

SEQ ID NO: 1558364 - RNA, 23 nt, Pseudomonas aeruginosa PA01
acgcccagcagggccagccagag

SEQ ID NO: 1558365 - RNA, 16 nt, Pseudomonas aeruginosa PA01
acgcccaucuucaggc

SEQ ID NO: 1558366 - RNA, 22 nt, Pseudomonas aeruginosa PA01
acgcccaugccuugcagcgcca

SEQ ID NO: 1558367 - RNA, 22 nt, Pseudomonas aeruginosa PA01
acgcccauguagaccaccagcg

SEQ ID NO: 1558368 - RNA, 14 nt, Pseudomonas aeruginosa PA01
acgccccuccuucg

SEQ ID NO: 1558369 - RNA, 21 nt, Pseudomonas aeruginosa PA01
acgccccuagaccaacugcgc

SEQ ID NO: 1558370 - RNA, 18 nt, Pseudomonas aeruginosa PA01
acgcccgcuugcgccgcc

SEQ ID NO: 1558371 - RNA, 21 nt, Pseudomonas aeruginosa PA01
acgcccgcuugcgccgccucg

SEQ ID NO: 1558372 - RNA, 15 nt, Pseudomonas aeruginosa PA01
acgcccggagcgcga

SEQ ID NO: 1558373 - RNA, 11 nt, Pseudomonas aeruginosa PA01
acgcccucggc

SEQ ID NO: 1558374 - RNA, 13 nt, Pseudomonas aeruginosa PA01
acgcccuccagca

SEQ ID NO: 1558375 - RNA, 23 nt, Pseudomonas aeruginosa PA01
acgcccuccagcaccgccuggcg

SEQ ID NO: 1558376 - RNA, 13 nt, Pseudomonas aeruginosa PA01
acgcccuggauga

SEQ ID NO: 1558377 - RNA, 20 nt, Pseudomonas aeruginosa PA01
acgcccuggcgcuugggcgc

SEQ ID NO: 1558378 - RNA, 23 nt, Pseudomonas aeruginosa PA01
acgccgacggacguccuccugga

SEQ ID NO: 1558379 - RNA, 22 nt, Pseudomonas aeruginosa PA01
acgccgagaacgcggcgaaggg

SEQ ID NO: 1558380 - RNA, 24 nt, Pseudomonas aeruginosa PA01
acgccgaaguucuucagcagcaug

SEQ ID NO: 1558381 - RNA, 13 nt, Pseudomonas aeruginosa PA01
acgccgagggcgc

SEQ ID NO: 1558382 - RNA, 21 nt, Pseudomonas aeruginosa PA01
acgccgagcaugaugcaggca

SEQ ID NO: 1558383 - RNA, 13 nt, Pseudomonas aeruginosa PA01
acgccgcaggcgu

SEQ ID NO: 1558384 - RNA, 17 nt, Pseudomonas aeruginosa PA01
acgcgugauacagcucg

SEQ ID NO: 1558385 - RNA, 21 nt, Pseudomonas aeruginosa PA01
acgcgguuccacucccaugcc

SEQ ID NO: 1558386 - RNA, 16 nt, Pseudomonas aeruginosa PA01
acgcggguugcccggc

SEQ ID NO: 1558387 - RNA, 16 nt, Pseudomonas aeruginosa PA01
acgcugggacggcugc

SEQ ID NO: 1558388 - RNA, 15 nt, Pseudomonas aeruginosa PA01
acgcugcugccggcc

SEQ ID NO: 1558389 - RNA, 14 nt, Pseudomonas aeruginosa PA01
acgcugcgaccugg

SEQ ID NO: 1558390 - RNA, 15 nt, Pseudomonas aeruginosa PA01
acgcugcgaccuggc

SEQ ID NO: 1558391 - RNA, 22 nt, Pseudomonas aeruginosa PA01
acgcgcuggaccauggccggcg

SEQ ID NO: 1558392 - RNA, 23 nt, Pseudomonas aeruginosa PA01
acgcggacccaguugggccagga

SEQ ID NO: 1558393 - RNA, 15 nt, Pseudomonas aeruginosa PA01
acgcgcgcucucgcc

SEQ ID NO: 1558394 - RNA, 17 nt, Pseudomonas aeruginosa PA01
acgcgcggcugcuugcc

SEQ ID NO: 1558395 - RNA, 18 nt, Pseudomonas aeruginosa PA01
acgcgcggcugcuugccg

SEQ ID NO: 1558396 - RNA, 13 nt, Pseudomonas aeruginosa PA01
acgcgccuggccg

SEQ ID NO: 1558397 - RNA, 15 nt, Pseudomonas aeruginosa PA01
acgcggagcaggcgg

SEQ ID NO: 1558398 - RNA, 17 nt, Pseudomonas aeruginosa PA01
acgcggauuggccgggc

SEQ ID NO: 1558399 - RNA, 15 nt, Pseudomonas aeruginosa PA01
acgcgggccucugcc

SEQ ID NO: 1558400 - RNA, 15 nt, Pseudomonas aeruginosa PA01
acgcggcgaagggcg

SEQ ID NO: 1558401 - RNA, 23 nt, Pseudomonas aeruginosa PA01
acgcggcggcuccggcgccaggc

SEQ ID NO: 1558402 - RNA, 16 nt, Pseudomonas aeruginosa PA01
acgcgcccggccaggc

SEQ ID NO: 1558403 - RNA, 18 nt, Pseudomonas aeruginosa PA01
acgcgcagggucaggccc

SEQ ID NO: 1558404 - RNA, 14 nt, Pseudomonas aeruginosa PA01
acgcgacugcugcu

SEQ ID NO: 1558405 - RNA, 19 nt, Pseudomonas aeruginosa PA01
acgcgaccagcgccaggcg

SEQ ID NO: 1558406 - RNA, 21 nt, Pseudomonas aeruginosa PA01
acgcgaucgcggccagccgcu

SEQ ID NO: 1558407 - RNA, 15 nt, Pseudomonas aeruginosa PA01
acgcgcaagccagcc

SEQ ID NO: 1558408 - RNA, 17 nt, Pseudomonas aeruginosa PA01
acguggcgcuugagcag

SEQ ID NO: 1558409 - RNA, 17 nt, Pseudomonas aeruginosa PA01
acguguucgcagucgcu

SEQ ID NO: 1558410 - RNA, 17 nt, Pseudomonas aeruginosa PA01
acgucggcggggugauc

SEQ ID NO: 1558411 - RNA, 14 nt, Pseudomonas aeruginosa PA01
acgucggcccgguu

SEQ ID NO: 1558412 - RNA, 16 nt, Pseudomonas aeruginosa PA01
acgucguagccaggca

SEQ ID NO: 1558413 - RNA, 14 nt, Pseudomonas aeruginosa PA01
acgucgccccaggg

SEQ ID NO: 1558414 - RNA, 13 nt, Pseudomonas aeruginosa PA01
acgucgccgacca

SEQ ID NO: 1558415 - RNA, 16 nt, Pseudomonas aeruginosa PA01
acgucgcgcaccuggc

SEQ ID NO: 1558416 - RNA, 18 nt, Pseudomonas aeruginosa PA01
acgucgcgcaccuggcgg

SEQ ID NO: 1558417 - RNA, 14 nt, Pseudomonas aeruginosa PA01
acgucgagguaguc

SEQ ID NO: 1558418 - RNA, 22 nt, Pseudomonas aeruginosa PA01
acguccggcgucccgcaguagc

SEQ ID NO: 1558419 - RNA, 16 nt, Pseudomonas aeruginosa PA01
acguccuacgaaggca

SEQ ID NO: 1558420 - RNA, 21 nt, Pseudomonas aeruginosa PA01
acguccucgaugcccgccucg

SEQ ID NO: 1558421 - RNA, 16 nt, Pseudomonas aeruginosa PA01
acguccacugcguccu

SEQ ID NO: 1558422 - RNA, 19 nt, Pseudomonas aeruginosa PA01
acguccagaugaaacugcc

SEQ ID NO: 1558423 - RNA, 15 nt, Pseudomonas aeruginosa PA01
acgucaccguccuuc

SEQ ID NO: 1558424 - RNA, 14 nt, Pseudomonas aeruginosa PA01
acggugguggaagu

SEQ ID NO: 1558425 - RNA, 23 nt, Pseudomonas aeruginosa PA01
acggcguaccaggaugcccugcu

SEQ ID NO: 1558426 - RNA, 18 nt, Pseudomonas aeruginosa PA01
acggcggcgaccccgauc

SEQ ID NO: 1558427 - RNA, 15 nt, Pseudomonas aeruginosa PA01
acggcgcaagggcgc

SEQ ID NO: 1558428 - RNA, 15 nt, Pseudomonas aeruginosa PA01
acggcggccgccauc

SEQ ID NO: 1558429 - RNA, 17 nt, Pseudomonas aeruginosa PA01
acgguagcggcaggagc

SEQ ID NO: 1558430 - RNA, 13 nt, Pseudomonas aeruginosa PA01
acggugaaccagg

SEQ ID NO: 1558431 - RNA, 13 nt, Pseudomonas aeruginosa PA01
acggcagccgcgu

SEQ ID NO: 1558432 - RNA, 22 nt, Pseudomonas aeruginosa PA01
acggcagccgcguugucccugu

SEQ ID NO: 1558433 - RNA, 15 nt, Pseudomonas aeruginosa PA01
acgcuguagaaugcg

SEQ ID NO: 1558434 - RNA, 19 nt, Pseudomonas aeruginosa PA01
acgcuguagaccagcuuga

SEQ ID NO: 1558435 - RNA, 12 nt, Pseudomonas aeruginosa PA01
acggcaccacca

SEQ ID NO: 1558436 - RNA, 13 nt, Pseudomonas aeruginosa PA01
acggcaccaccac

SEQ ID NO: 1558437 - RNA, 13 nt, Pseudomonas aeruginosa PA01
acggcaccagcgc

SEQ ID NO: 1558438 - RNA, 22 nt, Pseudomonas aeruginosa PA01
acggcauuccugguccagccag

SEQ ID NO: 1558439 - RNA, 23 nt, Pseudomonas aeruginosa PA01
acggcauuccugguccagccagc

SEQ ID NO: 1558440 - RNA, 20 nt, Pseudomonas aeruginosa PA01
acggcaggguagccacgccg

SEQ ID NO: 1558441 - RNA, 15 nt, Pseudomonas aeruginosa PA01
acggccuucggcagg

SEQ ID NO: 1558442 - RNA, 20 nt, Pseudomonas aeruginosa PA01
acggcgacccgcacguugag

SEQ ID NO: 1558443 - RNA, 18 nt, Pseudomonas aeruginosa PA01
acggcgacccgccguucg

SEQ ID NO: 1558444 - RNA, 19 nt, Pseudomonas aeruginosa PA01
acggcgacccgccguucgc

SEQ ID NO: 1558445 - RNA, 23 nt, Pseudomonas aeruginosa PA01
acggcgaagccgcgcccggccuc

SEQ ID NO: 1558446 - RNA, 17 nt, Pseudomonas aeruginosa PA01
acggccguccugcggcc

SEQ ID NO: 1558447 - RNA, 13 nt, Pseudomonas aeruginosa PA01
acggccaggccca

SEQ ID NO: 1558448 - RNA, 18 nt, Pseudomonas aeruginosa PA01
acggccauaauggccgcu

SEQ ID NO: 1558449 - RNA, 20 nt, Pseudomonas aeruginosa PA01
acggccccgagaaaacccug

SEQ ID NO: 1558450 - RNA, 22 nt, Pseudomonas aeruginosa PA01
accugcucgcgcaccgcggcca

SEQ ID NO: 1558451 - RNA, 15 nt, Pseudomonas aeruginosa PA01
accugcucgcggguc

SEQ ID NO: 1558452 - RNA, 15 nt, Pseudomonas aeruginosa PA01
accuggaacuugcug

SEQ ID NO: 1558453 - RNA, 19 nt, Pseudomonas aeruginosa PA01
accugcuugggcgccucgc

SEQ ID NO: 1558454 - RNA, 17 nt, Pseudomonas aeruginosa PA01
accuggccgcuguggaa

SEQ ID NO: 1558455 - RNA, 21 nt, Pseudomonas aeruginosa PA01
accuggccgcuguggaaguac

SEQ ID NO: 1558456 - RNA, 20 nt, Pseudomonas aeruginosa PA01
accugccgcccggccaggcc

SEQ ID NO: 1558457 - RNA, 20 nt, Pseudomonas aeruginosa PA01
accugccgucacuugaaguc

SEQ ID NO: 1558458 - RNA, 17 nt, Pseudomonas aeruginosa PA01
accugccugcgcagggc

SEQ ID NO: 1558459 - RNA, 17 nt, Pseudomonas aeruginosa PA01
accugcgaauugcgcug

SEQ ID NO: 1558460 - RNA, 23 nt, Pseudomonas aeruginosa PA01
accugcguggcgaacgcccggcu

SEQ ID NO: 1558461 - RNA, 22 nt, Pseudomonas aeruginosa PA01
accugcggugucccuucuuuuu

SEQ ID NO: 1558462 - RNA, 15 nt, Pseudomonas aeruginosa PA01
accuccagccggcca

SEQ ID NO: 1558463 - RNA, 16 nt, Pseudomonas aeruginosa PA01
accuccagccagcagc

SEQ ID NO: 1558464 - RNA, 22 nt, Pseudomonas aeruginosa PA01
accuccagccagcagcccggcc

SEQ ID NO: 1558465 - RNA, 12 nt, Pseudomonas aeruginosa PA01
accugcaucacg

SEQ ID NO: 1558466 - RNA, 21 nt, Pseudomonas aeruginosa PA01
accugcagacgguucagcagc

SEQ ID NO: 1558467 - RNA, 23 nt, Pseudomonas aeruginosa PA01
accugcagacgguucagcagcgg

SEQ ID NO: 1558468 - RNA, 19 nt, Pseudomonas aeruginosa PA01
accuggccgucccugacca

SEQ ID NO: 1558469 - RNA, 16 nt, Pseudomonas aeruginosa PA01
accuggcgcucgccgu

SEQ ID NO: 1558470 - RNA, 17 nt, Pseudomonas aeruginosa PA01
accuggcgcagguagaa

SEQ ID NO: 1558471 - RNA, 17 nt, Pseudomonas aeruginosa PA01
accuggcucuguuccuc

SEQ ID NO: 1558472 - RNA, 16 nt, Pseudomonas aeruginosa PA01
accuggcggcugagcu

SEQ ID NO: 1558473 - RNA, 16 nt, Pseudomonas aeruginosa PA01
accuggcuccacugcu

SEQ ID NO: 1558474 - RNA, 17 nt, Pseudomonas aeruginosa PA01
accugugcugcgcgccg

SEQ ID NO: 1558475 - RNA, 23 nt, Pseudomonas aeruginosa PA01
accugucccggacgacgaaagaa

SEQ ID NO: 1558476 - RNA, 18 nt, Pseudomonas aeruginosa PA01
accuucaccggcacgccc

SEQ ID NO: 1558477 - RNA, 14 nt, Pseudomonas aeruginosa PA01
accuucagcaccug

SEQ ID NO: 1558478 - RNA, 20 nt, Pseudomonas aeruginosa PA01
accuuguccaggcgcugcuc

SEQ ID NO: 1558479 - RNA, 14 nt, Pseudomonas aeruginosa PA01
accuuguccugcgg

SEQ ID NO: 1558480 - RNA, 15 nt, Pseudomonas aeruginosa PA01
accuuggccaugggc

SEQ ID NO: 1558481 - RNA, 20 nt, Pseudomonas aeruginosa PA01
accuugucgccggugaggau

SEQ ID NO: 1558482 - RNA, 23 nt, Pseudomonas aeruginosa PA01
accuuugagggucagaccagccc

SEQ ID NO: 1558483 - RNA, 17 nt, Pseudomonas aeruginosa PA01
accuuucggagugaaca

SEQ ID NO: 1558484 - RNA, 18 nt, Pseudomonas aeruginosa PA01
accuugaagccuucgccc

SEQ ID NO: 1558485 - RNA, 19 nt, Pseudomonas aeruginosa PA01
acgagcagcucgccggcgu

SEQ ID NO: 1558486 - RNA, 16 nt, Pseudomonas aeruginosa PA01
acgagaucgagcgcgc

SEQ ID NO: 1558487 - RNA, 18 nt, Pseudomonas aeruginosa PA01
acgagaucgagcgcgccc

SEQ ID NO: 1558488 - RNA, 16 nt, Pseudomonas aeruginosa PA01
acgacgcuggccugcc

SEQ ID NO: 1558489 - RNA, 22 nt, Pseudomonas aeruginosa PA01
acgacuccagcuucuucugcag

SEQ ID NO: 1558490 - RNA, 15 nt, Pseudomonas aeruginosa PA01
acgacgggagcgcga

SEQ ID NO: 1558491 - RNA, 19 nt, Pseudomonas aeruginosa PA01
acgacgccggugccaggac

SEQ ID NO: 1558492 - RNA, 21 nt, Pseudomonas aeruginosa PA01
acgacgaagcgccggcggccu

SEQ ID NO: 1558493 - RNA, 22 nt, Pseudomonas aeruginosa PA01
acgacgaagugaccgcgcgcca

SEQ ID NO: 1558494 - RNA, 14 nt, Pseudomonas aeruginosa PA01
acgacgcacucaua

SEQ ID NO: 1558495 - RNA, 19 nt, Pseudomonas aeruginosa PA01
acgaaacucaucaggcugc

SEQ ID NO: 1558496 - RNA, 17 nt, Pseudomonas aeruginosa PA01
acgaaagccuugaccaa

SEQ ID NO: 1558497 - RNA, 15 nt, Pseudomonas aeruginosa PA01
acgacagccccggcc

SEQ ID NO: 1558498 - RNA, 20 nt, Pseudomonas aeruginosa PA01
acgacagccccggcccgguc

SEQ ID NO: 1558499 - RNA, 12 nt, Pseudomonas aeruginosa PA01
acgacaggcugg

SEQ ID NO: 1558500 - RNA, 17 nt, Pseudomonas aeruginosa PA01
acgaccacaucggccag

SEQ ID NO: 1558501 - RNA, 12 nt, Pseudomonas aeruginosa PA01
acgaccacgccu

SEQ ID NO: 1558502 - RNA, 14 nt, Pseudomonas aeruginosa PA01
acgaauggcuucuu

SEQ ID NO: 1558503 - RNA, 17 nt, Pseudomonas aeruginosa PA01
accgugcgcaccucgcc

SEQ ID NO: 1558504 - RNA, 13 nt, Pseudomonas aeruginosa PA01
accgugccgccgg

SEQ ID NO: 1558505 - RNA, 17 nt, Pseudomonas aeruginosa PA01
accguggaaccgauggc

SEQ ID NO: 1558506 - RNA, 22 nt, Pseudomonas aeruginosa PA01
accguggucagcaccagggcca

SEQ ID NO: 1558507 - RNA, 16 nt, Pseudomonas aeruginosa PA01
accguucccagcagcg

SEQ ID NO: 1558508 - RNA, 21 nt, Pseudomonas aeruginosa PA01
accgucgcggucaucgccggc

SEQ ID NO: 1558509 - RNA, 14 nt, Pseudomonas aeruginosa PA01
accgugaccagcau

SEQ ID NO: 1558510 - RNA, 22 nt, Pseudomonas aeruginosa PA01
accgucuucaguaggccagcgg

SEQ ID NO: 1558511 - RNA, 19 nt, Pseudomonas aeruginosa PA01
accgugcccgccggcgcgc

SEQ ID NO: 1558512 - RNA, 17 nt, Pseudomonas aeruginosa PA01
accgucgaucucgagca

SEQ ID NO: 1558513 - RNA, 17 nt, Pseudomonas aeruginosa PA01
accgucgaaccagccgc

SEQ ID NO: 1558514 - RNA, 23 nt, Pseudomonas aeruginosa PA01
accgucgaauuggacagcaggcu

SEQ ID NO: 1558515 - RNA, 23 nt, Pseudomonas aeruginosa PA01
accguuucgccgccggccagccg

SEQ ID NO: 1558516 - RNA, 20 nt, Pseudomonas aeruginosa PA01
accgggauggucgagggcgc

SEQ ID NO: 1558517 - RNA, 17 nt, Pseudomonas aeruginosa PA01
accggucaaaccauggc

SEQ ID NO: 1558518 - RNA, 16 nt, Pseudomonas aeruginosa PA01
accgguaccacgggca

SEQ ID NO: 1558519 - RNA, 21 nt, Pseudomonas aeruginosa PA01
accggcagcgccgccagcagg

SEQ ID NO: 1558520 - RNA, 17 nt, Pseudomonas aeruginosa PA01
accggcauguagcgcgc

SEQ ID NO: 1558521 - RNA, 19 nt, Pseudomonas aeruginosa PA01
accgguuucccucgagcac

SEQ ID NO: 1558522 - RNA, 14 nt, Pseudomonas aeruginosa PA01
accguaggccaggc

SEQ ID NO: 1558523 - RNA, 15 nt, Pseudomonas aeruginosa PA01
accguaggccaggca

SEQ ID NO: 1558524 - RNA, 13 nt, Pseudomonas aeruginosa PA01
accgucacgcgga

SEQ ID NO: 1558525 - RNA, 23 nt, Pseudomonas aeruginosa PA01
accgucacggcgaaaccggccag

SEQ ID NO: 1558526 - RNA, 16 nt, Pseudomonas aeruginosa PA01
accgucaccuguucgg

SEQ ID NO: 1558527 - RNA, 15 nt, Pseudomonas aeruginosa PA01
accgucagccaggcu

SEQ ID NO: 1558528 - RNA, 15 nt, Pseudomonas aeruginosa PA01
accgcuugccagccg

SEQ ID NO: 1558529 - RNA, 23 nt, Pseudomonas aeruginosa PA01
accgcucucgaggacgugcacca

SEQ ID NO: 1558530 - RNA, 12 nt, Pseudomonas aeruginosa PA01
accgcucugcac

SEQ ID NO: 1558531 - RNA, 16 nt, Pseudomonas aeruginosa PA01
accggaccgggcgccu

SEQ ID NO: 1558532 - RNA, 17 nt, Pseudomonas aeruginosa PA01
accggacggcugaggcu

SEQ ID NO: 1558533 - RNA, 18 nt, Pseudomonas aeruginosa PA01
accggacggcugaggcug

SEQ ID NO: 1558534 - RNA, 15 nt, Pseudomonas aeruginosa PA01
accgcucgucaggcg

SEQ ID NO: 1558535 - RNA, 20 nt, Pseudomonas aeruginosa PA01
accgcucaagacggcccgca

SEQ ID NO: 1558536 - RNA, 20 nt, Pseudomonas aeruginosa PA01
accgcgucgggaaaggccgc

SEQ ID NO: 1558537 - RNA, 19 nt, Pseudomonas aeruginosa PA01
accgcguccauccccgccu

SEQ ID NO: 1558538 - RNA, 17 nt, Pseudomonas aeruginosa PA01
accagcgccgccaggca

SEQ ID NO: 1558539 - RNA, 16 nt, Pseudomonas aeruginosa PA01
accagcgcugccucgg

SEQ ID NO: 1558540 - RNA, 17 nt, Pseudomonas aeruginosa PA01
accagcgucgccaggcc

SEQ ID NO: 1558541 - RNA, 17 nt, Pseudomonas aeruginosa PA01
accagccuugagccuug

SEQ ID NO: 1558542 - RNA, 19 nt, Pseudomonas aeruginosa PA01
accagccuugagccuugcc

SEQ ID NO: 1558543 - RNA, 20 nt, Pseudomonas aeruginosa PA01
accagccuugagccuugccc

SEQ ID NO: 1558544 - RNA, 22 nt, Pseudomonas aeruginosa PA01
accagccuugagccuugccccg

SEQ ID NO: 1558545 - RNA, 19 nt, Pseudomonas aeruginosa PA01
accagcgaagugcgcugcu

SEQ ID NO: 1558546 - RNA, 15 nt, Pseudomonas aeruginosa PA01
accagcgaggagccu

SEQ ID NO: 1558547 - RNA, 19 nt, Pseudomonas aeruginosa PA01
accagcgagucgacccagg

SEQ ID NO: 1558548 - RNA, 12 nt, Pseudomonas aeruginosa PA01
accagcagggcc

SEQ ID NO: 1558549 - RNA, 15 nt, Pseudomonas aeruginosa PA01
accagcagggccagg

SEQ ID NO: 1558550 - RNA, 14 nt, Pseudomonas aeruginosa PA01
accagcaggaagcc

SEQ ID NO: 1558551 - RNA, 14 nt, Pseudomonas aeruginosa PA01
accagcaugcccag

SEQ ID NO: 1558552 - RNA, 18 nt, Pseudomonas aeruginosa PA01
accagcauguccugcagg

SEQ ID NO: 1558553 - RNA, 23 nt, Pseudomonas aeruginosa PA01
accagcauguccugcaggcucag

SEQ ID NO: 1558554 - RNA, 17 nt, Pseudomonas aeruginosa PA01
accagcauggcgggcca

SEQ ID NO: 1558555 - RNA, 21 nt, Pseudomonas aeruginosa PA01
accagcccgcgcgacagcucu

SEQ ID NO: 1558556 - RNA, 22 nt, Pseudomonas aeruginosa PA01
accagccgcguugcauguccuc

SEQ ID NO: 1558557 - RNA, 16 nt, Pseudomonas aeruginosa PA01
accagccgcaggcugc

SEQ ID NO: 1558558 - RNA, 16 nt, Pseudomonas aeruginosa PA01
accagcccuggcgcag

SEQ ID NO: 1558559 - RNA, 18 nt, Pseudomonas aeruginosa PA01
accagcccuggcgcggca

SEQ ID NO: 1558560 - RNA, 18 nt, Pseudomonas aeruginosa PA01
accagccaguccggcagc

SEQ ID NO: 1558561 - RNA, 22 nt, Pseudomonas aeruginosa PA01
accagccagucgagacgccagc

SEQ ID NO: 1558562 - RNA, 22 nt, Pseudomonas aeruginosa PA01
accagccagucggcggucuuga

SEQ ID NO: 1558563 - RNA, 15 nt, Pseudomonas aeruginosa PA01
accagaaggucuugc

SEQ ID NO: 1558564 - RNA, 14 nt, Pseudomonas aeruginosa PA01
accaacuuucccuc

SEQ ID NO: 1558565 - RNA, 14 nt, Pseudomonas aeruginosa PA01
accagcaccgccug

SEQ ID NO: 1558566 - RNA, 18 nt, Pseudomonas aeruginosa PA01
accagcaccgccugcaac

SEQ ID NO: 1558567 - RNA, 18 nt, Pseudomonas aeruginosa PA01
accagcaaugcccagcgc

SEQ ID NO: 1558568 - RNA, 16 nt, Pseudomonas aeruginosa PA01
accagacuuccgggcu

SEQ ID NO: 1558569 - RNA, 15 nt, Pseudomonas aeruginosa PA01
accagagccagccgc

SEQ ID NO: 1558570 - RNA, 17 nt, Pseudomonas aeruginosa PA01
accagauagaccaaggc

SEQ ID NO: 1558571 - RNA, 14 nt, Pseudomonas aeruginosa PA01
accagcaaacggga

SEQ ID NO: 1558572 - RNA, 23 nt, Pseudomonas aeruginosa PA01
accauaaagcccacacgcaugau

SEQ ID NO: 1558573 - RNA, 21 nt, Pseudomonas aeruginosa PA01
accauagcgagccgcgcugcu

SEQ ID NO: 1558574 - RNA, 23 nt, Pseudomonas aeruginosa PA01
accaucgcggcgauggccgccag

SEQ ID NO: 1558575 - RNA, 18 nt, Pseudomonas aeruginosa PA01
accaguagggggugaagc

SEQ ID NO: 1558576 - RNA, 13 nt, Pseudomonas aeruginosa PA01
accaguccagcac

SEQ ID NO: 1558577 - RNA, 14 nt, Pseudomonas aeruginosa PA01
accaguccagcacg

SEQ ID NO: 1558578 - RNA, 15 nt, Pseudomonas aeruginosa PA01
accagugcaccgccg

SEQ ID NO: 1558579 - RNA, 18 nt, Pseudomonas aeruginosa PA01
accagucgcccgcuucgc

SEQ ID NO: 1558580 - RNA, 15 nt, Pseudomonas aeruginosa PA01
accaggaaggccggg

SEQ ID NO: 1558581 - RNA, 16 nt, Pseudomonas aeruginosa PA01
accaggaaggcgucgc

SEQ ID NO: 1558582 - RNA, 13 nt, Pseudomonas aeruginosa PA01
accaggaauuccu

SEQ ID NO: 1558583 - RNA, 16 nt, Pseudomonas aeruginosa PA01
accaggacccagauga

SEQ ID NO: 1558584 - RNA, 19 nt, Pseudomonas aeruginosa PA01
accaggaccagcgccugcu

SEQ ID NO: 1558585 - RNA, 14 nt, Pseudomonas aeruginosa PA01
accaggagcgccag

SEQ ID NO: 1558586 - RNA, 17 nt, Pseudomonas aeruginosa PA01
accaggagcgccagcac

SEQ ID NO: 1558587 - RNA, 14 nt, Pseudomonas aeruginosa PA01
accaggccaggcug

SEQ ID NO: 1558588 - RNA, 21 nt, Pseudomonas aeruginosa PA01
accaggccgaacgggaaguag

SEQ ID NO: 1558589 - RNA, 22 nt, Pseudomonas aeruginosa PA01
accagcuucaaccguggcucga

SEQ ID NO: 1558590 - RNA, 11 nt, Pseudomonas aeruginosa PA01
accagcucgaa

SEQ ID NO: 1558591 - RNA, 21 nt, Pseudomonas aeruginosa PA01
accagcucagcuccaggccgc

SEQ ID NO: 1558592 - RNA, 15 nt, Pseudomonas aeruginosa PA01
accaggucggcgcgc

SEQ ID NO: 1558593 - RNA, 21 nt, Pseudomonas aeruginosa PA01
accagguccgccacuucaagc

SEQ ID NO: 1558594 - RNA, 14 nt, Pseudomonas aeruginosa PA01
accaggucgauccu

SEQ ID NO: 1558595 - RNA, 18 nt, Pseudomonas aeruginosa PA01
accaggucguggaaggcu

SEQ ID NO: 1558596 - RNA, 19 nt, Pseudomonas aeruginosa PA01
accaggucguggaaggcuu

SEQ ID NO: 1558597 - RNA, 16 nt, Pseudomonas aeruginosa PA01
accaggugaugcacgu

SEQ ID NO: 1558598 - RNA, 20 nt, Pseudomonas aeruginosa PA01
accaggucgccaugcccguc

SEQ ID NO: 1558599 - RNA, 17 nt, Pseudomonas aeruginosa PA01
accagguugcccggcuu

SEQ ID NO: 1558600 - RNA, 16 nt, Pseudomonas aeruginosa PA01
accaggcgccagggac

SEQ ID NO: 1558601 - RNA, 20 nt, Pseudomonas aeruginosa PA01
accaggcgccgcccccggcc

SEQ ID NO: 1558602 - RNA, 15 nt, Pseudomonas aeruginosa PA01
accagggaagcgcgc

SEQ ID NO: 1558603 - RNA, 17 nt, Pseudomonas aeruginosa PA01
accagggcauccagggu

SEQ ID NO: 1558604 - RNA, 17 nt, Pseudomonas aeruginosa PA01
accaggcgguuggcccg

SEQ ID NO: 1558605 - RNA, 13 nt, Pseudomonas aeruginosa PA01
accagggccucgg

SEQ ID NO: 1558606 - RNA, 16 nt, Pseudomonas aeruginosa PA01
accagguagagcagcc

SEQ ID NO: 1558607 - RNA, 21 nt, Pseudomonas aeruginosa PA01
accaggggucgacgcagggcg

SEQ ID NO: 1558608 - RNA, 21 nt, Pseudomonas aeruginosa PA01
accagggucacgccgcggcug

SEQ ID NO: 1558609 - RNA, 15 nt, Pseudomonas aeruginosa PA01
accagggucgccagg

SEQ ID NO: 1558610 - RNA, 15 nt, Pseudomonas aeruginosa PA01
accaggguggcgcgc

SEQ ID NO: 1558611 - RNA, 16 nt, Pseudomonas aeruginosa PA01
accaucuuuuccugcu

SEQ ID NO: 1558612 - RNA, 18 nt, Pseudomonas aeruginosa PA01
accaucuuuuccugcugg

SEQ ID NO: 1558613 - RNA, 17 nt, Pseudomonas aeruginosa PA01
acccagaagccgaccuu

SEQ ID NO: 1558614 - RNA, 19 nt, Pseudomonas aeruginosa PA01
acccagacaggccugugga

SEQ ID NO: 1558615 - RNA, 21 nt, Pseudomonas aeruginosa PA01
acccagacaggccuguggaua

SEQ ID NO: 1558616 - RNA, 23 nt, Pseudomonas aeruginosa PA01
acccagacaggccuguggauaga

SEQ ID NO: 1558617 - RNA, 15 nt, Pseudomonas aeruginosa PA01
acccagaccugccgc

SEQ ID NO: 1558618 - RNA, 17 nt, Pseudomonas aeruginosa PA01
acccagaccugccgccc

SEQ ID NO: 1558619 - RNA, 19 nt, Pseudomonas aeruginosa PA01
acccagaccuuccagccgc

SEQ ID NO: 1558620 - RNA, 21 nt, Pseudomonas aeruginosa PA01
acccagaccuuccagccgcgc

SEQ ID NO: 1558621 - RNA, 16 nt, Pseudomonas aeruginosa PA01
acccacuccggcaggc

SEQ ID NO: 1558622 - RNA, 15 nt, Pseudomonas aeruginosa PA01
acccacuugaacacc

SEQ ID NO: 1558623 - RNA, 20 nt, Pseudomonas aeruginosa PA01
acccaguugggccaggaggc

SEQ ID NO: 1558624 - RNA, 20 nt, Pseudomonas aeruginosa PA01
acccaggugcgcaggcgcuc

SEQ ID NO: 1558625 - RNA, 20 nt, Pseudomonas aeruginosa PA01
acccagguggucgaccaggc

SEQ ID NO: 1558626 - RNA, 18 nt, Pseudomonas aeruginosa PA01
acccagggcgcugccgau

SEQ ID NO: 1558627 - RNA, 19 nt, Pseudomonas aeruginosa PA01
acccaggccgucgagggca

SEQ ID NO: 1558628 - RNA, 19 nt, Pseudomonas aeruginosa PA01
acccagccauugagcgcgc

SEQ ID NO: 1558629 - RNA, 18 nt, Pseudomonas aeruginosa PA01
acccagccgcggccguug

SEQ ID NO: 1558630 - RNA, 15 nt, Pseudomonas aeruginosa PA01
acccaggccacgccc

SEQ ID NO: 1558631 - RNA, 12 nt, Pseudomonas aeruginosa PA01
acccccgcaacc

SEQ ID NO: 1558632 - RNA, 16 nt, Pseudomonas aeruginosa PA01
acccauguggcgcagc

SEQ ID NO: 1558633 - RNA, 20 nt, Pseudomonas aeruginosa PA01
acccccuugcccgucgggca

SEQ ID NO: 1558634 - RNA, 16 nt, Pseudomonas aeruginosa PA01
acccccugcgcggacg

SEQ ID NO: 1558635 - RNA, 22 nt, Pseudomonas aeruginosa PA01
accccggccuggcuggccuugu

SEQ ID NO: 1558636 - RNA, 13 nt, Pseudomonas aeruginosa PA01
accccgagcccgg

SEQ ID NO: 1558637 - RNA, 23 nt, Pseudomonas aeruginosa PA01
accccggcgaucuucagguaggc

SEQ ID NO: 1558638 - RNA, 18 nt, Pseudomonas aeruginosa PA01
accccggccuccaggcug

SEQ ID NO: 1558639 - RNA, 19 nt, Pseudomonas aeruginosa PA01
accccggccuccaggcugg

SEQ ID NO: 1558640 - RNA, 20 nt, Pseudomonas aeruginosa PA01
accccggccuccaggcuggc

SEQ ID NO: 1558641 - RNA, 18 nt, Pseudomonas aeruginosa PA01
accccgguugugcgcccg

SEQ ID NO: 1558642 - RNA, 18 nt, Pseudomonas aeruginosa PA01
accccgucaacccuugcu

SEQ ID NO: 1558643 - RNA, 15 nt, Pseudomonas aeruginosa PA01
acccgcagccccgcc

SEQ ID NO: 1558644 - RNA, 17 nt, Pseudomonas aeruginosa PA01
acccgcaccuugcccug

SEQ ID NO: 1558645 - RNA, 14 nt, Pseudomonas aeruginosa PA01
acccgcaccagccg

SEQ ID NO: 1558646 - RNA, 20 nt, Pseudomonas aeruginosa PA01
accccucggcuaaccgccuu

SEQ ID NO: 1558647 - RNA, 16 nt, Pseudomonas aeruginosa PA01
acccgacaggcagcgc

SEQ ID NO: 1558648 - RNA, 13 nt, Pseudomonas aeruginosa PA01
acccgagcaacug

SEQ ID NO: 1558649 - RNA, 14 nt, Pseudomonas aeruginosa PA01
accccguuguaccc

SEQ ID NO: 1558650 - RNA, 14 nt, Pseudomonas aeruginosa PA01
acccguacgcugcc

SEQ ID NO: 1558651 - RNA, 16 nt, Pseudomonas aeruginosa PA01
acccggucgcgcugga

SEQ ID NO: 1558652 - RNA, 16 nt, Pseudomonas aeruginosa PA01
acccggucgcugacca

SEQ ID NO: 1558653 - RNA, 17 nt, Pseudomonas aeruginosa PA01
acccggucggccuguuc

SEQ ID NO: 1558654 - RNA, 13 nt, Pseudomonas aeruginosa PA01
acccgcccggcuc

SEQ ID NO: 1558655 - RNA, 15 nt, Pseudomonas aeruginosa PA01
acccgggucaggccg

SEQ ID NO: 1558656 - RNA, 17 nt, Pseudomonas aeruginosa PA01
acccggguuuccugccc

SEQ ID NO: 1558657 - RNA, 21 nt, Pseudomonas aeruginosa PA01
acccggguuuccugcccgacc

SEQ ID NO: 1558658 - RNA, 16 nt, Pseudomonas aeruginosa PA01
acccgguacagcgccu

SEQ ID NO: 1558659 - RNA, 19 nt, Pseudomonas aeruginosa PA01
acccgguacagcgccuggu

SEQ ID NO: 1558660 - RNA, 17 nt, Pseudomonas aeruginosa PA01
acccgcaucgaggccgc

SEQ ID NO: 1558661 - RNA, 17 nt, Pseudomonas aeruginosa PA01
acccgccccugcuccuc

SEQ ID NO: 1558662 - RNA, 17 nt, Pseudomonas aeruginosa PA01
acccugggagccgccgg

SEQ ID NO: 1558663 - RNA, 19 nt, Pseudomonas aeruginosa PA01
acccugguaguccagcagg

SEQ ID NO: 1558664 - RNA, 14 nt, Pseudomonas aeruginosa PA01
acccugccccagca

SEQ ID NO: 1558665 - RNA, 18 nt, Pseudomonas aeruginosa PA01
acccugcugcugcucagc

SEQ ID NO: 1558666 - RNA, 23 nt, Pseudomonas aeruginosa PA01
acccuggccgcgcggcuugccgg

SEQ ID NO: 1558667 - RNA, 18 nt, Pseudomonas aeruginosa PA01
acccucagucgcccccac

SEQ ID NO: 1558668 - RNA, 24 nt, Pseudomonas aeruginosa PA01
accgaauccuugaucaccuugcca

SEQ ID NO: 1558669 - RNA, 21 nt, Pseudomonas aeruginosa PA01
accgaagucgcccgccggcgu

SEQ ID NO: 1558670 - RNA, 16 nt, Pseudomonas aeruginosa PA01
accgaacagcgcgcca

SEQ ID NO: 1558671 - RNA, 14 nt, Pseudomonas aeruginosa PA01
accgaaacagggcg

SEQ ID NO: 1558672 - RNA, 12 nt, Pseudomonas aeruginosa PA01
accgaggcgcgc

SEQ ID NO: 1558673 - RNA, 21 nt, Pseudomonas aeruginosa PA01
accgagguagucccagaccac

SEQ ID NO: 1558674 - RNA, 18 nt, Pseudomonas aeruginosa PA01
accgaguugaccagcaug

SEQ ID NO: 1558675 - RNA, 13 nt, Pseudomonas aeruginosa PA01
accgacgaugggc

SEQ ID NO: 1558676 - RNA, 18 nt, Pseudomonas aeruginosa PA01
accgacgccgccugcgcc

SEQ ID NO: 1558677 - RNA, 20 nt, Pseudomonas aeruginosa PA01
accgacgccgccugcgccuc

SEQ ID NO: 1558678 - RNA, 20 nt, Pseudomonas aeruginosa PA01
accgacgccggacgcaccag

SEQ ID NO: 1558679 - RNA, 20 nt, Pseudomonas aeruginosa PA01
accgacaggccgaccagcag

SEQ ID NO: 1558680 - RNA, 14 nt, Pseudomonas aeruginosa PA01
accgaccaguacca

SEQ ID NO: 1558681 - RNA, 15 nt, Pseudomonas aeruginosa PA01
accgacagucccagg

SEQ ID NO: 1558682 - RNA, 22 nt, Pseudomonas aeruginosa PA01
agcuccgccugaccgcugauga

SEQ ID NO: 1558683 - RNA, 14 nt, Pseudomonas aeruginosa PA01
agcuccuccagccg

SEQ ID NO: 1558684 - RNA, 13 nt, Pseudomonas aeruginosa PA01
agcuccccgccgc

SEQ ID NO: 1558685 - RNA, 19 nt, Pseudomonas aeruginosa PA01
agcuccccgucccucaggu

SEQ ID NO: 1558686 - RNA, 16 nt, Pseudomonas aeruginosa PA01
agcucccuugccgccg

SEQ ID NO: 1558687 - RNA, 14 nt, Pseudomonas aeruginosa PA01
agcgucucagcccu

SEQ ID NO: 1558688 - RNA, 22 nt, Pseudomonas aeruginosa PA01
agcgucugcagcuugcgcgcca

SEQ ID NO: 1558689 - RNA, 19 nt, Pseudomonas aeruginosa PA01
agcgucugccgcuggcggc

SEQ ID NO: 1558690 - RNA, 21 nt, Pseudomonas aeruginosa PA01
agcgucugccgcuggcggccu

SEQ ID NO: 1558691 - RNA, 14 nt, Pseudomonas aeruginosa PA01
agcgucgccgggcg

SEQ ID NO: 1558692 - RNA, 18 nt, Pseudomonas aeruginosa PA01
agcgucgccugccaggcg

SEQ ID NO: 1558693 - RNA, 19 nt, Pseudomonas aeruginosa PA01
agcgucgcgcguccagccg

SEQ ID NO: 1558694 - RNA, 14 nt, Pseudomonas aeruginosa PA01
agcgucgugcgccg

SEQ ID NO: 1558695 - RNA, 18 nt, Pseudomonas aeruginosa PA01
agcucgaaauccggugcc

SEQ ID NO: 1558696 - RNA, 15 nt, Pseudomonas aeruginosa PA01
agcuccuugcucucg

SEQ ID NO: 1558697 - RNA, 16 nt, Pseudomonas aeruginosa PA01
agcucgaagccgccgu

SEQ ID NO: 1558698 - RNA, 19 nt, Pseudomonas aeruginosa PA01
agcucgaucucauggucgg

SEQ ID NO: 1558699 - RNA, 13 nt, Pseudomonas aeruginosa PA01
agcucggccaggc

SEQ ID NO: 1558700 - RNA, 22 nt, Pseudomonas aeruginosa PA01
agcucggcaaucgcggggugau

SEQ ID NO: 1558701 - RNA, 13 nt, Pseudomonas aeruginosa PA01
agcucggcagcac

SEQ ID NO: 1558702 - RNA, 12 nt, Pseudomonas aeruginosa PA01
agcucggccgcu

SEQ ID NO: 1558703 - RNA, 16 nt, Pseudomonas aeruginosa PA01
agcucggccggcaggc

SEQ ID NO: 1558704 - RNA, 18 nt, Pseudomonas aeruginosa PA01
agcucgcuaugcagcagg

SEQ ID NO: 1558705 - RNA, 20 nt, Pseudomonas aeruginosa PA01
agcucgcugucgccgagcac

SEQ ID NO: 1558706 - RNA, 18 nt, Pseudomonas aeruginosa PA01
agcucggacaagggccag

SEQ ID NO: 1558707 - RNA, 14 nt, Pseudomonas aeruginosa PA01
agcucgcccgccuc

SEQ ID NO: 1558708 - RNA, 15 nt, Pseudomonas aeruginosa PA01
agcucgcccgccucg

SEQ ID NO: 1558709 - RNA, 15 nt, Pseudomonas aeruginosa PA01
agcucuggggucagu

SEQ ID NO: 1558710 - RNA, 13 nt, Pseudomonas aeruginosa PA01
agcucugucuccu

SEQ ID NO: 1558711 - RNA, 15 nt, Pseudomonas aeruginosa PA01
agcucugcuggcugu

SEQ ID NO: 1558712 - RNA, 23 nt, Pseudomonas aeruginosa PA01
agcucugcgacuggaugcagccg

SEQ ID NO: 1558713 - RNA, 21 nt, Pseudomonas aeruginosa PA01
agcucucgcugguggcgaggg

SEQ ID NO: 1558714 - RNA, 17 nt, Pseudomonas aeruginosa PA01
agcucggccugguccgg

SEQ ID NO: 1558715 - RNA, 18 nt, Pseudomonas aeruginosa PA01
agcucggcgauggcgcgc

SEQ ID NO: 1558716 - RNA, 21 nt, Pseudomonas aeruginosa PA01
agcucggcgcccuggccgcca

SEQ ID NO: 1558717 - RNA, 12 nt, Pseudomonas aeruginosa PA01
agcucggcggga

SEQ ID NO: 1558718 - RNA, 21 nt, Pseudomonas aeruginosa PA01
agcucggcguagcgcugggcu

SEQ ID NO: 1558719 - RNA, 19 nt, Pseudomonas aeruginosa PA01
agcucggugagcaggcgcc

SEQ ID NO: 1558720 - RNA, 19 nt, Pseudomonas aeruginosa PA01
agcucgucgagcugcucgg

SEQ ID NO: 1558721 - RNA, 20 nt, Pseudomonas aeruginosa PA01
agcucguccauguugcggcc

SEQ ID NO: 1558722 - RNA, 16 nt, Pseudomonas aeruginosa PA01
agcucgucguggaagu

SEQ ID NO: 1558723 - RNA, 15 nt, Pseudomonas aeruginosa PA01
agcucguuggccacc

SEQ ID NO: 1558724 - RNA, 16 nt, Pseudomonas aeruginosa PA01
agcucguugcccggcu

SEQ ID NO: 1558725 - RNA, 22 nt, Pseudomonas aeruginosa PA01
agcugaagcgccgcggcccggc

SEQ ID NO: 1558726 - RNA, 16 nt, Pseudomonas aeruginosa PA01
agcucuuccaggugau

SEQ ID NO: 1558727 - RNA, 11 nt, Pseudomonas aeruginosa PA01
agcugaccacg

SEQ ID NO: 1558728 - RNA, 17 nt, Pseudomonas aeruginosa PA01
agcugacgaacaucgcc

SEQ ID NO: 1558729 - RNA, 14 nt, Pseudomonas aeruginosa PA01
agcugggcaggcug

SEQ ID NO: 1558730 - RNA, 14 nt, Pseudomonas aeruginosa PA01
agcuggcgcagccg

SEQ ID NO: 1558731 - RNA, 17 nt, Pseudomonas aeruginosa PA01
agcuggcgcaggccuuc

SEQ ID NO: 1558732 - RNA, 15 nt, Pseudomonas aeruginosa PA01
agcuggcgcagggcg

SEQ ID NO: 1558733 - RNA, 23 nt, Pseudomonas aeruginosa PA01
agcuggcgcagggcguucuucac

SEQ ID NO: 1558734 - RNA, 22 nt, Pseudomonas aeruginosa PA01
agcuggcgcgucgcugccgccg

SEQ ID NO: 1558735 - RNA, 23 nt, Pseudomonas aeruginosa PA01
agcuggcgcguugugccgccacc

SEQ ID NO: 1558736 - RNA, 16 nt, Pseudomonas aeruginosa PA01
agcuggauagaguacu

SEQ ID NO: 1558737 - RNA, 20 nt, Pseudomonas aeruginosa PA01
agcuggauccgugccaggcg

SEQ ID NO: 1558738 - RNA, 16 nt, Pseudomonas aeruginosa PA01
agcuggaucggcaggc

SEQ ID NO: 1558739 - RNA, 15 nt, Pseudomonas aeruginosa PA01
agcuggcgcacacgg

SEQ ID NO: 1558740 - RNA, 22 nt, Pseudomonas aeruginosa PA01
agcugaucucggcgacuucgca

SEQ ID NO: 1558741 - RNA, 15 nt, Pseudomonas aeruginosa PA01
agcugcuccagcccg

SEQ ID NO: 1558742 - RNA, 17 nt, Pseudomonas aeruginosa PA01
agcugcgccgccuuucu

SEQ ID NO: 1558743 - RNA, 13 nt, Pseudomonas aeruginosa PA01
agcugcgccugca

SEQ ID NO: 1558744 - RNA, 13 nt, Pseudomonas aeruginosa PA01
agcugcgcagggc

SEQ ID NO: 1558745 - RNA, 19 nt, Pseudomonas aeruginosa PA01
agcugcagcgccccagcac

SEQ ID NO: 1558746 - RNA, 14 nt, Pseudomonas aeruginosa PA01
agcugcaccgcgcg

SEQ ID NO: 1558747 - RNA, 12 nt, Pseudomonas aeruginosa PA01
agcuuuccaggg

SEQ ID NO: 1558748 - RNA, 13 nt, Pseudomonas aeruginosa PA01
agcuuuccagggc

SEQ ID NO: 1558749 - RNA, 18 nt, Pseudomonas aeruginosa PA01
agcuuggccacuccgggc

SEQ ID NO: 1558750 - RNA, 18 nt, Pseudomonas aeruginosa PA01
agcuugcgccagagcagg

SEQ ID NO: 1558751 - RNA, 22 nt, Pseudomonas aeruginosa PA01
agcuucuucggcagccauuuua

SEQ ID NO: 1558752 - RNA, 22 nt, Pseudomonas aeruginosa PA01
agcuucaccggugccgggaagc

SEQ ID NO: 1558753 - RNA, 15 nt, Pseudomonas aeruginosa PA01
agcuucagcuccgag

SEQ ID NO: 1558754 - RNA, 12 nt, Pseudomonas aeruginosa PA01
agcuucagggug

SEQ ID NO: 1558755 - RNA, 13 nt, Pseudomonas aeruginosa PA01
aggacgccgggcu

SEQ ID NO: 1558756 - RNA, 17 nt, Pseudomonas aeruginosa PA01
aggacgaagucgccggc

SEQ ID NO: 1558757 - RNA, 18 nt, Pseudomonas aeruginosa PA01
aggaccuugucgcgcacc

SEQ ID NO: 1558758 - RNA, 16 nt, Pseudomonas aeruginosa PA01
aggaccuuccgccagc

SEQ ID NO: 1558759 - RNA, 20 nt, Pseudomonas aeruginosa PA01
aggaccuuccgccagcaggc

SEQ ID NO: 1558760 - RNA, 21 nt, Pseudomonas aeruginosa PA01
aggaccuuccgccagcaggcg

SEQ ID NO: 1558761 - RNA, 22 nt, Pseudomonas aeruginosa PA01
aggaccuuccgccagcaggcgc

SEQ ID NO: 1558762 - RNA, 16 nt, Pseudomonas aeruginosa PA01
aggaccuggcugaggc

SEQ ID NO: 1558763 - RNA, 15 nt, Pseudomonas aeruginosa PA01
aggaccugcugcccg

SEQ ID NO: 1558764 - RNA, 18 nt, Pseudomonas aeruginosa PA01
aggaccugcugcccggca

SEQ ID NO: 1558765 - RNA, 18 nt, Pseudomonas aeruginosa PA01
aggaaucgaacccccgac

SEQ ID NO: 1558766 - RNA, 18 nt, Pseudomonas aeruginosa PA01
aggaccgacggcaacuga

SEQ ID NO: 1558767 - RNA, 16 nt, Pseudomonas aeruginosa PA01
aggaccaucggcacca

SEQ ID NO: 1558768 - RNA, 21 nt, Pseudomonas aeruginosa PA01
aggaccaggaucgaccccgcc

SEQ ID NO: 1558769 - RNA, 16 nt, Pseudomonas aeruginosa PA01
aggaaguugcgcagca

SEQ ID NO: 1558770 - RNA, 13 nt, Pseudomonas aeruginosa PA01
aggaaacccaugc

SEQ ID NO: 1558771 - RNA, 15 nt, Pseudomonas aeruginosa PA01
aggaaaaagcccgcg

SEQ ID NO: 1558772 - RNA, 16 nt, Pseudomonas aeruginosa PA01
aggaaaaggauuuccg

SEQ ID NO: 1558773 - RNA, 21 nt, Pseudomonas aeruginosa PA01
aggacgucguagccaggcacc

SEQ ID NO: 1558774 - RNA, 19 nt, Pseudomonas aeruginosa PA01
aggaggcccacgggcggcc

SEQ ID NO: 1558775 - RNA, 15 nt, Pseudomonas aeruginosa PA01
aggagggcugcuguc

SEQ ID NO: 1558776 - RNA, 20 nt, Pseudomonas aeruginosa PA01
aggaggaucucgcgccccgg

SEQ ID NO: 1558777 - RNA, 15 nt, Pseudomonas aeruginosa PA01
aggagucgacgaaaa

SEQ ID NO: 1558778 - RNA, 15 nt, Pseudomonas aeruginosa PA01
aggagguuggucugc

SEQ ID NO: 1558779 - RNA, 18 nt, Pseudomonas aeruginosa PA01
aggauacgcucaggaaga

SEQ ID NO: 1558780 - RNA, 16 nt, Pseudomonas aeruginosa PA01
aggauagcguccagcu

SEQ ID NO: 1558781 - RNA, 15 nt, Pseudomonas aeruginosa PA01
aggaugaccaggcug

SEQ ID NO: 1558782 - RNA, 16 nt, Pseudomonas aeruginosa PA01
aggaucggcauggcca

SEQ ID NO: 1558783 - RNA, 18 nt, Pseudomonas aeruginosa PA01
aggaucggcgcggucggg

SEQ ID NO: 1558784 - RNA, 15 nt, Pseudomonas aeruginosa PA01
aggaucgcgcuggcc

SEQ ID NO: 1558785 - RNA, 19 nt, Pseudomonas aeruginosa PA01
aggaucgccgcgaccugcu

SEQ ID NO: 1558786 - RNA, 16 nt, Pseudomonas aeruginosa PA01
aggaucgcucccaggc

SEQ ID NO: 1558787 - RNA, 21 nt, Pseudomonas aeruginosa PA01
aggaucggagagacccgccag

SEQ ID NO: 1558788 - RNA, 16 nt, Pseudomonas aeruginosa PA01
aggaucgacagcagcg

SEQ ID NO: 1558789 - RNA, 14 nt, Pseudomonas aeruginosa PA01
aggaucgagccagc

SEQ ID NO: 1558790 - RNA, 18 nt, Pseudomonas aeruginosa PA01
aggaucagccacgggcgc

SEQ ID NO: 1558791 - RNA, 14 nt, Pseudomonas aeruginosa PA01
aggaucacgcagca

SEQ ID NO: 1558792 - RNA, 20 nt, Pseudomonas aeruginosa PA01
aggccgcucaccgccacccc

SEQ ID NO: 1558793 - RNA, 17 nt, Pseudomonas aeruginosa PA01
aggccgcggagcaccgc

SEQ ID NO: 1558794 - RNA, 18 nt, Pseudomonas aeruginosa PA01
aggccgcgcagcaacggc

SEQ ID NO: 1558795 - RNA, 20 nt, Pseudomonas aeruginosa PA01
aggccgcgcagcaacggcgc

SEQ ID NO: 1558796 - RNA, 19 nt, Pseudomonas aeruginosa PA01
aggccgccggcggccaggg

SEQ ID NO: 1558797 - RNA, 15 nt, Pseudomonas aeruginosa PA01
aggccgaacucacgg

SEQ ID NO: 1558798 - RNA, 17 nt, Pseudomonas aeruginosa PA01
aggccgaaggccaggac

SEQ ID NO: 1558799 - RNA, 21 nt, Pseudomonas aeruginosa PA01
aggccgcccuugaccccaccg

SEQ ID NO: 1558800 - RNA, 15 nt, Pseudomonas aeruginosa PA01
aggccgccgcgucga

SEQ ID NO: 1558801 - RNA, 16 nt, Pseudomonas aeruginosa PA01
aggcccucggcgacca

SEQ ID NO: 1558802 - RNA, 16 nt, Pseudomonas aeruginosa PA01
aggcccucggcgccga

SEQ ID NO: 1558803 - RNA, 16 nt, Pseudomonas aeruginosa PA01
aggcccuugaggaagu

SEQ ID NO: 1558804 - RNA, 18 nt, Pseudomonas aeruginosa PA01
aggcccuacaaugauggc

SEQ ID NO: 1558805 - RNA, 19 nt, Pseudomonas aeruginosa PA01
aggcccggagugugucggg

SEQ ID NO: 1558806 - RNA, 22 nt, Pseudomonas aeruginosa PA01
aggcccggcgcugcuucuuguc

SEQ ID NO: 1558807 - RNA, 23 nt, Pseudomonas aeruginosa PA01
aggcccggcgcugcuucuugucg

SEQ ID NO: 1558808 - RNA, 18 nt, Pseudomonas aeruginosa PA01
aggccagcuugucggccu

SEQ ID NO: 1558809 - RNA, 22 nt, Pseudomonas aeruginosa PA01
aggccaggaucgucggcccgca

SEQ ID NO: 1558810 - RNA, 18 nt, Pseudomonas aeruginosa PA01
aggccagcggcauccgcc

SEQ ID NO: 1558811 - RNA, 22 nt, Pseudomonas aeruginosa PA01
aggccagccaacugcuucaggc

SEQ ID NO: 1558812 - RNA, 19 nt, Pseudomonas aeruginosa PA01
aggccauucuucuccagaa

SEQ ID NO: 1558813 - RNA, 20 nt, Pseudomonas aeruginosa PA01
aggccaggcagaccagcgca

SEQ ID NO: 1558814 - RNA, 17 nt, Pseudomonas aeruginosa PA01
aggccaggccggcgccu

SEQ ID NO: 1558815 - RNA, 16 nt, Pseudomonas aeruginosa PA01
aggccagggcauugac

SEQ ID NO: 1558816 - RNA, 17 nt, Pseudomonas aeruginosa PA01
aggccagggcggcgccg

SEQ ID NO: 1558817 - RNA, 20 nt, Pseudomonas aeruginosa PA01
aggcaguccuugagcgccag

SEQ ID NO: 1558818 - RNA, 16 nt, Pseudomonas aeruginosa PA01
aggcauccagcaccgc

SEQ ID NO: 1558819 - RNA, 17 nt, Pseudomonas aeruginosa PA01
aggcauccagcaccgcu

SEQ ID NO: 1558820 - RNA, 17 nt, Pseudomonas aeruginosa PA01
aggcagcgaucgccgcc

SEQ ID NO: 1558821 - RNA, 17 nt, Pseudomonas aeruginosa PA01
aggcagcgccgcccaca

SEQ ID NO: 1558822 - RNA, 14 nt, Pseudomonas aeruginosa PA01
aggcaggccgggcu

SEQ ID NO: 1558823 - RNA, 19 nt, Pseudomonas aeruginosa PA01
aggcaggccgggcuggcca

SEQ ID NO: 1558824 - RNA, 23 nt, Pseudomonas aeruginosa PA01
aggcaggccugggcaagcugcac

SEQ ID NO: 1558825 - RNA, 14 nt, Pseudomonas aeruginosa PA01
aggcagugccgggc

SEQ ID NO: 1558826 - RNA, 15 nt, Pseudomonas aeruginosa PA01
aggcagugccgggcg

SEQ ID NO: 1558827 - RNA, 19 nt, Pseudomonas aeruginosa PA01
aggcaguggcgccagccag

SEQ ID NO: 1558828 - RNA, 16 nt, Pseudomonas aeruginosa PA01
aggcaggcauggugga

SEQ ID NO: 1558829 - RNA, 16 nt, Pseudomonas aeruginosa PA01
aggcagaucgcgccga

SEQ ID NO: 1558830 - RNA, 15 nt, Pseudomonas aeruginosa PA01
aggaugccggccucg

SEQ ID NO: 1558831 - RNA, 15 nt, Pseudomonas aeruginosa PA01
aggaugcgaugcugu

SEQ ID NO: 1558832 - RNA, 22 nt, Pseudomonas aeruginosa PA01
aggaugcgaugcugucagcgcc

SEQ ID NO: 1558833 - RNA, 21 nt, Pseudomonas aeruginosa PA01
aggaugcgccagcggcccggc

SEQ ID NO: 1558834 - RNA, 17 nt, Pseudomonas aeruginosa PA01
aggaugccgagguguag

SEQ ID NO: 1558835 - RNA, 16 nt, Pseudomonas aeruginosa PA01
aggaugaugacgaggg

SEQ ID NO: 1558836 - RNA, 21 nt, Pseudomonas aeruginosa PA01
aggauggacagcuuggccagc

SEQ ID NO: 1558837 - RNA, 15 nt, Pseudomonas aeruginosa PA01
aggauguccuuguuc

SEQ ID NO: 1558838 - RNA, 22 nt, Pseudomonas aeruginosa PA01
aggauguugacgauggcccaga

SEQ ID NO: 1558839 - RNA, 23 nt, Pseudomonas aeruginosa PA01
aggcugcaucggcucggcaagcg

SEQ ID NO: 1558840 - RNA, 13 nt, Pseudomonas aeruginosa PA01
aggcugaggccga

SEQ ID NO: 1558841 - RNA, 15 nt, Pseudomonas aeruginosa PA01
aggcugaucuugccg

SEQ ID NO: 1558842 - RNA, 23 nt, Pseudomonas aeruginosa PA01
aggcugcgcaccucggccaggcg

SEQ ID NO: 1558843 - RNA, 22 nt, Pseudomonas aeruginosa PA01
aggcugcggcggaaggcggcgu

SEQ ID NO: 1558844 - RNA, 17 nt, Pseudomonas aeruginosa PA01
aggcugcgcuccaggcg

SEQ ID NO: 1558845 - RNA, 14 nt, Pseudomonas aeruginosa PA01
aggcugccuucgac

SEQ ID NO: 1558846 - RNA, 21 nt, Pseudomonas aeruginosa PA01
aggcugccgccuucgcgggcc

SEQ ID NO: 1558847 - RNA, 17 nt, Pseudomonas aeruginosa PA01
aggcugccguugcggcc

SEQ ID NO: 1558848 - RNA, 16 nt, Pseudomonas aeruginosa PA01
aggcugccggccaggu

SEQ ID NO: 1558849 - RNA, 16 nt, Pseudomonas aeruginosa PA01
aggcugucagggcgca

SEQ ID NO: 1558850 - RNA, 21 nt, Pseudomonas aeruginosa PA01
aggcugggccgaaccggggcg

SEQ ID NO: 1558851 - RNA, 22 nt, Pseudomonas aeruginosa PA01
aggcugguggucaccgccagcg

SEQ ID NO: 1558852 - RNA, 15 nt, Pseudomonas aeruginosa PA01
aggcuguacagcagg

SEQ ID NO: 1558853 - RNA, 15 nt, Pseudomonas aeruginosa PA01
aggcuguagccggcg

SEQ ID NO: 1558854 - RNA, 22 nt, Pseudomonas aeruginosa PA01
aggcuguagccucccgccgcgg

SEQ ID NO: 1558855 - RNA, 19 nt, Pseudomonas aeruginosa PA01
aggcugcuucggcagccuu

SEQ ID NO: 1558856 - RNA, 15 nt, Pseudomonas aeruginosa PA01
aggcuggagcgcugc

SEQ ID NO: 1558857 - RNA, 22 nt, Pseudomonas aeruginosa PA01
aggcuggcggcauaggcccggc

SEQ ID NO: 1558858 - RNA, 19 nt, Pseudomonas aeruginosa PA01
aggcuggcggccagggcau

SEQ ID NO: 1558859 - RNA, 23 nt, Pseudomonas aeruginosa PA01
aggcuggccucguugaucggcaa

SEQ ID NO: 1558860 - RNA, 17 nt, Pseudomonas aeruginosa PA01
aggcucaugcccagcuu

SEQ ID NO: 1558861 - RNA, 21 nt, Pseudomonas aeruginosa PA01
aggcucacgcaucccuucgag

SEQ ID NO: 1558862 - RNA, 17 nt, Pseudomonas aeruginosa PA01
aggcucuugggcucugc

SEQ ID NO: 1558863 - RNA, 19 nt, Pseudomonas aeruginosa PA01
aggcucuugggcucugccu

SEQ ID NO: 1558864 - RNA, 17 nt, Pseudomonas aeruginosa PA01
aggcucucgcgcagcag

SEQ ID NO: 1558865 - RNA, 19 nt, Pseudomonas aeruginosa PA01
aggcucgccccggcggcga

SEQ ID NO: 1558866 - RNA, 16 nt, Pseudomonas aeruginosa PA01
aggcucgccgccagca

SEQ ID NO: 1558867 - RNA, 23 nt, Pseudomonas aeruginosa PA01
aggcucgccggguuguccaggcg

SEQ ID NO: 1558868 - RNA, 21 nt, Pseudomonas aeruginosa PA01
aggcggccgaauccuccagcc

SEQ ID NO: 1558869 - RNA, 18 nt, Pseudomonas aeruginosa PA01
aggcggccguagccgucg

SEQ ID NO: 1558870 - RNA, 20 nt, Pseudomonas aeruginosa PA01
aggcggcggaagaagcccuu

SEQ ID NO: 1558871 - RNA, 17 nt, Pseudomonas aeruginosa PA01
aggccggcggccgaggc

SEQ ID NO: 1558872 - RNA, 13 nt, Pseudomonas aeruginosa PA01
aggccggcgccuu

SEQ ID NO: 1558873 - RNA, 13 nt, Pseudomonas aeruginosa PA01
aggccggccucca

SEQ ID NO: 1558874 - RNA, 14 nt, Pseudomonas aeruginosa PA01
aggccggccaggga

SEQ ID NO: 1558875 - RNA, 19 nt, Pseudomonas aeruginosa PA01
aggcggucaugcgcccuac

SEQ ID NO: 1558876 - RNA, 15 nt, Pseudomonas aeruginosa PA01
aggcgguccagccag

SEQ ID NO: 1558877 - RNA, 16 nt, Pseudomonas aeruginosa PA01
aggcggucggaaagca

SEQ ID NO: 1558878 - RNA, 13 nt, Pseudomonas aeruginosa PA01
aggcgggccagca

SEQ ID NO: 1558879 - RNA, 17 nt, Pseudomonas aeruginosa PA01
aggcgggccagcagggu

SEQ ID NO: 1558880 - RNA, 14 nt, Pseudomonas aeruginosa PA01
aggcgggcuuugaa

SEQ ID NO: 1558881 - RNA, 20 nt, Pseudomonas aeruginosa PA01
aggcgucccuggagcagggc

SEQ ID NO: 1558882 - RNA, 21 nt, Pseudomonas aeruginosa PA01
aggcgucccuggagcagggcg

SEQ ID NO: 1558883 - RNA, 21 nt, Pseudomonas aeruginosa PA01
aggcggucuuuuugcagggaa

SEQ ID NO: 1558884 - RNA, 19 nt, Pseudomonas aeruginosa PA01
aggcggugcagcggaagcc

SEQ ID NO: 1558885 - RNA, 17 nt, Pseudomonas aeruginosa PA01
aggcgguuggcccgcgc

SEQ ID NO: 1558886 - RNA, 15 nt, Pseudomonas aeruginosa PA01
aggcggucggccauc

SEQ ID NO: 1558887 - RNA, 13 nt, Pseudomonas aeruginosa PA01
aggcguugccgga

SEQ ID NO: 1558888 - RNA, 15 nt, Pseudomonas aeruginosa PA01
aggcuaacgccgagg

SEQ ID NO: 1558889 - RNA, 15 nt, Pseudomonas aeruginosa PA01
aggcguuauccgccg

SEQ ID NO: 1558890 - RNA, 23 nt, Pseudomonas aeruginosa PA01
aggcgugggcgccggcgcgcagg

SEQ ID NO: 1558891 - RNA, 20 nt, Pseudomonas aeruginosa PA01
aggcgugcugcacggagugg

SEQ ID NO: 1558892 - RNA, 21 nt, Pseudomonas aeruginosa PA01
aggcguucaugaaagccagca

SEQ ID NO: 1558893 - RNA, 23 nt, Pseudomonas aeruginosa PA01
aggcgugcaguacuuggccagca

SEQ ID NO: 1558894 - RNA, 20 nt, Pseudomonas aeruginosa PA01
aggcgucguuguugcgggcg

SEQ ID NO: 1558895 - RNA, 17 nt, Pseudomonas aeruginosa PA01
aggcgugccuguuccuc

SEQ ID NO: 1558896 - RNA, 21 nt, Pseudomonas aeruginosa PA01
aggcgugccuguuccuccgcc

SEQ ID NO: 1558897 - RNA, 16 nt, Pseudomonas aeruginosa PA01
aggcgucgaaggccuc

SEQ ID NO: 1558898 - RNA, 14 nt, Pseudomonas aeruginosa PA01
aggcguccuggcga

SEQ ID NO: 1558899 - RNA, 16 nt, Pseudomonas aeruginosa PA01
aggcgucgcgccagca

SEQ ID NO: 1558900 - RNA, 15 nt, Pseudomonas aeruginosa PA01
aggcgucauccgcca

SEQ ID NO: 1558901 - RNA, 21 nt, Pseudomonas aeruginosa PA01
aggcgucgaucccgaucgcca

SEQ ID NO: 1558902 - RNA, 16 nt, Pseudomonas aeruginosa PA01
aggcgucguccucgaa

SEQ ID NO: 1558903 - RNA, 22 nt, Pseudomonas aeruginosa PA01
agggcuugcgcgccaccagcgu

SEQ ID NO: 1558904 - RNA, 23 nt, Pseudomonas aeruginosa PA01
agggcuugcgcgccaccagcgug

SEQ ID NO: 1558905 - RNA, 22 nt, Pseudomonas aeruginosa PA01
agggcggauagcgcgcaggcgc

SEQ ID NO: 1558906 - RNA, 18 nt, Pseudomonas aeruginosa PA01
agggcuugugcagagagg

SEQ ID NO: 1558907 - RNA, 15 nt, Pseudomonas aeruginosa PA01
aggggaccaccccgg

SEQ ID NO: 1558908 - RNA, 23 nt, Pseudomonas aeruginosa PA01
aggggaacauugccaccaccaug

SEQ ID NO: 1558909 - RNA, 13 nt, Pseudomonas aeruginosa PA01
agggcgcgccccg

SEQ ID NO: 1558910 - RNA, 21 nt, Pseudomonas aeruginosa PA01
agggcgcgccccgucccuacc

SEQ ID NO: 1558911 - RNA, 19 nt, Pseudomonas aeruginosa PA01
agggcgccgaccagcuuca

SEQ ID NO: 1558912 - RNA, 17 nt, Pseudomonas aeruginosa PA01
agggcgccgaucaggcg

SEQ ID NO: 1558913 - RNA, 12 nt, Pseudomonas aeruginosa PA01
agggcgccgucg

SEQ ID NO: 1558914 - RNA, 13 nt, Pseudomonas aeruginosa PA01
agggcgccgccga

SEQ ID NO: 1558915 - RNA, 21 nt, Pseudomonas aeruginosa PA01
agggcgccgccgacgccaugg

SEQ ID NO: 1558916 - RNA, 23 nt, Pseudomonas aeruginosa PA01
agggcgccgccgacgccaugggu

SEQ ID NO: 1558917 - RNA, 16 nt, Pseudomonas aeruginosa PA01
aggguuuccagcagca

SEQ ID NO: 1558918 - RNA, 17 nt, Pseudomonas aeruginosa PA01
aggguuggccgcagcag

SEQ ID NO: 1558919 - RNA, 19 nt, Pseudomonas aeruginosa PA01
aggguuggccgcagcagcg

SEQ ID NO: 1558920 - RNA, 13 nt, Pseudomonas aeruginosa PA01
agggucuccagga

SEQ ID NO: 1558921 - RNA, 14 nt, Pseudomonas aeruginosa PA01
agggucuccaggac

SEQ ID NO: 1558922 - RNA, 12 nt, Pseudomonas aeruginosa PA01
agggucugcucg

SEQ ID NO: 1558923 - RNA, 13 nt, Pseudomonas aeruginosa PA01
agggucugcucga

SEQ ID NO: 1558924 - RNA, 13 nt, Pseudomonas aeruginosa PA01
agggucggcagga

SEQ ID NO: 1558925 - RNA, 17 nt, Pseudomonas aeruginosa PA01
agggucgcgagcagggc

SEQ ID NO: 1558926 - RNA, 16 nt, Pseudomonas aeruginosa PA01
agggucuucaggcgcc

SEQ ID NO: 1558927 - RNA, 21 nt, Pseudomonas aeruginosa PA01
agggucuucaggcgugggcca

SEQ ID NO: 1558928 - RNA, 17 nt, Pseudomonas aeruginosa PA01
aggguauuuuccagcag

SEQ ID NO: 1558929 - RNA, 18 nt, Pseudomonas aeruginosa PA01
aggguauuuuccagcagg

SEQ ID NO: 1558930 - RNA, 17 nt, Pseudomonas aeruginosa PA01
agggucacgccgcggcu

SEQ ID NO: 1558931 - RNA, 17 nt, Pseudomonas aeruginosa PA01
aggggucgacgcagggc

SEQ ID NO: 1558932 - RNA, 16 nt, Pseudomonas aeruginosa PA01
aggguccaguucaggg

SEQ ID NO: 1558933 - RNA, 16 nt, Pseudomonas aeruginosa PA01
agggucagcaggcugc

SEQ ID NO: 1558934 - RNA, 20 nt, Pseudomonas aeruginosa PA01
agggucagccgcaggccguu

SEQ ID NO: 1558935 - RNA, 21 nt, Pseudomonas aeruginosa PA01
agggucagccgcaggccguuu

SEQ ID NO: 1558936 - RNA, 19 nt, Pseudomonas aeruginosa PA01
agggucaggccgagggcug

SEQ ID NO: 1558937 - RNA, 13 nt, Pseudomonas aeruginosa PA01
agggucaggccuu

SEQ ID NO: 1558938 - RNA, 19 nt, Pseudomonas aeruginosa PA01
agggucagucgagcaguuc

SEQ ID NO: 1558939 - RNA, 17 nt, Pseudomonas aeruginosa PA01
aggcugugcgccaggcc

SEQ ID NO: 1558940 - RNA, 13 nt, Pseudomonas aeruginosa PA01
aggcugugggucg

SEQ ID NO: 1558941 - RNA, 21 nt, Pseudomonas aeruginosa PA01
aggcuguugcccugggccggc

SEQ ID NO: 1558942 - RNA, 23 nt, Pseudomonas aeruginosa PA01
agggaucgucgccaagcccggcg

SEQ ID NO: 1558943 - RNA, 14 nt, Pseudomonas aeruginosa PA01
agggauaccaacuu

SEQ ID NO: 1558944 - RNA, 15 nt, Pseudomonas aeruginosa PA01
agggauacucaugca

SEQ ID NO: 1558945 - RNA, 18 nt, Pseudomonas aeruginosa PA01
agggauacucaugcaggc

SEQ ID NO: 1558946 - RNA, 20 nt, Pseudomonas aeruginosa PA01
aggcuucgagcacuucccag

SEQ ID NO: 1558947 - RNA, 23 nt, Pseudomonas aeruginosa PA01
aggcuucgaugcuuagcccggga

SEQ ID NO: 1558948 - RNA, 17 nt, Pseudomonas aeruginosa PA01
agggcgaccgccaggcg

SEQ ID NO: 1558949 - RNA, 14 nt, Pseudomonas aeruginosa PA01
agggcgacuaccag

SEQ ID NO: 1558950 - RNA, 16 nt, Pseudomonas aeruginosa PA01
agggcgacuaccaggu

SEQ ID NO: 1558951 - RNA, 14 nt, Pseudomonas aeruginosa PA01
agggcgagcagggc

SEQ ID NO: 1558952 - RNA, 15 nt, Pseudomonas aeruginosa PA01
agggcgagcagggca

SEQ ID NO: 1558953 - RNA, 18 nt, Pseudomonas aeruginosa PA01
agggcgagcagggcacag

SEQ ID NO: 1558954 - RNA, 16 nt, Pseudomonas aeruginosa PA01
agggcgaaggccacca

SEQ ID NO: 1558955 - RNA, 20 nt, Pseudomonas aeruginosa PA01
agggcgaauaacgccacagg

SEQ ID NO: 1558956 - RNA, 22 nt, Pseudomonas aeruginosa PA01
agggcgaauaacgccacaggcg

SEQ ID NO: 1558957 - RNA, 17 nt, Pseudomonas aeruginosa PA01
agggcgaauaccagugc

SEQ ID NO: 1558958 - RNA, 18 nt, Pseudomonas aeruginosa PA01
agggcgaauagcgccgca

SEQ ID NO: 1558959 - RNA, 23 nt, Pseudomonas aeruginosa PA01
agggcgaauagcgccgcaggcgc

SEQ ID NO: 1558960 - RNA, 18 nt, Pseudomonas aeruginosa PA01
agggcgaauagcgccgcg

SEQ ID NO: 1558961 - RNA, 14 nt, Pseudomonas aeruginosa PA01
agggccggcgcccu

SEQ ID NO: 1558962 - RNA, 19 nt, Pseudomonas aeruginosa PA01
agggccucuucgcaacggc

SEQ ID NO: 1558963 - RNA, 20 nt, Pseudomonas aeruginosa PA01
agggcgaacagcagcgguag

SEQ ID NO: 1558964 - RNA, 17 nt, Pseudomonas aeruginosa PA01
agggccuugccgcgacc

SEQ ID NO: 1558965 - RNA, 14 nt, Pseudomonas aeruginosa PA01
agggccugcucagc

SEQ ID NO: 1558966 - RNA, 21 nt, Pseudomonas aeruginosa PA01
agggcauauucauagccguug

SEQ ID NO: 1558967 - RNA, 21 nt, Pseudomonas aeruginosa PA01
agggcaguacguggcgcuuga

SEQ ID NO: 1558968 - RNA, 19 nt, Pseudomonas aeruginosa PA01
agggcaucgccgacagguc

SEQ ID NO: 1558969 - RNA, 14 nt, Pseudomonas aeruginosa PA01
agggcaucagcccc

SEQ ID NO: 1558970 - RNA, 21 nt, Pseudomonas aeruginosa PA01
agggcaucagccccucggcca

SEQ ID NO: 1558971 - RNA, 17 nt, Pseudomonas aeruginosa PA01
agggcauguuggcgccu

SEQ ID NO: 1558972 - RNA, 12 nt, Pseudomonas aeruginosa PA01
agggcaggaacc

SEQ ID NO: 1558973 - RNA, 23 nt, Pseudomonas aeruginosa PA01
agggcagcaggucgcgcaguucg

SEQ ID NO: 1558974 - RNA, 18 nt, Pseudomonas aeruginosa PA01
agggaugccgccggcauc

SEQ ID NO: 1558975 - RNA, 21 nt, Pseudomonas aeruginosa PA01
agggaugccggcggcaucccu

SEQ ID NO: 1558976 - RNA, 22 nt, Pseudomonas aeruginosa PA01
agggcacuucguccaggccgcc

SEQ ID NO: 1558977 - RNA, 13 nt, Pseudomonas aeruginosa PA01
agggauuccuugg

SEQ ID NO: 1558978 - RNA, 22 nt, Pseudomonas aeruginosa PA01
agguugaccccgcggccgagga

SEQ ID NO: 1558979 - RNA, 16 nt, Pseudomonas aeruginosa PA01
agguucaggccgggca

SEQ ID NO: 1558980 - RNA, 20 nt, Pseudomonas aeruginosa PA01
agguucaucgccgccaggca

SEQ ID NO: 1558981 - RNA, 13 nt, Pseudomonas aeruginosa PA01
aguaacuuauuga

SEQ ID NO: 1558982 - RNA, 15 nt, Pseudomonas aeruginosa PA01
aguaaaugcuugaaa

SEQ ID NO: 1558983 - RNA, 21 nt, Pseudomonas aeruginosa PA01
aguaaaugcuugaaaaucaag

SEQ ID NO: 1558984 - RNA, 14 nt, Pseudomonas aeruginosa PA01
aguaccgcugcggc

SEQ ID NO: 1558985 - RNA, 18 nt, Pseudomonas aeruginosa PA01
aguaccgcugcggccggc

SEQ ID NO: 1558986 - RNA, 19 nt, Pseudomonas aeruginosa PA01
aguaccggcagcgccgagg

SEQ ID NO: 1558987 - RNA, 21 nt, Pseudomonas aeruginosa PA01
aguacgaucagccagggcaac

SEQ ID NO: 1558988 - RNA, 22 nt, Pseudomonas aeruginosa PA01
aguaccucgaagcccagcgccu

SEQ ID NO: 1558989 - RNA, 22 nt, Pseudomonas aeruginosa PA01
aguaccuggcgguacagccccc

SEQ ID NO: 1558990 - RNA, 16 nt, Pseudomonas aeruginosa PA01
agguggucgaccaggc

SEQ ID NO: 1558991 - RNA, 21 nt, Pseudomonas aeruginosa PA01
agguggucgaugggcgagcga

SEQ ID NO: 1558992 - RNA, 20 nt, Pseudomonas aeruginosa PA01
aggugcgguugaaacugcgc

SEQ ID NO: 1558993 - RNA, 22 nt, Pseudomonas aeruginosa PA01
aggugcguacuuggcccggcgu

SEQ ID NO: 1558994 - RNA, 19 nt, Pseudomonas aeruginosa PA01
agguggcgcacugccagga

SEQ ID NO: 1558995 - RNA, 17 nt, Pseudomonas aeruginosa PA01
agguggcgcagccgucc

SEQ ID NO: 1558996 - RNA, 22 nt, Pseudomonas aeruginosa PA01
aggugagcgacccgcugaagga

SEQ ID NO: 1558997 - RNA, 19 nt, Pseudomonas aeruginosa PA01
aggugcgcuggcgccagua

SEQ ID NO: 1558998 - RNA, 20 nt, Pseudomonas aeruginosa PA01
aggugcgcggcaggacccag

SEQ ID NO: 1558999 - RNA, 19 nt, Pseudomonas aeruginosa PA01
agguguucguccagaugcu

SEQ ID NO: 1559000 - RNA, 12 nt, Pseudomonas aeruginosa PA01
aggucacuuccu

SEQ ID NO: 1559001 - RNA, 21 nt, Pseudomonas aeruginosa PA01
aggucagcgguaugccgcagg

SEQ ID NO: 1559002 - RNA, 22 nt, Pseudomonas aeruginosa PA01
aggucagcgguaugccgcaggc

SEQ ID NO: 1559003 - RNA, 19 nt, Pseudomonas aeruginosa PA01
aggucaccgaaaggcucuu

SEQ ID NO: 1559004 - RNA, 13 nt, Pseudomonas aeruginosa PA01
aggucaccgcgcc

SEQ ID NO: 1559005 - RNA, 13 nt, Pseudomonas aeruginosa PA01
aggucgagggcau

SEQ ID NO: 1559006 - RNA, 16 nt, Pseudomonas aeruginosa PA01
aggucgacgccgccga

SEQ ID NO: 1559007 - RNA, 19 nt, Pseudomonas aeruginosa PA01
aggucgacgaacaggaagc

SEQ ID NO: 1559008 - RNA, 14 nt, Pseudomonas aeruginosa PA01
aggucucgccgccg

SEQ ID NO: 1559009 - RNA, 17 nt, Pseudomonas aeruginosa PA01
aggucgaucagcagcag

SEQ ID NO: 1559010 - RNA, 21 nt, Pseudomonas aeruginosa PA01
aggucgauccugaccccggcc

SEQ ID NO: 1559011 - RNA, 19 nt, Pseudomonas aeruginosa PA01
aggucgaacagcggcuggc

SEQ ID NO: 1559012 - RNA, 20 nt, Pseudomonas aeruginosa PA01
aggucugcgguauaggccuu

SEQ ID NO: 1559013 - RNA, 16 nt, Pseudomonas aeruginosa PA01
aggucugccccggcuu

SEQ ID NO: 1559014 - RNA, 20 nt, Pseudomonas aeruginosa PA01
aggucugcccguggcgcgga

SEQ ID NO: 1559015 - RNA, 15 nt, Pseudomonas aeruginosa PA01
aguacuccgagggcc

SEQ ID NO: 1559016 - RNA, 15 nt, Pseudomonas aeruginosa PA01
aguacuuggccagca

SEQ ID NO: 1559017 - RNA, 16 nt, Pseudomonas aeruginosa PA01
aguacuuggccagcag

SEQ ID NO: 1559018 - RNA, 18 nt, Pseudomonas aeruginosa PA01
aguacuuggccagcagca

SEQ ID NO: 1559019 - RNA, 21 nt, Pseudomonas aeruginosa PA01
aguccagggcgguuaccaggu

SEQ ID NO: 1559020 - RNA, 18 nt, Pseudomonas aeruginosa PA01
aguccagguacaccaggg

SEQ ID NO: 1559021 - RNA, 15 nt, Pseudomonas aeruginosa PA01
aguccagccagugca

SEQ ID NO: 1559022 - RNA, 16 nt, Pseudomonas aeruginosa PA01
aguccacugucucgcc

SEQ ID NO: 1559023 - RNA, 14 nt, Pseudomonas aeruginosa PA01
agucagguccuugu

SEQ ID NO: 1559024 - RNA, 23 nt, Pseudomonas aeruginosa PA01
agucagguccuuguuccugggcg

SEQ ID NO: 1559025 - RNA, 15 nt, Pseudomonas aeruginosa PA01
agucaggaucggcgc

SEQ ID NO: 1559026 - RNA, 19 nt, Pseudomonas aeruginosa PA01
agucaggaucggcgcccag

SEQ ID NO: 1559027 - RNA, 17 nt, Pseudomonas aeruginosa PA01
agucaggcgccggccuc

SEQ ID NO: 1559028 - RNA, 19 nt, Pseudomonas aeruginosa PA01
agucuucucgguggugaca

SEQ ID NO: 1559029 - RNA, 11 nt, Pseudomonas aeruginosa PA01
agucuuccugc

SEQ ID NO: 1559030 - RNA, 15 nt, Pseudomonas aeruginosa PA01
agugaccgcgcgcca

SEQ ID NO: 1559031 - RNA, 19 nt, Pseudomonas aeruginosa PA01
agugacauccucccugccc

SEQ ID NO: 1559032 - RNA, 13 nt, Pseudomonas aeruginosa PA01
agucguugaagac

SEQ ID NO: 1559033 - RNA, 17 nt, Pseudomonas aeruginosa PA01
agucgccguucagguuc

SEQ ID NO: 1559034 - RNA, 22 nt, Pseudomonas aeruginosa PA01
agucgccguucagguucagggu

SEQ ID NO: 1559035 - RNA, 15 nt, Pseudomonas aeruginosa PA01
agucgccggucagag

SEQ ID NO: 1559036 - RNA, 22 nt, Pseudomonas aeruginosa PA01
agucgcccccaccgcccccgca

SEQ ID NO: 1559037 - RNA, 19 nt, Pseudomonas aeruginosa PA01
agucccguccgcugcgcca

SEQ ID NO: 1559038 - RNA, 23 nt, Pseudomonas aeruginosa PA01
aguccccuaggggacgccacuuc

SEQ ID NO: 1559039 - RNA, 18 nt, Pseudomonas aeruginosa PA01
agucccauugcaucugcg

SEQ ID NO: 1559040 - RNA, 15 nt, Pseudomonas aeruginosa PA01
agucgaacaggcccu

SEQ ID NO: 1559041 - RNA, 16 nt, Pseudomonas aeruginosa PA01
agucgaacaggcccuu

SEQ ID NO: 1559042 - RNA, 12 nt, Pseudomonas aeruginosa PA01
aguccugcugcg

SEQ ID NO: 1559043 - RNA, 16 nt, Pseudomonas aeruginosa PA01
aguggguaggccaggc

SEQ ID NO: 1559044 - RNA, 17 nt, Pseudomonas aeruginosa PA01
aguguuugcgcagggcg

SEQ ID NO: 1559045 - RNA, 20 nt, Pseudomonas aeruginosa PA01
aguugcuuggcgcgcuggca

SEQ ID NO: 1559046 - RNA, 16 nt, Pseudomonas aeruginosa PA01
aguugaggcagguggc

SEQ ID NO: 1559047 - RNA, 19 nt, Pseudomonas aeruginosa PA01
aguugagccccagguaggc

SEQ ID NO: 1559048 - RNA, 16 nt, Pseudomonas aeruginosa PA01
aguugagcugugguug

SEQ ID NO: 1559049 - RNA, 20 nt, Pseudomonas aeruginosa PA01
aguugcgcuccgguggcgga

SEQ ID NO: 1559050 - RNA, 16 nt, Pseudomonas aeruginosa PA01
aguucgcugccgccgc

SEQ ID NO: 1559051 - RNA, 16 nt, Pseudomonas aeruginosa PA01
aguucgcgcggagugc

SEQ ID NO: 1559052 - RNA, 23 nt, Pseudomonas aeruginosa PA01
aguucgccgccgagcgccuggca

SEQ ID NO: 1559053 - RNA, 19 nt, Pseudomonas aeruginosa PA01
aguucgccguucagcuccc

SEQ ID NO: 1559054 - RNA, 19 nt, Pseudomonas aeruginosa PA01
aguucgccaaaaaaagccc

SEQ ID NO: 1559055 - RNA, 16 nt, Pseudomonas aeruginosa PA01
aguucgccacugaacu

SEQ ID NO: 1559056 - RNA, 20 nt, Pseudomonas aeruginosa PA01
aguucgcccagcucgccgcu

SEQ ID NO: 1559057 - RNA, 18 nt, Pseudomonas aeruginosa PA01
aguucgaagcgccaggcg

SEQ ID NO: 1559058 - RNA, 19 nt, Pseudomonas aeruginosa PA01
aguucaucgagcagguagc

SEQ ID NO: 1559059 - RNA, 17 nt, Pseudomonas aeruginosa PA01
aguuccucgccgcugcu

SEQ ID NO: 1559060 - RNA, 22 nt, Pseudomonas aeruginosa PA01
aguucagccgguacugcgccag

SEQ ID NO: 1559061 - RNA, 14 nt, Pseudomonas aeruginosa PA01
aguucagggccacg

SEQ ID NO: 1559062 - RNA, 23 nt, Pseudomonas aeruginosa PA01
auaagcucggcuugacuggcagu

SEQ ID NO: 1559063 - RNA, 17 nt, Pseudomonas aeruginosa PA01
auaaggcgugcaguacu

SEQ ID NO: 1559064 - RNA, 14 nt, Pseudomonas aeruginosa PA01
auaaaaaggcccgg

SEQ ID NO: 1559065 - RNA, 13 nt, Pseudomonas aeruginosa PA01
aguugggccagga

SEQ ID NO: 1559066 - RNA, 15 nt, Pseudomonas aeruginosa PA01
aguugggcgaccugc

SEQ ID NO: 1559067 - RNA, 16 nt, Pseudomonas aeruginosa PA01
aguugggcgaccugcu

SEQ ID NO: 1559068 - RNA, 23 nt, Pseudomonas aeruginosa PA01
auaaaugcccgggagguuugcca

SEQ ID NO: 1559069 - RNA, 13 nt, Pseudomonas aeruginosa PA01
aucaucugggcca

SEQ ID NO: 1559070 - RNA, 17 nt, Pseudomonas aeruginosa PA01
aucaucggcccugggcg

SEQ ID NO: 1559071 - RNA, 17 nt, Pseudomonas aeruginosa PA01
aucaugccgagcaucag

SEQ ID NO: 1559072 - RNA, 13 nt, Pseudomonas aeruginosa PA01
aucaugcgccccg

SEQ ID NO: 1559073 - RNA, 15 nt, Pseudomonas aeruginosa PA01
aucaugggugaagac

SEQ ID NO: 1559074 - RNA, 14 nt, Pseudomonas aeruginosa PA01
aaaagaagaaaaac

SEQ ID NO: 1559075 - RNA, 20 nt, Pseudomonas aeruginosa PA01
auccacgcugugcggcagca

SEQ ID NO: 1559076 - RNA, 15 nt, Pseudomonas aeruginosa PA01
auccagcggacgcuu

SEQ ID NO: 1559077 - RNA, 22 nt, Pseudomonas aeruginosa PA01
auccagcggacgcuuguccuuc

SEQ ID NO: 1559078 - RNA, 15 nt, Pseudomonas aeruginosa PA01
auccagcacccgcac

SEQ ID NO: 1559079 - RNA, 12 nt, Pseudomonas aeruginosa PA01
auccagcggcag

SEQ ID NO: 1559080 - RNA, 13 nt, Pseudomonas aeruginosa PA01
auccaguuccugc

SEQ ID NO: 1559081 - RNA, 14 nt, Pseudomonas aeruginosa PA01
auccaguuccugca

SEQ ID NO: 1559082 - RNA, 16 nt, Pseudomonas aeruginosa PA01
auccagucggcgcugg

SEQ ID NO: 1559083 - RNA, 17 nt, Pseudomonas aeruginosa PA01
auccccaacccggccag

SEQ ID NO: 1559084 - RNA, 21 nt, Pseudomonas aeruginosa PA01
aucccgacgcccuccagcacc

SEQ ID NO: 1559085 - RNA, 12 nt, Pseudomonas aeruginosa PA01
auccggguggag

SEQ ID NO: 1559086 - RNA, 14 nt, Pseudomonas aeruginosa PA01
auccgugccaggcg

SEQ ID NO: 1559087 - RNA, 17 nt, Pseudomonas aeruginosa PA01
auccugaccguccuggc

SEQ ID NO: 1559088 - RNA, 17 nt, Pseudomonas aeruginosa PA01
auccuccgccagcccca

SEQ ID NO: 1559089 - RNA, 15 nt, Pseudomonas aeruginosa PA01
auccucguuccacgg

SEQ ID NO: 1559090 - RNA, 14 nt, Pseudomonas aeruginosa PA01
aucgcugaccugga

SEQ ID NO: 1559091 - RNA, 20 nt, Pseudomonas aeruginosa PA01
aucgcgugggccaccaucag

SEQ ID NO: 1559092 - RNA, 15 nt, Pseudomonas aeruginosa PA01
aucgccuccaccagc

SEQ ID NO: 1559093 - RNA, 15 nt, Pseudomonas aeruginosa PA01
aucgccuccacggcg

SEQ ID NO: 1559094 - RNA, 14 nt, Pseudomonas aeruginosa PA01
aucgccucgcggac

SEQ ID NO: 1559095 - RNA, 23 nt, Pseudomonas aeruginosa PA01
aucgccgcggcgaagcgcucgac

SEQ ID NO: 1559096 - RNA, 17 nt, Pseudomonas aeruginosa PA01
aucgcccagcggcuggc

SEQ ID NO: 1559097 - RNA, 17 nt, Pseudomonas aeruginosa PA01
aucgcccauugccgggc

SEQ ID NO: 1559098 - RNA, 19 nt, Pseudomonas aeruginosa PA01
aucgccggcccgcgcggca

SEQ ID NO: 1559099 - RNA, 19 nt, Pseudomonas aeruginosa PA01
aucgccggcgagccgcugg

SEQ ID NO: 1559100 - RNA, 22 nt, Pseudomonas aeruginosa PA01
aucgccggcgagccgcuggcau

SEQ ID NO: 1559101 - RNA, 17 nt, Pseudomonas aeruginosa PA01
aucgagcggcggccguc

SEQ ID NO: 1559102 - RNA, 13 nt, Pseudomonas aeruginosa PA01
aucgagccgccgg

SEQ ID NO: 1559103 - RNA, 22 nt, Pseudomonas aeruginosa PA01
aucgagccgccggggaagcugc

SEQ ID NO: 1559104 - RNA, 13 nt, Pseudomonas aeruginosa PA01
aucgagccagcgc

SEQ ID NO: 1559105 - RNA, 11 nt, Pseudomonas aeruginosa PA01
aucgaucucga

SEQ ID NO: 1559106 - RNA, 12 nt, Pseudomonas aeruginosa PA01
aucgaugaccuu

SEQ ID NO: 1559107 - RNA, 18 nt, Pseudomonas aeruginosa PA01
aucgcacuucgucacugu

SEQ ID NO: 1559108 - RNA, 15 nt, Pseudomonas aeruginosa PA01
aucgcaagauuauca

SEQ ID NO: 1559109 - RNA, 17 nt, Pseudomonas aeruginosa PA01
aucgccauuggccaggg

SEQ ID NO: 1559110 - RNA, 14 nt, Pseudomonas aeruginosa PA01
aucgcaggccaggc

SEQ ID NO: 1559111 - RNA, 22 nt, Pseudomonas aeruginosa PA01
aucgucgaagggccauuguucu

SEQ ID NO: 1559112 - RNA, 15 nt, Pseudomonas aeruginosa PA01
aucguccagcucggc

SEQ ID NO: 1559113 - RNA, 17 nt, Pseudomonas aeruginosa PA01
aucguccagcucggcca

SEQ ID NO: 1559114 - RNA, 11 nt, Pseudomonas aeruginosa PA01
aucgucggccc

SEQ ID NO: 1559115 - RNA, 19 nt, Pseudomonas aeruginosa PA01
aucggcaacuggcuggccu

SEQ ID NO: 1559116 - RNA, 20 nt, Pseudomonas aeruginosa PA01
aucggcaacuggcuggccug

SEQ ID NO: 1559117 - RNA, 14 nt, Pseudomonas aeruginosa PA01
aucggcaccaucac

SEQ ID NO: 1559118 - RNA, 21 nt, Pseudomonas aeruginosa PA01
aucggauagccgugcagcagc

SEQ ID NO: 1559119 - RNA, 18 nt, Pseudomonas aeruginosa PA01
aucucgugggccagcagg

SEQ ID NO: 1559120 - RNA, 16 nt, Pseudomonas aeruginosa PA01
aucucguccucggcgu

SEQ ID NO: 1559121 - RNA, 16 nt, Pseudomonas aeruginosa PA01
aucucgguuuccagga

SEQ ID NO: 1559122 - RNA, 16 nt, Pseudomonas aeruginosa PA01
aucucggugcgcccca

SEQ ID NO: 1559123 - RNA, 20 nt, Pseudomonas aeruginosa PA01
aucucggccaccugcuccgg

SEQ ID NO: 1559124 - RNA, 20 nt, Pseudomonas aeruginosa PA01
aucucuuccucgcugccuac

SEQ ID NO: 1559125 - RNA, 18 nt, Pseudomonas aeruginosa PA01
aucuccgaguccugcugc

SEQ ID NO: 1559126 - RNA, 15 nt, Pseudomonas aeruginosa PA01
aucucccuauaaugc

SEQ ID NO: 1559127 - RNA, 15 nt, Pseudomonas aeruginosa PA01
aucuccgcgccgggc

SEQ ID NO: 1559128 - RNA, 17 nt, Pseudomonas aeruginosa PA01
aucuccgcgccgggcug

SEQ ID NO: 1559129 - RNA, 17 nt, Pseudomonas aeruginosa PA01
aucuccgcggagaggau

SEQ ID NO: 1559130 - RNA, 21 nt, Pseudomonas aeruginosa PA01
aucucgcugaguuugcccagc

SEQ ID NO: 1559131 - RNA, 23 nt, Pseudomonas aeruginosa PA01
aucuggaucaggaagguccaggc

SEQ ID NO: 1559132 - RNA, 13 nt, Pseudomonas aeruginosa PA01
aucugcugcagca

SEQ ID NO: 1559133 - RNA, 23 nt, Pseudomonas aeruginosa PA01
aucugccgguaauuggccaggcu

SEQ ID NO: 1559134 - RNA, 19 nt, Pseudomonas aeruginosa PA01
aucugccggccaccaucac

SEQ ID NO: 1559135 - RNA, 13 nt, Pseudomonas aeruginosa PA01
aucugcucgucca

SEQ ID NO: 1559136 - RNA, 22 nt, Pseudomonas aeruginosa PA01
aucugcacgucguagcccuucu

SEQ ID NO: 1559137 - RNA, 16 nt, Pseudomonas aeruginosa PA01
aucuucugucccggac

SEQ ID NO: 1559138 - RNA, 14 nt, Pseudomonas aeruginosa PA01
aucugguggaacag

SEQ ID NO: 1559139 - RNA, 17 nt, Pseudomonas aeruginosa PA01
aucugguugaacugcgg

SEQ ID NO: 1559140 - RNA, 14 nt, Pseudomonas aeruginosa PA01
aucuucuaccuggc

SEQ ID NO: 1559141 - RNA, 19 nt, Pseudomonas aeruginosa PA01
aucuucuccgauuccugcg

SEQ ID NO: 1559142 - RNA, 12 nt, Pseudomonas aeruginosa PA01
augaccaggcug

SEQ ID NO: 1559143 - RNA, 12 nt, Pseudomonas aeruginosa PA01
augaccgagcau

SEQ ID NO: 1559144 - RNA, 19 nt, Pseudomonas aeruginosa PA01
augaccguccacggcgcgu

SEQ ID NO: 1559145 - RNA, 21 nt, Pseudomonas aeruginosa PA01
augaccuucagcaccugcgcc

SEQ ID NO: 1559146 - RNA, 23 nt, Pseudomonas aeruginosa PA01
augaccuucagguagauguccag

SEQ ID NO: 1559147 - RNA, 20 nt, Pseudomonas aeruginosa PA01
augaacuggucgcuccagcc

SEQ ID NO: 1559148 - RNA, 12 nt, Pseudomonas aeruginosa PA01
augaaagccagc

SEQ ID NO: 1559149 - RNA, 18 nt, Pseudomonas aeruginosa PA01
auacggaacacacgcuuc

SEQ ID NO: 1559150 - RNA, 18 nt, Pseudomonas aeruginosa PA01
auagaaaccgucuuaaau

SEQ ID NO: 1559151 - RNA, 17 nt, Pseudomonas aeruginosa PA01
auagaaacgcagggccu

SEQ ID NO: 1559152 - RNA, 14 nt, Pseudomonas aeruginosa PA01
auacaugcugcuca

SEQ ID NO: 1559153 - RNA, 15 nt, Pseudomonas aeruginosa PA01
auacccggcgccccg

SEQ ID NO: 1559154 - RNA, 16 nt, Pseudomonas aeruginosa PA01
auagcgcggccuucag

SEQ ID NO: 1559155 - RNA, 21 nt, Pseudomonas aeruginosa PA01
auagcuggucaauaccacccu

SEQ ID NO: 1559156 - RNA, 21 nt, Pseudomonas aeruginosa PA01
auaggcauauucuucaacagc

SEQ ID NO: 1559157 - RNA, 21 nt, Pseudomonas aeruginosa PA01
auaggccugggcguacaggcc

SEQ ID NO: 1559158 - RNA, 18 nt, Pseudomonas aeruginosa PA01
auagggcaucagccccuc

SEQ ID NO: 1559159 - RNA, 14 nt, Pseudomonas aeruginosa PA01
auauagcuggucaa

SEQ ID NO: 1559160 - RNA, 19 nt, Pseudomonas aeruginosa PA01
auauuuuucuaaaauggcu

SEQ ID NO: 1559161 - RNA, 16 nt, Pseudomonas aeruginosa PA01
aucaacgggcccugcc

SEQ ID NO: 1559162 - RNA, 23 nt, Pseudomonas aeruginosa PA01
aucaacccaccgaccaccaucac

SEQ ID NO: 1559163 - RNA, 14 nt, Pseudomonas aeruginosa PA01
auaugccgcucagc

SEQ ID NO: 1559164 - RNA, 14 nt, Pseudomonas aeruginosa PA01
auaugcaggucgaa

SEQ ID NO: 1559165 - RNA, 16 nt, Pseudomonas aeruginosa PA01
auaugggugaugaccc

SEQ ID NO: 1559166 - RNA, 20 nt, Pseudomonas aeruginosa PA01
aucacaccgaagucgcccgc

SEQ ID NO: 1559167 - RNA, 20 nt, Pseudomonas aeruginosa PA01
aucacaacggaagauggcua

SEQ ID NO: 1559168 - RNA, 13 nt, Pseudomonas aeruginosa PA01
aucaccccgcaac

SEQ ID NO: 1559169 - RNA, 15 nt, Pseudomonas aeruginosa PA01
aucaccccgcccagu

SEQ ID NO: 1559170 - RNA, 23 nt, Pseudomonas aeruginosa PA01
aucaccagcgccgucaccagcag

SEQ ID NO: 1559171 - RNA, 21 nt, Pseudomonas aeruginosa PA01
aucaccagcggcgagcaggcg

SEQ ID NO: 1559172 - RNA, 16 nt, Pseudomonas aeruginosa PA01
aucaccaccggcuggc

SEQ ID NO: 1559173 - RNA, 23 nt, Pseudomonas aeruginosa PA01
aucaccaccggcuggcggcucgg

SEQ ID NO: 1559174 - RNA, 19 nt, Pseudomonas aeruginosa PA01
aucaccagccacugcuugg

SEQ ID NO: 1559175 - RNA, 13 nt, Pseudomonas aeruginosa PA01
aucaccaccagca

SEQ ID NO: 1559176 - RNA, 15 nt, Pseudomonas aeruginosa PA01
aucaccaccagcauc

SEQ ID NO: 1559177 - RNA, 22 nt, Pseudomonas aeruginosa PA01
aucaccuugucgcaccagccuu

SEQ ID NO: 1559178 - RNA, 18 nt, Pseudomonas aeruginosa PA01
aucacgaacagcuugccg

SEQ ID NO: 1559179 - RNA, 11 nt, Pseudomonas aeruginosa PA01
aucaccugcuu

SEQ ID NO: 1559180 - RNA, 20 nt, Pseudomonas aeruginosa PA01
aucaccuugccaucaucgga

SEQ ID NO: 1559181 - RNA, 15 nt, Pseudomonas aeruginosa PA01
aucaccuucgcccuc

SEQ ID NO: 1559182 - RNA, 14 nt, Pseudomonas aeruginosa PA01
aucagcacccgguc

SEQ ID NO: 1559183 - RNA, 11 nt, Pseudomonas aeruginosa PA01
aucagcacaug

SEQ ID NO: 1559184 - RNA, 15 nt, Pseudomonas aeruginosa PA01
aucagaacgaugccg

SEQ ID NO: 1559185 - RNA, 14 nt, Pseudomonas aeruginosa PA01
aucacugccuggca

SEQ ID NO: 1559186 - RNA, 20 nt, Pseudomonas aeruginosa PA01
aucagcgaaauggucaccau

SEQ ID NO: 1559187 - RNA, 21 nt, Pseudomonas aeruginosa PA01
aucagcggcggucccaucagc

SEQ ID NO: 1559188 - RNA, 16 nt, Pseudomonas aeruginosa PA01
aucagcggcccgagca

SEQ ID NO: 1559189 - RNA, 18 nt, Pseudomonas aeruginosa PA01
aucagccgcuccaggauc

SEQ ID NO: 1559190 - RNA, 16 nt, Pseudomonas aeruginosa PA01
aucagguugaagagca

SEQ ID NO: 1559191 - RNA, 21 nt, Pseudomonas aeruginosa PA01
aucaggucgccgcugaauacc

SEQ ID NO: 1559192 - RNA, 22 nt, Pseudomonas aeruginosa PA01
aucaggucgccgcugaauacca

SEQ ID NO: 1559193 - RNA, 14 nt, Pseudomonas aeruginosa PA01
aucaggucggccgc

SEQ ID NO: 1559194 - RNA, 15 nt, Pseudomonas aeruginosa PA01
aucaguaccggcagc

SEQ ID NO: 1559195 - RNA, 17 nt, Pseudomonas aeruginosa PA01
aucaggugcaggaacag

SEQ ID NO: 1559196 - RNA, 21 nt, Pseudomonas aeruginosa PA01
aucagggucuucaggcguggg

SEQ ID NO: 1559197 - RNA, 14 nt, Pseudomonas aeruginosa PA01
aucagggcugggcg

SEQ ID NO: 1559198 - RNA, 16 nt, Pseudomonas aeruginosa PA01
aucaggcugccgagca

SEQ ID NO: 1559199 - RNA, 17 nt, Pseudomonas aeruginosa PA01
aucaggcucaggcguuc

SEQ ID NO: 1559200 - RNA, 14 nt, Pseudomonas aeruginosa PA01
aucaggcugugcau

SEQ ID NO: 1559201 - RNA, 23 nt, Pseudomonas aeruginosa PA01
aucaggcauccccggaccagggc

SEQ ID NO: 1559202 - RNA, 17 nt, Pseudomonas aeruginosa PA01
caaggaugcgccagcgg

SEQ ID NO: 1559203 - RNA, 13 nt, Pseudomonas aeruginosa PA01
caauacaccuugg

SEQ ID NO: 1559204 - RNA, 19 nt, Pseudomonas aeruginosa PA01
caaucuauaaugcgccccc

SEQ ID NO: 1559205 - RNA, 15 nt, Pseudomonas aeruginosa PA01
caaucgacuucccac

SEQ ID NO: 1559206 - RNA, 13 nt, Pseudomonas aeruginosa PA01
caagaagccccgc

SEQ ID NO: 1559207 - RNA, 17 nt, Pseudomonas aeruginosa PA01
caagcuccccgccgcca

SEQ ID NO: 1559208 - RNA, 18 nt, Pseudomonas aeruginosa PA01
caagcucgacgagccgcg

SEQ ID NO: 1559209 - RNA, 16 nt, Pseudomonas aeruginosa PA01
caagccuccagcgccg

SEQ ID NO: 1559210 - RNA, 17 nt, Pseudomonas aeruginosa PA01
caagccuccagcgccgc

SEQ ID NO: 1559211 - RNA, 12 nt, Pseudomonas aeruginosa PA01
caagcgcaugag

SEQ ID NO: 1559212 - RNA, 19 nt, Pseudomonas aeruginosa PA01
caagccgagcggcaaggcc

SEQ ID NO: 1559213 - RNA, 21 nt, Pseudomonas aeruginosa PA01
caagccgagcggcaaggccaa

SEQ ID NO: 1559214 - RNA, 19 nt, Pseudomonas aeruginosa PA01
caacguccucgcgccgcuu

SEQ ID NO: 1559215 - RNA, 17 nt, Pseudomonas aeruginosa PA01
caacugcuuaccuugcc

SEQ ID NO: 1559216 - RNA, 19 nt, Pseudomonas aeruginosa PA01
caacugcuuaccuugccgg

SEQ ID NO: 1559217 - RNA, 15 nt, Pseudomonas aeruginosa PA01
caacugcggggcgcu

SEQ ID NO: 1559218 - RNA, 21 nt, Pseudomonas aeruginosa PA01
caacugcggggcgcucagggu

SEQ ID NO: 1559219 - RNA, 11 nt, Pseudomonas aeruginosa PA01
caacugcucga

SEQ ID NO: 1559220 - RNA, 18 nt, Pseudomonas aeruginosa PA01
caacucgucguccagcgg

SEQ ID NO: 1559221 - RNA, 17 nt, Pseudomonas aeruginosa PA01
caacucggccuggaacc

SEQ ID NO: 1559222 - RNA, 14 nt, Pseudomonas aeruginosa PA01
caacucggcgccgu

SEQ ID NO: 1559223 - RNA, 21 nt, Pseudomonas aeruginosa PA01
caacucggcggcgagcgccgc

SEQ ID NO: 1559224 - RNA, 22 nt, Pseudomonas aeruginosa PA01
caaccguucugccgcagcgccu

SEQ ID NO: 1559225 - RNA, 19 nt, Pseudomonas aeruginosa PA01
caaccgggcaucgccgacc

SEQ ID NO: 1559226 - RNA, 21 nt, Pseudomonas aeruginosa PA01
caaccgcuugucgccuucccg

SEQ ID NO: 1559227 - RNA, 20 nt, Pseudomonas aeruginosa PA01
caacgcgguuauccgccgcu

SEQ ID NO: 1559228 - RNA, 21 nt, Pseudomonas aeruginosa PA01
caacgcggccagcagcacgcc

SEQ ID NO: 1559229 - RNA, 20 nt, Pseudomonas aeruginosa PA01
caacgcgcagaggcgcucca

SEQ ID NO: 1559230 - RNA, 14 nt, Pseudomonas aeruginosa PA01
caacgcuuccagca

SEQ ID NO: 1559231 - RNA, 20 nt, Pseudomonas aeruginosa PA01
caacgcuuccagcaccuccc

SEQ ID NO: 1559232 - RNA, 19 nt, Pseudomonas aeruginosa PA01
caacggaaaaaggcgccuu

SEQ ID NO: 1559233 - RNA, 23 nt, Pseudomonas aeruginosa PA01
caacggacguuccaccuggcgca

SEQ ID NO: 1559234 - RNA, 19 nt, Pseudomonas aeruginosa PA01
caacggcgaccgcuggacc

SEQ ID NO: 1559235 - RNA, 15 nt, Pseudomonas aeruginosa PA01
caacgggcggcggga

SEQ ID NO: 1559236 - RNA, 11 nt, Pseudomonas aeruginosa PA01
caacggcuggg

SEQ ID NO: 1559237 - RNA, 15 nt, Pseudomonas aeruginosa PA01
caacccuguccccuc

SEQ ID NO: 1559238 - RNA, 15 nt, Pseudomonas aeruginosa PA01
caacccggcgcuggc

SEQ ID NO: 1559239 - RNA, 16 nt, Pseudomonas aeruginosa PA01
caacagcguuuuccug

SEQ ID NO: 1559240 - RNA, 20 nt, Pseudomonas aeruginosa PA01
caacagcggugugcucaggc

SEQ ID NO: 1559241 - RNA, 13 nt, Pseudomonas aeruginosa PA01
caacagcguucac

SEQ ID NO: 1559242 - RNA, 22 nt, Pseudomonas aeruginosa PA01
caacaguugccgcagcagcggc

SEQ ID NO: 1559243 - RNA, 22 nt, Pseudomonas aeruginosa PA01
caacaguggguaggccaggcaa

SEQ ID NO: 1559244 - RNA, 13 nt, Pseudomonas aeruginosa PA01
caacaccagcgcc

SEQ ID NO: 1559245 - RNA, 12 nt, Pseudomonas aeruginosa PA01
caacagcaggua

SEQ ID NO: 1559246 - RNA, 13 nt, Pseudomonas aeruginosa PA01
caaaccucccggg

SEQ ID NO: 1559247 - RNA, 22 nt, Pseudomonas aeruginosa PA01
caaacgggacagguugucgacc

SEQ ID NO: 1559248 - RNA, 22 nt, Pseudomonas aeruginosa PA01
caaaggaaucuucggcgcccac

SEQ ID NO: 1559249 - RNA, 16 nt, Pseudomonas aeruginosa PA01
cacccuggacccgggc

SEQ ID NO: 1559250 - RNA, 18 nt, Pseudomonas aeruginosa PA01
cacccuggacccgggccu

SEQ ID NO: 1559251 - RNA, 21 nt, Pseudomonas aeruginosa PA01
cacccugcugcugcucagcgc

SEQ ID NO: 1559252 - RNA, 23 nt, Pseudomonas aeruginosa PA01
cacccugcugcugcucagcgcgc

SEQ ID NO: 1559253 - RNA, 13 nt, Pseudomonas aeruginosa PA01
cacccugccgcgc

SEQ ID NO: 1559254 - RNA, 14 nt, Pseudomonas aeruginosa PA01
cacccgucccgcgc

SEQ ID NO: 1559255 - RNA, 18 nt, Pseudomonas aeruginosa PA01
cacccgucccgcgcgccg

SEQ ID NO: 1559256 - RNA, 18 nt, Pseudomonas aeruginosa PA01
cacccuugcgcccggcuu

SEQ ID NO: 1559257 - RNA, 19 nt, Pseudomonas aeruginosa PA01
cacccuugcgcccggcuuc

SEQ ID NO: 1559258 - RNA, 19 nt, Pseudomonas aeruginosa PA01
cacccuugcguccugccuc

SEQ ID NO: 1559259 - RNA, 19 nt, Pseudomonas aeruginosa PA01
cacccuuggagccgcccuc

SEQ ID NO: 1559260 - RNA, 20 nt, Pseudomonas aeruginosa PA01
cacccuuggagccgcccucg

SEQ ID NO: 1559261 - RNA, 14 nt, Pseudomonas aeruginosa PA01
caccgaggcgcgcc

SEQ ID NO: 1559262 - RNA, 22 nt, Pseudomonas aeruginosa PA01
caccgaggcgcgccgacagcac

SEQ ID NO: 1559263 - RNA, 20 nt, Pseudomonas aeruginosa PA01
caccgagcaggcacccgcgg

SEQ ID NO: 1559264 - RNA, 16 nt, Pseudomonas aeruginosa PA01
caccgacggcuccgga

SEQ ID NO: 1559265 - RNA, 22 nt, Pseudomonas aeruginosa PA01
caccccgcccuuggcggcgcca

SEQ ID NO: 1559266 - RNA, 12 nt, Pseudomonas aeruginosa PA01
caccccgccggc

SEQ ID NO: 1559267 - RNA, 20 nt, Pseudomonas aeruginosa PA01
cacccgcaucgaggccgccc

SEQ ID NO: 1559268 - RNA, 22 nt, Pseudomonas aeruginosa PA01
cacccgcaucgaggccgcccag

SEQ ID NO: 1559269 - RNA, 17 nt, Pseudomonas aeruginosa PA01
cacccgcccgccgucgc

SEQ ID NO: 1559270 - RNA, 15 nt, Pseudomonas aeruginosa PA01
cacccgcagccccgc

SEQ ID NO: 1559271 - RNA, 17 nt, Pseudomonas aeruginosa PA01
cacccgguugaccccgc

SEQ ID NO: 1559272 - RNA, 14 nt, Pseudomonas aeruginosa PA01
cacccgggcgaccu

SEQ ID NO: 1559273 - RNA, 15 nt, Pseudomonas aeruginosa PA01
cacccggucggccug

SEQ ID NO: 1559274 - RNA, 12 nt, Pseudomonas aeruginosa PA01
cacccggcugca

SEQ ID NO: 1559275 - RNA, 15 nt, Pseudomonas aeruginosa PA01
cacccgcgccgccgc

SEQ ID NO: 1559276 - RNA, 20 nt, Pseudomonas aeruginosa PA01
cacccgcgccgccgcggcca

SEQ ID NO: 1559277 - RNA, 17 nt, Pseudomonas aeruginosa PA01
cacccgcgaaugcuccg

SEQ ID NO: 1559278 - RNA, 23 nt, Pseudomonas aeruginosa PA01
cacccgccucgucgccaugcggc

SEQ ID NO: 1559279 - RNA, 14 nt, Pseudomonas aeruginosa PA01
cacccaggccacgc

SEQ ID NO: 1559280 - RNA, 23 nt, Pseudomonas aeruginosa PA01
cacccagcagcaacuccagagcc

SEQ ID NO: 1559281 - RNA, 17 nt, Pseudomonas aeruginosa PA01
caccaguggcgccgcca

SEQ ID NO: 1559282 - RNA, 21 nt, Pseudomonas aeruginosa PA01
caccaguggcgccgccauggu

SEQ ID NO: 1559283 - RNA, 17 nt, Pseudomonas aeruginosa PA01
caccccgaccagcgcgc

SEQ ID NO: 1559284 - RNA, 15 nt, Pseudomonas aeruginosa PA01
caccccgagcccggc

SEQ ID NO: 1559285 - RNA, 18 nt, Pseudomonas aeruginosa PA01
caccccgagcggcgcgaa

SEQ ID NO: 1559286 - RNA, 16 nt, Pseudomonas aeruginosa PA01
cacccccggcccggcc

SEQ ID NO: 1559287 - RNA, 17 nt, Pseudomonas aeruginosa PA01
cacccccagcgagccga

SEQ ID NO: 1559288 - RNA, 15 nt, Pseudomonas aeruginosa PA01
caccccauccucgcc

SEQ ID NO: 1559289 - RNA, 17 nt, Pseudomonas aeruginosa PA01
caccccauccucgccgg

SEQ ID NO: 1559290 - RNA, 21 nt, Pseudomonas aeruginosa PA01
cacccagggcaguacguggcg

SEQ ID NO: 1559291 - RNA, 23 nt, Pseudomonas aeruginosa PA01
cacccagggcaguacguggcgcu

SEQ ID NO: 1559292 - RNA, 18 nt, Pseudomonas aeruginosa PA01
cacccagucuucgcuggc

SEQ ID NO: 1559293 - RNA, 23 nt, Pseudomonas aeruginosa PA01
cacccauucgaugccgcgcgccu

SEQ ID NO: 1559294 - RNA, 17 nt, Pseudomonas aeruginosa PA01
caccguucccagcagcg

SEQ ID NO: 1559295 - RNA, 17 nt, Pseudomonas aeruginosa PA01
caccguuccgacccggc

SEQ ID NO: 1559296 - RNA, 22 nt, Pseudomonas aeruginosa PA01
caccguuggcguuaugcgcccu

SEQ ID NO: 1559297 - RNA, 15 nt, Pseudomonas aeruginosa PA01
caccggcuggcccuc

SEQ ID NO: 1559298 - RNA, 20 nt, Pseudomonas aeruginosa PA01
caccggcuggcggcucggcu

SEQ ID NO: 1559299 - RNA, 21 nt, Pseudomonas aeruginosa PA01
caccggcugcauguccgccag

SEQ ID NO: 1559300 - RNA, 19 nt, Pseudomonas aeruginosa PA01
caccggcguuauccgccga

SEQ ID NO: 1559301 - RNA, 22 nt, Pseudomonas aeruginosa PA01
caccggcggauuacuccgccgg

SEQ ID NO: 1559302 - RNA, 20 nt, Pseudomonas aeruginosa PA01
caccggcuuguugcgcucca

SEQ ID NO: 1559303 - RNA, 23 nt, Pseudomonas aeruginosa PA01
caccgggaucuggcccugcaaca

SEQ ID NO: 1559304 - RNA, 23 nt, Pseudomonas aeruginosa PA01
caccgggaucagcggcggggcca

SEQ ID NO: 1559305 - RNA, 20 nt, Pseudomonas aeruginosa PA01
caccgggaggcgccgcgcca

SEQ ID NO: 1559306 - RNA, 20 nt, Pseudomonas aeruginosa PA01
caccgucaagggccaggaaa

SEQ ID NO: 1559307 - RNA, 18 nt, Pseudomonas aeruginosa PA01
caccggaagcguccaggg

SEQ ID NO: 1559308 - RNA, 14 nt, Pseudomonas aeruginosa PA01
caccggcagcagcg

SEQ ID NO: 1559309 - RNA, 12 nt, Pseudomonas aeruginosa PA01
caccgagggcag

SEQ ID NO: 1559310 - RNA, 16 nt, Pseudomonas aeruginosa PA01
caccgaguggcgcagc

SEQ ID NO: 1559311 - RNA, 19 nt, Pseudomonas aeruginosa PA01
caccgcauaggucaugccc

SEQ ID NO: 1559312 - RNA, 15 nt, Pseudomonas aeruginosa PA01
caccgcaucgaaggc

SEQ ID NO: 1559313 - RNA, 22 nt, Pseudomonas aeruginosa PA01
caccgcaucgaaggcgccggca

SEQ ID NO: 1559314 - RNA, 18 nt, Pseudomonas aeruginosa PA01
caccgcauccucguucca

SEQ ID NO: 1559315 - RNA, 22 nt, Pseudomonas aeruginosa PA01
caccgccuuggcaucgccgccc

SEQ ID NO: 1559316 - RNA, 20 nt, Pseudomonas aeruginosa PA01
caccgccucggagaacagca

SEQ ID NO: 1559317 - RNA, 15 nt, Pseudomonas aeruginosa PA01
caccgccugccccac

SEQ ID NO: 1559318 - RNA, 20 nt, Pseudomonas aeruginosa PA01
caccgcgaauccgcggcccu

SEQ ID NO: 1559319 - RNA, 16 nt, Pseudomonas aeruginosa PA01
caccgcgacgcgcugg

SEQ ID NO: 1559320 - RNA, 18 nt, Pseudomonas aeruginosa PA01
caccgcggccucgcuggc

SEQ ID NO: 1559321 - RNA, 14 nt, Pseudomonas aeruginosa PA01
caccgcgcuccgcu

SEQ ID NO: 1559322 - RNA, 18 nt, Pseudomonas aeruginosa PA01
caccgcggaauccgcuuc

SEQ ID NO: 1559323 - RNA, 18 nt, Pseudomonas aeruginosa PA01
caccgcgucgaguaccgc

SEQ ID NO: 1559324 - RNA, 16 nt, Pseudomonas aeruginosa PA01
caccgcguggugcugc

SEQ ID NO: 1559325 - RNA, 19 nt, Pseudomonas aeruginosa PA01
caccgcggugucggugccc

SEQ ID NO: 1559326 - RNA, 21 nt, Pseudomonas aeruginosa PA01
caccgcgguggaggcggcggu

SEQ ID NO: 1559327 - RNA, 17 nt, Pseudomonas aeruginosa PA01
caccgcugcgcaggugc

SEQ ID NO: 1559328 - RNA, 17 nt, Pseudomonas aeruginosa PA01
caccgcugcgccgccgu

SEQ ID NO: 1559329 - RNA, 19 nt, Pseudomonas aeruginosa PA01
caccgcucgaguucgcgcg

SEQ ID NO: 1559330 - RNA, 13 nt, Pseudomonas aeruginosa PA01
caccgcucgccag

SEQ ID NO: 1559331 - RNA, 16 nt, Pseudomonas aeruginosa PA01
caccgcucaagacggc

SEQ ID NO: 1559332 - RNA, 19 nt, Pseudomonas aeruginosa PA01
caccgcuucgagcaccccg

SEQ ID NO: 1559333 - RNA, 18 nt, Pseudomonas aeruginosa PA01
cacggcgauacccaggcc

SEQ ID NO: 1559334 - RNA, 19 nt, Pseudomonas aeruginosa PA01
cacggcgagagcgccgacc

SEQ ID NO: 1559335 - RNA, 22 nt, Pseudomonas aeruginosa PA01
cacggcgaauucgucgccgccg

SEQ ID NO: 1559336 - RNA, 17 nt, Pseudomonas aeruginosa PA01
cacggcgcgcuccggcg

SEQ ID NO: 1559337 - RNA, 15 nt, Pseudomonas aeruginosa PA01
cacggcgccuuccca

SEQ ID NO: 1559338 - RNA, 15 nt, Pseudomonas aeruginosa PA01
cacggcgcgagaaaa

SEQ ID NO: 1559339 - RNA, 23 nt, Pseudomonas aeruginosa PA01
cacgggcagaccuucgaagaccc

SEQ ID NO: 1559340 - RNA, 12 nt, Pseudomonas aeruginosa PA01
cacgggcggcuu

SEQ ID NO: 1559341 - RNA, 17 nt, Pseudomonas aeruginosa PA01
cacggccuucggcagga

SEQ ID NO: 1559342 - RNA, 16 nt, Pseudomonas aeruginosa PA01
cacggauaccacccgc

SEQ ID NO: 1559343 - RNA, 20 nt, Pseudomonas aeruginosa PA01
cacggaucgcgcugggcgca

SEQ ID NO: 1559344 - RNA, 15 nt, Pseudomonas aeruginosa PA01
cacggaugcaguccc

SEQ ID NO: 1559345 - RNA, 16 nt, Pseudomonas aeruginosa PA01
cacggauaugcgccgc

SEQ ID NO: 1559346 - RNA, 17 nt, Pseudomonas aeruginosa PA01
cacggauaugcgccgcc

SEQ ID NO: 1559347 - RNA, 20 nt, Pseudomonas aeruginosa PA01
cacgcuccagaucgccguuc

SEQ ID NO: 1559348 - RNA, 17 nt, Pseudomonas aeruginosa PA01
cacgcggaucuggcccu

SEQ ID NO: 1559349 - RNA, 13 nt, Pseudomonas aeruginosa PA01
cacgcgcuggagu

SEQ ID NO: 1559350 - RNA, 19 nt, Pseudomonas aeruginosa PA01
cacgcgccgggucggaugc

SEQ ID NO: 1559351 - RNA, 15 nt, Pseudomonas aeruginosa PA01
cacgcgcaguacgau

SEQ ID NO: 1559352 - RNA, 18 nt, Pseudomonas aeruginosa PA01
cacgccuugcagcaccgc

SEQ ID NO: 1559353 - RNA, 15 nt, Pseudomonas aeruginosa PA01
cacgccuucgcggcc

SEQ ID NO: 1559354 - RNA, 19 nt, Pseudomonas aeruginosa PA01
cacgccuucgggcgaugcg

SEQ ID NO: 1559355 - RNA, 18 nt, Pseudomonas aeruginosa PA01
cacgcgaccaccuucuac

SEQ ID NO: 1559356 - RNA, 16 nt, Pseudomonas aeruginosa PA01
cacgcccugggacagg

SEQ ID NO: 1559357 - RNA, 15 nt, Pseudomonas aeruginosa PA01
cacgccgaaguucuu

SEQ ID NO: 1559358 - RNA, 18 nt, Pseudomonas aeruginosa PA01
cacgccgaucaccccgcc

SEQ ID NO: 1559359 - RNA, 17 nt, Pseudomonas aeruginosa PA01
cacgccgaucccgaucg

SEQ ID NO: 1559360 - RNA, 19 nt, Pseudomonas aeruginosa PA01
cacgccgagggcgcggcgc

SEQ ID NO: 1559361 - RNA, 20 nt, Pseudomonas aeruginosa PA01
cacgccgagggcgcggcgcc

SEQ ID NO: 1559362 - RNA, 18 nt, Pseudomonas aeruginosa PA01
cacgcaagugcccugggc

SEQ ID NO: 1559363 - RNA, 14 nt, Pseudomonas aeruginosa PA01
cacgauggccggca

SEQ ID NO: 1559364 - RNA, 15 nt, Pseudomonas aeruginosa PA01
cacgauggccggcag

SEQ ID NO: 1559365 - RNA, 16 nt, Pseudomonas aeruginosa PA01
cacgaugucgaccugg

SEQ ID NO: 1559366 - RNA, 17 nt, Pseudomonas aeruginosa PA01
cacgaugucgaccuggg

SEQ ID NO: 1559367 - RNA, 12 nt, Pseudomonas aeruginosa PA01
caccucaugcug

SEQ ID NO: 1559368 - RNA, 17 nt, Pseudomonas aeruginosa PA01
caccuggaacuugcugu

SEQ ID NO: 1559369 - RNA, 21 nt, Pseudomonas aeruginosa PA01
caccuggcagugcgccggcau

SEQ ID NO: 1559370 - RNA, 22 nt, Pseudomonas aeruginosa PA01
caccugguggacacccugcugc

SEQ ID NO: 1559371 - RNA, 19 nt, Pseudomonas aeruginosa PA01
caccugggcguuggccagc

SEQ ID NO: 1559372 - RNA, 22 nt, Pseudomonas aeruginosa PA01
caccugggcguuggccagcgcc

SEQ ID NO: 1559373 - RNA, 17 nt, Pseudomonas aeruginosa PA01
caccugggugcuuuccu

SEQ ID NO: 1559374 - RNA, 18 nt, Pseudomonas aeruginosa PA01
caccugggugcuuuccug

SEQ ID NO: 1559375 - RNA, 23 nt, Pseudomonas aeruginosa PA01
caccugggugcuuuccugcucca

SEQ ID NO: 1559376 - RNA, 18 nt, Pseudomonas aeruginosa PA01
caccuggcgaugcccugg

SEQ ID NO: 1559377 - RNA, 18 nt, Pseudomonas aeruginosa PA01
caccuggcggucgccgcc

SEQ ID NO: 1559378 - RNA, 22 nt, Pseudomonas aeruginosa PA01
cacgaacaggcugugcgccagg

SEQ ID NO: 1559379 - RNA, 17 nt, Pseudomonas aeruginosa PA01
cacgagccgcugcggcu

SEQ ID NO: 1559380 - RNA, 12 nt, Pseudomonas aeruginosa PA01
cacgacucaccc

SEQ ID NO: 1559381 - RNA, 20 nt, Pseudomonas aeruginosa PA01
cacgaucugcuugcgcgccg

SEQ ID NO: 1559382 - RNA, 12 nt, Pseudomonas aeruginosa PA01
cacagccagggg

SEQ ID NO: 1559383 - RNA, 20 nt, Pseudomonas aeruginosa PA01
cacagcguggccagcgccca

SEQ ID NO: 1559384 - RNA, 18 nt, Pseudomonas aeruginosa PA01
cacagcggugggaagagc

SEQ ID NO: 1559385 - RNA, 14 nt, Pseudomonas aeruginosa PA01
cacagcugccagcc

SEQ ID NO: 1559386 - RNA, 17 nt, Pseudomonas aeruginosa PA01
cacagcugccagccccg

SEQ ID NO: 1559387 - RNA, 15 nt, Pseudomonas aeruginosa PA01
cacauccagcccugg

SEQ ID NO: 1559388 - RNA, 20 nt, Pseudomonas aeruginosa PA01
caccagcagggccaggccga

SEQ ID NO: 1559389 - RNA, 22 nt, Pseudomonas aeruginosa PA01
caccagcaggaucgagcccugg

SEQ ID NO: 1559390 - RNA, 13 nt, Pseudomonas aeruginosa PA01
caccagcaggccc

SEQ ID NO: 1559391 - RNA, 15 nt, Pseudomonas aeruginosa PA01
caccagcagccccga

SEQ ID NO: 1559392 - RNA, 12 nt, Pseudomonas aeruginosa PA01
caccagccagcu

SEQ ID NO: 1559393 - RNA, 17 nt, Pseudomonas aeruginosa PA01
caccagcaucaccaccg

SEQ ID NO: 1559394 - RNA, 15 nt, Pseudomonas aeruginosa PA01
caccagcgccgccac

SEQ ID NO: 1559395 - RNA, 18 nt, Pseudomonas aeruginosa PA01
caccagcgccgccaggca

SEQ ID NO: 1559396 - RNA, 19 nt, Pseudomonas aeruginosa PA01
caccagcgccggcggcgcg

SEQ ID NO: 1559397 - RNA, 13 nt, Pseudomonas aeruginosa PA01
caccagcgccguc

SEQ ID NO: 1559398 - RNA, 20 nt, Pseudomonas aeruginosa PA01
caccagcgccgucaccagca

SEQ ID NO: 1559399 - RNA, 23 nt, Pseudomonas aeruginosa PA01
caccagcgccgucaccagcagcc

SEQ ID NO: 1559400 - RNA, 14 nt, Pseudomonas aeruginosa PA01
caccagccaggcgg

SEQ ID NO: 1559401 - RNA, 22 nt, Pseudomonas aeruginosa PA01
caccagguugaagaacggcccg

SEQ ID NO: 1559402 - RNA, 17 nt, Pseudomonas aeruginosa PA01
caccagguugcccggcu

SEQ ID NO: 1559403 - RNA, 14 nt, Pseudomonas aeruginosa PA01
caccagguuggcca

SEQ ID NO: 1559404 - RNA, 22 nt, Pseudomonas aeruginosa PA01
caccagguuggccaguuggccc

SEQ ID NO: 1559405 - RNA, 15 nt, Pseudomonas aeruginosa PA01
caccaggcucgcccc

SEQ ID NO: 1559406 - RNA, 17 nt, Pseudomonas aeruginosa PA01
caccaggcugccgccgu

SEQ ID NO: 1559407 - RNA, 14 nt, Pseudomonas aeruginosa PA01
caccagcgucgcca

SEQ ID NO: 1559408 - RNA, 17 nt, Pseudomonas aeruginosa PA01
caccagcgucgccaggc

SEQ ID NO: 1559409 - RNA, 19 nt, Pseudomonas aeruginosa PA01
caccagcgugggcaacagg

SEQ ID NO: 1559410 - RNA, 17 nt, Pseudomonas aeruginosa PA01
caccagcguggcgcgca

SEQ ID NO: 1559411 - RNA, 21 nt, Pseudomonas aeruginosa PA01
caccagcggaccgucgggcag

SEQ ID NO: 1559412 - RNA, 20 nt, Pseudomonas aeruginosa PA01
caccagcggcgagcaggcga

SEQ ID NO: 1559413 - RNA, 17 nt, Pseudomonas aeruginosa PA01
caccaccagcgcgcgcu

SEQ ID NO: 1559414 - RNA, 14 nt, Pseudomonas aeruginosa PA01
caccaccagcgccg

SEQ ID NO: 1559415 - RNA, 17 nt, Pseudomonas aeruginosa PA01
caccaccagcgccgcca

SEQ ID NO: 1559416 - RNA, 18 nt, Pseudomonas aeruginosa PA01
caccaccagcgccgccac

SEQ ID NO: 1559417 - RNA, 13 nt, Pseudomonas aeruginosa PA01
caccaccagcagg

SEQ ID NO: 1559418 - RNA, 23 nt, Pseudomonas aeruginosa PA01
caccaccagcaucagcaggaagc

SEQ ID NO: 1559419 - RNA, 13 nt, Pseudomonas aeruginosa PA01
caccaccacgccg

SEQ ID NO: 1559420 - RNA, 16 nt, Pseudomonas aeruginosa PA01
caccaccaccgcgccg

SEQ ID NO: 1559421 - RNA, 21 nt, Pseudomonas aeruginosa PA01
caccacgcgauauccgccagg

SEQ ID NO: 1559422 - RNA, 22 nt, Pseudomonas aeruginosa PA01
caccacgcgauauccgccaggc

SEQ ID NO: 1559423 - RNA, 19 nt, Pseudomonas aeruginosa PA01
caccacgccgucgccgcug

SEQ ID NO: 1559424 - RNA, 14 nt, Pseudomonas aeruginosa PA01
caccacgaucaggc

SEQ ID NO: 1559425 - RNA, 16 nt, Pseudomonas aeruginosa PA01
caccacgaucaggccc

SEQ ID NO: 1559426 - RNA, 17 nt, Pseudomonas aeruginosa PA01
caccacucgccagcgcg

SEQ ID NO: 1559427 - RNA, 20 nt, Pseudomonas aeruginosa PA01
caccacugcaacacuuccuu

SEQ ID NO: 1559428 - RNA, 12 nt, Pseudomonas aeruginosa PA01
caccagcaauug

SEQ ID NO: 1559429 - RNA, 14 nt, Pseudomonas aeruginosa PA01
caccagagccagcc

SEQ ID NO: 1559430 - RNA, 20 nt, Pseudomonas aeruginosa PA01
caccagcaaacgggacaggu

SEQ ID NO: 1559431 - RNA, 19 nt, Pseudomonas aeruginosa PA01
cacacgaauggcuucuuga

SEQ ID NO: 1559432 - RNA, 14 nt, Pseudomonas aeruginosa PA01
cacacaugcagguc

SEQ ID NO: 1559433 - RNA, 13 nt, Pseudomonas aeruginosa PA01
cacacgcccggca

SEQ ID NO: 1559434 - RNA, 16 nt, Pseudomonas aeruginosa PA01
cacaaugaaaaaggga

SEQ ID NO: 1559435 - RNA, 17 nt, Pseudomonas aeruginosa PA01
cacacuguccagggcga

SEQ ID NO: 1559436 - RNA, 22 nt, Pseudomonas aeruginosa PA01
cacaaccagccaugcaggcugc

SEQ ID NO: 1559437 - RNA, 13 nt, Pseudomonas aeruginosa PA01
caauucuucaagg

SEQ ID NO: 1559438 - RNA, 15 nt, Pseudomonas aeruginosa PA01
augauuucguuggcc

SEQ ID NO: 1559439 - RNA, 23 nt, Pseudomonas aeruginosa PA01
augauuucguuggcccagaccuu

SEQ ID NO: 1559440 - RNA, 17 nt, Pseudomonas aeruginosa PA01
augauggucaacaccag

SEQ ID NO: 1559441 - RNA, 18 nt, Pseudomonas aeruginosa PA01
augauggucaacaccagc

SEQ ID NO: 1559442 - RNA, 18 nt, Pseudomonas aeruginosa PA01
augaugugcgcaggcugg

SEQ ID NO: 1559443 - RNA, 16 nt, Pseudomonas aeruginosa PA01
augauggugccgccgg

SEQ ID NO: 1559444 - RNA, 22 nt, Pseudomonas aeruginosa PA01
augaugccgcggcgauaggcgc

SEQ ID NO: 1559445 - RNA, 17 nt, Pseudomonas aeruginosa PA01
augaugcgcccggagcu

SEQ ID NO: 1559446 - RNA, 20 nt, Pseudomonas aeruginosa PA01
augaugacgagggacugaag

SEQ ID NO: 1559447 - RNA, 21 nt, Pseudomonas aeruginosa PA01
augaucuccaggucgcccugc

SEQ ID NO: 1559448 - RNA, 15 nt, Pseudomonas aeruginosa PA01
augccgcuagcccug

SEQ ID NO: 1559449 - RNA, 23 nt, Pseudomonas aeruginosa PA01
augccgcgcgccuggcuggccag

SEQ ID NO: 1559450 - RNA, 14 nt, Pseudomonas aeruginosa PA01
augccgcgccaggc

SEQ ID NO: 1559451 - RNA, 18 nt, Pseudomonas aeruginosa PA01
augccuuucggggugcag

SEQ ID NO: 1559452 - RNA, 18 nt, Pseudomonas aeruginosa PA01
augccugcuuucccugcu

SEQ ID NO: 1559453 - RNA, 20 nt, Pseudomonas aeruginosa PA01
augccugugcaccgaaggga

SEQ ID NO: 1559454 - RNA, 21 nt, Pseudomonas aeruginosa PA01
augcgccccagcgccugggcc

SEQ ID NO: 1559455 - RNA, 18 nt, Pseudomonas aeruginosa PA01
augcgccagcggcccggc

SEQ ID NO: 1559456 - RNA, 19 nt, Pseudomonas aeruginosa PA01
augcgccagcggcccggca

SEQ ID NO: 1559457 - RNA, 19 nt, Pseudomonas aeruginosa PA01
augccaucgaggccaggcc

SEQ ID NO: 1559458 - RNA, 13 nt, Pseudomonas aeruginosa PA01
augccgcaggcag

SEQ ID NO: 1559459 - RNA, 14 nt, Pseudomonas aeruginosa PA01
augccgcccagcac

SEQ ID NO: 1559460 - RNA, 14 nt, Pseudomonas aeruginosa PA01
augccgcacaggcu

SEQ ID NO: 1559461 - RNA, 20 nt, Pseudomonas aeruginosa PA01
augccgcacaggcuggccag

SEQ ID NO: 1559462 - RNA, 15 nt, Pseudomonas aeruginosa PA01
augccgaucucgccc

SEQ ID NO: 1559463 - RNA, 15 nt, Pseudomonas aeruginosa PA01
augccgaugacaugg

SEQ ID NO: 1559464 - RNA, 21 nt, Pseudomonas aeruginosa PA01
augcagcaacccggcccagcg

SEQ ID NO: 1559465 - RNA, 15 nt, Pseudomonas aeruginosa PA01
augcagcagguagug

SEQ ID NO: 1559466 - RNA, 17 nt, Pseudomonas aeruginosa PA01
augcacacgcucccaac

SEQ ID NO: 1559467 - RNA, 18 nt, Pseudomonas aeruginosa PA01
augcacacgcucccaaca

SEQ ID NO: 1559468 - RNA, 22 nt, Pseudomonas aeruginosa PA01
augcacaggcguaccagcuugu

SEQ ID NO: 1559469 - RNA, 17 nt, Pseudomonas aeruginosa PA01
augccaaguugccuggc

SEQ ID NO: 1559470 - RNA, 23 nt, Pseudomonas aeruginosa PA01
augcugcucggcauucgacccgc

SEQ ID NO: 1559471 - RNA, 13 nt, Pseudomonas aeruginosa PA01
augcugcgcggga

SEQ ID NO: 1559472 - RNA, 22 nt, Pseudomonas aeruginosa PA01
augcugcgggcgccgccgcugg

SEQ ID NO: 1559473 - RNA, 13 nt, Pseudomonas aeruginosa PA01
augcugccacccg

SEQ ID NO: 1559474 - RNA, 19 nt, Pseudomonas aeruginosa PA01
augcugcccggagcggcug

SEQ ID NO: 1559475 - RNA, 14 nt, Pseudomonas aeruginosa PA01
augcucggccaggu

SEQ ID NO: 1559476 - RNA, 18 nt, Pseudomonas aeruginosa PA01
augcucgguugccaggcc

SEQ ID NO: 1559477 - RNA, 13 nt, Pseudomonas aeruginosa PA01
augcucggccagc

SEQ ID NO: 1559478 - RNA, 19 nt, Pseudomonas aeruginosa PA01
augcgcgugguaucggcgc

SEQ ID NO: 1559479 - RNA, 16 nt, Pseudomonas aeruginosa PA01
augcgcgcggcgaggg

SEQ ID NO: 1559480 - RNA, 17 nt, Pseudomonas aeruginosa PA01
augcgcggcagcaggcg

SEQ ID NO: 1559481 - RNA, 16 nt, Pseudomonas aeruginosa PA01
augcuguuccucgucg

SEQ ID NO: 1559482 - RNA, 14 nt, Pseudomonas aeruginosa PA01
augcugugcaggga

SEQ ID NO: 1559483 - RNA, 16 nt, Pseudomonas aeruginosa PA01
augcuuagcccgggau

SEQ ID NO: 1559484 - RNA, 22 nt, Pseudomonas aeruginosa PA01
augcuuucgaagcgcucccaga

SEQ ID NO: 1559485 - RNA, 22 nt, Pseudomonas aeruginosa PA01
auggagcacagccauuucugcu

SEQ ID NO: 1559486 - RNA, 23 nt, Pseudomonas aeruginosa PA01
auggaucggcaacuggcuggccu

SEQ ID NO: 1559487 - RNA, 15 nt, Pseudomonas aeruginosa PA01
auggaacugcagggc

SEQ ID NO: 1559488 - RNA, 18 nt, Pseudomonas aeruginosa PA01
auggaacagcagccaggc

SEQ ID NO: 1559489 - RNA, 19 nt, Pseudomonas aeruginosa PA01
auggaacagcagccaggcg

SEQ ID NO: 1559490 - RNA, 19 nt, Pseudomonas aeruginosa PA01
auggacagcuuggccagca

SEQ ID NO: 1559491 - RNA, 16 nt, Pseudomonas aeruginosa PA01
auggacaggcgccccu

SEQ ID NO: 1559492 - RNA, 21 nt, Pseudomonas aeruginosa PA01
auggacaggcgccccuggucc

SEQ ID NO: 1559493 - RNA, 15 nt, Pseudomonas aeruginosa PA01
augcuuuugaacacc

SEQ ID NO: 1559494 - RNA, 15 nt, Pseudomonas aeruginosa PA01
auggccccuccaccu

SEQ ID NO: 1559495 - RNA, 16 nt, Pseudomonas aeruginosa PA01
auggccguccaggcug

SEQ ID NO: 1559496 - RNA, 17 nt, Pseudomonas aeruginosa PA01
auggccguccaggcugc

SEQ ID NO: 1559497 - RNA, 14 nt, Pseudomonas aeruginosa PA01
auggccguccucgu

SEQ ID NO: 1559498 - RNA, 16 nt, Pseudomonas aeruginosa PA01
auggcuaaacaagcca

SEQ ID NO: 1559499 - RNA, 15 nt, Pseudomonas aeruginosa PA01
auggccgccagcagg

SEQ ID NO: 1559500 - RNA, 18 nt, Pseudomonas aeruginosa PA01
auggccgccagcaggccg

SEQ ID NO: 1559501 - RNA, 22 nt, Pseudomonas aeruginosa PA01
auggcccguuccaccgccugga

SEQ ID NO: 1559502 - RNA, 13 nt, Pseudomonas aeruginosa PA01
auggcccagauga

SEQ ID NO: 1559503 - RNA, 14 nt, Pseudomonas aeruginosa PA01
auggcccagaugau

SEQ ID NO: 1559504 - RNA, 15 nt, Pseudomonas aeruginosa PA01
auggcagcaggcaca

SEQ ID NO: 1559505 - RNA, 16 nt, Pseudomonas aeruginosa PA01
auggcagccuuggcca

SEQ ID NO: 1559506 - RNA, 17 nt, Pseudomonas aeruginosa PA01
auggguucccagcagca

SEQ ID NO: 1559507 - RNA, 18 nt, Pseudomonas aeruginosa PA01
auggguucccagcagcaa

SEQ ID NO: 1559508 - RNA, 18 nt, Pseudomonas aeruginosa PA01
augggcgagaccggggau

SEQ ID NO: 1559509 - RNA, 22 nt, Pseudomonas aeruginosa PA01
augggcgcgcgccgggcucagc

SEQ ID NO: 1559510 - RNA, 23 nt, Pseudomonas aeruginosa PA01
augggcgcguucucccugagccu

SEQ ID NO: 1559511 - RNA, 15 nt, Pseudomonas aeruginosa PA01
auggcuguagggaca

SEQ ID NO: 1559512 - RNA, 19 nt, Pseudomonas aeruginosa PA01
auggugcgcuuaaagcaac

SEQ ID NO: 1559513 - RNA, 19 nt, Pseudomonas aeruginosa PA01
auggugcccagcaggcugc

SEQ ID NO: 1559514 - RNA, 21 nt, Pseudomonas aeruginosa PA01
auggugggcucuaugcaaugg

SEQ ID NO: 1559515 - RNA, 22 nt, Pseudomonas aeruginosa PA01
augguugccguacuucagggug

SEQ ID NO: 1559516 - RNA, 16 nt, Pseudomonas aeruginosa PA01
auguacagggucuugc

SEQ ID NO: 1559517 - RNA, 19 nt, Pseudomonas aeruginosa PA01
augucgcacuggucggcca

SEQ ID NO: 1559518 - RNA, 16 nt, Pseudomonas aeruginosa PA01
augucgcgggcaugcu

SEQ ID NO: 1559519 - RNA, 14 nt, Pseudomonas aeruginosa PA01
augucgcuggccag

SEQ ID NO: 1559520 - RNA, 12 nt, Pseudomonas aeruginosa PA01
augucugcaacc

SEQ ID NO: 1559521 - RNA, 22 nt, Pseudomonas aeruginosa PA01
auguggccgucgcgccgcggaa

SEQ ID NO: 1559522 - RNA, 15 nt, Pseudomonas aeruginosa PA01
augugccaggccugg

SEQ ID NO: 1559523 - RNA, 16 nt, Pseudomonas aeruginosa PA01
augugcguauggaucu

SEQ ID NO: 1559524 - RNA, 17 nt, Pseudomonas aeruginosa PA01
augugcgcggugacgac

SEQ ID NO: 1559525 - RNA, 19 nt, Pseudomonas aeruginosa PA01
auguuccaaggugcugccg

SEQ ID NO: 1559526 - RNA, 14 nt, Pseudomonas aeruginosa PA01
auguucgccgccgc

SEQ ID NO: 1559527 - RNA, 17 nt, Pseudomonas aeruginosa PA01
auguucgaaggccaguc

SEQ ID NO: 1559528 - RNA, 17 nt, Pseudomonas aeruginosa PA01
auguugacgauggccca

SEQ ID NO: 1559529 - RNA, 20 nt, Pseudomonas aeruginosa PA01
auucaaguguuagagguuga

SEQ ID NO: 1559530 - RNA, 21 nt, Pseudomonas aeruginosa PA01
aaaagcccagguggcaggccu

SEQ ID NO: 1559531 - RNA, 15 nt, Pseudomonas aeruginosa PA01
auuacuuggcuucag

SEQ ID NO: 1559532 - RNA, 17 nt, Pseudomonas aeruginosa PA01
aaaagccggaagcgcuc

SEQ ID NO: 1559533 - RNA, 21 nt, Pseudomonas aeruginosa PA01
aaaagccggaagcgcucgcgc

SEQ ID NO: 1559534 - RNA, 14 nt, Pseudomonas aeruginosa PA01
auucaucggcggca

SEQ ID NO: 1559535 - RNA, 21 nt, Pseudomonas aeruginosa PA01
auuccacgucgccgaccaggc

SEQ ID NO: 1559536 - RNA, 18 nt, Pseudomonas aeruginosa PA01
auuccaugggcagacgau

SEQ ID NO: 1559537 - RNA, 19 nt, Pseudomonas aeruginosa PA01
auucccgccgcuccggcug

SEQ ID NO: 1559538 - RNA, 13 nt, Pseudomonas aeruginosa PA01
auuccuuccaggg

SEQ ID NO: 1559539 - RNA, 18 nt, Pseudomonas aeruginosa PA01
auuccuuccaggguuucc

SEQ ID NO: 1559540 - RNA, 14 nt, Pseudomonas aeruginosa PA01
auuccuacgaaggu

SEQ ID NO: 1559541 - RNA, 14 nt, Pseudomonas aeruginosa PA01
auucguccagccgc

SEQ ID NO: 1559542 - RNA, 15 nt, Pseudomonas aeruginosa PA01
auucguccagccgcc

SEQ ID NO: 1559543 - RNA, 17 nt, Pseudomonas aeruginosa PA01
auucgucgcugcacgca

SEQ ID NO: 1559544 - RNA, 15 nt, Pseudomonas aeruginosa PA01
auucgcugucagggc

SEQ ID NO: 1559545 - RNA, 20 nt, Pseudomonas aeruginosa PA01
auucuucaugggacaaacga

SEQ ID NO: 1559546 - RNA, 22 nt, Pseudomonas aeruginosa PA01
auugcaccgcuugccagccgcu

SEQ ID NO: 1559547 - RNA, 15 nt, Pseudomonas aeruginosa PA01
auugcacaacgggug

SEQ ID NO: 1559548 - RNA, 14 nt, Pseudomonas aeruginosa PA01
auugcagcgucgac

SEQ ID NO: 1559549 - RNA, 15 nt, Pseudomonas aeruginosa PA01
auugcagcuccuggu

SEQ ID NO: 1559550 - RNA, 21 nt, Pseudomonas aeruginosa PA01
auugcaggcccggccgccugc

SEQ ID NO: 1559551 - RNA, 16 nt, Pseudomonas aeruginosa PA01
auugaugcaaggacuu

SEQ ID NO: 1559552 - RNA, 17 nt, Pseudomonas aeruginosa PA01
auugaugaagcgcugcu

SEQ ID NO: 1559553 - RNA, 19 nt, Pseudomonas aeruginosa PA01
auugccgggcuuccuggcc

SEQ ID NO: 1559554 - RNA, 15 nt, Pseudomonas aeruginosa PA01
auugcuacagcaauu

SEQ ID NO: 1559555 - RNA, 18 nt, Pseudomonas aeruginosa PA01
auugcguaacguuacgca

SEQ ID NO: 1559556 - RNA, 16 nt, Pseudomonas aeruginosa PA01
auugcccggccaggcg

SEQ ID NO: 1559557 - RNA, 19 nt, Pseudomonas aeruginosa PA01
auugcccgguggccuccug

SEQ ID NO: 1559558 - RNA, 16 nt, Pseudomonas aeruginosa PA01
aaaagggagccaggcg

SEQ ID NO: 1559559 - RNA, 19 nt, Pseudomonas aeruginosa PA01
auuggcggaugagccgcug

SEQ ID NO: 1559560 - RNA, 12 nt, Pseudomonas aeruginosa PA01
auugcugggugc

SEQ ID NO: 1559561 - RNA, 16 nt, Pseudomonas aeruginosa PA01
auuguccaccggcccg

SEQ ID NO: 1559562 - RNA, 17 nt, Pseudomonas aeruginosa PA01
auuuuucuaaaauggcu

SEQ ID NO: 1559563 - RNA, 14 nt, Pseudomonas aeruginosa PA01
auuuucauugccuc

SEQ ID NO: 1559564 - RNA, 19 nt, Pseudomonas aeruginosa PA01
auuuguuuuaaaguucgac

SEQ ID NO: 1559565 - RNA, 23 nt, Pseudomonas aeruginosa PA01
aaaagugcccccggcaacacccu

SEQ ID NO: 1559566 - RNA, 22 nt, Pseudomonas aeruginosa PA01
auuucguuggcccagaccuugg

SEQ ID NO: 1559567 - RNA, 15 nt, Pseudomonas aeruginosa PA01
auuuccgcgcccggc

SEQ ID NO: 1559568 - RNA, 13 nt, Pseudomonas aeruginosa PA01
auuucccgcagua

SEQ ID NO: 1559569 - RNA, 18 nt, Pseudomonas aeruginosa PA01
auuuccgauccuccuggg

SEQ ID NO: 1559570 - RNA, 19 nt, Pseudomonas aeruginosa PA01
auuuccccaaggcacgccc

SEQ ID NO: 1559571 - RNA, 16 nt, Pseudomonas aeruginosa PA01
auuuccccaacaucaa

SEQ ID NO: 1559572 - RNA, 18 nt, Pseudomonas aeruginosa PA01
auuuccccaacaucaacc

SEQ ID NO: 1559573 - RNA, 14 nt, Pseudomonas aeruginosa PA01
cagcucggcgcccu

SEQ ID NO: 1559574 - RNA, 15 nt, Pseudomonas aeruginosa PA01
cagcucggcgcccug

SEQ ID NO: 1559575 - RNA, 16 nt, Pseudomonas aeruginosa PA01
cagcucggcgcccugg

SEQ ID NO: 1559576 - RNA, 17 nt, Pseudomonas aeruginosa PA01
cagcucggcgcccuggc

SEQ ID NO: 1559577 - RNA, 21 nt, Pseudomonas aeruginosa PA01
cagcucggcgcccuggccgcc

SEQ ID NO: 1559578 - RNA, 20 nt, Pseudomonas aeruginosa PA01
cagcucggccggcaggcugu

SEQ ID NO: 1559579 - RNA, 15 nt, Pseudomonas aeruginosa PA01
cagcucggccugguc

SEQ ID NO: 1559580 - RNA, 21 nt, Pseudomonas aeruginosa PA01
cagcucggccugguccggcac

SEQ ID NO: 1559581 - RNA, 23 nt, Pseudomonas aeruginosa PA01
cagcucggcgaguaaccaccgcu

SEQ ID NO: 1559582 - RNA, 22 nt, Pseudomonas aeruginosa PA01
cagcucguggcuggcgccgcgg

SEQ ID NO: 1559583 - RNA, 17 nt, Pseudomonas aeruginosa PA01
cagcucggugaggaacu

SEQ ID NO: 1559584 - RNA, 14 nt, Pseudomonas aeruginosa PA01
cagcucguccaggc

SEQ ID NO: 1559585 - RNA, 20 nt, Pseudomonas aeruginosa PA01
cagcucguccaggcaagcgc

SEQ ID NO: 1559586 - RNA, 21 nt, Pseudomonas aeruginosa PA01
cagcucggucucgaucggccc

SEQ ID NO: 1559587 - RNA, 18 nt, Pseudomonas aeruginosa PA01
cagcucggcgggacggcg

SEQ ID NO: 1559588 - RNA, 15 nt, Pseudomonas aeruginosa PA01
cagcucgucgagcug

SEQ ID NO: 1559589 - RNA, 17 nt, Pseudomonas aeruginosa PA01
cagcucgucgagcugcu

SEQ ID NO: 1559590 - RNA, 16 nt, Pseudomonas aeruginosa PA01
cagcucgucgcccuuc

SEQ ID NO: 1559591 - RNA, 19 nt, Pseudomonas aeruginosa PA01
cagcugcaccgcgcggauc

SEQ ID NO: 1559592 - RNA, 13 nt, Pseudomonas aeruginosa PA01
cagcugccagccc

SEQ ID NO: 1559593 - RNA, 15 nt, Pseudomonas aeruginosa PA01
cagcugccagccccg

SEQ ID NO: 1559594 - RNA, 15 nt, Pseudomonas aeruginosa PA01
cagcugccagugcuc

SEQ ID NO: 1559595 - RNA, 19 nt, Pseudomonas aeruginosa PA01
cagcugcggcggcaccacg

SEQ ID NO: 1559596 - RNA, 24 nt, Pseudomonas aeruginosa PA01
cagcuggauccgugccaggcgcuc

SEQ ID NO: 1559597 - RNA, 21 nt, Pseudomonas aeruginosa PA01
caggaagcgucgugcgccggc

SEQ ID NO: 1559598 - RNA, 18 nt, Pseudomonas aeruginosa PA01
caggaagcugacgaacau

SEQ ID NO: 1559599 - RNA, 14 nt, Pseudomonas aeruginosa PA01
caggaagagcaggc

SEQ ID NO: 1559600 - RNA, 22 nt, Pseudomonas aeruginosa PA01
caggaagccgcgccccagcggc

SEQ ID NO: 1559601 - RNA, 16 nt, Pseudomonas aeruginosa PA01
caggaagaagccucgc

SEQ ID NO: 1559602 - RNA, 23 nt, Pseudomonas aeruginosa PA01
caggaacucgaucagcgcggcca

SEQ ID NO: 1559603 - RNA, 16 nt, Pseudomonas aeruginosa PA01
caggaaaacgcucagg

SEQ ID NO: 1559604 - RNA, 18 nt, Pseudomonas aeruginosa PA01
caggaaauccgccgcgca

SEQ ID NO: 1559605 - RNA, 17 nt, Pseudomonas aeruginosa PA01
caggaaaucgagcgcca

SEQ ID NO: 1559606 - RNA, 19 nt, Pseudomonas aeruginosa PA01
caggaaaucgagcgccagg

SEQ ID NO: 1559607 - RNA, 14 nt, Pseudomonas aeruginosa PA01
cagcuucugcaggg

SEQ ID NO: 1559608 - RNA, 19 nt, Pseudomonas aeruginosa PA01
cagcuucuccagcaggguc

SEQ ID NO: 1559609 - RNA, 16 nt, Pseudomonas aeruginosa PA01
cagcuucuucugcagc

SEQ ID NO: 1559610 - RNA, 13 nt, Pseudomonas aeruginosa PA01
cagcuuguccacg

SEQ ID NO: 1559611 - RNA, 16 nt, Pseudomonas aeruginosa PA01
cagcuucgccgcccug

SEQ ID NO: 1559612 - RNA, 22 nt, Pseudomonas aeruginosa PA01
cagcuggcgcguugugccgcca

SEQ ID NO: 1559613 - RNA, 16 nt, Pseudomonas aeruginosa PA01
caggaugcgaugcugu

SEQ ID NO: 1559614 - RNA, 18 nt, Pseudomonas aeruginosa PA01
caggaucgucggcccgca

SEQ ID NO: 1559615 - RNA, 16 nt, Pseudomonas aeruginosa PA01
caggaugcugcacagc

SEQ ID NO: 1559616 - RNA, 21 nt, Pseudomonas aeruginosa PA01
caggagugugggacaggaaga

SEQ ID NO: 1559617 - RNA, 21 nt, Pseudomonas aeruginosa PA01
caggagugauauuagcgauuc

SEQ ID NO: 1559618 - RNA, 19 nt, Pseudomonas aeruginosa PA01
caggaucggagagacccgc

SEQ ID NO: 1559619 - RNA, 15 nt, Pseudomonas aeruginosa PA01
caggaucggcgccca

SEQ ID NO: 1559620 - RNA, 18 nt, Pseudomonas aeruginosa PA01
caggaucgccuccaccag

SEQ ID NO: 1559621 - RNA, 19 nt, Pseudomonas aeruginosa PA01
caggaucgccuccaccagc

SEQ ID NO: 1559622 - RNA, 16 nt, Pseudomonas aeruginosa PA01
caggaucgacagcagc

SEQ ID NO: 1559623 - RNA, 19 nt, Pseudomonas aeruginosa PA01
caggaucgacagcagcgcc

SEQ ID NO: 1559624 - RNA, 19 nt, Pseudomonas aeruginosa PA01
caggaucgaccccgccggg

SEQ ID NO: 1559625 - RNA, 18 nt, Pseudomonas aeruginosa PA01
caggaauuccuggccggu

SEQ ID NO: 1559626 - RNA, 17 nt, Pseudomonas aeruginosa PA01
caggacagcacgcucag

SEQ ID NO: 1559627 - RNA, 23 nt, Pseudomonas aeruginosa PA01
caggacagcacgcucaggcagcg

SEQ ID NO: 1559628 - RNA, 19 nt, Pseudomonas aeruginosa PA01
caggacaacgacagccccg

SEQ ID NO: 1559629 - RNA, 22 nt, Pseudomonas aeruginosa PA01
caggaccaggaucgaccccgcc

SEQ ID NO: 1559630 - RNA, 14 nt, Pseudomonas aeruginosa PA01
caggaccaucggca

SEQ ID NO: 1559631 - RNA, 16 nt, Pseudomonas aeruginosa PA01
caggacccagaugauc

SEQ ID NO: 1559632 - RNA, 17 nt, Pseudomonas aeruginosa PA01
caggacccaucgaugcu

SEQ ID NO: 1559633 - RNA, 19 nt, Pseudomonas aeruginosa PA01
caggaccacgcuggucacc

SEQ ID NO: 1559634 - RNA, 21 nt, Pseudomonas aeruginosa PA01
caggacccuuccagcgugugg

SEQ ID NO: 1559635 - RNA, 13 nt, Pseudomonas aeruginosa PA01
caggaccuggccg

SEQ ID NO: 1559636 - RNA, 16 nt, Pseudomonas aeruginosa PA01
caggaccuggcugagg

SEQ ID NO: 1559637 - RNA, 14 nt, Pseudomonas aeruginosa PA01
caggaccuccugca

SEQ ID NO: 1559638 - RNA, 21 nt, Pseudomonas aeruginosa PA01
caggaccuccugcacauagug

SEQ ID NO: 1559639 - RNA, 13 nt, Pseudomonas aeruginosa PA01
caggaccgcgaug

SEQ ID NO: 1559640 - RNA, 22 nt, Pseudomonas aeruginosa PA01
caggaccuugucgcgcaccaca

SEQ ID NO: 1559641 - RNA, 23 nt, Pseudomonas aeruginosa PA01
caggaccuucagauacuccagca

SEQ ID NO: 1559642 - RNA, 14 nt, Pseudomonas aeruginosa PA01
caggaccuuccgcc

SEQ ID NO: 1559643 - RNA, 19 nt, Pseudomonas aeruginosa PA01
caggaccuuccgccagcag

SEQ ID NO: 1559644 - RNA, 21 nt, Pseudomonas aeruginosa PA01
caggaccuuccgccagcaggc

SEQ ID NO: 1559645 - RNA, 19 nt, Pseudomonas aeruginosa PA01
caggaggaucgccaggacg

SEQ ID NO: 1559646 - RNA, 13 nt, Pseudomonas aeruginosa PA01
caggagggcugcu

SEQ ID NO: 1559647 - RNA, 17 nt, Pseudomonas aeruginosa PA01
caggcaaucucccccuc

SEQ ID NO: 1559648 - RNA, 23 nt, Pseudomonas aeruginosa PA01
caggcaagcgcaugaggcuggcc

SEQ ID NO: 1559649 - RNA, 12 nt, Pseudomonas aeruginosa PA01
caggcacagggc

SEQ ID NO: 1559650 - RNA, 22 nt, Pseudomonas aeruginosa PA01
caggcacagggcgacuaccagg

SEQ ID NO: 1559651 - RNA, 20 nt, Pseudomonas aeruginosa PA01
caggcaaaaagaaaccccgc

SEQ ID NO: 1559652 - RNA, 21 nt, Pseudomonas aeruginosa PA01
caggauuucuccugcggucgg

SEQ ID NO: 1559653 - RNA, 14 nt, Pseudomonas aeruginosa PA01
caggcagugccggg

SEQ ID NO: 1559654 - RNA, 18 nt, Pseudomonas aeruginosa PA01
caggcaguggcgccagcc

SEQ ID NO: 1559655 - RNA, 16 nt, Pseudomonas aeruginosa PA01
caggcagugugcaccg

SEQ ID NO: 1559656 - RNA, 16 nt, Pseudomonas aeruginosa PA01
caggcauugccguccg

SEQ ID NO: 1559657 - RNA, 14 nt, Pseudomonas aeruginosa PA01
caggcaggccuggg

SEQ ID NO: 1559658 - RNA, 23 nt, Pseudomonas aeruginosa PA01
caggcagucccagaaggccaggg

SEQ ID NO: 1559659 - RNA, 14 nt, Pseudomonas aeruginosa PA01
caggcaggcauggu

SEQ ID NO: 1559660 - RNA, 14 nt, Pseudomonas aeruginosa PA01
caggcagcgccgcc

SEQ ID NO: 1559661 - RNA, 19 nt, Pseudomonas aeruginosa PA01
caggcagcgcgcggccagu

SEQ ID NO: 1559662 - RNA, 15 nt, Pseudomonas aeruginosa PA01
caggcacggaagcgc

SEQ ID NO: 1559663 - RNA, 17 nt, Pseudomonas aeruginosa PA01
caggcacggcuucagcg

SEQ ID NO: 1559664 - RNA, 22 nt, Pseudomonas aeruginosa PA01
caggcacggcuucagcgccagg

SEQ ID NO: 1559665 - RNA, 22 nt, Pseudomonas aeruginosa PA01
caggcagaccugcagcaggauc

SEQ ID NO: 1559666 - RNA, 14 nt, Pseudomonas aeruginosa PA01
caggcagaccaggc

SEQ ID NO: 1559667 - RNA, 18 nt, Pseudomonas aeruginosa PA01
caggcagaucgcgccgag

SEQ ID NO: 1559668 - RNA, 15 nt, Pseudomonas aeruginosa PA01
caggcgccggccucg

SEQ ID NO: 1559669 - RNA, 23 nt, Pseudomonas aeruginosa PA01
caggcgccgcucgaugcccgcca

SEQ ID NO: 1559670 - RNA, 23 nt, Pseudomonas aeruginosa PA01
caggcgcgccuggaucagcgccu

SEQ ID NO: 1559671 - RNA, 16 nt, Pseudomonas aeruginosa PA01
caggcgcgccuggccc

SEQ ID NO: 1559672 - RNA, 15 nt, Pseudomonas aeruginosa PA01
caggcgcgccgugcg

SEQ ID NO: 1559673 - RNA, 21 nt, Pseudomonas aeruginosa PA01
caggcgcgcggucuucaucac

SEQ ID NO: 1559674 - RNA, 17 nt, Pseudomonas aeruginosa PA01
caggcgcggcgucgggc

SEQ ID NO: 1559675 - RNA, 16 nt, Pseudomonas aeruginosa PA01
caggcgcucagggaaa

SEQ ID NO: 1559676 - RNA, 20 nt, Pseudomonas aeruginosa PA01
caggcgcgggucaucggccc

SEQ ID NO: 1559677 - RNA, 17 nt, Pseudomonas aeruginosa PA01
caggcgcgucuccagcu

SEQ ID NO: 1559678 - RNA, 19 nt, Pseudomonas aeruginosa PA01
caggcgcucucgccgccuu

SEQ ID NO: 1559679 - RNA, 16 nt, Pseudomonas aeruginosa PA01
caggcgcuccuccagc

SEQ ID NO: 1559680 - RNA, 16 nt, Pseudomonas aeruginosa PA01
caggcgcuccuggagg

SEQ ID NO: 1559681 - RNA, 19 nt, Pseudomonas aeruginosa PA01
caggcgcuccuugagcagc

SEQ ID NO: 1559682 - RNA, 17 nt, Pseudomonas aeruginosa PA01
caggcgcucggcggcgc

SEQ ID NO: 1559683 - RNA, 20 nt, Pseudomonas aeruginosa PA01
caggcgcucggcggcgcgca

SEQ ID NO: 1559684 - RNA, 22 nt, Pseudomonas aeruginosa PA01
caggcgcaucaggccaaagccg

SEQ ID NO: 1559685 - RNA, 14 nt, Pseudomonas aeruginosa PA01
caggcgccccuggu

SEQ ID NO: 1559686 - RNA, 21 nt, Pseudomonas aeruginosa PA01
caggcgcccuggccgucggcc

SEQ ID NO: 1559687 - RNA, 22 nt, Pseudomonas aeruginosa PA01
caggcgcccuggccgucggccu

SEQ ID NO: 1559688 - RNA, 17 nt, Pseudomonas aeruginosa PA01
caggcgcccaggcagca

SEQ ID NO: 1559689 - RNA, 17 nt, Pseudomonas aeruginosa PA01
caggcgcccggucaggu

SEQ ID NO: 1559690 - RNA, 23 nt, Pseudomonas aeruginosa PA01
caggcgccgauggcugucggcgc

SEQ ID NO: 1559691 - RNA, 23 nt, Pseudomonas aeruginosa PA01
caggcgcgaacgcucccagccga

SEQ ID NO: 1559692 - RNA, 14 nt, Pseudomonas aeruginosa PA01
caggcgcaugucca

SEQ ID NO: 1559693 - RNA, 18 nt, Pseudomonas aeruginosa PA01
caggcgccagagcgcgcu

SEQ ID NO: 1559694 - RNA, 12 nt, Pseudomonas aeruginosa PA01
caggcgccaggc

SEQ ID NO: 1559695 - RNA, 16 nt, Pseudomonas aeruginosa PA01
caggcgacggucaggc

SEQ ID NO: 1559696 - RNA, 22 nt, Pseudomonas aeruginosa PA01
caggcgauagccgaccaggccg

SEQ ID NO: 1559697 - RNA, 22 nt, Pseudomonas aeruginosa PA01
caggcgacguuuuucccguggg

SEQ ID NO: 1559698 - RNA, 15 nt, Pseudomonas aeruginosa PA01
caggccacccgccuc

SEQ ID NO: 1559699 - RNA, 16 nt, Pseudomonas aeruginosa PA01
caggccacccgccucg

SEQ ID NO: 1559700 - RNA, 19 nt, Pseudomonas aeruginosa PA01
caggccaccgguggacugg

SEQ ID NO: 1559701 - RNA, 13 nt, Pseudomonas aeruginosa PA01
caggccuccagca

SEQ ID NO: 1559702 - RNA, 22 nt, Pseudomonas aeruginosa PA01
caggccuccagcaacgccgccc

SEQ ID NO: 1559703 - RNA, 15 nt, Pseudomonas aeruginosa PA01
caggccucccagccg

SEQ ID NO: 1559704 - RNA, 24 nt, Pseudomonas aeruginosa PA01
caggccuuuugguuuucgcuccuc

SEQ ID NO: 1559705 - RNA, 21 nt, Pseudomonas aeruginosa PA01
caggcgaaaaaaagccccgcc

SEQ ID NO: 1559706 - RNA, 17 nt, Pseudomonas aeruginosa PA01
caggcgaaagucggcgc

SEQ ID NO: 1559707 - RNA, 15 nt, Pseudomonas aeruginosa PA01
caggcgaagcggcug

SEQ ID NO: 1559708 - RNA, 14 nt, Pseudomonas aeruginosa PA01
caggcuuuccaccg

SEQ ID NO: 1559709 - RNA, 15 nt, Pseudomonas aeruginosa PA01
caggcuuucguaggc

SEQ ID NO: 1559710 - RNA, 13 nt, Pseudomonas aeruginosa PA01
caggcugacccgg

SEQ ID NO: 1559711 - RNA, 23 nt, Pseudomonas aeruginosa PA01
caggcugacgucgacgcagcgcg

SEQ ID NO: 1559712 - RNA, 18 nt, Pseudomonas aeruginosa PA01
caggcugaggucgcgggc

SEQ ID NO: 1559713 - RNA, 15 nt, Pseudomonas aeruginosa PA01
caggcucgcgaugcu

SEQ ID NO: 1559714 - RNA, 14 nt, Pseudomonas aeruginosa PA01
caggcugccgccgc

SEQ ID NO: 1559715 - RNA, 16 nt, Pseudomonas aeruginosa PA01
caggcugccggccagg

SEQ ID NO: 1559716 - RNA, 17 nt, Pseudomonas aeruginosa PA01
caggcugccggccaggu

SEQ ID NO: 1559717 - RNA, 16 nt, Pseudomonas aeruginosa PA01
caggcucgccgccagc

SEQ ID NO: 1559718 - RNA, 20 nt, Pseudomonas aeruginosa PA01
caggcucgccgccagcagga

SEQ ID NO: 1559719 - RNA, 17 nt, Pseudomonas aeruginosa PA01
caggcucucgcgcagca

SEQ ID NO: 1559720 - RNA, 23 nt, Pseudomonas aeruginosa PA01
caggcgggaguccaggcgggcca

SEQ ID NO: 1559721 - RNA, 16 nt, Pseudomonas aeruginosa PA01
caggcggcuggcgcga

SEQ ID NO: 1559722 - RNA, 20 nt, Pseudomonas aeruginosa PA01
caggcgggcuccgccgccgu

SEQ ID NO: 1559723 - RNA, 13 nt, Pseudomonas aeruginosa PA01
caggcgucggcgc

SEQ ID NO: 1559724 - RNA, 17 nt, Pseudomonas aeruginosa PA01
caggcgugccuguuccu

SEQ ID NO: 1559725 - RNA, 19 nt, Pseudomonas aeruginosa PA01
caggcgugggccagcccag

SEQ ID NO: 1559726 - RNA, 23 nt, Pseudomonas aeruginosa PA01
caggcguuccaccaggcgucgca

SEQ ID NO: 1559727 - RNA, 16 nt, Pseudomonas aeruginosa PA01
caggcguuauccgccg

SEQ ID NO: 1559728 - RNA, 20 nt, Pseudomonas aeruginosa PA01
caggcgcugcgcggccugcg

SEQ ID NO: 1559729 - RNA, 19 nt, Pseudomonas aeruginosa PA01
caggcgcugcucgauggcc

SEQ ID NO: 1559730 - RNA, 21 nt, Pseudomonas aeruginosa PA01
caggcgcugcugguggacguc

SEQ ID NO: 1559731 - RNA, 12 nt, Pseudomonas aeruginosa PA01
caggcgcuggcc

SEQ ID NO: 1559732 - RNA, 20 nt, Pseudomonas aeruginosa PA01
caggcgcuggcgccgaugcu

SEQ ID NO: 1559733 - RNA, 13 nt, Pseudomonas aeruginosa PA01
caggcggaucacc

SEQ ID NO: 1559734 - RNA, 15 nt, Pseudomonas aeruginosa PA01
caggcggaucgccgc

SEQ ID NO: 1559735 - RNA, 17 nt, Pseudomonas aeruginosa PA01
caggcggaucgccgccu

SEQ ID NO: 1559736 - RNA, 19 nt, Pseudomonas aeruginosa PA01
caggcgcuguccuguggcg

SEQ ID NO: 1559737 - RNA, 20 nt, Pseudomonas aeruginosa PA01
caggcgcuugcucuccacua

SEQ ID NO: 1559738 - RNA, 22 nt, Pseudomonas aeruginosa PA01
caggcggaacggcucgcgaccg

SEQ ID NO: 1559739 - RNA, 23 nt, Pseudomonas aeruginosa PA01
caggcggacacgcaggcgccgau

SEQ ID NO: 1559740 - RNA, 18 nt, Pseudomonas aeruginosa PA01
caggcggccguccucggg

SEQ ID NO: 1559741 - RNA, 19 nt, Pseudomonas aeruginosa PA01
caggcggccgucggccugg

SEQ ID NO: 1559742 - RNA, 12 nt, Pseudomonas aeruginosa PA01
cagggcgccggg

SEQ ID NO: 1559743 - RNA, 18 nt, Pseudomonas aeruginosa PA01
cagggcgccgggcugccg

SEQ ID NO: 1559744 - RNA, 23 nt, Pseudomonas aeruginosa PA01
cagggcgccgucgggggcgcgua

SEQ ID NO: 1559745 - RNA, 19 nt, Pseudomonas aeruginosa PA01
cagggcuugcgcgccacca

SEQ ID NO: 1559746 - RNA, 15 nt, Pseudomonas aeruginosa PA01
cagggcuugugcaga

SEQ ID NO: 1559747 - RNA, 18 nt, Pseudomonas aeruginosa PA01
cagggcuugugcagagag

SEQ ID NO: 1559748 - RNA, 21 nt, Pseudomonas aeruginosa PA01
cagggcuugugcagagaggcu

SEQ ID NO: 1559749 - RNA, 22 nt, Pseudomonas aeruginosa PA01
cagggcuugugcagagaggcug

SEQ ID NO: 1559750 - RNA, 18 nt, Pseudomonas aeruginosa PA01
cagggcuucccaggccag

SEQ ID NO: 1559751 - RNA, 23 nt, Pseudomonas aeruginosa PA01
cagggcuucccaggccagcgggc

SEQ ID NO: 1559752 - RNA, 22 nt, Pseudomonas aeruginosa PA01
cagggcgcguccagcuccacca

SEQ ID NO: 1559753 - RNA, 15 nt, Pseudomonas aeruginosa PA01
cagggcgcugagcgc

SEQ ID NO: 1559754 - RNA, 18 nt, Pseudomonas aeruginosa PA01
cagggcugggcgcccuuc

SEQ ID NO: 1559755 - RNA, 21 nt, Pseudomonas aeruginosa PA01
caggguccgcuucagcgcgcc

SEQ ID NO: 1559756 - RNA, 22 nt, Pseudomonas aeruginosa PA01
caggguccgcuucagcgcgccg

SEQ ID NO: 1559757 - RNA, 14 nt, Pseudomonas aeruginosa PA01
cagggucgccagca

SEQ ID NO: 1559758 - RNA, 17 nt, Pseudomonas aeruginosa PA01
cagggucgccagcaggu

SEQ ID NO: 1559759 - RNA, 16 nt, Pseudomonas aeruginosa PA01
cagggucaggcccuug

SEQ ID NO: 1559760 - RNA, 20 nt, Pseudomonas aeruginosa PA01
cagggucaggcccuugagga

SEQ ID NO: 1559761 - RNA, 16 nt, Pseudomonas aeruginosa PA01
cagggucggcaggacc

SEQ ID NO: 1559762 - RNA, 22 nt, Pseudomonas aeruginosa PA01
cagggucgcgccguccaucagg

SEQ ID NO: 1559763 - RNA, 17 nt, Pseudomonas aeruginosa PA01
cagggucagucgagcag

SEQ ID NO: 1559764 - RNA, 17 nt, Pseudomonas aeruginosa PA01
cagggucuccaggacca

SEQ ID NO: 1559765 - RNA, 19 nt, Pseudomonas aeruginosa PA01
cagggucagcuggcgcgcc

SEQ ID NO: 1559766 - RNA, 15 nt, Pseudomonas aeruginosa PA01
cagggucacgccggu

SEQ ID NO: 1559767 - RNA, 20 nt, Pseudomonas aeruginosa PA01
cagggucacgcugggcaggu

SEQ ID NO: 1559768 - RNA, 13 nt, Pseudomonas aeruginosa PA01
cagggucagcagc

SEQ ID NO: 1559769 - RNA, 15 nt, Pseudomonas aeruginosa PA01
caggguagcgccgcg

SEQ ID NO: 1559770 - RNA, 18 nt, Pseudomonas aeruginosa PA01
caggguauagguggugcu

SEQ ID NO: 1559771 - RNA, 21 nt, Pseudomonas aeruginosa PA01
cagggauuccuuggucagguc

SEQ ID NO: 1559772 - RNA, 20 nt, Pseudomonas aeruginosa PA01
cagggcgcaauugcaccgcu

SEQ ID NO: 1559773 - RNA, 15 nt, Pseudomonas aeruginosa PA01
cagggcgcccgcccg

SEQ ID NO: 1559774 - RNA, 19 nt, Pseudomonas aeruginosa PA01
cagggcgaaggccaccauc

SEQ ID NO: 1559775 - RNA, 20 nt, Pseudomonas aeruginosa PA01
cagggcgaagucggcgcgcc

SEQ ID NO: 1559776 - RNA, 24 nt, Pseudomonas aeruginosa PA01
cagggcgaauaccagugccgcggu

SEQ ID NO: 1559777 - RNA, 18 nt, Pseudomonas aeruginosa PA01
cagggcgacgccgaugcu

SEQ ID NO: 1559778 - RNA, 12 nt, Pseudomonas aeruginosa PA01
cagggcgagcag

SEQ ID NO: 1559779 - RNA, 14 nt, Pseudomonas aeruginosa PA01
cagggcgagcaggg

SEQ ID NO: 1559780 - RNA, 16 nt, Pseudomonas aeruginosa PA01
cagggcgagcagggcg

SEQ ID NO: 1559781 - RNA, 17 nt, Pseudomonas aeruginosa PA01
cagggccugcuccagcg

SEQ ID NO: 1559782 - RNA, 20 nt, Pseudomonas aeruginosa PA01
cagggccugcuccagcggag

SEQ ID NO: 1559783 - RNA, 15 nt, Pseudomonas aeruginosa PA01
cagguacugggcgau

SEQ ID NO: 1559784 - RNA, 17 nt, Pseudomonas aeruginosa PA01
cagguagcgcugcgcca

SEQ ID NO: 1559785 - RNA, 23 nt, Pseudomonas aeruginosa PA01
cagguagcgcugcgccaggcuuu

SEQ ID NO: 1559786 - RNA, 20 nt, Pseudomonas aeruginosa PA01
cagguagcgcugcgcccgcu

SEQ ID NO: 1559787 - RNA, 21 nt, Pseudomonas aeruginosa PA01
cagguagcguuguguagucau

SEQ ID NO: 1559788 - RNA, 19 nt, Pseudomonas aeruginosa PA01
cagguagcugcuccagccc

SEQ ID NO: 1559789 - RNA, 13 nt, Pseudomonas aeruginosa PA01
cagguagcuggaa

SEQ ID NO: 1559790 - RNA, 23 nt, Pseudomonas aeruginosa PA01
cagguaggggucguugccgucga

SEQ ID NO: 1559791 - RNA, 17 nt, Pseudomonas aeruginosa PA01
cagguaggcgcgggcgu

SEQ ID NO: 1559792 - RNA, 16 nt, Pseudomonas aeruginosa PA01
cagguaguccagccag

SEQ ID NO: 1559793 - RNA, 14 nt, Pseudomonas aeruginosa PA01
cagguaguccagcu

SEQ ID NO: 1559794 - RNA, 20 nt, Pseudomonas aeruginosa PA01
cagguaguccagcuccucga

SEQ ID NO: 1559795 - RNA, 20 nt, Pseudomonas aeruginosa PA01
cagguagaaggugcccagcg

SEQ ID NO: 1559796 - RNA, 22 nt, Pseudomonas aeruginosa PA01
cagguacucggcccgggccugg

SEQ ID NO: 1559797 - RNA, 23 nt, Pseudomonas aeruginosa PA01
cagguacucggcccgggccuggu

SEQ ID NO: 1559798 - RNA, 14 nt, Pseudomonas aeruginosa PA01
cagguacggcgccg

SEQ ID NO: 1559799 - RNA, 18 nt, Pseudomonas aeruginosa PA01
cagguagagcagcccggg

SEQ ID NO: 1559800 - RNA, 21 nt, Pseudomonas aeruginosa PA01
cagguagagcagcccgggcaa

SEQ ID NO: 1559801 - RNA, 20 nt, Pseudomonas aeruginosa PA01
cagguagccugcggccagcg

SEQ ID NO: 1559802 - RNA, 21 nt, Pseudomonas aeruginosa PA01
cagguagccugcggccagcgc

SEQ ID NO: 1559803 - RNA, 13 nt, Pseudomonas aeruginosa PA01
cagguagccugga

SEQ ID NO: 1559804 - RNA, 20 nt, Pseudomonas aeruginosa PA01
cagguagcagccguccagcu

SEQ ID NO: 1559805 - RNA, 19 nt, Pseudomonas aeruginosa PA01
cagguagccaggggucagg

SEQ ID NO: 1559806 - RNA, 14 nt, Pseudomonas aeruginosa PA01
cagguagccgcgcc

SEQ ID NO: 1559807 - RNA, 23 nt, Pseudomonas aeruginosa PA01
cagguaaggcaccaccgccgcca

SEQ ID NO: 1559808 - RNA, 17 nt, Pseudomonas aeruginosa PA01
cagguaacccgcggcga

SEQ ID NO: 1559809 - RNA, 16 nt, Pseudomonas aeruginosa PA01
cagguaaaggccacca

SEQ ID NO: 1559810 - RNA, 20 nt, Pseudomonas aeruginosa PA01
caggguguuguucgccagca

SEQ ID NO: 1559811 - RNA, 23 nt, Pseudomonas aeruginosa PA01
caggguguuguucgccagcaggc

SEQ ID NO: 1559812 - RNA, 15 nt, Pseudomonas aeruginosa PA01
caggguuuccagcag

SEQ ID NO: 1559813 - RNA, 18 nt, Pseudomonas aeruginosa PA01
caggguuuccagcagcac

SEQ ID NO: 1559814 - RNA, 19 nt, Pseudomonas aeruginosa PA01
caggguuuccagcagcacc

SEQ ID NO: 1559815 - RNA, 19 nt, Pseudomonas aeruginosa PA01
cagggugcgauggaugcgc

SEQ ID NO: 1559816 - RNA, 22 nt, Pseudomonas aeruginosa PA01
cagggucuucaggcgugggcca

SEQ ID NO: 1559817 - RNA, 19 nt, Pseudomonas aeruginosa PA01
cagggucuucagugcacgu

SEQ ID NO: 1559818 - RNA, 15 nt, Pseudomonas aeruginosa PA01
cagggugaagcugcg

SEQ ID NO: 1559819 - RNA, 23 nt, Pseudomonas aeruginosa PA01
cagggugacgcucuucaccucga

SEQ ID NO: 1559820 - RNA, 19 nt, Pseudomonas aeruginosa PA01
caggguggcgggcggcccc

SEQ ID NO: 1559821 - RNA, 17 nt, Pseudomonas aeruginosa PA01
caggguggcgcgcacca

SEQ ID NO: 1559822 - RNA, 14 nt, Pseudomonas aeruginosa PA01
caggguggccaggg

SEQ ID NO: 1559823 - RNA, 14 nt, Pseudomonas aeruginosa PA01
cagggugcugccca

SEQ ID NO: 1559824 - RNA, 15 nt, Pseudomonas aeruginosa PA01
cagggugcggcugcu

SEQ ID NO: 1559825 - RNA, 22 nt, Pseudomonas aeruginosa PA01
cagggugcggcugcucauguuc

SEQ ID NO: 1559826 - RNA, 18 nt, Pseudomonas aeruginosa PA01
cagccguggcacccaggc

SEQ ID NO: 1559827 - RNA, 18 nt, Pseudomonas aeruginosa PA01
cagccguggcaggcgccc

SEQ ID NO: 1559828 - RNA, 17 nt, Pseudomonas aeruginosa PA01
cagccguucgcuggaca

SEQ ID NO: 1559829 - RNA, 15 nt, Pseudomonas aeruginosa PA01
cagccguccaucugu

SEQ ID NO: 1559830 - RNA, 20 nt, Pseudomonas aeruginosa PA01
cagccggguucccaguugcu

SEQ ID NO: 1559831 - RNA, 23 nt, Pseudomonas aeruginosa PA01
cagccgggcgugucgaggaaggc

SEQ ID NO: 1559832 - RNA, 15 nt, Pseudomonas aeruginosa PA01
cagcccggccuggau

SEQ ID NO: 1559833 - RNA, 19 nt, Pseudomonas aeruginosa PA01
cagcccggcggugaugccg

SEQ ID NO: 1559834 - RNA, 18 nt, Pseudomonas aeruginosa PA01
cagcccgggcaacugccg

SEQ ID NO: 1559835 - RNA, 15 nt, Pseudomonas aeruginosa PA01
cagccgcgcgccgca

SEQ ID NO: 1559836 - RNA, 20 nt, Pseudomonas aeruginosa PA01
cagccgcggccguuguccag

SEQ ID NO: 1559837 - RNA, 22 nt, Pseudomonas aeruginosa PA01
cagcccguagucguucagcgcc

SEQ ID NO: 1559838 - RNA, 19 nt, Pseudomonas aeruginosa PA01
cagcccgucgcgcgccgga

SEQ ID NO: 1559839 - RNA, 15 nt, Pseudomonas aeruginosa PA01
cagcccgucggccuc

SEQ ID NO: 1559840 - RNA, 17 nt, Pseudomonas aeruginosa PA01
cagcccgucggccucgc

SEQ ID NO: 1559841 - RNA, 17 nt, Pseudomonas aeruginosa PA01
cagccggcgacgcagga

SEQ ID NO: 1559842 - RNA, 20 nt, Pseudomonas aeruginosa PA01
cagccggcgaacagguagcc

SEQ ID NO: 1559843 - RNA, 18 nt, Pseudomonas aeruginosa PA01
cagccggcgaagggcagg

SEQ ID NO: 1559844 - RNA, 17 nt, Pseudomonas aeruginosa PA01
cagccgcugcugcaacc

SEQ ID NO: 1559845 - RNA, 21 nt, Pseudomonas aeruginosa PA01
cagccgcugcagggcggcgcu

SEQ ID NO: 1559846 - RNA, 16 nt, Pseudomonas aeruginosa PA01
cagccgcugggccacg

SEQ ID NO: 1559847 - RNA, 17 nt, Pseudomonas aeruginosa PA01
cagccggcgccgcaggg

SEQ ID NO: 1559848 - RNA, 13 nt, Pseudomonas aeruginosa PA01
cagccggcgcuuc

SEQ ID NO: 1559849 - RNA, 13 nt, Pseudomonas aeruginosa PA01
cagccggcgcgcu

SEQ ID NO: 1559850 - RNA, 16 nt, Pseudomonas aeruginosa PA01
cagccgggaucuccuc

SEQ ID NO: 1559851 - RNA, 20 nt, Pseudomonas aeruginosa PA01
cagccgcguugucccugucc

SEQ ID NO: 1559852 - RNA, 22 nt, Pseudomonas aeruginosa PA01
cagccgcguugucccugucccg

SEQ ID NO: 1559853 - RNA, 19 nt, Pseudomonas aeruginosa PA01
cagccgcgugcgcgccgcc

SEQ ID NO: 1559854 - RNA, 22 nt, Pseudomonas aeruginosa PA01
cagccgcggcuguagccacggc

SEQ ID NO: 1559855 - RNA, 15 nt, Pseudomonas aeruginosa PA01
cagccuuccggcacc

SEQ ID NO: 1559856 - RNA, 23 nt, Pseudomonas aeruginosa PA01
cagccuucgagccacucgugcaa

SEQ ID NO: 1559857 - RNA, 22 nt, Pseudomonas aeruginosa PA01
cagccuucuccccagaugcccu

SEQ ID NO: 1559858 - RNA, 14 nt, Pseudomonas aeruginosa PA01
cagccuuggccacg

SEQ ID NO: 1559859 - RNA, 19 nt, Pseudomonas aeruginosa PA01
cagccuugcuggacuuccc

SEQ ID NO: 1559860 - RNA, 23 nt, Pseudomonas aeruginosa PA01
cagcgaggagccuuucacuuuca

SEQ ID NO: 1559861 - RNA, 17 nt, Pseudomonas aeruginosa PA01
cagcgagcggucggcca

SEQ ID NO: 1559862 - RNA, 21 nt, Pseudomonas aeruginosa PA01
cagcgagcggucggccauggc

SEQ ID NO: 1559863 - RNA, 18 nt, Pseudomonas aeruginosa PA01
cagcgagccgaucaccag

SEQ ID NO: 1559864 - RNA, 15 nt, Pseudomonas aeruginosa PA01
cagcgacgacuugcc

SEQ ID NO: 1559865 - RNA, 23 nt, Pseudomonas aeruginosa PA01
cagcgauucccgaggguggcgcu

SEQ ID NO: 1559866 - RNA, 14 nt, Pseudomonas aeruginosa PA01
cagcgcaagcggcg

SEQ ID NO: 1559867 - RNA, 16 nt, Pseudomonas aeruginosa PA01
cagcgcaagcggcggc

SEQ ID NO: 1559868 - RNA, 13 nt, Pseudomonas aeruginosa PA01
cagcgcagccugc

SEQ ID NO: 1559869 - RNA, 19 nt, Pseudomonas aeruginosa PA01
cagcgcagccugcuggccu

SEQ ID NO: 1559870 - RNA, 19 nt, Pseudomonas aeruginosa PA01
cagcgaggcccgcgccgcc

SEQ ID NO: 1559871 - RNA, 15 nt, Pseudomonas aeruginosa PA01
cagcgaguagucgcg

SEQ ID NO: 1559872 - RNA, 18 nt, Pseudomonas aeruginosa PA01
cagcgagucgucggacuu

SEQ ID NO: 1559873 - RNA, 23 nt, Pseudomonas aeruginosa PA01
cagcgagugcaggaaguggcgga

SEQ ID NO: 1559874 - RNA, 17 nt, Pseudomonas aeruginosa PA01
cagcgagucgacccagg

SEQ ID NO: 1559875 - RNA, 18 nt, Pseudomonas aeruginosa PA01
cagcgagucgacccaggc

SEQ ID NO: 1559876 - RNA, 19 nt, Pseudomonas aeruginosa PA01
cagcgagucgacccaggcc

SEQ ID NO: 1559877 - RNA, 20 nt, Pseudomonas aeruginosa PA01
cagcgagucgacccaggccc

SEQ ID NO: 1559878 - RNA, 16 nt, Pseudomonas aeruginosa PA01
cagcgaguugaccuug

SEQ ID NO: 1559879 - RNA, 20 nt, Pseudomonas aeruginosa PA01
cagcgaguugaccuuggcca

SEQ ID NO: 1559880 - RNA, 13 nt, Pseudomonas aeruginosa PA01
cagccaguagucc

SEQ ID NO: 1559881 - RNA, 18 nt, Pseudomonas aeruginosa PA01
cagccaguaguccuccgc

SEQ ID NO: 1559882 - RNA, 21 nt, Pseudomonas aeruginosa PA01
cagccaguagucuuccuggga

SEQ ID NO: 1559883 - RNA, 13 nt, Pseudomonas aeruginosa PA01
cagccagcagccc

SEQ ID NO: 1559884 - RNA, 12 nt, Pseudomonas aeruginosa PA01
cagccagagccc

SEQ ID NO: 1559885 - RNA, 21 nt, Pseudomonas aeruginosa PA01
cagccagagcguaucgaugcg

SEQ ID NO: 1559886 - RNA, 15 nt, Pseudomonas aeruginosa PA01
cagccagagcuccag

SEQ ID NO: 1559887 - RNA, 19 nt, Pseudomonas aeruginosa PA01
cagccagagcuccagggcu

SEQ ID NO: 1559888 - RNA, 21 nt, Pseudomonas aeruginosa PA01
cagccagagcuccagggcugc

SEQ ID NO: 1559889 - RNA, 19 nt, Pseudomonas aeruginosa PA01
cagccagacguccggcagg

SEQ ID NO: 1559890 - RNA, 21 nt, Pseudomonas aeruginosa PA01
cagccagaccggcagcgccgc

SEQ ID NO: 1559891 - RNA, 16 nt, Pseudomonas aeruginosa PA01
cagccagagcagcguc

SEQ ID NO: 1559892 - RNA, 16 nt, Pseudomonas aeruginosa PA01
cagccacucggccagg

SEQ ID NO: 1559893 - RNA, 22 nt, Pseudomonas aeruginosa PA01
cagccacuggcggaccgccucg

SEQ ID NO: 1559894 - RNA, 13 nt, Pseudomonas aeruginosa PA01
cagccacugccgc

SEQ ID NO: 1559895 - RNA, 22 nt, Pseudomonas aeruginosa PA01
cagcagccccgaggccagcagg

SEQ ID NO: 1559896 - RNA, 14 nt, Pseudomonas aeruginosa PA01
cagcagccaggcga

SEQ ID NO: 1559897 - RNA, 16 nt, Pseudomonas aeruginosa PA01
cagcagccaaggaugc

SEQ ID NO: 1559898 - RNA, 16 nt, Pseudomonas aeruginosa PA01
cagcagccggaccagc

SEQ ID NO: 1559899 - RNA, 23 nt, Pseudomonas aeruginosa PA01
cagccaaggaugcgccagcggcc

SEQ ID NO: 1559900 - RNA, 21 nt, Pseudomonas aeruginosa PA01
cagcccgccggcgaugcgcag

SEQ ID NO: 1559901 - RNA, 16 nt, Pseudomonas aeruginosa PA01
cagcccgccgugcgcu

SEQ ID NO: 1559902 - RNA, 15 nt, Pseudomonas aeruginosa PA01
cagcccggccauccu

SEQ ID NO: 1559903 - RNA, 20 nt, Pseudomonas aeruginosa PA01
cagcccgccaacguccucga

SEQ ID NO: 1559904 - RNA, 19 nt, Pseudomonas aeruginosa PA01
cagccccuugcgcucuggc

SEQ ID NO: 1559905 - RNA, 17 nt, Pseudomonas aeruginosa PA01
cagccccuugagcgcgu

SEQ ID NO: 1559906 - RNA, 14 nt, Pseudomonas aeruginosa PA01
cagccccucggcca

SEQ ID NO: 1559907 - RNA, 19 nt, Pseudomonas aeruginosa PA01
cagccccucggccaggacc

SEQ ID NO: 1559908 - RNA, 16 nt, Pseudomonas aeruginosa PA01
cagccccgaggccagc

SEQ ID NO: 1559909 - RNA, 19 nt, Pseudomonas aeruginosa PA01
cagccccgaucgccucggc

SEQ ID NO: 1559910 - RNA, 14 nt, Pseudomonas aeruginosa PA01
cagcccccgccggc

SEQ ID NO: 1559911 - RNA, 14 nt, Pseudomonas aeruginosa PA01
cagccccggcccgg

SEQ ID NO: 1559912 - RNA, 22 nt, Pseudomonas aeruginosa PA01
cagccccgcgauugcagcuccu

SEQ ID NO: 1559913 - RNA, 17 nt, Pseudomonas aeruginosa PA01
cagccccgccggaagac

SEQ ID NO: 1559914 - RNA, 16 nt, Pseudomonas aeruginosa PA01
cagccccagucccuuc

SEQ ID NO: 1559915 - RNA, 14 nt, Pseudomonas aeruginosa PA01
cagcccccaggcac

SEQ ID NO: 1559916 - RNA, 15 nt, Pseudomonas aeruginosa PA01
cagcccccaggcacc

SEQ ID NO: 1559917 - RNA, 21 nt, Pseudomonas aeruginosa PA01
cagcccaguucgcgcaggacc

SEQ ID NO: 1559918 - RNA, 22 nt, Pseudomonas aeruginosa PA01
cagccccacuggaagaaggcga

SEQ ID NO: 1559919 - RNA, 16 nt, Pseudomonas aeruginosa PA01
cagcccagccgcucgc

SEQ ID NO: 1559920 - RNA, 19 nt, Pseudomonas aeruginosa PA01
cagcccagcggcgcggcgu

SEQ ID NO: 1559921 - RNA, 16 nt, Pseudomonas aeruginosa PA01
cagcccaggcgccgcu

SEQ ID NO: 1559922 - RNA, 16 nt, Pseudomonas aeruginosa PA01
cagcccacgcgccugg

SEQ ID NO: 1559923 - RNA, 17 nt, Pseudomonas aeruginosa PA01
cagcccacgcgccuggc

SEQ ID NO: 1559924 - RNA, 15 nt, Pseudomonas aeruginosa PA01
cagcccacccccagc

SEQ ID NO: 1559925 - RNA, 17 nt, Pseudomonas aeruginosa PA01
cagcccacccccagccc

SEQ ID NO: 1559926 - RNA, 15 nt, Pseudomonas aeruginosa PA01
cagcccacccccggc

SEQ ID NO: 1559927 - RNA, 16 nt, Pseudomonas aeruginosa PA01
cagccauugagcgcgc

SEQ ID NO: 1559928 - RNA, 17 nt, Pseudomonas aeruginosa PA01
cagccauugcgccagga

SEQ ID NO: 1559929 - RNA, 22 nt, Pseudomonas aeruginosa PA01
cagccauuggccgacgccgcug

SEQ ID NO: 1559930 - RNA, 15 nt, Pseudomonas aeruginosa PA01
cagccauuucugcug

SEQ ID NO: 1559931 - RNA, 20 nt, Pseudomonas aeruginosa PA01
cagcggcaccgagagcugca

SEQ ID NO: 1559932 - RNA, 17 nt, Pseudomonas aeruginosa PA01
cagcggcacccggcugg

SEQ ID NO: 1559933 - RNA, 20 nt, Pseudomonas aeruginosa PA01
cagcggcacccggcuggguu

SEQ ID NO: 1559934 - RNA, 18 nt, Pseudomonas aeruginosa PA01
cagcggcacuucccgccc

SEQ ID NO: 1559935 - RNA, 17 nt, Pseudomonas aeruginosa PA01
cagcggcauccgccgcu

SEQ ID NO: 1559936 - RNA, 15 nt, Pseudomonas aeruginosa PA01
cagcggcauggucag

SEQ ID NO: 1559937 - RNA, 20 nt, Pseudomonas aeruginosa PA01
cagcggcaggccacggccgc

SEQ ID NO: 1559938 - RNA, 21 nt, Pseudomonas aeruginosa PA01
cagcggcaggccacggccgcu

SEQ ID NO: 1559939 - RNA, 19 nt, Pseudomonas aeruginosa PA01
cagcggcgacaccgccagc

SEQ ID NO: 1559940 - RNA, 14 nt, Pseudomonas aeruginosa PA01
cagcggcgccagcu

SEQ ID NO: 1559941 - RNA, 14 nt, Pseudomonas aeruginosa PA01
cagcggcgccucga

SEQ ID NO: 1559942 - RNA, 14 nt, Pseudomonas aeruginosa PA01
cagcggccccgagc

SEQ ID NO: 1559943 - RNA, 16 nt, Pseudomonas aeruginosa PA01
cagcggcccgagcagg

SEQ ID NO: 1559944 - RNA, 16 nt, Pseudomonas aeruginosa PA01
cagcggcccggcaggc

SEQ ID NO: 1559945 - RNA, 13 nt, Pseudomonas aeruginosa PA01
cagcggcccggcg

SEQ ID NO: 1559946 - RNA, 22 nt, Pseudomonas aeruginosa PA01
cagcggccgagcaggcgcgcca

SEQ ID NO: 1559947 - RNA, 14 nt, Pseudomonas aeruginosa PA01
cagcggccgcgccu

SEQ ID NO: 1559948 - RNA, 20 nt, Pseudomonas aeruginosa PA01
cagcggcccagcgccccgcc

SEQ ID NO: 1559949 - RNA, 15 nt, Pseudomonas aeruginosa PA01
cagcggcuggcccuc

SEQ ID NO: 1559950 - RNA, 19 nt, Pseudomonas aeruginosa PA01
cagcggcuggcgaugcuga

SEQ ID NO: 1559951 - RNA, 23 nt, Pseudomonas aeruginosa PA01
cagcggcuggcgaugcugaccca

SEQ ID NO: 1559952 - RNA, 23 nt, Pseudomonas aeruginosa PA01
cagcggcuggcgcuugccgcgcc

SEQ ID NO: 1559953 - RNA, 15 nt, Pseudomonas aeruginosa PA01
cagcggcuggcgggc

SEQ ID NO: 1559954 - RNA, 17 nt, Pseudomonas aeruginosa PA01
cagcggcuggcgggcga

SEQ ID NO: 1559955 - RNA, 15 nt, Pseudomonas aeruginosa PA01
cagcggcugcccggg

SEQ ID NO: 1559956 - RNA, 20 nt, Pseudomonas aeruginosa PA01
cagcggcucgucaucgucca

SEQ ID NO: 1559957 - RNA, 17 nt, Pseudomonas aeruginosa PA01
cagcggcucacgcccca

SEQ ID NO: 1559958 - RNA, 17 nt, Pseudomonas aeruginosa PA01
cagcggcuuguccuggc

SEQ ID NO: 1559959 - RNA, 17 nt, Pseudomonas aeruginosa PA01
cagcgggaaggucggca

SEQ ID NO: 1559960 - RNA, 20 nt, Pseudomonas aeruginosa PA01
cagcgggaaggucggcagca

SEQ ID NO: 1559961 - RNA, 20 nt, Pseudomonas aeruginosa PA01
cagcggcgugaagccgccgc

SEQ ID NO: 1559962 - RNA, 23 nt, Pseudomonas aeruginosa PA01
cagcggcgugaagccgccgccca

SEQ ID NO: 1559963 - RNA, 13 nt, Pseudomonas aeruginosa PA01
cagcggcgcggcg

SEQ ID NO: 1559964 - RNA, 22 nt, Pseudomonas aeruginosa PA01
cagcggcgcuugcgggcgcgcc

SEQ ID NO: 1559965 - RNA, 23 nt, Pseudomonas aeruginosa PA01
cagcggcgcuugcgggcgcgccu

SEQ ID NO: 1559966 - RNA, 17 nt, Pseudomonas aeruginosa PA01
cagcgcguucaccccgc

SEQ ID NO: 1559967 - RNA, 18 nt, Pseudomonas aeruginosa PA01
cagcgcguucaccccgcc

SEQ ID NO: 1559968 - RNA, 19 nt, Pseudomonas aeruginosa PA01
cagcgcguucaccccgccc

SEQ ID NO: 1559969 - RNA, 19 nt, Pseudomonas aeruginosa PA01
cagcgcgugcaggcgcccu

SEQ ID NO: 1559970 - RNA, 21 nt, Pseudomonas aeruginosa PA01
cagcgcgugcaggcgcccugg

SEQ ID NO: 1559971 - RNA, 17 nt, Pseudomonas aeruginosa PA01
cagcgcgucggcacgcc

SEQ ID NO: 1559972 - RNA, 14 nt, Pseudomonas aeruginosa PA01
cagcgcggcgcccc

SEQ ID NO: 1559973 - RNA, 15 nt, Pseudomonas aeruginosa PA01
cagcgcggcgcccca

SEQ ID NO: 1559974 - RNA, 23 nt, Pseudomonas aeruginosa PA01
cagcgcuucguugcuccugcggc

SEQ ID NO: 1559975 - RNA, 22 nt, Pseudomonas aeruginosa PA01
cagcgcuugaacgcgcgccuga

SEQ ID NO: 1559976 - RNA, 13 nt, Pseudomonas aeruginosa PA01
cagcgcuugcugg

SEQ ID NO: 1559977 - RNA, 23 nt, Pseudomonas aeruginosa PA01
cagcgcuuguagcagccgcagga

SEQ ID NO: 1559978 - RNA, 20 nt, Pseudomonas aeruginosa PA01
cagcggaacgaaggacaggu

SEQ ID NO: 1559979 - RNA, 19 nt, Pseudomonas aeruginosa PA01
cagcggaagcccagcaggu

SEQ ID NO: 1559980 - RNA, 18 nt, Pseudomonas aeruginosa PA01
cagcggaagcccugcugg

SEQ ID NO: 1559981 - RNA, 16 nt, Pseudomonas aeruginosa PA01
cagcggaaucgcgccc

SEQ ID NO: 1559982 - RNA, 17 nt, Pseudomonas aeruginosa PA01
cagcggacaaccgccgu

SEQ ID NO: 1559983 - RNA, 15 nt, Pseudomonas aeruginosa PA01
cagcggaccgucggg

SEQ ID NO: 1559984 - RNA, 22 nt, Pseudomonas aeruginosa PA01
cagcggaccgucgggcaguucc

SEQ ID NO: 1559985 - RNA, 23 nt, Pseudomonas aeruginosa PA01
cagcggauauucgacgcgcggcu

SEQ ID NO: 1559986 - RNA, 21 nt, Pseudomonas aeruginosa PA01
cagcggauccggguggagagg

SEQ ID NO: 1559987 - RNA, 17 nt, Pseudomonas aeruginosa PA01
cagcggaggauucagca

SEQ ID NO: 1559988 - RNA, 22 nt, Pseudomonas aeruginosa PA01
cagcgcgcucggccuggugcac

SEQ ID NO: 1559989 - RNA, 17 nt, Pseudomonas aeruginosa PA01
cagcgcggaucagucag

SEQ ID NO: 1559990 - RNA, 16 nt, Pseudomonas aeruginosa PA01
cagcgccuugaccucg

SEQ ID NO: 1559991 - RNA, 17 nt, Pseudomonas aeruginosa PA01
cagcgccuugaccucga

SEQ ID NO: 1559992 - RNA, 14 nt, Pseudomonas aeruginosa PA01
cagcgccugggccg

SEQ ID NO: 1559993 - RNA, 17 nt, Pseudomonas aeruginosa PA01
cagcgcaugcggaaggc

SEQ ID NO: 1559994 - RNA, 19 nt, Pseudomonas aeruginosa PA01
cagcgcauaggccugggcg

SEQ ID NO: 1559995 - RNA, 18 nt, Pseudomonas aeruginosa PA01
cagcggguagaugccacu

SEQ ID NO: 1559996 - RNA, 17 nt, Pseudomonas aeruginosa PA01
cagcggguagcugcugg

SEQ ID NO: 1559997 - RNA, 21 nt, Pseudomonas aeruginosa PA01
cagcggggaugaccguccggu

SEQ ID NO: 1559998 - RNA, 13 nt, Pseudomonas aeruginosa PA01
cagcgggcgcggu

SEQ ID NO: 1559999 - RNA, 12 nt, Pseudomonas aeruginosa PA01
cagcgggccagg

SEQ ID NO: 1560000 - RNA, 14 nt, Pseudomonas aeruginosa PA01
cagcgggcccaugg

SEQ ID NO: 1560001 - RNA, 12 nt, Pseudomonas aeruginosa PA01
cagcgggccggg

SEQ ID NO: 1560002 - RNA, 13 nt, Pseudomonas aeruginosa PA01
cagcgggccgggg

SEQ ID NO: 1560003 - RNA, 17 nt, Pseudomonas aeruginosa PA01
cagcgggaugugcacca

SEQ ID NO: 1560004 - RNA, 18 nt, Pseudomonas aeruginosa PA01
cagcgguacuaucccggu

SEQ ID NO: 1560005 - RNA, 14 nt, Pseudomonas aeruginosa PA01
cagcgguaguucag

SEQ ID NO: 1560006 - RNA, 18 nt, Pseudomonas aeruginosa PA01
cagcggugugcucaggcg

SEQ ID NO: 1560007 - RNA, 16 nt, Pseudomonas aeruginosa PA01
cagcgguugagcaggg

SEQ ID NO: 1560008 - RNA, 15 nt, Pseudomonas aeruginosa PA01
cagcgugcaccagca

SEQ ID NO: 1560009 - RNA, 16 nt, Pseudomonas aeruginosa PA01
cagcgugcggcccuug

SEQ ID NO: 1560010 - RNA, 15 nt, Pseudomonas aeruginosa PA01
cagcguggccagcgc

SEQ ID NO: 1560011 - RNA, 22 nt, Pseudomonas aeruginosa PA01
cagcguguggcgaaacuccagc

SEQ ID NO: 1560012 - RNA, 14 nt, Pseudomonas aeruginosa PA01
cagcguuccagcgc

SEQ ID NO: 1560013 - RNA, 15 nt, Pseudomonas aeruginosa PA01
cagcguuccagcgcu

SEQ ID NO: 1560014 - RNA, 13 nt, Pseudomonas aeruginosa PA01
cagcgugcccgcu

SEQ ID NO: 1560015 - RNA, 23 nt, Pseudomonas aeruginosa PA01
cagcgugcccgcugcaugugcca

SEQ ID NO: 1560016 - RNA, 20 nt, Pseudomonas aeruginosa PA01
cagcgucgccaacgcgccgu

SEQ ID NO: 1560017 - RNA, 22 nt, Pseudomonas aeruginosa PA01
cagcgucggaaaacccuguucc

SEQ ID NO: 1560018 - RNA, 17 nt, Pseudomonas aeruginosa PA01
cagcgucgcgucggccu

SEQ ID NO: 1560019 - RNA, 16 nt, Pseudomonas aeruginosa PA01
cagcgucgcgcgucca

SEQ ID NO: 1560020 - RNA, 16 nt, Pseudomonas aeruginosa PA01
cacugcgagcaccaug

SEQ ID NO: 1560021 - RNA, 14 nt, Pseudomonas aeruginosa PA01
cacugcuuggccag

SEQ ID NO: 1560022 - RNA, 16 nt, Pseudomonas aeruginosa PA01
cacugcuuggccaggc

SEQ ID NO: 1560023 - RNA, 24 nt, Pseudomonas aeruginosa PA01
cacugcggcggucccuucgugggc

SEQ ID NO: 1560024 - RNA, 12 nt, Pseudomonas aeruginosa PA01
cacugacgcgca

SEQ ID NO: 1560025 - RNA, 20 nt, Pseudomonas aeruginosa PA01
cacugacgcgcagcgccgcc

SEQ ID NO: 1560026 - RNA, 11 nt, Pseudomonas aeruginosa PA01
cacucuucagu

SEQ ID NO: 1560027 - RNA, 22 nt, Pseudomonas aeruginosa PA01
cacucuagugaaaguccuucuu

SEQ ID NO: 1560028 - RNA, 22 nt, Pseudomonas aeruginosa PA01
cacucugagggacacggcgacc

SEQ ID NO: 1560029 - RNA, 17 nt, Pseudomonas aeruginosa PA01
cacucgcuccuccgggc

SEQ ID NO: 1560030 - RNA, 19 nt, Pseudomonas aeruginosa PA01
cacucguuaaccugccugc

SEQ ID NO: 1560031 - RNA, 13 nt, Pseudomonas aeruginosa PA01
cacucgccgccgu

SEQ ID NO: 1560032 - RNA, 14 nt, Pseudomonas aeruginosa PA01
cacucgcagccgcg

SEQ ID NO: 1560033 - RNA, 19 nt, Pseudomonas aeruginosa PA01
cacucgacaggccauucuu

SEQ ID NO: 1560034 - RNA, 16 nt, Pseudomonas aeruginosa PA01
cacuccuccgccugca

SEQ ID NO: 1560035 - RNA, 20 nt, Pseudomonas aeruginosa PA01
cacuccguccagugcggcag

SEQ ID NO: 1560036 - RNA, 15 nt, Pseudomonas aeruginosa PA01
cacucccguccagcg

SEQ ID NO: 1560037 - RNA, 15 nt, Pseudomonas aeruginosa PA01
cacuccggcagcacc

SEQ ID NO: 1560038 - RNA, 13 nt, Pseudomonas aeruginosa PA01
cacucccggcccu

SEQ ID NO: 1560039 - RNA, 23 nt, Pseudomonas aeruginosa PA01
cacguugcugugcugcaccagca

SEQ ID NO: 1560040 - RNA, 16 nt, Pseudomonas aeruginosa PA01
cacguucugcaggacg

SEQ ID NO: 1560041 - RNA, 18 nt, Pseudomonas aeruginosa PA01
cacgugugucgacaccug

SEQ ID NO: 1560042 - RNA, 19 nt, Pseudomonas aeruginosa PA01
cacgugugucgacaccugg

SEQ ID NO: 1560043 - RNA, 14 nt, Pseudomonas aeruginosa PA01
cacgugcacgccgu

SEQ ID NO: 1560044 - RNA, 17 nt, Pseudomonas aeruginosa PA01
cacgugcggggugcgcu

SEQ ID NO: 1560045 - RNA, 21 nt, Pseudomonas aeruginosa PA01
cacuccagauagugcggccag

SEQ ID NO: 1560046 - RNA, 22 nt, Pseudomonas aeruginosa PA01
cacuccagauagugcggccagg

SEQ ID NO: 1560047 - RNA, 23 nt, Pseudomonas aeruginosa PA01
cacuccagauagugcggccaggc

SEQ ID NO: 1560048 - RNA, 21 nt, Pseudomonas aeruginosa PA01
cacucaggcaugcgggcgcga

SEQ ID NO: 1560049 - RNA, 17 nt, Pseudomonas aeruginosa PA01
cacucauagcucagcug

SEQ ID NO: 1560050 - RNA, 23 nt, Pseudomonas aeruginosa PA01
cacuguggagucgaaugugaaua

SEQ ID NO: 1560051 - RNA, 16 nt, Pseudomonas aeruginosa PA01
cacuggcgaggcugcg

SEQ ID NO: 1560052 - RNA, 18 nt, Pseudomonas aeruginosa PA01
cacuggcccacggcgccu

SEQ ID NO: 1560053 - RNA, 21 nt, Pseudomonas aeruginosa PA01
cacuggaaacgcccaucuuca

SEQ ID NO: 1560054 - RNA, 20 nt, Pseudomonas aeruginosa PA01
cacuggucggccaguuccuu

SEQ ID NO: 1560055 - RNA, 16 nt, Pseudomonas aeruginosa PA01
cacugguggcgaacag

SEQ ID NO: 1560056 - RNA, 19 nt, Pseudomonas aeruginosa PA01
cacuguccaugaaugccuu

SEQ ID NO: 1560057 - RNA, 13 nt, Pseudomonas aeruginosa PA01
cacuugccgccgc

SEQ ID NO: 1560058 - RNA, 15 nt, Pseudomonas aeruginosa PA01
cacuugcgccggcug

SEQ ID NO: 1560059 - RNA, 17 nt, Pseudomonas aeruginosa PA01
cacuucguccaggccgc

SEQ ID NO: 1560060 - RNA, 23 nt, Pseudomonas aeruginosa PA01
cacuucguccgccaccacggcga

SEQ ID NO: 1560061 - RNA, 15 nt, Pseudomonas aeruginosa PA01
cacuucguccggccg

SEQ ID NO: 1560062 - RNA, 18 nt, Pseudomonas aeruginosa PA01
cacuucguccggccgccc

SEQ ID NO: 1560063 - RNA, 19 nt, Pseudomonas aeruginosa PA01
cacuucguccggccgcccg

SEQ ID NO: 1560064 - RNA, 20 nt, Pseudomonas aeruginosa PA01
cacuucucgaacagcuccuc

SEQ ID NO: 1560065 - RNA, 17 nt, Pseudomonas aeruginosa PA01
cacuucacgacaggcgg

SEQ ID NO: 1560066 - RNA, 15 nt, Pseudomonas aeruginosa PA01
cacuuccagcacgcc

SEQ ID NO: 1560067 - RNA, 21 nt, Pseudomonas aeruginosa PA01
cacuucgguggauucgaaggu

SEQ ID NO: 1560068 - RNA, 15 nt, Pseudomonas aeruginosa PA01
cacuuccagcugcca

SEQ ID NO: 1560069 - RNA, 21 nt, Pseudomonas aeruginosa PA01
cacuuccagcugccagugcuc

SEQ ID NO: 1560070 - RNA, 12 nt, Pseudomonas aeruginosa PA01
cacuuccagcuu

SEQ ID NO: 1560071 - RNA, 12 nt, Pseudomonas aeruginosa PA01
cacuuccaggua

SEQ ID NO: 1560072 - RNA, 16 nt, Pseudomonas aeruginosa PA01
cacuuccucggcgacc

SEQ ID NO: 1560073 - RNA, 18 nt, Pseudomonas aeruginosa PA01
cacuuccugaaggcgcgg

SEQ ID NO: 1560074 - RNA, 22 nt, Pseudomonas aeruginosa PA01
cacuuccggacugcccagcgcc

SEQ ID NO: 1560075 - RNA, 16 nt, Pseudomonas aeruginosa PA01
cacuuccggcccggcc

SEQ ID NO: 1560076 - RNA, 21 nt, Pseudomonas aeruginosa PA01
cacuuccggcccggccaggcg

SEQ ID NO: 1560077 - RNA, 19 nt, Pseudomonas aeruginosa PA01
cagaaguauuucaaccagg

SEQ ID NO: 1560078 - RNA, 23 nt, Pseudomonas aeruginosa PA01
cagaagucccagcgagugcugaa

SEQ ID NO: 1560079 - RNA, 21 nt, Pseudomonas aeruginosa PA01
cagaagucgcuggccuggggu

SEQ ID NO: 1560080 - RNA, 18 nt, Pseudomonas aeruginosa PA01
cagaaguaguacuggucc

SEQ ID NO: 1560081 - RNA, 18 nt, Pseudomonas aeruginosa PA01
cagaaguaguaggggaau

SEQ ID NO: 1560082 - RNA, 19 nt, Pseudomonas aeruginosa PA01
cagaacugccgggccagcu

SEQ ID NO: 1560083 - RNA, 23 nt, Pseudomonas aeruginosa PA01
cagaacuugcgcaccgcgccggg

SEQ ID NO: 1560084 - RNA, 19 nt, Pseudomonas aeruginosa PA01
cagaagacgcccagcaggg

SEQ ID NO: 1560085 - RNA, 21 nt, Pseudomonas aeruginosa PA01
cagaagacgcccagcagggcc

SEQ ID NO: 1560086 - RNA, 24 nt, Pseudomonas aeruginosa PA01
cagaaccagacgcucggccagcgu

SEQ ID NO: 1560087 - RNA, 14 nt, Pseudomonas aeruginosa PA01
cagaccggcagcgc

SEQ ID NO: 1560088 - RNA, 15 nt, Pseudomonas aeruginosa PA01
cagaccggcagcgcc

SEQ ID NO: 1560089 - RNA, 18 nt, Pseudomonas aeruginosa PA01
cagaccggcagcgccgcc

SEQ ID NO: 1560090 - RNA, 15 nt, Pseudomonas aeruginosa PA01
cagaccuccagguag

SEQ ID NO: 1560091 - RNA, 20 nt, Pseudomonas aeruginosa PA01
cagaccgucgaucucgagca

SEQ ID NO: 1560092 - RNA, 16 nt, Pseudomonas aeruginosa PA01
cagacaucgccgaggg

SEQ ID NO: 1560093 - RNA, 12 nt, Pseudomonas aeruginosa PA01
cagacccucucc

SEQ ID NO: 1560094 - RNA, 23 nt, Pseudomonas aeruginosa PA01
cagacgaucagcggcccgagcag

SEQ ID NO: 1560095 - RNA, 22 nt, Pseudomonas aeruginosa PA01
cagaccuggccgcuguggaagu

SEQ ID NO: 1560096 - RNA, 19 nt, Pseudomonas aeruginosa PA01
cagaccugcagcaggauca

SEQ ID NO: 1560097 - RNA, 15 nt, Pseudomonas aeruginosa PA01
cagacgggugcugaa

SEQ ID NO: 1560098 - RNA, 16 nt, Pseudomonas aeruginosa PA01
cagacgggugcugaag

SEQ ID NO: 1560099 - RNA, 17 nt, Pseudomonas aeruginosa PA01
cagacgggugcugaaga

SEQ ID NO: 1560100 - RNA, 18 nt, Pseudomonas aeruginosa PA01
cagacgggugcugaagau

SEQ ID NO: 1560101 - RNA, 20 nt, Pseudomonas aeruginosa PA01
cagacugagguucaugccgc

SEQ ID NO: 1560102 - RNA, 17 nt, Pseudomonas aeruginosa PA01
cagaaucucccgcaggc

SEQ ID NO: 1560103 - RNA, 13 nt, Pseudomonas aeruginosa PA01
cagaggcgcucca

SEQ ID NO: 1560104 - RNA, 21 nt, Pseudomonas aeruginosa PA01
cagaggcgcuccaccagggcc

SEQ ID NO: 1560105 - RNA, 21 nt, Pseudomonas aeruginosa PA01
cagaggcugcgcuccaggcgg

SEQ ID NO: 1560106 - RNA, 17 nt, Pseudomonas aeruginosa PA01
cagagcgcugccugcac

SEQ ID NO: 1560107 - RNA, 22 nt, Pseudomonas aeruginosa PA01
cagagcgcugccugcaccgggc

SEQ ID NO: 1560108 - RNA, 12 nt, Pseudomonas aeruginosa PA01
cagagcgcgccc

SEQ ID NO: 1560109 - RNA, 15 nt, Pseudomonas aeruginosa PA01
cagagcgccagccag

SEQ ID NO: 1560110 - RNA, 21 nt, Pseudomonas aeruginosa PA01
cagagguuaacaguugagcug

SEQ ID NO: 1560111 - RNA, 20 nt, Pseudomonas aeruginosa PA01
cagaguugccuguccagcuc

SEQ ID NO: 1560112 - RNA, 22 nt, Pseudomonas aeruginosa PA01
cagaguugccuguccagcuccc

SEQ ID NO: 1560113 - RNA, 15 nt, Pseudomonas aeruginosa PA01
cagauagaccaaggc

SEQ ID NO: 1560114 - RNA, 18 nt, Pseudomonas aeruginosa PA01
cagauagggcaucagccc

SEQ ID NO: 1560115 - RNA, 14 nt, Pseudomonas aeruginosa PA01
cagauacuccagca

SEQ ID NO: 1560116 - RNA, 17 nt, Pseudomonas aeruginosa PA01
cagauacuccagcagcg

SEQ ID NO: 1560117 - RNA, 19 nt, Pseudomonas aeruginosa PA01
cagauacuccagcagcgca

SEQ ID NO: 1560118 - RNA, 18 nt, Pseudomonas aeruginosa PA01
cagauaaccgauaucucc

SEQ ID NO: 1560119 - RNA, 18 nt, Pseudomonas aeruginosa PA01
cagauagugcggccaggc

SEQ ID NO: 1560120 - RNA, 17 nt, Pseudomonas aeruginosa PA01
cagcaccgagacgcccu

SEQ ID NO: 1560121 - RNA, 21 nt, Pseudomonas aeruginosa PA01
cagcaccgagacgcccuggau

SEQ ID NO: 1560122 - RNA, 20 nt, Pseudomonas aeruginosa PA01
cagcaccgccaccagcgagu

SEQ ID NO: 1560123 - RNA, 22 nt, Pseudomonas aeruginosa PA01
cagcaccgcaagggugcucagg

SEQ ID NO: 1560124 - RNA, 13 nt, Pseudomonas aeruginosa PA01
cagcacggccucg

SEQ ID NO: 1560125 - RNA, 17 nt, Pseudomonas aeruginosa PA01
cagcacggcgauaccca

SEQ ID NO: 1560126 - RNA, 15 nt, Pseudomonas aeruginosa PA01
cagcaccugcgggcu

SEQ ID NO: 1560127 - RNA, 16 nt, Pseudomonas aeruginosa PA01
cagcaccugcgggcug

SEQ ID NO: 1560128 - RNA, 16 nt, Pseudomonas aeruginosa PA01
cagcaccuucaccgug

SEQ ID NO: 1560129 - RNA, 17 nt, Pseudomonas aeruginosa PA01
cagcaccuugugcugcc

SEQ ID NO: 1560130 - RNA, 19 nt, Pseudomonas aeruginosa PA01
cagcaccuugugcugccug

SEQ ID NO: 1560131 - RNA, 17 nt, Pseudomonas aeruginosa PA01
cagcaccucgcgggaac

SEQ ID NO: 1560132 - RNA, 12 nt, Pseudomonas aeruginosa PA01
cagcaccacagc

SEQ ID NO: 1560133 - RNA, 20 nt, Pseudomonas aeruginosa PA01
cagcaauacccgccgcuggc

SEQ ID NO: 1560134 - RNA, 22 nt, Pseudomonas aeruginosa PA01
cagcaccaccucgccaagcugg

SEQ ID NO: 1560135 - RNA, 15 nt, Pseudomonas aeruginosa PA01
cagcaccacgccgcu

SEQ ID NO: 1560136 - RNA, 19 nt, Pseudomonas aeruginosa PA01
cagcaccagggccagggcg

SEQ ID NO: 1560137 - RNA, 17 nt, Pseudomonas aeruginosa PA01
cagcaccagucccuggc

SEQ ID NO: 1560138 - RNA, 14 nt, Pseudomonas aeruginosa PA01
cagcaccaggaagc

SEQ ID NO: 1560139 - RNA, 15 nt, Pseudomonas aeruginosa PA01
cagcaccaggaagcc

SEQ ID NO: 1560140 - RNA, 22 nt, Pseudomonas aeruginosa PA01
cagcacguugccauccagcgcc

SEQ ID NO: 1560141 - RNA, 17 nt, Pseudomonas aeruginosa PA01
cagcacuacgcccaugg

SEQ ID NO: 1560142 - RNA, 17 nt, Pseudomonas aeruginosa PA01
cagcacgguguuguggc

SEQ ID NO: 1560143 - RNA, 19 nt, Pseudomonas aeruginosa PA01
cagcacgguguuguggcug

SEQ ID NO: 1560144 - RNA, 21 nt, Pseudomonas aeruginosa PA01
cagcacgucgauauccagcgg

SEQ ID NO: 1560145 - RNA, 22 nt, Pseudomonas aeruginosa PA01
cagcacgucgauauccagcggc

SEQ ID NO: 1560146 - RNA, 15 nt, Pseudomonas aeruginosa PA01
aaaauggcugccgaa

SEQ ID NO: 1560147 - RNA, 17 nt, Pseudomonas aeruginosa PA01
cagcagcaacuccagag

SEQ ID NO: 1560148 - RNA, 13 nt, Pseudomonas aeruginosa PA01
cagcagcaccgcg

SEQ ID NO: 1560149 - RNA, 17 nt, Pseudomonas aeruginosa PA01
cagcagcaccgcgcgcu

SEQ ID NO: 1560150 - RNA, 13 nt, Pseudomonas aeruginosa PA01
cagcagcaccauc

SEQ ID NO: 1560151 - RNA, 18 nt, Pseudomonas aeruginosa PA01
cagcagcaccaucagcca

SEQ ID NO: 1560152 - RNA, 19 nt, Pseudomonas aeruginosa PA01
cagcagcaccaucagccag

SEQ ID NO: 1560153 - RNA, 15 nt, Pseudomonas aeruginosa PA01
cagcagcacccggac

SEQ ID NO: 1560154 - RNA, 16 nt, Pseudomonas aeruginosa PA01
cagcagcacccggacc

SEQ ID NO: 1560155 - RNA, 12 nt, Pseudomonas aeruginosa PA01
cagcagcaagcc

SEQ ID NO: 1560156 - RNA, 17 nt, Pseudomonas aeruginosa PA01
cagcagcacgcccuggg

SEQ ID NO: 1560157 - RNA, 11 nt, Pseudomonas aeruginosa PA01
cagcagcaggc

SEQ ID NO: 1560158 - RNA, 19 nt, Pseudomonas aeruginosa PA01
cagcagcaugccgcucugc

SEQ ID NO: 1560159 - RNA, 22 nt, Pseudomonas aeruginosa PA01
cagcagcaugccgcucugccag

SEQ ID NO: 1560160 - RNA, 23 nt, Pseudomonas aeruginosa PA01
cagcagcaugccgcucugccaga

SEQ ID NO: 1560161 - RNA, 18 nt, Pseudomonas aeruginosa PA01
cagcaaacccgggcccaa

SEQ ID NO: 1560162 - RNA, 19 nt, Pseudomonas aeruginosa PA01
cagauccccugcaggaccc

SEQ ID NO: 1560163 - RNA, 15 nt, Pseudomonas aeruginosa PA01
cagaucccaucgccc

SEQ ID NO: 1560164 - RNA, 16 nt, Pseudomonas aeruginosa PA01
cagauccgggaaggcc

SEQ ID NO: 1560165 - RNA, 17 nt, Pseudomonas aeruginosa PA01
cagaucauguagagcag

SEQ ID NO: 1560166 - RNA, 19 nt, Pseudomonas aeruginosa PA01
cagaucauguagagcaggc

SEQ ID NO: 1560167 - RNA, 12 nt, Pseudomonas aeruginosa PA01
cagcaacaccgc

SEQ ID NO: 1560168 - RNA, 22 nt, Pseudomonas aeruginosa PA01
cagcaacggacguuccaccugg

SEQ ID NO: 1560169 - RNA, 17 nt, Pseudomonas aeruginosa PA01
cagcaacugccaaccgc

SEQ ID NO: 1560170 - RNA, 13 nt, Pseudomonas aeruginosa PA01
cagugccugcuuc

SEQ ID NO: 1560171 - RNA, 14 nt, Pseudomonas aeruginosa PA01
cagugccugcuuca

SEQ ID NO: 1560172 - RNA, 13 nt, Pseudomonas aeruginosa PA01
cagugcgggcagu

SEQ ID NO: 1560173 - RNA, 12 nt, Pseudomonas aeruginosa PA01
cagugcgccggg

SEQ ID NO: 1560174 - RNA, 22 nt, Pseudomonas aeruginosa PA01
cagugccaggcucgccgccagc

SEQ ID NO: 1560175 - RNA, 14 nt, Pseudomonas aeruginosa PA01
cagugccagcagac

SEQ ID NO: 1560176 - RNA, 16 nt, Pseudomonas aeruginosa PA01
cagguagugcggcggg

SEQ ID NO: 1560177 - RNA, 17 nt, Pseudomonas aeruginosa PA01
cagguagugcaacaccu

SEQ ID NO: 1560178 - RNA, 20 nt, Pseudomonas aeruginosa PA01
cagguagugcaacaccuggc

SEQ ID NO: 1560179 - RNA, 16 nt, Pseudomonas aeruginosa PA01
cagguaguugaggucg

SEQ ID NO: 1560180 - RNA, 18 nt, Pseudomonas aeruginosa PA01
cagugcccggcagaucuc

SEQ ID NO: 1560181 - RNA, 20 nt, Pseudomonas aeruginosa PA01
cagugcggggcgcucgcccu

SEQ ID NO: 1560182 - RNA, 15 nt, Pseudomonas aeruginosa PA01
cagugcguaguccuu

SEQ ID NO: 1560183 - RNA, 17 nt, Pseudomonas aeruginosa PA01
cagugcucaucauugaa

SEQ ID NO: 1560184 - RNA, 24 nt, Pseudomonas aeruginosa PA01
cagugcucccgcaaccugccagaa

SEQ ID NO: 1560185 - RNA, 23 nt, Pseudomonas aeruginosa PA01
caguggaucguugaacuggaugu

SEQ ID NO: 1560186 - RNA, 16 nt, Pseudomonas aeruginosa PA01
cagugguuuuccugca

SEQ ID NO: 1560187 - RNA, 21 nt, Pseudomonas aeruginosa PA01
caguggucgcagcuccagcgg

SEQ ID NO: 1560188 - RNA, 17 nt, Pseudomonas aeruginosa PA01
caguggguaggccaggc

SEQ ID NO: 1560189 - RNA, 17 nt, Pseudomonas aeruginosa PA01
cagugguuccaggaggg

SEQ ID NO: 1560190 - RNA, 18 nt, Pseudomonas aeruginosa PA01
caguuccaggucggcggc

SEQ ID NO: 1560191 - RNA, 21 nt, Pseudomonas aeruginosa PA01
caguucaucgagguucuccac

SEQ ID NO: 1560192 - RNA, 14 nt, Pseudomonas aeruginosa PA01
caguucagcgcgcu

SEQ ID NO: 1560193 - RNA, 15 nt, Pseudomonas aeruginosa PA01
caguucagcgcgcuc

SEQ ID NO: 1560194 - RNA, 23 nt, Pseudomonas aeruginosa PA01
caguuggacgcggccugggccga

SEQ ID NO: 1560195 - RNA, 17 nt, Pseudomonas aeruginosa PA01
caguugcucgcuccgag

SEQ ID NO: 1560196 - RNA, 21 nt, Pseudomonas aeruginosa PA01
caguugcgcuccgguggcgga

SEQ ID NO: 1560197 - RNA, 13 nt, Pseudomonas aeruginosa PA01
caguugccgagcu

SEQ ID NO: 1560198 - RNA, 16 nt, Pseudomonas aeruginosa PA01
caguugccgcagcagc

SEQ ID NO: 1560199 - RNA, 16 nt, Pseudomonas aeruginosa PA01
caguucguugggccgg

SEQ ID NO: 1560200 - RNA, 22 nt, Pseudomonas aeruginosa PA01
caguucgucgaugaugccgucu

SEQ ID NO: 1560201 - RNA, 23 nt, Pseudomonas aeruginosa PA01
caguucgucgcccaucucggugu

SEQ ID NO: 1560202 - RNA, 16 nt, Pseudomonas aeruginosa PA01
caguucgccccgccgc

SEQ ID NO: 1560203 - RNA, 22 nt, Pseudomonas aeruginosa PA01
caguucgccccgccgccaggcg

SEQ ID NO: 1560204 - RNA, 13 nt, Pseudomonas aeruginosa PA01
caguucgccgccc

SEQ ID NO: 1560205 - RNA, 19 nt, Pseudomonas aeruginosa PA01
caguucgccgcccgaggcg

SEQ ID NO: 1560206 - RNA, 17 nt, Pseudomonas aeruginosa PA01
caguucgccgccgagcg

SEQ ID NO: 1560207 - RNA, 21 nt, Pseudomonas aeruginosa PA01
caguucgcgcaggaccuggcu

SEQ ID NO: 1560208 - RNA, 14 nt, Pseudomonas aeruginosa PA01
caguucgcccggcu

SEQ ID NO: 1560209 - RNA, 18 nt, Pseudomonas aeruginosa PA01
caguuccaugucgcuggc

SEQ ID NO: 1560210 - RNA, 17 nt, Pseudomonas aeruginosa PA01
caguucccccagcaccu

SEQ ID NO: 1560211 - RNA, 17 nt, Pseudomonas aeruginosa PA01
caguucgaccuccaggc

SEQ ID NO: 1560212 - RNA, 16 nt, Pseudomonas aeruginosa PA01
caguuccucgccgcug

SEQ ID NO: 1560213 - RNA, 14 nt, Pseudomonas aeruginosa PA01
caguuccugcacca

SEQ ID NO: 1560214 - RNA, 15 nt, Pseudomonas aeruginosa PA01
caguuccugcuccuc

SEQ ID NO: 1560215 - RNA, 14 nt, Pseudomonas aeruginosa PA01
caguuccuugaggu

SEQ ID NO: 1560216 - RNA, 21 nt, Pseudomonas aeruginosa PA01
caguuucuucgcgugggccag

SEQ ID NO: 1560217 - RNA, 20 nt, Pseudomonas aeruginosa PA01
cauaccgacaugccccgccg

SEQ ID NO: 1560218 - RNA, 16 nt, Pseudomonas aeruginosa PA01
cauaccgccucggugg

SEQ ID NO: 1560219 - RNA, 19 nt, Pseudomonas aeruginosa PA01
cauaccggcaaggcggccu

SEQ ID NO: 1560220 - RNA, 19 nt, Pseudomonas aeruginosa PA01
cauacgaaaaaaaggcgcu

SEQ ID NO: 1560221 - RNA, 18 nt, Pseudomonas aeruginosa PA01
cauacaggcgcgccuggc

SEQ ID NO: 1560222 - RNA, 22 nt, Pseudomonas aeruginosa PA01
cauaaccccuuugccgagcgga

SEQ ID NO: 1560223 - RNA, 15 nt, Pseudomonas aeruginosa PA01
cauaaccggaagcga

SEQ ID NO: 1560224 - RNA, 16 nt, Pseudomonas aeruginosa PA01
cauaguagagaugcac

SEQ ID NO: 1560225 - RNA, 22 nt, Pseudomonas aeruginosa PA01
caucagcuggaucugguggaac

SEQ ID NO: 1560226 - RNA, 15 nt, Pseudomonas aeruginosa PA01
caucagcgccgccuc

SEQ ID NO: 1560227 - RNA, 12 nt, Pseudomonas aeruginosa PA01
caucagccgcgc

SEQ ID NO: 1560228 - RNA, 16 nt, Pseudomonas aeruginosa PA01
caucacgcuuuccggc

SEQ ID NO: 1560229 - RNA, 18 nt, Pseudomonas aeruginosa PA01
caucacggccccgagaaa

SEQ ID NO: 1560230 - RNA, 17 nt, Pseudomonas aeruginosa PA01
caucacgucgcgcaccu

SEQ ID NO: 1560231 - RNA, 20 nt, Pseudomonas aeruginosa PA01
caucacgucgcgcaccuggc

SEQ ID NO: 1560232 - RNA, 15 nt, Pseudomonas aeruginosa PA01
caucauccgcguggc

SEQ ID NO: 1560233 - RNA, 18 nt, Pseudomonas aeruginosa PA01
caucaggcgcuguccugu

SEQ ID NO: 1560234 - RNA, 21 nt, Pseudomonas aeruginosa PA01
caucaggcugccgagcagggu

SEQ ID NO: 1560235 - RNA, 22 nt, Pseudomonas aeruginosa PA01
caucaggucggcgcgcaccugu

SEQ ID NO: 1560236 - RNA, 20 nt, Pseudomonas aeruginosa PA01
caucagggucggcccggaga

SEQ ID NO: 1560237 - RNA, 15 nt, Pseudomonas aeruginosa PA01
caucagggcgaaagc

SEQ ID NO: 1560238 - RNA, 18 nt, Pseudomonas aeruginosa PA01
caucagguagaugaacug

SEQ ID NO: 1560239 - RNA, 13 nt, Pseudomonas aeruginosa PA01
caucaguuccucg

SEQ ID NO: 1560240 - RNA, 20 nt, Pseudomonas aeruginosa PA01
caucgcauagccggcgcgcc

SEQ ID NO: 1560241 - RNA, 15 nt, Pseudomonas aeruginosa PA01
caucgccgccaggca

SEQ ID NO: 1560242 - RNA, 17 nt, Pseudomonas aeruginosa PA01
caucgacgccagcggcg

SEQ ID NO: 1560243 - RNA, 16 nt, Pseudomonas aeruginosa PA01
caucgccggcagcgcc

SEQ ID NO: 1560244 - RNA, 18 nt, Pseudomonas aeruginosa PA01
caucgccggcgagccgcu

SEQ ID NO: 1560245 - RNA, 19 nt, Pseudomonas aeruginosa PA01
caucgccggcgagccgcug

SEQ ID NO: 1560246 - RNA, 21 nt, Pseudomonas aeruginosa PA01
caucgccggcgagccgcuggc

SEQ ID NO: 1560247 - RNA, 13 nt, Pseudomonas aeruginosa PA01
caucgccggcgcc

SEQ ID NO: 1560248 - RNA, 23 nt, Pseudomonas aeruginosa PA01
caucgccgcggcgaagcgcucga

SEQ ID NO: 1560249 - RNA, 14 nt, Pseudomonas aeruginosa PA01
caucgccgcggaaa

SEQ ID NO: 1560250 - RNA, 15 nt, Pseudomonas aeruginosa PA01
caucgccuccacggc

SEQ ID NO: 1560251 - RNA, 19 nt, Pseudomonas aeruginosa PA01
caucgccuccacggcggcc

SEQ ID NO: 1560252 - RNA, 15 nt, Pseudomonas aeruginosa PA01
caucgcggacaccgc

SEQ ID NO: 1560253 - RNA, 20 nt, Pseudomonas aeruginosa PA01
caucgcggcgauggccgcca

SEQ ID NO: 1560254 - RNA, 21 nt, Pseudomonas aeruginosa PA01
caucgcggcgauggccgccag

SEQ ID NO: 1560255 - RNA, 13 nt, Pseudomonas aeruginosa PA01
caucgcgccgccg

SEQ ID NO: 1560256 - RNA, 19 nt, Pseudomonas aeruginosa PA01
caucgcgaaaacucccggc

SEQ ID NO: 1560257 - RNA, 17 nt, Pseudomonas aeruginosa PA01
cauccugccgccuguuc

SEQ ID NO: 1560258 - RNA, 20 nt, Pseudomonas aeruginosa PA01
cauccugcgcgccucuuccu

SEQ ID NO: 1560259 - RNA, 23 nt, Pseudomonas aeruginosa PA01
cauccugcgcgccucuuccugga

SEQ ID NO: 1560260 - RNA, 15 nt, Pseudomonas aeruginosa PA01
cauccuguggcugca

SEQ ID NO: 1560261 - RNA, 17 nt, Pseudomonas aeruginosa PA01
caucgaccagacgcagc

SEQ ID NO: 1560262 - RNA, 18 nt, Pseudomonas aeruginosa PA01
caucgaccagacgcagca

SEQ ID NO: 1560263 - RNA, 16 nt, Pseudomonas aeruginosa PA01
caucgaccaggucgcc

SEQ ID NO: 1560264 - RNA, 22 nt, Pseudomonas aeruginosa PA01
caucgauaacaccaggagcgcc

SEQ ID NO: 1560265 - RNA, 18 nt, Pseudomonas aeruginosa PA01
caucgauccgcacccggg

SEQ ID NO: 1560266 - RNA, 21 nt, Pseudomonas aeruginosa PA01
caucgauccgcacccgggcaa

SEQ ID NO: 1560267 - RNA, 14 nt, Pseudomonas aeruginosa PA01
cauccgacgccggc

SEQ ID NO: 1560268 - RNA, 23 nt, Pseudomonas aeruginosa PA01
caucccuuuuucauucuccagcc

SEQ ID NO: 1560269 - RNA, 12 nt, Pseudomonas aeruginosa PA01
caucccuucuuu

SEQ ID NO: 1560270 - RNA, 14 nt, Pseudomonas aeruginosa PA01
cauccgcggccccg

SEQ ID NO: 1560271 - RNA, 16 nt, Pseudomonas aeruginosa PA01
cauccgcggccccggc

SEQ ID NO: 1560272 - RNA, 24 nt, Pseudomonas aeruginosa PA01
cauccgugcgaacacaccgaccgc

SEQ ID NO: 1560273 - RNA, 21 nt, Pseudomonas aeruginosa PA01
cauccguaaaauggcgcgccu

SEQ ID NO: 1560274 - RNA, 23 nt, Pseudomonas aeruginosa PA01
cauccguaaaauggcgcgccucu

SEQ ID NO: 1560275 - RNA, 16 nt, Pseudomonas aeruginosa PA01
cauccucggcauccag

SEQ ID NO: 1560276 - RNA, 14 nt, Pseudomonas aeruginosa PA01
cauccucccugccc

SEQ ID NO: 1560277 - RNA, 23 nt, Pseudomonas aeruginosa PA01
cauccucccugcccgcucggggc

SEQ ID NO: 1560278 - RNA, 12 nt, Pseudomonas aeruginosa PA01
cauccuccagca

SEQ ID NO: 1560279 - RNA, 13 nt, Pseudomonas aeruginosa PA01
cauccuccagcac

SEQ ID NO: 1560280 - RNA, 15 nt, Pseudomonas aeruginosa PA01
cauccuccagcacua

SEQ ID NO: 1560281 - RNA, 23 nt, Pseudomonas aeruginosa PA01
cauccugaugaaucgccucccug

SEQ ID NO: 1560282 - RNA, 15 nt, Pseudomonas aeruginosa PA01
caucgcugaccugga

SEQ ID NO: 1560283 - RNA, 23 nt, Pseudomonas aeruginosa PA01
caucgcguaggacgcauaaccgc

SEQ ID NO: 1560284 - RNA, 23 nt, Pseudomonas aeruginosa PA01
caucgcguagggcguauaaccgc

SEQ ID NO: 1560285 - RNA, 22 nt, Pseudomonas aeruginosa PA01
caucgcguagguggcgccgccg

SEQ ID NO: 1560286 - RNA, 18 nt, Pseudomonas aeruginosa PA01
caucgucgaaacgcuggc

SEQ ID NO: 1560287 - RNA, 15 nt, Pseudomonas aeruginosa PA01
caucguuggcgccgu

SEQ ID NO: 1560288 - RNA, 14 nt, Pseudomonas aeruginosa PA01
caucuccuguggau

SEQ ID NO: 1560289 - RNA, 14 nt, Pseudomonas aeruginosa PA01
caucucggccaccu

SEQ ID NO: 1560290 - RNA, 23 nt, Pseudomonas aeruginosa PA01
caucuguaccaccgccaugcugu

SEQ ID NO: 1560291 - RNA, 15 nt, Pseudomonas aeruginosa PA01
caucuggcugccgag

SEQ ID NO: 1560292 - RNA, 17 nt, Pseudomonas aeruginosa PA01
caucuggcugcgcgcca

SEQ ID NO: 1560293 - RNA, 21 nt, Pseudomonas aeruginosa PA01
caucugggccaucgccggccc

SEQ ID NO: 1560294 - RNA, 18 nt, Pseudomonas aeruginosa PA01
caucuggguccuggugau

SEQ ID NO: 1560295 - RNA, 19 nt, Pseudomonas aeruginosa PA01
caucugcggguugccgcag

SEQ ID NO: 1560296 - RNA, 16 nt, Pseudomonas aeruginosa PA01
ccaacagucgucgcgc

SEQ ID NO: 1560297 - RNA, 21 nt, Pseudomonas aeruginosa PA01
cauuuucagcggaguucguca

SEQ ID NO: 1560298 - RNA, 23 nt, Pseudomonas aeruginosa PA01
ccaacgguagcggaucagccggc

SEQ ID NO: 1560299 - RNA, 19 nt, Pseudomonas aeruginosa PA01
ccaacguccucgaugcccg

SEQ ID NO: 1560300 - RNA, 23 nt, Pseudomonas aeruginosa PA01
ccaacguccucgaugcccgccuc

SEQ ID NO: 1560301 - RNA, 14 nt, Pseudomonas aeruginosa PA01
ccaacugagcggcg

SEQ ID NO: 1560302 - RNA, 17 nt, Pseudomonas aeruginosa PA01
ccaacuggcguccccau

SEQ ID NO: 1560303 - RNA, 21 nt, Pseudomonas aeruginosa PA01
ccaacugcuugccgagcuggg

SEQ ID NO: 1560304 - RNA, 13 nt, Pseudomonas aeruginosa PA01
ccaaggaugcgcc

SEQ ID NO: 1560305 - RNA, 13 nt, Pseudomonas aeruginosa PA01
ccaaggccgccag

SEQ ID NO: 1560306 - RNA, 15 nt, Pseudomonas aeruginosa PA01
ccaauacccacaggg

SEQ ID NO: 1560307 - RNA, 21 nt, Pseudomonas aeruginosa PA01
ccaauacggcggggucgggca

SEQ ID NO: 1560308 - RNA, 14 nt, Pseudomonas aeruginosa PA01
ccaagucggccgcc

SEQ ID NO: 1560309 - RNA, 18 nt, Pseudomonas aeruginosa PA01
ccaagucggccgcccagc

SEQ ID NO: 1560310 - RNA, 17 nt, Pseudomonas aeruginosa PA01
ccaaguugccuggcagg

SEQ ID NO: 1560311 - RNA, 17 nt, Pseudomonas aeruginosa PA01
ccaauccgcgccggugg

SEQ ID NO: 1560312 - RNA, 23 nt, Pseudomonas aeruginosa PA01
ccaauccaugaucccuagggguu

SEQ ID NO: 1560313 - RNA, 18 nt, Pseudomonas aeruginosa PA01
ccacagcugccagccccg

SEQ ID NO: 1560314 - RNA, 14 nt, Pseudomonas aeruginosa PA01
ccaccgccaugcug

SEQ ID NO: 1560315 - RNA, 21 nt, Pseudomonas aeruginosa PA01
ccacccuugcgcccggcuucg

SEQ ID NO: 1560316 - RNA, 19 nt, Pseudomonas aeruginosa PA01
ccacccuugcguccugccu

SEQ ID NO: 1560317 - RNA, 20 nt, Pseudomonas aeruginosa PA01
ccacccuuggagccgcccuc

SEQ ID NO: 1560318 - RNA, 12 nt, Pseudomonas aeruginosa PA01
ccaccgccugcc

SEQ ID NO: 1560319 - RNA, 13 nt, Pseudomonas aeruginosa PA01
ccaccgccgccag

SEQ ID NO: 1560320 - RNA, 15 nt, Pseudomonas aeruginosa PA01
ccaccgccgccagca

SEQ ID NO: 1560321 - RNA, 14 nt, Pseudomonas aeruginosa PA01
ccaccgccagcacc

SEQ ID NO: 1560322 - RNA, 15 nt, Pseudomonas aeruginosa PA01
ccaccgggaucagcg

SEQ ID NO: 1560323 - RNA, 21 nt, Pseudomonas aeruginosa PA01
ccaccgggaucuggcccugca

SEQ ID NO: 1560324 - RNA, 23 nt, Pseudomonas aeruginosa PA01
ccaccgguggcgacgcgcaggcc

SEQ ID NO: 1560325 - RNA, 21 nt, Pseudomonas aeruginosa PA01
ccaccugaacgcgcccggcca

SEQ ID NO: 1560326 - RNA, 18 nt, Pseudomonas aeruginosa PA01
ccaccuccggaugcagau

SEQ ID NO: 1560327 - RNA, 14 nt, Pseudomonas aeruginosa PA01
ccaccucggcgucg

SEQ ID NO: 1560328 - RNA, 16 nt, Pseudomonas aeruginosa PA01
ccacgacgcacucaua

SEQ ID NO: 1560329 - RNA, 20 nt, Pseudomonas aeruginosa PA01
ccacgacgcacucauagcuc

SEQ ID NO: 1560330 - RNA, 12 nt, Pseudomonas aeruginosa PA01
ccacgacccgcu

SEQ ID NO: 1560331 - RNA, 18 nt, Pseudomonas aeruginosa PA01
ccacgacucacccgcugc

SEQ ID NO: 1560332 - RNA, 23 nt, Pseudomonas aeruginosa PA01
ccacgaucauggugaagcccacc

SEQ ID NO: 1560333 - RNA, 19 nt, Pseudomonas aeruginosa PA01
ccacccggcgguccgccgc

SEQ ID NO: 1560334 - RNA, 18 nt, Pseudomonas aeruginosa PA01
ccacccucggcuucgucc

SEQ ID NO: 1560335 - RNA, 17 nt, Pseudomonas aeruginosa PA01
ccaccaugugcuggcgg

SEQ ID NO: 1560336 - RNA, 17 nt, Pseudomonas aeruginosa PA01
ccaccauaaagcccaca

SEQ ID NO: 1560337 - RNA, 18 nt, Pseudomonas aeruginosa PA01
ccaccauaaagcccacac

SEQ ID NO: 1560338 - RNA, 21 nt, Pseudomonas aeruginosa PA01
ccaccaggguaccgaaacagg

SEQ ID NO: 1560339 - RNA, 18 nt, Pseudomonas aeruginosa PA01
ccaccacucgcgagcugg

SEQ ID NO: 1560340 - RNA, 12 nt, Pseudomonas aeruginosa PA01
ccaccagagcca

SEQ ID NO: 1560341 - RNA, 11 nt, Pseudomonas aeruginosa PA01
ccaccagcacc

SEQ ID NO: 1560342 - RNA, 13 nt, Pseudomonas aeruginosa PA01
ccaccagcagcag

SEQ ID NO: 1560343 - RNA, 15 nt, Pseudomonas aeruginosa PA01
ccaccagcagcagcg

SEQ ID NO: 1560344 - RNA, 15 nt, Pseudomonas aeruginosa PA01
ccaccagcagggcca

SEQ ID NO: 1560345 - RNA, 18 nt, Pseudomonas aeruginosa PA01
ccaccagcagggccaggc

SEQ ID NO: 1560346 - RNA, 11 nt, Pseudomonas aeruginosa PA01
ccaccagccag

SEQ ID NO: 1560347 - RNA, 21 nt, Pseudomonas aeruginosa PA01
ccaccagccaguagucuuccu

SEQ ID NO: 1560348 - RNA, 12 nt, Pseudomonas aeruginosa PA01
ccaccaccgcgc

SEQ ID NO: 1560349 - RNA, 13 nt, Pseudomonas aeruginosa PA01
ccacaggcccugg

SEQ ID NO: 1560350 - RNA, 21 nt, Pseudomonas aeruginosa PA01
ccacaggcggcggaagaagcc

SEQ ID NO: 1560351 - RNA, 23 nt, Pseudomonas aeruginosa PA01
ccacggguaacgguagcggcagg

SEQ ID NO: 1560352 - RNA, 14 nt, Pseudomonas aeruginosa PA01
ccacgggucgcagc

SEQ ID NO: 1560353 - RNA, 17 nt, Pseudomonas aeruginosa PA01
ccacggcgccuucccag

SEQ ID NO: 1560354 - RNA, 13 nt, Pseudomonas aeruginosa PA01
ccacguacuccag

SEQ ID NO: 1560355 - RNA, 15 nt, Pseudomonas aeruginosa PA01
ccacguacuccagca

SEQ ID NO: 1560356 - RNA, 16 nt, Pseudomonas aeruginosa PA01
ccacguacuccagcaa

SEQ ID NO: 1560357 - RNA, 13 nt, Pseudomonas aeruginosa PA01
ccacuaccgccga

SEQ ID NO: 1560358 - RNA, 18 nt, Pseudomonas aeruginosa PA01
ccacguccuugguguagc

SEQ ID NO: 1560359 - RNA, 15 nt, Pseudomonas aeruginosa PA01
ccacgucgccgacca

SEQ ID NO: 1560360 - RNA, 12 nt, Pseudomonas aeruginosa PA01
ccacgugcagca

SEQ ID NO: 1560361 - RNA, 23 nt, Pseudomonas aeruginosa PA01
ccacgucugugccgaggccgccg

SEQ ID NO: 1560362 - RNA, 21 nt, Pseudomonas aeruginosa PA01
ccacgugcggggugcgcugga

SEQ ID NO: 1560363 - RNA, 13 nt, Pseudomonas aeruginosa PA01
ccacguugcgccg

SEQ ID NO: 1560364 - RNA, 21 nt, Pseudomonas aeruginosa PA01
ccacgccgaagucggcgagcc

SEQ ID NO: 1560365 - RNA, 17 nt, Pseudomonas aeruginosa PA01
ccacgccgauaccggcc

SEQ ID NO: 1560366 - RNA, 18 nt, Pseudomonas aeruginosa PA01
ccacgccauaggcggcgc

SEQ ID NO: 1560367 - RNA, 12 nt, Pseudomonas aeruginosa PA01
ccacgcaccacc

SEQ ID NO: 1560368 - RNA, 21 nt, Pseudomonas aeruginosa PA01
ccacgcgcaucgugcagccag

SEQ ID NO: 1560369 - RNA, 14 nt, Pseudomonas aeruginosa PA01
ccacgcgaccagcg

SEQ ID NO: 1560370 - RNA, 17 nt, Pseudomonas aeruginosa PA01
ccacgcgaccagcgcca

SEQ ID NO: 1560371 - RNA, 15 nt, Pseudomonas aeruginosa PA01
ccacgccuggcccug

SEQ ID NO: 1560372 - RNA, 22 nt, Pseudomonas aeruginosa PA01
ccacgccuugcagcaccgccug

SEQ ID NO: 1560373 - RNA, 17 nt, Pseudomonas aeruginosa PA01
ccacgccgcugucgucc

SEQ ID NO: 1560374 - RNA, 22 nt, Pseudomonas aeruginosa PA01
ccacgccgcugucguccagcgg

SEQ ID NO: 1560375 - RNA, 13 nt, Pseudomonas aeruginosa PA01
ccacgccggcgcu

SEQ ID NO: 1560376 - RNA, 13 nt, Pseudomonas aeruginosa PA01
ccacgcucaccgg

SEQ ID NO: 1560377 - RNA, 20 nt, Pseudomonas aeruginosa PA01
ccacgcgguuccacucccau

SEQ ID NO: 1560378 - RNA, 14 nt, Pseudomonas aeruginosa PA01
ccacgcucuugauc

SEQ ID NO: 1560379 - RNA, 22 nt, Pseudomonas aeruginosa PA01
ccacgcugugcggcagcaggcu

SEQ ID NO: 1560380 - RNA, 17 nt, Pseudomonas aeruginosa PA01
ccacggaaggccacgcc

SEQ ID NO: 1560381 - RNA, 20 nt, Pseudomonas aeruginosa PA01
ccacgcugaucaucagcagg

SEQ ID NO: 1560382 - RNA, 22 nt, Pseudomonas aeruginosa PA01
ccacgcugaucaucagcagggu

SEQ ID NO: 1560383 - RNA, 21 nt, Pseudomonas aeruginosa PA01
ccacggaugcagucccgccag

SEQ ID NO: 1560384 - RNA, 18 nt, Pseudomonas aeruginosa PA01
ccacggcgaagccgcgcc

SEQ ID NO: 1560385 - RNA, 12 nt, Pseudomonas aeruginosa PA01
ccacggccggcg

SEQ ID NO: 1560386 - RNA, 16 nt, Pseudomonas aeruginosa PA01
caugucgcugagcggc

SEQ ID NO: 1560387 - RNA, 18 nt, Pseudomonas aeruginosa PA01
caugucgagguugcgcuc

SEQ ID NO: 1560388 - RNA, 22 nt, Pseudomonas aeruginosa PA01
cauguccaccgccgccagcaac

SEQ ID NO: 1560389 - RNA, 16 nt, Pseudomonas aeruginosa PA01
cauguagaccaccagc

SEQ ID NO: 1560390 - RNA, 18 nt, Pseudomonas aeruginosa PA01
cauguagagcaggcugcu

SEQ ID NO: 1560391 - RNA, 14 nt, Pseudomonas aeruginosa PA01
cauguaccucuggc

SEQ ID NO: 1560392 - RNA, 16 nt, Pseudomonas aeruginosa PA01
cauggccagcucgacc

SEQ ID NO: 1560393 - RNA, 22 nt, Pseudomonas aeruginosa PA01
cauggccagcucgaccuugccc

SEQ ID NO: 1560394 - RNA, 21 nt, Pseudomonas aeruginosa PA01
cauggccaccgaaucggacag

SEQ ID NO: 1560395 - RNA, 17 nt, Pseudomonas aeruginosa PA01
cauggcgggcguuuucg

SEQ ID NO: 1560396 - RNA, 16 nt, Pseudomonas aeruginosa PA01
cauggccgaccgccag

SEQ ID NO: 1560397 - RNA, 21 nt, Pseudomonas aeruginosa PA01
cauggcuuuccaggcgccgcu

SEQ ID NO: 1560398 - RNA, 22 nt, Pseudomonas aeruginosa PA01
cauggcuuuccaggcgccgcuu

SEQ ID NO: 1560399 - RNA, 18 nt, Pseudomonas aeruginosa PA01
caugggugcuguucagcg

SEQ ID NO: 1560400 - RNA, 19 nt, Pseudomonas aeruginosa PA01
caugguccguucggcgccc

SEQ ID NO: 1560401 - RNA, 23 nt, Pseudomonas aeruginosa PA01
cauggucgagaaggcugccgggc

SEQ ID NO: 1560402 - RNA, 13 nt, Pseudomonas aeruginosa PA01
cauggucuuccca

SEQ ID NO: 1560403 - RNA, 23 nt, Pseudomonas aeruginosa PA01
cauggucgcgcuguugccgcgcu

SEQ ID NO: 1560404 - RNA, 20 nt, Pseudomonas aeruginosa PA01
caugggucagcgccagcaac

SEQ ID NO: 1560405 - RNA, 23 nt, Pseudomonas aeruginosa PA01
cauggaccgagaccgacgcucgc

SEQ ID NO: 1560406 - RNA, 21 nt, Pseudomonas aeruginosa PA01
cauggagcaacagcgucgcca

SEQ ID NO: 1560407 - RNA, 17 nt, Pseudomonas aeruginosa PA01
caugcuguugccguggc

SEQ ID NO: 1560408 - RNA, 17 nt, Pseudomonas aeruginosa PA01
caucuucaaucgcgcgu

SEQ ID NO: 1560409 - RNA, 18 nt, Pseudomonas aeruginosa PA01
caugcucgggcugccgca

SEQ ID NO: 1560410 - RNA, 20 nt, Pseudomonas aeruginosa PA01
caugcucgggguuuccucga

SEQ ID NO: 1560411 - RNA, 15 nt, Pseudomonas aeruginosa PA01
caugcucggccagcu

SEQ ID NO: 1560412 - RNA, 12 nt, Pseudomonas aeruginosa PA01
caugcugcucgg

SEQ ID NO: 1560413 - RNA, 16 nt, Pseudomonas aeruginosa PA01
caugcugcucggcauu

SEQ ID NO: 1560414 - RNA, 12 nt, Pseudomonas aeruginosa PA01
caugucuucuca

SEQ ID NO: 1560415 - RNA, 13 nt, Pseudomonas aeruginosa PA01
caugucugcaacc

SEQ ID NO: 1560416 - RNA, 21 nt, Pseudomonas aeruginosa PA01
caugugcuugaccgccgccug

SEQ ID NO: 1560417 - RNA, 19 nt, Pseudomonas aeruginosa PA01
cauuccgcggcacuccggc

SEQ ID NO: 1560418 - RNA, 11 nt, Pseudomonas aeruginosa PA01
cauuccuccag

SEQ ID NO: 1560419 - RNA, 18 nt, Pseudomonas aeruginosa PA01
cauucgaauggcgccggc

SEQ ID NO: 1560420 - RNA, 16 nt, Pseudomonas aeruginosa PA01
cauucgcagcggcccc

SEQ ID NO: 1560421 - RNA, 19 nt, Pseudomonas aeruginosa PA01
cauucgaugccgcgcgccu

SEQ ID NO: 1560422 - RNA, 13 nt, Pseudomonas aeruginosa PA01
cauucgccgcgac

SEQ ID NO: 1560423 - RNA, 16 nt, Pseudomonas aeruginosa PA01
cauucgccgcgacgcu

SEQ ID NO: 1560424 - RNA, 20 nt, Pseudomonas aeruginosa PA01
cauugcgcuccgacuccugc

SEQ ID NO: 1560425 - RNA, 21 nt, Pseudomonas aeruginosa PA01
cauugcgcuccgacuccugca

SEQ ID NO: 1560426 - RNA, 21 nt, Pseudomonas aeruginosa PA01
cauugcccgguggccuccugc

SEQ ID NO: 1560427 - RNA, 22 nt, Pseudomonas aeruginosa PA01
cauugcacuuccacuccaggcg

SEQ ID NO: 1560428 - RNA, 23 nt, Pseudomonas aeruginosa PA01
cauugccaccaccaugccuucca

SEQ ID NO: 1560429 - RNA, 18 nt, Pseudomonas aeruginosa PA01
cauucggugcgcuccugu

SEQ ID NO: 1560430 - RNA, 21 nt, Pseudomonas aeruginosa PA01
cauucggccagcgcggcgcgc

SEQ ID NO: 1560431 - RNA, 17 nt, Pseudomonas aeruginosa PA01
cauugggucccugguuc

SEQ ID NO: 1560432 - RNA, 15 nt, Pseudomonas aeruginosa PA01
cauuggcacccugga

SEQ ID NO: 1560433 - RNA, 20 nt, Pseudomonas aeruginosa PA01
cauuuccugggugccgcgaa

SEQ ID NO: 1560434 - RNA, 22 nt, Pseudomonas aeruginosa PA01
cauuucgaguguccgcaguuga

SEQ ID NO: 1560435 - RNA, 15 nt, Pseudomonas aeruginosa PA01
cauuucgaagcuguc

SEQ ID NO: 1560436 - RNA, 15 nt, Pseudomonas aeruginosa PA01
ccagcuugucgucgg

SEQ ID NO: 1560437 - RNA, 17 nt, Pseudomonas aeruginosa PA01
ccagcuugucgccuucc

SEQ ID NO: 1560438 - RNA, 21 nt, Pseudomonas aeruginosa PA01
ccagcuuguaguagcgcccga

SEQ ID NO: 1560439 - RNA, 20 nt, Pseudomonas aeruginosa PA01
ccagcuugcgccagagcagg

SEQ ID NO: 1560440 - RNA, 15 nt, Pseudomonas aeruginosa PA01
ccagcuuccaggcgc

SEQ ID NO: 1560441 - RNA, 19 nt, Pseudomonas aeruginosa PA01
ccagcuucuucugcagcuc

SEQ ID NO: 1560442 - RNA, 23 nt, Pseudomonas aeruginosa PA01
ccagcuucuucugcagcucggcc

SEQ ID NO: 1560443 - RNA, 12 nt, Pseudomonas aeruginosa PA01
ccagcuucuugc

SEQ ID NO: 1560444 - RNA, 22 nt, Pseudomonas aeruginosa PA01
ccaggaaggccgcuucgccgcc

SEQ ID NO: 1560445 - RNA, 16 nt, Pseudomonas aeruginosa PA01
ccaggaagcucggcag

SEQ ID NO: 1560446 - RNA, 17 nt, Pseudomonas aeruginosa PA01
ccaggaagcucggcagc

SEQ ID NO: 1560447 - RNA, 17 nt, Pseudomonas aeruginosa PA01
ccaggaaggaaugcugc

SEQ ID NO: 1560448 - RNA, 12 nt, Pseudomonas aeruginosa PA01
ccaggaagcccc

SEQ ID NO: 1560449 - RNA, 15 nt, Pseudomonas aeruginosa PA01
ccaggaagccccaga

SEQ ID NO: 1560450 - RNA, 13 nt, Pseudomonas aeruginosa PA01
ccaggaagccgcg

SEQ ID NO: 1560451 - RNA, 15 nt, Pseudomonas aeruginosa PA01
ccaggaagccgcgcc

SEQ ID NO: 1560452 - RNA, 22 nt, Pseudomonas aeruginosa PA01
ccaggaagccgcgccccagcgg

SEQ ID NO: 1560453 - RNA, 17 nt, Pseudomonas aeruginosa PA01
ccaggaacgccucugcg

SEQ ID NO: 1560454 - RNA, 12 nt, Pseudomonas aeruginosa PA01
ccagcucggaca

SEQ ID NO: 1560455 - RNA, 13 nt, Pseudomonas aeruginosa PA01
ccagcucggcggg

SEQ ID NO: 1560456 - RNA, 14 nt, Pseudomonas aeruginosa PA01
ccagcucgucgccc

SEQ ID NO: 1560457 - RNA, 14 nt, Pseudomonas aeruginosa PA01
ccagcucggugccg

SEQ ID NO: 1560458 - RNA, 22 nt, Pseudomonas aeruginosa PA01
ccagcucuugcccugccagcgg

SEQ ID NO: 1560459 - RNA, 12 nt, Pseudomonas aeruginosa PA01
ccagcuggcgcg

SEQ ID NO: 1560460 - RNA, 16 nt, Pseudomonas aeruginosa PA01
ccagcuggcgcagccg

SEQ ID NO: 1560461 - RNA, 18 nt, Pseudomonas aeruginosa PA01
ccagcugcgccugcagcu

SEQ ID NO: 1560462 - RNA, 18 nt, Pseudomonas aeruginosa PA01
ccaggcaauggccggcgg

SEQ ID NO: 1560463 - RNA, 20 nt, Pseudomonas aeruginosa PA01
ccaggcaccguaggccaggc

SEQ ID NO: 1560464 - RNA, 22 nt, Pseudomonas aeruginosa PA01
ccaggcaccguaggccaggcag

SEQ ID NO: 1560465 - RNA, 17 nt, Pseudomonas aeruginosa PA01
ccaggcagaccugcagc

SEQ ID NO: 1560466 - RNA, 16 nt, Pseudomonas aeruginosa PA01
ccaggcauuccuccag

SEQ ID NO: 1560467 - RNA, 17 nt, Pseudomonas aeruginosa PA01
ccaggccaggcugcgcu

SEQ ID NO: 1560468 - RNA, 18 nt, Pseudomonas aeruginosa PA01
ccaggcauccagcaccgc

SEQ ID NO: 1560469 - RNA, 19 nt, Pseudomonas aeruginosa PA01
ccaggcauccagcaccgcu

SEQ ID NO: 1560470 - RNA, 16 nt, Pseudomonas aeruginosa PA01
ccaggcagucguaggu

SEQ ID NO: 1560471 - RNA, 17 nt, Pseudomonas aeruginosa PA01
ccaggcaggcggucagc

SEQ ID NO: 1560472 - RNA, 13 nt, Pseudomonas aeruginosa PA01
ccaggaccagccc

SEQ ID NO: 1560473 - RNA, 15 nt, Pseudomonas aeruginosa PA01
ccaggacacuuccag

SEQ ID NO: 1560474 - RNA, 15 nt, Pseudomonas aeruginosa PA01
ccaggacagcacgcu

SEQ ID NO: 1560475 - RNA, 21 nt, Pseudomonas aeruginosa PA01
ccaggacagcacgcucaggca

SEQ ID NO: 1560476 - RNA, 13 nt, Pseudomonas aeruginosa PA01
ccaggaccagggc

SEQ ID NO: 1560477 - RNA, 15 nt, Pseudomonas aeruginosa PA01
ccaggaccaucggca

SEQ ID NO: 1560478 - RNA, 18 nt, Pseudomonas aeruginosa PA01
ccaggaccaucggcacca

SEQ ID NO: 1560479 - RNA, 19 nt, Pseudomonas aeruginosa PA01
ccaggaccauuugcgccuc

SEQ ID NO: 1560480 - RNA, 20 nt, Pseudomonas aeruginosa PA01
ccaggaccauuugcgccucg

SEQ ID NO: 1560481 - RNA, 22 nt, Pseudomonas aeruginosa PA01
ccaggaccucgaagcuggccag

SEQ ID NO: 1560482 - RNA, 19 nt, Pseudomonas aeruginosa PA01
ccaggaccuugucgcgcac

SEQ ID NO: 1560483 - RNA, 13 nt, Pseudomonas aeruginosa PA01
ccaggacggcagg

SEQ ID NO: 1560484 - RNA, 14 nt, Pseudomonas aeruginosa PA01
ccaggagcagggcg

SEQ ID NO: 1560485 - RNA, 16 nt, Pseudomonas aeruginosa PA01
ccaggagcagggcgcc

SEQ ID NO: 1560486 - RNA, 22 nt, Pseudomonas aeruginosa PA01
ccaggagcacgccgugcagggu

SEQ ID NO: 1560487 - RNA, 19 nt, Pseudomonas aeruginosa PA01
ccaggaguggugaagcgcu

SEQ ID NO: 1560488 - RNA, 16 nt, Pseudomonas aeruginosa PA01
ccaggaucgccgggcu

SEQ ID NO: 1560489 - RNA, 18 nt, Pseudomonas aeruginosa PA01
ccaggaucgaacuggcca

SEQ ID NO: 1560490 - RNA, 19 nt, Pseudomonas aeruginosa PA01
ccaggaucgaacuggccag

SEQ ID NO: 1560491 - RNA, 18 nt, Pseudomonas aeruginosa PA01
ccaggaucgaccccgccg

SEQ ID NO: 1560492 - RNA, 18 nt, Pseudomonas aeruginosa PA01
ccaggaugaccaggcuga

SEQ ID NO: 1560493 - RNA, 19 nt, Pseudomonas aeruginosa PA01
ccaggaugcaaccgcccug

SEQ ID NO: 1560494 - RNA, 21 nt, Pseudomonas aeruginosa PA01
ccaggaugcccugcucuucca

SEQ ID NO: 1560495 - RNA, 23 nt, Pseudomonas aeruginosa PA01
ccaggaugcccugcucuuccagc

SEQ ID NO: 1560496 - RNA, 20 nt, Pseudomonas aeruginosa PA01
ccaggcgucgcaccugggac

SEQ ID NO: 1560497 - RNA, 16 nt, Pseudomonas aeruginosa PA01
ccaggcgucgcgccag

SEQ ID NO: 1560498 - RNA, 18 nt, Pseudomonas aeruginosa PA01
ccaggcgguugcggaacu

SEQ ID NO: 1560499 - RNA, 15 nt, Pseudomonas aeruginosa PA01
ccaggcgguuggccc

SEQ ID NO: 1560500 - RNA, 16 nt, Pseudomonas aeruginosa PA01
ccaggcgguuggcccg

SEQ ID NO: 1560501 - RNA, 19 nt, Pseudomonas aeruginosa PA01
ccaggcgguuggcccgcgc

SEQ ID NO: 1560502 - RNA, 21 nt, Pseudomonas aeruginosa PA01
ccaggcgguuggcccgcgccg

SEQ ID NO: 1560503 - RNA, 17 nt, Pseudomonas aeruginosa PA01
ccaggcgggccagcugg

SEQ ID NO: 1560504 - RNA, 20 nt, Pseudomonas aeruginosa PA01
ccaggcggggauggcgggcu

SEQ ID NO: 1560505 - RNA, 17 nt, Pseudomonas aeruginosa PA01
ccaggcgcuccuccagc

SEQ ID NO: 1560506 - RNA, 19 nt, Pseudomonas aeruginosa PA01
ccaggcgcuccuccagcgc

SEQ ID NO: 1560507 - RNA, 15 nt, Pseudomonas aeruginosa PA01
ccaggcgcgccgugc

SEQ ID NO: 1560508 - RNA, 21 nt, Pseudomonas aeruginosa PA01
ccaggcgcggcgucgggcgaa

SEQ ID NO: 1560509 - RNA, 17 nt, Pseudomonas aeruginosa PA01
ccaggcgcgcuggaugc

SEQ ID NO: 1560510 - RNA, 15 nt, Pseudomonas aeruginosa PA01
ccaggcgcuggcgcc

SEQ ID NO: 1560511 - RNA, 16 nt, Pseudomonas aeruginosa PA01
ccaggcggagcauggu

SEQ ID NO: 1560512 - RNA, 16 nt, Pseudomonas aeruginosa PA01
ccaggcgcucucgccg

SEQ ID NO: 1560513 - RNA, 19 nt, Pseudomonas aeruginosa PA01
ccaggcgcucucgccgccu

SEQ ID NO: 1560514 - RNA, 17 nt, Pseudomonas aeruginosa PA01
ccaggcgcgucuccagc

SEQ ID NO: 1560515 - RNA, 16 nt, Pseudomonas aeruginosa PA01
ccaggcgccgaugccc

SEQ ID NO: 1560516 - RNA, 16 nt, Pseudomonas aeruginosa PA01
ccaggcgccgcccccg

SEQ ID NO: 1560517 - RNA, 18 nt, Pseudomonas aeruginosa PA01
ccaggcgccgcccccggc

SEQ ID NO: 1560518 - RNA, 23 nt, Pseudomonas aeruginosa PA01
ccaggcgccagggacgcgcagcg

SEQ ID NO: 1560519 - RNA, 22 nt, Pseudomonas aeruginosa PA01
ccaggcgccagguagugccgcc

SEQ ID NO: 1560520 - RNA, 20 nt, Pseudomonas aeruginosa PA01
ccaggcgcccaggcagcaga

SEQ ID NO: 1560521 - RNA, 13 nt, Pseudomonas aeruginosa PA01
ccaggcgcagcca

SEQ ID NO: 1560522 - RNA, 19 nt, Pseudomonas aeruginosa PA01
ccaggcgccaauccgggcg

SEQ ID NO: 1560523 - RNA, 20 nt, Pseudomonas aeruginosa PA01
ccaggcgccaauccgggcgu

SEQ ID NO: 1560524 - RNA, 15 nt, Pseudomonas aeruginosa PA01
ccaggcgaugguugc

SEQ ID NO: 1560525 - RNA, 24 nt, Pseudomonas aeruginosa PA01
ccaggcgcaccuccucgggcggau

SEQ ID NO: 1560526 - RNA, 19 nt, Pseudomonas aeruginosa PA01
ccaggcgauaucccgccgc

SEQ ID NO: 1560527 - RNA, 16 nt, Pseudomonas aeruginosa PA01
ccaggcgauccagcgg

SEQ ID NO: 1560528 - RNA, 16 nt, Pseudomonas aeruginosa PA01
ccaggcgaagcggcug

SEQ ID NO: 1560529 - RNA, 12 nt, Pseudomonas aeruginosa PA01
ccaggcgaaggu

SEQ ID NO: 1560530 - RNA, 16 nt, Pseudomonas aeruginosa PA01
ccaggccuuccagaac

SEQ ID NO: 1560531 - RNA, 23 nt, Pseudomonas aeruginosa PA01
ccaggccuuccagaacgccgcgc

SEQ ID NO: 1560532 - RNA, 15 nt, Pseudomonas aeruginosa PA01
ccaggccucagaacu

SEQ ID NO: 1560533 - RNA, 15 nt, Pseudomonas aeruginosa PA01
ccaggccucccagcc

SEQ ID NO: 1560534 - RNA, 17 nt, Pseudomonas aeruginosa PA01
ccaggccucccagccgu

SEQ ID NO: 1560535 - RNA, 14 nt, Pseudomonas aeruginosa PA01
ccaggcccagccgg

SEQ ID NO: 1560536 - RNA, 18 nt, Pseudomonas aeruginosa PA01
ccaggcccauccuggcga

SEQ ID NO: 1560537 - RNA, 19 nt, Pseudomonas aeruginosa PA01
ccaggccccaggccgccgc

SEQ ID NO: 1560538 - RNA, 23 nt, Pseudomonas aeruginosa PA01
ccaggccgacagcggcuggcgcu

SEQ ID NO: 1560539 - RNA, 15 nt, Pseudomonas aeruginosa PA01
ccaggccgagcagga

SEQ ID NO: 1560540 - RNA, 22 nt, Pseudomonas aeruginosa PA01
ccaggccgagcaggaagaagcc

SEQ ID NO: 1560541 - RNA, 20 nt, Pseudomonas aeruginosa PA01
ccaggccgaugaacgccgcg

SEQ ID NO: 1560542 - RNA, 21 nt, Pseudomonas aeruginosa PA01
ccaggccgaugaacgccgcga

SEQ ID NO: 1560543 - RNA, 21 nt, Pseudomonas aeruginosa PA01
ccaggccgauguucaggccgg

SEQ ID NO: 1560544 - RNA, 22 nt, Pseudomonas aeruginosa PA01
ccaggccgauguucaggccgga

SEQ ID NO: 1560545 - RNA, 21 nt, Pseudomonas aeruginosa PA01
ccaggccgcaaguaccgccgg

SEQ ID NO: 1560546 - RNA, 16 nt, Pseudomonas aeruginosa PA01
ccaggccgagcgccag

SEQ ID NO: 1560547 - RNA, 16 nt, Pseudomonas aeruginosa PA01
ccaggccgccaugcuc

SEQ ID NO: 1560548 - RNA, 13 nt, Pseudomonas aeruginosa PA01
ccaggccgccggc

SEQ ID NO: 1560549 - RNA, 15 nt, Pseudomonas aeruginosa PA01
ccaggccgcccagga

SEQ ID NO: 1560550 - RNA, 16 nt, Pseudomonas aeruginosa PA01
ccaggccgccgaagaa

SEQ ID NO: 1560551 - RNA, 18 nt, Pseudomonas aeruginosa PA01
ccaggccgccgaagaacu

SEQ ID NO: 1560552 - RNA, 20 nt, Pseudomonas aeruginosa PA01
ccaggccgcgcagucccgcg

SEQ ID NO: 1560553 - RNA, 20 nt, Pseudomonas aeruginosa PA01
ccaggccgcuuuccacccga

SEQ ID NO: 1560554 - RNA, 15 nt, Pseudomonas aeruginosa PA01
ccaggccggagccgc

SEQ ID NO: 1560555 - RNA, 16 nt, Pseudomonas aeruginosa PA01
ccaggccggagccgcg

SEQ ID NO: 1560556 - RNA, 22 nt, Pseudomonas aeruginosa PA01
ccaggccgcgucguaguugccu

SEQ ID NO: 1560557 - RNA, 14 nt, Pseudomonas aeruginosa PA01
ccaggccgcugccg

SEQ ID NO: 1560558 - RNA, 13 nt, Pseudomonas aeruginosa PA01
ccaggccggcggc

SEQ ID NO: 1560559 - RNA, 18 nt, Pseudomonas aeruginosa PA01
ccaggccggugcagaaga

SEQ ID NO: 1560560 - RNA, 15 nt, Pseudomonas aeruginosa PA01
ccagggccagcagcg

SEQ ID NO: 1560561 - RNA, 12 nt, Pseudomonas aeruginosa PA01
ccagggccaggg

SEQ ID NO: 1560562 - RNA, 21 nt, Pseudomonas aeruginosa PA01
ccagggcaugggucagcgcca

SEQ ID NO: 1560563 - RNA, 13 nt, Pseudomonas aeruginosa PA01
ccagggccucggg

SEQ ID NO: 1560564 - RNA, 19 nt, Pseudomonas aeruginosa PA01
ccagggccggcgcccuucg

SEQ ID NO: 1560565 - RNA, 14 nt, Pseudomonas aeruginosa PA01
ccagggcggcgccg

SEQ ID NO: 1560566 - RNA, 23 nt, Pseudomonas aeruginosa PA01
ccagggcgguuaccaggucugug

SEQ ID NO: 1560567 - RNA, 22 nt, Pseudomonas aeruginosa PA01
ccagggcggugagguugccgcc

SEQ ID NO: 1560568 - RNA, 23 nt, Pseudomonas aeruginosa PA01
ccagggcggugagguugccgccg

SEQ ID NO: 1560569 - RNA, 19 nt, Pseudomonas aeruginosa PA01
ccagggccugcuccagcgg

SEQ ID NO: 1560570 - RNA, 13 nt, Pseudomonas aeruginosa PA01
ccagggccuggcg

SEQ ID NO: 1560571 - RNA, 15 nt, Pseudomonas aeruginosa PA01
ccagggccuggcgca

SEQ ID NO: 1560572 - RNA, 20 nt, Pseudomonas aeruginosa PA01
ccagggcgaauaccagugcc

SEQ ID NO: 1560573 - RNA, 23 nt, Pseudomonas aeruginosa PA01
ccagggcgaggaucacgcagcag

SEQ ID NO: 1560574 - RNA, 23 nt, Pseudomonas aeruginosa PA01
ccagggcgaggccgcucuucugg

SEQ ID NO: 1560575 - RNA, 21 nt, Pseudomonas aeruginosa PA01
ccaggggcuagucgcgcagcg

SEQ ID NO: 1560576 - RNA, 13 nt, Pseudomonas aeruginosa PA01
ccaggggcacgcu

SEQ ID NO: 1560577 - RNA, 17 nt, Pseudomonas aeruginosa PA01
ccaggggagcgccggcg

SEQ ID NO: 1560578 - RNA, 14 nt, Pseudomonas aeruginosa PA01
ccagguccggcagc

SEQ ID NO: 1560579 - RNA, 23 nt, Pseudomonas aeruginosa PA01
ccaggucgaacagcggcuggccc

SEQ ID NO: 1560580 - RNA, 16 nt, Pseudomonas aeruginosa PA01
ccaggcugccgccuuc

SEQ ID NO: 1560581 - RNA, 20 nt, Pseudomonas aeruginosa PA01
ccaggcuggccacgaacagg

SEQ ID NO: 1560582 - RNA, 21 nt, Pseudomonas aeruginosa PA01
ccaggcugugggcgacuuccu

SEQ ID NO: 1560583 - RNA, 15 nt, Pseudomonas aeruginosa PA01
ccaggcuguagccgg

SEQ ID NO: 1560584 - RNA, 17 nt, Pseudomonas aeruginosa PA01
ccaggcuuacccgcgac

SEQ ID NO: 1560585 - RNA, 23 nt, Pseudomonas aeruginosa PA01
ccaggcuuacccgcgaccacagg

SEQ ID NO: 1560586 - RNA, 19 nt, Pseudomonas aeruginosa PA01
ccaggcugaucagcccgcu

SEQ ID NO: 1560587 - RNA, 20 nt, Pseudomonas aeruginosa PA01
ccaggcucgguucugcgcac

SEQ ID NO: 1560588 - RNA, 14 nt, Pseudomonas aeruginosa PA01
ccaggcucgccgcc

SEQ ID NO: 1560589 - RNA, 15 nt, Pseudomonas aeruginosa PA01
ccaggcucaccucga

SEQ ID NO: 1560590 - RNA, 16 nt, Pseudomonas aeruginosa PA01
ccaggcucaccucgaa

SEQ ID NO: 1560591 - RNA, 17 nt, Pseudomonas aeruginosa PA01
ccaggcucagcucuccc

SEQ ID NO: 1560592 - RNA, 14 nt, Pseudomonas aeruginosa PA01
ccaggcucgccccg

SEQ ID NO: 1560593 - RNA, 22 nt, Pseudomonas aeruginosa PA01
ccaggcucgccccggcggcgau

SEQ ID NO: 1560594 - RNA, 15 nt, Pseudomonas aeruginosa PA01
ccagggcaaacagcu

SEQ ID NO: 1560595 - RNA, 16 nt, Pseudomonas aeruginosa PA01
ccagggcaaacagcuc

SEQ ID NO: 1560596 - RNA, 17 nt, Pseudomonas aeruginosa PA01
ccagggcaaacagcucc

SEQ ID NO: 1560597 - RNA, 22 nt, Pseudomonas aeruginosa PA01
ccagggagcgcucgcgcagcca

SEQ ID NO: 1560598 - RNA, 15 nt, Pseudomonas aeruginosa PA01
ccagggaagcgcgcg

SEQ ID NO: 1560599 - RNA, 16 nt, Pseudomonas aeruginosa PA01
ccagggaagcgcgcgc

SEQ ID NO: 1560600 - RNA, 13 nt, Pseudomonas aeruginosa PA01
ccagggacgcgcc

SEQ ID NO: 1560601 - RNA, 16 nt, Pseudomonas aeruginosa PA01
ccagggacgcgccggc

SEQ ID NO: 1560602 - RNA, 23 nt, Pseudomonas aeruginosa PA01
ccagggagaacagcagggucagg

SEQ ID NO: 1560603 - RNA, 21 nt, Pseudomonas aeruginosa PA01
ccagggaaaagcccagguggc

SEQ ID NO: 1560604 - RNA, 19 nt, Pseudomonas aeruginosa PA01
ccaggcuuuccaccgccag

SEQ ID NO: 1560605 - RNA, 16 nt, Pseudomonas aeruginosa PA01
ccaggcuucggcgcgc

SEQ ID NO: 1560606 - RNA, 17 nt, Pseudomonas aeruginosa PA01
ccaggcuucggcgcgcu

SEQ ID NO: 1560607 - RNA, 17 nt, Pseudomonas aeruginosa PA01
ccagcgcagccugcugg

SEQ ID NO: 1560608 - RNA, 13 nt, Pseudomonas aeruginosa PA01
ccagcgcaggccg

SEQ ID NO: 1560609 - RNA, 17 nt, Pseudomonas aeruginosa PA01
ccagcgccacuuccagg

SEQ ID NO: 1560610 - RNA, 15 nt, Pseudomonas aeruginosa PA01
ccagcgccacgccgc

SEQ ID NO: 1560611 - RNA, 16 nt, Pseudomonas aeruginosa PA01
ccagcgccacgccgcu

SEQ ID NO: 1560612 - RNA, 14 nt, Pseudomonas aeruginosa PA01
ccagcgccaccagc

SEQ ID NO: 1560613 - RNA, 15 nt, Pseudomonas aeruginosa PA01
ccagcgagcgggcga

SEQ ID NO: 1560614 - RNA, 23 nt, Pseudomonas aeruginosa PA01
ccagcgaccgucgaaccagggac

SEQ ID NO: 1560615 - RNA, 21 nt, Pseudomonas aeruginosa PA01
ccagcgagaacuugccggcgc

SEQ ID NO: 1560616 - RNA, 16 nt, Pseudomonas aeruginosa PA01
ccagcgacuccgccag

SEQ ID NO: 1560617 - RNA, 21 nt, Pseudomonas aeruginosa PA01
ccagcgacuccgccaguuccg

SEQ ID NO: 1560618 - RNA, 12 nt, Pseudomonas aeruginosa PA01
ccagcgccgcgg

SEQ ID NO: 1560619 - RNA, 18 nt, Pseudomonas aeruginosa PA01
ccagcgccgccaggcaga

SEQ ID NO: 1560620 - RNA, 17 nt, Pseudomonas aeruginosa PA01
ccagcgccgccaggcgc

SEQ ID NO: 1560621 - RNA, 21 nt, Pseudomonas aeruginosa PA01
ccagcgccgucaccagcagcc

SEQ ID NO: 1560622 - RNA, 18 nt, Pseudomonas aeruginosa PA01
ccagcgccucgggccgga

SEQ ID NO: 1560623 - RNA, 20 nt, Pseudomonas aeruginosa PA01
ccagcgccgccaaccacucc

SEQ ID NO: 1560624 - RNA, 13 nt, Pseudomonas aeruginosa PA01
ccagcgccaggcc

SEQ ID NO: 1560625 - RNA, 14 nt, Pseudomonas aeruginosa PA01
ccagcgccaggcgc

SEQ ID NO: 1560626 - RNA, 18 nt, Pseudomonas aeruginosa PA01
ccagcgccaggagcaggg

SEQ ID NO: 1560627 - RNA, 14 nt, Pseudomonas aeruginosa PA01
ccagccggccaucc

SEQ ID NO: 1560628 - RNA, 13 nt, Pseudomonas aeruginosa PA01
ccagccggccgcg

SEQ ID NO: 1560629 - RNA, 15 nt, Pseudomonas aeruginosa PA01
ccagccggcgccgca

SEQ ID NO: 1560630 - RNA, 18 nt, Pseudomonas aeruginosa PA01
ccagccgggcuccgccgc

SEQ ID NO: 1560631 - RNA, 20 nt, Pseudomonas aeruginosa PA01
ccacugacgcgcagcgccgc

SEQ ID NO: 1560632 - RNA, 21 nt, Pseudomonas aeruginosa PA01
ccacugacgcgcagcgccgcc

SEQ ID NO: 1560633 - RNA, 22 nt, Pseudomonas aeruginosa PA01
ccacugacgcgcagcgccgccg

SEQ ID NO: 1560634 - RNA, 23 nt, Pseudomonas aeruginosa PA01
ccacugaacuggaucggccccac

SEQ ID NO: 1560635 - RNA, 14 nt, Pseudomonas aeruginosa PA01
ccacucggccagca

SEQ ID NO: 1560636 - RNA, 22 nt, Pseudomonas aeruginosa PA01
ccacucgcgagcuggcgccguc

SEQ ID NO: 1560637 - RNA, 19 nt, Pseudomonas aeruginosa PA01
ccacucggugcagaugacc

SEQ ID NO: 1560638 - RNA, 23 nt, Pseudomonas aeruginosa PA01
ccacuccagauagugcggccagg

SEQ ID NO: 1560639 - RNA, 14 nt, Pseudomonas aeruginosa PA01
ccacuccagccccg

SEQ ID NO: 1560640 - RNA, 15 nt, Pseudomonas aeruginosa PA01
ccacuccggcagcac

SEQ ID NO: 1560641 - RNA, 12 nt, Pseudomonas aeruginosa PA01
ccagccugcagc

SEQ ID NO: 1560642 - RNA, 12 nt, Pseudomonas aeruginosa PA01
ccagccucagcc

SEQ ID NO: 1560643 - RNA, 13 nt, Pseudomonas aeruginosa PA01
ccagccucagcca

SEQ ID NO: 1560644 - RNA, 15 nt, Pseudomonas aeruginosa PA01
ccagccuccacccgg

SEQ ID NO: 1560645 - RNA, 14 nt, Pseudomonas aeruginosa PA01
ccagccguccgcgg

SEQ ID NO: 1560646 - RNA, 23 nt, Pseudomonas aeruginosa PA01
ccagccguggcaggcgcccgguc

SEQ ID NO: 1560647 - RNA, 15 nt, Pseudomonas aeruginosa PA01
ccagcgaaccgccgg

SEQ ID NO: 1560648 - RNA, 17 nt, Pseudomonas aeruginosa PA01
ccagcgaaccgccggcc

SEQ ID NO: 1560649 - RNA, 18 nt, Pseudomonas aeruginosa PA01
ccagcgaaccgccggccu

SEQ ID NO: 1560650 - RNA, 18 nt, Pseudomonas aeruginosa PA01
ccagcgaaagcgucagcg

SEQ ID NO: 1560651 - RNA, 19 nt, Pseudomonas aeruginosa PA01
ccagcgaaagcgucagcgc

SEQ ID NO: 1560652 - RNA, 21 nt, Pseudomonas aeruginosa PA01
ccagccuugcuggacuucccg

SEQ ID NO: 1560653 - RNA, 14 nt, Pseudomonas aeruginosa PA01
ccagccuucccggc

SEQ ID NO: 1560654 - RNA, 20 nt, Pseudomonas aeruginosa PA01
ccagccuuccggcaccacca

SEQ ID NO: 1560655 - RNA, 16 nt, Pseudomonas aeruginosa PA01
ccagcgaauggacagg

SEQ ID NO: 1560656 - RNA, 21 nt, Pseudomonas aeruginosa PA01
ccagcgaauggacaggcgccc

SEQ ID NO: 1560657 - RNA, 16 nt, Pseudomonas aeruginosa PA01
ccagcgugcccgcugc

SEQ ID NO: 1560658 - RNA, 15 nt, Pseudomonas aeruginosa PA01
ccagcgucgccgccg

SEQ ID NO: 1560659 - RNA, 16 nt, Pseudomonas aeruginosa PA01
ccagcgucgccaggcc

SEQ ID NO: 1560660 - RNA, 16 nt, Pseudomonas aeruginosa PA01
ccagcgugggcaacag

SEQ ID NO: 1560661 - RNA, 14 nt, Pseudomonas aeruginosa PA01
ccagcguggccagc

SEQ ID NO: 1560662 - RNA, 21 nt, Pseudomonas aeruginosa PA01
ccagcgucgcgcgugccccgu

SEQ ID NO: 1560663 - RNA, 15 nt, Pseudomonas aeruginosa PA01
ccagcuccagcgccc

SEQ ID NO: 1560664 - RNA, 14 nt, Pseudomonas aeruginosa PA01
ccagcuccgccuga

SEQ ID NO: 1560665 - RNA, 14 nt, Pseudomonas aeruginosa PA01
ccagcuccaccagg

SEQ ID NO: 1560666 - RNA, 16 nt, Pseudomonas aeruginosa PA01
ccagcuccaccaggcc

SEQ ID NO: 1560667 - RNA, 17 nt, Pseudomonas aeruginosa PA01
ccagcuccaccaggcca

SEQ ID NO: 1560668 - RNA, 19 nt, Pseudomonas aeruginosa PA01
ccagcucauggagcaacag

SEQ ID NO: 1560669 - RNA, 18 nt, Pseudomonas aeruginosa PA01
ccagcucagcuccaggcc

SEQ ID NO: 1560670 - RNA, 19 nt, Pseudomonas aeruginosa PA01
ccagcucagcuccaggccg

SEQ ID NO: 1560671 - RNA, 13 nt, Pseudomonas aeruginosa PA01
ccagcucgccgcg

SEQ ID NO: 1560672 - RNA, 19 nt, Pseudomonas aeruginosa PA01
ccagcucgaccuugcccuu

SEQ ID NO: 1560673 - RNA, 14 nt, Pseudomonas aeruginosa PA01
ccagcucgcccgcc

SEQ ID NO: 1560674 - RNA, 19 nt, Pseudomonas aeruginosa PA01
ccagcucgacccgcccgcc

SEQ ID NO: 1560675 - RNA, 20 nt, Pseudomonas aeruginosa PA01
ccagcguuucgaagccgccg

SEQ ID NO: 1560676 - RNA, 21 nt, Pseudomonas aeruginosa PA01
ccagcguuguccucggcggcu

SEQ ID NO: 1560677 - RNA, 13 nt, Pseudomonas aeruginosa PA01
ccagcgcgcagcg

SEQ ID NO: 1560678 - RNA, 19 nt, Pseudomonas aeruginosa PA01
ccagcgcgagcguuccaug

SEQ ID NO: 1560679 - RNA, 14 nt, Pseudomonas aeruginosa PA01
ccagcgcgccgcgc

SEQ ID NO: 1560680 - RNA, 22 nt, Pseudomonas aeruginosa PA01
ccagcgcgcucuucgccgcggc

SEQ ID NO: 1560681 - RNA, 22 nt, Pseudomonas aeruginosa PA01
ccagcgcggcggacaggcagcc

SEQ ID NO: 1560682 - RNA, 23 nt, Pseudomonas aeruginosa PA01
ccagcgcggcggacaggcagccg

SEQ ID NO: 1560683 - RNA, 15 nt, Pseudomonas aeruginosa PA01
ccagcgcuggcaggu

SEQ ID NO: 1560684 - RNA, 12 nt, Pseudomonas aeruginosa PA01
ccagcgcuccuu

SEQ ID NO: 1560685 - RNA, 18 nt, Pseudomonas aeruginosa PA01
ccagcgcucgaacgccgc

SEQ ID NO: 1560686 - RNA, 20 nt, Pseudomonas aeruginosa PA01
ccagcgcucgaacgccgccc

SEQ ID NO: 1560687 - RNA, 14 nt, Pseudomonas aeruginosa PA01
ccagcgcucguagc

SEQ ID NO: 1560688 - RNA, 20 nt, Pseudomonas aeruginosa PA01
ccagcgcucguagccggcgc

SEQ ID NO: 1560689 - RNA, 16 nt, Pseudomonas aeruginosa PA01
ccagcgcuuccucggg

SEQ ID NO: 1560690 - RNA, 20 nt, Pseudomonas aeruginosa PA01
ccagcgcuuccucgggcagc

SEQ ID NO: 1560691 - RNA, 17 nt, Pseudomonas aeruginosa PA01
ccagcggaccgucgggc

SEQ ID NO: 1560692 - RNA, 17 nt, Pseudomonas aeruginosa PA01
ccagcggaaucgcgccc

SEQ ID NO: 1560693 - RNA, 14 nt, Pseudomonas aeruginosa PA01
ccagcggcgccucg

SEQ ID NO: 1560694 - RNA, 22 nt, Pseudomonas aeruginosa PA01
ccagcggcgccucgaagcggau

SEQ ID NO: 1560695 - RNA, 24 nt, Pseudomonas aeruginosa PA01
ccagcggcgcggcguaccagccgc

SEQ ID NO: 1560696 - RNA, 23 nt, Pseudomonas aeruginosa PA01
ccagcggccgcgccuugcucagg

SEQ ID NO: 1560697 - RNA, 12 nt, Pseudomonas aeruginosa PA01
ccagcggcagcc

SEQ ID NO: 1560698 - RNA, 20 nt, Pseudomonas aeruginosa PA01
ccagcggcauccgccgcugg

SEQ ID NO: 1560699 - RNA, 21 nt, Pseudomonas aeruginosa PA01
ccagcggcuuguccuggcgca

SEQ ID NO: 1560700 - RNA, 20 nt, Pseudomonas aeruginosa PA01
ccagcgguaccagcagcgcc

SEQ ID NO: 1560701 - RNA, 23 nt, Pseudomonas aeruginosa PA01
ccagcggcuccucggccugggcg

SEQ ID NO: 1560702 - RNA, 23 nt, Pseudomonas aeruginosa PA01
ccagcgggcggucgcggaccucc

SEQ ID NO: 1560703 - RNA, 18 nt, Pseudomonas aeruginosa PA01
ccagcggguaggaauuga

SEQ ID NO: 1560704 - RNA, 21 nt, Pseudomonas aeruginosa PA01
ccaguucgcugacccagcgca

SEQ ID NO: 1560705 - RNA, 18 nt, Pseudomonas aeruginosa PA01
ccaguucgcugccgccgc

SEQ ID NO: 1560706 - RNA, 14 nt, Pseudomonas aeruginosa PA01
ccaguucgccggcc

SEQ ID NO: 1560707 - RNA, 20 nt, Pseudomonas aeruginosa PA01
ccaguucgcgcaggaccugg

SEQ ID NO: 1560708 - RNA, 16 nt, Pseudomonas aeruginosa PA01
ccaguuccggggucag

SEQ ID NO: 1560709 - RNA, 15 nt, Pseudomonas aeruginosa PA01
ccaguuccucgcgag

SEQ ID NO: 1560710 - RNA, 16 nt, Pseudomonas aeruginosa PA01
ccaguuccugcuccuc

SEQ ID NO: 1560711 - RNA, 20 nt, Pseudomonas aeruginosa PA01
ccaguuccuucacggcaucc

SEQ ID NO: 1560712 - RNA, 13 nt, Pseudomonas aeruginosa PA01
ccagugggccacc

SEQ ID NO: 1560713 - RNA, 24 nt, Pseudomonas aeruginosa PA01
ccaggucgcccugcagcgcgcgcu

SEQ ID NO: 1560714 - RNA, 14 nt, Pseudomonas aeruginosa PA01
ccaggucgccgcac

SEQ ID NO: 1560715 - RNA, 20 nt, Pseudomonas aeruginosa PA01
ccaggucgauccugaccccg

SEQ ID NO: 1560716 - RNA, 22 nt, Pseudomonas aeruginosa PA01
ccaggucgauccugaccccggc

SEQ ID NO: 1560717 - RNA, 15 nt, Pseudomonas aeruginosa PA01
ccaggucgccaugcc

SEQ ID NO: 1560718 - RNA, 18 nt, Pseudomonas aeruginosa PA01
ccaggucggcggcacgcu

SEQ ID NO: 1560719 - RNA, 22 nt, Pseudomonas aeruginosa PA01
ccaggucggcgggcaccgccag

SEQ ID NO: 1560720 - RNA, 23 nt, Pseudomonas aeruginosa PA01
ccaggucggcgggcaccgccagc

SEQ ID NO: 1560721 - RNA, 22 nt, Pseudomonas aeruginosa PA01
ccaggucgcuguccuccagcgg

SEQ ID NO: 1560722 - RNA, 15 nt, Pseudomonas aeruginosa PA01
ccaggucgucgcgcu

SEQ ID NO: 1560723 - RNA, 22 nt, Pseudomonas aeruginosa PA01
ccaggucgucgucacgcaggcu

SEQ ID NO: 1560724 - RNA, 21 nt, Pseudomonas aeruginosa PA01
ccaggucguugcgccggccca

SEQ ID NO: 1560725 - RNA, 20 nt, Pseudomonas aeruginosa PA01
ccaucguucaguugccucug

SEQ ID NO: 1560726 - RNA, 16 nt, Pseudomonas aeruginosa PA01
ccaucgacugcaacag

SEQ ID NO: 1560727 - RNA, 18 nt, Pseudomonas aeruginosa PA01
ccaucgaucagcagcgcc

SEQ ID NO: 1560728 - RNA, 23 nt, Pseudomonas aeruginosa PA01
ccaucgauggucacuggcgaggc

SEQ ID NO: 1560729 - RNA, 15 nt, Pseudomonas aeruginosa PA01
ccaucgauggucagg

SEQ ID NO: 1560730 - RNA, 18 nt, Pseudomonas aeruginosa PA01
ccauccgcgccgaccagc

SEQ ID NO: 1560731 - RNA, 16 nt, Pseudomonas aeruginosa PA01
ccauccgacgccggcu

SEQ ID NO: 1560732 - RNA, 22 nt, Pseudomonas aeruginosa PA01
ccaucgaaaucgcccaccaggu

SEQ ID NO: 1560733 - RNA, 17 nt, Pseudomonas aeruginosa PA01
ccauccuggcgaucagg

SEQ ID NO: 1560734 - RNA, 15 nt, Pseudomonas aeruginosa PA01
ccaugccgcccggcc

SEQ ID NO: 1560735 - RNA, 18 nt, Pseudomonas aeruginosa PA01
ccaugccgcccggccgcu

SEQ ID NO: 1560736 - RNA, 20 nt, Pseudomonas aeruginosa PA01
ccaugccgcuagcccugcug

SEQ ID NO: 1560737 - RNA, 21 nt, Pseudomonas aeruginosa PA01
ccaugccgcuagcccugcugc

SEQ ID NO: 1560738 - RNA, 15 nt, Pseudomonas aeruginosa PA01
ccaugccggcgccga

SEQ ID NO: 1560739 - RNA, 16 nt, Pseudomonas aeruginosa PA01
ccaugccuugcagcgc

SEQ ID NO: 1560740 - RNA, 13 nt, Pseudomonas aeruginosa PA01
ccaugccuccgac

SEQ ID NO: 1560741 - RNA, 20 nt, Pseudomonas aeruginosa PA01
ccaugaucaucgccugcugg

SEQ ID NO: 1560742 - RNA, 22 nt, Pseudomonas aeruginosa PA01
ccaucagcaccaggaagcccca

SEQ ID NO: 1560743 - RNA, 23 nt, Pseudomonas aeruginosa PA01
ccaucaccgacagucccaggcca

SEQ ID NO: 1560744 - RNA, 21 nt, Pseudomonas aeruginosa PA01
ccaucaccgccaucagcacga

SEQ ID NO: 1560745 - RNA, 19 nt, Pseudomonas aeruginosa PA01
ccaucacggccccgagaaa

SEQ ID NO: 1560746 - RNA, 20 nt, Pseudomonas aeruginosa PA01
ccaucagcuccacgucggcc

SEQ ID NO: 1560747 - RNA, 15 nt, Pseudomonas aeruginosa PA01
ccaucagcgccgccu

SEQ ID NO: 1560748 - RNA, 17 nt, Pseudomonas aeruginosa PA01
ccaucagcgccgccucg

SEQ ID NO: 1560749 - RNA, 14 nt, Pseudomonas aeruginosa PA01
ccaucagccgcgcg

SEQ ID NO: 1560750 - RNA, 14 nt, Pseudomonas aeruginosa PA01
ccaucagcgaccag

SEQ ID NO: 1560751 - RNA, 14 nt, Pseudomonas aeruginosa PA01
ccaucagcgccgcc

SEQ ID NO: 1560752 - RNA, 15 nt, Pseudomonas aeruginosa PA01
ccaucagccagccca

SEQ ID NO: 1560753 - RNA, 16 nt, Pseudomonas aeruginosa PA01
ccaucagcgccagggc

SEQ ID NO: 1560754 - RNA, 14 nt, Pseudomonas aeruginosa PA01
ccaucagcaguccg

SEQ ID NO: 1560755 - RNA, 15 nt, Pseudomonas aeruginosa PA01
ccaucagcaguccgc

SEQ ID NO: 1560756 - RNA, 12 nt, Pseudomonas aeruginosa PA01
ccauccccgagg

SEQ ID NO: 1560757 - RNA, 17 nt, Pseudomonas aeruginosa PA01
cccaccugaacgcgccc

SEQ ID NO: 1560758 - RNA, 20 nt, Pseudomonas aeruginosa PA01
cccaccgcccccgcauccuc

SEQ ID NO: 1560759 - RNA, 15 nt, Pseudomonas aeruginosa PA01
cccaccgcgcggcac

SEQ ID NO: 1560760 - RNA, 22 nt, Pseudomonas aeruginosa PA01
cccaccgcgcggcacaggcggc

SEQ ID NO: 1560761 - RNA, 14 nt, Pseudomonas aeruginosa PA01
cccacccccagccc

SEQ ID NO: 1560762 - RNA, 14 nt, Pseudomonas aeruginosa PA01
cccacccccggccc

SEQ ID NO: 1560763 - RNA, 17 nt, Pseudomonas aeruginosa PA01
cccacccccggcccggc

SEQ ID NO: 1560764 - RNA, 16 nt, Pseudomonas aeruginosa PA01
cccaccgaccaccauc

SEQ ID NO: 1560765 - RNA, 22 nt, Pseudomonas aeruginosa PA01
cccacccugcgcgaggagccgu

SEQ ID NO: 1560766 - RNA, 12 nt, Pseudomonas aeruginosa PA01
cccacccguccc

SEQ ID NO: 1560767 - RNA, 12 nt, Pseudomonas aeruginosa PA01
cccaccaggcuc

SEQ ID NO: 1560768 - RNA, 13 nt, Pseudomonas aeruginosa PA01
cccaccagcgucg

SEQ ID NO: 1560769 - RNA, 18 nt, Pseudomonas aeruginosa PA01
cccaccagcgucgccagg

SEQ ID NO: 1560770 - RNA, 19 nt, Pseudomonas aeruginosa PA01
cccaccagcgucgccaggc

SEQ ID NO: 1560771 - RNA, 21 nt, Pseudomonas aeruginosa PA01
cccaccagcgucgccaggccg

SEQ ID NO: 1560772 - RNA, 20 nt, Pseudomonas aeruginosa PA01
cccacaggcccugcagcgcc

SEQ ID NO: 1560773 - RNA, 22 nt, Pseudomonas aeruginosa PA01
cccacaggguggcgggcggccc

SEQ ID NO: 1560774 - RNA, 15 nt, Pseudomonas aeruginosa PA01
cccacagugccaggc

SEQ ID NO: 1560775 - RNA, 14 nt, Pseudomonas aeruginosa PA01
cccaccaccaggac

SEQ ID NO: 1560776 - RNA, 13 nt, Pseudomonas aeruginosa PA01
cccaccaccaucg

SEQ ID NO: 1560777 - RNA, 13 nt, Pseudomonas aeruginosa PA01
cccaccaccaccg

SEQ ID NO: 1560778 - RNA, 19 nt, Pseudomonas aeruginosa PA01
cccacauggcgguccaggu

SEQ ID NO: 1560779 - RNA, 16 nt, Pseudomonas aeruginosa PA01
cccagaccacccggcu

SEQ ID NO: 1560780 - RNA, 14 nt, Pseudomonas aeruginosa PA01
cccagaccagcagc

SEQ ID NO: 1560781 - RNA, 23 nt, Pseudomonas aeruginosa PA01
cccagacccucucccugaaggga

SEQ ID NO: 1560782 - RNA, 13 nt, Pseudomonas aeruginosa PA01
cccagaccuggcc

SEQ ID NO: 1560783 - RNA, 16 nt, Pseudomonas aeruginosa PA01
cccagaccuuccagcc

SEQ ID NO: 1560784 - RNA, 17 nt, Pseudomonas aeruginosa PA01
cccagaccuuccagccg

SEQ ID NO: 1560785 - RNA, 20 nt, Pseudomonas aeruginosa PA01
cccagaccucgaaguccugc

SEQ ID NO: 1560786 - RNA, 14 nt, Pseudomonas aeruginosa PA01
cccagagcccgccg

SEQ ID NO: 1560787 - RNA, 19 nt, Pseudomonas aeruginosa PA01
cccagauccccugcaggac

SEQ ID NO: 1560788 - RNA, 19 nt, Pseudomonas aeruginosa PA01
cccagaugaucuucauccc

SEQ ID NO: 1560789 - RNA, 21 nt, Pseudomonas aeruginosa PA01
cccagauauccagggccagga

SEQ ID NO: 1560790 - RNA, 20 nt, Pseudomonas aeruginosa PA01
cccagagcagcaccagcacc

SEQ ID NO: 1560791 - RNA, 20 nt, Pseudomonas aeruginosa PA01
cccacucaucucagcaaccc

SEQ ID NO: 1560792 - RNA, 15 nt, Pseudomonas aeruginosa PA01
cccacuccggcaggc

SEQ ID NO: 1560793 - RNA, 15 nt, Pseudomonas aeruginosa PA01
cccacucggccagca

SEQ ID NO: 1560794 - RNA, 12 nt, Pseudomonas aeruginosa PA01
cccacugaagac

SEQ ID NO: 1560795 - RNA, 12 nt, Pseudomonas aeruginosa PA01
cccagacacgcc

SEQ ID NO: 1560796 - RNA, 13 nt, Pseudomonas aeruginosa PA01
cccagacacgccu

SEQ ID NO: 1560797 - RNA, 20 nt, Pseudomonas aeruginosa PA01
cccagacacgccucaaggca

SEQ ID NO: 1560798 - RNA, 10 nt, Pseudomonas aeruginosa PA01
cccagacagc

SEQ ID NO: 1560799 - RNA, 20 nt, Pseudomonas aeruginosa PA01
cccacgcauuggcuucgccc

SEQ ID NO: 1560800 - RNA, 19 nt, Pseudomonas aeruginosa PA01
cccacgcgacccaucgccg

SEQ ID NO: 1560801 - RNA, 14 nt, Pseudomonas aeruginosa PA01
cccacgcccaucgg

SEQ ID NO: 1560802 - RNA, 13 nt, Pseudomonas aeruginosa PA01
cccacggccaggc

SEQ ID NO: 1560803 - RNA, 15 nt, Pseudomonas aeruginosa PA01
cccacggccaggccc

SEQ ID NO: 1560804 - RNA, 20 nt, Pseudomonas aeruginosa PA01
cccacggccaggcccacgcc

SEQ ID NO: 1560805 - RNA, 19 nt, Pseudomonas aeruginosa PA01
cccacgcgccuggccgucu

SEQ ID NO: 1560806 - RNA, 15 nt, Pseudomonas aeruginosa PA01
cccacgggcgaccca

SEQ ID NO: 1560807 - RNA, 20 nt, Pseudomonas aeruginosa PA01
cccacgggcgacccaggccg

SEQ ID NO: 1560808 - RNA, 13 nt, Pseudomonas aeruginosa PA01
cccacgggcggcu

SEQ ID NO: 1560809 - RNA, 15 nt, Pseudomonas aeruginosa PA01
cccacggcgcggccg

SEQ ID NO: 1560810 - RNA, 19 nt, Pseudomonas aeruginosa PA01
cccaacagcggugugcuca

SEQ ID NO: 1560811 - RNA, 18 nt, Pseudomonas aeruginosa PA01
cccaauugcccguagggc

SEQ ID NO: 1560812 - RNA, 17 nt, Pseudomonas aeruginosa PA01
cccaauugccguagggc

SEQ ID NO: 1560813 - RNA, 14 nt, Pseudomonas aeruginosa PA01
cccaauccgcgccg

SEQ ID NO: 1560814 - RNA, 16 nt, Pseudomonas aeruginosa PA01
cccaacccggccagcc

SEQ ID NO: 1560815 - RNA, 13 nt, Pseudomonas aeruginosa PA01
ccauuggccaggg

SEQ ID NO: 1560816 - RNA, 19 nt, Pseudomonas aeruginosa PA01
ccauuggccgacgccgcug

SEQ ID NO: 1560817 - RNA, 17 nt, Pseudomonas aeruginosa PA01
ccauugacgaaauacuc

SEQ ID NO: 1560818 - RNA, 21 nt, Pseudomonas aeruginosa PA01
ccaugcgaaaacggcgacccu

SEQ ID NO: 1560819 - RNA, 24 nt, Pseudomonas aeruginosa PA01
ccaugcgaaaacggcgacccuggg

SEQ ID NO: 1560820 - RNA, 20 nt, Pseudomonas aeruginosa PA01
cccgacugucgugccuccag

SEQ ID NO: 1560821 - RNA, 21 nt, Pseudomonas aeruginosa PA01
cccgacugucgugccuccagc

SEQ ID NO: 1560822 - RNA, 13 nt, Pseudomonas aeruginosa PA01
cccgacugcagcg

SEQ ID NO: 1560823 - RNA, 14 nt, Pseudomonas aeruginosa PA01
ccccgggucgcugc

SEQ ID NO: 1560824 - RNA, 14 nt, Pseudomonas aeruginosa PA01
ccccuguggucagg

SEQ ID NO: 1560825 - RNA, 14 nt, Pseudomonas aeruginosa PA01
ccccugggccggcu

SEQ ID NO: 1560826 - RNA, 14 nt, Pseudomonas aeruginosa PA01
ccccuucagcucca

SEQ ID NO: 1560827 - RNA, 17 nt, Pseudomonas aeruginosa PA01
ccccuucagcuccagca

SEQ ID NO: 1560828 - RNA, 16 nt, Pseudomonas aeruginosa PA01
ccccucaggcgccgcu

SEQ ID NO: 1560829 - RNA, 21 nt, Pseudomonas aeruginosa PA01
ccccugcggaccgcagaacca

SEQ ID NO: 1560830 - RNA, 16 nt, Pseudomonas aeruginosa PA01
ccccuggagcccccgu

SEQ ID NO: 1560831 - RNA, 22 nt, Pseudomonas aeruginosa PA01
ccccuggcgcugggccuugagc

SEQ ID NO: 1560832 - RNA, 17 nt, Pseudomonas aeruginosa PA01
cccgccguucgcccgcc

SEQ ID NO: 1560833 - RNA, 20 nt, Pseudomonas aeruginosa PA01
cccgccucgucgccaugcgg

SEQ ID NO: 1560834 - RNA, 15 nt, Pseudomonas aeruginosa PA01
cccgccgcuccuccg

SEQ ID NO: 1560835 - RNA, 14 nt, Pseudomonas aeruginosa PA01
cccgccgcucugcu

SEQ ID NO: 1560836 - RNA, 14 nt, Pseudomonas aeruginosa PA01
cccgccgcugaggc

SEQ ID NO: 1560837 - RNA, 21 nt, Pseudomonas aeruginosa PA01
cccgccggaagacggaaacgc

SEQ ID NO: 1560838 - RNA, 23 nt, Pseudomonas aeruginosa PA01
cccgccggaaugacgagccgcag

SEQ ID NO: 1560839 - RNA, 20 nt, Pseudomonas aeruginosa PA01
cccgccgugcgcuccgccag

SEQ ID NO: 1560840 - RNA, 14 nt, Pseudomonas aeruginosa PA01
cccgccgaacagca

SEQ ID NO: 1560841 - RNA, 16 nt, Pseudomonas aeruginosa PA01
cccgccgcgagcgccg

SEQ ID NO: 1560842 - RNA, 22 nt, Pseudomonas aeruginosa PA01
cccgccgcggcguuagccgccu

SEQ ID NO: 1560843 - RNA, 15 nt, Pseudomonas aeruginosa PA01
cccgccgcggcgagc

SEQ ID NO: 1560844 - RNA, 15 nt, Pseudomonas aeruginosa PA01
cccgccgcgccgcuc

SEQ ID NO: 1560845 - RNA, 15 nt, Pseudomonas aeruginosa PA01
cccgcaucgaggccg

SEQ ID NO: 1560846 - RNA, 23 nt, Pseudomonas aeruginosa PA01
cccgcccggucucagccggcgcu

SEQ ID NO: 1560847 - RNA, 16 nt, Pseudomonas aeruginosa PA01
cccgcccggcaccacc

SEQ ID NO: 1560848 - RNA, 17 nt, Pseudomonas aeruginosa PA01
cccgccccgcaccagcc

SEQ ID NO: 1560849 - RNA, 14 nt, Pseudomonas aeruginosa PA01
cccgccccugcucc

SEQ ID NO: 1560850 - RNA, 13 nt, Pseudomonas aeruginosa PA01
cccgcaggccggc

SEQ ID NO: 1560851 - RNA, 16 nt, Pseudomonas aeruginosa PA01
cccgcaggccggccag

SEQ ID NO: 1560852 - RNA, 14 nt, Pseudomonas aeruginosa PA01
cccgcagcggcagc

SEQ ID NO: 1560853 - RNA, 15 nt, Pseudomonas aeruginosa PA01
cccgcccaguucgua

SEQ ID NO: 1560854 - RNA, 14 nt, Pseudomonas aeruginosa PA01
ccccacucggccag

SEQ ID NO: 1560855 - RNA, 13 nt, Pseudomonas aeruginosa PA01
ccccacuggaaga

SEQ ID NO: 1560856 - RNA, 14 nt, Pseudomonas aeruginosa PA01
ccccagagcccgcc

SEQ ID NO: 1560857 - RNA, 18 nt, Pseudomonas aeruginosa PA01
ccccagagcccgccgaac

SEQ ID NO: 1560858 - RNA, 14 nt, Pseudomonas aeruginosa PA01
ccccagacccaggu

SEQ ID NO: 1560859 - RNA, 21 nt, Pseudomonas aeruginosa PA01
ccccacgggcgacccaggccg

SEQ ID NO: 1560860 - RNA, 22 nt, Pseudomonas aeruginosa PA01
ccccacgggcgacccaggccga

SEQ ID NO: 1560861 - RNA, 21 nt, Pseudomonas aeruginosa PA01
ccccacgguagagacggcggc

SEQ ID NO: 1560862 - RNA, 19 nt, Pseudomonas aeruginosa PA01
ccccacggaggccuucgcc

SEQ ID NO: 1560863 - RNA, 13 nt, Pseudomonas aeruginosa PA01
ccccaggcugccc

SEQ ID NO: 1560864 - RNA, 22 nt, Pseudomonas aeruginosa PA01
ccccaggcgauccacagcaggu

SEQ ID NO: 1560865 - RNA, 12 nt, Pseudomonas aeruginosa PA01
ccccaggcgccc

SEQ ID NO: 1560866 - RNA, 13 nt, Pseudomonas aeruginosa PA01
ccccaggcgccca

SEQ ID NO: 1560867 - RNA, 17 nt, Pseudomonas aeruginosa PA01
ccccaggcgcccaggca

SEQ ID NO: 1560868 - RNA, 22 nt, Pseudomonas aeruginosa PA01
ccccaggcaccguaggccaggc

SEQ ID NO: 1560869 - RNA, 14 nt, Pseudomonas aeruginosa PA01
ccccagcggcaggc

SEQ ID NO: 1560870 - RNA, 20 nt, Pseudomonas aeruginosa PA01
ccccagguaggcgaaggcga

SEQ ID NO: 1560871 - RNA, 22 nt, Pseudomonas aeruginosa PA01
cccauucgaugccgcgcgccug

SEQ ID NO: 1560872 - RNA, 18 nt, Pseudomonas aeruginosa PA01
cccauucgcugucgucgg

SEQ ID NO: 1560873 - RNA, 15 nt, Pseudomonas aeruginosa PA01
ccccaaggcacgccc

SEQ ID NO: 1560874 - RNA, 13 nt, Pseudomonas aeruginosa PA01
cccccgcaaccgc

SEQ ID NO: 1560875 - RNA, 20 nt, Pseudomonas aeruginosa PA01
cccccggcaacacccucccu

SEQ ID NO: 1560876 - RNA, 12 nt, Pseudomonas aeruginosa PA01
ccccgaccaggu

SEQ ID NO: 1560877 - RNA, 22 nt, Pseudomonas aeruginosa PA01
ccccgaccaggucgcuggcacc

SEQ ID NO: 1560878 - RNA, 13 nt, Pseudomonas aeruginosa PA01
ccccgaacuuccc

SEQ ID NO: 1560879 - RNA, 14 nt, Pseudomonas aeruginosa PA01
ccccgaacuucccc

SEQ ID NO: 1560880 - RNA, 12 nt, Pseudomonas aeruginosa PA01
ccccggcgccca

SEQ ID NO: 1560881 - RNA, 16 nt, Pseudomonas aeruginosa PA01
ccccggcuuggcgggc

SEQ ID NO: 1560882 - RNA, 12 nt, Pseudomonas aeruginosa PA01
ccccggccuggc

SEQ ID NO: 1560883 - RNA, 20 nt, Pseudomonas aeruginosa PA01
ccccgggaugcccggccgca

SEQ ID NO: 1560884 - RNA, 12 nt, Pseudomonas aeruginosa PA01
ccccggccaggu

SEQ ID NO: 1560885 - RNA, 23 nt, Pseudomonas aeruginosa PA01
ccccggccagguaccggccaggc

SEQ ID NO: 1560886 - RNA, 16 nt, Pseudomonas aeruginosa PA01
ccccggcccgcgccgc

SEQ ID NO: 1560887 - RNA, 20 nt, Pseudomonas aeruginosa PA01
ccccggcccggcgugagcag

SEQ ID NO: 1560888 - RNA, 16 nt, Pseudomonas aeruginosa PA01
ccccggcagccaccag

SEQ ID NO: 1560889 - RNA, 18 nt, Pseudomonas aeruginosa PA01
ccccggcagccaccaggu

SEQ ID NO: 1560890 - RNA, 16 nt, Pseudomonas aeruginosa PA01
ccccgcauccuccacc

SEQ ID NO: 1560891 - RNA, 17 nt, Pseudomonas aeruginosa PA01
ccccgccccucacuccg

SEQ ID NO: 1560892 - RNA, 15 nt, Pseudomonas aeruginosa PA01
cccgcuugcgccgcc

SEQ ID NO: 1560893 - RNA, 16 nt, Pseudomonas aeruginosa PA01
cccgcuucggcccgcu

SEQ ID NO: 1560894 - RNA, 13 nt, Pseudomonas aeruginosa PA01
cccgcuguccgcc

SEQ ID NO: 1560895 - RNA, 21 nt, Pseudomonas aeruginosa PA01
cccgcugcgcugccagcgccg

SEQ ID NO: 1560896 - RNA, 22 nt, Pseudomonas aeruginosa PA01
cccgcugcaugugccaggccug

SEQ ID NO: 1560897 - RNA, 22 nt, Pseudomonas aeruginosa PA01
cccgcucgucauggcgcacgcc

SEQ ID NO: 1560898 - RNA, 23 nt, Pseudomonas aeruginosa PA01
cccgcucgucauggcgcacgccg

SEQ ID NO: 1560899 - RNA, 21 nt, Pseudomonas aeruginosa PA01
cccgcucaugagauccgccag

SEQ ID NO: 1560900 - RNA, 15 nt, Pseudomonas aeruginosa PA01
cccgcuccgcggccg

SEQ ID NO: 1560901 - RNA, 14 nt, Pseudomonas aeruginosa PA01
cccgcuccggcucu

SEQ ID NO: 1560902 - RNA, 15 nt, Pseudomonas aeruginosa PA01
cccgcuccgucgcuu

SEQ ID NO: 1560903 - RNA, 15 nt, Pseudomonas aeruginosa PA01
cccggcaccaggccg

SEQ ID NO: 1560904 - RNA, 14 nt, Pseudomonas aeruginosa PA01
cccggcacucgccg

SEQ ID NO: 1560905 - RNA, 15 nt, Pseudomonas aeruginosa PA01
cccggcacucgccgg

SEQ ID NO: 1560906 - RNA, 15 nt, Pseudomonas aeruginosa PA01
cccggcaagggccug

SEQ ID NO: 1560907 - RNA, 16 nt, Pseudomonas aeruginosa PA01
cccggcaagggccugc

SEQ ID NO: 1560908 - RNA, 21 nt, Pseudomonas aeruginosa PA01
cccggcaagggccugcucagc

SEQ ID NO: 1560909 - RNA, 22 nt, Pseudomonas aeruginosa PA01
cccggcaauagccgggcuuuuu

SEQ ID NO: 1560910 - RNA, 17 nt, Pseudomonas aeruginosa PA01
cccggaguuccagcggg

SEQ ID NO: 1560911 - RNA, 19 nt, Pseudomonas aeruginosa PA01
cccggagaccgugccgccg

SEQ ID NO: 1560912 - RNA, 21 nt, Pseudomonas aeruginosa PA01
cccggagaccgugccgccggg

SEQ ID NO: 1560913 - RNA, 20 nt, Pseudomonas aeruginosa PA01
cccggagcgcgaaagcgccc

SEQ ID NO: 1560914 - RNA, 22 nt, Pseudomonas aeruginosa PA01
cccggaaugcaaaaagcccacu

SEQ ID NO: 1560915 - RNA, 14 nt, Pseudomonas aeruginosa PA01
cccggacagccuuc

SEQ ID NO: 1560916 - RNA, 19 nt, Pseudomonas aeruginosa PA01
cccggaccugggcaccagu

SEQ ID NO: 1560917 - RNA, 16 nt, Pseudomonas aeruginosa PA01
cccggaccuuguccag

SEQ ID NO: 1560918 - RNA, 18 nt, Pseudomonas aeruginosa PA01
cccggaccuuguccaggg

SEQ ID NO: 1560919 - RNA, 13 nt, Pseudomonas aeruginosa PA01
cccgcgagccgcg

SEQ ID NO: 1560920 - RNA, 16 nt, Pseudomonas aeruginosa PA01
cccgcgagccgcgcag

SEQ ID NO: 1560921 - RNA, 23 nt, Pseudomonas aeruginosa PA01
cccgcgagccguccugcggccgc

SEQ ID NO: 1560922 - RNA, 16 nt, Pseudomonas aeruginosa PA01
cccgcgaggccggccc

SEQ ID NO: 1560923 - RNA, 18 nt, Pseudomonas aeruginosa PA01
cccgcgaggccggcccca

SEQ ID NO: 1560924 - RNA, 15 nt, Pseudomonas aeruginosa PA01
cccgccuucaggcgg

SEQ ID NO: 1560925 - RNA, 17 nt, Pseudomonas aeruginosa PA01
cccgcgacaacggccgu

SEQ ID NO: 1560926 - RNA, 23 nt, Pseudomonas aeruginosa PA01
cccgcgcauggagacggcccgcc

SEQ ID NO: 1560927 - RNA, 15 nt, Pseudomonas aeruginosa PA01
cccgcgccagcgccg

SEQ ID NO: 1560928 - RNA, 16 nt, Pseudomonas aeruginosa PA01
cccgcgccagcgccgc

SEQ ID NO: 1560929 - RNA, 17 nt, Pseudomonas aeruginosa PA01
cccgcgccagcgccgcc

SEQ ID NO: 1560930 - RNA, 14 nt, Pseudomonas aeruginosa PA01
cccgcgccagcucg

SEQ ID NO: 1560931 - RNA, 19 nt, Pseudomonas aeruginosa PA01
cccgcgccuucaguucguu

SEQ ID NO: 1560932 - RNA, 17 nt, Pseudomonas aeruginosa PA01
cccgcgcgacagcucug

SEQ ID NO: 1560933 - RNA, 13 nt, Pseudomonas aeruginosa PA01
cccgcgccuccag

SEQ ID NO: 1560934 - RNA, 16 nt, Pseudomonas aeruginosa PA01
cccgcgccuccaggcg

SEQ ID NO: 1560935 - RNA, 20 nt, Pseudomonas aeruginosa PA01
cccgcgccuccaggcgcgcc

SEQ ID NO: 1560936 - RNA, 13 nt, Pseudomonas aeruginosa PA01
cccgcgccgccgg

SEQ ID NO: 1560937 - RNA, 13 nt, Pseudomonas aeruginosa PA01
cccgcgccgccuc

SEQ ID NO: 1560938 - RNA, 16 nt, Pseudomonas aeruginosa PA01
cccgcgccgccucgau

SEQ ID NO: 1560939 - RNA, 14 nt, Pseudomonas aeruginosa PA01
cccgcggcgcgccu

SEQ ID NO: 1560940 - RNA, 14 nt, Pseudomonas aeruginosa PA01
cccgcgggcagcuc

SEQ ID NO: 1560941 - RNA, 17 nt, Pseudomonas aeruginosa PA01
cccgcgcucggccgccu

SEQ ID NO: 1560942 - RNA, 16 nt, Pseudomonas aeruginosa PA01
cccgcggaccgggcgg

SEQ ID NO: 1560943 - RNA, 13 nt, Pseudomonas aeruginosa PA01
cccgcgcuucuuc

SEQ ID NO: 1560944 - RNA, 16 nt, Pseudomonas aeruginosa PA01
cccgcggcagcagcca

SEQ ID NO: 1560945 - RNA, 13 nt, Pseudomonas aeruginosa PA01
cccgcgucgcgcg

SEQ ID NO: 1560946 - RNA, 12 nt, Pseudomonas aeruginosa PA01
cccgcguccucc

SEQ ID NO: 1560947 - RNA, 11 nt, Pseudomonas aeruginosa PA01
cccggccaggc

SEQ ID NO: 1560948 - RNA, 15 nt, Pseudomonas aeruginosa PA01
cccggccaggccgcc

SEQ ID NO: 1560949 - RNA, 17 nt, Pseudomonas aeruginosa PA01
cccggccaggccgccca

SEQ ID NO: 1560950 - RNA, 13 nt, Pseudomonas aeruginosa PA01
cccggccagcagc

SEQ ID NO: 1560951 - RNA, 18 nt, Pseudomonas aeruginosa PA01
cccggccagcagcgccuc

SEQ ID NO: 1560952 - RNA, 22 nt, Pseudomonas aeruginosa PA01
cccggccagcccggccucgccg

SEQ ID NO: 1560953 - RNA, 14 nt, Pseudomonas aeruginosa PA01
cccggcagcggcug

SEQ ID NO: 1560954 - RNA, 15 nt, Pseudomonas aeruginosa PA01
cccggcagccaccag

SEQ ID NO: 1560955 - RNA, 16 nt, Pseudomonas aeruginosa PA01
cccggcagcucccuug

SEQ ID NO: 1560956 - RNA, 22 nt, Pseudomonas aeruginosa PA01
cccggcagcucccuugccgccg

SEQ ID NO: 1560957 - RNA, 18 nt, Pseudomonas aeruginosa PA01
cccggcaggcaggccugg

SEQ ID NO: 1560958 - RNA, 12 nt, Pseudomonas aeruginosa PA01
cccggcaggcgc

SEQ ID NO: 1560959 - RNA, 14 nt, Pseudomonas aeruginosa PA01
cccggcaggcgcac

SEQ ID NO: 1560960 - RNA, 17 nt, Pseudomonas aeruginosa PA01
cccggcauaggcgccag

SEQ ID NO: 1560961 - RNA, 15 nt, Pseudomonas aeruginosa PA01
cccggcauucgccgg

SEQ ID NO: 1560962 - RNA, 15 nt, Pseudomonas aeruginosa PA01
cccggcaucugccgg

SEQ ID NO: 1560963 - RNA, 17 nt, Pseudomonas aeruginosa PA01
cccggcaucugccgggc

SEQ ID NO: 1560964 - RNA, 14 nt, Pseudomonas aeruginosa PA01
cccggccgcgccag

SEQ ID NO: 1560965 - RNA, 11 nt, Pseudomonas aeruginosa PA01
cccggccgccu

SEQ ID NO: 1560966 - RNA, 19 nt, Pseudomonas aeruginosa PA01
cccggccagguaccggcca

SEQ ID NO: 1560967 - RNA, 17 nt, Pseudomonas aeruginosa PA01
cccggccauccuggccg

SEQ ID NO: 1560968 - RNA, 13 nt, Pseudomonas aeruginosa PA01
cccggccaugagc

SEQ ID NO: 1560969 - RNA, 20 nt, Pseudomonas aeruginosa PA01
cccggccaugagccgggguu

SEQ ID NO: 1560970 - RNA, 14 nt, Pseudomonas aeruginosa PA01
cccggccauggcgg

SEQ ID NO: 1560971 - RNA, 17 nt, Pseudomonas aeruginosa PA01
cccggccauugaacgga

SEQ ID NO: 1560972 - RNA, 19 nt, Pseudomonas aeruginosa PA01
cccggcgcgacgcuccagg

SEQ ID NO: 1560973 - RNA, 14 nt, Pseudomonas aeruginosa PA01
cccggcgcggccga

SEQ ID NO: 1560974 - RNA, 22 nt, Pseudomonas aeruginosa PA01
cccggcgcggcuacccucuccc

SEQ ID NO: 1560975 - RNA, 19 nt, Pseudomonas aeruginosa PA01
cccggcgcacugcgugggu

SEQ ID NO: 1560976 - RNA, 12 nt, Pseudomonas aeruginosa PA01
cccggcgccccg

SEQ ID NO: 1560977 - RNA, 16 nt, Pseudomonas aeruginosa PA01
cccggcgcccggcgca

SEQ ID NO: 1560978 - RNA, 19 nt, Pseudomonas aeruginosa PA01
cccggcgaagcuccucgau

SEQ ID NO: 1560979 - RNA, 11 nt, Pseudomonas aeruginosa PA01
cccggcgagcg

SEQ ID NO: 1560980 - RNA, 14 nt, Pseudomonas aeruginosa PA01
cccggccgcugccg

SEQ ID NO: 1560981 - RNA, 17 nt, Pseudomonas aeruginosa PA01
cccggccgcugccgggc

SEQ ID NO: 1560982 - RNA, 13 nt, Pseudomonas aeruginosa PA01
cccggccuggcug

SEQ ID NO: 1560983 - RNA, 15 nt, Pseudomonas aeruginosa PA01
cccggccuggcgcgc

SEQ ID NO: 1560984 - RNA, 21 nt, Pseudomonas aeruginosa PA01
cccggccuggcgcgcgcgcca

SEQ ID NO: 1560985 - RNA, 17 nt, Pseudomonas aeruginosa PA01
cccggccuggcgucccg

SEQ ID NO: 1560986 - RNA, 17 nt, Pseudomonas aeruginosa PA01
cccggucuagcgccccg

SEQ ID NO: 1560987 - RNA, 14 nt, Pseudomonas aeruginosa PA01
cccggucucagccg

SEQ ID NO: 1560988 - RNA, 21 nt, Pseudomonas aeruginosa PA01
cccgguccguccagcgcgccc

SEQ ID NO: 1560989 - RNA, 15 nt, Pseudomonas aeruginosa PA01
cccgguccugcaacu

SEQ ID NO: 1560990 - RNA, 14 nt, Pseudomonas aeruginosa PA01
cccgguucucgccc

SEQ ID NO: 1560991 - RNA, 19 nt, Pseudomonas aeruginosa PA01
cccgguugagauccuggcc

SEQ ID NO: 1560992 - RNA, 15 nt, Pseudomonas aeruginosa PA01
cccgguuggcgcccc

SEQ ID NO: 1560993 - RNA, 22 nt, Pseudomonas aeruginosa PA01
cccggucgcgcuggaccuggcc

SEQ ID NO: 1560994 - RNA, 13 nt, Pseudomonas aeruginosa PA01
cccgguucagcgg

SEQ ID NO: 1560995 - RNA, 17 nt, Pseudomonas aeruginosa PA01
cccggucucgcgcagcg

SEQ ID NO: 1560996 - RNA, 18 nt, Pseudomonas aeruginosa PA01
cccgguuaccggcgacca

SEQ ID NO: 1560997 - RNA, 20 nt, Pseudomonas aeruginosa PA01
cccguaccccgacgcuguug

SEQ ID NO: 1560998 - RNA, 15 nt, Pseudomonas aeruginosa PA01
cccguaaggccaggc

SEQ ID NO: 1560999 - RNA, 21 nt, Pseudomonas aeruginosa PA01
cccgggcgaccugcucgcgca

SEQ ID NO: 1561000 - RNA, 21 nt, Pseudomonas aeruginosa PA01
cccggcgucggcgcgggcgcc

SEQ ID NO: 1561001 - RNA, 14 nt, Pseudomonas aeruginosa PA01
cccgggcuccgggu

SEQ ID NO: 1561002 - RNA, 21 nt, Pseudomonas aeruginosa PA01
cccggucagcuucgccgcccu

SEQ ID NO: 1561003 - RNA, 13 nt, Pseudomonas aeruginosa PA01
cccgggucggcac

SEQ ID NO: 1561004 - RNA, 23 nt, Pseudomonas aeruginosa PA01
cccgggucgucggucggccagga

SEQ ID NO: 1561005 - RNA, 21 nt, Pseudomonas aeruginosa PA01
cccggcggguucagcccgccg

SEQ ID NO: 1561006 - RNA, 17 nt, Pseudomonas aeruginosa PA01
cccggcgguccgccgcg

SEQ ID NO: 1561007 - RNA, 15 nt, Pseudomonas aeruginosa PA01
cccggcgugagcagg

SEQ ID NO: 1561008 - RNA, 14 nt, Pseudomonas aeruginosa PA01
cccggcgcguagag

SEQ ID NO: 1561009 - RNA, 14 nt, Pseudomonas aeruginosa PA01
cccggcgcuccaac

SEQ ID NO: 1561010 - RNA, 15 nt, Pseudomonas aeruginosa PA01
cccggcgcugcuucu

SEQ ID NO: 1561011 - RNA, 22 nt, Pseudomonas aeruginosa PA01
ccgauacccugggagccgccgg

SEQ ID NO: 1561012 - RNA, 17 nt, Pseudomonas aeruginosa PA01
ccgauaggcgccggcgc

SEQ ID NO: 1561013 - RNA, 15 nt, Pseudomonas aeruginosa PA01
ccgaucaccaccagc

SEQ ID NO: 1561014 - RNA, 16 nt, Pseudomonas aeruginosa PA01
ccgaucaccaccagcg

SEQ ID NO: 1561015 - RNA, 19 nt, Pseudomonas aeruginosa PA01
ccgaucaccaccagcgccg

SEQ ID NO: 1561016 - RNA, 21 nt, Pseudomonas aeruginosa PA01
ccgaucaccaccagcgccgcc

SEQ ID NO: 1561017 - RNA, 13 nt, Pseudomonas aeruginosa PA01
ccgaucaccagca

SEQ ID NO: 1561018 - RNA, 17 nt, Pseudomonas aeruginosa PA01
ccgaucaccagcgccag

SEQ ID NO: 1561019 - RNA, 18 nt, Pseudomonas aeruginosa PA01
ccgaucaccagcgccagg

SEQ ID NO: 1561020 - RNA, 21 nt, Pseudomonas aeruginosa PA01
ccgaucaccagcgccaggccg

SEQ ID NO: 1561021 - RNA, 19 nt, Pseudomonas aeruginosa PA01
ccgaucagcgccucggcgc

SEQ ID NO: 1561022 - RNA, 19 nt, Pseudomonas aeruginosa PA01
ccgaucaacgcggccagca

SEQ ID NO: 1561023 - RNA, 15 nt, Pseudomonas aeruginosa PA01
ccgaucaccuggcca

SEQ ID NO: 1561024 - RNA, 14 nt, Pseudomonas aeruginosa PA01
ccgaucaggaaaua

SEQ ID NO: 1561025 - RNA, 15 nt, Pseudomonas aeruginosa PA01
ccgaucaggucgcgc

SEQ ID NO: 1561026 - RNA, 21 nt, Pseudomonas aeruginosa PA01
ccgaucaguggucgcagcucc

SEQ ID NO: 1561027 - RNA, 21 nt, Pseudomonas aeruginosa PA01
ccgaucccgacgcccuccagc

SEQ ID NO: 1561028 - RNA, 23 nt, Pseudomonas aeruginosa PA01
ccgaucccgacgcccuccagcac

SEQ ID NO: 1561029 - RNA, 16 nt, Pseudomonas aeruginosa PA01
ccgaucaucggcuggu

SEQ ID NO: 1561030 - RNA, 13 nt, Pseudomonas aeruginosa PA01
ccgauccaggcgu

SEQ ID NO: 1561031 - RNA, 23 nt, Pseudomonas aeruginosa PA01
ccgaucggcugcccaagggccug

SEQ ID NO: 1561032 - RNA, 13 nt, Pseudomonas aeruginosa PA01
ccgaucgccucgg

SEQ ID NO: 1561033 - RNA, 13 nt, Pseudomonas aeruginosa PA01
ccgauccuccugg

SEQ ID NO: 1561034 - RNA, 15 nt, Pseudomonas aeruginosa PA01
ccgaucuccuccgcc

SEQ ID NO: 1561035 - RNA, 16 nt, Pseudomonas aeruginosa PA01
ccgaucuccugguaga

SEQ ID NO: 1561036 - RNA, 13 nt, Pseudomonas aeruginosa PA01
ccgaucucgccca

SEQ ID NO: 1561037 - RNA, 19 nt, Pseudomonas aeruginosa PA01
ccgaucucgguuuccagga

SEQ ID NO: 1561038 - RNA, 18 nt, Pseudomonas aeruginosa PA01
ccgaucucgugggccagc

SEQ ID NO: 1561039 - RNA, 13 nt, Pseudomonas aeruginosa PA01
ccgaucuucgccg

SEQ ID NO: 1561040 - RNA, 17 nt, Pseudomonas aeruginosa PA01
ccgaugccggccggcag

SEQ ID NO: 1561041 - RNA, 21 nt, Pseudomonas aeruginosa PA01
ccgaugccgccgaccucggcc

SEQ ID NO: 1561042 - RNA, 16 nt, Pseudomonas aeruginosa PA01
ccgaugaagcaggcgg

SEQ ID NO: 1561043 - RNA, 22 nt, Pseudomonas aeruginosa PA01
ccgcaccugguggacacccugc

SEQ ID NO: 1561044 - RNA, 23 nt, Pseudomonas aeruginosa PA01
ccgcaccugguggacacccugcu

SEQ ID NO: 1561045 - RNA, 13 nt, Pseudomonas aeruginosa PA01
ccgcacccgggca

SEQ ID NO: 1561046 - RNA, 14 nt, Pseudomonas aeruginosa PA01
ccgcaccgccagcg

SEQ ID NO: 1561047 - RNA, 14 nt, Pseudomonas aeruginosa PA01
ccgcaaguggcggc

SEQ ID NO: 1561048 - RNA, 15 nt, Pseudomonas aeruginosa PA01
ccgcaaguggcggcu

SEQ ID NO: 1561049 - RNA, 17 nt, Pseudomonas aeruginosa PA01
ccgcaagcuccccgccg

SEQ ID NO: 1561050 - RNA, 17 nt, Pseudomonas aeruginosa PA01
ccgcaaggccagggcgg

SEQ ID NO: 1561051 - RNA, 20 nt, Pseudomonas aeruginosa PA01
ccgcaaggccagggcggcgc

SEQ ID NO: 1561052 - RNA, 21 nt, Pseudomonas aeruginosa PA01
ccgcaaccugccagaaaaccc

SEQ ID NO: 1561053 - RNA, 16 nt, Pseudomonas aeruginosa PA01
ccgcaaccgguccucg

SEQ ID NO: 1561054 - RNA, 17 nt, Pseudomonas aeruginosa PA01
ccgcaaccgcugccgcc

SEQ ID NO: 1561055 - RNA, 14 nt, Pseudomonas aeruginosa PA01
ccgcaaccgcagac

SEQ ID NO: 1561056 - RNA, 20 nt, Pseudomonas aeruginosa PA01
ccgaugcugaucacccgccc

SEQ ID NO: 1561057 - RNA, 22 nt, Pseudomonas aeruginosa PA01
ccgaugcugaucacccgcccgc

SEQ ID NO: 1561058 - RNA, 13 nt, Pseudomonas aeruginosa PA01
ccgauggccaggg

SEQ ID NO: 1561059 - RNA, 11 nt, Pseudomonas aeruginosa PA01
ccgauggcccc

SEQ ID NO: 1561060 - RNA, 12 nt, Pseudomonas aeruginosa PA01
ccgauggccccg

SEQ ID NO: 1561061 - RNA, 14 nt, Pseudomonas aeruginosa PA01
ccgauggcgcacca

SEQ ID NO: 1561062 - RNA, 21 nt, Pseudomonas aeruginosa PA01
ccgaugcuguauuccuugcgg

SEQ ID NO: 1561063 - RNA, 16 nt, Pseudomonas aeruginosa PA01
ccgaugcucgcgccag

SEQ ID NO: 1561064 - RNA, 19 nt, Pseudomonas aeruginosa PA01
ccgauggcugucggcgccc

SEQ ID NO: 1561065 - RNA, 15 nt, Pseudomonas aeruginosa PA01
ccgaugggccuucag

SEQ ID NO: 1561066 - RNA, 14 nt, Pseudomonas aeruginosa PA01
ccgaggcuuuccag

SEQ ID NO: 1561067 - RNA, 23 nt, Pseudomonas aeruginosa PA01
ccgaggcuuuccagcaggcgcuc

SEQ ID NO: 1561068 - RNA, 12 nt, Pseudomonas aeruginosa PA01
ccgagggccgcg

SEQ ID NO: 1561069 - RNA, 15 nt, Pseudomonas aeruginosa PA01
ccgagggccgcgccg

SEQ ID NO: 1561070 - RNA, 15 nt, Pseudomonas aeruginosa PA01
ccgagggcgcggcgc

SEQ ID NO: 1561071 - RNA, 17 nt, Pseudomonas aeruginosa PA01
ccgagggcgcggcgcca

SEQ ID NO: 1561072 - RNA, 22 nt, Pseudomonas aeruginosa PA01
ccgagggcgaagaucucgccau

SEQ ID NO: 1561073 - RNA, 20 nt, Pseudomonas aeruginosa PA01
ccgaggcggauuugccgccg

SEQ ID NO: 1561074 - RNA, 13 nt, Pseudomonas aeruginosa PA01
ccgaggcgcgcca

SEQ ID NO: 1561075 - RNA, 13 nt, Pseudomonas aeruginosa PA01
ccgaggggcggcu

SEQ ID NO: 1561076 - RNA, 22 nt, Pseudomonas aeruginosa PA01
ccgaggucaguucggugccgcc

SEQ ID NO: 1561077 - RNA, 23 nt, Pseudomonas aeruginosa PA01
ccgaggucaguucggugccgccg

SEQ ID NO: 1561078 - RNA, 13 nt, Pseudomonas aeruginosa PA01
ccgaggucgccgc

SEQ ID NO: 1561079 - RNA, 18 nt, Pseudomonas aeruginosa PA01
ccgaggucgcgggccagg

SEQ ID NO: 1561080 - RNA, 19 nt, Pseudomonas aeruginosa PA01
ccgaggucgcgggccaggc

SEQ ID NO: 1561081 - RNA, 13 nt, Pseudomonas aeruginosa PA01
ccgaggucggcgg

SEQ ID NO: 1561082 - RNA, 18 nt, Pseudomonas aeruginosa PA01
ccgagggugaucagccga

SEQ ID NO: 1561083 - RNA, 20 nt, Pseudomonas aeruginosa PA01
ccgagggugcagagcagagu

SEQ ID NO: 1561084 - RNA, 13 nt, Pseudomonas aeruginosa PA01
ccgaggguggcgc

SEQ ID NO: 1561085 - RNA, 18 nt, Pseudomonas aeruginosa PA01
ccgaggguggcgcuggcc

SEQ ID NO: 1561086 - RNA, 12 nt, Pseudomonas aeruginosa PA01
ccgagggcggca

SEQ ID NO: 1561087 - RNA, 18 nt, Pseudomonas aeruginosa PA01
ccgagggcugagacgcug

SEQ ID NO: 1561088 - RNA, 17 nt, Pseudomonas aeruginosa PA01
ccgagggcugccgcccg

SEQ ID NO: 1561089 - RNA, 16 nt, Pseudomonas aeruginosa PA01
ccgaggccagcaggcc

SEQ ID NO: 1561090 - RNA, 14 nt, Pseudomonas aeruginosa PA01
ccgaggcgacgccc

SEQ ID NO: 1561091 - RNA, 12 nt, Pseudomonas aeruginosa PA01
ccgagcuugacc

SEQ ID NO: 1561092 - RNA, 15 nt, Pseudomonas aeruginosa PA01
ccgagcuugaccuug

SEQ ID NO: 1561093 - RNA, 20 nt, Pseudomonas aeruginosa PA01
ccgaggaacucgcggucccg

SEQ ID NO: 1561094 - RNA, 18 nt, Pseudomonas aeruginosa PA01
ccgagcuuugcgcagcca

SEQ ID NO: 1561095 - RNA, 19 nt, Pseudomonas aeruginosa PA01
ccgagcuuugcgcagccac

SEQ ID NO: 1561096 - RNA, 13 nt, Pseudomonas aeruginosa PA01
ccgaggaaggcgc

SEQ ID NO: 1561097 - RNA, 16 nt, Pseudomonas aeruginosa PA01
ccgaggaagucggcgg

SEQ ID NO: 1561098 - RNA, 23 nt, Pseudomonas aeruginosa PA01
ccgaguuggaaccaguugccgag

SEQ ID NO: 1561099 - RNA, 18 nt, Pseudomonas aeruginosa PA01
ccgaguggccgaaggcgc

SEQ ID NO: 1561100 - RNA, 19 nt, Pseudomonas aeruginosa PA01
ccgaguggccgaaggcgcu

SEQ ID NO: 1561101 - RNA, 13 nt, Pseudomonas aeruginosa PA01
ccgagugcgccca

SEQ ID NO: 1561102 - RNA, 15 nt, Pseudomonas aeruginosa PA01
ccgagugcgcccagc

SEQ ID NO: 1561103 - RNA, 18 nt, Pseudomonas aeruginosa PA01
ccgagugcgcccagcagc

SEQ ID NO: 1561104 - RNA, 21 nt, Pseudomonas aeruginosa PA01
ccgaguucgccgcgagcacca

SEQ ID NO: 1561105 - RNA, 14 nt, Pseudomonas aeruginosa PA01
ccgaggugcggcuu

SEQ ID NO: 1561106 - RNA, 19 nt, Pseudomonas aeruginosa PA01
ccgaggucuuggccagccg

SEQ ID NO: 1561107 - RNA, 23 nt, Pseudomonas aeruginosa PA01
ccgaggucuuggccagccgcgcg

SEQ ID NO: 1561108 - RNA, 12 nt, Pseudomonas aeruginosa PA01
ccgagguucuuc

SEQ ID NO: 1561109 - RNA, 14 nt, Pseudomonas aeruginosa PA01
ccgagguuuccagu

SEQ ID NO: 1561110 - RNA, 14 nt, Pseudomonas aeruginosa PA01
ccgagucccuugcg

SEQ ID NO: 1561111 - RNA, 16 nt, Pseudomonas aeruginosa PA01
ccgaguccgcgcgcgc

SEQ ID NO: 1561112 - RNA, 14 nt, Pseudomonas aeruginosa PA01
ccgaguccugcugc

SEQ ID NO: 1561113 - RNA, 20 nt, Pseudomonas aeruginosa PA01
ccgacugucgugccuccagc

SEQ ID NO: 1561114 - RNA, 15 nt, Pseudomonas aeruginosa PA01
ccgacuuccaggcgc

SEQ ID NO: 1561115 - RNA, 15 nt, Pseudomonas aeruginosa PA01
ccgagaucaccuugu

SEQ ID NO: 1561116 - RNA, 18 nt, Pseudomonas aeruginosa PA01
ccgagaggguggucgcgc

SEQ ID NO: 1561117 - RNA, 19 nt, Pseudomonas aeruginosa PA01
ccgagacgugaagccccug

SEQ ID NO: 1561118 - RNA, 17 nt, Pseudomonas aeruginosa PA01
ccgagcggcaaggccaa

SEQ ID NO: 1561119 - RNA, 13 nt, Pseudomonas aeruginosa PA01
ccgagcgccgccu

SEQ ID NO: 1561120 - RNA, 17 nt, Pseudomonas aeruginosa PA01
ccgagcgccgccugggc

SEQ ID NO: 1561121 - RNA, 13 nt, Pseudomonas aeruginosa PA01
ccgagcgccgcca

SEQ ID NO: 1561122 - RNA, 15 nt, Pseudomonas aeruginosa PA01
ccgagcgcagcgcca

SEQ ID NO: 1561123 - RNA, 22 nt, Pseudomonas aeruginosa PA01
ccgagcgacuggaugaacagcg

SEQ ID NO: 1561124 - RNA, 16 nt, Pseudomonas aeruginosa PA01
ccgagauuggccgccu

SEQ ID NO: 1561125 - RNA, 18 nt, Pseudomonas aeruginosa PA01
ccgagauucugcaggcgc

SEQ ID NO: 1561126 - RNA, 18 nt, Pseudomonas aeruginosa PA01
ccgacggcuucgaccacg

SEQ ID NO: 1561127 - RNA, 23 nt, Pseudomonas aeruginosa PA01
ccgacggcuugaucacgccgaag

SEQ ID NO: 1561128 - RNA, 14 nt, Pseudomonas aeruginosa PA01
ccgacggguucuuc

SEQ ID NO: 1561129 - RNA, 17 nt, Pseudomonas aeruginosa PA01
ccgacggguucuucucg

SEQ ID NO: 1561130 - RNA, 16 nt, Pseudomonas aeruginosa PA01
ccgacgcugaggauca

SEQ ID NO: 1561131 - RNA, 23 nt, Pseudomonas aeruginosa PA01
ccgacgcugaggaucacgauggc

SEQ ID NO: 1561132 - RNA, 17 nt, Pseudomonas aeruginosa PA01
ccgacgcucgcggcauc

SEQ ID NO: 1561133 - RNA, 22 nt, Pseudomonas aeruginosa PA01
ccgacgucgaugacgauggcgc

SEQ ID NO: 1561134 - RNA, 16 nt, Pseudomonas aeruginosa PA01
ccgacguugagaaggc

SEQ ID NO: 1561135 - RNA, 19 nt, Pseudomonas aeruginosa PA01
ccgacguugagaaggcgcc

SEQ ID NO: 1561136 - RNA, 13 nt, Pseudomonas aeruginosa PA01
ccgacgugcaccc

SEQ ID NO: 1561137 - RNA, 23 nt, Pseudomonas aeruginosa PA01
ccgacgugcacccgcuguuucuc

SEQ ID NO: 1561138 - RNA, 16 nt, Pseudomonas aeruginosa PA01
cccgucccgcgcgccg

SEQ ID NO: 1561139 - RNA, 15 nt, Pseudomonas aeruginosa PA01
cccugcacagggacg

SEQ ID NO: 1561140 - RNA, 17 nt, Pseudomonas aeruginosa PA01
cccugcacagggacgcg

SEQ ID NO: 1561141 - RNA, 12 nt, Pseudomonas aeruginosa PA01
cccugcaccuug

SEQ ID NO: 1561142 - RNA, 15 nt, Pseudomonas aeruginosa PA01
cccugcagcgccaug

SEQ ID NO: 1561143 - RNA, 16 nt, Pseudomonas aeruginosa PA01
cccugcagcgcgcgcu

SEQ ID NO: 1561144 - RNA, 15 nt, Pseudomonas aeruginosa PA01
cccugcgccagcauc

SEQ ID NO: 1561145 - RNA, 23 nt, Pseudomonas aeruginosa PA01
cccugcaggccgaauccgccggc

SEQ ID NO: 1561146 - RNA, 16 nt, Pseudomonas aeruginosa PA01
cccugcaucgcgacag

SEQ ID NO: 1561147 - RNA, 22 nt, Pseudomonas aeruginosa PA01
cccuggccgcgcggcuugccgg

SEQ ID NO: 1561148 - RNA, 12 nt, Pseudomonas aeruginosa PA01
cccuggccggcc

SEQ ID NO: 1561149 - RNA, 16 nt, Pseudomonas aeruginosa PA01
cccuggccggccucgg

SEQ ID NO: 1561150 - RNA, 19 nt, Pseudomonas aeruginosa PA01
cccuggccgucggccugcu

SEQ ID NO: 1561151 - RNA, 13 nt, Pseudomonas aeruginosa PA01
cccuggccuuggc

SEQ ID NO: 1561152 - RNA, 15 nt, Pseudomonas aeruginosa PA01
cccuggcgcaggcgg

SEQ ID NO: 1561153 - RNA, 16 nt, Pseudomonas aeruginosa PA01
cccuggcgccagcguu

SEQ ID NO: 1561154 - RNA, 17 nt, Pseudomonas aeruginosa PA01
cccuggcguggccggcg

SEQ ID NO: 1561155 - RNA, 23 nt, Pseudomonas aeruginosa PA01
cccuggcguggccggcgaggcgg

SEQ ID NO: 1561156 - RNA, 20 nt, Pseudomonas aeruginosa PA01
cccuggcggauaucgcgccg

SEQ ID NO: 1561157 - RNA, 17 nt, Pseudomonas aeruginosa PA01
cccuggcagacgcugcu

SEQ ID NO: 1561158 - RNA, 20 nt, Pseudomonas aeruginosa PA01
cccuggcaccgauggcgugu

SEQ ID NO: 1561159 - RNA, 18 nt, Pseudomonas aeruginosa PA01
cccugcgcgaucccccgc

SEQ ID NO: 1561160 - RNA, 17 nt, Pseudomonas aeruginosa PA01
cccugcggaccgcagaa

SEQ ID NO: 1561161 - RNA, 21 nt, Pseudomonas aeruginosa PA01
cccugcuggccggugccgccc

SEQ ID NO: 1561162 - RNA, 22 nt, Pseudomonas aeruginosa PA01
cccugcuggccggugccgcccu

SEQ ID NO: 1561163 - RNA, 22 nt, Pseudomonas aeruginosa PA01
cccugcuucgaacgugcgcgca

SEQ ID NO: 1561164 - RNA, 14 nt, Pseudomonas aeruginosa PA01
cccuggacccgggc

SEQ ID NO: 1561165 - RNA, 14 nt, Pseudomonas aeruginosa PA01
cccuugagcgcguu

SEQ ID NO: 1561166 - RNA, 16 nt, Pseudomonas aeruginosa PA01
cccuugaagcgcuucu

SEQ ID NO: 1561167 - RNA, 21 nt, Pseudomonas aeruginosa PA01
cccuugaagcgcuucugcagg

SEQ ID NO: 1561168 - RNA, 14 nt, Pseudomonas aeruginosa PA01
cccuucuccgccag

SEQ ID NO: 1561169 - RNA, 23 nt, Pseudomonas aeruginosa PA01
cccuucuuuuauacccggcgccc

SEQ ID NO: 1561170 - RNA, 19 nt, Pseudomonas aeruginosa PA01
cccuugccggucaccgugg

SEQ ID NO: 1561171 - RNA, 16 nt, Pseudomonas aeruginosa PA01
cccuugcguccugccu

SEQ ID NO: 1561172 - RNA, 14 nt, Pseudomonas aeruginosa PA01
cccuugcucccgcc

SEQ ID NO: 1561173 - RNA, 16 nt, Pseudomonas aeruginosa PA01
cccuugcucgcggcgu

SEQ ID NO: 1561174 - RNA, 20 nt, Pseudomonas aeruginosa PA01
cccuugucgcccuucuucca

SEQ ID NO: 1561175 - RNA, 15 nt, Pseudomonas aeruginosa PA01
cccuugucgccgcug

SEQ ID NO: 1561176 - RNA, 20 nt, Pseudomonas aeruginosa PA01
cccuuggcugcucgccucgg

SEQ ID NO: 1561177 - RNA, 19 nt, Pseudomonas aeruginosa PA01
cccuugugaaagggcggca

SEQ ID NO: 1561178 - RNA, 22 nt, Pseudomonas aeruginosa PA01
cccuuguagaucgacagccacu

SEQ ID NO: 1561179 - RNA, 18 nt, Pseudomonas aeruginosa PA01
cccuuguacagcuucagg

SEQ ID NO: 1561180 - RNA, 17 nt, Pseudomonas aeruginosa PA01
cccuuguuuuccuggcc

SEQ ID NO: 1561181 - RNA, 20 nt, Pseudomonas aeruginosa PA01
cccuuguuuuccuggcccug

SEQ ID NO: 1561182 - RNA, 21 nt, Pseudomonas aeruginosa PA01
cccuguuucggguccaggcgc

SEQ ID NO: 1561183 - RNA, 17 nt, Pseudomonas aeruginosa PA01
cccuguccccucacggc

SEQ ID NO: 1561184 - RNA, 12 nt, Pseudomonas aeruginosa PA01
cccugucccgcc

SEQ ID NO: 1561185 - RNA, 18 nt, Pseudomonas aeruginosa PA01
cccugucccgccgcgccg

SEQ ID NO: 1561186 - RNA, 19 nt, Pseudomonas aeruginosa PA01
cccuggcucugggccauga

SEQ ID NO: 1561187 - RNA, 16 nt, Pseudomonas aeruginosa PA01
cccuguagcguuccgg

SEQ ID NO: 1561188 - RNA, 19 nt, Pseudomonas aeruginosa PA01
cccuucggucgcgccccgc

SEQ ID NO: 1561189 - RNA, 15 nt, Pseudomonas aeruginosa PA01
cccuucgaacccgcc

SEQ ID NO: 1561190 - RNA, 16 nt, Pseudomonas aeruginosa PA01
ccgaaauagcgcgccc

SEQ ID NO: 1561191 - RNA, 20 nt, Pseudomonas aeruginosa PA01
ccgaaauagcgcgcccagug

SEQ ID NO: 1561192 - RNA, 23 nt, Pseudomonas aeruginosa PA01
cccuuuuccaccggccgcgccuu

SEQ ID NO: 1561193 - RNA, 13 nt, Pseudomonas aeruginosa PA01
cccuuuuccucca

SEQ ID NO: 1561194 - RNA, 12 nt, Pseudomonas aeruginosa PA01
ccgaacaccagc

SEQ ID NO: 1561195 - RNA, 22 nt, Pseudomonas aeruginosa PA01
ccgaaaucgaugucgcggcgcu

SEQ ID NO: 1561196 - RNA, 21 nt, Pseudomonas aeruginosa PA01
ccgaaauggcgguggccgugg

SEQ ID NO: 1561197 - RNA, 21 nt, Pseudomonas aeruginosa PA01
ccgaaauugaccagguacgga

SEQ ID NO: 1561198 - RNA, 15 nt, Pseudomonas aeruginosa PA01
ccgaacagcgcgcca

SEQ ID NO: 1561199 - RNA, 19 nt, Pseudomonas aeruginosa PA01
ccgaacagcagggaggcgc

SEQ ID NO: 1561200 - RNA, 17 nt, Pseudomonas aeruginosa PA01
ccgaacagcaacaccgc

SEQ ID NO: 1561201 - RNA, 17 nt, Pseudomonas aeruginosa PA01
ccgaacaggcgucccau

SEQ ID NO: 1561202 - RNA, 20 nt, Pseudomonas aeruginosa PA01
ccgaacagggcgaaggccac

SEQ ID NO: 1561203 - RNA, 14 nt, Pseudomonas aeruginosa PA01
ccgaacagggcgag

SEQ ID NO: 1561204 - RNA, 16 nt, Pseudomonas aeruginosa PA01
ccgaacagggcgagca

SEQ ID NO: 1561205 - RNA, 18 nt, Pseudomonas aeruginosa PA01
ccgaacagggcgagcagg

SEQ ID NO: 1561206 - RNA, 15 nt, Pseudomonas aeruginosa PA01
ccgaacgccaccagg

SEQ ID NO: 1561207 - RNA, 14 nt, Pseudomonas aeruginosa PA01
ccgaacgccccagu

SEQ ID NO: 1561208 - RNA, 13 nt, Pseudomonas aeruginosa PA01
ccgaaguuguaga

SEQ ID NO: 1561209 - RNA, 16 nt, Pseudomonas aeruginosa PA01
ccgaagucgcccgccg

SEQ ID NO: 1561210 - RNA, 20 nt, Pseudomonas aeruginosa PA01
ccgaagucgcccgccggcgu

SEQ ID NO: 1561211 - RNA, 13 nt, Pseudomonas aeruginosa PA01
ccgaagucggcga

SEQ ID NO: 1561212 - RNA, 16 nt, Pseudomonas aeruginosa PA01
ccgaagucggcgagcc

SEQ ID NO: 1561213 - RNA, 17 nt, Pseudomonas aeruginosa PA01
ccgaaggcgugggcgcc

SEQ ID NO: 1561214 - RNA, 19 nt, Pseudomonas aeruginosa PA01
ccgaagggaaacaccaggc

SEQ ID NO: 1561215 - RNA, 17 nt, Pseudomonas aeruginosa PA01
ccgaagguacugccgcu

SEQ ID NO: 1561216 - RNA, 12 nt, Pseudomonas aeruginosa PA01
ccgaaggugcag

SEQ ID NO: 1561217 - RNA, 16 nt, Pseudomonas aeruginosa PA01
ccgaagcugucgagca

SEQ ID NO: 1561218 - RNA, 18 nt, Pseudomonas aeruginosa PA01
ccgaagggaacccgcggc

SEQ ID NO: 1561219 - RNA, 20 nt, Pseudomonas aeruginosa PA01
ccgaagggaacccgcggcgc

SEQ ID NO: 1561220 - RNA, 23 nt, Pseudomonas aeruginosa PA01
ccgaagggaacccgcggcgcgcc

SEQ ID NO: 1561221 - RNA, 22 nt, Pseudomonas aeruginosa PA01
ccgaagggaaucuuuccuccag

SEQ ID NO: 1561222 - RNA, 19 nt, Pseudomonas aeruginosa PA01
ccgaaggccaggccggcgc

SEQ ID NO: 1561223 - RNA, 16 nt, Pseudomonas aeruginosa PA01
ccgaagaacucggcgc

SEQ ID NO: 1561224 - RNA, 18 nt, Pseudomonas aeruginosa PA01
ccugguugcgccauugcc

SEQ ID NO: 1561225 - RNA, 14 nt, Pseudomonas aeruginosa PA01
ccuguagcagggug

SEQ ID NO: 1561226 - RNA, 14 nt, Pseudomonas aeruginosa PA01
ccugucgcuccggc

SEQ ID NO: 1561227 - RNA, 20 nt, Pseudomonas aeruginosa PA01
ccugucgcuccggcagcgcg

SEQ ID NO: 1561228 - RNA, 15 nt, Pseudomonas aeruginosa PA01
ccugucgaggccucg

SEQ ID NO: 1561229 - RNA, 16 nt, Pseudomonas aeruginosa PA01
ccugucccgccgcgcc

SEQ ID NO: 1561230 - RNA, 15 nt, Pseudomonas aeruginosa PA01
ccugucccagcgagu

SEQ ID NO: 1561231 - RNA, 19 nt, Pseudomonas aeruginosa PA01
ccugucccaucacggcccc

SEQ ID NO: 1561232 - RNA, 14 nt, Pseudomonas aeruginosa PA01
ccuguccccucacg

SEQ ID NO: 1561233 - RNA, 16 nt, Pseudomonas aeruginosa PA01
ccugcucgcgcaccgc

SEQ ID NO: 1561234 - RNA, 15 nt, Pseudomonas aeruginosa PA01
ccugcucgcgcagcc

SEQ ID NO: 1561235 - RNA, 17 nt, Pseudomonas aeruginosa PA01
ccugcucgcggcuggcc

SEQ ID NO: 1561236 - RNA, 17 nt, Pseudomonas aeruginosa PA01
ccuggucauccuggccc

SEQ ID NO: 1561237 - RNA, 22 nt, Pseudomonas aeruginosa PA01
ccugguccggcacuuccuuggu

SEQ ID NO: 1561238 - RNA, 18 nt, Pseudomonas aeruginosa PA01
ccugguucugcuccggac

SEQ ID NO: 1561239 - RNA, 19 nt, Pseudomonas aeruginosa PA01
ccugcugcagggccucgcu

SEQ ID NO: 1561240 - RNA, 17 nt, Pseudomonas aeruginosa PA01
ccuggguggcgacgccg

SEQ ID NO: 1561241 - RNA, 16 nt, Pseudomonas aeruginosa PA01
ccuggguugccgcgcc

SEQ ID NO: 1561242 - RNA, 23 nt, Pseudomonas aeruginosa PA01
ccugugggugaaaaucauccaca

SEQ ID NO: 1561243 - RNA, 22 nt, Pseudomonas aeruginosa PA01
ccuguggaauguccugccgcag

SEQ ID NO: 1561244 - RNA, 18 nt, Pseudomonas aeruginosa PA01
ccuguuucugcuguggag

SEQ ID NO: 1561245 - RNA, 18 nt, Pseudomonas aeruginosa PA01
ccuguuucgaugagcuuc

SEQ ID NO: 1561246 - RNA, 19 nt, Pseudomonas aeruginosa PA01
ccuguugcagagcggccag

SEQ ID NO: 1561247 - RNA, 16 nt, Pseudomonas aeruginosa PA01
ccuguuccagggccug

SEQ ID NO: 1561248 - RNA, 14 nt, Pseudomonas aeruginosa PA01
ccuguuccuccgcc

SEQ ID NO: 1561249 - RNA, 14 nt, Pseudomonas aeruginosa PA01
ccuugaugccggcg

SEQ ID NO: 1561250 - RNA, 12 nt, Pseudomonas aeruginosa PA01
ccuugcagcgcc

SEQ ID NO: 1561251 - RNA, 17 nt, Pseudomonas aeruginosa PA01
ccuugcacuugcggcag

SEQ ID NO: 1561252 - RNA, 22 nt, Pseudomonas aeruginosa PA01
ccuugcagggccgccagccgcc

SEQ ID NO: 1561253 - RNA, 15 nt, Pseudomonas aeruginosa PA01
ccuugcacauccagc

SEQ ID NO: 1561254 - RNA, 20 nt, Pseudomonas aeruginosa PA01
ccuugcacauccagcccugg

SEQ ID NO: 1561255 - RNA, 15 nt, Pseudomonas aeruginosa PA01
ccuugcagcaccgcc

SEQ ID NO: 1561256 - RNA, 20 nt, Pseudomonas aeruginosa PA01
ccuugaggucguuggccagg

SEQ ID NO: 1561257 - RNA, 22 nt, Pseudomonas aeruginosa PA01
ccuugaguagcuggcgcagggc

SEQ ID NO: 1561258 - RNA, 21 nt, Pseudomonas aeruginosa PA01
ccuugaguucccagaccuggc

SEQ ID NO: 1561259 - RNA, 17 nt, Pseudomonas aeruginosa PA01
ccuugagccaguccugg

SEQ ID NO: 1561260 - RNA, 21 nt, Pseudomonas aeruginosa PA01
ccuugagcggcgcccuggcuc

SEQ ID NO: 1561261 - RNA, 22 nt, Pseudomonas aeruginosa PA01
ccuugagcggcgcccuggcucu

SEQ ID NO: 1561262 - RNA, 13 nt, Pseudomonas aeruginosa PA01
ccuugagcgccag

SEQ ID NO: 1561263 - RNA, 15 nt, Pseudomonas aeruginosa PA01
ccuugagcgccagca

SEQ ID NO: 1561264 - RNA, 16 nt, Pseudomonas aeruginosa PA01
ccuugagcgccagcag

SEQ ID NO: 1561265 - RNA, 15 nt, Pseudomonas aeruginosa PA01
ccuugaucacgguga

SEQ ID NO: 1561266 - RNA, 22 nt, Pseudomonas aeruginosa PA01
ccuucucgucgccgcccggcag

SEQ ID NO: 1561267 - RNA, 14 nt, Pseudomonas aeruginosa PA01
ccuugccgcgcccg

SEQ ID NO: 1561268 - RNA, 14 nt, Pseudomonas aeruginosa PA01
ccuugcccuggccg

SEQ ID NO: 1561269 - RNA, 17 nt, Pseudomonas aeruginosa PA01
ccuugcccuggccggca

SEQ ID NO: 1561270 - RNA, 23 nt, Pseudomonas aeruginosa PA01
ccuugcccucgcggaucugcucc

SEQ ID NO: 1561271 - RNA, 22 nt, Pseudomonas aeruginosa PA01
ccuugcccggauuuugggcagc

SEQ ID NO: 1561272 - RNA, 17 nt, Pseudomonas aeruginosa PA01
ccuugccguccagccgg

SEQ ID NO: 1561273 - RNA, 19 nt, Pseudomonas aeruginosa PA01
ccuugccguccagccggcg

SEQ ID NO: 1561274 - RNA, 21 nt, Pseudomonas aeruginosa PA01
ccuugccguccagccggcgcu

SEQ ID NO: 1561275 - RNA, 18 nt, Pseudomonas aeruginosa PA01
ccuugcgaccagguccgg

SEQ ID NO: 1561276 - RNA, 18 nt, Pseudomonas aeruginosa PA01
ccuugcgaaaagcccgcc

SEQ ID NO: 1561277 - RNA, 18 nt, Pseudomonas aeruginosa PA01
ccuugcgcaccagggcca

SEQ ID NO: 1561278 - RNA, 13 nt, Pseudomonas aeruginosa PA01
ccuugcgcaccgc

SEQ ID NO: 1561279 - RNA, 17 nt, Pseudomonas aeruginosa PA01
ccuugcgcaccgccugc

SEQ ID NO: 1561280 - RNA, 19 nt, Pseudomonas aeruginosa PA01
ccuugcgcaccgccugcag

SEQ ID NO: 1561281 - RNA, 20 nt, Pseudomonas aeruginosa PA01
ccuugcgcaccgccugcagc

SEQ ID NO: 1561282 - RNA, 21 nt, Pseudomonas aeruginosa PA01
ccuugcgcaccgccugcagca

SEQ ID NO: 1561283 - RNA, 15 nt, Pseudomonas aeruginosa PA01
ccuugcggcccccag

SEQ ID NO: 1561284 - RNA, 13 nt, Pseudomonas aeruginosa PA01
ccuugcggcgccg

SEQ ID NO: 1561285 - RNA, 17 nt, Pseudomonas aeruginosa PA01
ccuugcggcgcggcccg

SEQ ID NO: 1561286 - RNA, 16 nt, Pseudomonas aeruginosa PA01
ccuugcgcggcaggcc

SEQ ID NO: 1561287 - RNA, 19 nt, Pseudomonas aeruginosa PA01
ccuugcgccaggcccggcg

SEQ ID NO: 1561288 - RNA, 15 nt, Pseudomonas aeruginosa PA01
ccuugcgcccggcuu

SEQ ID NO: 1561289 - RNA, 22 nt, Pseudomonas aeruginosa PA01
ccuugcgcuccuuggcuggcca

SEQ ID NO: 1561290 - RNA, 14 nt, Pseudomonas aeruginosa PA01
ccuuccgacgccgc

SEQ ID NO: 1561291 - RNA, 12 nt, Pseudomonas aeruginosa PA01
ccuuccgccagc

SEQ ID NO: 1561292 - RNA, 14 nt, Pseudomonas aeruginosa PA01
ccuuccagccgccc

SEQ ID NO: 1561293 - RNA, 19 nt, Pseudomonas aeruginosa PA01
ccuuccagaacgccgcgca

SEQ ID NO: 1561294 - RNA, 15 nt, Pseudomonas aeruginosa PA01
ccuucccagccgagg

SEQ ID NO: 1561295 - RNA, 19 nt, Pseudomonas aeruginosa PA01
ccuucucccuucagggaga

SEQ ID NO: 1561296 - RNA, 18 nt, Pseudomonas aeruginosa PA01
ccuucgguggcgaccagg

SEQ ID NO: 1561297 - RNA, 15 nt, Pseudomonas aeruginosa PA01
ccuucggucgcgccc

SEQ ID NO: 1561298 - RNA, 20 nt, Pseudomonas aeruginosa PA01
ccuucggucgcgccccgcca

SEQ ID NO: 1561299 - RNA, 21 nt, Pseudomonas aeruginosa PA01
ccuucgucgcuggggugcaga

SEQ ID NO: 1561300 - RNA, 16 nt, Pseudomonas aeruginosa PA01
ccuucgugggccugcu

SEQ ID NO: 1561301 - RNA, 22 nt, Pseudomonas aeruginosa PA01
ccuucuacaccguacucguuga

SEQ ID NO: 1561302 - RNA, 24 nt, Pseudomonas aeruginosa PA01
ccuucauuacuauuuaccugagua

SEQ ID NO: 1561303 - RNA, 13 nt, Pseudomonas aeruginosa PA01
ccuucaucuuggc

SEQ ID NO: 1561304 - RNA, 17 nt, Pseudomonas aeruginosa PA01
ccuucaucuuggcccau

SEQ ID NO: 1561305 - RNA, 19 nt, Pseudomonas aeruginosa PA01
ccuucaucuuggcccauuc

SEQ ID NO: 1561306 - RNA, 14 nt, Pseudomonas aeruginosa PA01
ccuucaucaccagg

SEQ ID NO: 1561307 - RNA, 15 nt, Pseudomonas aeruginosa PA01
ccuucaucgccaccu

SEQ ID NO: 1561308 - RNA, 18 nt, Pseudomonas aeruginosa PA01
ccuuugagggucagacca

SEQ ID NO: 1561309 - RNA, 12 nt, Pseudomonas aeruginosa PA01
ccuugggccagg

SEQ ID NO: 1561310 - RNA, 14 nt, Pseudomonas aeruginosa PA01
ccuuggucaggccg

SEQ ID NO: 1561311 - RNA, 19 nt, Pseudomonas aeruginosa PA01
ccuuggucaggccgaccag

SEQ ID NO: 1561312 - RNA, 15 nt, Pseudomonas aeruginosa PA01
ccuuggucagggugc

SEQ ID NO: 1561313 - RNA, 18 nt, Pseudomonas aeruginosa PA01
ccuuggucaucagcacau

SEQ ID NO: 1561314 - RNA, 18 nt, Pseudomonas aeruginosa PA01
cgaaaaaaaggcgcugcu

SEQ ID NO: 1561315 - RNA, 13 nt, Pseudomonas aeruginosa PA01
cgaaaagagccgc

SEQ ID NO: 1561316 - RNA, 11 nt, Pseudomonas aeruginosa PA01
ccuuuuuucag

SEQ ID NO: 1561317 - RNA, 18 nt, Pseudomonas aeruginosa PA01
cgaaaauaacgcuugacg

SEQ ID NO: 1561318 - RNA, 19 nt, Pseudomonas aeruginosa PA01
cgaaagaacaacuccugca

SEQ ID NO: 1561319 - RNA, 12 nt, Pseudomonas aeruginosa PA01
cgaaacggcagg

SEQ ID NO: 1561320 - RNA, 17 nt, Pseudomonas aeruginosa PA01
cgaaacgguagcccgcg

SEQ ID NO: 1561321 - RNA, 21 nt, Pseudomonas aeruginosa PA01
cgaaauggguucccagcagca

SEQ ID NO: 1561322 - RNA, 16 nt, Pseudomonas aeruginosa PA01
cgaaauggcagaacau

SEQ ID NO: 1561323 - RNA, 19 nt, Pseudomonas aeruginosa PA01
cgaaauccggugccuugaa

SEQ ID NO: 1561324 - RNA, 16 nt, Pseudomonas aeruginosa PA01
cgaaaucggcaggcug

SEQ ID NO: 1561325 - RNA, 19 nt, Pseudomonas aeruginosa PA01
cgaaagcuucgucgcgcag

SEQ ID NO: 1561326 - RNA, 16 nt, Pseudomonas aeruginosa PA01
cgaaagccaugcccag

SEQ ID NO: 1561327 - RNA, 14 nt, Pseudomonas aeruginosa PA01
cgaaagccuccagc

SEQ ID NO: 1561328 - RNA, 17 nt, Pseudomonas aeruginosa PA01
cgaaagccuccagcagc

SEQ ID NO: 1561329 - RNA, 18 nt, Pseudomonas aeruginosa PA01
cgaaauacucgucgacgg

SEQ ID NO: 1561330 - RNA, 21 nt, Pseudomonas aeruginosa PA01
cgaaauacucgucgacggccu

SEQ ID NO: 1561331 - RNA, 14 nt, Pseudomonas aeruginosa PA01
cgaaccgccggccu

SEQ ID NO: 1561332 - RNA, 14 nt, Pseudomonas aeruginosa PA01
cgaacgcccggcuu

SEQ ID NO: 1561333 - RNA, 15 nt, Pseudomonas aeruginosa PA01
cgaaccagggacgcc

SEQ ID NO: 1561334 - RNA, 12 nt, Pseudomonas aeruginosa PA01
cgaaccagucca

SEQ ID NO: 1561335 - RNA, 17 nt, Pseudomonas aeruginosa PA01
cgaaccaguccagcacg

SEQ ID NO: 1561336 - RNA, 13 nt, Pseudomonas aeruginosa PA01
cgaaccagcagca

SEQ ID NO: 1561337 - RNA, 15 nt, Pseudomonas aeruginosa PA01
cgaaccagcucagcu

SEQ ID NO: 1561338 - RNA, 20 nt, Pseudomonas aeruginosa PA01
cgaaccagcucagcuccagg

SEQ ID NO: 1561339 - RNA, 18 nt, Pseudomonas aeruginosa PA01
cgaaccacauccuugccg

SEQ ID NO: 1561340 - RNA, 16 nt, Pseudomonas aeruginosa PA01
cgaacaucucgaagca

SEQ ID NO: 1561341 - RNA, 20 nt, Pseudomonas aeruginosa PA01
cgaacaugaagccgcgcgcc

SEQ ID NO: 1561342 - RNA, 15 nt, Pseudomonas aeruginosa PA01
cgaaauugccuccgc

SEQ ID NO: 1561343 - RNA, 18 nt, Pseudomonas aeruginosa PA01
cgaacaccggcgccgccu

SEQ ID NO: 1561344 - RNA, 17 nt, Pseudomonas aeruginosa PA01
cgaacagacgcaggcag

SEQ ID NO: 1561345 - RNA, 13 nt, Pseudomonas aeruginosa PA01
cgaacagcgcgcc

SEQ ID NO: 1561346 - RNA, 12 nt, Pseudomonas aeruginosa PA01
cgaacagccaga

SEQ ID NO: 1561347 - RNA, 19 nt, Pseudomonas aeruginosa PA01
cgaacagcagggaggcgca

SEQ ID NO: 1561348 - RNA, 12 nt, Pseudomonas aeruginosa PA01
cgaacagcagca

SEQ ID NO: 1561349 - RNA, 15 nt, Pseudomonas aeruginosa PA01
cgaacagcagcaagc

SEQ ID NO: 1561350 - RNA, 14 nt, Pseudomonas aeruginosa PA01
cgaacagcgcuucc

SEQ ID NO: 1561351 - RNA, 17 nt, Pseudomonas aeruginosa PA01
cgaacagcuccuccagc

SEQ ID NO: 1561352 - RNA, 15 nt, Pseudomonas aeruginosa PA01
cgaacaggaucuccu

SEQ ID NO: 1561353 - RNA, 17 nt, Pseudomonas aeruginosa PA01
cgaacagggcgaaggcc

SEQ ID NO: 1561354 - RNA, 19 nt, Pseudomonas aeruginosa PA01
cgaacagggcgagcagggc

SEQ ID NO: 1561355 - RNA, 18 nt, Pseudomonas aeruginosa PA01
cgaacaggcgucccaugg

SEQ ID NO: 1561356 - RNA, 23 nt, Pseudomonas aeruginosa PA01
cgaacaggcccuugauggugugc

SEQ ID NO: 1561357 - RNA, 14 nt, Pseudomonas aeruginosa PA01
cgaaggcggcagcg

SEQ ID NO: 1561358 - RNA, 16 nt, Pseudomonas aeruginosa PA01
cgaaggcggcgcggcg

SEQ ID NO: 1561359 - RNA, 17 nt, Pseudomonas aeruginosa PA01
cgaaggcgcgcucgauc

SEQ ID NO: 1561360 - RNA, 19 nt, Pseudomonas aeruginosa PA01
cgaagcggcucggccaggg

SEQ ID NO: 1561361 - RNA, 22 nt, Pseudomonas aeruginosa PA01
cgaagcggcucggccagggccg

SEQ ID NO: 1561362 - RNA, 17 nt, Pseudomonas aeruginosa PA01
cgaagcgcuugcccagg

SEQ ID NO: 1561363 - RNA, 15 nt, Pseudomonas aeruginosa PA01
cgaagggaacccgcg

SEQ ID NO: 1561364 - RNA, 14 nt, Pseudomonas aeruginosa PA01
cgaagggcaggccg

SEQ ID NO: 1561365 - RNA, 15 nt, Pseudomonas aeruginosa PA01
cgaaggucggcggca

SEQ ID NO: 1561366 - RNA, 22 nt, Pseudomonas aeruginosa PA01
cgaagguaaggauguccgggug

SEQ ID NO: 1561367 - RNA, 18 nt, Pseudomonas aeruginosa PA01
cgaaguccaccaggcgcc

SEQ ID NO: 1561368 - RNA, 21 nt, Pseudomonas aeruginosa PA01
cgaaguacucguguuccggca

SEQ ID NO: 1561369 - RNA, 15 nt, Pseudomonas aeruginosa PA01
cgaagguuucguccc

SEQ ID NO: 1561370 - RNA, 18 nt, Pseudomonas aeruginosa PA01
cgaagguuucguccccuu

SEQ ID NO: 1561371 - RNA, 19 nt, Pseudomonas aeruginosa PA01
cgaagucggcgagccggcg

SEQ ID NO: 1561372 - RNA, 22 nt, Pseudomonas aeruginosa PA01
cgaagucggcgcgccagaagcg

SEQ ID NO: 1561373 - RNA, 19 nt, Pseudomonas aeruginosa PA01
cgaagucguuguacuggcc

SEQ ID NO: 1561374 - RNA, 16 nt, Pseudomonas aeruginosa PA01
cgaagucgcccgccgg

SEQ ID NO: 1561375 - RNA, 17 nt, Pseudomonas aeruginosa PA01
cgaagucgcgagguucc

SEQ ID NO: 1561376 - RNA, 22 nt, Pseudomonas aeruginosa PA01
cgaaguccuugugcugcucgca

SEQ ID NO: 1561377 - RNA, 16 nt, Pseudomonas aeruginosa PA01
cgaagucgaagcagcc

SEQ ID NO: 1561378 - RNA, 21 nt, Pseudomonas aeruginosa PA01
cgaagucgaagcagcccagcg

SEQ ID NO: 1561379 - RNA, 21 nt, Pseudomonas aeruginosa PA01
cgaacgggaaguaggccuggc

SEQ ID NO: 1561380 - RNA, 13 nt, Pseudomonas aeruginosa PA01
cgaagaccaccau

SEQ ID NO: 1561381 - RNA, 17 nt, Pseudomonas aeruginosa PA01
cgaagaccagggugggg

SEQ ID NO: 1561382 - RNA, 20 nt, Pseudomonas aeruginosa PA01
cgaagaccuguugcagagcg

SEQ ID NO: 1561383 - RNA, 12 nt, Pseudomonas aeruginosa PA01
cgaagagcaccu

SEQ ID NO: 1561384 - RNA, 23 nt, Pseudomonas aeruginosa PA01
cgaacggcgugagggucgcgccg

SEQ ID NO: 1561385 - RNA, 19 nt, Pseudomonas aeruginosa PA01
cgaacgcuugagccccggc

SEQ ID NO: 1561386 - RNA, 23 nt, Pseudomonas aeruginosa PA01
cgaacggaucgcgucgcaggcga

SEQ ID NO: 1561387 - RNA, 20 nt, Pseudomonas aeruginosa PA01
cgaagccggauucgcgcagc

SEQ ID NO: 1561388 - RNA, 15 nt, Pseudomonas aeruginosa PA01
cgaagccgcgcagca

SEQ ID NO: 1561389 - RNA, 19 nt, Pseudomonas aeruginosa PA01
cgaagcgaccgaucaugcc

SEQ ID NO: 1561390 - RNA, 22 nt, Pseudomonas aeruginosa PA01
cgaagcgauuccaugggcagac

SEQ ID NO: 1561391 - RNA, 15 nt, Pseudomonas aeruginosa PA01
cgaagcgcagcuccg

SEQ ID NO: 1561392 - RNA, 16 nt, Pseudomonas aeruginosa PA01
cgaagcgcagcuccgg

SEQ ID NO: 1561393 - RNA, 15 nt, Pseudomonas aeruginosa PA01
cgaagcgccaggcgu

SEQ ID NO: 1561394 - RNA, 21 nt, Pseudomonas aeruginosa PA01
cgaagaguaaaugcuugaaaa

SEQ ID NO: 1561395 - RNA, 19 nt, Pseudomonas aeruginosa PA01
cgaagcccucgcgacggca

SEQ ID NO: 1561396 - RNA, 12 nt, Pseudomonas aeruginosa PA01
cgaagccgagcu

SEQ ID NO: 1561397 - RNA, 18 nt, Pseudomonas aeruginosa PA01
cgaagaucuuuucgaugg

SEQ ID NO: 1561398 - RNA, 16 nt, Pseudomonas aeruginosa PA01
cgaagauccgcuccag

SEQ ID NO: 1561399 - RNA, 16 nt, Pseudomonas aeruginosa PA01
ccugacgaugcagggc

SEQ ID NO: 1561400 - RNA, 14 nt, Pseudomonas aeruginosa PA01
ccugaccccggccu

SEQ ID NO: 1561401 - RNA, 16 nt, Pseudomonas aeruginosa PA01
ccugaccccggccugg

SEQ ID NO: 1561402 - RNA, 18 nt, Pseudomonas aeruginosa PA01
ccugagaucagcgcccgg

SEQ ID NO: 1561403 - RNA, 17 nt, Pseudomonas aeruginosa PA01
ccugacguugccgcgcg

SEQ ID NO: 1561404 - RNA, 20 nt, Pseudomonas aeruginosa PA01
ccucuucgccauccuugagu

SEQ ID NO: 1561405 - RNA, 22 nt, Pseudomonas aeruginosa PA01
ccucuggcugaagacccugcac

SEQ ID NO: 1561406 - RNA, 20 nt, Pseudomonas aeruginosa PA01
ccugaagggagagggaacca

SEQ ID NO: 1561407 - RNA, 19 nt, Pseudomonas aeruginosa PA01
ccugaaggcgcggggcgag

SEQ ID NO: 1561408 - RNA, 17 nt, Pseudomonas aeruginosa PA01
ccugaaggaccagcuug

SEQ ID NO: 1561409 - RNA, 17 nt, Pseudomonas aeruginosa PA01
ccugaucaucugggcca

SEQ ID NO: 1561410 - RNA, 22 nt, Pseudomonas aeruginosa PA01
ccugaucaucugggccaucgcc

SEQ ID NO: 1561411 - RNA, 20 nt, Pseudomonas aeruginosa PA01
ccugcagacgguucagcagc

SEQ ID NO: 1561412 - RNA, 22 nt, Pseudomonas aeruginosa PA01
ccugcagacgguucagcagcgg

SEQ ID NO: 1561413 - RNA, 16 nt, Pseudomonas aeruginosa PA01
ccugcagauaaagcug

SEQ ID NO: 1561414 - RNA, 18 nt, Pseudomonas aeruginosa PA01
ccugcagauaaagcugga

SEQ ID NO: 1561415 - RNA, 19 nt, Pseudomonas aeruginosa PA01
ccugcagauaaagcuggac

SEQ ID NO: 1561416 - RNA, 14 nt, Pseudomonas aeruginosa PA01
ccugcagcgccucg

SEQ ID NO: 1561417 - RNA, 17 nt, Pseudomonas aeruginosa PA01
ccugcagcaguuccagg

SEQ ID NO: 1561418 - RNA, 21 nt, Pseudomonas aeruginosa PA01
ccugcagcaggucgagcaguu

SEQ ID NO: 1561419 - RNA, 22 nt, Pseudomonas aeruginosa PA01
ccugcaauggggcggccggcgc

SEQ ID NO: 1561420 - RNA, 20 nt, Pseudomonas aeruginosa PA01
ccugcaacucggcgucgcgc

SEQ ID NO: 1561421 - RNA, 22 nt, Pseudomonas aeruginosa PA01
ccugcaacucgucguccagcgg

SEQ ID NO: 1561422 - RNA, 17 nt, Pseudomonas aeruginosa PA01
ccugcaacgccagcagg

SEQ ID NO: 1561423 - RNA, 16 nt, Pseudomonas aeruginosa PA01
ccugcaacgccgccaa

SEQ ID NO: 1561424 - RNA, 17 nt, Pseudomonas aeruginosa PA01
ccugcaacgccgccaac

SEQ ID NO: 1561425 - RNA, 22 nt, Pseudomonas aeruginosa PA01
ccugcaacacccaggccugggu

SEQ ID NO: 1561426 - RNA, 15 nt, Pseudomonas aeruginosa PA01
ccugcaacaggaccc

SEQ ID NO: 1561427 - RNA, 13 nt, Pseudomonas aeruginosa PA01
ccugcaacagugg

SEQ ID NO: 1561428 - RNA, 21 nt, Pseudomonas aeruginosa PA01
ccugcaacaguggguaggcca

SEQ ID NO: 1561429 - RNA, 18 nt, Pseudomonas aeruginosa PA01
ccugcgcuuccggcagcc

SEQ ID NO: 1561430 - RNA, 20 nt, Pseudomonas aeruginosa PA01
ccugcgcuuccggcagccag

SEQ ID NO: 1561431 - RNA, 17 nt, Pseudomonas aeruginosa PA01
ccugcggugucccuucu

SEQ ID NO: 1561432 - RNA, 20 nt, Pseudomonas aeruginosa PA01
ccugcgucgcauccaccagc

SEQ ID NO: 1561433 - RNA, 14 nt, Pseudomonas aeruginosa PA01
ccugcggucgggug

SEQ ID NO: 1561434 - RNA, 14 nt, Pseudomonas aeruginosa PA01
ccugcgugagcugg

SEQ ID NO: 1561435 - RNA, 16 nt, Pseudomonas aeruginosa PA01
ccugcgugagcugggc

SEQ ID NO: 1561436 - RNA, 19 nt, Pseudomonas aeruginosa PA01
ccugcgugagcugggcagg

SEQ ID NO: 1561437 - RNA, 20 nt, Pseudomonas aeruginosa PA01
ccugcguggaaccgcggcgc

SEQ ID NO: 1561438 - RNA, 17 nt, Pseudomonas aeruginosa PA01
ccugcgccgcagcggcc

SEQ ID NO: 1561439 - RNA, 22 nt, Pseudomonas aeruginosa PA01
ccugcgcaaggaacuggaagcc

SEQ ID NO: 1561440 - RNA, 14 nt, Pseudomonas aeruginosa PA01
ccugcgccggacca

SEQ ID NO: 1561441 - RNA, 22 nt, Pseudomonas aeruginosa PA01
ccugcgcccucaagucuccagc

SEQ ID NO: 1561442 - RNA, 18 nt, Pseudomonas aeruginosa PA01
ccugcgcgcaccaggccu

SEQ ID NO: 1561443 - RNA, 19 nt, Pseudomonas aeruginosa PA01
ccugcaucacguacggcgc

SEQ ID NO: 1561444 - RNA, 22 nt, Pseudomonas aeruginosa PA01
ccugcaugcuuuugaacaccag

SEQ ID NO: 1561445 - RNA, 18 nt, Pseudomonas aeruginosa PA01
ccugcaugccggccgucg

SEQ ID NO: 1561446 - RNA, 19 nt, Pseudomonas aeruginosa PA01
ccugccggugcucggccug

SEQ ID NO: 1561447 - RNA, 16 nt, Pseudomonas aeruginosa PA01
ccugccguauccgcgg

SEQ ID NO: 1561448 - RNA, 14 nt, Pseudomonas aeruginosa PA01
ccugccggcacgcu

SEQ ID NO: 1561449 - RNA, 15 nt, Pseudomonas aeruginosa PA01
ccugccgaucgccgc

SEQ ID NO: 1561450 - RNA, 14 nt, Pseudomonas aeruginosa PA01
ccugccgcaggcgg

SEQ ID NO: 1561451 - RNA, 13 nt, Pseudomonas aeruginosa PA01
ccugccgcccggc

SEQ ID NO: 1561452 - RNA, 14 nt, Pseudomonas aeruginosa PA01
ccugccgcccuucg

SEQ ID NO: 1561453 - RNA, 19 nt, Pseudomonas aeruginosa PA01
ccucaacgaccgcccaggc

SEQ ID NO: 1561454 - RNA, 20 nt, Pseudomonas aeruginosa PA01
ccucaaccggcguccccuuc

SEQ ID NO: 1561455 - RNA, 20 nt, Pseudomonas aeruginosa PA01
ccucacggucgcaggggcuu

SEQ ID NO: 1561456 - RNA, 18 nt, Pseudomonas aeruginosa PA01
ccucacggcgcagccgca

SEQ ID NO: 1561457 - RNA, 20 nt, Pseudomonas aeruginosa PA01
ccucacggcgcagccgcaag

SEQ ID NO: 1561458 - RNA, 20 nt, Pseudomonas aeruginosa PA01
ccucacggcgcgagaaaaac

SEQ ID NO: 1561459 - RNA, 21 nt, Pseudomonas aeruginosa PA01
ccucaggcgcugcgcggccug

SEQ ID NO: 1561460 - RNA, 17 nt, Pseudomonas aeruginosa PA01
ccucaggauagccggcg

SEQ ID NO: 1561461 - RNA, 17 nt, Pseudomonas aeruginosa PA01
ccucagguagucggcga

SEQ ID NO: 1561462 - RNA, 14 nt, Pseudomonas aeruginosa PA01
ccgugcgcaccucg

SEQ ID NO: 1561463 - RNA, 11 nt, Pseudomonas aeruginosa PA01
ccgugcggccu

SEQ ID NO: 1561464 - RNA, 16 nt, Pseudomonas aeruginosa PA01
ccgugcgcuccgccag

SEQ ID NO: 1561465 - RNA, 20 nt, Pseudomonas aeruginosa PA01
ccgugcgcuccgccaggccg

SEQ ID NO: 1561466 - RNA, 23 nt, Pseudomonas aeruginosa PA01
ccgugcggaaaccgcggccggcu

SEQ ID NO: 1561467 - RNA, 15 nt, Pseudomonas aeruginosa PA01
ccgugccgggccagc

SEQ ID NO: 1561468 - RNA, 13 nt, Pseudomonas aeruginosa PA01
ccuccgccagccc

SEQ ID NO: 1561469 - RNA, 14 nt, Pseudomonas aeruginosa PA01
ccuccgccagcccc

SEQ ID NO: 1561470 - RNA, 19 nt, Pseudomonas aeruginosa PA01
ccuccgccaggaccuccug

SEQ ID NO: 1561471 - RNA, 21 nt, Pseudomonas aeruginosa PA01
ccuccgccaggaccuccugca

SEQ ID NO: 1561472 - RNA, 22 nt, Pseudomonas aeruginosa PA01
ccuccgccaggaccuccugcac

SEQ ID NO: 1561473 - RNA, 21 nt, Pseudomonas aeruginosa PA01
ccuccgacgccccccacucgc

SEQ ID NO: 1561474 - RNA, 13 nt, Pseudomonas aeruginosa PA01
ccucccgccgcgg

SEQ ID NO: 1561475 - RNA, 13 nt, Pseudomonas aeruginosa PA01
ccucccgcgccag

SEQ ID NO: 1561476 - RNA, 22 nt, Pseudomonas aeruginosa PA01
ccucccgggccagcuccgccug

SEQ ID NO: 1561477 - RNA, 14 nt, Pseudomonas aeruginosa PA01
ccuccagcauccag

SEQ ID NO: 1561478 - RNA, 15 nt, Pseudomonas aeruginosa PA01
ccuccagcaggaccu

SEQ ID NO: 1561479 - RNA, 18 nt, Pseudomonas aeruginosa PA01
ccuccagcaggaccuggc

SEQ ID NO: 1561480 - RNA, 12 nt, Pseudomonas aeruginosa PA01
ccuccagccagc

SEQ ID NO: 1561481 - RNA, 15 nt, Pseudomonas aeruginosa PA01
ccuccagccagcagc

SEQ ID NO: 1561482 - RNA, 16 nt, Pseudomonas aeruginosa PA01
ccuccagcaccgccug

SEQ ID NO: 1561483 - RNA, 21 nt, Pseudomonas aeruginosa PA01
ccuccagcacucgcuccuccg

SEQ ID NO: 1561484 - RNA, 20 nt, Pseudomonas aeruginosa PA01
ccuccagcaacgccgccccc

SEQ ID NO: 1561485 - RNA, 23 nt, Pseudomonas aeruginosa PA01
ccuccagcaacgccgcccccagc

SEQ ID NO: 1561486 - RNA, 14 nt, Pseudomonas aeruginosa PA01
ccucccccagcggg

SEQ ID NO: 1561487 - RNA, 15 nt, Pseudomonas aeruginosa PA01
ccuccagcgccucgc

SEQ ID NO: 1561488 - RNA, 11 nt, Pseudomonas aeruginosa PA01
ccuccagcggc

SEQ ID NO: 1561489 - RNA, 22 nt, Pseudomonas aeruginosa PA01
ccuccagcgggccuucgccagc

SEQ ID NO: 1561490 - RNA, 23 nt, Pseudomonas aeruginosa PA01
ccuccagcgucugccgcuggcgg

SEQ ID NO: 1561491 - RNA, 15 nt, Pseudomonas aeruginosa PA01
ccuccagcguggcgg

SEQ ID NO: 1561492 - RNA, 20 nt, Pseudomonas aeruginosa PA01
ccucauggaaaccccggccu

SEQ ID NO: 1561493 - RNA, 17 nt, Pseudomonas aeruginosa PA01
aaacgcccggcagaugc

SEQ ID NO: 1561494 - RNA, 18 nt, Pseudomonas aeruginosa PA01
ccucagucgugcaggugu

SEQ ID NO: 1561495 - RNA, 17 nt, Pseudomonas aeruginosa PA01
ccucgcagagcgccagc

SEQ ID NO: 1561496 - RNA, 14 nt, Pseudomonas aeruginosa PA01
ccucgcagccggcg

SEQ ID NO: 1561497 - RNA, 15 nt, Pseudomonas aeruginosa PA01
ccucgccaaccagga

SEQ ID NO: 1561498 - RNA, 17 nt, Pseudomonas aeruginosa PA01
ccucgccauucucgcca

SEQ ID NO: 1561499 - RNA, 16 nt, Pseudomonas aeruginosa PA01
ccucgcgccgcgccag

SEQ ID NO: 1561500 - RNA, 18 nt, Pseudomonas aeruginosa PA01
ccucgcgccgcgccagca

SEQ ID NO: 1561501 - RNA, 15 nt, Pseudomonas aeruginosa PA01
ccuccucggcggcuu

SEQ ID NO: 1561502 - RNA, 21 nt, Pseudomonas aeruginosa PA01
ccuccucguaggcguccuggc

SEQ ID NO: 1561503 - RNA, 14 nt, Pseudomonas aeruginosa PA01
ccuccucgccgccg

SEQ ID NO: 1561504 - RNA, 21 nt, Pseudomonas aeruginosa PA01
ccuccgccgcuuccgccaggc

SEQ ID NO: 1561505 - RNA, 14 nt, Pseudomonas aeruginosa PA01
ccuccgcucugcug

SEQ ID NO: 1561506 - RNA, 17 nt, Pseudomonas aeruginosa PA01
ccuccgcucugcuggcc

SEQ ID NO: 1561507 - RNA, 17 nt, Pseudomonas aeruginosa PA01
ccucgcggcucaccgag

SEQ ID NO: 1561508 - RNA, 22 nt, Pseudomonas aeruginosa PA01
ccucgcggcucaccgagaacca

SEQ ID NO: 1561509 - RNA, 18 nt, Pseudomonas aeruginosa PA01
ccucgcgguucugcuccu

SEQ ID NO: 1561510 - RNA, 16 nt, Pseudomonas aeruginosa PA01
ccucgcggaucugcuc

SEQ ID NO: 1561511 - RNA, 18 nt, Pseudomonas aeruginosa PA01
ccucgcgcucggcggccu

SEQ ID NO: 1561512 - RNA, 14 nt, Pseudomonas aeruginosa PA01
ccucgcggcggcag

SEQ ID NO: 1561513 - RNA, 15 nt, Pseudomonas aeruginosa PA01
ccucgcggcggcagg

SEQ ID NO: 1561514 - RNA, 19 nt, Pseudomonas aeruginosa PA01
ccucgcggaagucggcggg

SEQ ID NO: 1561515 - RNA, 20 nt, Pseudomonas aeruginosa PA01
ccucgcggaccucgggcagc

SEQ ID NO: 1561516 - RNA, 17 nt, Pseudomonas aeruginosa PA01
ccucgcgcguggccgcc

SEQ ID NO: 1561517 - RNA, 22 nt, Pseudomonas aeruginosa PA01
ccucgcgcguggccgccagggu

SEQ ID NO: 1561518 - RNA, 13 nt, Pseudomonas aeruginosa PA01
ccucggccgacag

SEQ ID NO: 1561519 - RNA, 18 nt, Pseudomonas aeruginosa PA01
ccucggccauaccuccag

SEQ ID NO: 1561520 - RNA, 19 nt, Pseudomonas aeruginosa PA01
ccucggccauaccuccagc

SEQ ID NO: 1561521 - RNA, 19 nt, Pseudomonas aeruginosa PA01
ccucggccaugccggccag

SEQ ID NO: 1561522 - RNA, 16 nt, Pseudomonas aeruginosa PA01
ccucgcuagucuuccu

SEQ ID NO: 1561523 - RNA, 13 nt, Pseudomonas aeruginosa PA01
ccucggccaggca

SEQ ID NO: 1561524 - RNA, 14 nt, Pseudomonas aeruginosa PA01
ccucggccaggcgg

SEQ ID NO: 1561525 - RNA, 18 nt, Pseudomonas aeruginosa PA01
ccucggcgcgauccuccg

SEQ ID NO: 1561526 - RNA, 19 nt, Pseudomonas aeruginosa PA01
ccucggcgcgauccuccgc

SEQ ID NO: 1561527 - RNA, 14 nt, Pseudomonas aeruginosa PA01
ccucggcgcuggcc

SEQ ID NO: 1561528 - RNA, 16 nt, Pseudomonas aeruginosa PA01
ccucggcgcuggccag

SEQ ID NO: 1561529 - RNA, 17 nt, Pseudomonas aeruginosa PA01
ccucggcgaugccggag

SEQ ID NO: 1561530 - RNA, 20 nt, Pseudomonas aeruginosa PA01
ccucggcgccauaggccagc

SEQ ID NO: 1561531 - RNA, 23 nt, Pseudomonas aeruginosa PA01
ccucggcgccauaggccagcacc

SEQ ID NO: 1561532 - RNA, 19 nt, Pseudomonas aeruginosa PA01
ccucggcgcccgccugcag

SEQ ID NO: 1561533 - RNA, 16 nt, Pseudomonas aeruginosa PA01
ccucggccugggcgca

SEQ ID NO: 1561534 - RNA, 18 nt, Pseudomonas aeruginosa PA01
ccucggccugggcgcagg

SEQ ID NO: 1561535 - RNA, 18 nt, Pseudomonas aeruginosa PA01
ccucggccuugcuggcga

SEQ ID NO: 1561536 - RNA, 19 nt, Pseudomonas aeruginosa PA01
ccucgguggcccacuccag

SEQ ID NO: 1561537 - RNA, 21 nt, Pseudomonas aeruginosa PA01
ccucggucuuuuucgcgugcu

SEQ ID NO: 1561538 - RNA, 22 nt, Pseudomonas aeruginosa PA01
ccucgguagccggccaaccacc

SEQ ID NO: 1561539 - RNA, 20 nt, Pseudomonas aeruginosa PA01
ccucggucaggcgcugguga

SEQ ID NO: 1561540 - RNA, 21 nt, Pseudomonas aeruginosa PA01
ccucggucagguauucgccgg

SEQ ID NO: 1561541 - RNA, 17 nt, Pseudomonas aeruginosa PA01
ccucugcgcugagcagg

SEQ ID NO: 1561542 - RNA, 20 nt, Pseudomonas aeruginosa PA01
ccucucuacacucugaggga

SEQ ID NO: 1561543 - RNA, 19 nt, Pseudomonas aeruginosa PA01
ccucuccccaaccuucucc

SEQ ID NO: 1561544 - RNA, 21 nt, Pseudomonas aeruginosa PA01
ccucuccccaaccuucucccu

SEQ ID NO: 1561545 - RNA, 15 nt, Pseudomonas aeruginosa PA01
ccucuccccagaccc

SEQ ID NO: 1561546 - RNA, 16 nt, Pseudomonas aeruginosa PA01
ccucgucgagcgcagc

SEQ ID NO: 1561547 - RNA, 17 nt, Pseudomonas aeruginosa PA01
ccucgucgagcagcgcg

SEQ ID NO: 1561548 - RNA, 19 nt, Pseudomonas aeruginosa PA01
ccucgucguucagcccacc

SEQ ID NO: 1561549 - RNA, 23 nt, Pseudomonas aeruginosa PA01
ccucgucguucagcccacccccg

SEQ ID NO: 1561550 - RNA, 14 nt, Pseudomonas aeruginosa PA01
ccucgucgcgccag

SEQ ID NO: 1561551 - RNA, 19 nt, Pseudomonas aeruginosa PA01
ccucgucgcaccuguucca

SEQ ID NO: 1561552 - RNA, 21 nt, Pseudomonas aeruginosa PA01
ccucuaaggaaaaacccggcc

SEQ ID NO: 1561553 - RNA, 12 nt, Pseudomonas aeruginosa PA01
ccucgugcagca

SEQ ID NO: 1561554 - RNA, 15 nt, Pseudomonas aeruginosa PA01
ccucguucagcagca

SEQ ID NO: 1561555 - RNA, 18 nt, Pseudomonas aeruginosa PA01
ccucguggcgcgccgcua

SEQ ID NO: 1561556 - RNA, 20 nt, Pseudomonas aeruginosa PA01
ccucguggcgcgccgcuaug

SEQ ID NO: 1561557 - RNA, 23 nt, Pseudomonas aeruginosa PA01
ccucguggggccagaagcgcucg

SEQ ID NO: 1561558 - RNA, 17 nt, Pseudomonas aeruginosa PA01
ccgcgccacgggcagac

SEQ ID NO: 1561559 - RNA, 21 nt, Pseudomonas aeruginosa PA01
ccgcgccagccacucccggcc

SEQ ID NO: 1561560 - RNA, 21 nt, Pseudomonas aeruginosa PA01
ccgcgcaugaaaaagccgccc

SEQ ID NO: 1561561 - RNA, 16 nt, Pseudomonas aeruginosa PA01
ccgcgcagcgcggcgc

SEQ ID NO: 1561562 - RNA, 20 nt, Pseudomonas aeruginosa PA01
ccgcgcauggagacggcccg

SEQ ID NO: 1561563 - RNA, 12 nt, Pseudomonas aeruginosa PA01
ccgcgcauggcg

SEQ ID NO: 1561564 - RNA, 14 nt, Pseudomonas aeruginosa PA01
ccgcgcauggcggc

SEQ ID NO: 1561565 - RNA, 14 nt, Pseudomonas aeruginosa PA01
ccgcgcagcuugcc

SEQ ID NO: 1561566 - RNA, 20 nt, Pseudomonas aeruginosa PA01
ccgcgcagaucgcguccagg

SEQ ID NO: 1561567 - RNA, 14 nt, Pseudomonas aeruginosa PA01
ccgcgcaccagcac

SEQ ID NO: 1561568 - RNA, 18 nt, Pseudomonas aeruginosa PA01
ccgcgcaaggcagcgucc

SEQ ID NO: 1561569 - RNA, 19 nt, Pseudomonas aeruginosa PA01
ccgcgcacaaaaaagcccg

SEQ ID NO: 1561570 - RNA, 14 nt, Pseudomonas aeruginosa PA01
ccgcgauucgccgg

SEQ ID NO: 1561571 - RNA, 17 nt, Pseudomonas aeruginosa PA01
ccgcgauggcucgcggc

SEQ ID NO: 1561572 - RNA, 19 nt, Pseudomonas aeruginosa PA01
ccgcgauggcucgcggcgc

SEQ ID NO: 1561573 - RNA, 16 nt, Pseudomonas aeruginosa PA01
ccgcgauguccccggc

SEQ ID NO: 1561574 - RNA, 17 nt, Pseudomonas aeruginosa PA01
ccgcgauugcagcuccu

SEQ ID NO: 1561575 - RNA, 23 nt, Pseudomonas aeruginosa PA01
ccgcgaggcauucucgcgacccu

SEQ ID NO: 1561576 - RNA, 20 nt, Pseudomonas aeruginosa PA01
ccgcgagguccggcuccggc

SEQ ID NO: 1561577 - RNA, 14 nt, Pseudomonas aeruginosa PA01
ccgcgagccgcgca

SEQ ID NO: 1561578 - RNA, 20 nt, Pseudomonas aeruginosa PA01
ccgcgagaccccggcggcgc

SEQ ID NO: 1561579 - RNA, 18 nt, Pseudomonas aeruginosa PA01
ccgcgagcgcggccggcc

SEQ ID NO: 1561580 - RNA, 15 nt, Pseudomonas aeruginosa PA01
ccgcgaguucgccgg

SEQ ID NO: 1561581 - RNA, 21 nt, Pseudomonas aeruginosa PA01
ccgcgaguucgccggccaggu

SEQ ID NO: 1561582 - RNA, 17 nt, Pseudomonas aeruginosa PA01
ccgcgauagcucagucg

SEQ ID NO: 1561583 - RNA, 14 nt, Pseudomonas aeruginosa PA01
ccgcgacggcugcu

SEQ ID NO: 1561584 - RNA, 13 nt, Pseudomonas aeruginosa PA01
ccgcgacgcucca

SEQ ID NO: 1561585 - RNA, 19 nt, Pseudomonas aeruginosa PA01
ccgcgacgacugcggcagc

SEQ ID NO: 1561586 - RNA, 17 nt, Pseudomonas aeruginosa PA01
ccgcgaccgaagccgcg

SEQ ID NO: 1561587 - RNA, 19 nt, Pseudomonas aeruginosa PA01
ccgcgacaggauggacagc

SEQ ID NO: 1561588 - RNA, 22 nt, Pseudomonas aeruginosa PA01
ccgcgacaacccuguccccuca

SEQ ID NO: 1561589 - RNA, 17 nt, Pseudomonas aeruginosa PA01
ccgcgaauccgcggccc

SEQ ID NO: 1561590 - RNA, 21 nt, Pseudomonas aeruginosa PA01
ccgcgaauggcagcaggcaca

SEQ ID NO: 1561591 - RNA, 12 nt, Pseudomonas aeruginosa PA01
ccgcagccgugg

SEQ ID NO: 1561592 - RNA, 17 nt, Pseudomonas aeruginosa PA01
ccgcagccguggcgcga

SEQ ID NO: 1561593 - RNA, 18 nt, Pseudomonas aeruginosa PA01
ccgcagcgcaagucggcc

SEQ ID NO: 1561594 - RNA, 14 nt, Pseudomonas aeruginosa PA01
ccgcagccagccuc

SEQ ID NO: 1561595 - RNA, 20 nt, Pseudomonas aeruginosa PA01
ccgcagcccgguccguccag

SEQ ID NO: 1561596 - RNA, 17 nt, Pseudomonas aeruginosa PA01
ccgcagccacaggcgcc

SEQ ID NO: 1561597 - RNA, 19 nt, Pseudomonas aeruginosa PA01
ccgcagccacaggcgccag

SEQ ID NO: 1561598 - RNA, 11 nt, Pseudomonas aeruginosa PA01
ccgcagcagcg

SEQ ID NO: 1561599 - RNA, 12 nt, Pseudomonas aeruginosa PA01
ccgcagcggcgc

SEQ ID NO: 1561600 - RNA, 13 nt, Pseudomonas aeruginosa PA01
ccgcagcggcgcu

SEQ ID NO: 1561601 - RNA, 23 nt, Pseudomonas aeruginosa PA01
ccgcagcggcgcuacgaaggcgu

SEQ ID NO: 1561602 - RNA, 21 nt, Pseudomonas aeruginosa PA01
ccgcagcgcuuuucaggaugu

SEQ ID NO: 1561603 - RNA, 16 nt, Pseudomonas aeruginosa PA01
ccgcagcggcagcggc

SEQ ID NO: 1561604 - RNA, 14 nt, Pseudomonas aeruginosa PA01
ccgccugcgccucg

SEQ ID NO: 1561605 - RNA, 17 nt, Pseudomonas aeruginosa PA01
ccgccuuuuuugugccc

SEQ ID NO: 1561606 - RNA, 24 nt, Pseudomonas aeruginosa PA01
ccgccuugcguaccagcgcgcagc

SEQ ID NO: 1561607 - RNA, 17 nt, Pseudomonas aeruginosa PA01
ccgccuugauggcgggc

SEQ ID NO: 1561608 - RNA, 16 nt, Pseudomonas aeruginosa PA01
ccgccuugagcggcgc

SEQ ID NO: 1561609 - RNA, 22 nt, Pseudomonas aeruginosa PA01
ccgcgaaccucgguagccggcc

SEQ ID NO: 1561610 - RNA, 19 nt, Pseudomonas aeruginosa PA01
ccgcgaagcgguuagccgg

SEQ ID NO: 1561611 - RNA, 13 nt, Pseudomonas aeruginosa PA01
ccgccugcucgcc

SEQ ID NO: 1561612 - RNA, 14 nt, Pseudomonas aeruginosa PA01
ccgccugcucggcc

SEQ ID NO: 1561613 - RNA, 13 nt, Pseudomonas aeruginosa PA01
ccgccuggccggc

SEQ ID NO: 1561614 - RNA, 20 nt, Pseudomonas aeruginosa PA01
ccgccuggcgugccgccagg

SEQ ID NO: 1561615 - RNA, 15 nt, Pseudomonas aeruginosa PA01
ccgccuggucggggc

SEQ ID NO: 1561616 - RNA, 16 nt, Pseudomonas aeruginosa PA01
ccgccuggucggggcc

SEQ ID NO: 1561617 - RNA, 18 nt, Pseudomonas aeruginosa PA01
ccgccuggucggggccgg

SEQ ID NO: 1561618 - RNA, 17 nt, Pseudomonas aeruginosa PA01
ccgccuucgcgggccag

SEQ ID NO: 1561619 - RNA, 19 nt, Pseudomonas aeruginosa PA01
ccgccuucgcgggccaggc

SEQ ID NO: 1561620 - RNA, 21 nt, Pseudomonas aeruginosa PA01
ccgccuucgcgggccaggccg

SEQ ID NO: 1561621 - RNA, 18 nt, Pseudomonas aeruginosa PA01
ccgccuucuuuucuuccg

SEQ ID NO: 1561622 - RNA, 23 nt, Pseudomonas aeruginosa PA01
ccgccuucuuuucuuccgccucg

SEQ ID NO: 1561623 - RNA, 19 nt, Pseudomonas aeruginosa PA01
ccgccuugaccugcugggc

SEQ ID NO: 1561624 - RNA, 13 nt, Pseudomonas aeruginosa PA01
ccgcgcccggcug

SEQ ID NO: 1561625 - RNA, 21 nt, Pseudomonas aeruginosa PA01
ccgcgccgagauagcggcaac

SEQ ID NO: 1561626 - RNA, 19 nt, Pseudomonas aeruginosa PA01
ccgcgccgccgcggccagc

SEQ ID NO: 1561627 - RNA, 15 nt, Pseudomonas aeruginosa PA01
ccgcgccgcggcggc

SEQ ID NO: 1561628 - RNA, 11 nt, Pseudomonas aeruginosa PA01
ccgcgccgcgu

SEQ ID NO: 1561629 - RNA, 20 nt, Pseudomonas aeruginosa PA01
ccgcgccgcgucgccgccag

SEQ ID NO: 1561630 - RNA, 15 nt, Pseudomonas aeruginosa PA01
ccgcgccggggcagc

SEQ ID NO: 1561631 - RNA, 19 nt, Pseudomonas aeruginosa PA01
ccgcgccggaaguggcagc

SEQ ID NO: 1561632 - RNA, 13 nt, Pseudomonas aeruginosa PA01
ccgcgcccggccu

SEQ ID NO: 1561633 - RNA, 15 nt, Pseudomonas aeruginosa PA01
ccgcgcccggccucc

SEQ ID NO: 1561634 - RNA, 20 nt, Pseudomonas aeruginosa PA01
ccgcgccgacccagagcgcg

SEQ ID NO: 1561635 - RNA, 21 nt, Pseudomonas aeruginosa PA01
ccgcgccgacccagagcgcgc

SEQ ID NO: 1561636 - RNA, 13 nt, Pseudomonas aeruginosa PA01
ccgcgccgaccag

SEQ ID NO: 1561637 - RNA, 13 nt, Pseudomonas aeruginosa PA01
ccgcgccagugcc

SEQ ID NO: 1561638 - RNA, 21 nt, Pseudomonas aeruginosa PA01
ccgcgccagugccugcaccac

SEQ ID NO: 1561639 - RNA, 12 nt, Pseudomonas aeruginosa PA01
ccgcgcccaggc

SEQ ID NO: 1561640 - RNA, 16 nt, Pseudomonas aeruginosa PA01
ccgcgcccaggcgcac

SEQ ID NO: 1561641 - RNA, 13 nt, Pseudomonas aeruginosa PA01
ccgcgcccaggcu

SEQ ID NO: 1561642 - RNA, 19 nt, Pseudomonas aeruginosa PA01
ccgcgcggcauagcgcagc

SEQ ID NO: 1561643 - RNA, 20 nt, Pseudomonas aeruginosa PA01
ccgcgcggauccccucccgc

SEQ ID NO: 1561644 - RNA, 20 nt, Pseudomonas aeruginosa PA01
ccgcgcggcacagcguggcc

SEQ ID NO: 1561645 - RNA, 22 nt, Pseudomonas aeruginosa PA01
ccgcgcgcuggauuucgccgag

SEQ ID NO: 1561646 - RNA, 22 nt, Pseudomonas aeruginosa PA01
ccgcgcgcgcggucgagcagcg

SEQ ID NO: 1561647 - RNA, 20 nt, Pseudomonas aeruginosa PA01
ccgcgcgcgcaaggccgaag

SEQ ID NO: 1561648 - RNA, 14 nt, Pseudomonas aeruginosa PA01
ccgcgccugggccg

SEQ ID NO: 1561649 - RNA, 19 nt, Pseudomonas aeruginosa PA01
ccgcgccuucagcgccagc

SEQ ID NO: 1561650 - RNA, 16 nt, Pseudomonas aeruginosa PA01
ccgcgccuuccagccc

SEQ ID NO: 1561651 - RNA, 17 nt, Pseudomonas aeruginosa PA01
ccgcgccuuccagcccu

SEQ ID NO: 1561652 - RNA, 12 nt, Pseudomonas aeruginosa PA01
ccgcgccucgcg

SEQ ID NO: 1561653 - RNA, 17 nt, Pseudomonas aeruginosa PA01
ccgcgccgguggccagg

SEQ ID NO: 1561654 - RNA, 11 nt, Pseudomonas aeruginosa PA01
ccgcgccucca

SEQ ID NO: 1561655 - RNA, 13 nt, Pseudomonas aeruginosa PA01
ccgcgccuccagg

SEQ ID NO: 1561656 - RNA, 18 nt, Pseudomonas aeruginosa PA01
ccgcgccuccaggcgcgc

SEQ ID NO: 1561657 - RNA, 23 nt, Pseudomonas aeruginosa PA01
ccgcgcgacggaacaagccgccu

SEQ ID NO: 1561658 - RNA, 15 nt, Pseudomonas aeruginosa PA01
ccgcgcgaccgcggc

SEQ ID NO: 1561659 - RNA, 17 nt, Pseudomonas aeruginosa PA01
ccgcgcgaccgcggcgc

SEQ ID NO: 1561660 - RNA, 20 nt, Pseudomonas aeruginosa PA01
ccgcgcgccgagcccccggc

SEQ ID NO: 1561661 - RNA, 18 nt, Pseudomonas aeruginosa PA01
ccgcgcgccuggcuggcc

SEQ ID NO: 1561662 - RNA, 18 nt, Pseudomonas aeruginosa PA01
ccgcgcgcauggucgcgc

SEQ ID NO: 1561663 - RNA, 18 nt, Pseudomonas aeruginosa PA01
ccgcgcgauggccggcgg

SEQ ID NO: 1561664 - RNA, 23 nt, Pseudomonas aeruginosa PA01
ccgcgcguggcuucguccagcga

SEQ ID NO: 1561665 - RNA, 15 nt, Pseudomonas aeruginosa PA01
ccgcgcguucagcca

SEQ ID NO: 1561666 - RNA, 17 nt, Pseudomonas aeruginosa PA01
ccgcgcguucagccacg

SEQ ID NO: 1561667 - RNA, 13 nt, Pseudomonas aeruginosa PA01
ccgcgcucggauc

SEQ ID NO: 1561668 - RNA, 16 nt, Pseudomonas aeruginosa PA01
ccgcgcucggccgccu

SEQ ID NO: 1561669 - RNA, 15 nt, Pseudomonas aeruginosa PA01
aaaccgaucagcacc

SEQ ID NO: 1561670 - RNA, 19 nt, Pseudomonas aeruginosa PA01
aaaccgaucagcaccgcca

SEQ ID NO: 1561671 - RNA, 19 nt, Pseudomonas aeruginosa PA01
ccgcgcggcuugccggcgc

SEQ ID NO: 1561672 - RNA, 13 nt, Pseudomonas aeruginosa PA01
ccgcgcgggccgg

SEQ ID NO: 1561673 - RNA, 14 nt, Pseudomonas aeruginosa PA01
ccgcgcgggccggc

SEQ ID NO: 1561674 - RNA, 12 nt, Pseudomonas aeruginosa PA01
ccgcggagucgc

SEQ ID NO: 1561675 - RNA, 15 nt, Pseudomonas aeruginosa PA01
ccgcggagucgccgg

SEQ ID NO: 1561676 - RNA, 18 nt, Pseudomonas aeruginosa PA01
ccgcggaccgggcggcgc

SEQ ID NO: 1561677 - RNA, 16 nt, Pseudomonas aeruginosa PA01
ccgcggaauggcgcgc

SEQ ID NO: 1561678 - RNA, 15 nt, Pseudomonas aeruginosa PA01
ccgcggaaggcccgc

SEQ ID NO: 1561679 - RNA, 21 nt, Pseudomonas aeruginosa PA01
ccgcgcuugccgucgcggaag

SEQ ID NO: 1561680 - RNA, 22 nt, Pseudomonas aeruginosa PA01
ccgcgcuugccgucgcggaagc

SEQ ID NO: 1561681 - RNA, 24 nt, Pseudomonas aeruginosa PA01
ccgcgcuugacgacugcacgcaga

SEQ ID NO: 1561682 - RNA, 14 nt, Pseudomonas aeruginosa PA01
ccgcgcugucggcc

SEQ ID NO: 1561683 - RNA, 17 nt, Pseudomonas aeruginosa PA01
ccgcgcugucggccucg

SEQ ID NO: 1561684 - RNA, 15 nt, Pseudomonas aeruginosa PA01
ccgcgcugcgccagg

SEQ ID NO: 1561685 - RNA, 18 nt, Pseudomonas aeruginosa PA01
ccgcgcugcgccaggccg

SEQ ID NO: 1561686 - RNA, 14 nt, Pseudomonas aeruginosa PA01
ccgcggccagcccc

SEQ ID NO: 1561687 - RNA, 20 nt, Pseudomonas aeruginosa PA01
ccgcggcccugcgccgcagc

SEQ ID NO: 1561688 - RNA, 22 nt, Pseudomonas aeruginosa PA01
ccgcggcccugcucgccggcgc

SEQ ID NO: 1561689 - RNA, 15 nt, Pseudomonas aeruginosa PA01
ccgcggccucgcugg

SEQ ID NO: 1561690 - RNA, 13 nt, Pseudomonas aeruginosa PA01
ccgcggccggcag

SEQ ID NO: 1561691 - RNA, 12 nt, Pseudomonas aeruginosa PA01
ccgcggccggca

SEQ ID NO: 1561692 - RNA, 14 nt, Pseudomonas aeruginosa PA01
ccgcggcagcagcc

SEQ ID NO: 1561693 - RNA, 21 nt, Pseudomonas aeruginosa PA01
ccgcggaucaccuggccgugc

SEQ ID NO: 1561694 - RNA, 11 nt, Pseudomonas aeruginosa PA01
ccgcguaagcg

SEQ ID NO: 1561695 - RNA, 14 nt, Pseudomonas aeruginosa PA01
ccgcguccaucccc

SEQ ID NO: 1561696 - RNA, 20 nt, Pseudomonas aeruginosa PA01
ccgcguccauccccgccucg

SEQ ID NO: 1561697 - RNA, 16 nt, Pseudomonas aeruginosa PA01
ccgcggucgggcagau

SEQ ID NO: 1561698 - RNA, 14 nt, Pseudomonas aeruginosa PA01
ccgcgggucugcuc

SEQ ID NO: 1561699 - RNA, 21 nt, Pseudomonas aeruginosa PA01
ccgcgggucuugcgcagggcg

SEQ ID NO: 1561700 - RNA, 17 nt, Pseudomonas aeruginosa PA01
ccgcgggccagccguuc

SEQ ID NO: 1561701 - RNA, 20 nt, Pseudomonas aeruginosa PA01
ccgcgggcaaccgcggcggc

SEQ ID NO: 1561702 - RNA, 20 nt, Pseudomonas aeruginosa PA01
ccgcgggcgccuuuuucaug

SEQ ID NO: 1561703 - RNA, 13 nt, Pseudomonas aeruginosa PA01
ccgcgggucacca

SEQ ID NO: 1561704 - RNA, 16 nt, Pseudomonas aeruginosa PA01
ccgcgggucaccagcg

SEQ ID NO: 1561705 - RNA, 20 nt, Pseudomonas aeruginosa PA01
ccgcggggaggaagcucccc

SEQ ID NO: 1561706 - RNA, 21 nt, Pseudomonas aeruginosa PA01
ccgcggcgccacgcucaccgg

SEQ ID NO: 1561707 - RNA, 20 nt, Pseudomonas aeruginosa PA01
ccgcggcgacggcucuuccc

SEQ ID NO: 1561708 - RNA, 21 nt, Pseudomonas aeruginosa PA01
ccgcggcgacggcucuucccc

SEQ ID NO: 1561709 - RNA, 14 nt, Pseudomonas aeruginosa PA01
ccgcggcgagcagc

SEQ ID NO: 1561710 - RNA, 18 nt, Pseudomonas aeruginosa PA01
ccgcggcgagcagcggcg

SEQ ID NO: 1561711 - RNA, 23 nt, Pseudomonas aeruginosa PA01
ccgcggcgagcaucucggccagg

SEQ ID NO: 1561712 - RNA, 19 nt, Pseudomonas aeruginosa PA01
ccgcggcgcccucugccgg

SEQ ID NO: 1561713 - RNA, 14 nt, Pseudomonas aeruginosa PA01
ccgcggcggccuca

SEQ ID NO: 1561714 - RNA, 15 nt, Pseudomonas aeruginosa PA01
ccgcuagcccugcug

SEQ ID NO: 1561715 - RNA, 13 nt, Pseudomonas aeruginosa PA01
ccgcuacccugcc

SEQ ID NO: 1561716 - RNA, 19 nt, Pseudomonas aeruginosa PA01
ccgcuacccugccccagca

SEQ ID NO: 1561717 - RNA, 18 nt, Pseudomonas aeruginosa PA01
ccgcguuaccguccgcgc

SEQ ID NO: 1561718 - RNA, 13 nt, Pseudomonas aeruginosa PA01
ccgcguggcgugc

SEQ ID NO: 1561719 - RNA, 14 nt, Pseudomonas aeruginosa PA01
ccgcguggcgugcu

SEQ ID NO: 1561720 - RNA, 14 nt, Pseudomonas aeruginosa PA01
ccgcgugggccggc

SEQ ID NO: 1561721 - RNA, 23 nt, Pseudomonas aeruginosa PA01
ccgcguucaccguggcgcuggcc

SEQ ID NO: 1561722 - RNA, 12 nt, Pseudomonas aeruginosa PA01
ccgcguugcggu

SEQ ID NO: 1561723 - RNA, 16 nt, Pseudomonas aeruginosa PA01
ccgcucaucugcacca

SEQ ID NO: 1561724 - RNA, 20 nt, Pseudomonas aeruginosa PA01
ccgcucaugagauccgccag

SEQ ID NO: 1561725 - RNA, 22 nt, Pseudomonas aeruginosa PA01
ccgcucaugagauccgccagca

SEQ ID NO: 1561726 - RNA, 19 nt, Pseudomonas aeruginosa PA01
ccgcucaccgccaccccgc

SEQ ID NO: 1561727 - RNA, 20 nt, Pseudomonas aeruginosa PA01
ccgcucaccgccaccccgcc

SEQ ID NO: 1561728 - RNA, 16 nt, Pseudomonas aeruginosa PA01
ccgcucaccaggcccg

SEQ ID NO: 1561729 - RNA, 21 nt, Pseudomonas aeruginosa PA01
ccgcucaagacggcccgcaga

SEQ ID NO: 1561730 - RNA, 14 nt, Pseudomonas aeruginosa PA01
ccgcuauggcgggg

SEQ ID NO: 1561731 - RNA, 15 nt, Pseudomonas aeruginosa PA01
ccgcuauggcggggc

SEQ ID NO: 1561732 - RNA, 16 nt, Pseudomonas aeruginosa PA01
ccgcuauggcggggcu

SEQ ID NO: 1561733 - RNA, 14 nt, Pseudomonas aeruginosa PA01
ccgcuaucgccgcc

SEQ ID NO: 1561734 - RNA, 17 nt, Pseudomonas aeruginosa PA01
ccgcuccccacucggcc

SEQ ID NO: 1561735 - RNA, 18 nt, Pseudomonas aeruginosa PA01
ccgcuccccacucggcca

SEQ ID NO: 1561736 - RNA, 14 nt, Pseudomonas aeruginosa PA01
ccgcucccaggcaa

SEQ ID NO: 1561737 - RNA, 21 nt, Pseudomonas aeruginosa PA01
ccgcucgcgguuauccgccgc

SEQ ID NO: 1561738 - RNA, 18 nt, Pseudomonas aeruginosa PA01
ccgcucgaugcccgccag

SEQ ID NO: 1561739 - RNA, 20 nt, Pseudomonas aeruginosa PA01
ccgcucgaugcccgccagca

SEQ ID NO: 1561740 - RNA, 13 nt, Pseudomonas aeruginosa PA01
ccgcucgacccgg

SEQ ID NO: 1561741 - RNA, 17 nt, Pseudomonas aeruginosa PA01
ccgcuggugacggugac

SEQ ID NO: 1561742 - RNA, 20 nt, Pseudomonas aeruginosa PA01
ccgcuggguuuccugcaugg

SEQ ID NO: 1561743 - RNA, 17 nt, Pseudomonas aeruginosa PA01
ccgcugguagcccaggc

SEQ ID NO: 1561744 - RNA, 21 nt, Pseudomonas aeruginosa PA01
ccgcuugcggucauccgccgg

SEQ ID NO: 1561745 - RNA, 22 nt, Pseudomonas aeruginosa PA01
ccgcuugcgguuauccgccgug

SEQ ID NO: 1561746 - RNA, 16 nt, Pseudomonas aeruginosa PA01
ccggaaagccuggccg

SEQ ID NO: 1561747 - RNA, 20 nt, Pseudomonas aeruginosa PA01
ccggagccuucuagcgaagg

SEQ ID NO: 1561748 - RNA, 17 nt, Pseudomonas aeruginosa PA01
ccggagaccgugccgcc

SEQ ID NO: 1561749 - RNA, 14 nt, Pseudomonas aeruginosa PA01
ccggagaucgccgc

SEQ ID NO: 1561750 - RNA, 16 nt, Pseudomonas aeruginosa PA01
ccggagaacgccgcca

SEQ ID NO: 1561751 - RNA, 18 nt, Pseudomonas aeruginosa PA01
ccggacguuuccagcggc

SEQ ID NO: 1561752 - RNA, 22 nt, Pseudomonas aeruginosa PA01
ccggacuggauucggccugccg

SEQ ID NO: 1561753 - RNA, 20 nt, Pseudomonas aeruginosa PA01
ccggaaccuguccgaacagg

SEQ ID NO: 1561754 - RNA, 22 nt, Pseudomonas aeruginosa PA01
ccgcucuucugguaggccagca

SEQ ID NO: 1561755 - RNA, 16 nt, Pseudomonas aeruginosa PA01
ccgcucuuuccucauc

SEQ ID NO: 1561756 - RNA, 12 nt, Pseudomonas aeruginosa PA01
ccgcucugcugg

SEQ ID NO: 1561757 - RNA, 17 nt, Pseudomonas aeruginosa PA01
ccgcucugcuggccgcc

SEQ ID NO: 1561758 - RNA, 15 nt, Pseudomonas aeruginosa PA01
ccgcucugcccgacc

SEQ ID NO: 1561759 - RNA, 17 nt, Pseudomonas aeruginosa PA01
ccgcucugcccgaccgg

SEQ ID NO: 1561760 - RNA, 20 nt, Pseudomonas aeruginosa PA01
ccgcucugccagaaggccug

SEQ ID NO: 1561761 - RNA, 21 nt, Pseudomonas aeruginosa PA01
ccgcucucggugaccaccagg

SEQ ID NO: 1561762 - RNA, 13 nt, Pseudomonas aeruginosa PA01
ccgcucggccgcc

SEQ ID NO: 1561763 - RNA, 15 nt, Pseudomonas aeruginosa PA01
ccgcucggccgccag

SEQ ID NO: 1561764 - RNA, 13 nt, Pseudomonas aeruginosa PA01
ccgcucgcgcggc

SEQ ID NO: 1561765 - RNA, 14 nt, Pseudomonas aeruginosa PA01
ccgcucggcgagcc

SEQ ID NO: 1561766 - RNA, 17 nt, Pseudomonas aeruginosa PA01
ccgcugcacgccuuccg

SEQ ID NO: 1561767 - RNA, 19 nt, Pseudomonas aeruginosa PA01
ccgcugcacgccuuccggg

SEQ ID NO: 1561768 - RNA, 15 nt, Pseudomonas aeruginosa PA01
ccgcugcaaaaaagc

SEQ ID NO: 1561769 - RNA, 19 nt, Pseudomonas aeruginosa PA01
ccgcugcaugugccaggcc

SEQ ID NO: 1561770 - RNA, 20 nt, Pseudomonas aeruginosa PA01
ccgcugcaugugccaggccu

SEQ ID NO: 1561771 - RNA, 22 nt, Pseudomonas aeruginosa PA01
ccgcugcaugaaaaagcccggc

SEQ ID NO: 1561772 - RNA, 23 nt, Pseudomonas aeruginosa PA01
ccgcugacggucugccagcucug

SEQ ID NO: 1561773 - RNA, 15 nt, Pseudomonas aeruginosa PA01
ccgcugcgugccagg

SEQ ID NO: 1561774 - RNA, 20 nt, Pseudomonas aeruginosa PA01
ccgcuggcauaaccggaagc

SEQ ID NO: 1561775 - RNA, 14 nt, Pseudomonas aeruginosa PA01
ccgcuggccuggcc

SEQ ID NO: 1561776 - RNA, 15 nt, Pseudomonas aeruginosa PA01
ccgcuggccgaccag

SEQ ID NO: 1561777 - RNA, 12 nt, Pseudomonas aeruginosa PA01
ccgcugggcagg

SEQ ID NO: 1561778 - RNA, 18 nt, Pseudomonas aeruginosa PA01
ccgcugggccacguucug

SEQ ID NO: 1561779 - RNA, 14 nt, Pseudomonas aeruginosa PA01
ccgcugggacggcg

SEQ ID NO: 1561780 - RNA, 17 nt, Pseudomonas aeruginosa PA01
ccgcugggacggcggcu

SEQ ID NO: 1561781 - RNA, 20 nt, Pseudomonas aeruginosa PA01
ccgcuggcggcgacgaaggu

SEQ ID NO: 1561782 - RNA, 13 nt, Pseudomonas aeruginosa PA01
ccgcugcgccgcc

SEQ ID NO: 1561783 - RNA, 14 nt, Pseudomonas aeruginosa PA01
ccgcugcgccgccg

SEQ ID NO: 1561784 - RNA, 17 nt, Pseudomonas aeruginosa PA01
ccgcugcgccgccgucu

SEQ ID NO: 1561785 - RNA, 22 nt, Pseudomonas aeruginosa PA01
ccgcugcgcaggccgagaaggu

SEQ ID NO: 1561786 - RNA, 15 nt, Pseudomonas aeruginosa PA01
ccgcugcggccggcg

SEQ ID NO: 1561787 - RNA, 21 nt, Pseudomonas aeruginosa PA01
ccgcugcggcggucccagacc

SEQ ID NO: 1561788 - RNA, 15 nt, Pseudomonas aeruginosa PA01
ccgcugcggcucgcc

SEQ ID NO: 1561789 - RNA, 15 nt, Pseudomonas aeruginosa PA01
ccgcugcggcugcag

SEQ ID NO: 1561790 - RNA, 21 nt, Pseudomonas aeruginosa PA01
ccgcugcgcgggucuugccgg

SEQ ID NO: 1561791 - RNA, 15 nt, Pseudomonas aeruginosa PA01
ccgcugcgcugccag

SEQ ID NO: 1561792 - RNA, 21 nt, Pseudomonas aeruginosa PA01
ccgcugcgcugccagcgccgc

SEQ ID NO: 1561793 - RNA, 14 nt, Pseudomonas aeruginosa PA01
ccgcugccgccguc

SEQ ID NO: 1561794 - RNA, 15 nt, Pseudomonas aeruginosa PA01
ccgcugccgccgucu

SEQ ID NO: 1561795 - RNA, 15 nt, Pseudomonas aeruginosa PA01
ccgcugccgccgcgc

SEQ ID NO: 1561796 - RNA, 16 nt, Pseudomonas aeruginosa PA01
ccgcugccgccgcgca

SEQ ID NO: 1561797 - RNA, 17 nt, Pseudomonas aeruginosa PA01
ccgcugccgccgcgcag

SEQ ID NO: 1561798 - RNA, 21 nt, Pseudomonas aeruginosa PA01
ccgcugccguacagcccccgc

SEQ ID NO: 1561799 - RNA, 19 nt, Pseudomonas aeruginosa PA01
ccgcugccgcucuggcugc

SEQ ID NO: 1561800 - RNA, 20 nt, Pseudomonas aeruginosa PA01
ccgcugccgcucuggcugcu

SEQ ID NO: 1561801 - RNA, 22 nt, Pseudomonas aeruginosa PA01
ccgcugccgcucuggcugcugg

SEQ ID NO: 1561802 - RNA, 13 nt, Pseudomonas aeruginosa PA01
ccgggccgccggc

SEQ ID NO: 1561803 - RNA, 16 nt, Pseudomonas aeruginosa PA01
ccgggccgaccugccc

SEQ ID NO: 1561804 - RNA, 19 nt, Pseudomonas aeruginosa PA01
ccgggccgaccugcccgcu

SEQ ID NO: 1561805 - RNA, 19 nt, Pseudomonas aeruginosa PA01
ccgggccgaucaccaccug

SEQ ID NO: 1561806 - RNA, 21 nt, Pseudomonas aeruginosa PA01
ccgggccgaucaccaccugga

SEQ ID NO: 1561807 - RNA, 15 nt, Pseudomonas aeruginosa PA01
ccgggccgcagcgca

SEQ ID NO: 1561808 - RNA, 23 nt, Pseudomonas aeruginosa PA01
ccgggccgcgcacaaaaaagccc

SEQ ID NO: 1561809 - RNA, 18 nt, Pseudomonas aeruginosa PA01
ccgggccgggggcggcgc

SEQ ID NO: 1561810 - RNA, 16 nt, Pseudomonas aeruginosa PA01
ccgggccgucgggcau

SEQ ID NO: 1561811 - RNA, 20 nt, Pseudomonas aeruginosa PA01
ccgggccgucgggcauggcg

SEQ ID NO: 1561812 - RNA, 20 nt, Pseudomonas aeruginosa PA01
ccgggcgcgcgccucagcgg

SEQ ID NO: 1561813 - RNA, 14 nt, Pseudomonas aeruginosa PA01
ccgggccuccuggc

SEQ ID NO: 1561814 - RNA, 22 nt, Pseudomonas aeruginosa PA01
ccgggaucaccucgaaccccug

SEQ ID NO: 1561815 - RNA, 23 nt, Pseudomonas aeruginosa PA01
ccgggaucuggcccugcaacagg

SEQ ID NO: 1561816 - RNA, 23 nt, Pseudomonas aeruginosa PA01
ccgggaucuccucgacggcggga

SEQ ID NO: 1561817 - RNA, 17 nt, Pseudomonas aeruginosa PA01
ccggggccuacugcugg

SEQ ID NO: 1561818 - RNA, 22 nt, Pseudomonas aeruginosa PA01
ccggggcaggcaugcggccccg

SEQ ID NO: 1561819 - RNA, 19 nt, Pseudomonas aeruginosa PA01
ccggggaucaggucgccgc

SEQ ID NO: 1561820 - RNA, 22 nt, Pseudomonas aeruginosa PA01
ccgggcuuuuucaugggcgcgc

SEQ ID NO: 1561821 - RNA, 13 nt, Pseudomonas aeruginosa PA01
ccggggaacaggu

SEQ ID NO: 1561822 - RNA, 15 nt, Pseudomonas aeruginosa PA01
ccggggaaccacacc

SEQ ID NO: 1561823 - RNA, 23 nt, Pseudomonas aeruginosa PA01
ccggggaagauguucgccgccgc

SEQ ID NO: 1561824 - RNA, 22 nt, Pseudomonas aeruginosa PA01
ccggggcggauucaggcgcgcu

SEQ ID NO: 1561825 - RNA, 17 nt, Pseudomonas aeruginosa PA01
ccggggcgggccgcgcc

SEQ ID NO: 1561826 - RNA, 18 nt, Pseudomonas aeruginosa PA01
ccggggcgugcaggccgc

SEQ ID NO: 1561827 - RNA, 13 nt, Pseudomonas aeruginosa PA01
ccgggggcggcgc

SEQ ID NO: 1561828 - RNA, 15 nt, Pseudomonas aeruginosa PA01
ccggggcucugccgg

SEQ ID NO: 1561829 - RNA, 20 nt, Pseudomonas aeruginosa PA01
ccggggcugagcgcauugac

SEQ ID NO: 1561830 - RNA, 14 nt, Pseudomonas aeruginosa PA01
ccgggcggcggcgc

SEQ ID NO: 1561831 - RNA, 14 nt, Pseudomonas aeruginosa PA01
ccgggcuggccacc

SEQ ID NO: 1561832 - RNA, 17 nt, Pseudomonas aeruginosa PA01
ccgggcuggccaccagc

SEQ ID NO: 1561833 - RNA, 15 nt, Pseudomonas aeruginosa PA01
ccggcggccagggcg

SEQ ID NO: 1561834 - RNA, 18 nt, Pseudomonas aeruginosa PA01
ccggcggaugacguuccc

SEQ ID NO: 1561835 - RNA, 13 nt, Pseudomonas aeruginosa PA01
ccggcggcauccc

SEQ ID NO: 1561836 - RNA, 17 nt, Pseudomonas aeruginosa PA01
aaaccgggaugaagauc

SEQ ID NO: 1561837 - RNA, 21 nt, Pseudomonas aeruginosa PA01
aaaccgggaugaagaucaucu

SEQ ID NO: 1561838 - RNA, 11 nt, Pseudomonas aeruginosa PA01
ccggcucgccg

SEQ ID NO: 1561839 - RNA, 19 nt, Pseudomonas aeruginosa PA01
ccggcucgccgacuuccag

SEQ ID NO: 1561840 - RNA, 20 nt, Pseudomonas aeruginosa PA01
ccggcucgccgacuuccagg

SEQ ID NO: 1561841 - RNA, 23 nt, Pseudomonas aeruginosa PA01
ccggcucgccgacuuccaggcgc

SEQ ID NO: 1561842 - RNA, 15 nt, Pseudomonas aeruginosa PA01
ccggcucgccgcgcu

SEQ ID NO: 1561843 - RNA, 21 nt, Pseudomonas aeruginosa PA01
ccggcucguucaugucggcuc

SEQ ID NO: 1561844 - RNA, 16 nt, Pseudomonas aeruginosa PA01
ccgggauacagcagcc

SEQ ID NO: 1561845 - RNA, 14 nt, Pseudomonas aeruginosa PA01
ccgggaggcgccgc

SEQ ID NO: 1561846 - RNA, 16 nt, Pseudomonas aeruginosa PA01
ccgggagcggccgugc

SEQ ID NO: 1561847 - RNA, 18 nt, Pseudomonas aeruginosa PA01
ccgggacgaagcggaagc

SEQ ID NO: 1561848 - RNA, 20 nt, Pseudomonas aeruginosa PA01
ccgggaacagcccgucgcgc

SEQ ID NO: 1561849 - RNA, 20 nt, Pseudomonas aeruginosa PA01
ccggcuucgcgggugaccug

SEQ ID NO: 1561850 - RNA, 15 nt, Pseudomonas aeruginosa PA01
ccggcuuccucgccc

SEQ ID NO: 1561851 - RNA, 15 nt, Pseudomonas aeruginosa PA01
ccggcuucuacgccu

SEQ ID NO: 1561852 - RNA, 15 nt, Pseudomonas aeruginosa PA01
ccggcuugccgucgg

SEQ ID NO: 1561853 - RNA, 19 nt, Pseudomonas aeruginosa PA01
ccggcugagcgccaggcgc

SEQ ID NO: 1561854 - RNA, 14 nt, Pseudomonas aeruginosa PA01
ccggcuuuccucgg

SEQ ID NO: 1561855 - RNA, 18 nt, Pseudomonas aeruginosa PA01
ccgggaaaauggaacagu

SEQ ID NO: 1561856 - RNA, 22 nt, Pseudomonas aeruginosa PA01
ccggcgccgcuagggcgcccuc

SEQ ID NO: 1561857 - RNA, 15 nt, Pseudomonas aeruginosa PA01
ccggcgccggcagga

SEQ ID NO: 1561858 - RNA, 14 nt, Pseudomonas aeruginosa PA01
ccggcgccgccucg

SEQ ID NO: 1561859 - RNA, 18 nt, Pseudomonas aeruginosa PA01
ccggcgcgaccgucggcc

SEQ ID NO: 1561860 - RNA, 22 nt, Pseudomonas aeruginosa PA01
ccggcgcgccccugcgcccagg

SEQ ID NO: 1561861 - RNA, 16 nt, Pseudomonas aeruginosa PA01
ccggcgcgcccaggcc

SEQ ID NO: 1561862 - RNA, 17 nt, Pseudomonas aeruginosa PA01
ccggcgcggccugcagc

SEQ ID NO: 1561863 - RNA, 12 nt, Pseudomonas aeruginosa PA01
ccggcgcggcgc

SEQ ID NO: 1561864 - RNA, 11 nt, Pseudomonas aeruginosa PA01
ccggcgcggcu

SEQ ID NO: 1561865 - RNA, 22 nt, Pseudomonas aeruginosa PA01
ccggcgcggcuacccucucccc

SEQ ID NO: 1561866 - RNA, 16 nt, Pseudomonas aeruginosa PA01
ccggcgcggcggccgc

SEQ ID NO: 1561867 - RNA, 20 nt, Pseudomonas aeruginosa PA01
ccggcgcggcggccgccucg

SEQ ID NO: 1561868 - RNA, 16 nt, Pseudomonas aeruginosa PA01
ccggcgcuccaacagc

SEQ ID NO: 1561869 - RNA, 15 nt, Pseudomonas aeruginosa PA01
ccggcgcuccacagc

SEQ ID NO: 1561870 - RNA, 16 nt, Pseudomonas aeruginosa PA01
ccggcgcuccuccucg

SEQ ID NO: 1561871 - RNA, 16 nt, Pseudomonas aeruginosa PA01
ccggcgcucggccagg

SEQ ID NO: 1561872 - RNA, 16 nt, Pseudomonas aeruginosa PA01
ccggcgcugcuucuug

SEQ ID NO: 1561873 - RNA, 19 nt, Pseudomonas aeruginosa PA01
ccggcgcugguugaggucg

SEQ ID NO: 1561874 - RNA, 11 nt, Pseudomonas aeruginosa PA01
ccggcgcccgg

SEQ ID NO: 1561875 - RNA, 12 nt, Pseudomonas aeruginosa PA01
ccggcgccccug

SEQ ID NO: 1561876 - RNA, 14 nt, Pseudomonas aeruginosa PA01
ccggcgccccugcg

SEQ ID NO: 1561877 - RNA, 18 nt, Pseudomonas aeruginosa PA01
ccggcgccccugcggcgc

SEQ ID NO: 1561878 - RNA, 20 nt, Pseudomonas aeruginosa PA01
ccggcgcccuucgagaaacu

SEQ ID NO: 1561879 - RNA, 17 nt, Pseudomonas aeruginosa PA01
ccggcgccgccggggau

SEQ ID NO: 1561880 - RNA, 12 nt, Pseudomonas aeruginosa PA01
ccggcgccgccg

SEQ ID NO: 1561881 - RNA, 14 nt, Pseudomonas aeruginosa PA01
ccggcgccaggccc

SEQ ID NO: 1561882 - RNA, 14 nt, Pseudomonas aeruginosa PA01
ccggcgccaggcug

SEQ ID NO: 1561883 - RNA, 13 nt, Pseudomonas aeruginosa PA01
ccggcgccacccc

SEQ ID NO: 1561884 - RNA, 21 nt, Pseudomonas aeruginosa PA01
ccggcgccaccccgccgcgca

SEQ ID NO: 1561885 - RNA, 17 nt, Pseudomonas aeruginosa PA01
ccggcgcaugcgccggc

SEQ ID NO: 1561886 - RNA, 13 nt, Pseudomonas aeruginosa PA01
ccggcgccaccgc

SEQ ID NO: 1561887 - RNA, 19 nt, Pseudomonas aeruginosa PA01
ccggcgaccagcgucgcgc

SEQ ID NO: 1561888 - RNA, 14 nt, Pseudomonas aeruginosa PA01
ccggccuggcgccg

SEQ ID NO: 1561889 - RNA, 16 nt, Pseudomonas aeruginosa PA01
ccggccuggcuggccu

SEQ ID NO: 1561890 - RNA, 12 nt, Pseudomonas aeruginosa PA01
ccggccugggcc

SEQ ID NO: 1561891 - RNA, 13 nt, Pseudomonas aeruginosa PA01
ccggccugggccc

SEQ ID NO: 1561892 - RNA, 15 nt, Pseudomonas aeruginosa PA01
ccggcgacgcaggac

SEQ ID NO: 1561893 - RNA, 15 nt, Pseudomonas aeruginosa PA01
ccggcgcagcggagg

SEQ ID NO: 1561894 - RNA, 16 nt, Pseudomonas aeruginosa PA01
ccggcgagcgccugga

SEQ ID NO: 1561895 - RNA, 18 nt, Pseudomonas aeruginosa PA01
ccggcgagaaaggcugcu

SEQ ID NO: 1561896 - RNA, 21 nt, Pseudomonas aeruginosa PA01
ccggcgagaaaggcugcuucg

SEQ ID NO: 1561897 - RNA, 18 nt, Pseudomonas aeruginosa PA01
ccggcccagccgcggcgc

SEQ ID NO: 1561898 - RNA, 14 nt, Pseudomonas aeruginosa PA01
ccggccgcccgagc

SEQ ID NO: 1561899 - RNA, 17 nt, Pseudomonas aeruginosa PA01
ccggccgaucuccuggc

SEQ ID NO: 1561900 - RNA, 12 nt, Pseudomonas aeruginosa PA01
ccggcccaggcc

SEQ ID NO: 1561901 - RNA, 11 nt, Pseudomonas aeruginosa PA01
ccggcccaggc

SEQ ID NO: 1561902 - RNA, 20 nt, Pseudomonas aeruginosa PA01
ccggccgcgucgcccaggcc

SEQ ID NO: 1561903 - RNA, 14 nt, Pseudomonas aeruginosa PA01
ccggccgcgccagc

SEQ ID NO: 1561904 - RNA, 11 nt, Pseudomonas aeruginosa PA01
ccggccgcgcu

SEQ ID NO: 1561905 - RNA, 18 nt, Pseudomonas aeruginosa PA01
ccggccucgacgcagagc

SEQ ID NO: 1561906 - RNA, 16 nt, Pseudomonas aeruginosa PA01
ccggccucgaggaaca

SEQ ID NO: 1561907 - RNA, 19 nt, Pseudomonas aeruginosa PA01
ccggccucgccugcggcgc

SEQ ID NO: 1561908 - RNA, 17 nt, Pseudomonas aeruginosa PA01
ccggccucgcugccgcc

SEQ ID NO: 1561909 - RNA, 15 nt, Pseudomonas aeruginosa PA01
ccggccucggcggcg

SEQ ID NO: 1561910 - RNA, 13 nt, Pseudomonas aeruginosa PA01
ccggccuccaggc

SEQ ID NO: 1561911 - RNA, 16 nt, Pseudomonas aeruginosa PA01
ccggccuccaggcugg

SEQ ID NO: 1561912 - RNA, 19 nt, Pseudomonas aeruginosa PA01
ccggccucaacgaccgccc

SEQ ID NO: 1561913 - RNA, 23 nt, Pseudomonas aeruginosa PA01
ccggccucaacgaccgcccaggc

SEQ ID NO: 1561914 - RNA, 11 nt, Pseudomonas aeruginosa PA01
ccggagcuuug

SEQ ID NO: 1561915 - RNA, 20 nt, Pseudomonas aeruginosa PA01
ccggagcuuugcagggcgau

SEQ ID NO: 1561916 - RNA, 21 nt, Pseudomonas aeruginosa PA01
ccggagcgcgaaagcgccccg

SEQ ID NO: 1561917 - RNA, 13 nt, Pseudomonas aeruginosa PA01
ccggagucucggg

SEQ ID NO: 1561918 - RNA, 17 nt, Pseudomonas aeruginosa PA01
ccggaguucgcccgccc

SEQ ID NO: 1561919 - RNA, 22 nt, Pseudomonas aeruginosa PA01
ccggauacaccagguuggccag

SEQ ID NO: 1561920 - RNA, 17 nt, Pseudomonas aeruginosa PA01
ccggccauugccgccag

SEQ ID NO: 1561921 - RNA, 17 nt, Pseudomonas aeruginosa PA01
ccggccauuacgccgag

SEQ ID NO: 1561922 - RNA, 16 nt, Pseudomonas aeruginosa PA01
ccggccagcccggccu

SEQ ID NO: 1561923 - RNA, 19 nt, Pseudomonas aeruginosa PA01
ccggccagcagcgccuccu

SEQ ID NO: 1561924 - RNA, 23 nt, Pseudomonas aeruginosa PA01
ccggccaccaucacgucgcgcac

SEQ ID NO: 1561925 - RNA, 23 nt, Pseudomonas aeruginosa PA01
ccggauaccccgguugugcgccc

SEQ ID NO: 1561926 - RNA, 13 nt, Pseudomonas aeruginosa PA01
ccggccaccagca

SEQ ID NO: 1561927 - RNA, 19 nt, Pseudomonas aeruginosa PA01
ccggugacauucgacagca

SEQ ID NO: 1561928 - RNA, 23 nt, Pseudomonas aeruginosa PA01
ccggugacgcugcucaccaggug

SEQ ID NO: 1561929 - RNA, 13 nt, Pseudomonas aeruginosa PA01
ccggugccgcccu

SEQ ID NO: 1561930 - RNA, 15 nt, Pseudomonas aeruginosa PA01
ccggugccgcccugg

SEQ ID NO: 1561931 - RNA, 20 nt, Pseudomonas aeruginosa PA01
ccggugccgccggccaccag

SEQ ID NO: 1561932 - RNA, 19 nt, Pseudomonas aeruginosa PA01
ccggugccuucggcggcgc

SEQ ID NO: 1561933 - RNA, 21 nt, Pseudomonas aeruginosa PA01
ccgguggcguuauccgcccca

SEQ ID NO: 1561934 - RNA, 21 nt, Pseudomonas aeruginosa PA01
ccgguggggcgggcgaagcga

SEQ ID NO: 1561935 - RNA, 22 nt, Pseudomonas aeruginosa PA01
ccgggguuuucuuuuugcgcca

SEQ ID NO: 1561936 - RNA, 13 nt, Pseudomonas aeruginosa PA01
ccgggguuggcgc

SEQ ID NO: 1561937 - RNA, 14 nt, Pseudomonas aeruginosa PA01
ccggguaccugcuc

SEQ ID NO: 1561938 - RNA, 20 nt, Pseudomonas aeruginosa PA01
ccggguagcguuaucgccgg

SEQ ID NO: 1561939 - RNA, 24 nt, Pseudomonas aeruginosa PA01
ccgggggucgcggguucgaguccc

SEQ ID NO: 1561940 - RNA, 16 nt, Pseudomonas aeruginosa PA01
ccggucucagccggcg

SEQ ID NO: 1561941 - RNA, 10 nt, Pseudomonas aeruginosa PA01
ccggucuugc

SEQ ID NO: 1561942 - RNA, 22 nt, Pseudomonas aeruginosa PA01
ccgguccucgcccgucacuuca

SEQ ID NO: 1561943 - RNA, 20 nt, Pseudomonas aeruginosa PA01
ccgguccguccagcgcgccc

SEQ ID NO: 1561944 - RNA, 19 nt, Pseudomonas aeruginosa PA01
ccgguccgacaaucagcgg

SEQ ID NO: 1561945 - RNA, 22 nt, Pseudomonas aeruginosa PA01
ccguagggcgaacaacgccgcc

SEQ ID NO: 1561946 - RNA, 13 nt, Pseudomonas aeruginosa PA01
ccguagccgucga

SEQ ID NO: 1561947 - RNA, 22 nt, Pseudomonas aeruginosa PA01
ccguagccgucguagcgcagcg

SEQ ID NO: 1561948 - RNA, 21 nt, Pseudomonas aeruginosa PA01
ccguagcgcaguucgccgccg

SEQ ID NO: 1561949 - RNA, 16 nt, Pseudomonas aeruginosa PA01
ccguaggccacuuccc

SEQ ID NO: 1561950 - RNA, 20 nt, Pseudomonas aeruginosa PA01
ccgguuuguugcaggcuggg

SEQ ID NO: 1561951 - RNA, 14 nt, Pseudomonas aeruginosa PA01
ccguacgcaccgcg

SEQ ID NO: 1561952 - RNA, 22 nt, Pseudomonas aeruginosa PA01
ccguagaacgccaggaucggca

SEQ ID NO: 1561953 - RNA, 15 nt, Pseudomonas aeruginosa PA01
ccguagaccaccagc

SEQ ID NO: 1561954 - RNA, 21 nt, Pseudomonas aeruginosa PA01
ccguagaccggcuccagggcg

SEQ ID NO: 1561955 - RNA, 16 nt, Pseudomonas aeruginosa PA01
ccguacaggucggcgc

SEQ ID NO: 1561956 - RNA, 22 nt, Pseudomonas aeruginosa PA01
ccguccgucccacaggccggcu

SEQ ID NO: 1561957 - RNA, 22 nt, Pseudomonas aeruginosa PA01
ccguccuacgcgaccggucagg

SEQ ID NO: 1561958 - RNA, 19 nt, Pseudomonas aeruginosa PA01
ccguccucgucgaggucga

SEQ ID NO: 1561959 - RNA, 15 nt, Pseudomonas aeruginosa PA01
ccguccgccaggucc

SEQ ID NO: 1561960 - RNA, 19 nt, Pseudomonas aeruginosa PA01
ccguccgcagcacagcccc

SEQ ID NO: 1561961 - RNA, 12 nt, Pseudomonas aeruginosa PA01
ccguccgcagcg

SEQ ID NO: 1561962 - RNA, 21 nt, Pseudomonas aeruginosa PA01
ccguccgcagcgccacuucca

SEQ ID NO: 1561963 - RNA, 12 nt, Pseudomonas aeruginosa PA01
ccgucccagucg

SEQ ID NO: 1561964 - RNA, 21 nt, Pseudomonas aeruginosa PA01
ccgucccggaguuccagcggg

SEQ ID NO: 1561965 - RNA, 14 nt, Pseudomonas aeruginosa PA01
ccgucccugaccag

SEQ ID NO: 1561966 - RNA, 19 nt, Pseudomonas aeruginosa PA01
ccgucgcacucuuccuggg

SEQ ID NO: 1561967 - RNA, 18 nt, Pseudomonas aeruginosa PA01
ccgucgaagccaggcacc

SEQ ID NO: 1561968 - RNA, 15 nt, Pseudomonas aeruginosa PA01
ccguccugcggccgc

SEQ ID NO: 1561969 - RNA, 15 nt, Pseudomonas aeruginosa PA01
ccguccugcuugacc

SEQ ID NO: 1561970 - RNA, 18 nt, Pseudomonas aeruginosa PA01
ccgucggccggggucagg

SEQ ID NO: 1561971 - RNA, 21 nt, Pseudomonas aeruginosa PA01
ccgucggccggggucaggccg

SEQ ID NO: 1561972 - RNA, 17 nt, Pseudomonas aeruginosa PA01
ccgucuguucggccagg

SEQ ID NO: 1561973 - RNA, 16 nt, Pseudomonas aeruginosa PA01
ccgucuuccaccagaa

SEQ ID NO: 1561974 - RNA, 21 nt, Pseudomonas aeruginosa PA01
ccgucuggcgcauccgcccga

SEQ ID NO: 1561975 - RNA, 13 nt, Pseudomonas aeruginosa PA01
ccguccaggcugc

SEQ ID NO: 1561976 - RNA, 15 nt, Pseudomonas aeruginosa PA01
ccguccagugcggca

SEQ ID NO: 1561977 - RNA, 17 nt, Pseudomonas aeruginosa PA01
ccguccagugcggcagu

SEQ ID NO: 1561978 - RNA, 20 nt, Pseudomonas aeruginosa PA01
ccguccaucuguaccaccgc

SEQ ID NO: 1561979 - RNA, 21 nt, Pseudomonas aeruginosa PA01
ccguccacaccgagacgugaa

SEQ ID NO: 1561980 - RNA, 14 nt, Pseudomonas aeruginosa PA01
ccguccaccagcca

SEQ ID NO: 1561981 - RNA, 18 nt, Pseudomonas aeruginosa PA01
ccgucaccagcagccccg

SEQ ID NO: 1561982 - RNA, 18 nt, Pseudomonas aeruginosa PA01
ccgucacgcggacccagu

SEQ ID NO: 1561983 - RNA, 15 nt, Pseudomonas aeruginosa PA01
ccgucagccaggcug

SEQ ID NO: 1561984 - RNA, 16 nt, Pseudomonas aeruginosa PA01
ccgucaucgagcaguu

SEQ ID NO: 1561985 - RNA, 16 nt, Pseudomonas aeruginosa PA01
ccgucaucacccacca

SEQ ID NO: 1561986 - RNA, 16 nt, Pseudomonas aeruginosa PA01
cgcgaguucgccggcc

SEQ ID NO: 1561987 - RNA, 21 nt, Pseudomonas aeruginosa PA01
cgcgagcaugcucacugcgag

SEQ ID NO: 1561988 - RNA, 17 nt, Pseudomonas aeruginosa PA01
cgcgagaugaagcgccg

SEQ ID NO: 1561989 - RNA, 18 nt, Pseudomonas aeruginosa PA01
cgcgagaugaagcgccgc

SEQ ID NO: 1561990 - RNA, 21 nt, Pseudomonas aeruginosa PA01
cgcgagcaccaugcagcggca

SEQ ID NO: 1561991 - RNA, 13 nt, Pseudomonas aeruginosa PA01
cgcgagcaccgcg

SEQ ID NO: 1561992 - RNA, 16 nt, Pseudomonas aeruginosa PA01
cgcgagcaccgcgcag

SEQ ID NO: 1561993 - RNA, 18 nt, Pseudomonas aeruginosa PA01
cgcgagaccccggcggcg

SEQ ID NO: 1561994 - RNA, 21 nt, Pseudomonas aeruginosa PA01
cgcgacugucgagcagggucg

SEQ ID NO: 1561995 - RNA, 17 nt, Pseudomonas aeruginosa PA01
cgcgauaaaaagccccg

SEQ ID NO: 1561996 - RNA, 18 nt, Pseudomonas aeruginosa PA01
cgcgauaaaaagccccgc

SEQ ID NO: 1561997 - RNA, 13 nt, Pseudomonas aeruginosa PA01
cgcgauccaccgc

SEQ ID NO: 1561998 - RNA, 20 nt, Pseudomonas aeruginosa PA01
cgcgauccaccgccagggcg

SEQ ID NO: 1561999 - RNA, 19 nt, Pseudomonas aeruginosa PA01
cgcgauccuccgccagccc

SEQ ID NO: 1562000 - RNA, 22 nt, Pseudomonas aeruginosa PA01
cgcgauccuggcggcacuccag

SEQ ID NO: 1562001 - RNA, 22 nt, Pseudomonas aeruginosa PA01
cgccuuuuuucauccugcggaa

SEQ ID NO: 1562002 - RNA, 20 nt, Pseudomonas aeruginosa PA01
cgccuuuuuugugcccggcg

SEQ ID NO: 1562003 - RNA, 15 nt, Pseudomonas aeruginosa PA01
cgcgaagcgcagcac

SEQ ID NO: 1562004 - RNA, 14 nt, Pseudomonas aeruginosa PA01
cgcgaagcccagcg

SEQ ID NO: 1562005 - RNA, 19 nt, Pseudomonas aeruginosa PA01
cgcgaagcacgcucuucuu

SEQ ID NO: 1562006 - RNA, 22 nt, Pseudomonas aeruginosa PA01
cgcgaagcacgcucuucuuaca

SEQ ID NO: 1562007 - RNA, 17 nt, Pseudomonas aeruginosa PA01
cgcgaccuccggcgcca

SEQ ID NO: 1562008 - RNA, 23 nt, Pseudomonas aeruginosa PA01
cgcgaccgagaugcucgcgcagc

SEQ ID NO: 1562009 - RNA, 16 nt, Pseudomonas aeruginosa PA01
cgcgaccgcccgccuc

SEQ ID NO: 1562010 - RNA, 18 nt, Pseudomonas aeruginosa PA01
cgcgaauaccgcgcgcgc

SEQ ID NO: 1562011 - RNA, 19 nt, Pseudomonas aeruginosa PA01
cgcgaauaccgcgcgcgca

SEQ ID NO: 1562012 - RNA, 18 nt, Pseudomonas aeruginosa PA01
cgcgaaggcgccuuccag

SEQ ID NO: 1562013 - RNA, 22 nt, Pseudomonas aeruginosa PA01
cgcgaaggcgccuuccaggcgu

SEQ ID NO: 1562014 - RNA, 20 nt, Pseudomonas aeruginosa PA01
cgcgacccucagucgccccc

SEQ ID NO: 1562015 - RNA, 14 nt, Pseudomonas aeruginosa PA01
cgcgacccuggccg

SEQ ID NO: 1562016 - RNA, 16 nt, Pseudomonas aeruginosa PA01
cgccgucuccgccgcu

SEQ ID NO: 1562017 - RNA, 14 nt, Pseudomonas aeruginosa PA01
cgccgucgggggcg

SEQ ID NO: 1562018 - RNA, 14 nt, Pseudomonas aeruginosa PA01
cgccgucgcggcca

SEQ ID NO: 1562019 - RNA, 24 nt, Pseudomonas aeruginosa PA01
cgccugcggcgccuagacccuggg

SEQ ID NO: 1562020 - RNA, 19 nt, Pseudomonas aeruginosa PA01
cgccugucgcuccggcagc

SEQ ID NO: 1562021 - RNA, 18 nt, Pseudomonas aeruginosa PA01
cgccugcuuggcggcggu

SEQ ID NO: 1562022 - RNA, 14 nt, Pseudomonas aeruginosa PA01
cgccuguuccaggg

SEQ ID NO: 1562023 - RNA, 21 nt, Pseudomonas aeruginosa PA01
cgccugcuggugggugaucuc

SEQ ID NO: 1562024 - RNA, 20 nt, Pseudomonas aeruginosa PA01
cgccugcuucagcccggcac

SEQ ID NO: 1562025 - RNA, 23 nt, Pseudomonas aeruginosa PA01
cgccugcuucagguagugcaaca

SEQ ID NO: 1562026 - RNA, 20 nt, Pseudomonas aeruginosa PA01
cgccuggucggggccggcga

SEQ ID NO: 1562027 - RNA, 15 nt, Pseudomonas aeruginosa PA01
cgccugcucgcggcu

SEQ ID NO: 1562028 - RNA, 16 nt, Pseudomonas aeruginosa PA01
cgccugcucggccugc

SEQ ID NO: 1562029 - RNA, 17 nt, Pseudomonas aeruginosa PA01
cgccugcucggccugcu

SEQ ID NO: 1562030 - RNA, 22 nt, Pseudomonas aeruginosa PA01
cgccugcucuucggcggccagc

SEQ ID NO: 1562031 - RNA, 21 nt, Pseudomonas aeruginosa PA01
cgccugcugcgcguguacccc

SEQ ID NO: 1562032 - RNA, 15 nt, Pseudomonas aeruginosa PA01
cgccugcuggccggu

SEQ ID NO: 1562033 - RNA, 20 nt, Pseudomonas aeruginosa PA01
cgccuugguguagccgagca

SEQ ID NO: 1562034 - RNA, 15 nt, Pseudomonas aeruginosa PA01
cgccuuguccugcaa

SEQ ID NO: 1562035 - RNA, 19 nt, Pseudomonas aeruginosa PA01
cgccuuggcaucgccgccc

SEQ ID NO: 1562036 - RNA, 13 nt, Pseudomonas aeruginosa PA01
cgccuugcggggc

SEQ ID NO: 1562037 - RNA, 18 nt, Pseudomonas aeruginosa PA01
cgccuugcguaccagcgc

SEQ ID NO: 1562038 - RNA, 21 nt, Pseudomonas aeruginosa PA01
cgccuucuuuucuuccgccuc

SEQ ID NO: 1562039 - RNA, 16 nt, Pseudomonas aeruginosa PA01
cgccuugaaaccggcg

SEQ ID NO: 1562040 - RNA, 13 nt, Pseudomonas aeruginosa PA01
cgccuugaccucg

SEQ ID NO: 1562041 - RNA, 16 nt, Pseudomonas aeruginosa PA01
cgccuugaccagcggc

SEQ ID NO: 1562042 - RNA, 18 nt, Pseudomonas aeruginosa PA01
cgccuugaccagcggccc

SEQ ID NO: 1562043 - RNA, 13 nt, Pseudomonas aeruginosa PA01
cgccuugcccugg

SEQ ID NO: 1562044 - RNA, 14 nt, Pseudomonas aeruginosa PA01
cgccuugcagcacc

SEQ ID NO: 1562045 - RNA, 16 nt, Pseudomonas aeruginosa PA01
cgccuugcagcaccgc

SEQ ID NO: 1562046 - RNA, 21 nt, Pseudomonas aeruginosa PA01
cgcgccgguggccaggacgcu

SEQ ID NO: 1562047 - RNA, 22 nt, Pseudomonas aeruginosa PA01
cgcgccgguggcguacccgccc

SEQ ID NO: 1562048 - RNA, 14 nt, Pseudomonas aeruginosa PA01
cgcgccgcucaggc

SEQ ID NO: 1562049 - RNA, 17 nt, Pseudomonas aeruginosa PA01
cgcgcgcccccuggccg

SEQ ID NO: 1562050 - RNA, 20 nt, Pseudomonas aeruginosa PA01
cgcgccucgucgcgccaggc

SEQ ID NO: 1562051 - RNA, 22 nt, Pseudomonas aeruginosa PA01
cgcgcgccugcaacgccagcag

SEQ ID NO: 1562052 - RNA, 14 nt, Pseudomonas aeruginosa PA01
cgcgccgccgcggc

SEQ ID NO: 1562053 - RNA, 20 nt, Pseudomonas aeruginosa PA01
cgcgccgccgcggccagccc

SEQ ID NO: 1562054 - RNA, 16 nt, Pseudomonas aeruginosa PA01
cgcgccgcgccagcag

SEQ ID NO: 1562055 - RNA, 14 nt, Pseudomonas aeruginosa PA01
cgcgccgcggcggc

SEQ ID NO: 1562056 - RNA, 20 nt, Pseudomonas aeruginosa PA01
cgcgccgcgguuuccgugcg

SEQ ID NO: 1562057 - RNA, 19 nt, Pseudomonas aeruginosa PA01
cgcgccggguugcgccgca

SEQ ID NO: 1562058 - RNA, 23 nt, Pseudomonas aeruginosa PA01
cgcgccggugaucgagccgccgg

SEQ ID NO: 1562059 - RNA, 23 nt, Pseudomonas aeruginosa PA01
cgcgcccucggugauaccgccgg

SEQ ID NO: 1562060 - RNA, 14 nt, Pseudomonas aeruginosa PA01
cgcgcccggcgcca

SEQ ID NO: 1562061 - RNA, 17 nt, Pseudomonas aeruginosa PA01
cgcgcccggcgccaggc

SEQ ID NO: 1562062 - RNA, 12 nt, Pseudomonas aeruginosa PA01
cgcgcccggcca

SEQ ID NO: 1562063 - RNA, 15 nt, Pseudomonas aeruginosa PA01
cgcgcccggccaggc

SEQ ID NO: 1562064 - RNA, 20 nt, Pseudomonas aeruginosa PA01
cgcgcccggccaggccgccc

SEQ ID NO: 1562065 - RNA, 14 nt, Pseudomonas aeruginosa PA01
cgcgccccgccagg

SEQ ID NO: 1562066 - RNA, 11 nt, Pseudomonas aeruginosa PA01
cgcgccccggg

SEQ ID NO: 1562067 - RNA, 11 nt, Pseudomonas aeruginosa PA01
cgcgccccguc

SEQ ID NO: 1562068 - RNA, 13 nt, Pseudomonas aeruginosa PA01
cgcgccccguccc

SEQ ID NO: 1562069 - RNA, 21 nt, Pseudomonas aeruginosa PA01
cgcgccccgucccuaccagcg

SEQ ID NO: 1562070 - RNA, 17 nt, Pseudomonas aeruginosa PA01
cgcgcccaggcccagcg

SEQ ID NO: 1562071 - RNA, 18 nt, Pseudomonas aeruginosa PA01
cgcgccaaggccgccagg

SEQ ID NO: 1562072 - RNA, 19 nt, Pseudomonas aeruginosa PA01
cgcgccaaggccgccaggc

SEQ ID NO: 1562073 - RNA, 12 nt, Pseudomonas aeruginosa PA01
cgcgcccacucc

SEQ ID NO: 1562074 - RNA, 13 nt, Pseudomonas aeruginosa PA01
cgcgcccaggccc

SEQ ID NO: 1562075 - RNA, 13 nt, Pseudomonas aeruginosa PA01
cgcgcccaggcag

SEQ ID NO: 1562076 - RNA, 15 nt, Pseudomonas aeruginosa PA01
cgcgccauuccgcgg

SEQ ID NO: 1562077 - RNA, 14 nt, Pseudomonas aeruginosa PA01
cgcgcagggccagg

SEQ ID NO: 1562078 - RNA, 18 nt, Pseudomonas aeruginosa PA01
cgcgcagggccgcggcgu

SEQ ID NO: 1562079 - RNA, 19 nt, Pseudomonas aeruginosa PA01
cgcgcagggucaggcccuu

SEQ ID NO: 1562080 - RNA, 22 nt, Pseudomonas aeruginosa PA01
cgcgcaggcgcuggcgggcgcu

SEQ ID NO: 1562081 - RNA, 19 nt, Pseudomonas aeruginosa PA01
cgcgcaggaccuggcugag

SEQ ID NO: 1562082 - RNA, 22 nt, Pseudomonas aeruginosa PA01
cgcgcaggacgaggaaggcgcg

SEQ ID NO: 1562083 - RNA, 12 nt, Pseudomonas aeruginosa PA01
cgcgcaggagug

SEQ ID NO: 1562084 - RNA, 23 nt, Pseudomonas aeruginosa PA01
cgcgcagcuugccuuccaggcug

SEQ ID NO: 1562085 - RNA, 21 nt, Pseudomonas aeruginosa PA01
cgcgcaggugcuuggcaccgc

SEQ ID NO: 1562086 - RNA, 22 nt, Pseudomonas aeruginosa PA01
cgcgcaggugcuuggcaccgcg

SEQ ID NO: 1562087 - RNA, 19 nt, Pseudomonas aeruginosa PA01
cgcgcaguacgaucagcca

SEQ ID NO: 1562088 - RNA, 20 nt, Pseudomonas aeruginosa PA01
cgcgcaguaggcgcugccgu

SEQ ID NO: 1562089 - RNA, 19 nt, Pseudomonas aeruginosa PA01
cgcgcagucccgcgcggcc

SEQ ID NO: 1562090 - RNA, 16 nt, Pseudomonas aeruginosa PA01
cgcgcagaccaucagc

SEQ ID NO: 1562091 - RNA, 19 nt, Pseudomonas aeruginosa PA01
cgcgcacgucaccguccuu

SEQ ID NO: 1562092 - RNA, 19 nt, Pseudomonas aeruginosa PA01
cgcgcaccuguuucagcgg

SEQ ID NO: 1562093 - RNA, 23 nt, Pseudomonas aeruginosa PA01
cgcgcacggaucgcgcugggcgc

SEQ ID NO: 1562094 - RNA, 19 nt, Pseudomonas aeruginosa PA01
cgcgauugcagcuccuggu

SEQ ID NO: 1562095 - RNA, 15 nt, Pseudomonas aeruginosa PA01
cgcgauucgccgggc

SEQ ID NO: 1562096 - RNA, 15 nt, Pseudomonas aeruginosa PA01
cgcgauguccccggc

SEQ ID NO: 1562097 - RNA, 22 nt, Pseudomonas aeruginosa PA01
cgcgauguccccggccagcagc

SEQ ID NO: 1562098 - RNA, 16 nt, Pseudomonas aeruginosa PA01
cgcgcaaaccggcagc

SEQ ID NO: 1562099 - RNA, 17 nt, Pseudomonas aeruginosa PA01
cgcgaugcguuccaggg

SEQ ID NO: 1562100 - RNA, 21 nt, Pseudomonas aeruginosa PA01
cgcgauauccgccagggagca

SEQ ID NO: 1562101 - RNA, 17 nt, Pseudomonas aeruginosa PA01
cgcgaucugcugguuga

SEQ ID NO: 1562102 - RNA, 22 nt, Pseudomonas aeruginosa PA01
cgcgaucucuacuaccgccagc

SEQ ID NO: 1562103 - RNA, 16 nt, Pseudomonas aeruginosa PA01
cgcgguuauccgccga

SEQ ID NO: 1562104 - RNA, 16 nt, Pseudomonas aeruginosa PA01
cgcgguuauccgccgc

SEQ ID NO: 1562105 - RNA, 18 nt, Pseudomonas aeruginosa PA01
cgcgguuauccgccgccu

SEQ ID NO: 1562106 - RNA, 20 nt, Pseudomonas aeruginosa PA01
cgcgguggaggcggcgguca

SEQ ID NO: 1562107 - RNA, 19 nt, Pseudomonas aeruginosa PA01
cgcggucggguccgggccc

SEQ ID NO: 1562108 - RNA, 20 nt, Pseudomonas aeruginosa PA01
cgcgggugcggcuggcgcgc

SEQ ID NO: 1562109 - RNA, 22 nt, Pseudomonas aeruginosa PA01
cgcggguuccucacggcgcagc

SEQ ID NO: 1562110 - RNA, 17 nt, Pseudomonas aeruginosa PA01
cgcggguuucgcugccc

SEQ ID NO: 1562111 - RNA, 14 nt, Pseudomonas aeruginosa PA01
cgcgguacagccgg

SEQ ID NO: 1562112 - RNA, 18 nt, Pseudomonas aeruginosa PA01
cgcggucacucggccucg

SEQ ID NO: 1562113 - RNA, 14 nt, Pseudomonas aeruginosa PA01
cgcggucaccaggg

SEQ ID NO: 1562114 - RNA, 13 nt, Pseudomonas aeruginosa PA01
cgcggucacccau

SEQ ID NO: 1562115 - RNA, 23 nt, Pseudomonas aeruginosa PA01
cgcggucacccauucgaugccgc

SEQ ID NO: 1562116 - RNA, 21 nt, Pseudomonas aeruginosa PA01
cgcgguaucccuggaacuagc

SEQ ID NO: 1562117 - RNA, 17 nt, Pseudomonas aeruginosa PA01
cgcggucgagcucggcc

SEQ ID NO: 1562118 - RNA, 20 nt, Pseudomonas aeruginosa PA01
cgcggucgagcagcgccgcg

SEQ ID NO: 1562119 - RNA, 18 nt, Pseudomonas aeruginosa PA01
cgcgucccugggcgcagg

SEQ ID NO: 1562120 - RNA, 19 nt, Pseudomonas aeruginosa PA01
cgcgucccugggcgcaggg

SEQ ID NO: 1562121 - RNA, 18 nt, Pseudomonas aeruginosa PA01
cgcguccgaccauuuccc

SEQ ID NO: 1562122 - RNA, 20 nt, Pseudomonas aeruginosa PA01
cgcguccgcaguucgccccg

SEQ ID NO: 1562123 - RNA, 18 nt, Pseudomonas aeruginosa PA01
cgcguccggccagccugg

SEQ ID NO: 1562124 - RNA, 22 nt, Pseudomonas aeruginosa PA01
cgcguaggcuuggucgggcgcc

SEQ ID NO: 1562125 - RNA, 13 nt, Pseudomonas aeruginosa PA01
cgcguaagcggcc

SEQ ID NO: 1562126 - RNA, 22 nt, Pseudomonas aeruginosa PA01
cgcguaagcggccuuuucucug

SEQ ID NO: 1562127 - RNA, 16 nt, Pseudomonas aeruginosa PA01
cgcguacuugccaggg

SEQ ID NO: 1562128 - RNA, 16 nt, Pseudomonas aeruginosa PA01
cgcguagcgcuucccg

SEQ ID NO: 1562129 - RNA, 17 nt, Pseudomonas aeruginosa PA01
cgcguaggcgaacacgu

SEQ ID NO: 1562130 - RNA, 21 nt, Pseudomonas aeruginosa PA01
cgcguaccaguagcgacagca

SEQ ID NO: 1562131 - RNA, 16 nt, Pseudomonas aeruginosa PA01
cgcguacgcccgcagc

SEQ ID NO: 1562132 - RNA, 14 nt, Pseudomonas aeruginosa PA01
cgcguguucgcggc

SEQ ID NO: 1562133 - RNA, 15 nt, Pseudomonas aeruginosa PA01
cgcgugggccggcau

SEQ ID NO: 1562134 - RNA, 16 nt, Pseudomonas aeruginosa PA01
cgcguggcgucggcgc

SEQ ID NO: 1562135 - RNA, 14 nt, Pseudomonas aeruginosa PA01
cgcgugggccaggg

SEQ ID NO: 1562136 - RNA, 13 nt, Pseudomonas aeruginosa PA01
cgcguuccagguc

SEQ ID NO: 1562137 - RNA, 13 nt, Pseudomonas aeruginosa PA01
cgcguucaguccc

SEQ ID NO: 1562138 - RNA, 14 nt, Pseudomonas aeruginosa PA01
cgcgucuccaugcg

SEQ ID NO: 1562139 - RNA, 15 nt, Pseudomonas aeruginosa PA01
cgcgucgaccaccgc

SEQ ID NO: 1562140 - RNA, 20 nt, Pseudomonas aeruginosa PA01
cgcgucgaagcugucggccc

SEQ ID NO: 1562141 - RNA, 23 nt, Pseudomonas aeruginosa PA01
cgcggcggguaguguuugcgcag

SEQ ID NO: 1562142 - RNA, 15 nt, Pseudomonas aeruginosa PA01
cgcggcugcgcgccg

SEQ ID NO: 1562143 - RNA, 19 nt, Pseudomonas aeruginosa PA01
cgcggcuggccgccucgcg

SEQ ID NO: 1562144 - RNA, 12 nt, Pseudomonas aeruginosa PA01
cgcggcuggcug

SEQ ID NO: 1562145 - RNA, 21 nt, Pseudomonas aeruginosa PA01
cgcggcggcggccgcaugccg

SEQ ID NO: 1562146 - RNA, 13 nt, Pseudomonas aeruginosa PA01
cgcggcggcgacg

SEQ ID NO: 1562147 - RNA, 19 nt, Pseudomonas aeruginosa PA01
cgcggcggcuccggcgcca

SEQ ID NO: 1562148 - RNA, 12 nt, Pseudomonas aeruginosa PA01
cgcggccuucuc

SEQ ID NO: 1562149 - RNA, 20 nt, Pseudomonas aeruginosa PA01
cgcggccuucucgucgccgc

SEQ ID NO: 1562150 - RNA, 15 nt, Pseudomonas aeruginosa PA01
cgcggccugcgccgg

SEQ ID NO: 1562151 - RNA, 15 nt, Pseudomonas aeruginosa PA01
cgcggcgaacaucau

SEQ ID NO: 1562152 - RNA, 11 nt, Pseudomonas aeruginosa PA01
cgcggccagcu

SEQ ID NO: 1562153 - RNA, 15 nt, Pseudomonas aeruginosa PA01
cgcggccagcucgcc

SEQ ID NO: 1562154 - RNA, 18 nt, Pseudomonas aeruginosa PA01
cgcggccagcgcggccgc

SEQ ID NO: 1562155 - RNA, 14 nt, Pseudomonas aeruginosa PA01
cgcggccggcuucu

SEQ ID NO: 1562156 - RNA, 14 nt, Pseudomonas aeruginosa PA01
cgcgggucugcucg

SEQ ID NO: 1562157 - RNA, 20 nt, Pseudomonas aeruginosa PA01
cgcgggucugcucggcgccc

SEQ ID NO: 1562158 - RNA, 21 nt, Pseudomonas aeruginosa PA01
cgcgggucuugccggucugcu

SEQ ID NO: 1562159 - RNA, 22 nt, Pseudomonas aeruginosa PA01
cgcgggucuugccggucugcug

SEQ ID NO: 1562160 - RNA, 20 nt, Pseudomonas aeruginosa PA01
cgcgggucuugcgcagggcg

SEQ ID NO: 1562161 - RNA, 23 nt, Pseudomonas aeruginosa PA01
cgcgggucguacaccgcgcggca

SEQ ID NO: 1562162 - RNA, 15 nt, Pseudomonas aeruginosa PA01
cgcgggucaccagcg

SEQ ID NO: 1562163 - RNA, 18 nt, Pseudomonas aeruginosa PA01
cgcgggcgugcuccagca

SEQ ID NO: 1562164 - RNA, 17 nt, Pseudomonas aeruginosa PA01
cgcgggaggccgccucg

SEQ ID NO: 1562165 - RNA, 17 nt, Pseudomonas aeruginosa PA01
cgcgggacgcguucccc

SEQ ID NO: 1562166 - RNA, 16 nt, Pseudomonas aeruginosa PA01
cgcgggcuggccaccg

SEQ ID NO: 1562167 - RNA, 16 nt, Pseudomonas aeruginosa PA01
cgcgggcucaggcucu

SEQ ID NO: 1562168 - RNA, 18 nt, Pseudomonas aeruginosa PA01
cgcgggauagacggcgga

SEQ ID NO: 1562169 - RNA, 14 nt, Pseudomonas aeruginosa PA01
cgcgggcggcggcg

SEQ ID NO: 1562170 - RNA, 22 nt, Pseudomonas aeruginosa PA01
cgcgggcggccucgauggcggc

SEQ ID NO: 1562171 - RNA, 12 nt, Pseudomonas aeruginosa PA01
cgcggcaggcgg

SEQ ID NO: 1562172 - RNA, 18 nt, Pseudomonas aeruginosa PA01
cgcggcaucccgcccggu

SEQ ID NO: 1562173 - RNA, 19 nt, Pseudomonas aeruginosa PA01
cgcggcagguagccgccuu

SEQ ID NO: 1562174 - RNA, 17 nt, Pseudomonas aeruginosa PA01
cgcggcagugcucgauc

SEQ ID NO: 1562175 - RNA, 23 nt, Pseudomonas aeruginosa PA01
cgcggcacagcguggccagcgcc

SEQ ID NO: 1562176 - RNA, 16 nt, Pseudomonas aeruginosa PA01
cgcggcaccggcgacg

SEQ ID NO: 1562177 - RNA, 16 nt, Pseudomonas aeruginosa PA01
cgcggccagcccccuc

SEQ ID NO: 1562178 - RNA, 17 nt, Pseudomonas aeruginosa PA01
cgcggccagccgcuagc

SEQ ID NO: 1562179 - RNA, 13 nt, Pseudomonas aeruginosa PA01
cgcggccagcagc

SEQ ID NO: 1562180 - RNA, 15 nt, Pseudomonas aeruginosa PA01
cgcggccagcagcac

SEQ ID NO: 1562181 - RNA, 23 nt, Pseudomonas aeruginosa PA01
cgcgcgcuuuuccggcgccggca

SEQ ID NO: 1562182 - RNA, 22 nt, Pseudomonas aeruginosa PA01
cgcgcuggucguaggcgcgggc

SEQ ID NO: 1562183 - RNA, 13 nt, Pseudomonas aeruginosa PA01
cgcgcgcugugca

SEQ ID NO: 1562184 - RNA, 22 nt, Pseudomonas aeruginosa PA01
cgcgcgccuggcuggccagcag

SEQ ID NO: 1562185 - RNA, 20 nt, Pseudomonas aeruginosa PA01
cgcgcgccuucagccccagc

SEQ ID NO: 1562186 - RNA, 13 nt, Pseudomonas aeruginosa PA01
cgcgcgcgcgcuc

SEQ ID NO: 1562187 - RNA, 14 nt, Pseudomonas aeruginosa PA01
cgcgcuucaggcag

SEQ ID NO: 1562188 - RNA, 13 nt, Pseudomonas aeruginosa PA01
cgcgcuuccaggc

SEQ ID NO: 1562189 - RNA, 16 nt, Pseudomonas aeruginosa PA01
cgcgcuguugccgcgc

SEQ ID NO: 1562190 - RNA, 17 nt, Pseudomonas aeruginosa PA01
cgcgcugugcacggucu

SEQ ID NO: 1562191 - RNA, 16 nt, Pseudomonas aeruginosa PA01
cgcgcuguagccggcg

SEQ ID NO: 1562192 - RNA, 21 nt, Pseudomonas aeruginosa PA01
cgcggaccucugcguucugcu

SEQ ID NO: 1562193 - RNA, 20 nt, Pseudomonas aeruginosa PA01
cgcggacauggcgcucgagc

SEQ ID NO: 1562194 - RNA, 18 nt, Pseudomonas aeruginosa PA01
cgcggacccgcgccggca

SEQ ID NO: 1562195 - RNA, 22 nt, Pseudomonas aeruginosa PA01
cgcggaccgggcggcgcggcgc

SEQ ID NO: 1562196 - RNA, 14 nt, Pseudomonas aeruginosa PA01
cgcggaccuccagc

SEQ ID NO: 1562197 - RNA, 15 nt, Pseudomonas aeruginosa PA01
cgcggaccuccagcc

SEQ ID NO: 1562198 - RNA, 17 nt, Pseudomonas aeruginosa PA01
cgcggaccuccagccgg

SEQ ID NO: 1562199 - RNA, 12 nt, Pseudomonas aeruginosa PA01
cgcgcuuggccu

SEQ ID NO: 1562200 - RNA, 15 nt, Pseudomonas aeruginosa PA01
cgcgcuuggccuugc

SEQ ID NO: 1562201 - RNA, 14 nt, Pseudomonas aeruginosa PA01
cgcggaccagcucc

SEQ ID NO: 1562202 - RNA, 15 nt, Pseudomonas aeruginosa PA01
cgcggaccagcuccg

SEQ ID NO: 1562203 - RNA, 14 nt, Pseudomonas aeruginosa PA01
cgcggacccaguug

SEQ ID NO: 1562204 - RNA, 21 nt, Pseudomonas aeruginosa PA01
cgcgcuucuucgacuaccugg

SEQ ID NO: 1562205 - RNA, 23 nt, Pseudomonas aeruginosa PA01
cgcgcuuggacagcucgcgggac

SEQ ID NO: 1562206 - RNA, 14 nt, Pseudomonas aeruginosa PA01
cgcggacgggccgc

SEQ ID NO: 1562207 - RNA, 15 nt, Pseudomonas aeruginosa PA01
cgcggacggcacggg

SEQ ID NO: 1562208 - RNA, 19 nt, Pseudomonas aeruginosa PA01
cgcggacggcacggggcgc

SEQ ID NO: 1562209 - RNA, 12 nt, Pseudomonas aeruginosa PA01
cgcggagcugga

SEQ ID NO: 1562210 - RNA, 18 nt, Pseudomonas aeruginosa PA01
cgcggagcguccaccagc

SEQ ID NO: 1562211 - RNA, 21 nt, Pseudomonas aeruginosa PA01
cgcggagcguccaccagcgcc

SEQ ID NO: 1562212 - RNA, 19 nt, Pseudomonas aeruginosa PA01
cgcccgcaccacccgcugc

SEQ ID NO: 1562213 - RNA, 15 nt, Pseudomonas aeruginosa PA01
cgcccgcagccacag

SEQ ID NO: 1562214 - RNA, 16 nt, Pseudomonas aeruginosa PA01
cgcccgcagccacggc

SEQ ID NO: 1562215 - RNA, 17 nt, Pseudomonas aeruginosa PA01
cgcccgcagccagccuc

SEQ ID NO: 1562216 - RNA, 23 nt, Pseudomonas aeruginosa PA01
cgcccgcaguuccucgccgcugc

SEQ ID NO: 1562217 - RNA, 14 nt, Pseudomonas aeruginosa PA01
cgcccgccggccgu

SEQ ID NO: 1562218 - RNA, 18 nt, Pseudomonas aeruginosa PA01
cgcccgccacggcgcgcu

SEQ ID NO: 1562219 - RNA, 20 nt, Pseudomonas aeruginosa PA01
cgcccgaccccacgccggcc

SEQ ID NO: 1562220 - RNA, 22 nt, Pseudomonas aeruginosa PA01
cgcccgaggcguuauccgccga

SEQ ID NO: 1562221 - RNA, 18 nt, Pseudomonas aeruginosa PA01
cgcccgauaggcgccggc

SEQ ID NO: 1562222 - RNA, 20 nt, Pseudomonas aeruginosa PA01
cgcccgauaggcgccggcgc

SEQ ID NO: 1562223 - RNA, 21 nt, Pseudomonas aeruginosa PA01
cgcccgaggcgaccuuggcca

SEQ ID NO: 1562224 - RNA, 18 nt, Pseudomonas aeruginosa PA01
cgccccggccgcgccagc

SEQ ID NO: 1562225 - RNA, 12 nt, Pseudomonas aeruginosa PA01
cgccccggcagc

SEQ ID NO: 1562226 - RNA, 17 nt, Pseudomonas aeruginosa PA01
cgccccggcagccacca

SEQ ID NO: 1562227 - RNA, 18 nt, Pseudomonas aeruginosa PA01
cgccccgcuacccugccc

SEQ ID NO: 1562228 - RNA, 22 nt, Pseudomonas aeruginosa PA01
cgccccgcuacccugccccagc

SEQ ID NO: 1562229 - RNA, 18 nt, Pseudomonas aeruginosa PA01
cgccccacggcgcggccg

SEQ ID NO: 1562230 - RNA, 19 nt, Pseudomonas aeruginosa PA01
cgccccacggcgcggccgu

SEQ ID NO: 1562231 - RNA, 14 nt, Pseudomonas aeruginosa PA01
cgcccauugcccgg

SEQ ID NO: 1562232 - RNA, 13 nt, Pseudomonas aeruginosa PA01
cgccccaccaggc

SEQ ID NO: 1562233 - RNA, 15 nt, Pseudomonas aeruginosa PA01
cgccccaccaggcuc

SEQ ID NO: 1562234 - RNA, 12 nt, Pseudomonas aeruginosa PA01
cgcccagggcca

SEQ ID NO: 1562235 - RNA, 14 nt, Pseudomonas aeruginosa PA01
cgcccagggccagc

SEQ ID NO: 1562236 - RNA, 17 nt, Pseudomonas aeruginosa PA01
cgcccagggccagcggg

SEQ ID NO: 1562237 - RNA, 14 nt, Pseudomonas aeruginosa PA01
cgcccagggggccg

SEQ ID NO: 1562238 - RNA, 17 nt, Pseudomonas aeruginosa PA01
cgcccagggggccgggc

SEQ ID NO: 1562239 - RNA, 18 nt, Pseudomonas aeruginosa PA01
cgcccagggggccgggcc

SEQ ID NO: 1562240 - RNA, 13 nt, Pseudomonas aeruginosa PA01
cgcccagcgcagc

SEQ ID NO: 1562241 - RNA, 14 nt, Pseudomonas aeruginosa PA01
cgcccaggcugccg

SEQ ID NO: 1562242 - RNA, 17 nt, Pseudomonas aeruginosa PA01
cgcccaggcugccgccg

SEQ ID NO: 1562243 - RNA, 20 nt, Pseudomonas aeruginosa PA01
cgcccaguucuucgccgccc

SEQ ID NO: 1562244 - RNA, 22 nt, Pseudomonas aeruginosa PA01
cgcccaguucuucgccgcccgc

SEQ ID NO: 1562245 - RNA, 19 nt, Pseudomonas aeruginosa PA01
cgcccaguugcgccgccug

SEQ ID NO: 1562246 - RNA, 15 nt, Pseudomonas aeruginosa PA01
cgcccaggugcgccg

SEQ ID NO: 1562247 - RNA, 15 nt, Pseudomonas aeruginosa PA01
cgcccagugguucca

SEQ ID NO: 1562248 - RNA, 18 nt, Pseudomonas aeruginosa PA01
cgcccagugguuccagga

SEQ ID NO: 1562249 - RNA, 18 nt, Pseudomonas aeruginosa PA01
cgcccaguaccacgcagc

SEQ ID NO: 1562250 - RNA, 20 nt, Pseudomonas aeruginosa PA01
cgccacggaugcagucccgc

SEQ ID NO: 1562251 - RNA, 22 nt, Pseudomonas aeruginosa PA01
cgccacggaugcagucccgcca

SEQ ID NO: 1562252 - RNA, 12 nt, Pseudomonas aeruginosa PA01
cgccacgcugcu

SEQ ID NO: 1562253 - RNA, 15 nt, Pseudomonas aeruginosa PA01
cgccacgccggcgcu

SEQ ID NO: 1562254 - RNA, 22 nt, Pseudomonas aeruginosa PA01
cgccacgcgagaagccgcccac

SEQ ID NO: 1562255 - RNA, 15 nt, Pseudomonas aeruginosa PA01
cgccacgcugaucau

SEQ ID NO: 1562256 - RNA, 15 nt, Pseudomonas aeruginosa PA01
cgccaugacccgcgg

SEQ ID NO: 1562257 - RNA, 15 nt, Pseudomonas aeruginosa PA01
cgccaucuccucgcu

SEQ ID NO: 1562258 - RNA, 18 nt, Pseudomonas aeruginosa PA01
cgccaugacacaccacgc

SEQ ID NO: 1562259 - RNA, 21 nt, Pseudomonas aeruginosa PA01
cgccaugccguucaggccggc

SEQ ID NO: 1562260 - RNA, 20 nt, Pseudomonas aeruginosa PA01
cgccauguuccacaugcgcu

SEQ ID NO: 1562261 - RNA, 11 nt, Pseudomonas aeruginosa PA01
cgcccaccagg

SEQ ID NO: 1562262 - RNA, 19 nt, Pseudomonas aeruginosa PA01
cgccaugcuguugccgugg

SEQ ID NO: 1562263 - RNA, 15 nt, Pseudomonas aeruginosa PA01
cgccaugcucggcca

SEQ ID NO: 1562264 - RNA, 17 nt, Pseudomonas aeruginosa PA01
cgccaugcucggccagc

SEQ ID NO: 1562265 - RNA, 23 nt, Pseudomonas aeruginosa PA01
cgccaugcucuucaggcugucgg

SEQ ID NO: 1562266 - RNA, 22 nt, Pseudomonas aeruginosa PA01
cgccaugcaagaacgccgaccc

SEQ ID NO: 1562267 - RNA, 15 nt, Pseudomonas aeruginosa PA01
cgccaugcggcaggc

SEQ ID NO: 1562268 - RNA, 19 nt, Pseudomonas aeruginosa PA01
cgcccagcagcaggccggc

SEQ ID NO: 1562269 - RNA, 22 nt, Pseudomonas aeruginosa PA01
cgcccagcagggccagccagag

SEQ ID NO: 1562270 - RNA, 15 nt, Pseudomonas aeruginosa PA01
cgcccagcagggcca

SEQ ID NO: 1562271 - RNA, 20 nt, Pseudomonas aeruginosa PA01
cgccgccccagccucggcag

SEQ ID NO: 1562272 - RNA, 19 nt, Pseudomonas aeruginosa PA01
cgccgcccccagcgcgccg

SEQ ID NO: 1562273 - RNA, 20 nt, Pseudomonas aeruginosa PA01
cgccgcccccagcgcgccgc

SEQ ID NO: 1562274 - RNA, 21 nt, Pseudomonas aeruginosa PA01
cgccgcccccagcgcgccgcc

SEQ ID NO: 1562275 - RNA, 21 nt, Pseudomonas aeruginosa PA01
cgccgccaaccacuccgccac

SEQ ID NO: 1562276 - RNA, 19 nt, Pseudomonas aeruginosa PA01
cgccgcauuggccaggccc

SEQ ID NO: 1562277 - RNA, 20 nt, Pseudomonas aeruginosa PA01
cgccgcaucgcugaccucga

SEQ ID NO: 1562278 - RNA, 13 nt, Pseudomonas aeruginosa PA01
cgccgcaggcgcu

SEQ ID NO: 1562279 - RNA, 19 nt, Pseudomonas aeruginosa PA01
cgccgagcccccggcgccc

SEQ ID NO: 1562280 - RNA, 13 nt, Pseudomonas aeruginosa PA01
cgccgagcgccgc

SEQ ID NO: 1562281 - RNA, 17 nt, Pseudomonas aeruginosa PA01
cgccgagcgccgccagg

SEQ ID NO: 1562282 - RNA, 13 nt, Pseudomonas aeruginosa PA01
cgccgagcagcac

SEQ ID NO: 1562283 - RNA, 18 nt, Pseudomonas aeruginosa PA01
cgccgagcagcaccaggc

SEQ ID NO: 1562284 - RNA, 16 nt, Pseudomonas aeruginosa PA01
cgccgagcaccccgac

SEQ ID NO: 1562285 - RNA, 17 nt, Pseudomonas aeruginosa PA01
cgccgagcaagccuucc

SEQ ID NO: 1562286 - RNA, 16 nt, Pseudomonas aeruginosa PA01
cgccgacgccaccagc

SEQ ID NO: 1562287 - RNA, 20 nt, Pseudomonas aeruginosa PA01
cgccgagcugaccaccaggg

SEQ ID NO: 1562288 - RNA, 12 nt, Pseudomonas aeruginosa PA01
cgccgaggaacu

SEQ ID NO: 1562289 - RNA, 17 nt, Pseudomonas aeruginosa PA01
cgccgaggaagccgacc

SEQ ID NO: 1562290 - RNA, 24 nt, Pseudomonas aeruginosa PA01
cgccgaggaagccgaccggcgccg

SEQ ID NO: 1562291 - RNA, 17 nt, Pseudomonas aeruginosa PA01
cgccgaggagacgcggc

SEQ ID NO: 1562292 - RNA, 18 nt, Pseudomonas aeruginosa PA01
cgccgaggagacgcggca

SEQ ID NO: 1562293 - RNA, 14 nt, Pseudomonas aeruginosa PA01
cgccgaggcgcgcc

SEQ ID NO: 1562294 - RNA, 15 nt, Pseudomonas aeruginosa PA01
cgccgaggcgcgcca

SEQ ID NO: 1562295 - RNA, 15 nt, Pseudomonas aeruginosa PA01
cgccgaggauacgcu

SEQ ID NO: 1562296 - RNA, 20 nt, Pseudomonas aeruginosa PA01
cgccgaggauacgcucagga

SEQ ID NO: 1562297 - RNA, 14 nt, Pseudomonas aeruginosa PA01
cgccgagguugcgc

SEQ ID NO: 1562298 - RNA, 19 nt, Pseudomonas aeruginosa PA01
cgcccucagcagcgccgcc

SEQ ID NO: 1562299 - RNA, 20 nt, Pseudomonas aeruginosa PA01
cgcccucagcagcgccgccc

SEQ ID NO: 1562300 - RNA, 12 nt, Pseudomonas aeruginosa PA01
cgcccuccagca

SEQ ID NO: 1562301 - RNA, 15 nt, Pseudomonas aeruginosa PA01
cgcccuccagcaccc

SEQ ID NO: 1562302 - RNA, 15 nt, Pseudomonas aeruginosa PA01
cgcccuaccccaggg

SEQ ID NO: 1562303 - RNA, 15 nt, Pseudomonas aeruginosa PA01
cgcccuaccccccaa

SEQ ID NO: 1562304 - RNA, 15 nt, Pseudomonas aeruginosa PA01
cgcccuaccgcccac

SEQ ID NO: 1562305 - RNA, 22 nt, Pseudomonas aeruginosa PA01
cgcccuaccgcccacccugcgc

SEQ ID NO: 1562306 - RNA, 15 nt, Pseudomonas aeruginosa PA01
cgcccuaccguccgc

SEQ ID NO: 1562307 - RNA, 17 nt, Pseudomonas aeruginosa PA01
cgcccuaccguccgcag

SEQ ID NO: 1562308 - RNA, 22 nt, Pseudomonas aeruginosa PA01
cgcccuacgcaacccgcccggc

SEQ ID NO: 1562309 - RNA, 21 nt, Pseudomonas aeruginosa PA01
cgcccuacgccaccugagcga

SEQ ID NO: 1562310 - RNA, 15 nt, Pseudomonas aeruginosa PA01
cgcccuacgcggcac

SEQ ID NO: 1562311 - RNA, 18 nt, Pseudomonas aeruginosa PA01
cgcccuacggccccaggc

SEQ ID NO: 1562312 - RNA, 14 nt, Pseudomonas aeruginosa PA01
cgcccuacgggggc

SEQ ID NO: 1562313 - RNA, 16 nt, Pseudomonas aeruginosa PA01
cgcccuacuccagggg

SEQ ID NO: 1562314 - RNA, 23 nt, Pseudomonas aeruginosa PA01
cgcccgggccgggggcggcgccu

SEQ ID NO: 1562315 - RNA, 22 nt, Pseudomonas aeruginosa PA01
cgcccgggcgccaccgauagcg

SEQ ID NO: 1562316 - RNA, 17 nt, Pseudomonas aeruginosa PA01
cgcccggucuagcgccc

SEQ ID NO: 1562317 - RNA, 21 nt, Pseudomonas aeruginosa PA01
cgcccggucuagcgccccggc

SEQ ID NO: 1562318 - RNA, 20 nt, Pseudomonas aeruginosa PA01
cgcccggucucagccggcgc

SEQ ID NO: 1562319 - RNA, 14 nt, Pseudomonas aeruginosa PA01
cgcccggcucgacc

SEQ ID NO: 1562320 - RNA, 18 nt, Pseudomonas aeruginosa PA01
cgcccggcuucggcggcg

SEQ ID NO: 1562321 - RNA, 21 nt, Pseudomonas aeruginosa PA01
cgcccggcagcaggccgccgc

SEQ ID NO: 1562322 - RNA, 14 nt, Pseudomonas aeruginosa PA01
cgcccggcagcggc

SEQ ID NO: 1562323 - RNA, 17 nt, Pseudomonas aeruginosa PA01
cgcccgcugugcgggga

SEQ ID NO: 1562324 - RNA, 14 nt, Pseudomonas aeruginosa PA01
cgcccgccguccuc

SEQ ID NO: 1562325 - RNA, 23 nt, Pseudomonas aeruginosa PA01
cgcccgcugcgcugccagcgccg

SEQ ID NO: 1562326 - RNA, 23 nt, Pseudomonas aeruginosa PA01
cgcccggauagacgccguccacc

SEQ ID NO: 1562327 - RNA, 12 nt, Pseudomonas aeruginosa PA01
cgccgaccgcgc

SEQ ID NO: 1562328 - RNA, 22 nt, Pseudomonas aeruginosa PA01
cgccgacaacgaaaagagccgc

SEQ ID NO: 1562329 - RNA, 14 nt, Pseudomonas aeruginosa PA01
cgccgaccgcgcgc

SEQ ID NO: 1562330 - RNA, 16 nt, Pseudomonas aeruginosa PA01
cgccgaccgcgcgccu

SEQ ID NO: 1562331 - RNA, 17 nt, Pseudomonas aeruginosa PA01
cgccgaccucggccgcc

SEQ ID NO: 1562332 - RNA, 15 nt, Pseudomonas aeruginosa PA01
cgccgaaggacaggc

SEQ ID NO: 1562333 - RNA, 19 nt, Pseudomonas aeruginosa PA01
cgccgaagaacucggcgcu

SEQ ID NO: 1562334 - RNA, 15 nt, Pseudomonas aeruginosa PA01
cgcccuucagcgccu

SEQ ID NO: 1562335 - RNA, 16 nt, Pseudomonas aeruginosa PA01
cgcccuucagcgccuc

SEQ ID NO: 1562336 - RNA, 16 nt, Pseudomonas aeruginosa PA01
cgccgaauccaggccg

SEQ ID NO: 1562337 - RNA, 15 nt, Pseudomonas aeruginosa PA01
cgccgaaggccagcu

SEQ ID NO: 1562338 - RNA, 23 nt, Pseudomonas aeruginosa PA01
cgccgaagucggcgagccggcgc

SEQ ID NO: 1562339 - RNA, 23 nt, Pseudomonas aeruginosa PA01
cgccgaaggugaaguccggcgcg

SEQ ID NO: 1562340 - RNA, 19 nt, Pseudomonas aeruginosa PA01
cgcccuggcucuugccgcg

SEQ ID NO: 1562341 - RNA, 22 nt, Pseudomonas aeruginosa PA01
cgcccuggcucuugccgcgagc

SEQ ID NO: 1562342 - RNA, 15 nt, Pseudomonas aeruginosa PA01
cgcccuggccgagcg

SEQ ID NO: 1562343 - RNA, 23 nt, Pseudomonas aeruginosa PA01
cgcccuguuucggguccaggcgc

SEQ ID NO: 1562344 - RNA, 16 nt, Pseudomonas aeruginosa PA01
cgcccuguucggcggg

SEQ ID NO: 1562345 - RNA, 22 nt, Pseudomonas aeruginosa PA01
cgcccuguucgucuggcgccug

SEQ ID NO: 1562346 - RNA, 20 nt, Pseudomonas aeruginosa PA01
cgcccucgcucguuccgcgg

SEQ ID NO: 1562347 - RNA, 13 nt, Pseudomonas aeruginosa PA01
cgcccucgcggag

SEQ ID NO: 1562348 - RNA, 20 nt, Pseudomonas aeruginosa PA01
cgcccuggaugaucucgcag

SEQ ID NO: 1562349 - RNA, 12 nt, Pseudomonas aeruginosa PA01
cgcccugcucug

SEQ ID NO: 1562350 - RNA, 20 nt, Pseudomonas aeruginosa PA01
cgccggaaugacgagccgca

SEQ ID NO: 1562351 - RNA, 16 nt, Pseudomonas aeruginosa PA01
cgccggaccaacugcg

SEQ ID NO: 1562352 - RNA, 18 nt, Pseudomonas aeruginosa PA01
cgccggaccagccggucc

SEQ ID NO: 1562353 - RNA, 19 nt, Pseudomonas aeruginosa PA01
cgccggacgagcuuuccug

SEQ ID NO: 1562354 - RNA, 16 nt, Pseudomonas aeruginosa PA01
cgccggcagcgccgcg

SEQ ID NO: 1562355 - RNA, 16 nt, Pseudomonas aeruginosa PA01
cgccggcagcucggcc

SEQ ID NO: 1562356 - RNA, 23 nt, Pseudomonas aeruginosa PA01
cgccggcauuggcacccuggacc

SEQ ID NO: 1562357 - RNA, 15 nt, Pseudomonas aeruginosa PA01
cgccggccagccgcg

SEQ ID NO: 1562358 - RNA, 14 nt, Pseudomonas aeruginosa PA01
cgccggcgagccgc

SEQ ID NO: 1562359 - RNA, 19 nt, Pseudomonas aeruginosa PA01
cgccggcgaucuccgccag

SEQ ID NO: 1562360 - RNA, 16 nt, Pseudomonas aeruginosa PA01
cgccggcgaugcgcag

SEQ ID NO: 1562361 - RNA, 16 nt, Pseudomonas aeruginosa PA01
cgccggccucgcgcaa

SEQ ID NO: 1562362 - RNA, 19 nt, Pseudomonas aeruginosa PA01
cgccggccucgcugccgcc

SEQ ID NO: 1562363 - RNA, 21 nt, Pseudomonas aeruginosa PA01
cgccggccucgcugccgccgc

SEQ ID NO: 1562364 - RNA, 16 nt, Pseudomonas aeruginosa PA01
cgccggccuccagcac

SEQ ID NO: 1562365 - RNA, 14 nt, Pseudomonas aeruginosa PA01
cgccggcgccgccu

SEQ ID NO: 1562366 - RNA, 15 nt, Pseudomonas aeruginosa PA01
cgccggcgccgccuc

SEQ ID NO: 1562367 - RNA, 21 nt, Pseudomonas aeruginosa PA01
cgccggcgccgccucgggcag

SEQ ID NO: 1562368 - RNA, 17 nt, Pseudomonas aeruginosa PA01
cgccggcccagcaggcc

SEQ ID NO: 1562369 - RNA, 16 nt, Pseudomonas aeruginosa PA01
cgccggcccgcgcggc

SEQ ID NO: 1562370 - RNA, 17 nt, Pseudomonas aeruginosa PA01
cgccggcccgcgcggca

SEQ ID NO: 1562371 - RNA, 19 nt, Pseudomonas aeruginosa PA01
cgccggccggggcgcgccc

SEQ ID NO: 1562372 - RNA, 14 nt, Pseudomonas aeruginosa PA01
cgccgggaagcacc

SEQ ID NO: 1562373 - RNA, 15 nt, Pseudomonas aeruginosa PA01
cgccgggaagcaccg

SEQ ID NO: 1562374 - RNA, 20 nt, Pseudomonas aeruginosa PA01
cgccgggaaucgccagcagg

SEQ ID NO: 1562375 - RNA, 21 nt, Pseudomonas aeruginosa PA01
cgccgggcaacgccaggccgc

SEQ ID NO: 1562376 - RNA, 21 nt, Pseudomonas aeruginosa PA01
cgccgggaugcucaccgcgcu

SEQ ID NO: 1562377 - RNA, 17 nt, Pseudomonas aeruginosa PA01
cgccgggcgcgcgccuc

SEQ ID NO: 1562378 - RNA, 18 nt, Pseudomonas aeruginosa PA01
cgccgggcucagcgcgcg

SEQ ID NO: 1562379 - RNA, 13 nt, Pseudomonas aeruginosa PA01
cgccgggcugguu

SEQ ID NO: 1562380 - RNA, 12 nt, Pseudomonas aeruginosa PA01
cgccggcgcgcu

SEQ ID NO: 1562381 - RNA, 13 nt, Pseudomonas aeruginosa PA01
cgccggcgcgcuu

SEQ ID NO: 1562382 - RNA, 16 nt, Pseudomonas aeruginosa PA01
cgccggcgcuccuccu

SEQ ID NO: 1562383 - RNA, 16 nt, Pseudomonas aeruginosa PA01
cgccggcgcgcggcgg

SEQ ID NO: 1562384 - RNA, 22 nt, Pseudomonas aeruginosa PA01
cgccggcggcgaugaucggcag

SEQ ID NO: 1562385 - RNA, 15 nt, Pseudomonas aeruginosa PA01
cgccggcggccaggg

SEQ ID NO: 1562386 - RNA, 13 nt, Pseudomonas aeruginosa PA01
cgccggcggccug

SEQ ID NO: 1562387 - RNA, 22 nt, Pseudomonas aeruginosa PA01
cgccggcggccugccccgccgg

SEQ ID NO: 1562388 - RNA, 19 nt, Pseudomonas aeruginosa PA01
cgccggcguuauccgccga

SEQ ID NO: 1562389 - RNA, 17 nt, Pseudomonas aeruginosa PA01
cgccggcugccgcgcgu

SEQ ID NO: 1562390 - RNA, 19 nt, Pseudomonas aeruginosa PA01
cgccgguaguucgcugacc

SEQ ID NO: 1562391 - RNA, 15 nt, Pseudomonas aeruginosa PA01
cgccggggaucaggu

SEQ ID NO: 1562392 - RNA, 22 nt, Pseudomonas aeruginosa PA01
cgccggggaucaggucgccgcu

SEQ ID NO: 1562393 - RNA, 14 nt, Pseudomonas aeruginosa PA01
cgccggucaggcug

SEQ ID NO: 1562394 - RNA, 16 nt, Pseudomonas aeruginosa PA01
cgccggucaggcugcg

SEQ ID NO: 1562395 - RNA, 18 nt, Pseudomonas aeruginosa PA01
cgccggucaaccgcgggc

SEQ ID NO: 1562396 - RNA, 17 nt, Pseudomonas aeruginosa PA01
cgccggucuucacgccu

SEQ ID NO: 1562397 - RNA, 15 nt, Pseudomonas aeruginosa PA01
cgccggugacgcugc

SEQ ID NO: 1562398 - RNA, 21 nt, Pseudomonas aeruginosa PA01
cgccggugaggcgcagcagcg

SEQ ID NO: 1562399 - RNA, 22 nt, Pseudomonas aeruginosa PA01
cgccggugaggcgcagcagcgc

SEQ ID NO: 1562400 - RNA, 23 nt, Pseudomonas aeruginosa PA01
cgccgguuucgaccggcgcgccu

SEQ ID NO: 1562401 - RNA, 22 nt, Pseudomonas aeruginosa PA01
cgccggugauguaggacgccuc

SEQ ID NO: 1562402 - RNA, 18 nt, Pseudomonas aeruginosa PA01
cgccgguugcgucucagc

SEQ ID NO: 1562403 - RNA, 17 nt, Pseudomonas aeruginosa PA01
cgccgguugcugcugcg

SEQ ID NO: 1562404 - RNA, 15 nt, Pseudomonas aeruginosa PA01
cgccgguugcugcuu

SEQ ID NO: 1562405 - RNA, 19 nt, Pseudomonas aeruginosa PA01
cgccguagaguucggcugc

SEQ ID NO: 1562406 - RNA, 21 nt, Pseudomonas aeruginosa PA01
cgccguaggccacuucccggc

SEQ ID NO: 1562407 - RNA, 17 nt, Pseudomonas aeruginosa PA01
cgccgucgagccagccc

SEQ ID NO: 1562408 - RNA, 22 nt, Pseudomonas aeruginosa PA01
cgccgucgagccagcccagcgg

SEQ ID NO: 1562409 - RNA, 13 nt, Pseudomonas aeruginosa PA01
cgccgucgccgcu

SEQ ID NO: 1562410 - RNA, 14 nt, Pseudomonas aeruginosa PA01
cgccgucgcgaccu

SEQ ID NO: 1562411 - RNA, 17 nt, Pseudomonas aeruginosa PA01
cgccgucgcgcucuucc

SEQ ID NO: 1562412 - RNA, 18 nt, Pseudomonas aeruginosa PA01
cgccgcgggucaccagcg

SEQ ID NO: 1562413 - RNA, 21 nt, Pseudomonas aeruginosa PA01
cgccgcgggucaccagcgccg

SEQ ID NO: 1562414 - RNA, 23 nt, Pseudomonas aeruginosa PA01
cgccgcgggucugcucggcgccc

SEQ ID NO: 1562415 - RNA, 17 nt, Pseudomonas aeruginosa PA01
cgccgcgggcgaacggc

SEQ ID NO: 1562416 - RNA, 17 nt, Pseudomonas aeruginosa PA01
cgccgcggcugaugccg

SEQ ID NO: 1562417 - RNA, 15 nt, Pseudomonas aeruginosa PA01
cgccgcggcgcggag

SEQ ID NO: 1562418 - RNA, 14 nt, Pseudomonas aeruginosa PA01
cgccgcggcccggc

SEQ ID NO: 1562419 - RNA, 17 nt, Pseudomonas aeruginosa PA01
cgccgcggcccggcgcu

SEQ ID NO: 1562420 - RNA, 19 nt, Pseudomonas aeruginosa PA01
cgccgcggccagcccccuc

SEQ ID NO: 1562421 - RNA, 20 nt, Pseudomonas aeruginosa PA01
cgccgcugucguccagcggg

SEQ ID NO: 1562422 - RNA, 19 nt, Pseudomonas aeruginosa PA01
cgccgcuggccuggccacc

SEQ ID NO: 1562423 - RNA, 21 nt, Pseudomonas aeruginosa PA01
cgccgcuggccuggccacccu

SEQ ID NO: 1562424 - RNA, 17 nt, Pseudomonas aeruginosa PA01
cgccgcuggcgcugacc

SEQ ID NO: 1562425 - RNA, 13 nt, Pseudomonas aeruginosa PA01
cgccgcugcggcu

SEQ ID NO: 1562426 - RNA, 16 nt, Pseudomonas aeruginosa PA01
cgccgcugcggcugca

SEQ ID NO: 1562427 - RNA, 18 nt, Pseudomonas aeruginosa PA01
cgccgcuuccgccggcgc

SEQ ID NO: 1562428 - RNA, 19 nt, Pseudomonas aeruginosa PA01
cgccggaaguggcagcgcc

SEQ ID NO: 1562429 - RNA, 20 nt, Pseudomonas aeruginosa PA01
cgccggaaguggcagcgccg

SEQ ID NO: 1562430 - RNA, 21 nt, Pseudomonas aeruginosa PA01
cgccggaaguggcagcgccgu

SEQ ID NO: 1562431 - RNA, 16 nt, Pseudomonas aeruginosa PA01
cgccggaaccugcaug

SEQ ID NO: 1562432 - RNA, 19 nt, Pseudomonas aeruginosa PA01
cgccggaaccugcauguca

SEQ ID NO: 1562433 - RNA, 18 nt, Pseudomonas aeruginosa PA01
cgccgcgugggcuucgcc

SEQ ID NO: 1562434 - RNA, 15 nt, Pseudomonas aeruginosa PA01
cgccgcgugccgccg

SEQ ID NO: 1562435 - RNA, 16 nt, Pseudomonas aeruginosa PA01
cgccgcgugccgccgg

SEQ ID NO: 1562436 - RNA, 16 nt, Pseudomonas aeruginosa PA01
cgccgcgugcgcgccc

SEQ ID NO: 1562437 - RNA, 17 nt, Pseudomonas aeruginosa PA01
cgccgcgugcgcgcccu

SEQ ID NO: 1562438 - RNA, 17 nt, Pseudomonas aeruginosa PA01
cgccgcugcaccgaacg

SEQ ID NO: 1562439 - RNA, 21 nt, Pseudomonas aeruginosa PA01
cgccgcucggcgagccgccgg

SEQ ID NO: 1562440 - RNA, 21 nt, Pseudomonas aeruginosa PA01
cgccgcucugcuggccgcccu

SEQ ID NO: 1562441 - RNA, 15 nt, Pseudomonas aeruginosa PA01
cgccgcucugcccga

SEQ ID NO: 1562442 - RNA, 18 nt, Pseudomonas aeruginosa PA01
cgccgcuaucgccgccgc

SEQ ID NO: 1562443 - RNA, 21 nt, Pseudomonas aeruginosa PA01
cgccgcuaucgccgccgcagc

SEQ ID NO: 1562444 - RNA, 19 nt, Pseudomonas aeruginosa PA01
cgccgcucgaugcccgcca

SEQ ID NO: 1562445 - RNA, 22 nt, Pseudomonas aeruginosa PA01
cgccgcucgaugcccgccagca

SEQ ID NO: 1562446 - RNA, 15 nt, Pseudomonas aeruginosa PA01
cgccgcuccuggcag

SEQ ID NO: 1562447 - RNA, 16 nt, Pseudomonas aeruginosa PA01
cgccgcucaggcgucc

SEQ ID NO: 1562448 - RNA, 15 nt, Pseudomonas aeruginosa PA01
cgccgcuacugcgcg

SEQ ID NO: 1562449 - RNA, 15 nt, Pseudomonas aeruginosa PA01
cgccgcuccgcgcca

SEQ ID NO: 1562450 - RNA, 15 nt, Pseudomonas aeruginosa PA01
cgccgcccccggccc

SEQ ID NO: 1562451 - RNA, 15 nt, Pseudomonas aeruginosa PA01
cgccgcccgcgccuc

SEQ ID NO: 1562452 - RNA, 14 nt, Pseudomonas aeruginosa PA01
cgccgccggccagc

SEQ ID NO: 1562453 - RNA, 20 nt, Pseudomonas aeruginosa PA01
cgccgccggccagccgcgcc

SEQ ID NO: 1562454 - RNA, 20 nt, Pseudomonas aeruginosa PA01
cgccgccggcgaacagccag

SEQ ID NO: 1562455 - RNA, 21 nt, Pseudomonas aeruginosa PA01
cgccgccggcgaacagccagc

SEQ ID NO: 1562456 - RNA, 13 nt, Pseudomonas aeruginosa PA01
cgccgccggcgag

SEQ ID NO: 1562457 - RNA, 18 nt, Pseudomonas aeruginosa PA01
cgccgccgggcgcccggc

SEQ ID NO: 1562458 - RNA, 21 nt, Pseudomonas aeruginosa PA01
cgccgccgggcgcccggccgg

SEQ ID NO: 1562459 - RNA, 14 nt, Pseudomonas aeruginosa PA01
cgccgccgggcgcg

SEQ ID NO: 1562460 - RNA, 17 nt, Pseudomonas aeruginosa PA01
cgccgccgggcgcgcgc

SEQ ID NO: 1562461 - RNA, 22 nt, Pseudomonas aeruginosa PA01
cgccgccggcguuauccgccga

SEQ ID NO: 1562462 - RNA, 19 nt, Pseudomonas aeruginosa PA01
cgccgccgggcgcgcgccu

SEQ ID NO: 1562463 - RNA, 21 nt, Pseudomonas aeruginosa PA01
cgccgccggggaucagcgaga

SEQ ID NO: 1562464 - RNA, 13 nt, Pseudomonas aeruginosa PA01
cgccgccggggcg

SEQ ID NO: 1562465 - RNA, 19 nt, Pseudomonas aeruginosa PA01
cgccgccgucuugccgcug

SEQ ID NO: 1562466 - RNA, 17 nt, Pseudomonas aeruginosa PA01
cgccgccgugaucucga

SEQ ID NO: 1562467 - RNA, 22 nt, Pseudomonas aeruginosa PA01
cgccgccugcggcuugcccugc

SEQ ID NO: 1562468 - RNA, 18 nt, Pseudomonas aeruginosa PA01
cgccgccugcucgccgcu

SEQ ID NO: 1562469 - RNA, 15 nt, Pseudomonas aeruginosa PA01
cgccgccucgcgcaa

SEQ ID NO: 1562470 - RNA, 15 nt, Pseudomonas aeruginosa PA01
cgccgccuucggcag

SEQ ID NO: 1562471 - RNA, 21 nt, Pseudomonas aeruginosa PA01
cgccgccuugagcggcgcccu

SEQ ID NO: 1562472 - RNA, 21 nt, Pseudomonas aeruginosa PA01
cgccgccuugcguaccagcgc

SEQ ID NO: 1562473 - RNA, 13 nt, Pseudomonas aeruginosa PA01
cgccgccugggcc

SEQ ID NO: 1562474 - RNA, 16 nt, Pseudomonas aeruginosa PA01
cgccgccugggccgcc

SEQ ID NO: 1562475 - RNA, 19 nt, Pseudomonas aeruginosa PA01
cgccgccuggguggcgacg

SEQ ID NO: 1562476 - RNA, 16 nt, Pseudomonas aeruginosa PA01
cgccgcgcucgcgcau

SEQ ID NO: 1562477 - RNA, 18 nt, Pseudomonas aeruginosa PA01
cgccgcgcucgcgcauga

SEQ ID NO: 1562478 - RNA, 18 nt, Pseudomonas aeruginosa PA01
cgccgcgcugcgccaggc

SEQ ID NO: 1562479 - RNA, 22 nt, Pseudomonas aeruginosa PA01
cgccgcgccuucugcaccuugg

SEQ ID NO: 1562480 - RNA, 22 nt, Pseudomonas aeruginosa PA01
cgccgcgccuugaaaccggcga

SEQ ID NO: 1562481 - RNA, 14 nt, Pseudomonas aeruginosa PA01
cgccgcgccggcga

SEQ ID NO: 1562482 - RNA, 12 nt, Pseudomonas aeruginosa PA01
cgccgcgcgcca

SEQ ID NO: 1562483 - RNA, 22 nt, Pseudomonas aeruginosa PA01
cgccgcgcgcgcggucgagcag

SEQ ID NO: 1562484 - RNA, 12 nt, Pseudomonas aeruginosa PA01
cgccgcgccgcc

SEQ ID NO: 1562485 - RNA, 19 nt, Pseudomonas aeruginosa PA01
cgccgcgcagcgcggcgcu

SEQ ID NO: 1562486 - RNA, 13 nt, Pseudomonas aeruginosa PA01
cgccgcgcccggc

SEQ ID NO: 1562487 - RNA, 18 nt, Pseudomonas aeruginosa PA01
cgccgcgagcgccgccgg

SEQ ID NO: 1562488 - RNA, 17 nt, Pseudomonas aeruginosa PA01
cgccgcgacgcuccagc

SEQ ID NO: 1562489 - RNA, 21 nt, Pseudomonas aeruginosa PA01
cgccgcgacgcuccagcggca

SEQ ID NO: 1562490 - RNA, 14 nt, Pseudomonas aeruginosa PA01
cgccgcgagcacca

SEQ ID NO: 1562491 - RNA, 15 nt, Pseudomonas aeruginosa PA01
cgccgcgagcaccau

SEQ ID NO: 1562492 - RNA, 20 nt, Pseudomonas aeruginosa PA01
cgccgcgaagcccagcgccg

SEQ ID NO: 1562493 - RNA, 19 nt, Pseudomonas aeruginosa PA01
cgccgccuuucugcccggc

SEQ ID NO: 1562494 - RNA, 21 nt, Pseudomonas aeruginosa PA01
cgccgccuuucugcccggcuu

SEQ ID NO: 1562495 - RNA, 16 nt, Pseudomonas aeruginosa PA01
cgccgcgaaauggcag

SEQ ID NO: 1562496 - RNA, 20 nt, Pseudomonas aeruginosa PA01
cgccgcgaaauggcagaaca

SEQ ID NO: 1562497 - RNA, 17 nt, Pseudomonas aeruginosa PA01
cgauugcagcuccuggu

SEQ ID NO: 1562498 - RNA, 14 nt, Pseudomonas aeruginosa PA01
cgauguugaacagc

SEQ ID NO: 1562499 - RNA, 21 nt, Pseudomonas aeruginosa PA01
cgauguucgaggcgccgacca

SEQ ID NO: 1562500 - RNA, 13 nt, Pseudomonas aeruginosa PA01
cgaugugcacgcu

SEQ ID NO: 1562501 - RNA, 16 nt, Pseudomonas aeruginosa PA01
cgaugucguagccgcg

SEQ ID NO: 1562502 - RNA, 14 nt, Pseudomonas aeruginosa PA01
cgauguccugggcc

SEQ ID NO: 1562503 - RNA, 23 nt, Pseudomonas aeruginosa PA01
cgauguccugggccaccuggcuc

SEQ ID NO: 1562504 - RNA, 15 nt, Pseudomonas aeruginosa PA01
cgaugucgcggcgcu

SEQ ID NO: 1562505 - RNA, 19 nt, Pseudomonas aeruginosa PA01
cgaugucgaaaguguugga

SEQ ID NO: 1562506 - RNA, 21 nt, Pseudomonas aeruginosa PA01
cgaugucgaacaacccgccag

SEQ ID NO: 1562507 - RNA, 21 nt, Pseudomonas aeruginosa PA01
cgcaaacccauuucccgcagu

SEQ ID NO: 1562508 - RNA, 16 nt, Pseudomonas aeruginosa PA01
cgauuuugggcucaga

SEQ ID NO: 1562509 - RNA, 22 nt, Pseudomonas aeruginosa PA01
cgaugccguuguagcugaccac

SEQ ID NO: 1562510 - RNA, 18 nt, Pseudomonas aeruginosa PA01
cgaugccggagagcagca

SEQ ID NO: 1562511 - RNA, 21 nt, Pseudomonas aeruginosa PA01
cgaugccggagagcagcacgg

SEQ ID NO: 1562512 - RNA, 19 nt, Pseudomonas aeruginosa PA01
cgaugauggucaacaccag

SEQ ID NO: 1562513 - RNA, 21 nt, Pseudomonas aeruginosa PA01
cgaugauggucaacaccagcg

SEQ ID NO: 1562514 - RNA, 18 nt, Pseudomonas aeruginosa PA01
cgaugaucuccgcgccgg

SEQ ID NO: 1562515 - RNA, 13 nt, Pseudomonas aeruginosa PA01
cgaugaucagccc

SEQ ID NO: 1562516 - RNA, 14 nt, Pseudomonas aeruginosa PA01
cgaugcgcgcggcg

SEQ ID NO: 1562517 - RNA, 21 nt, Pseudomonas aeruginosa PA01
cgaugcugcugaucaggagga

SEQ ID NO: 1562518 - RNA, 20 nt, Pseudomonas aeruginosa PA01
cgaugcugaucacccgcccg

SEQ ID NO: 1562519 - RNA, 16 nt, Pseudomonas aeruginosa PA01
cgaugcguccgcgcag

SEQ ID NO: 1562520 - RNA, 17 nt, Pseudomonas aeruginosa PA01
cgaugcuaucgcguggc

SEQ ID NO: 1562521 - RNA, 16 nt, Pseudomonas aeruginosa PA01
cgauggcguccaccgc

SEQ ID NO: 1562522 - RNA, 12 nt, Pseudomonas aeruginosa PA01
cgauguccugga

SEQ ID NO: 1562523 - RNA, 18 nt, Pseudomonas aeruginosa PA01
cgauggucaggcuggccc

SEQ ID NO: 1562524 - RNA, 17 nt, Pseudomonas aeruginosa PA01
cgauggucacuggcgag

SEQ ID NO: 1562525 - RNA, 14 nt, Pseudomonas aeruginosa PA01
cgcacucauagcuc

SEQ ID NO: 1562526 - RNA, 13 nt, Pseudomonas aeruginosa PA01
cgcacgcagcgcc

SEQ ID NO: 1562527 - RNA, 14 nt, Pseudomonas aeruginosa PA01
cgcacgcagcgccg

SEQ ID NO: 1562528 - RNA, 16 nt, Pseudomonas aeruginosa PA01
cgcacgcagcgccgcg

SEQ ID NO: 1562529 - RNA, 17 nt, Pseudomonas aeruginosa PA01
cgcacgcagcgccgcgu

SEQ ID NO: 1562530 - RNA, 17 nt, Pseudomonas aeruginosa PA01
cgcacgcaauggcgcag

SEQ ID NO: 1562531 - RNA, 19 nt, Pseudomonas aeruginosa PA01
cgcacgcaauggcgcagcc

SEQ ID NO: 1562532 - RNA, 22 nt, Pseudomonas aeruginosa PA01
cgcacgcaauggcgcagccgcu

SEQ ID NO: 1562533 - RNA, 15 nt, Pseudomonas aeruginosa PA01
cgcacgcgccugcuu

SEQ ID NO: 1562534 - RNA, 22 nt, Pseudomonas aeruginosa PA01
cgcaccacccaucugccggcca

SEQ ID NO: 1562535 - RNA, 15 nt, Pseudomonas aeruginosa PA01
cgcaccagcacuucc

SEQ ID NO: 1562536 - RNA, 19 nt, Pseudomonas aeruginosa PA01
cgcacaguugcgcgccggc

SEQ ID NO: 1562537 - RNA, 18 nt, Pseudomonas aeruginosa PA01
cgcacaguacgccuugca

SEQ ID NO: 1562538 - RNA, 13 nt, Pseudomonas aeruginosa PA01
cgcaccacaucuu

SEQ ID NO: 1562539 - RNA, 16 nt, Pseudomonas aeruginosa PA01
cgcaccagccggccgc

SEQ ID NO: 1562540 - RNA, 23 nt, Pseudomonas aeruginosa PA01
cgcaccuggcggucgccgccggc

SEQ ID NO: 1562541 - RNA, 14 nt, Pseudomonas aeruginosa PA01
cgcaccuguuucag

SEQ ID NO: 1562542 - RNA, 18 nt, Pseudomonas aeruginosa PA01
cgcacaccgcgcgcgccu

SEQ ID NO: 1562543 - RNA, 12 nt, Pseudomonas aeruginosa PA01
cgcacacggucg

SEQ ID NO: 1562544 - RNA, 17 nt, Pseudomonas aeruginosa PA01
cgcacacggucgagacc

SEQ ID NO: 1562545 - RNA, 12 nt, Pseudomonas aeruginosa PA01
cgcacagccagg

SEQ ID NO: 1562546 - RNA, 16 nt, Pseudomonas aeruginosa PA01
cgcacagccaggggca

SEQ ID NO: 1562547 - RNA, 17 nt, Pseudomonas aeruginosa PA01
cgcacaaaaaagcccgc

SEQ ID NO: 1562548 - RNA, 18 nt, Pseudomonas aeruginosa PA01
cgcacaaaaaagcccgcc

SEQ ID NO: 1562549 - RNA, 15 nt, Pseudomonas aeruginosa PA01
cgcaaaggucggcga

SEQ ID NO: 1562550 - RNA, 16 nt, Pseudomonas aeruginosa PA01
cgcaacaccuugcgca

SEQ ID NO: 1562551 - RNA, 22 nt, Pseudomonas aeruginosa PA01
cgcaacaccuugcgcaccgccu

SEQ ID NO: 1562552 - RNA, 14 nt, Pseudomonas aeruginosa PA01
cgcaaccccuucgg

SEQ ID NO: 1562553 - RNA, 19 nt, Pseudomonas aeruginosa PA01
cgcaaccguuccagcgccu

SEQ ID NO: 1562554 - RNA, 21 nt, Pseudomonas aeruginosa PA01
cgcaacgcuuccagcaccucc

SEQ ID NO: 1562555 - RNA, 14 nt, Pseudomonas aeruginosa PA01
cgcaacgcgcgcag

SEQ ID NO: 1562556 - RNA, 12 nt, Pseudomonas aeruginosa PA01
cgcaggcugccu

SEQ ID NO: 1562557 - RNA, 19 nt, Pseudomonas aeruginosa PA01
cgcaggcugguaugcagca

SEQ ID NO: 1562558 - RNA, 15 nt, Pseudomonas aeruginosa PA01
cgcaggcgggcgcca

SEQ ID NO: 1562559 - RNA, 14 nt, Pseudomonas aeruginosa PA01
cgcaggcgggcggc

SEQ ID NO: 1562560 - RNA, 19 nt, Pseudomonas aeruginosa PA01
cgcaggccgggcggacgcu

SEQ ID NO: 1562561 - RNA, 18 nt, Pseudomonas aeruginosa PA01
cgcaggccgccggcggcc

SEQ ID NO: 1562562 - RNA, 22 nt, Pseudomonas aeruginosa PA01
cgcaggccgccggcggccaggg

SEQ ID NO: 1562563 - RNA, 16 nt, Pseudomonas aeruginosa PA01
cgcaggccggccaggg

SEQ ID NO: 1562564 - RNA, 14 nt, Pseudomonas aeruginosa PA01
cgcaggcgcuggcc

SEQ ID NO: 1562565 - RNA, 15 nt, Pseudomonas aeruginosa PA01
cgcaggcgcuggccg

SEQ ID NO: 1562566 - RNA, 20 nt, Pseudomonas aeruginosa PA01
cgcaggcgcuggcgggcgcu

SEQ ID NO: 1562567 - RNA, 21 nt, Pseudomonas aeruginosa PA01
cgcaggcggacacgcaggcgc

SEQ ID NO: 1562568 - RNA, 18 nt, Pseudomonas aeruginosa PA01
cgcaggcccuugagggug

SEQ ID NO: 1562569 - RNA, 15 nt, Pseudomonas aeruginosa PA01
cgcaggccgcggccg

SEQ ID NO: 1562570 - RNA, 12 nt, Pseudomonas aeruginosa PA01
cgcaggccaggc

SEQ ID NO: 1562571 - RNA, 18 nt, Pseudomonas aeruginosa PA01
cgcaggccagcgccaggg

SEQ ID NO: 1562572 - RNA, 19 nt, Pseudomonas aeruginosa PA01
cgcaggccagcgccagggg

SEQ ID NO: 1562573 - RNA, 22 nt, Pseudomonas aeruginosa PA01
cgcaggcaguggcgccagccag

SEQ ID NO: 1562574 - RNA, 21 nt, Pseudomonas aeruginosa PA01
cgcaggagugugggacaggaa

SEQ ID NO: 1562575 - RNA, 15 nt, Pseudomonas aeruginosa PA01
cgcaggcagcgcgcg

SEQ ID NO: 1562576 - RNA, 21 nt, Pseudomonas aeruginosa PA01
cgcagaugcggggcgaccagc

SEQ ID NO: 1562577 - RNA, 13 nt, Pseudomonas aeruginosa PA01
cgcagaugcucca

SEQ ID NO: 1562578 - RNA, 17 nt, Pseudomonas aeruginosa PA01
cgcagaucgcguccagg

SEQ ID NO: 1562579 - RNA, 14 nt, Pseudomonas aeruginosa PA01
cgcagaucgccgcg

SEQ ID NO: 1562580 - RNA, 14 nt, Pseudomonas aeruginosa PA01
cgcagauagaggcg

SEQ ID NO: 1562581 - RNA, 15 nt, Pseudomonas aeruginosa PA01
cgcagauagaggcgu

SEQ ID NO: 1562582 - RNA, 20 nt, Pseudomonas aeruginosa PA01
cgcagauagggcaucagccc

SEQ ID NO: 1562583 - RNA, 23 nt, Pseudomonas aeruginosa PA01
cgcagaaggcgcuuucguagggg

SEQ ID NO: 1562584 - RNA, 16 nt, Pseudomonas aeruginosa PA01
cgcagcguuccagcgc

SEQ ID NO: 1562585 - RNA, 12 nt, Pseudomonas aeruginosa PA01
cgcagcuccagc

SEQ ID NO: 1562586 - RNA, 20 nt, Pseudomonas aeruginosa PA01
cgcaggaccuggcugaggcg

SEQ ID NO: 1562587 - RNA, 23 nt, Pseudomonas aeruginosa PA01
cgcaggacgaggaaggcgcgcac

SEQ ID NO: 1562588 - RNA, 12 nt, Pseudomonas aeruginosa PA01
cgcaggaacugg

SEQ ID NO: 1562589 - RNA, 13 nt, Pseudomonas aeruginosa PA01
cgcaggaaacccc

SEQ ID NO: 1562590 - RNA, 19 nt, Pseudomonas aeruginosa PA01
cgcaggaaccgacgcgcag

SEQ ID NO: 1562591 - RNA, 13 nt, Pseudomonas aeruginosa PA01
cgcagcuccagcg

SEQ ID NO: 1562592 - RNA, 14 nt, Pseudomonas aeruginosa PA01
cgcagcggccaggg

SEQ ID NO: 1562593 - RNA, 17 nt, Pseudomonas aeruginosa PA01
cgcagcggcgcgucgcu

SEQ ID NO: 1562594 - RNA, 15 nt, Pseudomonas aeruginosa PA01
cgcagcguccugccc

SEQ ID NO: 1562595 - RNA, 16 nt, Pseudomonas aeruginosa PA01
cgcagcguccugcccu

SEQ ID NO: 1562596 - RNA, 14 nt, Pseudomonas aeruginosa PA01
cgcaucggccaccu

SEQ ID NO: 1562597 - RNA, 17 nt, Pseudomonas aeruginosa PA01
cgcaucuggugcgcguc

SEQ ID NO: 1562598 - RNA, 16 nt, Pseudomonas aeruginosa PA01
cgcaugaucgccucgg

SEQ ID NO: 1562599 - RNA, 19 nt, Pseudomonas aeruginosa PA01
cgcaugaaaaagcccggca

SEQ ID NO: 1562600 - RNA, 19 nt, Pseudomonas aeruginosa PA01
cgcaugaccuucagcaccu

SEQ ID NO: 1562601 - RNA, 16 nt, Pseudomonas aeruginosa PA01
cgcaucgaccuugccc

SEQ ID NO: 1562602 - RNA, 21 nt, Pseudomonas aeruginosa PA01
cgcaucgcgguuauccgccga

SEQ ID NO: 1562603 - RNA, 22 nt, Pseudomonas aeruginosa PA01
cgcaucgcgguuauccgccggc

SEQ ID NO: 1562604 - RNA, 16 nt, Pseudomonas aeruginosa PA01
cgcaucgaggccgccc

SEQ ID NO: 1562605 - RNA, 17 nt, Pseudomonas aeruginosa PA01
cgcaucgaggccgccca

SEQ ID NO: 1562606 - RNA, 19 nt, Pseudomonas aeruginosa PA01
cgcaucgaggccgcccagc

SEQ ID NO: 1562607 - RNA, 21 nt, Pseudomonas aeruginosa PA01
cgcaucgaugccuugcggccc

SEQ ID NO: 1562608 - RNA, 17 nt, Pseudomonas aeruginosa PA01
cgcaucaggccaaagcc

SEQ ID NO: 1562609 - RNA, 19 nt, Pseudomonas aeruginosa PA01
aaacggcucugcuucuguc

SEQ ID NO: 1562610 - RNA, 23 nt, Pseudomonas aeruginosa PA01
cgcagggcgccgucgggggcgcg

SEQ ID NO: 1562611 - RNA, 12 nt, Pseudomonas aeruginosa PA01
cgcagggccgga

SEQ ID NO: 1562612 - RNA, 17 nt, Pseudomonas aeruginosa PA01
cgcaggugcuuggcacc

SEQ ID NO: 1562613 - RNA, 21 nt, Pseudomonas aeruginosa PA01
cgcaggugcuuggcaccgcgc

SEQ ID NO: 1562614 - RNA, 23 nt, Pseudomonas aeruginosa PA01
cgcaggcuuucguaggcaggcgc

SEQ ID NO: 1562615 - RNA, 13 nt, Pseudomonas aeruginosa PA01
cgcauagccaccg

SEQ ID NO: 1562616 - RNA, 20 nt, Pseudomonas aeruginosa PA01
cgcauaggucaugcccaggc

SEQ ID NO: 1562617 - RNA, 16 nt, Pseudomonas aeruginosa PA01
cgcauaggccugggcg

SEQ ID NO: 1562618 - RNA, 18 nt, Pseudomonas aeruginosa PA01
cgcauggagacggcccgc

SEQ ID NO: 1562619 - RNA, 17 nt, Pseudomonas aeruginosa PA01
cgcauggaucaugggug

SEQ ID NO: 1562620 - RNA, 20 nt, Pseudomonas aeruginosa PA01
cgcaugggggaacuccugau

SEQ ID NO: 1562621 - RNA, 14 nt, Pseudomonas aeruginosa PA01
cgcaugcgcggcgu

SEQ ID NO: 1562622 - RNA, 13 nt, Pseudomonas aeruginosa PA01
cgcaugcgccggc

SEQ ID NO: 1562623 - RNA, 22 nt, Pseudomonas aeruginosa PA01
cgcaugccaucuuccugugcga

SEQ ID NO: 1562624 - RNA, 18 nt, Pseudomonas aeruginosa PA01
cgcaugcccagggccagc

SEQ ID NO: 1562625 - RNA, 16 nt, Pseudomonas aeruginosa PA01
cgcauuugcacgucgg

SEQ ID NO: 1562626 - RNA, 19 nt, Pseudomonas aeruginosa PA01
cgccaaaaaaagccccggc

SEQ ID NO: 1562627 - RNA, 12 nt, Pseudomonas aeruginosa PA01
cgccaacugcuu

SEQ ID NO: 1562628 - RNA, 21 nt, Pseudomonas aeruginosa PA01
cgccaaccaugguuuccgccg

SEQ ID NO: 1562629 - RNA, 18 nt, Pseudomonas aeruginosa PA01
cgccaacgccaccgcgcg

SEQ ID NO: 1562630 - RNA, 15 nt, Pseudomonas aeruginosa PA01
cgccaaggcccugcu

SEQ ID NO: 1562631 - RNA, 13 nt, Pseudomonas aeruginosa PA01
cgccaaggccgcc

SEQ ID NO: 1562632 - RNA, 20 nt, Pseudomonas aeruginosa PA01
cgccaaggccgccaggccuc

SEQ ID NO: 1562633 - RNA, 13 nt, Pseudomonas aeruginosa PA01
cgccaagggcgcc

SEQ ID NO: 1562634 - RNA, 21 nt, Pseudomonas aeruginosa PA01
cgccaagggcgccgccgagga

SEQ ID NO: 1562635 - RNA, 15 nt, Pseudomonas aeruginosa PA01
cgccaagcccggcga

SEQ ID NO: 1562636 - RNA, 22 nt, Pseudomonas aeruginosa PA01
cgccacaggcguuauccgccga

SEQ ID NO: 1562637 - RNA, 15 nt, Pseudomonas aeruginosa PA01
cgccacagaucgcca

SEQ ID NO: 1562638 - RNA, 16 nt, Pseudomonas aeruginosa PA01
cgccacagaucgccag

SEQ ID NO: 1562639 - RNA, 14 nt, Pseudomonas aeruginosa PA01
cgccaccccgcucc

SEQ ID NO: 1562640 - RNA, 16 nt, Pseudomonas aeruginosa PA01
cgccaccccgcuccgc

SEQ ID NO: 1562641 - RNA, 13 nt, Pseudomonas aeruginosa PA01
cgccaccccgccg

SEQ ID NO: 1562642 - RNA, 15 nt, Pseudomonas aeruginosa PA01
cgccaccccgccgcg

SEQ ID NO: 1562643 - RNA, 16 nt, Pseudomonas aeruginosa PA01
cgccaccccgccgcug

SEQ ID NO: 1562644 - RNA, 21 nt, Pseudomonas aeruginosa PA01
cgccaccccgccgcuggcggc

SEQ ID NO: 1562645 - RNA, 22 nt, Pseudomonas aeruginosa PA01
cgccacccguuccuugcgcggc

SEQ ID NO: 1562646 - RNA, 16 nt, Pseudomonas aeruginosa PA01
cgccaccgccuggucg

SEQ ID NO: 1562647 - RNA, 22 nt, Pseudomonas aeruginosa PA01
cgccaccggcguuauccgccga

SEQ ID NO: 1562648 - RNA, 20 nt, Pseudomonas aeruginosa PA01
cgccaccgcguugaccguga

SEQ ID NO: 1562649 - RNA, 17 nt, Pseudomonas aeruginosa PA01
cgccaccgcgacgcgcu

SEQ ID NO: 1562650 - RNA, 22 nt, Pseudomonas aeruginosa PA01
cgccaccgcgacgcgcuggacc

SEQ ID NO: 1562651 - RNA, 15 nt, Pseudomonas aeruginosa PA01
cgagccuugcggcgc

SEQ ID NO: 1562652 - RNA, 20 nt, Pseudomonas aeruginosa PA01
cgagcgccaggaacgccucu

SEQ ID NO: 1562653 - RNA, 21 nt, Pseudomonas aeruginosa PA01
cgagcgcccgccgucauggcg

SEQ ID NO: 1562654 - RNA, 14 nt, Pseudomonas aeruginosa PA01
cgagccgcugcaug

SEQ ID NO: 1562655 - RNA, 16 nt, Pseudomonas aeruginosa PA01
cgagccggcugaugcc

SEQ ID NO: 1562656 - RNA, 13 nt, Pseudomonas aeruginosa PA01
cgagccggcugcc

SEQ ID NO: 1562657 - RNA, 20 nt, Pseudomonas aeruginosa PA01
cgagccguccugcggccgca

SEQ ID NO: 1562658 - RNA, 18 nt, Pseudomonas aeruginosa PA01
cgagccggcgcaucagcg

SEQ ID NO: 1562659 - RNA, 16 nt, Pseudomonas aeruginosa PA01
cgagccuggccaggcg

SEQ ID NO: 1562660 - RNA, 17 nt, Pseudomonas aeruginosa PA01
cgagccuggccaggcgc

SEQ ID NO: 1562661 - RNA, 17 nt, Pseudomonas aeruginosa PA01
cgagccguuccaggcgg

SEQ ID NO: 1562662 - RNA, 18 nt, Pseudomonas aeruginosa PA01
cgagccguuccaggcggg

SEQ ID NO: 1562663 - RNA, 20 nt, Pseudomonas aeruginosa PA01
cgagcgacuccgggaacagc

SEQ ID NO: 1562664 - RNA, 20 nt, Pseudomonas aeruginosa PA01
cgagccgccggggaagcugc

SEQ ID NO: 1562665 - RNA, 18 nt, Pseudomonas aeruginosa PA01
cgagccgcgcugcuggua

SEQ ID NO: 1562666 - RNA, 15 nt, Pseudomonas aeruginosa PA01
cgagccgacauccug

SEQ ID NO: 1562667 - RNA, 17 nt, Pseudomonas aeruginosa PA01
cgagccgacauccuguc

SEQ ID NO: 1562668 - RNA, 14 nt, Pseudomonas aeruginosa PA01
cgagccgacuucca

SEQ ID NO: 1562669 - RNA, 15 nt, Pseudomonas aeruginosa PA01
cgagccgaucaccag

SEQ ID NO: 1562670 - RNA, 18 nt, Pseudomonas aeruginosa PA01
cgagccgaucaccagcaa

SEQ ID NO: 1562671 - RNA, 20 nt, Pseudomonas aeruginosa PA01
cgagcccaggcagaucgcgc

SEQ ID NO: 1562672 - RNA, 15 nt, Pseudomonas aeruginosa PA01
cgagcccgagugcgc

SEQ ID NO: 1562673 - RNA, 20 nt, Pseudomonas aeruginosa PA01
cgagcccgagugcgcccagc

SEQ ID NO: 1562674 - RNA, 18 nt, Pseudomonas aeruginosa PA01
cgagccagcccagcggcg

SEQ ID NO: 1562675 - RNA, 18 nt, Pseudomonas aeruginosa PA01
cgagccacucgugcaacg

SEQ ID NO: 1562676 - RNA, 22 nt, Pseudomonas aeruginosa PA01
cgagccacggauaugcgccgcc

SEQ ID NO: 1562677 - RNA, 16 nt, Pseudomonas aeruginosa PA01
cgagcaugccgaggaa

SEQ ID NO: 1562678 - RNA, 19 nt, Pseudomonas aeruginosa PA01
cgagcaugccgaggaacgc

SEQ ID NO: 1562679 - RNA, 18 nt, Pseudomonas aeruginosa PA01
cgagcaugaugcaggcag

SEQ ID NO: 1562680 - RNA, 14 nt, Pseudomonas aeruginosa PA01
cgagcaugcgggcg

SEQ ID NO: 1562681 - RNA, 22 nt, Pseudomonas aeruginosa PA01
cgagcauguaggcgcaccaggc

SEQ ID NO: 1562682 - RNA, 19 nt, Pseudomonas aeruginosa PA01
cgagcauuccucagcgccg

SEQ ID NO: 1562683 - RNA, 17 nt, Pseudomonas aeruginosa PA01
cgagcaucugccgggcg

SEQ ID NO: 1562684 - RNA, 21 nt, Pseudomonas aeruginosa PA01
cgagcaucugccgggcgcgcu

SEQ ID NO: 1562685 - RNA, 18 nt, Pseudomonas aeruginosa PA01
cgagcagcaccaggcugg

SEQ ID NO: 1562686 - RNA, 11 nt, Pseudomonas aeruginosa PA01
cgagcagcacc

SEQ ID NO: 1562687 - RNA, 14 nt, Pseudomonas aeruginosa PA01
cgagcacuucccag

SEQ ID NO: 1562688 - RNA, 18 nt, Pseudomonas aeruginosa PA01
cgagcacuucccaggugc

SEQ ID NO: 1562689 - RNA, 14 nt, Pseudomonas aeruginosa PA01
cgagcagacugaua

SEQ ID NO: 1562690 - RNA, 20 nt, Pseudomonas aeruginosa PA01
cgagcaccccgagcccggcc

SEQ ID NO: 1562691 - RNA, 14 nt, Pseudomonas aeruginosa PA01
cgagcaccaggcgg

SEQ ID NO: 1562692 - RNA, 14 nt, Pseudomonas aeruginosa PA01
cgagcaccaugcag

SEQ ID NO: 1562693 - RNA, 15 nt, Pseudomonas aeruginosa PA01
cgagcaccgcgcaga

SEQ ID NO: 1562694 - RNA, 21 nt, Pseudomonas aeruginosa PA01
cgagcaguucccccagcaccu

SEQ ID NO: 1562695 - RNA, 22 nt, Pseudomonas aeruginosa PA01
cgagcaguucccccagcaccug

SEQ ID NO: 1562696 - RNA, 21 nt, Pseudomonas aeruginosa PA01
cgagcagggagaaccaggcgg

SEQ ID NO: 1562697 - RNA, 21 nt, Pseudomonas aeruginosa PA01
cgagcagggcgcugagcgcgg

SEQ ID NO: 1562698 - RNA, 14 nt, Pseudomonas aeruginosa PA01
cgagcagggucaug

SEQ ID NO: 1562699 - RNA, 18 nt, Pseudomonas aeruginosa PA01
cgagcagcgccagccagg

SEQ ID NO: 1562700 - RNA, 18 nt, Pseudomonas aeruginosa PA01
cgagcagcucguucgccc

SEQ ID NO: 1562701 - RNA, 20 nt, Pseudomonas aeruginosa PA01
cgagcagcgcgcggcucggc

SEQ ID NO: 1562702 - RNA, 20 nt, Pseudomonas aeruginosa PA01
cgagcaggccacgcaccagc

SEQ ID NO: 1562703 - RNA, 23 nt, Pseudomonas aeruginosa PA01
cgagcaggccacgcaccagcucc

SEQ ID NO: 1562704 - RNA, 17 nt, Pseudomonas aeruginosa PA01
cgagcaggaagaagccg

SEQ ID NO: 1562705 - RNA, 12 nt, Pseudomonas aeruginosa PA01
cgagcaggacag

SEQ ID NO: 1562706 - RNA, 20 nt, Pseudomonas aeruginosa PA01
cgagcaggacagcagggucg

SEQ ID NO: 1562707 - RNA, 21 nt, Pseudomonas aeruginosa PA01
cgagcaggcgcgccaggccca

SEQ ID NO: 1562708 - RNA, 21 nt, Pseudomonas aeruginosa PA01
cgagcaggccuugcagggccg

SEQ ID NO: 1562709 - RNA, 19 nt, Pseudomonas aeruginosa PA01
cgagcaggcgauacaggcg

SEQ ID NO: 1562710 - RNA, 18 nt, Pseudomonas aeruginosa PA01
cgagaugcucgcgcagcg

SEQ ID NO: 1562711 - RNA, 21 nt, Pseudomonas aeruginosa PA01
cgagcaauugccagaggcugc

SEQ ID NO: 1562712 - RNA, 23 nt, Pseudomonas aeruginosa PA01
cgagcaauugccagaggcugcgc

SEQ ID NO: 1562713 - RNA, 12 nt, Pseudomonas aeruginosa PA01
cgagcaccacca

SEQ ID NO: 1562714 - RNA, 21 nt, Pseudomonas aeruginosa PA01
cgagcaccaccacucgcgagc

SEQ ID NO: 1562715 - RNA, 18 nt, Pseudomonas aeruginosa PA01
cgagcaacugcucgggcg

SEQ ID NO: 1562716 - RNA, 15 nt, Pseudomonas aeruginosa PA01
cgagcaacggcagca

SEQ ID NO: 1562717 - RNA, 23 nt, Pseudomonas aeruginosa PA01
cgagcaacucggcggcgagcgcc

SEQ ID NO: 1562718 - RNA, 20 nt, Pseudomonas aeruginosa PA01
cgagcaagccuuccagguag

SEQ ID NO: 1562719 - RNA, 17 nt, Pseudomonas aeruginosa PA01
cgagcaacacaugcagg

SEQ ID NO: 1562720 - RNA, 20 nt, Pseudomonas aeruginosa PA01
cgagauugaugaagcgcugc

SEQ ID NO: 1562721 - RNA, 14 nt, Pseudomonas aeruginosa PA01
cgagaagccagcca

SEQ ID NO: 1562722 - RNA, 14 nt, Pseudomonas aeruginosa PA01
cgagaaggcugccg

SEQ ID NO: 1562723 - RNA, 16 nt, Pseudomonas aeruginosa PA01
cgagacgaucagcagg

SEQ ID NO: 1562724 - RNA, 15 nt, Pseudomonas aeruginosa PA01
cgagacgccagccgc

SEQ ID NO: 1562725 - RNA, 16 nt, Pseudomonas aeruginosa PA01
cgagacgccagccgcc

SEQ ID NO: 1562726 - RNA, 17 nt, Pseudomonas aeruginosa PA01
cgagacgccagccgccc

SEQ ID NO: 1562727 - RNA, 15 nt, Pseudomonas aeruginosa PA01
cgagacgcccuggau

SEQ ID NO: 1562728 - RNA, 15 nt, Pseudomonas aeruginosa PA01
cgagacgcugcaccg

SEQ ID NO: 1562729 - RNA, 19 nt, Pseudomonas aeruginosa PA01
cgagacgcugcaccgcggc

SEQ ID NO: 1562730 - RNA, 15 nt, Pseudomonas aeruginosa PA01
cgagacccccgggau

SEQ ID NO: 1562731 - RNA, 21 nt, Pseudomonas aeruginosa PA01
cgagaccaccgacggcuccgg

SEQ ID NO: 1562732 - RNA, 21 nt, Pseudomonas aeruginosa PA01
cgagacuaccgaucggcugcc

SEQ ID NO: 1562733 - RNA, 22 nt, Pseudomonas aeruginosa PA01
cgagacuugaucgcacggcggg

SEQ ID NO: 1562734 - RNA, 23 nt, Pseudomonas aeruginosa PA01
cgagaggguggucgcgcucuggc

SEQ ID NO: 1562735 - RNA, 17 nt, Pseudomonas aeruginosa PA01
cgagaggucggcgcgcc

SEQ ID NO: 1562736 - RNA, 18 nt, Pseudomonas aeruginosa PA01
cgagagcuguccggcgcu

SEQ ID NO: 1562737 - RNA, 19 nt, Pseudomonas aeruginosa PA01
cgacuucggcaagcaccuu

SEQ ID NO: 1562738 - RNA, 12 nt, Pseudomonas aeruginosa PA01
cgacuucgcauu

SEQ ID NO: 1562739 - RNA, 22 nt, Pseudomonas aeruginosa PA01
cgacuuccugggaugccgggcc

SEQ ID NO: 1562740 - RNA, 12 nt, Pseudomonas aeruginosa PA01
cgacuuccaggc

SEQ ID NO: 1562741 - RNA, 22 nt, Pseudomonas aeruginosa PA01
cgagaaaaaccacgggaauggc

SEQ ID NO: 1562742 - RNA, 14 nt, Pseudomonas aeruginosa PA01
cgagaacccggcca

SEQ ID NO: 1562743 - RNA, 22 nt, Pseudomonas aeruginosa PA01
cgagaaaguucccgcauggcuc

SEQ ID NO: 1562744 - RNA, 14 nt, Pseudomonas aeruginosa PA01
cgagaaaccgccau

SEQ ID NO: 1562745 - RNA, 14 nt, Pseudomonas aeruginosa PA01
cgacugcggcagcu

SEQ ID NO: 1562746 - RNA, 20 nt, Pseudomonas aeruginosa PA01
cgacugcggcagcuuggcga

SEQ ID NO: 1562747 - RNA, 21 nt, Pseudomonas aeruginosa PA01
cgacugcgguuuuccugcccc

SEQ ID NO: 1562748 - RNA, 14 nt, Pseudomonas aeruginosa PA01
cgacugucgugccu

SEQ ID NO: 1562749 - RNA, 20 nt, Pseudomonas aeruginosa PA01
cgacugucgugccuccagcc

SEQ ID NO: 1562750 - RNA, 15 nt, Pseudomonas aeruginosa PA01
cgacugcaugaccuc

SEQ ID NO: 1562751 - RNA, 22 nt, Pseudomonas aeruginosa PA01
cgacucguugcacgcaggccgc

SEQ ID NO: 1562752 - RNA, 15 nt, Pseudomonas aeruginosa PA01
cgacucgcugggcgc

SEQ ID NO: 1562753 - RNA, 13 nt, Pseudomonas aeruginosa PA01
cgacuccgccagu

SEQ ID NO: 1562754 - RNA, 15 nt, Pseudomonas aeruginosa PA01
cgacuccagccaggc

SEQ ID NO: 1562755 - RNA, 14 nt, Pseudomonas aeruginosa PA01
cgacuccagcuucu

SEQ ID NO: 1562756 - RNA, 23 nt, Pseudomonas aeruginosa PA01
cgacuauuccgccaccagccagu

SEQ ID NO: 1562757 - RNA, 12 nt, Pseudomonas aeruginosa PA01
cgacguucugcu

SEQ ID NO: 1562758 - RNA, 14 nt, Pseudomonas aeruginosa PA01
cgacguugcaauug

SEQ ID NO: 1562759 - RNA, 18 nt, Pseudomonas aeruginosa PA01
cgaauaccagugccgcgg

SEQ ID NO: 1562760 - RNA, 17 nt, Pseudomonas aeruginosa PA01
cgacgucgccccagccu

SEQ ID NO: 1562761 - RNA, 20 nt, Pseudomonas aeruginosa PA01
cgacgucgaugacgauggcg

SEQ ID NO: 1562762 - RNA, 23 nt, Pseudomonas aeruginosa PA01
cgagggcugagacgcugccguuc

SEQ ID NO: 1562763 - RNA, 17 nt, Pseudomonas aeruginosa PA01
cgagggcguccuugccc

SEQ ID NO: 1562764 - RNA, 17 nt, Pseudomonas aeruginosa PA01
cgagggccgcgccgacc

SEQ ID NO: 1562765 - RNA, 21 nt, Pseudomonas aeruginosa PA01
cgagggccgcgccgacccaga

SEQ ID NO: 1562766 - RNA, 12 nt, Pseudomonas aeruginosa PA01
cgagggcgcgca

SEQ ID NO: 1562767 - RNA, 16 nt, Pseudomonas aeruginosa PA01
cgagggcgcggcgcca

SEQ ID NO: 1562768 - RNA, 21 nt, Pseudomonas aeruginosa PA01
cgagggcgaguucggcgagca

SEQ ID NO: 1562769 - RNA, 22 nt, Pseudomonas aeruginosa PA01
cgagggcgaguucggcgagcag

SEQ ID NO: 1562770 - RNA, 19 nt, Pseudomonas aeruginosa PA01
cgagggcgccaggugcagg

SEQ ID NO: 1562771 - RNA, 19 nt, Pseudomonas aeruginosa PA01
cgagggcaaaggcgcgcag

SEQ ID NO: 1562772 - RNA, 16 nt, Pseudomonas aeruginosa PA01
cgagggcaccacguug

SEQ ID NO: 1562773 - RNA, 18 nt, Pseudomonas aeruginosa PA01
cgagggcacguugggauc

SEQ ID NO: 1562774 - RNA, 18 nt, Pseudomonas aeruginosa PA01
cgaggcugaucugccggu

SEQ ID NO: 1562775 - RNA, 14 nt, Pseudomonas aeruginosa PA01
cgaggcugcgggcg

SEQ ID NO: 1562776 - RNA, 17 nt, Pseudomonas aeruginosa PA01
cgaggcugcgggcgaug

SEQ ID NO: 1562777 - RNA, 17 nt, Pseudomonas aeruginosa PA01
cgaggcuuuccagcagg

SEQ ID NO: 1562778 - RNA, 22 nt, Pseudomonas aeruginosa PA01
cgaggcuuccucgaagaacucg

SEQ ID NO: 1562779 - RNA, 17 nt, Pseudomonas aeruginosa PA01
cgaggccgagguagacc

SEQ ID NO: 1562780 - RNA, 15 nt, Pseudomonas aeruginosa PA01
cgaggcccgcgccgc

SEQ ID NO: 1562781 - RNA, 14 nt, Pseudomonas aeruginosa PA01
cgaggccgcccagc

SEQ ID NO: 1562782 - RNA, 22 nt, Pseudomonas aeruginosa PA01
cgaggccgccgcgggcaaccgc

SEQ ID NO: 1562783 - RNA, 22 nt, Pseudomonas aeruginosa PA01
cgaggccguaccagucgcccgc

SEQ ID NO: 1562784 - RNA, 22 nt, Pseudomonas aeruginosa PA01
cgaggccggcgaucagcucgcg

SEQ ID NO: 1562785 - RNA, 19 nt, Pseudomonas aeruginosa PA01
cgaggcgaccuuggccagc

SEQ ID NO: 1562786 - RNA, 15 nt, Pseudomonas aeruginosa PA01
cgaggccuacccgcg

SEQ ID NO: 1562787 - RNA, 17 nt, Pseudomonas aeruginosa PA01
cgaggcucggucgcgcg

SEQ ID NO: 1562788 - RNA, 14 nt, Pseudomonas aeruginosa PA01
cgaggcguggaagg

SEQ ID NO: 1562789 - RNA, 14 nt, Pseudomonas aeruginosa PA01
cgaggcgcgccgac

SEQ ID NO: 1562790 - RNA, 20 nt, Pseudomonas aeruginosa PA01
cgaggcgcgccgacagcacg

SEQ ID NO: 1562791 - RNA, 12 nt, Pseudomonas aeruginosa PA01
cgaggcgcgccu

SEQ ID NO: 1562792 - RNA, 16 nt, Pseudomonas aeruginosa PA01
cgaggcgcuccaccgc

SEQ ID NO: 1562793 - RNA, 18 nt, Pseudomonas aeruginosa PA01
cgaggcgcuccaccgccc

SEQ ID NO: 1562794 - RNA, 21 nt, Pseudomonas aeruginosa PA01
cgaggcgcucgacgaucaggu

SEQ ID NO: 1562795 - RNA, 14 nt, Pseudomonas aeruginosa PA01
cgaggcggaagacg

SEQ ID NO: 1562796 - RNA, 23 nt, Pseudomonas aeruginosa PA01
cgaggacuucauggaggaagcuc

SEQ ID NO: 1562797 - RNA, 17 nt, Pseudomonas aeruginosa PA01
cgaggagguuggucugc

SEQ ID NO: 1562798 - RNA, 23 nt, Pseudomonas aeruginosa PA01
cgaggaacuccuccucgcuccag

SEQ ID NO: 1562799 - RNA, 19 nt, Pseudomonas aeruginosa PA01
cgaggaacagcaccagcaa

SEQ ID NO: 1562800 - RNA, 20 nt, Pseudomonas aeruginosa PA01
cgaggaacagcaccagcaau

SEQ ID NO: 1562801 - RNA, 21 nt, Pseudomonas aeruginosa PA01
cgaggaacaggucgacgccau

SEQ ID NO: 1562802 - RNA, 18 nt, Pseudomonas aeruginosa PA01
cgaggaacaggucgacgg

SEQ ID NO: 1562803 - RNA, 18 nt, Pseudomonas aeruginosa PA01
cgaggaauuccggcagcg

SEQ ID NO: 1562804 - RNA, 16 nt, Pseudomonas aeruginosa PA01
cgaggaaggcgcuggc

SEQ ID NO: 1562805 - RNA, 20 nt, Pseudomonas aeruginosa PA01
cgaggaagaaaaagcccgcu

SEQ ID NO: 1562806 - RNA, 13 nt, Pseudomonas aeruginosa PA01
cgaggaaggccag

SEQ ID NO: 1562807 - RNA, 13 nt, Pseudomonas aeruginosa PA01
cgaggaagccgac

SEQ ID NO: 1562808 - RNA, 14 nt, Pseudomonas aeruginosa PA01
cgaggaagccgacc

SEQ ID NO: 1562809 - RNA, 23 nt, Pseudomonas aeruginosa PA01
cgaggaagccgaccggcgccggg

SEQ ID NO: 1562810 - RNA, 13 nt, Pseudomonas aeruginosa PA01
cgaggccagcagg

SEQ ID NO: 1562811 - RNA, 16 nt, Pseudomonas aeruginosa PA01
cgaggccagcaggccg

SEQ ID NO: 1562812 - RNA, 16 nt, Pseudomonas aeruginosa PA01
cgaggccauccccgag

SEQ ID NO: 1562813 - RNA, 22 nt, Pseudomonas aeruginosa PA01
cgaggccauccccgaggcgacg

SEQ ID NO: 1562814 - RNA, 19 nt, Pseudomonas aeruginosa PA01
cgaggccaggccgagcgcc

SEQ ID NO: 1562815 - RNA, 23 nt, Pseudomonas aeruginosa PA01
cgaggccaccacuucgcggacca

SEQ ID NO: 1562816 - RNA, 19 nt, Pseudomonas aeruginosa PA01
cgaggauuuccgcgcccgg

SEQ ID NO: 1562817 - RNA, 19 nt, Pseudomonas aeruginosa PA01
cgaggauuuccucgcgcac

SEQ ID NO: 1562818 - RNA, 16 nt, Pseudomonas aeruginosa PA01
cgaggaucgccagcaa

SEQ ID NO: 1562819 - RNA, 17 nt, Pseudomonas aeruginosa PA01
cgaggaucgccagcaau

SEQ ID NO: 1562820 - RNA, 21 nt, Pseudomonas aeruginosa PA01
cgaggaucagccacgggcgcc

SEQ ID NO: 1562821 - RNA, 23 nt, Pseudomonas aeruginosa PA01
cgaggaucagucgcugcucggcc

SEQ ID NO: 1562822 - RNA, 18 nt, Pseudomonas aeruginosa PA01
cgaggaucuugcgcccgg

SEQ ID NO: 1562823 - RNA, 18 nt, Pseudomonas aeruginosa PA01
cgaggaugaucagggcac

SEQ ID NO: 1562824 - RNA, 21 nt, Pseudomonas aeruginosa PA01
cgaggaugaucagggcaccgc

SEQ ID NO: 1562825 - RNA, 17 nt, Pseudomonas aeruginosa PA01
cgaggauggucaggccg

SEQ ID NO: 1562826 - RNA, 18 nt, Pseudomonas aeruginosa PA01
cgaggauguacagggucu

SEQ ID NO: 1562827 - RNA, 17 nt, Pseudomonas aeruginosa PA01
cgagcgcgagugcagcg

SEQ ID NO: 1562828 - RNA, 19 nt, Pseudomonas aeruginosa PA01
cgagcgcgaucagccgcuc

SEQ ID NO: 1562829 - RNA, 12 nt, Pseudomonas aeruginosa PA01
cgagcggcggcc

SEQ ID NO: 1562830 - RNA, 22 nt, Pseudomonas aeruginosa PA01
cgagcgcuccaccgcgcuccgc

SEQ ID NO: 1562831 - RNA, 24 nt, Pseudomonas aeruginosa PA01
cgagcgcuucauccugcgcgccuc

SEQ ID NO: 1562832 - RNA, 16 nt, Pseudomonas aeruginosa PA01
cgagcguccgccgccg

SEQ ID NO: 1562833 - RNA, 16 nt, Pseudomonas aeruginosa PA01
cgagcguugggccucg

SEQ ID NO: 1562834 - RNA, 20 nt, Pseudomonas aeruginosa PA01
cgagcuuguuggccagcagc

SEQ ID NO: 1562835 - RNA, 16 nt, Pseudomonas aeruginosa PA01
cgagcuuugcgcagcc

SEQ ID NO: 1562836 - RNA, 12 nt, Pseudomonas aeruginosa PA01
cgagcuuuccug

SEQ ID NO: 1562837 - RNA, 19 nt, Pseudomonas aeruginosa PA01
cgaggaaaaggaucgccgc

SEQ ID NO: 1562838 - RNA, 13 nt, Pseudomonas aeruginosa PA01
cgagcuugaccuu

SEQ ID NO: 1562839 - RNA, 19 nt, Pseudomonas aeruginosa PA01
cgagcuuggccacuccggg

SEQ ID NO: 1562840 - RNA, 18 nt, Pseudomonas aeruginosa PA01
cgagcugccgcaccgccu

SEQ ID NO: 1562841 - RNA, 14 nt, Pseudomonas aeruginosa PA01
cgagcugccgggcg

SEQ ID NO: 1562842 - RNA, 14 nt, Pseudomonas aeruginosa PA01
cgagcugaccacca

SEQ ID NO: 1562843 - RNA, 16 nt, Pseudomonas aeruginosa PA01
cgagcuggacgcgcuu

SEQ ID NO: 1562844 - RNA, 16 nt, Pseudomonas aeruginosa PA01
cgagcugggcguugcc

SEQ ID NO: 1562845 - RNA, 22 nt, Pseudomonas aeruginosa PA01
cgagcuguccaucucgccgcgc

SEQ ID NO: 1562846 - RNA, 15 nt, Pseudomonas aeruginosa PA01
cgauagccgaccagg

SEQ ID NO: 1562847 - RNA, 15 nt, Pseudomonas aeruginosa PA01
cgaguucgcgcaggc

SEQ ID NO: 1562848 - RNA, 15 nt, Pseudomonas aeruginosa PA01
cgaguucggcgagca

SEQ ID NO: 1562849 - RNA, 18 nt, Pseudomonas aeruginosa PA01
cgaguucgccggccaggu

SEQ ID NO: 1562850 - RNA, 15 nt, Pseudomonas aeruginosa PA01
cgaguugaccagcau

SEQ ID NO: 1562851 - RNA, 19 nt, Pseudomonas aeruginosa PA01
cgaguuucccggcgcggcc

SEQ ID NO: 1562852 - RNA, 15 nt, Pseudomonas aeruginosa PA01
cgauaacaccaggag

SEQ ID NO: 1562853 - RNA, 22 nt, Pseudomonas aeruginosa PA01
cgauaacaccaggagcgccagc

SEQ ID NO: 1562854 - RNA, 19 nt, Pseudomonas aeruginosa PA01
cgaguaccaccgugcccgc

SEQ ID NO: 1562855 - RNA, 20 nt, Pseudomonas aeruginosa PA01
cgaguaggcgaagcccagcg

SEQ ID NO: 1562856 - RNA, 14 nt, Pseudomonas aeruginosa PA01
cgaguaggcgcugc

SEQ ID NO: 1562857 - RNA, 15 nt, Pseudomonas aeruginosa PA01
cgaguagguccaggc

SEQ ID NO: 1562858 - RNA, 15 nt, Pseudomonas aeruginosa PA01
cgaguccgcgcgcgc

SEQ ID NO: 1562859 - RNA, 22 nt, Pseudomonas aeruginosa PA01
cgagucaccccgaccagcgcgc

SEQ ID NO: 1562860 - RNA, 11 nt, Pseudomonas aeruginosa PA01
cgaguccaggu

SEQ ID NO: 1562861 - RNA, 11 nt, Pseudomonas aeruginosa PA01
cgaguccccua

SEQ ID NO: 1562862 - RNA, 20 nt, Pseudomonas aeruginosa PA01
cgaguggccgcugagcagca

SEQ ID NO: 1562863 - RNA, 16 nt, Pseudomonas aeruginosa PA01
cgagugcgcccagcag

SEQ ID NO: 1562864 - RNA, 13 nt, Pseudomonas aeruginosa PA01
cgagucgaggcga

SEQ ID NO: 1562865 - RNA, 19 nt, Pseudomonas aeruginosa PA01
cgaggguggcgccgagcag

SEQ ID NO: 1562866 - RNA, 20 nt, Pseudomonas aeruginosa PA01
cgaggguggcgccgagcagc

SEQ ID NO: 1562867 - RNA, 15 nt, Pseudomonas aeruginosa PA01
cgaggggcggagcag

SEQ ID NO: 1562868 - RNA, 21 nt, Pseudomonas aeruginosa PA01
cgaggggaacauugccaccac

SEQ ID NO: 1562869 - RNA, 19 nt, Pseudomonas aeruginosa PA01
cgaggggaagaucuccggg

SEQ ID NO: 1562870 - RNA, 21 nt, Pseudomonas aeruginosa PA01
cgagggguaaggcaugcccag

SEQ ID NO: 1562871 - RNA, 20 nt, Pseudomonas aeruginosa PA01
cgaggucgccggggccuacu

SEQ ID NO: 1562872 - RNA, 18 nt, Pseudomonas aeruginosa PA01
cgaggucgcgggccaggc

SEQ ID NO: 1562873 - RNA, 20 nt, Pseudomonas aeruginosa PA01
cgagguagucggugaagcgc

SEQ ID NO: 1562874 - RNA, 17 nt, Pseudomonas aeruginosa PA01
cgagguagaacaggcug

SEQ ID NO: 1562875 - RNA, 17 nt, Pseudomonas aeruginosa PA01
cgaggguugucaccggc

SEQ ID NO: 1562876 - RNA, 22 nt, Pseudomonas aeruginosa PA01
cgaggugguauugcagcucguu

SEQ ID NO: 1562877 - RNA, 18 nt, Pseudomonas aeruginosa PA01
cgaggugaucgagggcca

SEQ ID NO: 1562878 - RNA, 14 nt, Pseudomonas aeruginosa PA01
cgaggucggccugg

SEQ ID NO: 1562879 - RNA, 21 nt, Pseudomonas aeruginosa PA01
cgaggucucgauggugaucac

SEQ ID NO: 1562880 - RNA, 13 nt, Pseudomonas aeruginosa PA01
cgaggucugugcc

SEQ ID NO: 1562881 - RNA, 13 nt, Pseudomonas aeruginosa PA01
cgagguugcccac

SEQ ID NO: 1562882 - RNA, 22 nt, Pseudomonas aeruginosa PA01
cgagguugcucugggcauggcu

SEQ ID NO: 1562883 - RNA, 22 nt, Pseudomonas aeruginosa PA01
cgagguguucccggaucagcuc

SEQ ID NO: 1562884 - RNA, 22 nt, Pseudomonas aeruginosa PA01
cgagguguuguguggcugcgcu

SEQ ID NO: 1562885 - RNA, 15 nt, Pseudomonas aeruginosa PA01
cgagguucucgaccc

SEQ ID NO: 1562886 - RNA, 22 nt, Pseudomonas aeruginosa PA01
cggcauucucucuucagcaggg

SEQ ID NO: 1562887 - RNA, 16 nt, Pseudomonas aeruginosa PA01
cggcauucgccgggcu

SEQ ID NO: 1562888 - RNA, 12 nt, Pseudomonas aeruginosa PA01
cggcauuccugg

SEQ ID NO: 1562889 - RNA, 22 nt, Pseudomonas aeruginosa PA01
cggcauuccugguccagccagc

SEQ ID NO: 1562890 - RNA, 16 nt, Pseudomonas aeruginosa PA01
cggcagcaucagccgc

SEQ ID NO: 1562891 - RNA, 22 nt, Pseudomonas aeruginosa PA01
cggcagcaucagccgcgacgac

SEQ ID NO: 1562892 - RNA, 15 nt, Pseudomonas aeruginosa PA01
cggcagcaggcugua

SEQ ID NO: 1562893 - RNA, 21 nt, Pseudomonas aeruginosa PA01
cggcagcaucucggugcgccc

SEQ ID NO: 1562894 - RNA, 19 nt, Pseudomonas aeruginosa PA01
cggcagcacccgcaccagc

SEQ ID NO: 1562895 - RNA, 14 nt, Pseudomonas aeruginosa PA01
cggcagcacggcga

SEQ ID NO: 1562896 - RNA, 15 nt, Pseudomonas aeruginosa PA01
cggcagauccgccgu

SEQ ID NO: 1562897 - RNA, 15 nt, Pseudomonas aeruginosa PA01
cggccacuccagccc

SEQ ID NO: 1562898 - RNA, 17 nt, Pseudomonas aeruginosa PA01
cggccacuccagccccg

SEQ ID NO: 1562899 - RNA, 18 nt, Pseudomonas aeruginosa PA01
cggccacuccagccccgc

SEQ ID NO: 1562900 - RNA, 14 nt, Pseudomonas aeruginosa PA01
cggccacucgcagc

SEQ ID NO: 1562901 - RNA, 12 nt, Pseudomonas aeruginosa PA01
cggccaccacca

SEQ ID NO: 1562902 - RNA, 18 nt, Pseudomonas aeruginosa PA01
cggccaccuucgcccgcu

SEQ ID NO: 1562903 - RNA, 20 nt, Pseudomonas aeruginosa PA01
cggcccgcggaucgcgccgu

SEQ ID NO: 1562904 - RNA, 14 nt, Pseudomonas aeruginosa PA01
cggcccggaagcuc

SEQ ID NO: 1562905 - RNA, 17 nt, Pseudomonas aeruginosa PA01
cggcccggaagcucugc

SEQ ID NO: 1562906 - RNA, 18 nt, Pseudomonas aeruginosa PA01
cggcccggaagcucugca

SEQ ID NO: 1562907 - RNA, 18 nt, Pseudomonas aeruginosa PA01
cggcccgccucggcggcu

SEQ ID NO: 1562908 - RNA, 16 nt, Pseudomonas aeruginosa PA01
cggcccgcgccgccuc

SEQ ID NO: 1562909 - RNA, 13 nt, Pseudomonas aeruginosa PA01
cggcccgcgcggc

SEQ ID NO: 1562910 - RNA, 15 nt, Pseudomonas aeruginosa PA01
cggcccgccgccggg

SEQ ID NO: 1562911 - RNA, 22 nt, Pseudomonas aeruginosa PA01
cggcccgccacagaucgccagc

SEQ ID NO: 1562912 - RNA, 12 nt, Pseudomonas aeruginosa PA01
cggcccgccccg

SEQ ID NO: 1562913 - RNA, 15 nt, Pseudomonas aeruginosa PA01
cggcccgagggcggc

SEQ ID NO: 1562914 - RNA, 16 nt, Pseudomonas aeruginosa PA01
cggcccgagcaggcug

SEQ ID NO: 1562915 - RNA, 13 nt, Pseudomonas aeruginosa PA01
cggccccugggcc

SEQ ID NO: 1562916 - RNA, 16 nt, Pseudomonas aeruginosa PA01
cggccccugggccggc

SEQ ID NO: 1562917 - RNA, 16 nt, Pseudomonas aeruginosa PA01
cggcccagcgccccgc

SEQ ID NO: 1562918 - RNA, 12 nt, Pseudomonas aeruginosa PA01
cggcccagcagg

SEQ ID NO: 1562919 - RNA, 21 nt, Pseudomonas aeruginosa PA01
cggcccagcaggccggccagc

SEQ ID NO: 1562920 - RNA, 20 nt, Pseudomonas aeruginosa PA01
cggcccagcguucggcgcug

SEQ ID NO: 1562921 - RNA, 18 nt, Pseudomonas aeruginosa PA01
cggccccggccagguacc

SEQ ID NO: 1562922 - RNA, 15 nt, Pseudomonas aeruginosa PA01
cggccccgagcgggc

SEQ ID NO: 1562923 - RNA, 13 nt, Pseudomonas aeruginosa PA01
cggccaggggcug

SEQ ID NO: 1562924 - RNA, 21 nt, Pseudomonas aeruginosa PA01
cggccaggggcugaacagcgc

SEQ ID NO: 1562925 - RNA, 23 nt, Pseudomonas aeruginosa PA01
cggccaggggcugaacagcgcca

SEQ ID NO: 1562926 - RNA, 19 nt, Pseudomonas aeruginosa PA01
cggccagguaggcgacgaa

SEQ ID NO: 1562927 - RNA, 15 nt, Pseudomonas aeruginosa PA01
cggccauugccgcgg

SEQ ID NO: 1562928 - RNA, 18 nt, Pseudomonas aeruginosa PA01
cggccauugucggccucg

SEQ ID NO: 1562929 - RNA, 14 nt, Pseudomonas aeruginosa PA01
cggccagcgcggcc

SEQ ID NO: 1562930 - RNA, 15 nt, Pseudomonas aeruginosa PA01
cggccaggggagcgc

SEQ ID NO: 1562931 - RNA, 16 nt, Pseudomonas aeruginosa PA01
cggccaggggagcgcc

SEQ ID NO: 1562932 - RNA, 16 nt, Pseudomonas aeruginosa PA01
cggccagcgcggccgc

SEQ ID NO: 1562933 - RNA, 18 nt, Pseudomonas aeruginosa PA01
cggccagcgcggccgccg

SEQ ID NO: 1562934 - RNA, 22 nt, Pseudomonas aeruginosa PA01
cggccagcgcggccgccgccga

SEQ ID NO: 1562935 - RNA, 13 nt, Pseudomonas aeruginosa PA01
cggccagcgcauc

SEQ ID NO: 1562936 - RNA, 19 nt, Pseudomonas aeruginosa PA01
cggccagcgccaggagcag

SEQ ID NO: 1562937 - RNA, 12 nt, Pseudomonas aeruginosa PA01
cggccagcgccg

SEQ ID NO: 1562938 - RNA, 13 nt, Pseudomonas aeruginosa PA01
cggccagcagcac

SEQ ID NO: 1562939 - RNA, 20 nt, Pseudomonas aeruginosa PA01
cggccagccuucccggcgcu

SEQ ID NO: 1562940 - RNA, 20 nt, Pseudomonas aeruginosa PA01
cggccuggcgguugaugccg

SEQ ID NO: 1562941 - RNA, 22 nt, Pseudomonas aeruginosa PA01
cggccugguagucgccggucag

SEQ ID NO: 1562942 - RNA, 20 nt, Pseudomonas aeruginosa PA01
cggccuggcgcagcggcagc

SEQ ID NO: 1562943 - RNA, 22 nt, Pseudomonas aeruginosa PA01
cggccugggugaacagcggccc

SEQ ID NO: 1562944 - RNA, 16 nt, Pseudomonas aeruginosa PA01
cggccugggcgcaggc

SEQ ID NO: 1562945 - RNA, 23 nt, Pseudomonas aeruginosa PA01
cggccuggguacgcaccggcuuc

SEQ ID NO: 1562946 - RNA, 23 nt, Pseudomonas aeruginosa PA01
cggccuggugacccggacagccu

SEQ ID NO: 1562947 - RNA, 16 nt, Pseudomonas aeruginosa PA01
cggccuggugcaccug

SEQ ID NO: 1562948 - RNA, 16 nt, Pseudomonas aeruginosa PA01
cggccuguaccgcuuc

SEQ ID NO: 1562949 - RNA, 17 nt, Pseudomonas aeruginosa PA01
cggccuguaccgcuucc

SEQ ID NO: 1562950 - RNA, 20 nt, Pseudomonas aeruginosa PA01
cggccuguaccgcuuccugg

SEQ ID NO: 1562951 - RNA, 22 nt, Pseudomonas aeruginosa PA01
cggccuguaccgcuuccugggc

SEQ ID NO: 1562952 - RNA, 19 nt, Pseudomonas aeruginosa PA01
cggccugucacgccggggg

SEQ ID NO: 1562953 - RNA, 16 nt, Pseudomonas aeruginosa PA01
cggccggggcgcgccc

SEQ ID NO: 1562954 - RNA, 16 nt, Pseudomonas aeruginosa PA01
cggccguuguccaggg

SEQ ID NO: 1562955 - RNA, 21 nt, Pseudomonas aeruginosa PA01
cggccggugccuucggcggcg

SEQ ID NO: 1562956 - RNA, 20 nt, Pseudomonas aeruginosa PA01
cggccuacgguacaguucag

SEQ ID NO: 1562957 - RNA, 24 nt, Pseudomonas aeruginosa PA01
cggccuacuugaucagccgcaggc

SEQ ID NO: 1562958 - RNA, 14 nt, Pseudomonas aeruginosa PA01
cggccuccagcacu

SEQ ID NO: 1562959 - RNA, 14 nt, Pseudomonas aeruginosa PA01
cggccuccagcgcc

SEQ ID NO: 1562960 - RNA, 15 nt, Pseudomonas aeruginosa PA01
cggccuccagcgccu

SEQ ID NO: 1562961 - RNA, 14 nt, Pseudomonas aeruginosa PA01
cggccuccaggcug

SEQ ID NO: 1562962 - RNA, 15 nt, Pseudomonas aeruginosa PA01
cggccuccaggcugg

SEQ ID NO: 1562963 - RNA, 19 nt, Pseudomonas aeruginosa PA01
cggccuccaggcuggccuu

SEQ ID NO: 1562964 - RNA, 22 nt, Pseudomonas aeruginosa PA01
cggccuucacgcagcucugcga

SEQ ID NO: 1562965 - RNA, 18 nt, Pseudomonas aeruginosa PA01
cggccuguucgcccaagg

SEQ ID NO: 1562966 - RNA, 19 nt, Pseudomonas aeruginosa PA01
cggccuguucgcccaaggc

SEQ ID NO: 1562967 - RNA, 20 nt, Pseudomonas aeruginosa PA01
cggccugguccggcacuucc

SEQ ID NO: 1562968 - RNA, 20 nt, Pseudomonas aeruginosa PA01
cggccuucucgucgccgccc

SEQ ID NO: 1562969 - RNA, 22 nt, Pseudomonas aeruginosa PA01
cggccuucucgucgccgcccgg

SEQ ID NO: 1562970 - RNA, 19 nt, Pseudomonas aeruginosa PA01
cggccuuggucucgcgggc

SEQ ID NO: 1562971 - RNA, 17 nt, Pseudomonas aeruginosa PA01
cggccuuguccgcgcgc

SEQ ID NO: 1562972 - RNA, 22 nt, Pseudomonas aeruginosa PA01
cggccuuguccgcgcgcuucca

SEQ ID NO: 1562973 - RNA, 16 nt, Pseudomonas aeruginosa PA01
cggccuuuucucugca

SEQ ID NO: 1562974 - RNA, 21 nt, Pseudomonas aeruginosa PA01
cggccuuuuucucguucgggc

SEQ ID NO: 1562975 - RNA, 20 nt, Pseudomonas aeruginosa PA01
cggcgaagcggaagcgcagc

SEQ ID NO: 1562976 - RNA, 20 nt, Pseudomonas aeruginosa PA01
cggcgaagcggcccuugucg

SEQ ID NO: 1562977 - RNA, 14 nt, Pseudomonas aeruginosa PA01
cggcgaagggcgcu

SEQ ID NO: 1562978 - RNA, 16 nt, Pseudomonas aeruginosa PA01
cggcgacaccccgaag

SEQ ID NO: 1562979 - RNA, 18 nt, Pseudomonas aeruginosa PA01
cggcgaauucgucgccgc

SEQ ID NO: 1562980 - RNA, 22 nt, Pseudomonas aeruginosa PA01
cggcgaauucgucgccgccgag

SEQ ID NO: 1562981 - RNA, 19 nt, Pseudomonas aeruginosa PA01
cggcgaccuugcgcaccag

SEQ ID NO: 1562982 - RNA, 15 nt, Pseudomonas aeruginosa PA01
cggcgaccuuguccu

SEQ ID NO: 1562983 - RNA, 23 nt, Pseudomonas aeruginosa PA01
cggcgaccuuguccugcggccgg

SEQ ID NO: 1562984 - RNA, 13 nt, Pseudomonas aeruginosa PA01
cggccgaacugga

SEQ ID NO: 1562985 - RNA, 21 nt, Pseudomonas aeruginosa PA01
cggcccuugucgccgcugggc

SEQ ID NO: 1562986 - RNA, 22 nt, Pseudomonas aeruginosa PA01
cggcccuugucgccgcugggca

SEQ ID NO: 1562987 - RNA, 19 nt, Pseudomonas aeruginosa PA01
cggcccuuguucgcggcga

SEQ ID NO: 1562988 - RNA, 13 nt, Pseudomonas aeruginosa PA01
cggccgaccaggc

SEQ ID NO: 1562989 - RNA, 20 nt, Pseudomonas aeruginosa PA01
cggccgagauccugcagcag

SEQ ID NO: 1562990 - RNA, 18 nt, Pseudomonas aeruginosa PA01
cggccgagcaccacgcgc

SEQ ID NO: 1562991 - RNA, 21 nt, Pseudomonas aeruginosa PA01
cggccgaugaucuccgcgccg

SEQ ID NO: 1562992 - RNA, 13 nt, Pseudomonas aeruginosa PA01
cggccgaucuuca

SEQ ID NO: 1562993 - RNA, 15 nt, Pseudomonas aeruginosa PA01
cggccgaucuucagc

SEQ ID NO: 1562994 - RNA, 20 nt, Pseudomonas aeruginosa PA01
cggccgcaaccagcccuggc

SEQ ID NO: 1562995 - RNA, 19 nt, Pseudomonas aeruginosa PA01
cggcccggcgugagcaggg

SEQ ID NO: 1562996 - RNA, 16 nt, Pseudomonas aeruginosa PA01
cggcccggcgcugccc

SEQ ID NO: 1562997 - RNA, 18 nt, Pseudomonas aeruginosa PA01
cggcccggcgcugcccgg

SEQ ID NO: 1562998 - RNA, 14 nt, Pseudomonas aeruginosa PA01
cggcccggccaggu

SEQ ID NO: 1562999 - RNA, 15 nt, Pseudomonas aeruginosa PA01
cggcccggccauccu

SEQ ID NO: 1563000 - RNA, 14 nt, Pseudomonas aeruginosa PA01
cggcccggccaggc

SEQ ID NO: 1563001 - RNA, 13 nt, Pseudomonas aeruginosa PA01
cggcccggagacc

SEQ ID NO: 1563002 - RNA, 17 nt, Pseudomonas aeruginosa PA01
cggcccggagccaacgc

SEQ ID NO: 1563003 - RNA, 15 nt, Pseudomonas aeruginosa PA01
cggcccggagcgcga

SEQ ID NO: 1563004 - RNA, 21 nt, Pseudomonas aeruginosa PA01
cggcccuucgacaugggccgc

SEQ ID NO: 1563005 - RNA, 20 nt, Pseudomonas aeruginosa PA01
cggcccugcucgccggcgcg

SEQ ID NO: 1563006 - RNA, 19 nt, Pseudomonas aeruginosa PA01
cggcccuggcggcgaaaug

SEQ ID NO: 1563007 - RNA, 14 nt, Pseudomonas aeruginosa PA01
cggccggcucagaa

SEQ ID NO: 1563008 - RNA, 14 nt, Pseudomonas aeruginosa PA01
cggccggggaacag

SEQ ID NO: 1563009 - RNA, 13 nt, Pseudomonas aeruginosa PA01
cggccggccaggu

SEQ ID NO: 1563010 - RNA, 18 nt, Pseudomonas aeruginosa PA01
cggccgcgucgcccaggc

SEQ ID NO: 1563011 - RNA, 19 nt, Pseudomonas aeruginosa PA01
cggcgauggacucgaucac

SEQ ID NO: 1563012 - RNA, 15 nt, Pseudomonas aeruginosa PA01
cggcgccaccgcguu

SEQ ID NO: 1563013 - RNA, 15 nt, Pseudomonas aeruginosa PA01
cggcgccagcgcccc

SEQ ID NO: 1563014 - RNA, 16 nt, Pseudomonas aeruginosa PA01
cggcgccagcgcccca

SEQ ID NO: 1563015 - RNA, 14 nt, Pseudomonas aeruginosa PA01
cggcgcaaccccuu

SEQ ID NO: 1563016 - RNA, 18 nt, Pseudomonas aeruginosa PA01
cggcgccaggcccucggc

SEQ ID NO: 1563017 - RNA, 19 nt, Pseudomonas aeruginosa PA01
cggcgccaggcccucggcg

SEQ ID NO: 1563018 - RNA, 21 nt, Pseudomonas aeruginosa PA01
cggcgccauaggccagcaccu

SEQ ID NO: 1563019 - RNA, 22 nt, Pseudomonas aeruginosa PA01
cggcgccaguucgccggugacg

SEQ ID NO: 1563020 - RNA, 15 nt, Pseudomonas aeruginosa PA01
cggcgacgcaggacg

SEQ ID NO: 1563021 - RNA, 15 nt, Pseudomonas aeruginosa PA01
cggcgacgaugccgc

SEQ ID NO: 1563022 - RNA, 19 nt, Pseudomonas aeruginosa PA01
cggcgacgaucacccccag

SEQ ID NO: 1563023 - RNA, 22 nt, Pseudomonas aeruginosa PA01
cggcgacgacgaucccggcggu

SEQ ID NO: 1563024 - RNA, 18 nt, Pseudomonas aeruginosa PA01
cggcgacgaagcccaggc

SEQ ID NO: 1563025 - RNA, 18 nt, Pseudomonas aeruginosa PA01
cggcgacgaaggccuggu

SEQ ID NO: 1563026 - RNA, 20 nt, Pseudomonas aeruginosa PA01
cggcgacgaaggccuggucg

SEQ ID NO: 1563027 - RNA, 16 nt, Pseudomonas aeruginosa PA01
cggcgauguucgcccc

SEQ ID NO: 1563028 - RNA, 16 nt, Pseudomonas aeruginosa PA01
cggcgauucgcggcga

SEQ ID NO: 1563029 - RNA, 21 nt, Pseudomonas aeruginosa PA01
cggcgauucgcggcgacagca

SEQ ID NO: 1563030 - RNA, 22 nt, Pseudomonas aeruginosa PA01
cggcgauucguucgagcagcuc

SEQ ID NO: 1563031 - RNA, 18 nt, Pseudomonas aeruginosa PA01
cggcgaugcucagcgccg

SEQ ID NO: 1563032 - RNA, 12 nt, Pseudomonas aeruginosa PA01
cggcgaugcugc

SEQ ID NO: 1563033 - RNA, 18 nt, Pseudomonas aeruginosa PA01
cggcgauggcgcgcgggc

SEQ ID NO: 1563034 - RNA, 20 nt, Pseudomonas aeruginosa PA01
cggcgauggcgcgcgggccu

SEQ ID NO: 1563035 - RNA, 17 nt, Pseudomonas aeruginosa PA01
cggcgauggccgccagc

SEQ ID NO: 1563036 - RNA, 15 nt, Pseudomonas aeruginosa PA01
cggcgauggccgccu

SEQ ID NO: 1563037 - RNA, 18 nt, Pseudomonas aeruginosa PA01
cggcgauggccggcacca

SEQ ID NO: 1563038 - RNA, 22 nt, Pseudomonas aeruginosa PA01
cggcgauggccggcaccagcag

SEQ ID NO: 1563039 - RNA, 18 nt, Pseudomonas aeruginosa PA01
cggcgcccuugacccggu

SEQ ID NO: 1563040 - RNA, 14 nt, Pseudomonas aeruginosa PA01
cggcgcccuggccg

SEQ ID NO: 1563041 - RNA, 17 nt, Pseudomonas aeruginosa PA01
cggcgcccucgggcgcc

SEQ ID NO: 1563042 - RNA, 17 nt, Pseudomonas aeruginosa PA01
cggcgcccucugccggu

SEQ ID NO: 1563043 - RNA, 13 nt, Pseudomonas aeruginosa PA01
cggcgccgaggcc

SEQ ID NO: 1563044 - RNA, 13 nt, Pseudomonas aeruginosa PA01
cggcgccgaugcc

SEQ ID NO: 1563045 - RNA, 16 nt, Pseudomonas aeruginosa PA01
cggcgccgauuccugg

SEQ ID NO: 1563046 - RNA, 24 nt, Pseudomonas aeruginosa PA01
cggcgccaggcugaccgcgugggc

SEQ ID NO: 1563047 - RNA, 17 nt, Pseudomonas aeruginosa PA01
cgcuuuccccggcggca

SEQ ID NO: 1563048 - RNA, 18 nt, Pseudomonas aeruginosa PA01
cgcuuuccggcgcggccu

SEQ ID NO: 1563049 - RNA, 14 nt, Pseudomonas aeruginosa PA01
cgcuacccugcccc

SEQ ID NO: 1563050 - RNA, 18 nt, Pseudomonas aeruginosa PA01
cgcuuguagcagccgcag

SEQ ID NO: 1563051 - RNA, 18 nt, Pseudomonas aeruginosa PA01
cgcuugucguggcgggcu

SEQ ID NO: 1563052 - RNA, 20 nt, Pseudomonas aeruginosa PA01
cgcuuguccgagaccggcag

SEQ ID NO: 1563053 - RNA, 14 nt, Pseudomonas aeruginosa PA01
cgcuuguccuccag

SEQ ID NO: 1563054 - RNA, 13 nt, Pseudomonas aeruginosa PA01
cggaaguucaccu

SEQ ID NO: 1563055 - RNA, 16 nt, Pseudomonas aeruginosa PA01
cggaagucgaagcagc

SEQ ID NO: 1563056 - RNA, 13 nt, Pseudomonas aeruginosa PA01
cggaagucggcgg

SEQ ID NO: 1563057 - RNA, 19 nt, Pseudomonas aeruginosa PA01
cggaaggcggcgucgucgc

SEQ ID NO: 1563058 - RNA, 16 nt, Pseudomonas aeruginosa PA01
cggaagccgucggcga

SEQ ID NO: 1563059 - RNA, 18 nt, Pseudomonas aeruginosa PA01
cggaagcccagcaggucg

SEQ ID NO: 1563060 - RNA, 13 nt, Pseudomonas aeruginosa PA01
cggaagcacggcu

SEQ ID NO: 1563061 - RNA, 16 nt, Pseudomonas aeruginosa PA01
cggaacgagagguugc

SEQ ID NO: 1563062 - RNA, 23 nt, Pseudomonas aeruginosa PA01
cggaacgaaagaaggggagccga

SEQ ID NO: 1563063 - RNA, 21 nt, Pseudomonas aeruginosa PA01
cggaacgcggcuucggucagg

SEQ ID NO: 1563064 - RNA, 18 nt, Pseudomonas aeruginosa PA01
cggaacgucggccugggu

SEQ ID NO: 1563065 - RNA, 17 nt, Pseudomonas aeruginosa PA01
cggaacuugcgccgacc

SEQ ID NO: 1563066 - RNA, 22 nt, Pseudomonas aeruginosa PA01
cggaacuugucgccgcuggacg

SEQ ID NO: 1563067 - RNA, 13 nt, Pseudomonas aeruginosa PA01
cggaagaugguuu

SEQ ID NO: 1563068 - RNA, 16 nt, Pseudomonas aeruginosa PA01
cggaagagguacggcc

SEQ ID NO: 1563069 - RNA, 18 nt, Pseudomonas aeruginosa PA01
cggaagagguacggccuu

SEQ ID NO: 1563070 - RNA, 18 nt, Pseudomonas aeruginosa PA01
cggaaauacggcuccggc

SEQ ID NO: 1563071 - RNA, 14 nt, Pseudomonas aeruginosa PA01
cggaaagcagggcg

SEQ ID NO: 1563072 - RNA, 15 nt, Pseudomonas aeruginosa PA01
cggaaacacagcacg

SEQ ID NO: 1563073 - RNA, 20 nt, Pseudomonas aeruginosa PA01
cggaaaccucgccggucagg

SEQ ID NO: 1563074 - RNA, 15 nt, Pseudomonas aeruginosa PA01
cggaaacgcgcgcuc

SEQ ID NO: 1563075 - RNA, 16 nt, Pseudomonas aeruginosa PA01
cggaaaccgcauugac

SEQ ID NO: 1563076 - RNA, 13 nt, Pseudomonas aeruginosa PA01
cggaacaccgccu

SEQ ID NO: 1563077 - RNA, 14 nt, Pseudomonas aeruginosa PA01
cggaacccgcgcag

SEQ ID NO: 1563078 - RNA, 21 nt, Pseudomonas aeruginosa PA01
cggaacccgcgcaguuccuuc

SEQ ID NO: 1563079 - RNA, 22 nt, Pseudomonas aeruginosa PA01
cggagcgcgaaagcgccccggg

SEQ ID NO: 1563080 - RNA, 22 nt, Pseudomonas aeruginosa PA01
cggagcgcgaggcgaguaccac

SEQ ID NO: 1563081 - RNA, 15 nt, Pseudomonas aeruginosa PA01
cggagcggcugccga

SEQ ID NO: 1563082 - RNA, 19 nt, Pseudomonas aeruginosa PA01
cggagcggcugccgaggcu

SEQ ID NO: 1563083 - RNA, 17 nt, Pseudomonas aeruginosa PA01
cggagcguccaccagcg

SEQ ID NO: 1563084 - RNA, 20 nt, Pseudomonas aeruginosa PA01
cggagcguccaccagcgccc

SEQ ID NO: 1563085 - RNA, 23 nt, Pseudomonas aeruginosa PA01
cggagcgucgggcgggaucaggu

SEQ ID NO: 1563086 - RNA, 16 nt, Pseudomonas aeruginosa PA01
cggagagcagcagcuc

SEQ ID NO: 1563087 - RNA, 22 nt, Pseudomonas aeruginosa PA01
cggagacguuggugauguugcg

SEQ ID NO: 1563088 - RNA, 21 nt, Pseudomonas aeruginosa PA01
cggagagacccgccagcggca

SEQ ID NO: 1563089 - RNA, 22 nt, Pseudomonas aeruginosa PA01
cggagauccccuccuccagcag

SEQ ID NO: 1563090 - RNA, 22 nt, Pseudomonas aeruginosa PA01
cggagcaccgcgccuuccagcc

SEQ ID NO: 1563091 - RNA, 14 nt, Pseudomonas aeruginosa PA01
cggagccaacgccc

SEQ ID NO: 1563092 - RNA, 12 nt, Pseudomonas aeruginosa PA01
cggagccaccgg

SEQ ID NO: 1563093 - RNA, 21 nt, Pseudomonas aeruginosa PA01
cggagccaccgggaucuggcc

SEQ ID NO: 1563094 - RNA, 18 nt, Pseudomonas aeruginosa PA01
cggacgcagcgggucgau

SEQ ID NO: 1563095 - RNA, 18 nt, Pseudomonas aeruginosa PA01
cggacgggccgcgccgca

SEQ ID NO: 1563096 - RNA, 17 nt, Pseudomonas aeruginosa PA01
cggacgcugggcugggu

SEQ ID NO: 1563097 - RNA, 14 nt, Pseudomonas aeruginosa PA01
cggacgcuuguccu

SEQ ID NO: 1563098 - RNA, 23 nt, Pseudomonas aeruginosa PA01
cggacgcggcuggcgcaggaccg

SEQ ID NO: 1563099 - RNA, 18 nt, Pseudomonas aeruginosa PA01
cggacguuccaccuggcg

SEQ ID NO: 1563100 - RNA, 11 nt, Pseudomonas aeruginosa PA01
cggagaagggc

SEQ ID NO: 1563101 - RNA, 17 nt, Pseudomonas aeruginosa PA01
cggagaagggcgcgccc

SEQ ID NO: 1563102 - RNA, 20 nt, Pseudomonas aeruginosa PA01
cggagaacaguugcagggug

SEQ ID NO: 1563103 - RNA, 17 nt, Pseudomonas aeruginosa PA01
cggagacgauggcgacg

SEQ ID NO: 1563104 - RNA, 23 nt, Pseudomonas aeruginosa PA01
cggagaacagcagcggcaccagc

SEQ ID NO: 1563105 - RNA, 16 nt, Pseudomonas aeruginosa PA01
cggagaacagcgagac

SEQ ID NO: 1563106 - RNA, 23 nt, Pseudomonas aeruginosa PA01
cggacugcccgacgaagacgcuc

SEQ ID NO: 1563107 - RNA, 16 nt, Pseudomonas aeruginosa PA01
cggacugguaggacag

SEQ ID NO: 1563108 - RNA, 18 nt, Pseudomonas aeruginosa PA01
cggacaacaggccgggcg

SEQ ID NO: 1563109 - RNA, 21 nt, Pseudomonas aeruginosa PA01
cggaaugcuuccguaggugga

SEQ ID NO: 1563110 - RNA, 13 nt, Pseudomonas aeruginosa PA01
cggaaugucaggg

SEQ ID NO: 1563111 - RNA, 19 nt, Pseudomonas aeruginosa PA01
cggacgcaccagcaggccg

SEQ ID NO: 1563112 - RNA, 13 nt, Pseudomonas aeruginosa PA01
cggaccuugucca

SEQ ID NO: 1563113 - RNA, 19 nt, Pseudomonas aeruginosa PA01
cggacgccguagcggccuc

SEQ ID NO: 1563114 - RNA, 12 nt, Pseudomonas aeruginosa PA01
cggaccgcaacc

SEQ ID NO: 1563115 - RNA, 23 nt, Pseudomonas aeruginosa PA01
cggaccgaaggcaacagcccgcg

SEQ ID NO: 1563116 - RNA, 15 nt, Pseudomonas aeruginosa PA01
cggaccgccucgacc

SEQ ID NO: 1563117 - RNA, 15 nt, Pseudomonas aeruginosa PA01
cggaccuccgccagg

SEQ ID NO: 1563118 - RNA, 14 nt, Pseudomonas aeruginosa PA01
cggaccucucucgc

SEQ ID NO: 1563119 - RNA, 21 nt, Pseudomonas aeruginosa PA01
cggaccuucgacggcaggugg

SEQ ID NO: 1563120 - RNA, 16 nt, Pseudomonas aeruginosa PA01
cggacgaaccccggau

SEQ ID NO: 1563121 - RNA, 12 nt, Pseudomonas aeruginosa PA01
cggaccagccgg

SEQ ID NO: 1563122 - RNA, 13 nt, Pseudomonas aeruginosa PA01
cggaccagcuccg

SEQ ID NO: 1563123 - RNA, 17 nt, Pseudomonas aeruginosa PA01
cggaccagggcgccggg

SEQ ID NO: 1563124 - RNA, 20 nt, Pseudomonas aeruginosa PA01
cggaccagaucggcgcgcag

SEQ ID NO: 1563125 - RNA, 21 nt, Pseudomonas aeruginosa PA01
cggaccagaucggcgcgcagg

SEQ ID NO: 1563126 - RNA, 17 nt, Pseudomonas aeruginosa PA01
cggacccaguugggcca

SEQ ID NO: 1563127 - RNA, 15 nt, Pseudomonas aeruginosa PA01
cggacccgcgccggc

SEQ ID NO: 1563128 - RNA, 21 nt, Pseudomonas aeruginosa PA01
cggacagguuggcgccgggcg

SEQ ID NO: 1563129 - RNA, 14 nt, Pseudomonas aeruginosa PA01
cggacaggcagccg

SEQ ID NO: 1563130 - RNA, 15 nt, Pseudomonas aeruginosa PA01
cggacagguuggcgc

SEQ ID NO: 1563131 - RNA, 15 nt, Pseudomonas aeruginosa PA01
cggcacucagccagc

SEQ ID NO: 1563132 - RNA, 20 nt, Pseudomonas aeruginosa PA01
cggcacucagccagcggcgc

SEQ ID NO: 1563133 - RNA, 21 nt, Pseudomonas aeruginosa PA01
cggcacuccggcauaccgccc

SEQ ID NO: 1563134 - RNA, 23 nt, Pseudomonas aeruginosa PA01
cggcacuccggcauaccgcccgu

SEQ ID NO: 1563135 - RNA, 21 nt, Pseudomonas aeruginosa PA01
cggcaccucgauggcggcggc

SEQ ID NO: 1563136 - RNA, 23 nt, Pseudomonas aeruginosa PA01
cggcaccggggugauccagcugg

SEQ ID NO: 1563137 - RNA, 21 nt, Pseudomonas aeruginosa PA01
cggcacggucauggccagcuc

SEQ ID NO: 1563138 - RNA, 15 nt, Pseudomonas aeruginosa PA01
cggcaccgcucugca

SEQ ID NO: 1563139 - RNA, 15 nt, Pseudomonas aeruginosa PA01
cggcacccggcuggg

SEQ ID NO: 1563140 - RNA, 16 nt, Pseudomonas aeruginosa PA01
cggcacccggcugggu

SEQ ID NO: 1563141 - RNA, 18 nt, Pseudomonas aeruginosa PA01
cggcacccugaccgcgag

SEQ ID NO: 1563142 - RNA, 19 nt, Pseudomonas aeruginosa PA01
cggcacccugaccgcgagc

SEQ ID NO: 1563143 - RNA, 22 nt, Pseudomonas aeruginosa PA01
cggcaccgagagcugcaaggcu

SEQ ID NO: 1563144 - RNA, 22 nt, Pseudomonas aeruginosa PA01
cggcaccagggcuucgcgcaga

SEQ ID NO: 1563145 - RNA, 20 nt, Pseudomonas aeruginosa PA01
cggcaccccuugcagccagc

SEQ ID NO: 1563146 - RNA, 14 nt, Pseudomonas aeruginosa PA01
cggcaccagccagg

SEQ ID NO: 1563147 - RNA, 14 nt, Pseudomonas aeruginosa PA01
cggcaccagcacgu

SEQ ID NO: 1563148 - RNA, 13 nt, Pseudomonas aeruginosa PA01
cggcaccaccacc

SEQ ID NO: 1563149 - RNA, 19 nt, Pseudomonas aeruginosa PA01
cggcaccaccagcgcgcgc

SEQ ID NO: 1563150 - RNA, 20 nt, Pseudomonas aeruginosa PA01
cggcaccaccagcgcgcgcu

SEQ ID NO: 1563151 - RNA, 23 nt, Pseudomonas aeruginosa PA01
cggcaccaccagcgcgcgcuggc

SEQ ID NO: 1563152 - RNA, 16 nt, Pseudomonas aeruginosa PA01
cggcaccacgugcagc

SEQ ID NO: 1563153 - RNA, 16 nt, Pseudomonas aeruginosa PA01
cggcaauagccgggcu

SEQ ID NO: 1563154 - RNA, 15 nt, Pseudomonas aeruginosa PA01
cggcaagggccugcu

SEQ ID NO: 1563155 - RNA, 19 nt, Pseudomonas aeruginosa PA01
cggcaagggccugcucagc

SEQ ID NO: 1563156 - RNA, 23 nt, Pseudomonas aeruginosa PA01
cggcaagcgccggcaacagcagc

SEQ ID NO: 1563157 - RNA, 14 nt, Pseudomonas aeruginosa PA01
cggcaagcgugccc

SEQ ID NO: 1563158 - RNA, 21 nt, Pseudomonas aeruginosa PA01
cggcaagcuccgcgauguccc

SEQ ID NO: 1563159 - RNA, 16 nt, Pseudomonas aeruginosa PA01
cggauucucucccagg

SEQ ID NO: 1563160 - RNA, 18 nt, Pseudomonas aeruginosa PA01
cggauuggccgaggugga

SEQ ID NO: 1563161 - RNA, 16 nt, Pseudomonas aeruginosa PA01
cggcaaaugccgggcu

SEQ ID NO: 1563162 - RNA, 17 nt, Pseudomonas aeruginosa PA01
cggauguucuucaccuu

SEQ ID NO: 1563163 - RNA, 21 nt, Pseudomonas aeruginosa PA01
cggauguaguccagcgccgcg

SEQ ID NO: 1563164 - RNA, 14 nt, Pseudomonas aeruginosa PA01
cggauguaguucuu

SEQ ID NO: 1563165 - RNA, 21 nt, Pseudomonas aeruginosa PA01
cggauggcgcggggccccggc

SEQ ID NO: 1563166 - RNA, 15 nt, Pseudomonas aeruginosa PA01
cggauucgcgcagca

SEQ ID NO: 1563167 - RNA, 16 nt, Pseudomonas aeruginosa PA01
cggauucaggcgcgcu

SEQ ID NO: 1563168 - RNA, 20 nt, Pseudomonas aeruginosa PA01
cggauucaggcgcgcucggg

SEQ ID NO: 1563169 - RNA, 17 nt, Pseudomonas aeruginosa PA01
cggauggcgaucgagcu

SEQ ID NO: 1563170 - RNA, 19 nt, Pseudomonas aeruginosa PA01
cggauggccguccaggcug

SEQ ID NO: 1563171 - RNA, 11 nt, Pseudomonas aeruginosa PA01
cggaugccacc

SEQ ID NO: 1563172 - RNA, 17 nt, Pseudomonas aeruginosa PA01
cggaugcacgugcagcu

SEQ ID NO: 1563173 - RNA, 18 nt, Pseudomonas aeruginosa PA01
cggaugcacgugcagcuc

SEQ ID NO: 1563174 - RNA, 12 nt, Pseudomonas aeruginosa PA01
cggaugaccuuc

SEQ ID NO: 1563175 - RNA, 19 nt, Pseudomonas aeruginosa PA01
cggaugacgcaaacgccau

SEQ ID NO: 1563176 - RNA, 18 nt, Pseudomonas aeruginosa PA01
cggaugacgggcgaagac

SEQ ID NO: 1563177 - RNA, 15 nt, Pseudomonas aeruginosa PA01
cggaucgguccccuc

SEQ ID NO: 1563178 - RNA, 20 nt, Pseudomonas aeruginosa PA01
cggaucucaggaccuuccgc

SEQ ID NO: 1563179 - RNA, 18 nt, Pseudomonas aeruginosa PA01
cggaucucgucgccgacc

SEQ ID NO: 1563180 - RNA, 17 nt, Pseudomonas aeruginosa PA01
cggaucgaucagcagca

SEQ ID NO: 1563181 - RNA, 13 nt, Pseudomonas aeruginosa PA01
cggaucgcccggc

SEQ ID NO: 1563182 - RNA, 23 nt, Pseudomonas aeruginosa PA01
cggaucggauagccgugcagcag

SEQ ID NO: 1563183 - RNA, 14 nt, Pseudomonas aeruginosa PA01
cggaucggcccggc

SEQ ID NO: 1563184 - RNA, 15 nt, Pseudomonas aeruginosa PA01
cggauccccucccgc

SEQ ID NO: 1563185 - RNA, 16 nt, Pseudomonas aeruginosa PA01
cggaucaggcuggggu

SEQ ID NO: 1563186 - RNA, 16 nt, Pseudomonas aeruginosa PA01
cggauccggguggaga

SEQ ID NO: 1563187 - RNA, 18 nt, Pseudomonas aeruginosa PA01
cggauauccccccacccg

SEQ ID NO: 1563188 - RNA, 20 nt, Pseudomonas aeruginosa PA01
cggauauccgggcccaggcu

SEQ ID NO: 1563189 - RNA, 20 nt, Pseudomonas aeruginosa PA01
cggauaucggccucggucag

SEQ ID NO: 1563190 - RNA, 16 nt, Pseudomonas aeruginosa PA01
cggauaugcgccgcca

SEQ ID NO: 1563191 - RNA, 20 nt, Pseudomonas aeruginosa PA01
cggauacaggcgcagcagca

SEQ ID NO: 1563192 - RNA, 18 nt, Pseudomonas aeruginosa PA01
cggauagccgugcagcag

SEQ ID NO: 1563193 - RNA, 16 nt, Pseudomonas aeruginosa PA01
cggauaacggcagccg

SEQ ID NO: 1563194 - RNA, 17 nt, Pseudomonas aeruginosa PA01
cggagcuuugcagggcg

SEQ ID NO: 1563195 - RNA, 22 nt, Pseudomonas aeruginosa PA01
cggaggccuucgccgaccaggu

SEQ ID NO: 1563196 - RNA, 17 nt, Pseudomonas aeruginosa PA01
cggaggucgagcagagu

SEQ ID NO: 1563197 - RNA, 20 nt, Pseudomonas aeruginosa PA01
cggagggaaugaagaagccc

SEQ ID NO: 1563198 - RNA, 13 nt, Pseudomonas aeruginosa PA01
cggaggggcggcc

SEQ ID NO: 1563199 - RNA, 14 nt, Pseudomonas aeruginosa PA01
cggaggggcggccg

SEQ ID NO: 1563200 - RNA, 17 nt, Pseudomonas aeruginosa PA01
cggaguagccggcggcg

SEQ ID NO: 1563201 - RNA, 22 nt, Pseudomonas aeruginosa PA01
cggaguucgucaaccagcaccg

SEQ ID NO: 1563202 - RNA, 16 nt, Pseudomonas aeruginosa PA01
cggagugugucggggc

SEQ ID NO: 1563203 - RNA, 16 nt, Pseudomonas aeruginosa PA01
cggaguucgcccgccc

SEQ ID NO: 1563204 - RNA, 18 nt, Human
cuuggggcugaugcaguu

SEQ ID NO: 1563205 - RNA, 15 nt, Human
cuggagggaagccuu

SEQ ID NO: 1563206 - RNA, 20 nt, Human
cucauggaauuggagcucgu

SEQ ID NO: 1563207 - RNA, 15 nt, Human
cucuuagaugcaguu

SEQ ID NO: 1563208 - RNA, 21 nt, Human
uuauuuuaauaauguuucaaa

SEQ ID NO: 1563209 - RNA, 23 nt, Human
uggagggaagccuuggggcugau

SEQ ID NO: 1563210 - RNA, 20 nt, Human
ugggacagucaccucaugga

SEQ ID NO: 1563211 - RNA, 22 nt, Human
acuuccagauccuggaaaucag

SEQ ID NO: 1563212 - RNA, 13 nt, Human
ccagguagagggu

SEQ ID NO: 1563213 - RNA, 12 nt, Human
ccacaagacugc

SEQ ID NO: 1563214 - RNA, 17 nt, Human
cccagccagcacagccu

SEQ ID NO: 1563215 - RNA, 16 nt, Human
caggaaccacaagacu

SEQ ID NO: 1563216 - RNA, 20 nt, Human
caggaugguucccuugauga

SEQ ID NO: 1563217 - RNA, 17 nt, Human
cauggaauuggagcucg

SEQ ID NO: 1563218 - RNA, 16 nt, Human
ccaagcauuuagaugu

SEQ ID NO: 1563219 - RNA, 21 nt, Human
caugggacauuugcucaugga

SEQ ID NO: 1563220 - RNA, 20 nt, Human
cugggacaggggagaaccua

SEQ ID NO: 1563221 - RNA, 18 nt, Human
ugggacagucaccucaug

SEQ ID NO: 1563222 - RNA, 19 nt, Human
ugggacauuugcucaugga

SEQ ID NO: 1563223 - RNA, 21 nt, Human
ugguauguuuucaggcuagau

SEQ ID NO: 1563224 - RNA, 21 nt, Human
ugaaagguacuucaaauccuu

SEQ ID NO: 1563225 - RNA, 18 nt, Human
uaccacaggaaccacaag

SEQ ID NO: 1563226 - RNA, 13 nt, Human
uauuguuugcuaa

SEQ ID NO: 1563227 - RNA, 23 nt, Human
ggcacuguggguagacacacaug

SEQ ID NO: 1563228 - RNA, 22 nt, Human
ggugguauguuuucaggcuaga

SEQ ID NO: 1563229 - RNA, 14 nt, Human
uuguguuuugcaag

SEQ ID NO: 1563230 - RNA, 11 nt, Human
acugaaaucau

SEQ ID NO: 1563231 - RNA, 21 nt, Human
accucauggaauuggagcucg

SEQ ID NO: 1563232 - RNA, 18 nt, Human
agcucguggaacaguuac

SEQ ID NO: 1563233 - RNA, 13 nt, Human
agcuccagguaga

SEQ ID NO: 1563234 - RNA, 18 nt, Human
cauggaauuggagcucgu

SEQ ID NO: 1563235 - RNA, 23 nt, Human
caucuagugagcagucaggaaag

SEQ ID NO: 1563236 - RNA, 14 nt, Human
cauuuccaagcaag

SEQ ID NO: 1563237 - RNA, 23 nt, Human
cagcccuucuuuccacagaagcu

SEQ ID NO: 1563238 - RNA, 15 nt, Human
cagucaccucaugga

SEQ ID NO: 1563239 - RNA, 22 nt, Human
caacuccagaaagugacaagcu

SEQ ID NO: 1563240 - RNA, 13 nt, Human
cacaggacagccc

SEQ ID NO: 1563241 - RNA, 18 nt, Human
agcucgugggacagucac

SEQ ID NO: 1563242 - RNA, 23 nt, Human
ugccaugugcuaguaauuggaaa

SEQ ID NO: 1563243 - RNA, 18 nt, Human
gggagaaccuagggugau

SEQ ID NO: 1563244 - RNA, 21 nt, Human
uaccucugccucagaaaacaa

SEQ ID NO: 1563245 - RNA, 15 nt, Human
ucauggaauuggagc

SEQ ID NO: 1563246 - RNA, 18 nt, Human
ucauggaauuggagcucg

SEQ ID NO: 1563247 - RNA, 18 nt, Human
gacucuuaagaagacugc

SEQ ID NO: 1563248 - RNA, 20 nt, Human
aauuuuuucucuaggaaaua

SEQ ID NO: 1563249 - RNA, 13 nt, Human
cuaugaaauauua

SEQ ID NO: 1563250 - RNA, 15 nt, Human
cuaguaauuggaaag

SEQ ID NO: 1563251 - RNA, 12 nt, Human
uuuuuuuuaaaa

SEQ ID NO: 1563252 - RNA, 22 nt, Human
ugaagcaaaauuuuuucucuag

SEQ ID NO: 1563253 - RNA, 17 nt, Human
cucgugggacagucacc

SEQ ID NO: 1563254 - RNA, 14 nt, Human
ccuugaugaagaag

SEQ ID NO: 1563255 - RNA, 21 nt, Human
aauuaaguuuuuuuuuaaaaa

SEQ ID NO: 1563256 - RNA, 21 nt, Human
aguuguugcccacagcuguau

SEQ ID NO: 1563257 - RNA, 19 nt, Human
uggaacaguuaccucugcc

SEQ ID NO: 1563258 - RNA, 12 nt, Human
ugagagacacac

SEQ ID NO: 1563259 - RNA, 13 nt, Human
uuuaaaaaagaaa

SEQ ID NO: 1563260 - RNA, 17 nt, Human
aacaguuaccucugccu

SEQ ID NO: 1563261 - RNA, 15 nt, Human
ugcuguauuuuaaaa

SEQ ID NO: 1563262 - RNA, 17 nt, Human
aguauuucuaugaaaua

SEQ ID NO: 1563263 - RNA, 23 nt, Human
agaguuuagcuggaaaaguaugu

SEQ ID NO: 1563264 - RNA, 14 nt, Human
auuuguauaaaaua

SEQ ID NO: 1563265 - RNA, 17 nt, Human
auuuuaauaauguuuca

SEQ ID NO: 1563266 - RNA, 14 nt, Human
uauuuauuuuaaua

SEQ ID NO: 1563267 - RNA, 15 nt, Human
aaugauuaugaauua

SEQ ID NO: 1563268 - RNA, 18 nt, Human
gaaaauaucacuugucaa

SEQ ID NO: 1563269 - RNA, 16 nt, Human
uaaaauccauacauuu

SEQ ID NO: 1563270 - RNA, 14 nt, Human
cucugccucagaaa

SEQ ID NO: 1563271 - RNA, 21 nt, Human
gcacuguggguagacacacau

SEQ ID NO: 1563272 - RNA, 13 nt, Human
uauuuauuuuaau

SEQ ID NO: 1563273 - RNA, 18 nt, Human
cagcuuauugucuaguga

SEQ ID NO: 1563274 - RNA, 17 nt, Human
ucauacuucuuaggguu

SEQ ID NO: 1563275 - RNA, 19 nt, Human
caucaaggguacacugccu

SEQ ID NO: 1563276 - RNA, 19 nt, Human
acauuuguauaaaauaauu

SEQ ID NO: 1563277 - RNA, 18 nt, Human
gaagcaaaauuuuuucuc

SEQ ID NO: 1563278 - RNA, 16 nt, Human
gagcucgugggacagu

SEQ ID NO: 1563279 - RNA, 12 nt, Human
uuuuauauuuga

SEQ ID NO: 1563280 - RNA, 15 nt, Human
uugcucauggaauug

SEQ ID NO: 1563281 - RNA, 23 nt, Human
uuagaugcaguucugaagaagau

SEQ ID NO: 1563282 - RNA, 22 nt, Human
agaaagugacaagcucacagac

SEQ ID NO: 1563283 - RNA, 18 nt, Human
auguuaaaacugggacag

SEQ ID NO: 1563284 - RNA, 14 nt, Human
auauuuauuuuaau

SEQ ID NO: 1563285 - RNA, 15 nt, Human
agugacaagcucaca

SEQ ID NO: 1563286 - RNA, 21 nt, Human
aaauaauuuuuauauuugaaa

SEQ ID NO: 1563287 - RNA, 18 nt, Human
acugccuucucaacucca

SEQ ID NO: 1563288 - RNA, 22 nt, Human
caaugcuguauuuuaaaagaau

SEQ ID NO: 1563289 - RNA, 22 nt, Human
uuuauggcacuaguauuucuau

SEQ ID NO: 1563290 - RNA, 21 nt, Human
auuauauuuauuacuguaaga

SEQ ID NO: 1563291 - RNA, 15 nt, Human
acugaagaagcacca

SEQ ID NO: 1563292 - RNA, 16 nt, Human
ugacaagcucacagac

SEQ ID NO: 1563293 - RNA, 15 nt, Human
auuugguaaggggaa

SEQ ID NO: 1563294 - RNA, 17 nt, Human
aggguguguaaguagau

SEQ ID NO: 1563295 - RNA, 22 nt, Human
uaaaauaauuuuuauauuugaa

SEQ ID NO: 1563296 - RNA, 19 nt, Human
aguauuucuaugaaauauu

SEQ ID NO: 1563297 - RNA, 13 nt, Human
acagcccuucuuu

SEQ ID NO: 1563298 - RNA, 19 nt, Human
aaauaugccccauucaaca

SEQ ID NO: 1563299 - RNA, 21 nt, Human
agggugauauuaaccaggggc

SEQ ID NO: 1563300 - RNA, 17 nt, Human
aucaaggguacacugcc

SEQ ID NO: 1563301 - RNA, 14 nt, Human
agcucguggaacag

SEQ ID NO: 1563302 - RNA, 22 nt, Human
cacuaguauuucuaugaaauau

SEQ ID NO: 1563303 - RNA, 16 nt, Human
uucucuaggaaauauu

SEQ ID NO: 1563304 - RNA, 20 nt, Human
aaucuuucacaggggacagg

SEQ ID NO: 1563305 - RNA, 22 nt, Human
uauuccuuuuucucuccucucc

SEQ ID NO: 1563306 - RNA, 17 nt, Human
uucucuaggaaauauuu

SEQ ID NO: 1563307 - RNA, 18 nt, Human
auuaaguuuuuuuuuaaa

SEQ ID NO: 1563308 - RNA, 20 nt, Human
accucauggaauuggagcuc

SEQ ID NO: 1563309 - RNA, 18 nt, Human
uggagggaagccuugggg

SEQ ID NO: 1563310 - RNA, 18 nt, Human
uuuauggcacuaguauuu

SEQ ID NO: 1563311 - RNA, 16 nt, Human
acauuugcucauggaa

SEQ ID NO: 1563312 - RNA, 20 nt, Human
agaagaacugaaaucauacu

SEQ ID NO: 1563313 - RNA, 20 nt, Human
auaacaaugcuguauuuuaa

SEQ ID NO: 1563314 - RNA, 16 nt, Human
uacauuuguauaaaau

SEQ ID NO: 1563315 - RNA, 14 nt, Human
cuggaaaucagggu

SEQ ID NO: 1563316 - RNA, 19 nt, Human
aggucuaccaaaaaucuca

SEQ ID NO: 1563317 - RNA, 19 nt, Human
uacuucuuaggguuaugau

SEQ ID NO: 1563318 - RNA, 21 nt, Human
aaaauaugccccauucaacau

SEQ ID NO: 1563319 - RNA, 19 nt, Human
cucugccucagaaaacaag

SEQ ID NO: 1563320 - RNA, 21 nt, Human
ucuuaggguuaugauuaagua

SEQ ID NO: 1563321 - RNA, 15 nt, Human
ggcaauagucaaauu

SEQ ID NO: 1563322 - RNA, 21 nt, Human
caagacugcacaucaaaauau

SEQ ID NO: 1563323 - RNA, 23 nt, Human
aggaugguucccuugaugaagaa

SEQ ID NO: 1563324 - RNA, 19 nt, Human
aagcuuguauuccuuuuuc

SEQ ID NO: 1563325 - RNA, 19 nt, Human
uagugagcagucaggaaag

SEQ ID NO: 1563326 - RNA, 21 nt, Human
gacagucaccucauggaauug

SEQ ID NO: 1563327 - RNA, 16 nt, Human
augcuguauuuuaaaa

SEQ ID NO: 1563328 - RNA, 22 nt, Human
agcuuguauuccuuuuucucuc

SEQ ID NO: 1563329 - RNA, 12 nt, Human
uaagaagacugc

SEQ ID NO: 1563330 - RNA, 14 nt, Human
ugcuguauuuuaaa

SEQ ID NO: 1563331 - RNA, 18 nt, Human
uacauuuguauaaaauaa

SEQ ID NO: 1563332 - RNA, 18 nt, Human
gaagcaccaaucaugaau

SEQ ID NO: 1563333 - RNA, 14 nt, Human
ucccuugaugaaga

SEQ ID NO: 1563334 - RNA, 19 nt, Human
cuuccagauccuggaaauc

SEQ ID NO: 1563335 - RNA, 15 nt, Human
ccuugccaugugcua

SEQ ID NO: 1563336 - RNA, 16 nt, Human
gacauuugcucaugga

SEQ ID NO: 1563337 - RNA, 14 nt, Human
gaaugauuaugaau

SEQ ID NO: 1563338 - RNA, 22 nt, Human
aauuacauuuguauaaaauaau

SEQ ID NO: 1563339 - RNA, 18 nt, Human
uucucuaggaaauauuua

SEQ ID NO: 1563340 - RNA, 16 nt, Human
ugcuguauuuuaaaag

SEQ ID NO: 1563341 - RNA, 23 nt, Human
uguugcccacagcuguaugauuc

SEQ ID NO: 1563342 - RNA, 22 nt, Human
uagacacacaugaaguccaagc

SEQ ID NO: 1563343 - RNA, 23 nt, Human
uuuccaucaaggguacacugccu

SEQ ID NO: 1563344 - RNA, 19 nt, Human
augaauuacauuuguauaa

SEQ ID NO: 1563345 - RNA, 20 nt, Human
acagcccuucuuuccacaga

SEQ ID NO: 1563346 - RNA, 19 nt, Human
gcuuguauuccuuuuucuc

SEQ ID NO: 1563347 - RNA, 15 nt, Human
agaauaccacaggaa

SEQ ID NO: 1563348 - RNA, 15 nt, Human
gcacagccucuuaga

SEQ ID NO: 1563349 - RNA, 12 nt, Human
guagacacacau

SEQ ID NO: 1563350 - RNA, 15 nt, Human
cuuuucccaacucca

SEQ ID NO: 1563351 - RNA, 22 nt, Human
gaugcaguuguugcccacagcu

SEQ ID NO: 1563352 - RNA, 17 nt, Human
auguugacaugggacau

SEQ ID NO: 1563353 - RNA, 22 nt, Human
agaaugagagacacacugaaga

SEQ ID NO: 1563354 - RNA, 20 nt, Human
agccuuggggcugaugcagu

SEQ ID NO: 1563355 - RNA, 19 nt, Human
uaucucauuuccaagcaag

SEQ ID NO: 1563356 - RNA, 17 nt, Human
aaagaaacauuugguaa

SEQ ID NO: 1563357 - RNA, 16 nt, Human
accucugccucagaaa

SEQ ID NO: 1563358 - RNA, 16 nt, Human
uuuucucuaggaaaua

SEQ ID NO: 1563359 - RNA, 18 nt, Human
cuggaaacuucagcgguu

SEQ ID NO: 1563360 - RNA, 15 nt, Human
ugcuucuguuuuaua

SEQ ID NO: 1563361 - RNA, 12 nt, Human
auuuuaaaagaa

SEQ ID NO: 1563362 - RNA, 15 nt, Human
augauaacuggaaac

SEQ ID NO: 1563363 - RNA, 17 nt, Human
aaucuuucacaggggac

SEQ ID NO: 1563364 - RNA, 21 nt, Human
auaauuuuuauauuugaaaua

SEQ ID NO: 1563365 - RNA, 18 nt, Human
ucaaggguacacugccuu

SEQ ID NO: 1563366 - RNA, 23 nt, Human
aguaauuggaaaggcagcucuaa

SEQ ID NO: 1563367 - RNA, 19 nt, Human
auuuugugaagcaaaauuu

SEQ ID NO: 1563368 - RNA, 22 nt, Human
gaugcaguucugaagaagaugg

SEQ ID NO: 1563369 - RNA, 21 nt, Human
aaaauuuuuucucuaggaaau

SEQ ID NO: 1563370 - RNA, 12 nt, Human
cauuauauuuau

SEQ ID NO: 1563371 - RNA, 13 nt, Human
uaauuuuuauauu

SEQ ID NO: 1563372 - RNA, 14 nt, Human
guauuuuaaaagaa

SEQ ID NO: 1563373 - RNA, 15 nt, Human
aaauaauuuuuauau

SEQ ID NO: 1563374 - RNA, 21 nt, Human
uauuacuguaagaaaauauca

SEQ ID NO: 1563375 - RNA, 17 nt, Human
cucguggaacaguuacc

SEQ ID NO: 1563376 - RNA, 18 nt, Human
cuuuucccaacuccagaa

SEQ ID NO: 1563377 - RNA, 19 nt, Human
ugggacaggggagaaccua

SEQ ID NO: 1563378 - RNA, 19 nt, Human
uuuccugaaaacccuugcc

SEQ ID NO: 1563379 - RNA, 20 nt, Human
uuaaguuuuuuuuuaaaaaa

SEQ ID NO: 1563380 - RNA, 15 nt, Human
agucaccucauggaa

SEQ ID NO: 1563381 - RNA, 16 nt, Human
ugcacaucaaaauaug

SEQ ID NO: 1563382 - RNA, 23 nt, Human
ucuaccaaaaaucucaauauuuc

SEQ ID NO: 1563383 - RNA, 17 nt, Human
uugugaagcaaaauuuu

SEQ ID NO: 1563384 - RNA, 18 nt, Human
uuauuacuguaagaaaau

SEQ ID NO: 1563385 - RNA, 18 nt, Human
ucuaugaaauauuauguu

SEQ ID NO: 1563386 - RNA, 15 nt, Human
uuaauuuguaguguu

SEQ ID NO: 1563387 - RNA, 21 nt, Human
uuuauauaagcuuguauuccu

SEQ ID NO: 1563388 - RNA, 14 nt, Human
agucugacuguuuc

SEQ ID NO: 1563389 - RNA, 19 nt, Human
uguaguguuggagaagaac

SEQ ID NO: 1563390 - RNA, 19 nt, Human
auaauuuuuauauuugaaa

SEQ ID NO: 1563391 - RNA, 19 nt, Human
gacagucaccucauggaau

SEQ ID NO: 1563392 - RNA, 12 nt, Human
caggacagcccu

SEQ ID NO: 1563393 - RNA, 19 nt, Human
uaucacuugucaauaaaau

SEQ ID NO: 1563394 - RNA, 21 nt, Human
gcaaaauuuuuucucuaggaa

SEQ ID NO: 1563395 - RNA, 22 nt, Human
aguauguuagugcaaauuguca

SEQ ID NO: 1563396 - RNA, 21 nt, Human
auuccuuuuucucuccucucc

SEQ ID NO: 1563397 - RNA, 22 nt, Human
gaugguucccuugaugaagaag

SEQ ID NO: 1563398 - RNA, 13 nt, Human
cucagaaaacaag

SEQ ID NO: 1563399 - RNA, 23 nt, Human
uagauguauagguugaugguggu

SEQ ID NO: 1563400 - RNA, 16 nt, Human
uugucaauaaaaucca

SEQ ID NO: 1563401 - RNA, 18 nt, Human
gccuuggggcugaugcag

SEQ ID NO: 1563402 - RNA, 23 nt, Human
uccagguagaggguguguaagua

SEQ ID NO: 1563403 - RNA, 21 nt, Human
aauuuuuauauuugaaauauu

SEQ ID NO: 1563404 - RNA, 16 nt, Human
aauuacauuuguauaa

SEQ ID NO: 1563405 - RNA, 22 nt, Human
agugagcagucaggaaagagaa

SEQ ID NO: 1563406 - RNA, 15 nt, Human
uguauuuuaaaagaa

SEQ ID NO: 1563407 - RNA, 22 nt, Human
auauauaacaaugcuguauuuu

SEQ ID NO: 1563408 - RNA, 20 nt, Human
aauuuugugaagcaaaauuu

SEQ ID NO: 1563409 - RNA, 18 nt, Human
caugaauuaguuuuauau

SEQ ID NO: 1563410 - RNA, 22 nt, Human
agaagcaccaaucaugaauuag

SEQ ID NO: 1563411 - RNA, 16 nt, Human
ugaaguccaagcauuu

SEQ ID NO: 1563412 - RNA, 15 nt, Human
aaauauuuauuuuaa

SEQ ID NO: 1563413 - RNA, 20 nt, Human
aaauaauuuuuauauuugaa

SEQ ID NO: 1563414 - RNA, 21 nt, Human
uagggugauauuaaccagggg

SEQ ID NO: 1563415 - RNA, 19 nt, Human
aauuuuuauauuugaaaua

SEQ ID NO: 1563416 - RNA, 22 nt, Human
agcacagccucuuagaugcagu

SEQ ID NO: 1563417 - RNA, 17 nt, Human
uuauuacuguaagaaaa

SEQ ID NO: 1563418 - RNA, 19 nt, Human
gcucauggaauuggagcuc

SEQ ID NO: 1563419 - RNA, 12 nt, Human
gcugaugcaguu

SEQ ID NO: 1563420 - RNA, 19 nt, Human
cucauggaauuggagcucg

SEQ ID NO: 1563421 - RNA, 22 nt, Human
auuacuguaagaaaauaucacu

SEQ ID NO: 1563422 - RNA, 11 nt, Human
uucacagggga

SEQ ID NO: 1563423 - RNA, 15 nt, Human
ccagcacagccucuu

SEQ ID NO: 1563424 - RNA, 17 nt, Human
aaccuagggugauauua

SEQ ID NO: 1563425 - RNA, 13 nt, Human
cacacugaagaag

SEQ ID NO: 1563426 - RNA, 23 nt, Human
ggaacaguuaccucugccucaga

SEQ ID NO: 1563427 - RNA, 16 nt, Human
aaauauuauguuaaaa

SEQ ID NO: 1563428 - RNA, 15 nt, Human
aaggguacacugccu

SEQ ID NO: 1563429 - RNA, 21 nt, Human
auuuuuucucuaggaaauauu

SEQ ID NO: 1563430 - RNA, 20 nt, Human
agagacacacugaagaagca

SEQ ID NO: 1563431 - RNA, 14 nt, Human
uucuaugaaauauu

SEQ ID NO: 1563432 - RNA, 17 nt, Human
augauuaaguaaugaua

SEQ ID NO: 1563433 - RNA, 18 nt, Human
uauaacaaugcuguauuu

SEQ ID NO: 1563434 - RNA, 21 nt, Human
uaguauuucuaugaaauauua

SEQ ID NO: 1563435 - RNA, 15 nt, Human
gcuguauuuuaaaag

SEQ ID NO: 1563436 - RNA, 16 nt, Human
auuuguauaaaauaau

SEQ ID NO: 1563437 - RNA, 16 nt, Human
gacaagcucacagacc

SEQ ID NO: 1563438 - RNA, 16 nt, Human
gccaugugcuaguaau

SEQ ID NO: 1563439 - RNA, 16 nt, Human
aagacugcacaucaaa

SEQ ID NO: 1563440 - RNA, 23 nt, Human
uuuauaugcuucuguuuuauaau

SEQ ID NO: 1563441 - RNA, 20 nt, Human
uuugcaagccagauuuuccu

SEQ ID NO: 1563442 - RNA, 21 nt, Human
uuuguauaaaauaauuuuuau

SEQ ID NO: 1563443 - RNA, 14 nt, Human
caguucugaagaag

SEQ ID NO: 1563444 - RNA, 21 nt, Human
aggguuaugauuaaguaauga

SEQ ID NO: 1563445 - RNA, 14 nt, Human
ucuaggaaauauuu

SEQ ID NO: 1563446 - RNA, 15 nt, Human
guaaggggaauugag

SEQ ID NO: 1563447 - RNA, 16 nt, Human
guuuuuuuuuaaaaaa

SEQ ID NO: 1563448 - RNA, 17 nt, Human
cuaucucauuuccaagc

SEQ ID NO: 1563449 - RNA, 18 nt, Human
auuuguauaaaauaauuu

SEQ ID NO: 1563450 - RNA, 14 nt, Human
auugucuagugaaa

SEQ ID NO: 1563451 - RNA, 13 nt, Human
aaauccuugaaga

SEQ ID NO: 1563452 - RNA, 14 nt, Human
auuucuaugaaaua

SEQ ID NO: 1563453 - RNA, 19 nt, Human
uuauggcacuaguauuucu

SEQ ID NO: 1563454 - RNA, 22 nt, Human
cuuuccacagaagcuccaggua

SEQ ID NO: 1563455 - RNA, 13 nt, Human
gaaccuaggguga

SEQ ID NO: 1563456 - RNA, 17 nt, Human
auauuugaaauauugac

SEQ ID NO: 1563457 - RNA, 16 nt, Human
aagcauuuagauguau

SEQ ID NO: 1563458 - RNA, 18 nt, Human
gacauuugcucauggaau

SEQ ID NO: 1563459 - RNA, 16 nt, Human
ucucuaggaaauauuu

SEQ ID NO: 1563460 - RNA, 18 nt, Human
acauuugcucauggaauu

SEQ ID NO: 1563461 - RNA, 23 nt, Human
ggaugguucccuugaugaagaag

SEQ ID NO: 1563462 - RNA, 13 nt, Human
acacacaugaagu

SEQ ID NO: 1563463 - RNA, 18 nt, Human
guuucaaacauauauaac

SEQ ID NO: 1563464 - RNA, 21 nt, Human
aggacagcccuucuuuccaca

SEQ ID NO: 1563465 - RNA, 15 nt, Human
auauugacuuuuuau

SEQ ID NO: 1563466 - RNA, 23 nt, Human
caccucauggaauuggagcucgu

SEQ ID NO: 1563467 - RNA, 12 nt, Human
ucuuaagaagac

SEQ ID NO: 1563468 - RNA, 18 nt, Human
guuaguauuguccagguc

SEQ ID NO: 1563469 - RNA, 13 nt, Human
uauuucuaugaaa

SEQ ID NO: 1563470 - RNA, 14 nt, Human
uuuguauaaaauaa

SEQ ID NO: 1563471 - RNA, 15 nt, Human
uagggugauauuaac

SEQ ID NO: 1563472 - RNA, 20 nt, Human
aauaauuuuuauauuugaaa

SEQ ID NO: 1563473 - RNA, 15 nt, Human
gccucuuagaugcag

SEQ ID NO: 1563474 - RNA, 17 nt, Human
gcaaauugucacaggac

SEQ ID NO: 1563475 - RNA, 19 nt, Human
cauggaauuggagcucgug

SEQ ID NO: 1563476 - RNA, 19 nt, Human
acuucagcgguuuauauaa

SEQ ID NO: 1563477 - RNA, 23 nt, Human
auguuaaaacugggacaggggag

SEQ ID NO: 1563478 - RNA, 21 nt, Human
gaaaaguauguuagugcaaau

SEQ ID NO: 1563479 - RNA, 20 nt, Human
augcaguuguugcccacagc

SEQ ID NO: 1563480 - RNA, 19 nt, Human
acagucaccucauggaauu

SEQ ID NO: 1563481 - RNA, 17 nt, Human
acacuaagagagaauga

SEQ ID NO: 1563482 - RNA, 20 nt, Human
uguaagaaaauaucacuugu

SEQ ID NO: 1563483 - RNA, 23 nt, Human
ggaugaauuaaguuuuuuuuuaa

SEQ ID NO: 1563484 - RNA, 20 nt, Human
aaauccuugaagauuuacca

SEQ ID NO: 1563485 - RNA, 23 nt, Human
cugaaaucauacuucuuaggguu

SEQ ID NO: 1563486 - RNA, 15 nt, Human
gaaaacaaggaugaa

SEQ ID NO: 1563487 - RNA, 23 nt, Human
uauguuaaaacugggacagggga

SEQ ID NO: 1563488 - RNA, 16 nt, Human
agguacuucaaauccu

SEQ ID NO: 1563489 - RNA, 11 nt, Human
cuguuuuauaa

SEQ ID NO: 1563490 - RNA, 23 nt, Human
uaauuuguaguguuggagaagaa

SEQ ID NO: 1563491 - RNA, 20 nt, Human
ugagagacacacugaagaag

SEQ ID NO: 1563492 - RNA, 11 nt, Human
uuauauuuauu

SEQ ID NO: 1563493 - RNA, 22 nt, Human
cugggacaggggagaaccuagg

SEQ ID NO: 1563494 - RNA, 14 nt, Human
aguuuuuuuuuaaa

SEQ ID NO: 1563495 - RNA, 12 nt, Human
gguuuauauaag

SEQ ID NO: 1563496 - RNA, 22 nt, Human
guacacugccuucucaacucca

SEQ ID NO: 1563497 - RNA, 15 nt, Human
aagccagauuuuccu

SEQ ID NO: 1563498 - RNA, 13 nt, Human
caacaucuaguga

SEQ ID NO: 1563499 - RNA, 18 nt, Human
auagucaaauugugugaa

SEQ ID NO: 1563500 - RNA, 16 nt, Human
uuuauauuugaaauau

SEQ ID NO: 1563501 - RNA, 20 nt, Human
auaaauggcuuccuggcaau

SEQ ID NO: 1563502 - RNA, 12 nt, Human
acacugaagaag

SEQ ID NO: 1563503 - RNA, 15 nt, Human
auuuuaaaagaauga

SEQ ID NO: 1563504 - RNA, 15 nt, Human
uauuuauuuuaauaa

SEQ ID NO: 1563505 - RNA, 14 nt, Human
ggcaauagucaaau

SEQ ID NO: 1563506 - RNA, 23 nt, Human
aauauuuauuuuaauaauguuuc

SEQ ID NO: 1563507 - RNA, 17 nt, Human
ugcacaucaaaauaugc

SEQ ID NO: 1563508 - RNA, 16 nt, Human
cauuuguauaaaauaa

SEQ ID NO: 1563509 - RNA, 20 nt, Human
uaugcuucuguuuuauaauu

SEQ ID NO: 1563510 - RNA, 14 nt, Human
uugccaugugcuag

SEQ ID NO: 1563511 - RNA, 19 nt, Human
aauauuauguuaaaacugg

SEQ ID NO: 1563512 - RNA, 14 nt, Human
acauauauaacaau

SEQ ID NO: 1563513 - RNA, 20 nt, Human
acuagaguuuagcuggaaaa

SEQ ID NO: 1563514 - RNA, 21 nt, Human
auuuuccugaaaacccuugcc

SEQ ID NO: 1563515 - RNA, 18 nt, Human
aaguugauaugccuuuuc

SEQ ID NO: 1563516 - RNA, 13 nt, Human
aguuaccucugcc

SEQ ID NO: 1563517 - RNA, 23 nt, Human
cuugauaaauggcuuccuggcaa

SEQ ID NO: 1563518 - RNA, 14 nt, Human
auuuauuuuaauaa

SEQ ID NO: 1563519 - RNA, 13 nt, Human
uuaaaaaagaaac

SEQ ID NO: 1563520 - RNA, 14 nt, Human
acacugaagaagca

SEQ ID NO: 1563521 - RNA, 20 nt, Human
auuacuguaagaaaauauca

SEQ ID NO: 1563522 - RNA, 15 nt, Human
ccagauccuggaaau

SEQ ID NO: 1563523 - RNA, 20 nt, Human
aagaugguaccaccagucug

SEQ ID NO: 1563524 - RNA, 18 nt, Human
uuuugugaagcaaaauuu

SEQ ID NO: 1563525 - RNA, 12 nt, Human
acugaaaucaua

SEQ ID NO: 1563526 - RNA, 20 nt, Human
agaugcaguucugaagaaga

SEQ ID NO: 1563527 - RNA, 20 nt, Human
aagggcuguuauaaucuuuc

SEQ ID NO: 1563528 - RNA, 21 nt, Human
uuuucaggcuagauguaugua

SEQ ID NO: 1563529 - RNA, 15 nt, Human
cacaggacagcccuu

SEQ ID NO: 1563530 - RNA, 19 nt, Human
gucaaauugugugaaaggu

SEQ ID NO: 1563531 - RNA, 22 nt, Human
aauaugccccauucaacaucua

SEQ ID NO: 1563532 - RNA, 22 nt, Human
gaauuaaguuuuuuuuuaaaaa

SEQ ID NO: 1563533 - RNA, 22 nt, Human
agcagcauaaauguugacaugg

SEQ ID NO: 1563534 - RNA, 14 nt, Human
uuuuaaaaaagaaa

SEQ ID NO: 1563535 - RNA, 12 nt, Human
cucauggaauug

SEQ ID NO: 1563536 - RNA, 14 nt, Human
accacaagacugca

SEQ ID NO: 1563537 - RNA, 13 nt, Human
aggcuagauguau

SEQ ID NO: 1563538 - RNA, 22 nt, Human
uuuccaagcaaguauuagaaua

SEQ ID NO: 1563539 - RNA, 21 nt, Human
auuuguauaaaauaauuuuua

SEQ ID NO: 1563540 - RNA, 16 nt, Human
acaugaaguccaagca

SEQ ID NO: 1563541 - RNA, 16 nt, Human
auaacuggaaacuuca

SEQ ID NO: 1563542 - RNA, 14 nt, Human
ugcucauggaauug

SEQ ID NO: 1563543 - RNA, 15 nt, Human
cugacucuuaagaag

SEQ ID NO: 1563544 - RNA, 19 nt, Human
auucccagccagcacagcc

SEQ ID NO: 1563545 - RNA, 13 nt, Human
auaacuggaaacu

SEQ ID NO: 1563546 - RNA, 22 nt, Human
ccacagcuguaugauucccagc

SEQ ID NO: 1563547 - RNA, 15 nt, Human
auaauuuugugaagc

SEQ ID NO: 1563548 - RNA, 15 nt, Human
augaauuaaguuuuu

SEQ ID NO: 1563549 - RNA, 22 nt, Human
gcacagccucuuagaugcaguu

SEQ ID NO: 1563550 - RNA, 13 nt, Human
aauuuuuauauuu

SEQ ID NO: 1563551 - RNA, 22 nt, Human
uuuaauaauguuucaaacauau

SEQ ID NO: 1563552 - RNA, 17 nt, Human
ccaaaaaucucaauauu

SEQ ID NO: 1563553 - RNA, 15 nt, Human
aguucugaagaagau

SEQ ID NO: 1563554 - RNA, 15 nt, Human
cagccagcacagccu

SEQ ID NO: 1563555 - RNA, 18 nt, Human
cuuuccacagaagcucca

SEQ ID NO: 1563556 - RNA, 18 nt, Human
acugacucuuaagaagac

SEQ ID NO: 1563557 - RNA, 20 nt, Human
uacaucccuuaccugggaaa

SEQ ID NO: 1563558 - RNA, 22 nt, Human
uuaccucugccucagaaaacaa

SEQ ID NO: 1563559 - RNA, 13 nt, Human
ccucauggaauug

SEQ ID NO: 1563560 - RNA, 16 nt, Human
auugucuagugaaacu

SEQ ID NO: 1563561 - RNA, 14 nt, Human
uauuugaaauauug

SEQ ID NO: 1563562 - RNA, 12 nt, Human
uucucuaggaaa

SEQ ID NO: 1563563 - RNA, 17 nt, Human
cuggagggaagccuugg

SEQ ID NO: 1563564 - RNA, 18 nt, Human
aaauauuuauuuuaauaa

SEQ ID NO: 1563565 - RNA, 20 nt, Human
gacauuugcucauggaauug

SEQ ID NO: 1563566 - RNA, 18 nt, Human
aacaaugcuguauuuuaa

SEQ ID NO: 1563567 - RNA, 15 nt, Human
cucguggaacaguua

SEQ ID NO: 1563568 - RNA, 20 nt, Human
uauuuauuacuguaagaaaa

SEQ ID NO: 1563569 - RNA, 21 nt, Human
cuaccaaaaaucucaauauuu

SEQ ID NO: 1563570 - RNA, 15 nt, Human
aaaaaagaaacauuu

SEQ ID NO: 1563571 - RNA, 14 nt, Human
aaugauuaugaauu

SEQ ID NO: 1563572 - RNA, 17 nt, Human
agucugacuguuuccau

SEQ ID NO: 1563573 - RNA, 21 nt, Human
agccucuuagaugcaguucug

SEQ ID NO: 1563574 - RNA, 17 nt, Human
gacagucaccucaugga

SEQ ID NO: 1563575 - RNA, 20 nt, Human
agcuuauugucuagugaaac

SEQ ID NO: 1563576 - RNA, 18 nt, Human
gaugcaguucugaagaag

SEQ ID NO: 1563577 - RNA, 14 nt, Human
agcaaguauuagaa

SEQ ID NO: 1563578 - RNA, 23 nt, Human
gaaugagagacacacugaagaag

SEQ ID NO: 1563579 - RNA, 12 nt, Human
cagauuuuccug

SEQ ID NO: 1563580 - RNA, 18 nt, Human
ucucuaggaaauauuuau

SEQ ID NO: 1563581 - RNA, 22 nt, Human
aauuuuuucucuaggaaauauu

SEQ ID NO: 1563582 - RNA, 19 nt, Human
gucaaucagccuaguugau

SEQ ID NO: 1563583 - RNA, 23 nt, Human
uccaaacugacucuuaagaagac

SEQ ID NO: 1563584 - RNA, 20 nt, Human
augcuucuguuuuauaauuu

SEQ ID NO: 1563585 - RNA, 23 nt, Human
uuuguauaaaauaauuuuuauau

SEQ ID NO: 1563586 - RNA, 23 nt, Human
gauauuaaccaggggccaugaau

SEQ ID NO: 1563587 - RNA, 20 nt, Human
acuucuuaggguuaugauua

SEQ ID NO: 1563588 - RNA, 18 nt, Human
auuuauuacuguaagaaa

SEQ ID NO: 1563589 - RNA, 20 nt, Human
aauuaaguuuuuuuuuaaaa

SEQ ID NO: 1563590 - RNA, 18 nt, Human
uaaaauccauacauuugu

SEQ ID NO: 1563591 - RNA, 14 nt, Human
auaaaauaauuuuu

SEQ ID NO: 1563592 - RNA, 21 nt, Human
agcccuucuuuccacagaagc

SEQ ID NO: 1563593 - RNA, 15 nt, Human
aaucucaauauuuca

SEQ ID NO: 1563594 - RNA, 19 nt, Human
aagcauuccaacuaucuca

SEQ ID NO: 1563595 - RNA, 12 nt, Human
auaacuggaaac

SEQ ID NO: 1563596 - RNA, 10 nt, Human
auguuuucag

SEQ ID NO: 1563597 - RNA, 15 nt, Human
cuuaagaagacugca

SEQ ID NO: 1563598 - RNA, 19 nt, Human
uucccuugaugaagaaguu

SEQ ID NO: 1563599 - RNA, 17 nt, Human
uuauauuugaaauauug

SEQ ID NO: 1563600 - RNA, 21 nt, Human
gccuuuucccaacuccagaaa

SEQ ID NO: 1563601 - RNA, 22 nt, Human
ugggcacuguggguagacacac

SEQ ID NO: 1563602 - RNA, 18 nt, Human
uuuucucuccucucccca

SEQ ID NO: 1563603 - RNA, 14 nt, Human
auauuugaaauauu

SEQ ID NO: 1563604 - RNA, 13 nt, Human
auugucuagugaa

SEQ ID NO: 1563605 - RNA, 22 nt, Human
aaauguugacaugggacauuug

SEQ ID NO: 1563606 - RNA, 19 nt, Human
auugaggacacugauaugg

SEQ ID NO: 1563607 - RNA, 14 nt, Human
aaaagaaacauuug

SEQ ID NO: 1563608 - RNA, 17 nt, Human
ugguucccuugaugaag

SEQ ID NO: 1563609 - RNA, 19 nt, Human
cuagaguuuagcuggaaaa

SEQ ID NO: 1563610 - RNA, 22 nt, Human
uauuucagauaaucacaauaca

SEQ ID NO: 1563611 - RNA, 18 nt, Human
uaaguuuuuuuuuaaaaa

SEQ ID NO: 1563612 - RNA, 23 nt, Human
auauaacaaugcuguauuuuaaa

SEQ ID NO: 1563613 - RNA, 19 nt, Human
cacaggaaccacaagacug

SEQ ID NO: 1563614 - RNA, 16 nt, Human
aaaauccauacauuug

SEQ ID NO: 1563615 - RNA, 16 nt, Human
auuuuaauaauguuuc

SEQ ID NO: 1563616 - RNA, 20 nt, Human
uagaugcaguucugaagaag

SEQ ID NO: 1563617 - RNA, 13 nt, Human
uuuuaaaaaagaa

SEQ ID NO: 1563618 - RNA, 15 nt, Human
cucgugggacaguca

SEQ ID NO: 1563619 - RNA, 21 nt, Human
uuacauuuguauaaaauaauu

SEQ ID NO: 1563620 - RNA, 17 nt, Human
uaauuuuuauauuugaa

SEQ ID NO: 1563621 - RNA, 13 nt, Human
uaugaaauauuau

SEQ ID NO: 1563622 - RNA, 19 nt, Human
auuggagcucgugggacag

SEQ ID NO: 1563623 - RNA, 19 nt, Human
guccaggucuaccaaaaau

SEQ ID NO: 1563624 - RNA, 14 nt, Human
aaagagaacuucca

SEQ ID NO: 1563625 - RNA, 18 nt, Human
cauggaauuggagcucgu

SEQ ID NO: 1563626 - RNA, 22 nt, Human
aaaucaggguuaguauugucca

SEQ ID NO: 1563627 - RNA, 17 nt, Human
cugccucagaaaacaag

SEQ ID NO: 1563628 - RNA, 18 nt, Human
uaauaauguuucaaacau

SEQ ID NO: 1563629 - RNA, 15 nt, Human
ccacaggaaccacaa

SEQ ID NO: 1563630 - RNA, 22 nt, Human
accaaucaugaauuaguuuuau

SEQ ID NO: 1563631 - RNA, 16 nt, Human
aaauauuuauuuuaau

SEQ ID NO: 1563632 - RNA, 22 nt, Human
cccaugauguuuagaaacacaa

SEQ ID NO: 1563633 - RNA, 16 nt, Human
uucccaacuccagaaa

SEQ ID NO: 1563634 - RNA, 14 nt, Human
aauauuuauuuuaa

SEQ ID NO: 1563635 - RNA, 23 nt, Human
cuuaagaagacugcauuauauuu

SEQ ID NO: 1563636 - RNA, 13 nt, Human
cacaacuauauug

SEQ ID NO: 1563637 - RNA, 20 nt, Human
agccuaguugaucagcuuau

SEQ ID NO: 1563638 - RNA, 19 nt, Human
uauuuuaauaauguuucaa

SEQ ID NO: 1563639 - RNA, 22 nt, Human
cauaaauguugacaugggacau

SEQ ID NO: 1563640 - RNA, 17 nt, Human
ggaaauauuuauuuuaa

SEQ ID NO: 1563641 - RNA, 14 nt, Human
auccuugaagauuu

SEQ ID NO: 1563642 - RNA, 11 nt, Human
acugggacagg

SEQ ID NO: 1563643 - RNA, 14 nt, Human
uuaugauuaaguaa

SEQ ID NO: 1563644 - RNA, 21 nt, Human
aauaauguuucaaacauauau

SEQ ID NO: 1563645 - RNA, 17 nt, Human
cauuuguauaaaauaau

SEQ ID NO: 1563646 - RNA, 19 nt, Human
acuaucucauuuccaagca

SEQ ID NO: 1563647 - RNA, 13 nt, Human
aagcauuccaacu

SEQ ID NO: 1563648 - RNA, 16 nt, Human
auccuugaagauuuac

SEQ ID NO: 1563649 - RNA, 13 nt, Human
cugccuucucaac

SEQ ID NO: 1563650 - RNA, 16 nt, Human
cacuaguauuucuaug

SEQ ID NO: 1563651 - RNA, 19 nt, Human
agucaaauugugugaaagg

SEQ ID NO: 1563652 - RNA, 12 nt, Human
gaauuggagcuc

SEQ ID NO: 1563653 - RNA, 22 nt, Human
uauuucuaugaaauauuauguu

SEQ ID NO: 1563654 - RNA, 22 nt, Human
caccagucugacuguuuccauc

SEQ ID NO: 1563655 - RNA, 17 nt, Human
agacacacugaagaagc

SEQ ID NO: 1563656 - RNA, 18 nt, Human
caguuguugcccacagcu

SEQ ID NO: 1563657 - RNA, 20 nt, Human
auuacauuuguauaaaauaa

SEQ ID NO: 1563658 - RNA, 18 nt, Human
cagccucuuagaugcagu

SEQ ID NO: 1563659 - RNA, 20 nt, Human
cuaaaugucaaucagccuag

SEQ ID NO: 1563660 - RNA, 16 nt, Human
ugaauuaguuuuauau

SEQ ID NO: 1563661 - RNA, 14 nt, Human
ugguauguuuucag

SEQ ID NO: 1563662 - RNA, 21 nt, Human
uauaaaauaauuuuuauauuu

SEQ ID NO: 1563663 - RNA, 14 nt, Human
uaugaauuacauuu

SEQ ID NO: 1563664 - RNA, 15 nt, Human
gccccauucaacauc

SEQ ID NO: 1563665 - RNA, 23 nt, Human
uccaacuaucucauuuccaagca

SEQ ID NO: 1563666 - RNA, 14 nt, Human
augauguuuagaaa

SEQ ID NO: 1563667 - RNA, 18 nt, Human
agagaaugagagacacac

SEQ ID NO: 1563668 - RNA, 21 nt, Human
caccagucugacuguuuccau

SEQ ID NO: 1563669 - RNA, 20 nt, Human
gaaacauuugguaaggggaa

SEQ ID NO: 1563670 - RNA, 15 nt, Human
ucuaugaaauauuau

SEQ ID NO: 1563671 - RNA, 15 nt, Human
ugucaauaaaaucca

SEQ ID NO: 1563672 - RNA, 20 nt, Human
ucaauaaaauccauacauuu

SEQ ID NO: 1563673 - RNA, 14 nt, Human
ugcuucuguuuuau

SEQ ID NO: 1563674 - RNA, 18 nt, Human
uuacuguaagaaaauauc

SEQ ID NO: 1563675 - RNA, 19 nt, Human
auuaaguuuuuuuuuaaaa

SEQ ID NO: 1563676 - RNA, 12 nt, Human
ggcugaugcagu

SEQ ID NO: 1563677 - RNA, 22 nt, Human
ucaacuccaaacugacucuuaa

SEQ ID NO: 1563678 - RNA, 18 nt, Human
agcaaaauuuuuucucua

SEQ ID NO: 1563679 - RNA, 17 nt, Human
ggagcucguggaacagu

SEQ ID NO: 1563680 - RNA, 17 nt, Human
gaagcaccaaucaugaa

SEQ ID NO: 1563681 - RNA, 16 nt, Human
acaaggaugaauuaag

SEQ ID NO: 1563682 - RNA, 23 nt, Human
uaaguuuuuuuuuaaaaaagaaa

SEQ ID NO: 1563683 - RNA, 15 nt, Human
uccagauccuggaaa

SEQ ID NO: 1563684 - RNA, 13 nt, Human
aacacaacuauau

SEQ ID NO: 1563685 - RNA, 13 nt, Human
gaagaacugaaau

SEQ ID NO: 1563686 - RNA, 14 nt, Human
uccagauccuggaa

SEQ ID NO: 1563687 - RNA, 17 nt, Human
gaaugagagacacacug

SEQ ID NO: 1563688 - RNA, 14 nt, Human
uaaaauccauacau

SEQ ID NO: 1563689 - RNA, 22 nt, Human
uguugcccacagcuguaugauu

SEQ ID NO: 1563690 - RNA, 23 nt, Human
agaaugauuaugaauuacauuug

SEQ ID NO: 1563691 - RNA, 21 nt, Human
uguauaaaauaauuuuuauau

SEQ ID NO: 1563692 - RNA, 14 nt, Human
cagauccuggaaau

SEQ ID NO: 1563693 - RNA, 23 nt, Human
aaaauaucacuugucaauaaaau

SEQ ID NO: 1563694 - RNA, 23 nt, Human
cuaguaauuggaaaggcagcucu

SEQ ID NO: 1563695 - RNA, 20 nt, Human
cacuguggguagacacacau

SEQ ID NO: 1563696 - RNA, 23 nt, Human
caugcugucuacacuaagagaga

SEQ ID NO: 1563697 - RNA, 17 nt, Human
caaacauauauaacaau

SEQ ID NO: 1563698 - RNA, 14 nt, Human
aaucucaauauuuc

SEQ ID NO: 1563699 - RNA, 20 nt, Human
auucccagccagcacagccu

SEQ ID NO: 1563700 - RNA, 20 nt, Human
accucugccucagaaaacaa

SEQ ID NO: 1563701 - RNA, 21 nt, Human
acaguuaccucugccucagaa

SEQ ID NO: 1563702 - RNA, 13 nt, Human
aucucaauauuuc

SEQ ID NO: 1563703 - RNA, 13 nt, Human
cuucucaacucca

SEQ ID NO: 1563704 - RNA, 23 nt, Human
augaauuaaguuuuuuuuuaaaa

SEQ ID NO: 1563705 - RNA, 16 nt, Human
aggguguguaaguaga

SEQ ID NO: 1563706 - RNA, 22 nt, Human
aaacaaggaugaauuaaguuuu

SEQ ID NO: 1563707 - RNA, 13 nt, Human
auuuuaaaagaau

SEQ ID NO: 1563708 - RNA, 21 nt, Human
acagcccuucuuuccacagaa

SEQ ID NO: 1563709 - RNA, 14 nt, Human
aauauuauguuaaa

SEQ ID NO: 1563710 - RNA, 18 nt, Human
acucuuaagaagacugca

SEQ ID NO: 1563711 - RNA, 13 nt, Human
cauuuguauaaaa

SEQ ID NO: 1563712 - RNA, 14 nt, Human
cuaagcauuccaac

SEQ ID NO: 1563713 - RNA, 23 nt, Human
uagacacacaugaaguccaagca

SEQ ID NO: 1563714 - RNA, 13 nt, Human
ccagcacagccuc

SEQ ID NO: 1563715 - RNA, 19 nt, Human
uccagaaagugacaagcuc

SEQ ID NO: 1563716 - RNA, 20 nt, Human
uuccacagaagcuccaggua

SEQ ID NO: 1563717 - RNA, 21 nt, Human
uuuuauggcacuaguauuucu

SEQ ID NO: 1563718 - RNA, 15 nt, Human
ucacaggacagcccu

SEQ ID NO: 1563719 - RNA, 19 nt, Human
agaguuuagcuggaaaagu

SEQ ID NO: 1563720 - RNA, 15 nt, Human
caagcucacagaccu

SEQ ID NO: 1563721 - RNA, 11 nt, Human
caucuagugag

SEQ ID NO: 1563722 - RNA, 23 nt, Human
ugaauuacauuuguauaaaauaa

SEQ ID NO: 1563723 - RNA, 19 nt, Human
gcacuaguauuucuaugaa

SEQ ID NO: 1563724 - RNA, 14 nt, Human
auuguccaggucua

SEQ ID NO: 1563725 - RNA, 14 nt, Human
uuucuaugaaauau

SEQ ID NO: 1563726 - RNA, 15 nt, Human
uaggaaauauuuauu

SEQ ID NO: 1563727 - RNA, 23 nt, Human
ucuuagaugcaguucugaagaag

SEQ ID NO: 1563728 - RNA, 18 nt, Human
uuuuaaaaaagaaacauu

SEQ ID NO: 1563729 - RNA, 22 nt, Human
ggacagcccuucuuuccacaga

SEQ ID NO: 1563730 - RNA, 15 nt, Human
uagauaggccauggg

SEQ ID NO: 1563731 - RNA, 16 nt, Human
ugcaaauugucacagg

SEQ ID NO: 1563732 - RNA, 17 nt, Human
acuuccagauccuggaa

SEQ ID NO: 1563733 - RNA, 17 nt, Human
uuauaaucuuucacagg

SEQ ID NO: 1563734 - RNA, 22 nt, Human
auaacaaugcuguauuuuaaaa

SEQ ID NO: 1563735 - RNA, 20 nt, Human
aguuuuuuuuuaaaaaagaa

SEQ ID NO: 1563736 - RNA, 15 nt, Human
auuucuaugaaauau

SEQ ID NO: 1563737 - RNA, 20 nt, Human
aacaaugcuguauuuuaaaa

SEQ ID NO: 1563738 - RNA, 13 nt, Pseudomonas putida KT2440
uugaccagcaacg

SEQ ID NO: 1563739 - RNA, 17 nt, Pseudomonas putida KT2440
uugaccagcaccagcga

SEQ ID NO: 1563740 - RNA, 18 nt, Pseudomonas putida KT2440
uugacacccucuugaauc

SEQ ID NO: 1563741 - RNA, 11 nt, Pseudomonas putida KT2440
uugacccgcuu

SEQ ID NO: 1563742 - RNA, 17 nt, Pseudomonas putida KT2440
uugaaucagccuuugcc

SEQ ID NO: 1563743 - RNA, 15 nt, Pseudomonas putida KT2440
uuccguuggccacca

SEQ ID NO: 1563744 - RNA, 14 nt, Pseudomonas putida KT2440
uugaacacgaacac

SEQ ID NO: 1563745 - RNA, 23 nt, Pseudomonas putida KT2440
uuccucgaacgacagcugcaaca

SEQ ID NO: 1563746 - RNA, 20 nt, Pseudomonas putida KT2440
uugaacccgugcaucugcuc

SEQ ID NO: 1563747 - RNA, 16 nt, Pseudomonas putida KT2440
uugaagaccgccauga

SEQ ID NO: 1563748 - RNA, 14 nt, Pseudomonas putida KT2440
uugaagaagcuccc

SEQ ID NO: 1563749 - RNA, 21 nt, Pseudomonas putida KT2440
uugagcgcagcgacgaccugc

SEQ ID NO: 1563750 - RNA, 17 nt, Pseudomonas putida KT2440
uugagcuucagcgcgcc

SEQ ID NO: 1563751 - RNA, 23 nt, Pseudomonas putida KT2440
uugaggcacaaaaaagcccggca

SEQ ID NO: 1563752 - RNA, 16 nt, Pseudomonas putida KT2440
uugagguccgccucga

SEQ ID NO: 1563753 - RNA, 12 nt, Pseudomonas putida KT2440
uugaggcggucg

SEQ ID NO: 1563754 - RNA, 23 nt, Pseudomonas putida KT2440
uugagaugaugguugacagcgcu

SEQ ID NO: 1563755 - RNA, 22 nt, Pseudomonas putida KT2440
uugagcgaaacccggcgcagcg

SEQ ID NO: 1563756 - RNA, 16 nt, Pseudomonas putida KT2440
uugacguuggccgcca

SEQ ID NO: 1563757 - RNA, 16 nt, Pseudomonas putida KT2440
uugacguuguagcggc

SEQ ID NO: 1563758 - RNA, 13 nt, Pseudomonas putida KT2440
uugacguccagcu

SEQ ID NO: 1563759 - RNA, 21 nt, Pseudomonas putida KT2440
uugacgggugaccaggcccag

SEQ ID NO: 1563760 - RNA, 23 nt, Pseudomonas putida KT2440
uugacgggugaccaggcccagca

SEQ ID NO: 1563761 - RNA, 13 nt, Pseudomonas putida KT2440
uugaccguccaca

SEQ ID NO: 1563762 - RNA, 16 nt, Pseudomonas putida KT2440
uugaccguccacaccg

SEQ ID NO: 1563763 - RNA, 19 nt, Pseudomonas putida KT2440
uugaccgugaucaucagcg

SEQ ID NO: 1563764 - RNA, 18 nt, Pseudomonas putida KT2440
uugaucaggcccugcugc

SEQ ID NO: 1563765 - RNA, 20 nt, Pseudomonas putida KT2440
uugaucuugcgccccagcag

SEQ ID NO: 1563766 - RNA, 17 nt, Pseudomonas putida KT2440
uugaucaacugacgcag

SEQ ID NO: 1563767 - RNA, 13 nt, Pseudomonas putida KT2440
uugauaccugcuu

SEQ ID NO: 1563768 - RNA, 18 nt, Pseudomonas putida KT2440
uugcaagccuucgucgcu

SEQ ID NO: 1563769 - RNA, 19 nt, Pseudomonas putida KT2440
uugcaaggaucauuugaaa

SEQ ID NO: 1563770 - RNA, 17 nt, Pseudomonas putida KT2440
uugauguacuccugcac

SEQ ID NO: 1563771 - RNA, 14 nt, Pseudomonas putida KT2440
uugcaggcgagcug

SEQ ID NO: 1563772 - RNA, 18 nt, Pseudomonas putida KT2440
uugcaggccagcgucgug

SEQ ID NO: 1563773 - RNA, 12 nt, Pseudomonas putida KT2440
uugcagcggguu

SEQ ID NO: 1563774 - RNA, 23 nt, Pseudomonas putida KT2440
uugcagcucuugucgacagugaa

SEQ ID NO: 1563775 - RNA, 16 nt, Pseudomonas putida KT2440
uugcaggaacaaccug

SEQ ID NO: 1563776 - RNA, 21 nt, Pseudomonas putida KT2440
uugccaccacccggggcagca

SEQ ID NO: 1563777 - RNA, 15 nt, Pseudomonas putida KT2440
uugccaccagcauca

SEQ ID NO: 1563778 - RNA, 15 nt, Pseudomonas putida KT2440
uugcccagcaugcgc

SEQ ID NO: 1563779 - RNA, 20 nt, Pseudomonas putida KT2440
uugcccggcaugaucagcuu

SEQ ID NO: 1563780 - RNA, 15 nt, Pseudomonas putida KT2440
uugcccgacaagcca

SEQ ID NO: 1563781 - RNA, 14 nt, Pseudomonas putida KT2440
uugcccgcgaagca

SEQ ID NO: 1563782 - RNA, 18 nt, Pseudomonas putida KT2440
uugcccgcgaagcagcca

SEQ ID NO: 1563783 - RNA, 21 nt, Pseudomonas putida KT2440
uugcccgcgacgaaacccagu

SEQ ID NO: 1563784 - RNA, 20 nt, Pseudomonas putida KT2440
uugcccgcgguaaugcgcac

SEQ ID NO: 1563785 - RNA, 15 nt, Pseudomonas putida KT2440
uugccagcauggugc

SEQ ID NO: 1563786 - RNA, 13 nt, Pseudomonas putida KT2440
uugccaccggcgc

SEQ ID NO: 1563787 - RNA, 22 nt, Pseudomonas putida KT2440
uugccaacagcaguugcugcug

SEQ ID NO: 1563788 - RNA, 17 nt, Pseudomonas putida KT2440
uugccacggcguggagc

SEQ ID NO: 1563789 - RNA, 18 nt, Pseudomonas putida KT2440
uuggccaggucgaccgag

SEQ ID NO: 1563790 - RNA, 16 nt, Pseudomonas putida KT2440
uuggccgccagcggca

SEQ ID NO: 1563791 - RNA, 21 nt, Pseudomonas putida KT2440
uuggcccggggaucuugcugg

SEQ ID NO: 1563792 - RNA, 15 nt, Pseudomonas putida KT2440
uuggccgaaggccgu

SEQ ID NO: 1563793 - RNA, 14 nt, Pseudomonas putida KT2440
uuggaauggcgcac

SEQ ID NO: 1563794 - RNA, 17 nt, Pseudomonas putida KT2440
uuggaaauguucaacag

SEQ ID NO: 1563795 - RNA, 14 nt, Pseudomonas putida KT2440
uuggacacagaccg

SEQ ID NO: 1563796 - RNA, 19 nt, Pseudomonas putida KT2440
uuggcaacaauguaccggg

SEQ ID NO: 1563797 - RNA, 17 nt, Pseudomonas putida KT2440
uuggagcguugcaggcg

SEQ ID NO: 1563798 - RNA, 16 nt, Pseudomonas putida KT2440
uugcucggcaccaccg

SEQ ID NO: 1563799 - RNA, 23 nt, Pseudomonas putida KT2440
uugcuaauuucagguuucgggca

SEQ ID NO: 1563800 - RNA, 18 nt, Pseudomonas putida KT2440
uugcuccagcucacagca

SEQ ID NO: 1563801 - RNA, 18 nt, Pseudomonas putida KT2440
uugcugguguggcgccag

SEQ ID NO: 1563802 - RNA, 22 nt, Pseudomonas putida KT2440
uugcugguguggcgccagggca

SEQ ID NO: 1563803 - RNA, 15 nt, Pseudomonas putida KT2440
uugcugccgaccugc

SEQ ID NO: 1563804 - RNA, 15 nt, Pseudomonas putida KT2440
uugcugggcgaacgc

SEQ ID NO: 1563805 - RNA, 15 nt, Pseudomonas putida KT2440
uugccggucgggcaa

SEQ ID NO: 1563806 - RNA, 14 nt, Pseudomonas putida KT2440
uugccgguggugac

SEQ ID NO: 1563807 - RNA, 15 nt, Pseudomonas putida KT2440
uugccgccagccccg

SEQ ID NO: 1563808 - RNA, 19 nt, Pseudomonas putida KT2440
uugccgaugaugcgggcaa

SEQ ID NO: 1563809 - RNA, 22 nt, Pseudomonas putida KT2440
uugccgaucagguugcccagca

SEQ ID NO: 1563810 - RNA, 21 nt, Pseudomonas putida KT2440
uugcccgugacuaguggccac

SEQ ID NO: 1563811 - RNA, 16 nt, Pseudomonas putida KT2440
uugcgcaucaccucga

SEQ ID NO: 1563812 - RNA, 19 nt, Pseudomonas putida KT2440
uugcgggucagcagcaccg

SEQ ID NO: 1563813 - RNA, 20 nt, Pseudomonas putida KT2440
uugcggauagaacgggucau

SEQ ID NO: 1563814 - RNA, 19 nt, Pseudomonas putida KT2440
uugcgcuugagcguggcaa

SEQ ID NO: 1563815 - RNA, 20 nt, Pseudomonas putida KT2440
uugcggcccuucgcgggcac

SEQ ID NO: 1563816 - RNA, 16 nt, Pseudomonas putida KT2440
uuggucagcaucaccg

SEQ ID NO: 1563817 - RNA, 18 nt, Pseudomonas putida KT2440
uuggugcgccuccagcag

SEQ ID NO: 1563818 - RNA, 20 nt, Pseudomonas putida KT2440
uuggugcgccuccagcagcg

SEQ ID NO: 1563819 - RNA, 18 nt, Pseudomonas putida KT2440
uugggcgggccgccgaac

SEQ ID NO: 1563820 - RNA, 19 nt, Pseudomonas putida KT2440
uugggguccuguuugccga

SEQ ID NO: 1563821 - RNA, 18 nt, Pseudomonas putida KT2440
uugggcuuggcagcaccg

SEQ ID NO: 1563822 - RNA, 22 nt, Pseudomonas putida KT2440
uugggcuucaugcacaacgcgc

SEQ ID NO: 1563823 - RNA, 19 nt, Pseudomonas putida KT2440
uugugguagucgcucaggc

SEQ ID NO: 1563824 - RNA, 17 nt, Pseudomonas putida KT2440
uugugcagcacuucgau

SEQ ID NO: 1563825 - RNA, 23 nt, Pseudomonas putida KT2440
uugugcagcacuucgaucaggca

SEQ ID NO: 1563826 - RNA, 23 nt, Pseudomonas putida KT2440
uugugcaucagcgugugacccag

SEQ ID NO: 1563827 - RNA, 13 nt, Pseudomonas putida KT2440
uugucauugccca

SEQ ID NO: 1563828 - RNA, 23 nt, Pseudomonas putida KT2440
uugucauugcccaagcgcuccgc

SEQ ID NO: 1563829 - RNA, 16 nt, Pseudomonas putida KT2440
uuguccagcagcagcg

SEQ ID NO: 1563830 - RNA, 19 nt, Pseudomonas putida KT2440
uuguccgacagcuugccca

SEQ ID NO: 1563831 - RNA, 19 nt, Pseudomonas putida KT2440
uugucaguucugcucagcu

SEQ ID NO: 1563832 - RNA, 22 nt, Pseudomonas putida KT2440
uuuccggcccgguuggcgcuuc

SEQ ID NO: 1563833 - RNA, 14 nt, Pseudomonas putida KT2440
uuucgaccaaggcu

SEQ ID NO: 1563834 - RNA, 16 nt, Pseudomonas putida KT2440
uuuccgugcaaccgcu

SEQ ID NO: 1563835 - RNA, 20 nt, Pseudomonas putida KT2440
uuucgccguagccaaccgag

SEQ ID NO: 1563836 - RNA, 19 nt, Pseudomonas putida KT2440
uuucgcgggagacccguuc

SEQ ID NO: 1563837 - RNA, 19 nt, Pseudomonas putida KT2440
uuucgcgggcgugcccgcg

SEQ ID NO: 1563838 - RNA, 20 nt, Pseudomonas putida KT2440
uuucgcggguaaacccccuc

SEQ ID NO: 1563839 - RNA, 19 nt, Pseudomonas putida KT2440
uuucgcggguaaacccgcc

SEQ ID NO: 1563840 - RNA, 20 nt, Pseudomonas putida KT2440
uuucgcggguagacccgcuc

SEQ ID NO: 1563841 - RNA, 19 nt, Pseudomonas putida KT2440
uuucgcgggugaacccgcu

SEQ ID NO: 1563842 - RNA, 19 nt, Pseudomonas putida KT2440
uuucgccacccucgcacca

SEQ ID NO: 1563843 - RNA, 20 nt, Pseudomonas putida KT2440
uuugcaagccuugugggagc

SEQ ID NO: 1563844 - RNA, 16 nt, Pseudomonas putida KT2440
uuugcgagcgcgggca

SEQ ID NO: 1563845 - RNA, 21 nt, Pseudomonas putida KT2440
uuuggggugagcgaaucccgc

SEQ ID NO: 1563846 - RNA, 16 nt, Pseudomonas putida KT2440
uuuucuauugcucagu

SEQ ID NO: 1563847 - RNA, 11 nt, Pseudomonas putida KT2440
uuuuugugccu

SEQ ID NO: 1563848 - RNA, 22 nt, Pseudomonas putida KT2440
uucagaucacccuuggccaccu

SEQ ID NO: 1563849 - RNA, 13 nt, Pseudomonas putida KT2440
uucaggccuucga

SEQ ID NO: 1563850 - RNA, 14 nt, Pseudomonas putida KT2440
uucagguguuccag

SEQ ID NO: 1563851 - RNA, 16 nt, Pseudomonas putida KT2440
uucagguucacuucca

SEQ ID NO: 1563852 - RNA, 14 nt, Pseudomonas putida KT2440
uucaccccguacac

SEQ ID NO: 1563853 - RNA, 22 nt, Pseudomonas putida KT2440
uucaacagcgcgacgcagcagc

SEQ ID NO: 1563854 - RNA, 14 nt, Pseudomonas putida KT2440
uuccacacccagcg

SEQ ID NO: 1563855 - RNA, 19 nt, Pseudomonas putida KT2440
uucauccagccggcugaug

SEQ ID NO: 1563856 - RNA, 11 nt, Pseudomonas putida KT2440
uuccaccggca

SEQ ID NO: 1563857 - RNA, 12 nt, Pseudomonas putida KT2440
uuccagcaucgg

SEQ ID NO: 1563858 - RNA, 21 nt, Pseudomonas putida KT2440
uuccggcccuuucgcggguaa

SEQ ID NO: 1563859 - RNA, 22 nt, Pseudomonas putida KT2440
uuccggcagggugaaguugauc

SEQ ID NO: 1563860 - RNA, 21 nt, Pseudomonas putida KT2440
uuccggccucuucgcgggcaa

SEQ ID NO: 1563861 - RNA, 18 nt, Pseudomonas putida KT2440
uuccagccugcagcaccc

SEQ ID NO: 1563862 - RNA, 18 nt, Pseudomonas putida KT2440
uuccagcccgccugcuca

SEQ ID NO: 1563863 - RNA, 23 nt, Pseudomonas putida KT2440
uuccagcugcgccugcaauucga

SEQ ID NO: 1563864 - RNA, 21 nt, Pseudomonas putida KT2440
uucccgccauguugcgcagca

SEQ ID NO: 1563865 - RNA, 23 nt, Pseudomonas putida KT2440
uguuggcacggcugaaaugcccg

SEQ ID NO: 1563866 - RNA, 18 nt, Pseudomonas putida KT2440
uguuuggguugacgguga

SEQ ID NO: 1563867 - RNA, 17 nt, Pseudomonas putida KT2440
uguuugagccggcgcug

SEQ ID NO: 1563868 - RNA, 24 nt, Pseudomonas putida KT2440
uguuugagccggcgcugggcuuac

SEQ ID NO: 1563869 - RNA, 19 nt, Pseudomonas putida KT2440
uuacccgcgaacaggcccu

SEQ ID NO: 1563870 - RNA, 20 nt, Pseudomonas putida KT2440
uuacccgcgaagaggccggu

SEQ ID NO: 1563871 - RNA, 17 nt, Pseudomonas putida KT2440
uuaccacauaacugccg

SEQ ID NO: 1563872 - RNA, 19 nt, Pseudomonas putida KT2440
uuacagaugucuggcauca

SEQ ID NO: 1563873 - RNA, 15 nt, Pseudomonas putida KT2440
ugguggcccugaccg

SEQ ID NO: 1563874 - RNA, 13 nt, Pseudomonas putida KT2440
ugguacacggcau

SEQ ID NO: 1563875 - RNA, 14 nt, Pseudomonas putida KT2440
ugguaauuggccgg

SEQ ID NO: 1563876 - RNA, 16 nt, Pseudomonas putida KT2440
ugguaauccucgguag

SEQ ID NO: 1563877 - RNA, 15 nt, Pseudomonas putida KT2440
ugguaauaccacauc

SEQ ID NO: 1563878 - RNA, 15 nt, Pseudomonas putida KT2440
uggugcgggccacca

SEQ ID NO: 1563879 - RNA, 20 nt, Pseudomonas putida KT2440
uggguuuuuuuaugggcagc

SEQ ID NO: 1563880 - RNA, 22 nt, Pseudomonas putida KT2440
uggguuuuaaccggcccugaag

SEQ ID NO: 1563881 - RNA, 19 nt, Pseudomonas putida KT2440
ugguugucgaacagcaucc

SEQ ID NO: 1563882 - RNA, 20 nt, Pseudomonas putida KT2440
ugguuggacacagaccgucg

SEQ ID NO: 1563883 - RNA, 17 nt, Pseudomonas putida KT2440
ugguuggcggagccagc

SEQ ID NO: 1563884 - RNA, 13 nt, Pseudomonas putida KT2440
ugguugccggucg

SEQ ID NO: 1563885 - RNA, 16 nt, Pseudomonas putida KT2440
ugguggugcugggcau

SEQ ID NO: 1563886 - RNA, 16 nt, Pseudomonas putida KT2440
uguacccgcuggcuga

SEQ ID NO: 1563887 - RNA, 14 nt, Pseudomonas putida KT2440
uguacgcuggccaa

SEQ ID NO: 1563888 - RNA, 12 nt, Pseudomonas putida KT2440
uguacagcaaca

SEQ ID NO: 1563889 - RNA, 18 nt, Pseudomonas putida KT2440
uguacacagcccaaggcu

SEQ ID NO: 1563890 - RNA, 23 nt, Pseudomonas putida KT2440
ugguuucacacucgccaggaucg

SEQ ID NO: 1563891 - RNA, 23 nt, Pseudomonas putida KT2440
uguaaugaaaaucgccuugcguc

SEQ ID NO: 1563892 - RNA, 14 nt, Pseudomonas putida KT2440
uguagccggcaguc

SEQ ID NO: 1563893 - RNA, 13 nt, Pseudomonas putida KT2440
uguagagcgccuu

SEQ ID NO: 1563894 - RNA, 19 nt, Pseudomonas putida KT2440
uguagcgcgguccggugau

SEQ ID NO: 1563895 - RNA, 17 nt, Pseudomonas putida KT2440
uguagaccaccagcguu

SEQ ID NO: 1563896 - RNA, 19 nt, Pseudomonas putida KT2440
uguagaacggcagcaggcc

SEQ ID NO: 1563897 - RNA, 24 nt, Pseudomonas putida KT2440
uguagaacggcagcaggccaaugc

SEQ ID NO: 1563898 - RNA, 13 nt, Pseudomonas putida KT2440
uguagaucgccgg

SEQ ID NO: 1563899 - RNA, 19 nt, Pseudomonas putida KT2440
uguagaucgccggcagcac

SEQ ID NO: 1563900 - RNA, 14 nt, Pseudomonas putida KT2440
uguacgugcgggcc

SEQ ID NO: 1563901 - RNA, 20 nt, Pseudomonas putida KT2440
uguaggagcggguucacccg

SEQ ID NO: 1563902 - RNA, 23 nt, Pseudomonas putida KT2440
uguaggagcggguucacccgcga

SEQ ID NO: 1563903 - RNA, 22 nt, Pseudomonas putida KT2440
ugucagccuucagauaguccuu

SEQ ID NO: 1563904 - RNA, 12 nt, Pseudomonas putida KT2440
ugucagcgccag

SEQ ID NO: 1563905 - RNA, 17 nt, Pseudomonas putida KT2440
ugucagcgccagcggcu

SEQ ID NO: 1563906 - RNA, 17 nt, Pseudomonas putida KT2440
ugucacccagcacuucg

SEQ ID NO: 1563907 - RNA, 18 nt, Pseudomonas putida KT2440
ugucgaccugguccagcu

SEQ ID NO: 1563908 - RNA, 18 nt, Pseudomonas putida KT2440
uguccacccccgcuccua

SEQ ID NO: 1563909 - RNA, 21 nt, Pseudomonas putida KT2440
uguccacaccaaagucagcca

SEQ ID NO: 1563910 - RNA, 21 nt, Pseudomonas putida KT2440
ugucauugcccaagcgcuccg

SEQ ID NO: 1563911 - RNA, 21 nt, Pseudomonas putida KT2440
ugucauccacaucacugcugu

SEQ ID NO: 1563912 - RNA, 18 nt, Pseudomonas putida KT2440
ugucaggugguaguccuu

SEQ ID NO: 1563913 - RNA, 12 nt, Pseudomonas putida KT2440
ugucccggcaca

SEQ ID NO: 1563914 - RNA, 22 nt, Pseudomonas putida KT2440
uguucgccguuguucacgguca

SEQ ID NO: 1563915 - RNA, 20 nt, Pseudomonas putida KT2440
uguucgcgaggaaacccgcg

SEQ ID NO: 1563916 - RNA, 22 nt, Pseudomonas putida KT2440
uguucgcgcaggauccacgccu

SEQ ID NO: 1563917 - RNA, 18 nt, Pseudomonas putida KT2440
uguuacggacgggcguug

SEQ ID NO: 1563918 - RNA, 20 nt, Pseudomonas putida KT2440
uguuaggcuugacgaccgac

SEQ ID NO: 1563919 - RNA, 19 nt, Pseudomonas putida KT2440
uguucaacgcaaugggcac

SEQ ID NO: 1563920 - RNA, 15 nt, Pseudomonas putida KT2440
uguucagcagcgaag

SEQ ID NO: 1563921 - RNA, 17 nt, Pseudomonas putida KT2440
uguucacggcggccuug

SEQ ID NO: 1563922 - RNA, 23 nt, Pseudomonas putida KT2440
uguucccccaccggccgccgcca

SEQ ID NO: 1563923 - RNA, 17 nt, Pseudomonas putida KT2440
uguuccauuucacuggc

SEQ ID NO: 1563924 - RNA, 22 nt, Pseudomonas putida KT2440
uguuccggccucuucgcgggca

SEQ ID NO: 1563925 - RNA, 17 nt, Pseudomonas putida KT2440
ugugcacacgcaacuga

SEQ ID NO: 1563926 - RNA, 21 nt, Pseudomonas putida KT2440
ugugcaguucgcacagcucga

SEQ ID NO: 1563927 - RNA, 24 nt, Pseudomonas putida KT2440
ugugggagcacaagcacgcgcuga

SEQ ID NO: 1563928 - RNA, 14 nt, Pseudomonas putida KT2440
ugugggagcggccu

SEQ ID NO: 1563929 - RNA, 20 nt, Pseudomonas putida KT2440
ugugggagcggccuugcguc

SEQ ID NO: 1563930 - RNA, 19 nt, Pseudomonas putida KT2440
ugugggagcgggucagccu

SEQ ID NO: 1563931 - RNA, 12 nt, Pseudomonas putida KT2440
uguggcgcagca

SEQ ID NO: 1563932 - RNA, 22 nt, Pseudomonas putida KT2440
ugugguuucacacucgccagga

SEQ ID NO: 1563933 - RNA, 22 nt, Pseudomonas putida KT2440
ugugguugacguuggccgccag

SEQ ID NO: 1563934 - RNA, 13 nt, Pseudomonas putida KT2440
uguguucgcugcg

SEQ ID NO: 1563935 - RNA, 17 nt, Pseudomonas putida KT2440
uguguugcgguggaagc

SEQ ID NO: 1563936 - RNA, 14 nt, Pseudomonas putida KT2440
ugugugccugcucc

SEQ ID NO: 1563937 - RNA, 17 nt, Pseudomonas putida KT2440
ugugugaacggcgccug

SEQ ID NO: 1563938 - RNA, 16 nt, Pseudomonas putida KT2440
ugugucgaaccacuga

SEQ ID NO: 1563939 - RNA, 17 nt, Pseudomonas putida KT2440
ugucgaguacgaucagc

SEQ ID NO: 1563940 - RNA, 19 nt, Pseudomonas putida KT2440
ugucgauacucacccgcuu

SEQ ID NO: 1563941 - RNA, 15 nt, Pseudomonas putida KT2440
ugucgaucagcggcu

SEQ ID NO: 1563942 - RNA, 16 nt, Pseudomonas putida KT2440
ugugaucccgcgaggu

SEQ ID NO: 1563943 - RNA, 13 nt, Pseudomonas putida KT2440
ugugacugaugau

SEQ ID NO: 1563944 - RNA, 15 nt, Pseudomonas putida KT2440
ugucgcuguugcgca

SEQ ID NO: 1563945 - RNA, 16 nt, Pseudomonas putida KT2440
uggcccugaucugccc

SEQ ID NO: 1563946 - RNA, 19 nt, Pseudomonas putida KT2440
uggcccggucccgcugccg

SEQ ID NO: 1563947 - RNA, 13 nt, Pseudomonas putida KT2440
uggcccgaacagc

SEQ ID NO: 1563948 - RNA, 16 nt, Pseudomonas putida KT2440
uggcccgaacagcacg

SEQ ID NO: 1563949 - RNA, 22 nt, Pseudomonas putida KT2440
uggcccgaacgcagcgccgcca

SEQ ID NO: 1563950 - RNA, 13 nt, Pseudomonas putida KT2440
uggcccgccgcca

SEQ ID NO: 1563951 - RNA, 22 nt, Pseudomonas putida KT2440
uggcccgccgccaccagcgccg

SEQ ID NO: 1563952 - RNA, 18 nt, Pseudomonas putida KT2440
uggcccgcgcccuugcgg

SEQ ID NO: 1563953 - RNA, 13 nt, Pseudomonas putida KT2440
uggccaucagcug

SEQ ID NO: 1563954 - RNA, 19 nt, Pseudomonas putida KT2440
uggccauugaccuugguga

SEQ ID NO: 1563955 - RNA, 15 nt, Pseudomonas putida KT2440
uggccauuucgcggc

SEQ ID NO: 1563956 - RNA, 22 nt, Pseudomonas putida KT2440
uggcccaguacgccucgaagua

SEQ ID NO: 1563957 - RNA, 16 nt, Pseudomonas putida KT2440
uggccagccggcagca

SEQ ID NO: 1563958 - RNA, 20 nt, Pseudomonas putida KT2440
uggccagcaggcccggccca

SEQ ID NO: 1563959 - RNA, 21 nt, Pseudomonas putida KT2440
uggccacguaggcacucgguc

SEQ ID NO: 1563960 - RNA, 19 nt, Pseudomonas putida KT2440
uggccagacucagcugcug

SEQ ID NO: 1563961 - RNA, 16 nt, Pseudomonas putida KT2440
uggccagagcgcgcca

SEQ ID NO: 1563962 - RNA, 18 nt, Pseudomonas putida KT2440
uggccaucacuucacggg

SEQ ID NO: 1563963 - RNA, 19 nt, Pseudomonas putida KT2440
uggccaucacuucacgggu

SEQ ID NO: 1563964 - RNA, 19 nt, Pseudomonas putida KT2440
uggcauuggugccagcgcc

SEQ ID NO: 1563965 - RNA, 19 nt, Pseudomonas putida KT2440
uggccaauuucuacccgcc

SEQ ID NO: 1563966 - RNA, 23 nt, Pseudomonas putida KT2440
uggccaaggguuugccaggcgca

SEQ ID NO: 1563967 - RNA, 18 nt, Pseudomonas putida KT2440
uggccaccagcaccugca

SEQ ID NO: 1563968 - RNA, 20 nt, Pseudomonas putida KT2440
uggccaccagcaccugcagg

SEQ ID NO: 1563969 - RNA, 17 nt, Pseudomonas putida KT2440
uggccaccagcauggcg

SEQ ID NO: 1563970 - RNA, 12 nt, Pseudomonas putida KT2440
uggccaccagca

SEQ ID NO: 1563971 - RNA, 19 nt, Pseudomonas putida KT2440
uggccaccaugaacagcac

SEQ ID NO: 1563972 - RNA, 16 nt, Pseudomonas putida KT2440
uggccacccggcugcu

SEQ ID NO: 1563973 - RNA, 12 nt, Pseudomonas putida KT2440
uggccaccgcgc

SEQ ID NO: 1563974 - RNA, 14 nt, Pseudomonas putida KT2440
uggcagugaugccg

SEQ ID NO: 1563975 - RNA, 15 nt, Pseudomonas putida KT2440
uggcaguaccacacg

SEQ ID NO: 1563976 - RNA, 17 nt, Pseudomonas putida KT2440
uggcaugggugagcacg

SEQ ID NO: 1563977 - RNA, 16 nt, Pseudomonas putida KT2440
uggcaugcgacgcggc

SEQ ID NO: 1563978 - RNA, 12 nt, Pseudomonas putida KT2440
uggcaccggcag

SEQ ID NO: 1563979 - RNA, 13 nt, Pseudomonas putida KT2440
uggcaccggcagc

SEQ ID NO: 1563980 - RNA, 14 nt, Pseudomonas putida KT2440
uggcaccggcgcca

SEQ ID NO: 1563981 - RNA, 18 nt, Pseudomonas putida KT2440
uggcaccuaucgcugccg

SEQ ID NO: 1563982 - RNA, 18 nt, Pseudomonas putida KT2440
uggcacccacgcgcuugg

SEQ ID NO: 1563983 - RNA, 23 nt, Pseudomonas putida KT2440
uggcaccaccagggcgcgcuggc

SEQ ID NO: 1563984 - RNA, 22 nt, Pseudomonas putida KT2440
uggcacaggcuacgcagcaccc

SEQ ID NO: 1563985 - RNA, 18 nt, Pseudomonas putida KT2440
uggcaaugcaacucggcg

SEQ ID NO: 1563986 - RNA, 20 nt, Pseudomonas putida KT2440
uggcaaugcaacucggcgcg

SEQ ID NO: 1563987 - RNA, 14 nt, Pseudomonas putida KT2440
uggcaagccgagca

SEQ ID NO: 1563988 - RNA, 23 nt, Pseudomonas putida KT2440
uggcaaucacgaacagccagaug

SEQ ID NO: 1563989 - RNA, 12 nt, Pseudomonas putida KT2440
uggcaaucagcg

SEQ ID NO: 1563990 - RNA, 17 nt, Pseudomonas putida KT2440
uggcaaucagcucuucg

SEQ ID NO: 1563991 - RNA, 18 nt, Pseudomonas putida KT2440
uggcagccgcccuugagc

SEQ ID NO: 1563992 - RNA, 20 nt, Pseudomonas putida KT2440
uggcagcccccccagcaacg

SEQ ID NO: 1563993 - RNA, 17 nt, Pseudomonas putida KT2440
uggcagcuacgagacgg

SEQ ID NO: 1563994 - RNA, 12 nt, Pseudomonas putida KT2440
uggcaggcaguu

SEQ ID NO: 1563995 - RNA, 14 nt, Pseudomonas putida KT2440
uggcaggcaguucg

SEQ ID NO: 1563996 - RNA, 17 nt, Pseudomonas putida KT2440
uggcagcaccgcugcca

SEQ ID NO: 1563997 - RNA, 11 nt, Pseudomonas putida KT2440
uggcagcagcc

SEQ ID NO: 1563998 - RNA, 17 nt, Pseudomonas putida KT2440
uggcacuggcgcgaugc

SEQ ID NO: 1563999 - RNA, 18 nt, Pseudomonas putida KT2440
uggcaccggcuucgccgg

SEQ ID NO: 1564000 - RNA, 16 nt, Pseudomonas putida KT2440
uggcacgcccggcacc

SEQ ID NO: 1564001 - RNA, 20 nt, Pseudomonas putida KT2440
uggcacgccuucagcagccg

SEQ ID NO: 1564002 - RNA, 18 nt, Pseudomonas putida KT2440
uggcacgcucgcgcagga

SEQ ID NO: 1564003 - RNA, 16 nt, Pseudomonas putida KT2440
uggaugacgccgcagc

SEQ ID NO: 1564004 - RNA, 17 nt, Pseudomonas putida KT2440
uggaucguggccggcau

SEQ ID NO: 1564005 - RNA, 14 nt, Pseudomonas putida KT2440
uggaucggcgugcg

SEQ ID NO: 1564006 - RNA, 21 nt, Pseudomonas putida KT2440
uggcaaaucgaaaaugcagau

SEQ ID NO: 1564007 - RNA, 15 nt, Pseudomonas putida KT2440
uggcaaacagcacca

SEQ ID NO: 1564008 - RNA, 18 nt, Pseudomonas putida KT2440
uggcaaacagcaccagcc

SEQ ID NO: 1564009 - RNA, 16 nt, Pseudomonas putida KT2440
uggcaaacgccuguuu

SEQ ID NO: 1564010 - RNA, 12 nt, Pseudomonas putida KT2440
uggcaaagcgca

SEQ ID NO: 1564011 - RNA, 15 nt, Pseudomonas putida KT2440
uggcaaagcgcagca

SEQ ID NO: 1564012 - RNA, 18 nt, Pseudomonas putida KT2440
uggauuccucgcgcuugc

SEQ ID NO: 1564013 - RNA, 15 nt, Pseudomonas putida KT2440
uggagaagcgaucga

SEQ ID NO: 1564014 - RNA, 15 nt, Pseudomonas putida KT2440
uggagauuggccagc

SEQ ID NO: 1564015 - RNA, 21 nt, Pseudomonas putida KT2440
uggagcugaaacugaucagcu

SEQ ID NO: 1564016 - RNA, 14 nt, Pseudomonas putida KT2440
uggagcggccuugu

SEQ ID NO: 1564017 - RNA, 17 nt, Pseudomonas putida KT2440
uggagcgggcguuggcg

SEQ ID NO: 1564018 - RNA, 14 nt, Pseudomonas putida KT2440
uggaguugcucgag

SEQ ID NO: 1564019 - RNA, 11 nt, Pseudomonas putida KT2440
uggaucagccg

SEQ ID NO: 1564020 - RNA, 23 nt, Pseudomonas putida KT2440
uggaccgacuucaaaaccagaug

SEQ ID NO: 1564021 - RNA, 15 nt, Pseudomonas putida KT2440
uggacagcggcagca

SEQ ID NO: 1564022 - RNA, 15 nt, Pseudomonas putida KT2440
uggacacugccguga

SEQ ID NO: 1564023 - RNA, 21 nt, Pseudomonas putida KT2440
uggacuucaucgcgggccagg

SEQ ID NO: 1564024 - RNA, 20 nt, Pseudomonas putida KT2440
ugcgggggccccaccaggca

SEQ ID NO: 1564025 - RNA, 21 nt, Pseudomonas putida KT2440
ugcgggggccccaccaggcac

SEQ ID NO: 1564026 - RNA, 17 nt, Pseudomonas putida KT2440
ugcgggcguuguguugc

SEQ ID NO: 1564027 - RNA, 21 nt, Pseudomonas putida KT2440
ugcgggcuuuccacgccucga

SEQ ID NO: 1564028 - RNA, 14 nt, Pseudomonas putida KT2440
uggaacgcuuggcc

SEQ ID NO: 1564029 - RNA, 17 nt, Pseudomonas putida KT2440
uggaauuauuggccagc

SEQ ID NO: 1564030 - RNA, 16 nt, Pseudomonas putida KT2440
uggaauuccugccggg

SEQ ID NO: 1564031 - RNA, 19 nt, Pseudomonas putida KT2440
uggaagcuggcuacccgcu

SEQ ID NO: 1564032 - RNA, 20 nt, Pseudomonas putida KT2440
uggccgagccaagaggcagc

SEQ ID NO: 1564033 - RNA, 15 nt, Pseudomonas putida KT2440
uggccgacuggcgca

SEQ ID NO: 1564034 - RNA, 14 nt, Pseudomonas putida KT2440
uggcccuucgcgga

SEQ ID NO: 1564035 - RNA, 23 nt, Pseudomonas putida KT2440
uggccgaaaccagccccuugcuc

SEQ ID NO: 1564036 - RNA, 13 nt, Pseudomonas putida KT2440
uggccgaaggccg

SEQ ID NO: 1564037 - RNA, 14 nt, Pseudomonas putida KT2440
uggccgaaggccgu

SEQ ID NO: 1564038 - RNA, 14 nt, Pseudomonas putida KT2440
uggccgacauggcg

SEQ ID NO: 1564039 - RNA, 17 nt, Pseudomonas putida KT2440
uggccgcauauacgccg

SEQ ID NO: 1564040 - RNA, 17 nt, Pseudomonas putida KT2440
uggccgccaacagcgca

SEQ ID NO: 1564041 - RNA, 19 nt, Pseudomonas putida KT2440
uggccgccaaggcgaugcu

SEQ ID NO: 1564042 - RNA, 23 nt, Pseudomonas putida KT2440
uggccgcaacacauuauccacca

SEQ ID NO: 1564043 - RNA, 13 nt, Pseudomonas putida KT2440
uggccgcaaccug

SEQ ID NO: 1564044 - RNA, 15 nt, Pseudomonas putida KT2440
uggccgcaauggcgc

SEQ ID NO: 1564045 - RNA, 14 nt, Pseudomonas putida KT2440
uggccgccagcggc

SEQ ID NO: 1564046 - RNA, 16 nt, Pseudomonas putida KT2440
uggccgccagcggcgu

SEQ ID NO: 1564047 - RNA, 22 nt, Pseudomonas putida KT2440
uggccuguccaggcaaucacug

SEQ ID NO: 1564048 - RNA, 17 nt, Pseudomonas putida KT2440
uggccuucaucgcugcg

SEQ ID NO: 1564049 - RNA, 15 nt, Pseudomonas putida KT2440
uggccuuuucgcggg

SEQ ID NO: 1564050 - RNA, 15 nt, Pseudomonas putida KT2440
uggccugcucacccg

SEQ ID NO: 1564051 - RNA, 20 nt, Pseudomonas putida KT2440
uggccugcucacccgaccag

SEQ ID NO: 1564052 - RNA, 22 nt, Pseudomonas putida KT2440
uggccggcgcugagcgacagca

SEQ ID NO: 1564053 - RNA, 16 nt, Pseudomonas putida KT2440
uggccggcaucgcagc

SEQ ID NO: 1564054 - RNA, 16 nt, Pseudomonas putida KT2440
uggccggcacugacca

SEQ ID NO: 1564055 - RNA, 15 nt, Pseudomonas putida KT2440
uggcgcgccuugggc

SEQ ID NO: 1564056 - RNA, 17 nt, Pseudomonas putida KT2440
uggcgcgaugcgguugc

SEQ ID NO: 1564057 - RNA, 14 nt, Pseudomonas putida KT2440
uggcgcgaucccug

SEQ ID NO: 1564058 - RNA, 21 nt, Pseudomonas putida KT2440
uggcgcgaucccugugggagc

SEQ ID NO: 1564059 - RNA, 17 nt, Pseudomonas putida KT2440
uggcgcgaccaucaccg

SEQ ID NO: 1564060 - RNA, 20 nt, Pseudomonas putida KT2440
uggcgcgaccaucaccgcca

SEQ ID NO: 1564061 - RNA, 14 nt, Pseudomonas putida KT2440
uggcgcccuccauc

SEQ ID NO: 1564062 - RNA, 15 nt, Pseudomonas putida KT2440
uggcgcuggucaauc

SEQ ID NO: 1564063 - RNA, 22 nt, Pseudomonas putida KT2440
uggcggagccagccacagacgg

SEQ ID NO: 1564064 - RNA, 14 nt, Pseudomonas putida KT2440
uggcggcagcaacg

SEQ ID NO: 1564065 - RNA, 21 nt, Pseudomonas putida KT2440
uggcggaucugacggcgcugc

SEQ ID NO: 1564066 - RNA, 22 nt, Pseudomonas putida KT2440
uggcggaucugacggcgcugcu

SEQ ID NO: 1564067 - RNA, 18 nt, Pseudomonas putida KT2440
uggcgaacacuuggcagc

SEQ ID NO: 1564068 - RNA, 23 nt, Pseudomonas putida KT2440
uggcgaagaccgccgcccagguc

SEQ ID NO: 1564069 - RNA, 23 nt, Pseudomonas putida KT2440
uggcgcagagggucuugggucgc

SEQ ID NO: 1564070 - RNA, 15 nt, Pseudomonas putida KT2440
uggcgcagcaccgug

SEQ ID NO: 1564071 - RNA, 14 nt, Pseudomonas putida KT2440
uggcgcacuuguuc

SEQ ID NO: 1564072 - RNA, 19 nt, Pseudomonas putida KT2440
uggcgcaccgagcgcucgc

SEQ ID NO: 1564073 - RNA, 18 nt, Pseudomonas putida KT2440
uggcgcaucuuccagcac

SEQ ID NO: 1564074 - RNA, 18 nt, Pseudomonas putida KT2440
uggcgcagcagguccagc

SEQ ID NO: 1564075 - RNA, 16 nt, Pseudomonas putida KT2440
uggcgccagcgaugcu

SEQ ID NO: 1564076 - RNA, 15 nt, Pseudomonas putida KT2440
uggcguaauccagcu

SEQ ID NO: 1564077 - RNA, 21 nt, Pseudomonas putida KT2440
uggcguaauccagcugcugga

SEQ ID NO: 1564078 - RNA, 21 nt, Pseudomonas putida KT2440
uggcggcauacaccaccggcc

SEQ ID NO: 1564079 - RNA, 15 nt, Pseudomonas putida KT2440
uggcggccagcgcau

SEQ ID NO: 1564080 - RNA, 19 nt, Pseudomonas putida KT2440
uggcggccagcgcaucggc

SEQ ID NO: 1564081 - RNA, 15 nt, Pseudomonas putida KT2440
uggcggccaaugcug

SEQ ID NO: 1564082 - RNA, 16 nt, Pseudomonas putida KT2440
uggcggcccgccggca

SEQ ID NO: 1564083 - RNA, 17 nt, Pseudomonas putida KT2440
uggcggcccgccggcaa

SEQ ID NO: 1564084 - RNA, 13 nt, Pseudomonas putida KT2440
uggcgucgaugau

SEQ ID NO: 1564085 - RNA, 15 nt, Pseudomonas putida KT2440
uggcugaccggcacg

SEQ ID NO: 1564086 - RNA, 14 nt, Pseudomonas putida KT2440
uggcguugccuucg

SEQ ID NO: 1564087 - RNA, 15 nt, Pseudomonas putida KT2440
uggcguugagcuuga

SEQ ID NO: 1564088 - RNA, 12 nt, Pseudomonas putida KT2440
uggcugccgcug

SEQ ID NO: 1564089 - RNA, 21 nt, Pseudomonas putida KT2440
uggcugccagcgcgcugcgca

SEQ ID NO: 1564090 - RNA, 16 nt, Pseudomonas putida KT2440
uggcugccggccuguu

SEQ ID NO: 1564091 - RNA, 20 nt, Pseudomonas putida KT2440
uggcugcguuuaccggcacc

SEQ ID NO: 1564092 - RNA, 12 nt, Pseudomonas putida KT2440
uggcugcacugg

SEQ ID NO: 1564093 - RNA, 19 nt, Pseudomonas putida KT2440
uggcugcaagguccaggcg

SEQ ID NO: 1564094 - RNA, 18 nt, Pseudomonas putida KT2440
uggcugcaccccgaucca

SEQ ID NO: 1564095 - RNA, 22 nt, Pseudomonas putida KT2440
uggcugauagccgccagcauca

SEQ ID NO: 1564096 - RNA, 17 nt, Pseudomonas putida KT2440
ugggaagcugcagcagc

SEQ ID NO: 1564097 - RNA, 22 nt, Pseudomonas putida KT2440
ugggaaaccgugucgggcaguu

SEQ ID NO: 1564098 - RNA, 15 nt, Pseudomonas putida KT2440
uggcuuuccaggucc

SEQ ID NO: 1564099 - RNA, 21 nt, Pseudomonas putida KT2440
uggcuuuugccacuucaccca

SEQ ID NO: 1564100 - RNA, 21 nt, Pseudomonas putida KT2440
ugggcgagcaggugacccugg

SEQ ID NO: 1564101 - RNA, 18 nt, Pseudomonas putida KT2440
ugggcgaugaucgagccg

SEQ ID NO: 1564102 - RNA, 21 nt, Pseudomonas putida KT2440
ugggcgaucacauaaggcagc

SEQ ID NO: 1564103 - RNA, 23 nt, Pseudomonas putida KT2440
ugggcgcaacaucgaucugguga

SEQ ID NO: 1564104 - RNA, 18 nt, Pseudomonas putida KT2440
ugggcgaagucccgacag

SEQ ID NO: 1564105 - RNA, 22 nt, Pseudomonas putida KT2440
ugggccagaaaugguguccacu

SEQ ID NO: 1564106 - RNA, 18 nt, Pseudomonas putida KT2440
ugggcaggucgacccgcg

SEQ ID NO: 1564107 - RNA, 22 nt, Pseudomonas putida KT2440
ugggcaggcccagguaacugcc

SEQ ID NO: 1564108 - RNA, 13 nt, Pseudomonas putida KT2440
ugggagcaggcau

SEQ ID NO: 1564109 - RNA, 20 nt, Pseudomonas putida KT2440
ugggagcggccuugcgucgc

SEQ ID NO: 1564110 - RNA, 17 nt, Pseudomonas putida KT2440
ugggagcggccuugugc

SEQ ID NO: 1564111 - RNA, 22 nt, Pseudomonas putida KT2440
ugggagcggccuugugcggccc

SEQ ID NO: 1564112 - RNA, 20 nt, Pseudomonas putida KT2440
ugggagcggccuugugucgc

SEQ ID NO: 1564113 - RNA, 13 nt, Pseudomonas putida KT2440
ugggagcgggcau

SEQ ID NO: 1564114 - RNA, 13 nt, Pseudomonas putida KT2440
ugggagcgggcgu

SEQ ID NO: 1564115 - RNA, 20 nt, Pseudomonas putida KT2440
ugggagcgggcuugcccgcg

SEQ ID NO: 1564116 - RNA, 16 nt, Pseudomonas putida KT2440
ugggugccaucagggc

SEQ ID NO: 1564117 - RNA, 19 nt, Pseudomonas putida KT2440
ugggcgguccuucaugccg

SEQ ID NO: 1564118 - RNA, 22 nt, Pseudomonas putida KT2440
ugggcggggugaucgacagguu

SEQ ID NO: 1564119 - RNA, 19 nt, Pseudomonas putida KT2440
uggggcugccuugcagccc

SEQ ID NO: 1564120 - RNA, 19 nt, Pseudomonas putida KT2440
uggggcugcuuugcagccc

SEQ ID NO: 1564121 - RNA, 19 nt, Pseudomonas putida KT2440
uggggcugcauugcagccc

SEQ ID NO: 1564122 - RNA, 13 nt, Pseudomonas putida KT2440
uggggcugacgcg

SEQ ID NO: 1564123 - RNA, 12 nt, Pseudomonas putida KT2440
uggggcgauguu

SEQ ID NO: 1564124 - RNA, 16 nt, Pseudomonas putida KT2440
uaaagauuaggcucca

SEQ ID NO: 1564125 - RNA, 18 nt, Pseudomonas putida KT2440
uaaaccggguaggcccca

SEQ ID NO: 1564126 - RNA, 11 nt, Pseudomonas putida KT2440
uaaacccgcgc

SEQ ID NO: 1564127 - RNA, 16 nt, Pseudomonas putida KT2440
uaaacccgcuccuaca

SEQ ID NO: 1564128 - RNA, 19 nt, Pseudomonas putida KT2440
uaaacccgcuccuacaggg

SEQ ID NO: 1564129 - RNA, 14 nt, Pseudomonas putida KT2440
uaaacacgaacauc

SEQ ID NO: 1564130 - RNA, 18 nt, Pseudomonas putida KT2440
guuucagauacugcaccc

SEQ ID NO: 1564131 - RNA, 15 nt, Pseudomonas putida KT2440
uaaaagcuggcgcga

SEQ ID NO: 1564132 - RNA, 17 nt, Pseudomonas putida KT2440
uaacgaaucugcagugc

SEQ ID NO: 1564133 - RNA, 20 nt, Pseudomonas putida KT2440
uacaccggcagcaccggcaa

SEQ ID NO: 1564134 - RNA, 22 nt, Pseudomonas putida KT2440
uacaccccgaccaaggccaacu

SEQ ID NO: 1564135 - RNA, 15 nt, Pseudomonas putida KT2440
uacagcacaccuucc

SEQ ID NO: 1564136 - RNA, 11 nt, Pseudomonas putida KT2440
uacaccgccuc

SEQ ID NO: 1564137 - RNA, 14 nt, Pseudomonas putida KT2440
uacaaugcacuucu

SEQ ID NO: 1564138 - RNA, 23 nt, Pseudomonas putida KT2440
uacacagcccaaggcuggccaga

SEQ ID NO: 1564139 - RNA, 22 nt, Pseudomonas putida KT2440
uaagccgccguggcacgcucgc

SEQ ID NO: 1564140 - RNA, 15 nt, Pseudomonas putida KT2440
uaagcgcugcgcagg

SEQ ID NO: 1564141 - RNA, 20 nt, Pseudomonas putida KT2440
uaaguuugcccagcgcugca

SEQ ID NO: 1564142 - RNA, 12 nt, Pseudomonas putida KT2440
uagccgccagca

SEQ ID NO: 1564143 - RNA, 13 nt, Pseudomonas putida KT2440
uagccgccagcau

SEQ ID NO: 1564144 - RNA, 16 nt, Pseudomonas putida KT2440
uagcgcacuugcacuu

SEQ ID NO: 1564145 - RNA, 15 nt, Pseudomonas putida KT2440
uagcgcacugagcaa

SEQ ID NO: 1564146 - RNA, 19 nt, Pseudomonas putida KT2440
uagcgcaucuuccggcacc

SEQ ID NO: 1564147 - RNA, 13 nt, Pseudomonas putida KT2440
uagccccgaggaa

SEQ ID NO: 1564148 - RNA, 13 nt, Pseudomonas putida KT2440
uagcccaccuuca

SEQ ID NO: 1564149 - RNA, 20 nt, Pseudomonas putida KT2440
uagcccguauucgcggguaa

SEQ ID NO: 1564150 - RNA, 21 nt, Pseudomonas putida KT2440
uagccaaucugauuugcgcua

SEQ ID NO: 1564151 - RNA, 18 nt, Pseudomonas putida KT2440
uagcagguaaacccgcgc

SEQ ID NO: 1564152 - RNA, 16 nt, Pseudomonas putida KT2440
uagcacaagggccagg

SEQ ID NO: 1564153 - RNA, 14 nt, Pseudomonas putida KT2440
uagcagcaccgauc

SEQ ID NO: 1564154 - RNA, 13 nt, Pseudomonas putida KT2440
uacuugcugcagg

SEQ ID NO: 1564155 - RNA, 16 nt, Pseudomonas putida KT2440
uacuuggccugggcuu

SEQ ID NO: 1564156 - RNA, 18 nt, Pseudomonas putida KT2440
uagacaaaaaaaucggcc

SEQ ID NO: 1564157 - RNA, 18 nt, Pseudomonas putida KT2440
uacugagucggccucgau

SEQ ID NO: 1564158 - RNA, 19 nt, Pseudomonas putida KT2440
uacugcagaacauggccga

SEQ ID NO: 1564159 - RNA, 18 nt, Pseudomonas putida KT2440
uacuggccaauugcgcca

SEQ ID NO: 1564160 - RNA, 23 nt, Pseudomonas putida KT2440
uacuggcuucgaugaaggcugcu

SEQ ID NO: 1564161 - RNA, 17 nt, Pseudomonas putida KT2440
uacgcaaucgcucaggg

SEQ ID NO: 1564162 - RNA, 21 nt, Pseudomonas putida KT2440
uacgcacaggcgcagcagcuu

SEQ ID NO: 1564163 - RNA, 16 nt, Pseudomonas putida KT2440
uacgcaccaacugguc

SEQ ID NO: 1564164 - RNA, 19 nt, Pseudomonas putida KT2440
uacgcaccgcuaccauggc

SEQ ID NO: 1564165 - RNA, 22 nt, Pseudomonas putida KT2440
uacgcagcacccggucgccgac

SEQ ID NO: 1564166 - RNA, 23 nt, Pseudomonas putida KT2440
uacgcccauggcccugaucugcc

SEQ ID NO: 1564167 - RNA, 18 nt, Pseudomonas putida KT2440
uacgccaugugcgcccga

SEQ ID NO: 1564168 - RNA, 22 nt, Pseudomonas putida KT2440
uacgccaugugcgcccgaacaa

SEQ ID NO: 1564169 - RNA, 16 nt, Pseudomonas putida KT2440
uaccgucgaucagcuu

SEQ ID NO: 1564170 - RNA, 21 nt, Pseudomonas putida KT2440
uacgagucauccucaccggca

SEQ ID NO: 1564171 - RNA, 15 nt, Pseudomonas putida KT2440
uaccguagcggucau

SEQ ID NO: 1564172 - RNA, 16 nt, Pseudomonas putida KT2440
uaccgcaacaccugcc

SEQ ID NO: 1564173 - RNA, 21 nt, Pseudomonas putida KT2440
uaccgcacagcaucacccgcg

SEQ ID NO: 1564174 - RNA, 20 nt, Pseudomonas putida KT2440
uaccggccucuucgcgggca

SEQ ID NO: 1564175 - RNA, 15 nt, Pseudomonas putida KT2440
uaccggcgccgccca

SEQ ID NO: 1564176 - RNA, 15 nt, Pseudomonas putida KT2440
uaccggacugcgcua

SEQ ID NO: 1564177 - RNA, 23 nt, Pseudomonas putida KT2440
uaccgcugcgcaccaaggcggca

SEQ ID NO: 1564178 - RNA, 17 nt, Pseudomonas putida KT2440
uaccgcugggcacccug

SEQ ID NO: 1564179 - RNA, 15 nt, Pseudomonas putida KT2440
uaccgccguccacca

SEQ ID NO: 1564180 - RNA, 17 nt, Pseudomonas putida KT2440
uaccaacaccggcgaug

SEQ ID NO: 1564181 - RNA, 14 nt, Pseudomonas putida KT2440
uaccaacgcagcau

SEQ ID NO: 1564182 - RNA, 22 nt, Pseudomonas putida KT2440
uaccaaggcgguggaguaccug

SEQ ID NO: 1564183 - RNA, 16 nt, Pseudomonas putida KT2440
uaccagcuugccgcgu

SEQ ID NO: 1564184 - RNA, 20 nt, Pseudomonas putida KT2440
uaccagcuugugaucccgcg

SEQ ID NO: 1564185 - RNA, 23 nt, Pseudomonas putida KT2440
uaccagcaccaucagagcgccag

SEQ ID NO: 1564186 - RNA, 15 nt, Pseudomonas putida KT2440
uaccacacaccccag

SEQ ID NO: 1564187 - RNA, 15 nt, Pseudomonas putida KT2440
uacccuguacccgcu

SEQ ID NO: 1564188 - RNA, 20 nt, Pseudomonas putida KT2440
uacccgguaaaaccgcucga

SEQ ID NO: 1564189 - RNA, 21 nt, Pseudomonas putida KT2440
uacccgguaaaaccgcucgaa

SEQ ID NO: 1564190 - RNA, 13 nt, Pseudomonas putida KT2440
uacccggucaggg

SEQ ID NO: 1564191 - RNA, 20 nt, Pseudomonas putida KT2440
uacccggucagggugaaguc

SEQ ID NO: 1564192 - RNA, 15 nt, Pseudomonas putida KT2440
uaccccgaugcgcug

SEQ ID NO: 1564193 - RNA, 13 nt, Pseudomonas putida KT2440
uacccgccagcaa

SEQ ID NO: 1564194 - RNA, 21 nt, Pseudomonas putida KT2440
uacccgcgaagaagccggcau

SEQ ID NO: 1564195 - RNA, 20 nt, Pseudomonas putida KT2440
uacccgcgaagaggccggca

SEQ ID NO: 1564196 - RNA, 20 nt, Pseudomonas putida KT2440
uacccgcgaaugggccgcca

SEQ ID NO: 1564197 - RNA, 19 nt, Pseudomonas putida KT2440
uacccgcguuggcagcacc

SEQ ID NO: 1564198 - RNA, 17 nt, Pseudomonas putida KT2440
uacccagcgcgcgcaga

SEQ ID NO: 1564199 - RNA, 12 nt, Pseudomonas putida KT2440
uaccccaggcaa

SEQ ID NO: 1564200 - RNA, 16 nt, Pseudomonas putida KT2440
uacccaggcgcgccug

SEQ ID NO: 1564201 - RNA, 17 nt, Pseudomonas putida KT2440
uaccaggucgccagcac

SEQ ID NO: 1564202 - RNA, 19 nt, Pseudomonas putida KT2440
uaccauccaucaccauggc

SEQ ID NO: 1564203 - RNA, 20 nt, Pseudomonas putida KT2440
uacccaaggccagcccaugg

SEQ ID NO: 1564204 - RNA, 19 nt, Pseudomonas putida KT2440
guguucuaccgcguuggac

SEQ ID NO: 1564205 - RNA, 15 nt, Pseudomonas putida KT2440
guguugccacccggc

SEQ ID NO: 1564206 - RNA, 14 nt, Pseudomonas putida KT2440
guguugcugggcga

SEQ ID NO: 1564207 - RNA, 19 nt, Pseudomonas putida KT2440
guguuguugcaaccaggcg

SEQ ID NO: 1564208 - RNA, 23 nt, Pseudomonas putida KT2440
guguuucaaaaaaaagggcaucu

SEQ ID NO: 1564209 - RNA, 12 nt, Pseudomonas putida KT2440
guuaagcgccac

SEQ ID NO: 1564210 - RNA, 16 nt, Pseudomonas putida KT2440
gugugcucggcgaugc

SEQ ID NO: 1564211 - RNA, 14 nt, Pseudomonas putida KT2440
guguggaaacccgc

SEQ ID NO: 1564212 - RNA, 18 nt, Pseudomonas putida KT2440
guguggaaacccgcauca

SEQ ID NO: 1564213 - RNA, 15 nt, Pseudomonas putida KT2440
guguggccagugcca

SEQ ID NO: 1564214 - RNA, 13 nt, Pseudomonas putida KT2440
gugugggccuugc

SEQ ID NO: 1564215 - RNA, 12 nt, Pseudomonas putida KT2440
guguuccagcac

SEQ ID NO: 1564216 - RNA, 20 nt, Pseudomonas putida KT2440
guguucgcgggcaugcccgc

SEQ ID NO: 1564217 - RNA, 21 nt, Pseudomonas putida KT2440
gugugcuccagcuccaggcga

SEQ ID NO: 1564218 - RNA, 15 nt, Pseudomonas putida KT2440
gugugcucacgguga

SEQ ID NO: 1564219 - RNA, 20 nt, Pseudomonas putida KT2440
gugugccacuucaugggcca

SEQ ID NO: 1564220 - RNA, 14 nt, Pseudomonas putida KT2440
gugugcccaccgca

SEQ ID NO: 1564221 - RNA, 22 nt, Pseudomonas putida KT2440
gugugcauuuucggcaaggcga

SEQ ID NO: 1564222 - RNA, 13 nt, Pseudomonas putida KT2440
gugugcaggugga

SEQ ID NO: 1564223 - RNA, 13 nt, Pseudomonas putida KT2440
gugucugcgccug

SEQ ID NO: 1564224 - RNA, 14 nt, Pseudomonas putida KT2440
gugucugcgccugc

SEQ ID NO: 1564225 - RNA, 19 nt, Pseudomonas putida KT2440
gugugacccaguucgcgga

SEQ ID NO: 1564226 - RNA, 14 nt, Pseudomonas putida KT2440
gugucuuccggcau

SEQ ID NO: 1564227 - RNA, 19 nt, Pseudomonas putida KT2440
gugucgauacucacccgcu

SEQ ID NO: 1564228 - RNA, 15 nt, Pseudomonas putida KT2440
gugucgucacggcgc

SEQ ID NO: 1564229 - RNA, 12 nt, Pseudomonas putida KT2440
guguaucggcca

SEQ ID NO: 1564230 - RNA, 23 nt, Pseudomonas putida KT2440
gugucaacaggcuggccgacguc

SEQ ID NO: 1564231 - RNA, 23 nt, Pseudomonas putida KT2440
guguccgccgccgucagguucaa

SEQ ID NO: 1564232 - RNA, 20 nt, Pseudomonas putida KT2440
guguccacccccgcuccuac

SEQ ID NO: 1564233 - RNA, 21 nt, Pseudomonas putida KT2440
guguccacccccgcuccuacg

SEQ ID NO: 1564234 - RNA, 22 nt, Pseudomonas putida KT2440
guguccacccccgcuccuacgg

SEQ ID NO: 1564235 - RNA, 16 nt, Pseudomonas putida KT2440
guguacgggacaaggc

SEQ ID NO: 1564236 - RNA, 19 nt, Pseudomonas putida KT2440
guguagaacggcagcaggc

SEQ ID NO: 1564237 - RNA, 19 nt, Pseudomonas putida KT2440
guguaggagcggguuuacc

SEQ ID NO: 1564238 - RNA, 16 nt, Pseudomonas putida KT2440
gugguugucggucagg

SEQ ID NO: 1564239 - RNA, 16 nt, Pseudomonas putida KT2440
gugguguacagcaaca

SEQ ID NO: 1564240 - RNA, 16 nt, Pseudomonas putida KT2440
gugcguucaccggcac

SEQ ID NO: 1564241 - RNA, 18 nt, Pseudomonas putida KT2440
gugcguucaccggcaccu

SEQ ID NO: 1564242 - RNA, 17 nt, Pseudomonas putida KT2440
guucaugcccaccgcug

SEQ ID NO: 1564243 - RNA, 12 nt, Pseudomonas putida KT2440
guucaugccggc

SEQ ID NO: 1564244 - RNA, 14 nt, Pseudomonas putida KT2440
guucaucgaacugc

SEQ ID NO: 1564245 - RNA, 15 nt, Pseudomonas putida KT2440
guucaucgaacugca

SEQ ID NO: 1564246 - RNA, 20 nt, Pseudomonas putida KT2440
guuccagccguccucgaccc

SEQ ID NO: 1564247 - RNA, 14 nt, Pseudomonas putida KT2440
guucagguacagca

SEQ ID NO: 1564248 - RNA, 13 nt, Pseudomonas putida KT2440
guucaggucguga

SEQ ID NO: 1564249 - RNA, 12 nt, Pseudomonas putida KT2440
guucaggccggu

SEQ ID NO: 1564250 - RNA, 18 nt, Pseudomonas putida KT2440
guucaggcgcagcacgcc

SEQ ID NO: 1564251 - RNA, 19 nt, Pseudomonas putida KT2440
guucagguguuccagcacg

SEQ ID NO: 1564252 - RNA, 18 nt, Pseudomonas putida KT2440
guucagcggguugguaug

SEQ ID NO: 1564253 - RNA, 22 nt, Pseudomonas putida KT2440
guucacccgcgaagaggccgga

SEQ ID NO: 1564254 - RNA, 21 nt, Pseudomonas putida KT2440
guucacccgcgaagcaggcga

SEQ ID NO: 1564255 - RNA, 18 nt, Pseudomonas putida KT2440
guucaccguacccaggug

SEQ ID NO: 1564256 - RNA, 19 nt, Pseudomonas putida KT2440
guucaccguguuguucgcc

SEQ ID NO: 1564257 - RNA, 15 nt, Pseudomonas putida KT2440
guucaccuugggcga

SEQ ID NO: 1564258 - RNA, 18 nt, Pseudomonas putida KT2440
guucagccaacggcguga

SEQ ID NO: 1564259 - RNA, 20 nt, Pseudomonas putida KT2440
guucacgggucaccacggga

SEQ ID NO: 1564260 - RNA, 16 nt, Pseudomonas putida KT2440
guuaguucgugcaccc

SEQ ID NO: 1564261 - RNA, 14 nt, Pseudomonas putida KT2440
guuacgcccggcaa

SEQ ID NO: 1564262 - RNA, 15 nt, Pseudomonas putida KT2440
guuacgcccggcaau

SEQ ID NO: 1564263 - RNA, 16 nt, Pseudomonas putida KT2440
guuacggcggccugcu

SEQ ID NO: 1564264 - RNA, 18 nt, Pseudomonas putida KT2440
guuauacgccgccgaggc

SEQ ID NO: 1564265 - RNA, 21 nt, Pseudomonas putida KT2440
guucacacucagccgcugcgc

SEQ ID NO: 1564266 - RNA, 18 nt, Pseudomonas putida KT2440
guucacccacacccgcgc

SEQ ID NO: 1564267 - RNA, 13 nt, Pseudomonas putida KT2440
guucacaucgccc

SEQ ID NO: 1564268 - RNA, 18 nt, Pseudomonas putida KT2440
guucacaucgcccuucug

SEQ ID NO: 1564269 - RNA, 21 nt, Pseudomonas putida KT2440
guucaaggaaggcaaucgcgc

SEQ ID NO: 1564270 - RNA, 17 nt, Pseudomonas putida KT2440
guucaagggcaggguga

SEQ ID NO: 1564271 - RNA, 20 nt, Pseudomonas putida KT2440
guuccggccucuucgcgggc

SEQ ID NO: 1564272 - RNA, 20 nt, Pseudomonas putida KT2440
guuccucaagcggccucgac

SEQ ID NO: 1564273 - RNA, 14 nt, Pseudomonas putida KT2440
guuccucggccuga

SEQ ID NO: 1564274 - RNA, 11 nt, Pseudomonas putida KT2440
guuccugcagg

SEQ ID NO: 1564275 - RNA, 17 nt, Pseudomonas putida KT2440
guuccaugucgugcugc

SEQ ID NO: 1564276 - RNA, 13 nt, Pseudomonas putida KT2440
guuccaucaccgg

SEQ ID NO: 1564277 - RNA, 22 nt, Pseudomonas putida KT2440
guucccgccauguugcgcagca

SEQ ID NO: 1564278 - RNA, 23 nt, Pseudomonas putida KT2440
guucgaugcgcagagccacgggu

SEQ ID NO: 1564279 - RNA, 18 nt, Pseudomonas putida KT2440
guucgccaugacguugca

SEQ ID NO: 1564280 - RNA, 18 nt, Pseudomonas putida KT2440
guucgcccuccugcagca

SEQ ID NO: 1564281 - RNA, 12 nt, Pseudomonas putida KT2440
guucgcccugcg

SEQ ID NO: 1564282 - RNA, 18 nt, Pseudomonas putida KT2440
guucgcccugcgccugca

SEQ ID NO: 1564283 - RNA, 21 nt, Pseudomonas putida KT2440
guucgacgcugcuguccagac

SEQ ID NO: 1564284 - RNA, 16 nt, Pseudomonas putida KT2440
guucgacgaucgacuu

SEQ ID NO: 1564285 - RNA, 17 nt, Pseudomonas putida KT2440
guucgaaaccacccuga

SEQ ID NO: 1564286 - RNA, 13 nt, Pseudomonas putida KT2440
guucggcggaacc

SEQ ID NO: 1564287 - RNA, 20 nt, Pseudomonas putida KT2440
guucgggaaguuacgggucg

SEQ ID NO: 1564288 - RNA, 16 nt, Pseudomonas putida KT2440
guucuguuucaccagc

SEQ ID NO: 1564289 - RNA, 15 nt, Pseudomonas putida KT2440
guugaccagcaccag

SEQ ID NO: 1564290 - RNA, 16 nt, Pseudomonas putida KT2440
guucuggcagcuccag

SEQ ID NO: 1564291 - RNA, 23 nt, Pseudomonas putida KT2440
guucuggccuuggcgugcacgcu

SEQ ID NO: 1564292 - RNA, 18 nt, Pseudomonas putida KT2440
guucggugcucaggcuca

SEQ ID NO: 1564293 - RNA, 15 nt, Pseudomonas putida KT2440
guucgccucgucggc

SEQ ID NO: 1564294 - RNA, 15 nt, Pseudomonas putida KT2440
guucgcgcaccaucg

SEQ ID NO: 1564295 - RNA, 18 nt, Pseudomonas putida KT2440
guucgcgagaaccggggc

SEQ ID NO: 1564296 - RNA, 22 nt, Pseudomonas putida KT2440
guucgcgcaagcaggugcgcag

SEQ ID NO: 1564297 - RNA, 15 nt, Pseudomonas putida KT2440
guucgcgugccaccu

SEQ ID NO: 1564298 - RNA, 14 nt, Pseudomonas putida KT2440
guucgcugcgcaag

SEQ ID NO: 1564299 - RNA, 16 nt, Pseudomonas putida KT2440
guucgcugaugcgccg

SEQ ID NO: 1564300 - RNA, 14 nt, Pseudomonas putida KT2440
guucggacaggcgc

SEQ ID NO: 1564301 - RNA, 17 nt, Pseudomonas putida KT2440
guucggacaggcgcuug

SEQ ID NO: 1564302 - RNA, 17 nt, Pseudomonas putida KT2440
guugaugccacgggcaa

SEQ ID NO: 1564303 - RNA, 18 nt, Pseudomonas putida KT2440
guugcccggcgagcgcag

SEQ ID NO: 1564304 - RNA, 20 nt, Pseudomonas putida KT2440
guugaccagggcgucgaaca

SEQ ID NO: 1564305 - RNA, 17 nt, Pseudomonas putida KT2440
guugaccgacgccagga

SEQ ID NO: 1564306 - RNA, 18 nt, Pseudomonas putida KT2440
guugaccguccacaccga

SEQ ID NO: 1564307 - RNA, 18 nt, Pseudomonas putida KT2440
guugaccguguugcagcg

SEQ ID NO: 1564308 - RNA, 18 nt, Pseudomonas putida KT2440
guugauccaggcuuggcg

SEQ ID NO: 1564309 - RNA, 20 nt, Pseudomonas putida KT2440
guugaugaaauccaccagcu

SEQ ID NO: 1564310 - RNA, 19 nt, Pseudomonas putida KT2440
guugcgcccggcgucgaac

SEQ ID NO: 1564311 - RNA, 16 nt, Pseudomonas putida KT2440
guugcgcaucaccucg

SEQ ID NO: 1564312 - RNA, 21 nt, Pseudomonas putida KT2440
guugcgcagguacacgggcau

SEQ ID NO: 1564313 - RNA, 14 nt, Pseudomonas putida KT2440
guugcguugcagcu

SEQ ID NO: 1564314 - RNA, 13 nt, Pseudomonas putida KT2440
guugugcuggccc

SEQ ID NO: 1564315 - RNA, 21 nt, Pseudomonas putida KT2440
guuguuugucaccccguucgc

SEQ ID NO: 1564316 - RNA, 18 nt, Pseudomonas putida KT2440
guuguugggcagccacgc

SEQ ID NO: 1564317 - RNA, 23 nt, Pseudomonas putida KT2440
guuguugggcagccacgcuccag

SEQ ID NO: 1564318 - RNA, 23 nt, Pseudomonas putida KT2440
guugugcacuuucuugacccgcu

SEQ ID NO: 1564319 - RNA, 22 nt, Pseudomonas putida KT2440
guuggucaccacguugcgcuug

SEQ ID NO: 1564320 - RNA, 19 nt, Pseudomonas putida KT2440
guugguaucgaucaggaag

SEQ ID NO: 1564321 - RNA, 19 nt, Pseudomonas putida KT2440
guuggucagcgacugccaa

SEQ ID NO: 1564322 - RNA, 22 nt, Pseudomonas putida KT2440
guuggucgccaggaucaccucg

SEQ ID NO: 1564323 - RNA, 22 nt, Pseudomonas putida KT2440
guugggcgggccgccgaacagg

SEQ ID NO: 1564324 - RNA, 13 nt, Pseudomonas putida KT2440
guuggcggagcca

SEQ ID NO: 1564325 - RNA, 12 nt, Pseudomonas putida KT2440
guugggcacgaa

SEQ ID NO: 1564326 - RNA, 16 nt, Pseudomonas putida KT2440
guuggccggcauggcg

SEQ ID NO: 1564327 - RNA, 13 nt, Pseudomonas putida KT2440
uccccuuggcccu

SEQ ID NO: 1564328 - RNA, 18 nt, Pseudomonas putida KT2440
uccccuuggcgacgugcc

SEQ ID NO: 1564329 - RNA, 15 nt, Pseudomonas putida KT2440
ucccggacagcagca

SEQ ID NO: 1564330 - RNA, 23 nt, Pseudomonas putida KT2440
ucccggcacaaccgaacccgcug

SEQ ID NO: 1564331 - RNA, 16 nt, Pseudomonas putida KT2440
ucccgcuucgccagcg

SEQ ID NO: 1564332 - RNA, 16 nt, Pseudomonas putida KT2440
uccccgcccaagcggc

SEQ ID NO: 1564333 - RNA, 18 nt, Pseudomonas putida KT2440
uccccgcccaagcggcag

SEQ ID NO: 1564334 - RNA, 14 nt, Pseudomonas putida KT2440
ucccccagccaacg

SEQ ID NO: 1564335 - RNA, 16 nt, Pseudomonas putida KT2440
uccccgccgugcaguu

SEQ ID NO: 1564336 - RNA, 22 nt, Pseudomonas putida KT2440
uccccggccuccucgcgggcaa

SEQ ID NO: 1564337 - RNA, 19 nt, Pseudomonas putida KT2440
uccccggcgacggcgaggu

SEQ ID NO: 1564338 - RNA, 17 nt, Pseudomonas putida KT2440
uccccggucagcauggc

SEQ ID NO: 1564339 - RNA, 16 nt, Pseudomonas putida KT2440
ucccacggccgcgcag

SEQ ID NO: 1564340 - RNA, 19 nt, Pseudomonas putida KT2440
ucccacaaaaaagcagggc

SEQ ID NO: 1564341 - RNA, 15 nt, Pseudomonas putida KT2440
uccaucaccugccca

SEQ ID NO: 1564342 - RNA, 21 nt, Pseudomonas putida KT2440
uccauagugugcucacgguga

SEQ ID NO: 1564343 - RNA, 20 nt, Pseudomonas putida KT2440
ucccacagguccagcgcagg

SEQ ID NO: 1564344 - RNA, 19 nt, Pseudomonas putida KT2440
ucccacaggugcagcacag

SEQ ID NO: 1564345 - RNA, 22 nt, Pseudomonas putida KT2440
ucccacagggaccucacagccu

SEQ ID NO: 1564346 - RNA, 19 nt, Pseudomonas putida KT2440
ucccacagggaucgcgcca

SEQ ID NO: 1564347 - RNA, 23 nt, Pseudomonas putida KT2440
ucccaggcgcuugagcucggcaa

SEQ ID NO: 1564348 - RNA, 14 nt, Pseudomonas putida KT2440
uccccaccggcacc

SEQ ID NO: 1564349 - RNA, 15 nt, Pseudomonas putida KT2440
uccccaccggcacca

SEQ ID NO: 1564350 - RNA, 18 nt, Pseudomonas putida KT2440
uccccaccagcaucagcg

SEQ ID NO: 1564351 - RNA, 22 nt, Pseudomonas putida KT2440
uccccagcauuggauacugccc

SEQ ID NO: 1564352 - RNA, 12 nt, Pseudomonas putida KT2440
uccccagcaacg

SEQ ID NO: 1564353 - RNA, 14 nt, Pseudomonas putida KT2440
uccccaucacgcag

SEQ ID NO: 1564354 - RNA, 22 nt, Pseudomonas putida KT2440
uccccaucacgcagcgcggaaa

SEQ ID NO: 1564355 - RNA, 18 nt, Pseudomonas putida KT2440
uccccaucacgcgguauu

SEQ ID NO: 1564356 - RNA, 18 nt, Pseudomonas putida KT2440
uccgcgccgaucacaccg

SEQ ID NO: 1564357 - RNA, 20 nt, Pseudomonas putida KT2440
uccgcucuucucgucguagc

SEQ ID NO: 1564358 - RNA, 12 nt, Pseudomonas putida KT2440
uccggcaaacca

SEQ ID NO: 1564359 - RNA, 23 nt, Pseudomonas putida KT2440
uccggcgaagcacugucgauggc

SEQ ID NO: 1564360 - RNA, 17 nt, Pseudomonas putida KT2440
uccgcgcccagucaccg

SEQ ID NO: 1564361 - RNA, 15 nt, Pseudomonas putida KT2440
uccgcgccaucagcu

SEQ ID NO: 1564362 - RNA, 16 nt, Pseudomonas putida KT2440
uccgcgccaucagcug

SEQ ID NO: 1564363 - RNA, 13 nt, Pseudomonas putida KT2440
uccgccucgucga

SEQ ID NO: 1564364 - RNA, 15 nt, Pseudomonas putida KT2440
uccgccuaccgcguc

SEQ ID NO: 1564365 - RNA, 16 nt, Pseudomonas putida KT2440
uccgccucgaucauuu

SEQ ID NO: 1564366 - RNA, 16 nt, Pseudomonas putida KT2440
uccgccgucaccgccg

SEQ ID NO: 1564367 - RNA, 19 nt, Pseudomonas putida KT2440
uccgccaauugcgccagcc

SEQ ID NO: 1564368 - RNA, 18 nt, Pseudomonas putida KT2440
uccgccaccacgaacagu

SEQ ID NO: 1564369 - RNA, 18 nt, Pseudomonas putida KT2440
uccgccaagauccgcggc

SEQ ID NO: 1564370 - RNA, 15 nt, Pseudomonas putida KT2440
uccgccaaaccccag

SEQ ID NO: 1564371 - RNA, 17 nt, Pseudomonas putida KT2440
uccgccaaaccccagca

SEQ ID NO: 1564372 - RNA, 21 nt, Pseudomonas putida KT2440
uccgccaaaccccagcaaggc

SEQ ID NO: 1564373 - RNA, 16 nt, Pseudomonas putida KT2440
ucccgggaaaagccug

SEQ ID NO: 1564374 - RNA, 13 nt, Pseudomonas putida KT2440
ucccgggccaugu

SEQ ID NO: 1564375 - RNA, 23 nt, Pseudomonas putida KT2440
ucccggugcuggcugaucagcau

SEQ ID NO: 1564376 - RNA, 23 nt, Pseudomonas putida KT2440
ucccggucaacgcuucggccaug

SEQ ID NO: 1564377 - RNA, 13 nt, Pseudomonas putida KT2440
uccgaccccagca

SEQ ID NO: 1564378 - RNA, 13 nt, Pseudomonas putida KT2440
uccagcgcggcca

SEQ ID NO: 1564379 - RNA, 13 nt, Pseudomonas putida KT2440
uccagccugcagc

SEQ ID NO: 1564380 - RNA, 24 nt, Pseudomonas putida KT2440
uccagcgaugacccggccuuucgc

SEQ ID NO: 1564381 - RNA, 16 nt, Pseudomonas putida KT2440
uccagcgcaggcuuca

SEQ ID NO: 1564382 - RNA, 18 nt, Pseudomonas putida KT2440
uccaguuccugcuugccg

SEQ ID NO: 1564383 - RNA, 22 nt, Pseudomonas putida KT2440
uccagugcuucacugccggcaa

SEQ ID NO: 1564384 - RNA, 11 nt, Pseudomonas putida KT2440
uccagucggcc

SEQ ID NO: 1564385 - RNA, 21 nt, Pseudomonas putida KT2440
uccagcuccuucuucacccgc

SEQ ID NO: 1564386 - RNA, 13 nt, Pseudomonas putida KT2440
uccagcucggcaa

SEQ ID NO: 1564387 - RNA, 20 nt, Pseudomonas putida KT2440
uccagcuucaccucaucggc

SEQ ID NO: 1564388 - RNA, 18 nt, Pseudomonas putida KT2440
uccagcucuggucaccuu

SEQ ID NO: 1564389 - RNA, 20 nt, Pseudomonas putida KT2440
uccagcucuggucaccuucg

SEQ ID NO: 1564390 - RNA, 14 nt, Pseudomonas putida KT2440
uccagcugagcgcc

SEQ ID NO: 1564391 - RNA, 16 nt, Pseudomonas putida KT2440
uccagcugcaacagcg

SEQ ID NO: 1564392 - RNA, 18 nt, Pseudomonas putida KT2440
uccagcugcucguacgag

SEQ ID NO: 1564393 - RNA, 12 nt, Pseudomonas putida KT2440
uccaggcacacc

SEQ ID NO: 1564394 - RNA, 17 nt, Pseudomonas putida KT2440
uccagguucucgcucca

SEQ ID NO: 1564395 - RNA, 14 nt, Pseudomonas putida KT2440
uccaggaacgcugc

SEQ ID NO: 1564396 - RNA, 17 nt, Pseudomonas putida KT2440
uccaccagcucacgcaa

SEQ ID NO: 1564397 - RNA, 18 nt, Pseudomonas putida KT2440
uccaauguuagcccgacg

SEQ ID NO: 1564398 - RNA, 14 nt, Pseudomonas putida KT2440
uccacccacccucg

SEQ ID NO: 1564399 - RNA, 16 nt, Pseudomonas putida KT2440
uccaccaucuccagcu

SEQ ID NO: 1564400 - RNA, 16 nt, Pseudomonas putida KT2440
uccaccauucccugca

SEQ ID NO: 1564401 - RNA, 16 nt, Pseudomonas putida KT2440
ucauuggcgccaucgc

SEQ ID NO: 1564402 - RNA, 16 nt, Pseudomonas putida KT2440
uccaccugcgccuugc

SEQ ID NO: 1564403 - RNA, 19 nt, Pseudomonas putida KT2440
uccaccgaaaucagcaacg

SEQ ID NO: 1564404 - RNA, 14 nt, Pseudomonas putida KT2440
uccacccgugcagg

SEQ ID NO: 1564405 - RNA, 23 nt, Pseudomonas putida KT2440
uccacccccgcuccuacggccga

SEQ ID NO: 1564406 - RNA, 15 nt, Pseudomonas putida KT2440
uccaccccacccucg

SEQ ID NO: 1564407 - RNA, 22 nt, Pseudomonas putida KT2440
uccagaccagacagcgcuaucu

SEQ ID NO: 1564408 - RNA, 22 nt, Pseudomonas putida KT2440
ucauccucgacacccagucgcc

SEQ ID NO: 1564409 - RNA, 18 nt, Pseudomonas putida KT2440
ucauccgagcugagcagc

SEQ ID NO: 1564410 - RNA, 20 nt, Pseudomonas putida KT2440
ucauccggcgcaucgacggg

SEQ ID NO: 1564411 - RNA, 15 nt, Pseudomonas putida KT2440
ucauccaggcuggcc

SEQ ID NO: 1564412 - RNA, 24 nt, Pseudomonas putida KT2440
ucauccaggcuggccagcaagugc

SEQ ID NO: 1564413 - RNA, 16 nt, Pseudomonas putida KT2440
ucauagcucagcugga

SEQ ID NO: 1564414 - RNA, 15 nt, Pseudomonas putida KT2440
ucauccucaccggca

SEQ ID NO: 1564415 - RNA, 15 nt, Pseudomonas putida KT2440
ucaucgaagaucagc

SEQ ID NO: 1564416 - RNA, 17 nt, Pseudomonas putida KT2440
ucaucgagauguggccc

SEQ ID NO: 1564417 - RNA, 19 nt, Pseudomonas putida KT2440
ucaucgccaagccgccauu

SEQ ID NO: 1564418 - RNA, 20 nt, Pseudomonas putida KT2440
ucaugcgcccuggcggccac

SEQ ID NO: 1564419 - RNA, 14 nt, Pseudomonas putida KT2440
ucaugaacagcgcc

SEQ ID NO: 1564420 - RNA, 22 nt, Pseudomonas putida KT2440
ucaugcccgcgucugccgcagc

SEQ ID NO: 1564421 - RNA, 17 nt, Pseudomonas putida KT2440
ucaggcugagcagacca

SEQ ID NO: 1564422 - RNA, 21 nt, Pseudomonas putida KT2440
ucaggcugaucaccgccgcca

SEQ ID NO: 1564423 - RNA, 13 nt, Pseudomonas putida KT2440
ucaggcuggcgac

SEQ ID NO: 1564424 - RNA, 16 nt, Pseudomonas putida KT2440
ucaggcuguccacacc

SEQ ID NO: 1564425 - RNA, 16 nt, Pseudomonas putida KT2440
ucaggcuuugcugcag

SEQ ID NO: 1564426 - RNA, 18 nt, Pseudomonas putida KT2440
ucaggcucaguugcaagu

SEQ ID NO: 1564427 - RNA, 16 nt, Pseudomonas putida KT2440
ucagggauacugcuga

SEQ ID NO: 1564428 - RNA, 22 nt, Pseudomonas putida KT2440
ucagggccgcagagcggcccug

SEQ ID NO: 1564429 - RNA, 13 nt, Pseudomonas putida KT2440
ucagggcacggcu

SEQ ID NO: 1564430 - RNA, 19 nt, Pseudomonas putida KT2440
ucagggcacggcugcccug

SEQ ID NO: 1564431 - RNA, 14 nt, Pseudomonas putida KT2440
ucagggcagcaacg

SEQ ID NO: 1564432 - RNA, 15 nt, Pseudomonas putida KT2440
ucagggucucgcggc

SEQ ID NO: 1564433 - RNA, 22 nt, Pseudomonas putida KT2440
ucagcgagcgggugccgcagca

SEQ ID NO: 1564434 - RNA, 16 nt, Pseudomonas putida KT2440
ucaggcgcgcaccggu

SEQ ID NO: 1564435 - RNA, 14 nt, Pseudomonas putida KT2440
ucaggcgcagcaca

SEQ ID NO: 1564436 - RNA, 22 nt, Pseudomonas putida KT2440
ucagcgaggaauagccggugcc

SEQ ID NO: 1564437 - RNA, 15 nt, Pseudomonas putida KT2440
ucagcgacaacggcu

SEQ ID NO: 1564438 - RNA, 21 nt, Pseudomonas putida KT2440
ucaguauuauacgcgccauca

SEQ ID NO: 1564439 - RNA, 21 nt, Pseudomonas putida KT2440
ucaggugcuucggcucuucgc

SEQ ID NO: 1564440 - RNA, 17 nt, Pseudomonas putida KT2440
ucagguggaucagccgc

SEQ ID NO: 1564441 - RNA, 17 nt, Pseudomonas putida KT2440
ucagguggaucaggguc

SEQ ID NO: 1564442 - RNA, 20 nt, Pseudomonas putida KT2440
ucaggugguaguccuugccg

SEQ ID NO: 1564443 - RNA, 16 nt, Pseudomonas putida KT2440
ucagguguuccagcac

SEQ ID NO: 1564444 - RNA, 18 nt, Pseudomonas putida KT2440
ucagguuacgcaccagcu

SEQ ID NO: 1564445 - RNA, 20 nt, Pseudomonas putida KT2440
ucaggugcaucgucacaucc

SEQ ID NO: 1564446 - RNA, 14 nt, Pseudomonas putida KT2440
ucauacagcgccuc

SEQ ID NO: 1564447 - RNA, 22 nt, Pseudomonas putida KT2440
ucauaguucuggcugccuucgc

SEQ ID NO: 1564448 - RNA, 16 nt, Pseudomonas putida KT2440
ucauaguuguggcaac

SEQ ID NO: 1564449 - RNA, 14 nt, Pseudomonas putida KT2440
ucacccuuggccac

SEQ ID NO: 1564450 - RNA, 16 nt, Pseudomonas putida KT2440
ucacccuuggucagga

SEQ ID NO: 1564451 - RNA, 17 nt, Pseudomonas putida KT2440
ucacccgggaacagcag

SEQ ID NO: 1564452 - RNA, 20 nt, Pseudomonas putida KT2440
ucacccgggaacagcagcac

SEQ ID NO: 1564453 - RNA, 17 nt, Pseudomonas putida KT2440
ucaccccuuuacuggcc

SEQ ID NO: 1564454 - RNA, 14 nt, Pseudomonas putida KT2440
ucacccgcaggguc

SEQ ID NO: 1564455 - RNA, 17 nt, Pseudomonas putida KT2440
ucaccgcguaaccaguc

SEQ ID NO: 1564456 - RNA, 14 nt, Pseudomonas putida KT2440
ucaccgguaccggc

SEQ ID NO: 1564457 - RNA, 16 nt, Pseudomonas putida KT2440
ucaccgguaccggcgu

SEQ ID NO: 1564458 - RNA, 16 nt, Pseudomonas putida KT2440
ucacccacacccgcgc

SEQ ID NO: 1564459 - RNA, 13 nt, Pseudomonas putida KT2440
ucaccaucagccg

SEQ ID NO: 1564460 - RNA, 17 nt, Pseudomonas putida KT2440
ucacccccaucagcggg

SEQ ID NO: 1564461 - RNA, 17 nt, Pseudomonas putida KT2440
ucaccagguuguggccc

SEQ ID NO: 1564462 - RNA, 22 nt, Pseudomonas putida KT2440
ucaauuucuuucagcucggcac

SEQ ID NO: 1564463 - RNA, 21 nt, Pseudomonas putida KT2440
ucacacagcggcagacacagg

SEQ ID NO: 1564464 - RNA, 13 nt, Pseudomonas putida KT2440
ucaccacaucggc

SEQ ID NO: 1564465 - RNA, 15 nt, Pseudomonas putida KT2440
ucaccacaucggcgg

SEQ ID NO: 1564466 - RNA, 20 nt, Pseudomonas putida KT2440
ucacaggcuucagccuucga

SEQ ID NO: 1564467 - RNA, 16 nt, Pseudomonas putida KT2440
ucacagggaccgugca

SEQ ID NO: 1564468 - RNA, 14 nt, Pseudomonas putida KT2440
ucacagcccgggca

SEQ ID NO: 1564469 - RNA, 15 nt, Pseudomonas putida KT2440
ucacaggccauagcc

SEQ ID NO: 1564470 - RNA, 14 nt, Pseudomonas putida KT2440
ucaccugccgggca

SEQ ID NO: 1564471 - RNA, 17 nt, Pseudomonas putida KT2440
ucaccugcacaucggcc

SEQ ID NO: 1564472 - RNA, 23 nt, Pseudomonas putida KT2440
ucacggcgcaggccgacaacagc

SEQ ID NO: 1564473 - RNA, 20 nt, Pseudomonas putida KT2440
ucaccucaucgacccuggca

SEQ ID NO: 1564474 - RNA, 18 nt, Pseudomonas putida KT2440
ucaccugaccaucagccu

SEQ ID NO: 1564475 - RNA, 18 nt, Pseudomonas putida KT2440
ucaccugaugaaagcgca

SEQ ID NO: 1564476 - RNA, 17 nt, Pseudomonas putida KT2440
ucaccguguuguucgcc

SEQ ID NO: 1564477 - RNA, 12 nt, Pseudomonas putida KT2440
ucacucaccgca

SEQ ID NO: 1564478 - RNA, 22 nt, Pseudomonas putida KT2440
ucacgggucaugccaccgccac

SEQ ID NO: 1564479 - RNA, 14 nt, Pseudomonas putida KT2440
ucacggucuuggcc

SEQ ID NO: 1564480 - RNA, 16 nt, Pseudomonas putida KT2440
ucacggucuuggccgc

SEQ ID NO: 1564481 - RNA, 21 nt, Pseudomonas putida KT2440
ucacggucaguaccuggccgc

SEQ ID NO: 1564482 - RNA, 20 nt, Pseudomonas putida KT2440
ucacgguguccgccgccguc

SEQ ID NO: 1564483 - RNA, 18 nt, Pseudomonas putida KT2440
ucacguuguagcccacca

SEQ ID NO: 1564484 - RNA, 20 nt, Pseudomonas putida KT2440
ucagccagugcugccugcug

SEQ ID NO: 1564485 - RNA, 17 nt, Pseudomonas putida KT2440
ucagccucggucaggua

SEQ ID NO: 1564486 - RNA, 16 nt, Pseudomonas putida KT2440
ucagcaggucggcguc

SEQ ID NO: 1564487 - RNA, 20 nt, Pseudomonas putida KT2440
ucagcaugcccagcgccacc

SEQ ID NO: 1564488 - RNA, 15 nt, Pseudomonas putida KT2440
ucagcauggccaguu

SEQ ID NO: 1564489 - RNA, 22 nt, Pseudomonas putida KT2440
ucagcauggccaguuccuggca

SEQ ID NO: 1564490 - RNA, 18 nt, Pseudomonas putida KT2440
ucagcagcaccgccacca

SEQ ID NO: 1564491 - RNA, 21 nt, Pseudomonas putida KT2440
ucagcagcaccgccaccaugc

SEQ ID NO: 1564492 - RNA, 17 nt, Pseudomonas putida KT2440
ucagcacgccgccgaua

SEQ ID NO: 1564493 - RNA, 18 nt, Pseudomonas putida KT2440
ucagcacgcgaucggcag

SEQ ID NO: 1564494 - RNA, 14 nt, Pseudomonas putida KT2440
ucagcacgggcagc

SEQ ID NO: 1564495 - RNA, 12 nt, Pseudomonas putida KT2440
ucagcaccuggc

SEQ ID NO: 1564496 - RNA, 13 nt, Pseudomonas putida KT2440
ucagacuuuccug

SEQ ID NO: 1564497 - RNA, 12 nt, Pseudomonas putida KT2440
ucagagcgccag

SEQ ID NO: 1564498 - RNA, 16 nt, Pseudomonas putida KT2440
ucagagcgccagcaag

SEQ ID NO: 1564499 - RNA, 23 nt, Pseudomonas putida KT2440
ucaaugaugcguacggccuuggc

SEQ ID NO: 1564500 - RNA, 20 nt, Pseudomonas putida KT2440
ucaaucagggauacugcuga

SEQ ID NO: 1564501 - RNA, 23 nt, Pseudomonas putida KT2440
ucaaucaaccagcccgccgccag

SEQ ID NO: 1564502 - RNA, 13 nt, Pseudomonas putida KT2440
ucaaggcccaguu

SEQ ID NO: 1564503 - RNA, 13 nt, Pseudomonas putida KT2440
ucaaggccgccac

SEQ ID NO: 1564504 - RNA, 22 nt, Pseudomonas putida KT2440
ucaaggaagcuccaggcgacca

SEQ ID NO: 1564505 - RNA, 22 nt, Pseudomonas putida KT2440
ucaaggucacggcugucaccau

SEQ ID NO: 1564506 - RNA, 14 nt, Pseudomonas putida KT2440
ucaagaaugcccgg

SEQ ID NO: 1564507 - RNA, 22 nt, Pseudomonas putida KT2440
ucaagaggagugcuucauagcc

SEQ ID NO: 1564508 - RNA, 18 nt, Pseudomonas putida KT2440
ucaagcucgaagcgcuca

SEQ ID NO: 1564509 - RNA, 16 nt, Pseudomonas putida KT2440
ucaagcccgcucgcca

SEQ ID NO: 1564510 - RNA, 19 nt, Pseudomonas putida KT2440
ucaagauagaccuugccag

SEQ ID NO: 1564511 - RNA, 21 nt, Pseudomonas putida KT2440
ucaagcagguaaccgcugcca

SEQ ID NO: 1564512 - RNA, 14 nt, Pseudomonas putida KT2440
ucaacucggcagug

SEQ ID NO: 1564513 - RNA, 17 nt, Pseudomonas putida KT2440
ucaacuccauggccagg

SEQ ID NO: 1564514 - RNA, 18 nt, Pseudomonas putida KT2440
ucaacgguaacguuggcc

SEQ ID NO: 1564515 - RNA, 16 nt, Pseudomonas putida KT2440
ucaacgguggccagca

SEQ ID NO: 1564516 - RNA, 20 nt, Pseudomonas putida KT2440
ucaacggcgcccgggccaug

SEQ ID NO: 1564517 - RNA, 18 nt, Pseudomonas putida KT2440
ucaacgcuucggccauga

SEQ ID NO: 1564518 - RNA, 19 nt, Pseudomonas putida KT2440
ucaaagccugcuccagcac

SEQ ID NO: 1564519 - RNA, 20 nt, Pseudomonas putida KT2440
ucaaagucgccuacaagggu

SEQ ID NO: 1564520 - RNA, 21 nt, Pseudomonas putida KT2440
ucaaacguauccgccgcaaug

SEQ ID NO: 1564521 - RNA, 13 nt, Pseudomonas putida KT2440
ucaaaugcuggca

SEQ ID NO: 1564522 - RNA, 21 nt, Pseudomonas putida KT2440
ucaacagcgcgacgcagcagc

SEQ ID NO: 1564523 - RNA, 15 nt, Pseudomonas putida KT2440
ucaacagccgcggca

SEQ ID NO: 1564524 - RNA, 17 nt, Pseudomonas putida KT2440
ucaacaccuucucggcc

SEQ ID NO: 1564525 - RNA, 15 nt, Pseudomonas putida KT2440
ucaacacgucggcug

SEQ ID NO: 1564526 - RNA, 19 nt, Pseudomonas putida KT2440
ucaaccgaccagcggauca

SEQ ID NO: 1564527 - RNA, 21 nt, Pseudomonas putida KT2440
ucaaccauggccccugucggu

SEQ ID NO: 1564528 - RNA, 23 nt, Pseudomonas putida KT2440
ucaacgccccaggguguuguuca

SEQ ID NO: 1564529 - RNA, 18 nt, Pseudomonas putida KT2440
uaugcggggucgcuacca

SEQ ID NO: 1564530 - RNA, 14 nt, Pseudomonas putida KT2440
uauugagcuucguc

SEQ ID NO: 1564531 - RNA, 16 nt, Pseudomonas putida KT2440
uagcgguacagcaccc

SEQ ID NO: 1564532 - RNA, 17 nt, Pseudomonas putida KT2440
uagcggcggcaauggcg

SEQ ID NO: 1564533 - RNA, 21 nt, Pseudomonas putida KT2440
uaucgagcacuuccuugacca

SEQ ID NO: 1564534 - RNA, 17 nt, Pseudomonas putida KT2440
uaucgcgacgcaaggcc

SEQ ID NO: 1564535 - RNA, 16 nt, Pseudomonas putida KT2440
uaucgccagaaaccaa

SEQ ID NO: 1564536 - RNA, 15 nt, Pseudomonas putida KT2440
uaucggcaggcugga

SEQ ID NO: 1564537 - RNA, 14 nt, Pseudomonas putida KT2440
uaucuucaggcauc

SEQ ID NO: 1564538 - RNA, 18 nt, Pseudomonas putida KT2440
uaugccacgacaccggga

SEQ ID NO: 1564539 - RNA, 19 nt, Pseudomonas putida KT2440
uaugcccggcucaccgcag

SEQ ID NO: 1564540 - RNA, 16 nt, Pseudomonas putida KT2440
ugaagcucuccagcag

SEQ ID NO: 1564541 - RNA, 18 nt, Pseudomonas putida KT2440
ugaaggaacgacuugaug

SEQ ID NO: 1564542 - RNA, 15 nt, Pseudomonas putida KT2440
ugaagcucgaucugc

SEQ ID NO: 1564543 - RNA, 21 nt, Pseudomonas putida KT2440
ugaagcuuggggccgcucugc

SEQ ID NO: 1564544 - RNA, 17 nt, Pseudomonas putida KT2440
ugaagaggccagugagc

SEQ ID NO: 1564545 - RNA, 19 nt, Pseudomonas putida KT2440
ugaagaggccagugagccu

SEQ ID NO: 1564546 - RNA, 15 nt, Pseudomonas putida KT2440
ugaagacgcucgaca

SEQ ID NO: 1564547 - RNA, 17 nt, Pseudomonas putida KT2440
ugaagaacaccugcagc

SEQ ID NO: 1564548 - RNA, 20 nt, Pseudomonas putida KT2440
ugaagucgcacaugaagccg

SEQ ID NO: 1564549 - RNA, 19 nt, Pseudomonas putida KT2440
ugaaguacuggucgcgugc

SEQ ID NO: 1564550 - RNA, 14 nt, Pseudomonas putida KT2440
ugaaguacuuggcg

SEQ ID NO: 1564551 - RNA, 24 nt, Pseudomonas putida KT2440
ugaaguaguccccaucacgcagcg

SEQ ID NO: 1564552 - RNA, 21 nt, Pseudomonas putida KT2440
ugaagggacuuaaucaaugca

SEQ ID NO: 1564553 - RNA, 18 nt, Pseudomonas putida KT2440
ugaaggggcaaaguucgc

SEQ ID NO: 1564554 - RNA, 21 nt, Pseudomonas putida KT2440
ugacaaacgccagcaugcugg

SEQ ID NO: 1564555 - RNA, 19 nt, Pseudomonas putida KT2440
ugacaaagcggaucggccg

SEQ ID NO: 1564556 - RNA, 13 nt, Pseudomonas putida KT2440
ugaaucagcaaac

SEQ ID NO: 1564557 - RNA, 19 nt, Pseudomonas putida KT2440
ugaaucagccccagccggu

SEQ ID NO: 1564558 - RNA, 17 nt, Pseudomonas putida KT2440
ugaaucagcggcaggcu

SEQ ID NO: 1564559 - RNA, 22 nt, Pseudomonas putida KT2440
ugaaucuucggugcccacugca

SEQ ID NO: 1564560 - RNA, 16 nt, Pseudomonas putida KT2440
ugaaucuugcgcgcca

SEQ ID NO: 1564561 - RNA, 18 nt, Pseudomonas putida KT2440
ucuccagcuccuggcccg

SEQ ID NO: 1564562 - RNA, 20 nt, Pseudomonas putida KT2440
ucucccgcgaacgcccgacc

SEQ ID NO: 1564563 - RNA, 18 nt, Pseudomonas putida KT2440
ucuuucagguaacgggca

SEQ ID NO: 1564564 - RNA, 14 nt, Pseudomonas putida KT2440
ugaacuugaucgcg

SEQ ID NO: 1564565 - RNA, 22 nt, Pseudomonas putida KT2440
ugaacuuggcgaugaugugcgc

SEQ ID NO: 1564566 - RNA, 21 nt, Pseudomonas putida KT2440
ugaacgcaaggguaauggcga

SEQ ID NO: 1564567 - RNA, 19 nt, Pseudomonas putida KT2440
ugaacgcaauaugcaccuu

SEQ ID NO: 1564568 - RNA, 18 nt, Pseudomonas putida KT2440
ugaacgcaaaaaaccgca

SEQ ID NO: 1564569 - RNA, 17 nt, Pseudomonas putida KT2440
ugaaccggcuguuggcc

SEQ ID NO: 1564570 - RNA, 22 nt, Pseudomonas putida KT2440
ugaaaucauccauguccauggc

SEQ ID NO: 1564571 - RNA, 21 nt, Pseudomonas putida KT2440
ugaaauagccacgcaucugca

SEQ ID NO: 1564572 - RNA, 18 nt, Pseudomonas putida KT2440
ugaaauuaaagguugacg

SEQ ID NO: 1564573 - RNA, 18 nt, Pseudomonas putida KT2440
ugaaauucaccugccggg

SEQ ID NO: 1564574 - RNA, 13 nt, Pseudomonas putida KT2440
ugaccaucagccu

SEQ ID NO: 1564575 - RNA, 15 nt, Pseudomonas putida KT2440
ugaccaggcccagca

SEQ ID NO: 1564576 - RNA, 17 nt, Pseudomonas putida KT2440
ugaccagcaccagcgac

SEQ ID NO: 1564577 - RNA, 21 nt, Pseudomonas putida KT2440
ugacccggugcacccacuggc

SEQ ID NO: 1564578 - RNA, 21 nt, Pseudomonas putida KT2440
ugacccuuccagcccgccugc

SEQ ID NO: 1564579 - RNA, 20 nt, Pseudomonas putida KT2440
ugacccggccuuucgcgcca

SEQ ID NO: 1564580 - RNA, 21 nt, Pseudomonas putida KT2440
ugacagagguauuggucaccg

SEQ ID NO: 1564581 - RNA, 15 nt, Pseudomonas putida KT2440
ugacagcacggccuu

SEQ ID NO: 1564582 - RNA, 19 nt, Pseudomonas putida KT2440
ugacagcaggaacagcggc

SEQ ID NO: 1564583 - RNA, 18 nt, Pseudomonas putida KT2440
ugacaaugcgacugagca

SEQ ID NO: 1564584 - RNA, 15 nt, Pseudomonas putida KT2440
ugaccaacaggcugg

SEQ ID NO: 1564585 - RNA, 21 nt, Pseudomonas putida KT2440
ugaccaaggaacugcgcugcc

SEQ ID NO: 1564586 - RNA, 21 nt, Pseudomonas putida KT2440
ugaccgcccagcgucgucugc

SEQ ID NO: 1564587 - RNA, 19 nt, Pseudomonas putida KT2440
ugaccgaugaucugccggg

SEQ ID NO: 1564588 - RNA, 19 nt, Pseudomonas putida KT2440
ugaccgagaacaggcggcc

SEQ ID NO: 1564589 - RNA, 20 nt, Pseudomonas putida KT2440
ugacccguguaggagcgggu

SEQ ID NO: 1564590 - RNA, 20 nt, Pseudomonas putida KT2440
ugaccggaauguuaccggcc

SEQ ID NO: 1564591 - RNA, 14 nt, Pseudomonas putida KT2440
ugaccgccugcgca

SEQ ID NO: 1564592 - RNA, 18 nt, Pseudomonas putida KT2440
ugaccgcggugcugacca

SEQ ID NO: 1564593 - RNA, 15 nt, Pseudomonas putida KT2440
ugaccguccacguug

SEQ ID NO: 1564594 - RNA, 15 nt, Pseudomonas putida KT2440
ugaccgggucgacgc

SEQ ID NO: 1564595 - RNA, 23 nt, Pseudomonas putida KT2440
ugaccguguauccauacuuggcc

SEQ ID NO: 1564596 - RNA, 20 nt, Pseudomonas putida KT2440
ugaccucgaccaggcgcucg

SEQ ID NO: 1564597 - RNA, 23 nt, Pseudomonas putida KT2440
ugaccucugguuuugucggccau

SEQ ID NO: 1564598 - RNA, 14 nt, Pseudomonas putida KT2440
ugaccuugcugcuc

SEQ ID NO: 1564599 - RNA, 14 nt, Pseudomonas putida KT2440
ugaucgccuggccg

SEQ ID NO: 1564600 - RNA, 14 nt, Pseudomonas putida KT2440
ugaucgcggcguug

SEQ ID NO: 1564601 - RNA, 14 nt, Pseudomonas putida KT2440
ugaucgcgcuggca

SEQ ID NO: 1564602 - RNA, 12 nt, Pseudomonas putida KT2440
ugaucgcggcaa

SEQ ID NO: 1564603 - RNA, 13 nt, Pseudomonas putida KT2440
ugaucgcuugcgc

SEQ ID NO: 1564604 - RNA, 17 nt, Pseudomonas putida KT2440
ugaucgaaagcgguuga

SEQ ID NO: 1564605 - RNA, 19 nt, Pseudomonas putida KT2440
ugaucgaagcgacagcggc

SEQ ID NO: 1564606 - RNA, 21 nt, Pseudomonas putida KT2440
ugaucgagccgaucaggaagc

SEQ ID NO: 1564607 - RNA, 22 nt, Pseudomonas putida KT2440
ugauccggcacuccagcgagug

SEQ ID NO: 1564608 - RNA, 16 nt, Pseudomonas putida KT2440
ugaucagguugcccgc

SEQ ID NO: 1564609 - RNA, 20 nt, Pseudomonas putida KT2440
ugaucauguccuugcugcgc

SEQ ID NO: 1564610 - RNA, 14 nt, Pseudomonas putida KT2440
ugaucauucaggca

SEQ ID NO: 1564611 - RNA, 19 nt, Pseudomonas putida KT2440
ugauccagucagacuccuu

SEQ ID NO: 1564612 - RNA, 15 nt, Pseudomonas putida KT2440
ugaucaggucggcgg

SEQ ID NO: 1564613 - RNA, 17 nt, Pseudomonas putida KT2440
ugaucagguuacuggcc

SEQ ID NO: 1564614 - RNA, 21 nt, Pseudomonas putida KT2440
ugaucagguuacuggccaauu

SEQ ID NO: 1564615 - RNA, 13 nt, Pseudomonas putida KT2440
ugcacccguggcg

SEQ ID NO: 1564616 - RNA, 18 nt, Pseudomonas putida KT2440
ugcaccgaagcaccacug

SEQ ID NO: 1564617 - RNA, 20 nt, Pseudomonas putida KT2440
ugcacccagcguauagccac

SEQ ID NO: 1564618 - RNA, 14 nt, Pseudomonas putida KT2440
ugcacccacuggcc

SEQ ID NO: 1564619 - RNA, 16 nt, Pseudomonas putida KT2440
ugcacagguaucgccg

SEQ ID NO: 1564620 - RNA, 15 nt, Pseudomonas putida KT2440
ugcaccccugccacc

SEQ ID NO: 1564621 - RNA, 21 nt, Pseudomonas putida KT2440
ugcacaacgcgcgggcaaugg

SEQ ID NO: 1564622 - RNA, 14 nt, Pseudomonas putida KT2440
ugcacagccgugcc

SEQ ID NO: 1564623 - RNA, 17 nt, Pseudomonas putida KT2440
ugcacagcgcucgaugc

SEQ ID NO: 1564624 - RNA, 23 nt, Pseudomonas putida KT2440
ugcacagcucccucguaggagcg

SEQ ID NO: 1564625 - RNA, 17 nt, Pseudomonas putida KT2440
ugcacagcaucagcaca

SEQ ID NO: 1564626 - RNA, 15 nt, Pseudomonas putida KT2440
ugcacacgucgccug

SEQ ID NO: 1564627 - RNA, 19 nt, Pseudomonas putida KT2440
ugcacacgucgccugggca

SEQ ID NO: 1564628 - RNA, 20 nt, Pseudomonas putida KT2440
ugcaagccggcgaacagcac

SEQ ID NO: 1564629 - RNA, 11 nt, Pseudomonas putida KT2440
ugcaagccuug

SEQ ID NO: 1564630 - RNA, 19 nt, Pseudomonas putida KT2440
ugcaagccuugugggagcg

SEQ ID NO: 1564631 - RNA, 14 nt, Pseudomonas putida KT2440
ugcaagcggcgaua

SEQ ID NO: 1564632 - RNA, 13 nt, Pseudomonas putida KT2440
ugcaaugccgcug

SEQ ID NO: 1564633 - RNA, 12 nt, Pseudomonas putida KT2440
ugaugcgcuugc

SEQ ID NO: 1564634 - RNA, 14 nt, Pseudomonas putida KT2440
ugaugcgcuugcca

SEQ ID NO: 1564635 - RNA, 15 nt, Pseudomonas putida KT2440
ugaugcgcuugccag

SEQ ID NO: 1564636 - RNA, 21 nt, Pseudomonas putida KT2440
ugcaaagcgcgucugauagcc

SEQ ID NO: 1564637 - RNA, 22 nt, Pseudomonas putida KT2440
ugcaaagcugucgcuacgcgcc

SEQ ID NO: 1564638 - RNA, 18 nt, Pseudomonas putida KT2440
ugauucagcacaccgcuc

SEQ ID NO: 1564639 - RNA, 13 nt, Pseudomonas putida KT2440
ugacgccgccagc

SEQ ID NO: 1564640 - RNA, 14 nt, Pseudomonas putida KT2440
ugacgcggagccgg

SEQ ID NO: 1564641 - RNA, 16 nt, Pseudomonas putida KT2440
ugacgcggagccggcu

SEQ ID NO: 1564642 - RNA, 20 nt, Pseudomonas putida KT2440
ugacgcaagcgcgccgccac

SEQ ID NO: 1564643 - RNA, 20 nt, Pseudomonas putida KT2440
ugacgcagggccucgaugcg

SEQ ID NO: 1564644 - RNA, 19 nt, Pseudomonas putida KT2440
ugacgauaugcccgucauc

SEQ ID NO: 1564645 - RNA, 18 nt, Pseudomonas putida KT2440
ugacggucugccggcacc

SEQ ID NO: 1564646 - RNA, 14 nt, Pseudomonas putida KT2440
ugacggcgcugcug

SEQ ID NO: 1564647 - RNA, 13 nt, Pseudomonas putida KT2440
ugacgcugcacuu

SEQ ID NO: 1564648 - RNA, 18 nt, Pseudomonas putida KT2440
ugagcacggcuucgacgc

SEQ ID NO: 1564649 - RNA, 12 nt, Pseudomonas putida KT2440
ugagcaccggca

SEQ ID NO: 1564650 - RNA, 20 nt, Pseudomonas putida KT2440
ugagcagggugccgccaugu

SEQ ID NO: 1564651 - RNA, 19 nt, Pseudomonas putida KT2440
ugagcaggucgaacagccc

SEQ ID NO: 1564652 - RNA, 19 nt, Pseudomonas putida KT2440
ugagcaguucgucgaccgc

SEQ ID NO: 1564653 - RNA, 22 nt, Pseudomonas putida KT2440
ugagcaucggcguugcggugca

SEQ ID NO: 1564654 - RNA, 16 nt, Pseudomonas putida KT2440
ugagcgaugcgcuggc

SEQ ID NO: 1564655 - RNA, 17 nt, Pseudomonas putida KT2440
ugagcgaugcgcuggca

SEQ ID NO: 1564656 - RNA, 22 nt, Pseudomonas putida KT2440
ugagccaggagaacacccagcg

SEQ ID NO: 1564657 - RNA, 14 nt, Pseudomonas putida KT2440
ugagccaggccgac

SEQ ID NO: 1564658 - RNA, 16 nt, Pseudomonas putida KT2440
ugagccaggccgacaa

SEQ ID NO: 1564659 - RNA, 21 nt, Pseudomonas putida KT2440
ugagccaugccguaagccgca

SEQ ID NO: 1564660 - RNA, 14 nt, Pseudomonas putida KT2440
ugacuggcagcaag

SEQ ID NO: 1564661 - RNA, 19 nt, Pseudomonas putida KT2440
ugagcggcucgcgcucuuc

SEQ ID NO: 1564662 - RNA, 18 nt, Pseudomonas putida KT2440
ugagcgcgccgccuucgc

SEQ ID NO: 1564663 - RNA, 14 nt, Pseudomonas putida KT2440
ugagggaaggcuug

SEQ ID NO: 1564664 - RNA, 15 nt, Pseudomonas putida KT2440
ugagcguggcaaacc

SEQ ID NO: 1564665 - RNA, 14 nt, Pseudomonas putida KT2440
ugagcugcgcgcga

SEQ ID NO: 1564666 - RNA, 15 nt, Pseudomonas putida KT2440
ugagcucuacaccua

SEQ ID NO: 1564667 - RNA, 13 nt, Pseudomonas putida KT2440
ugagcuuagcgcg

SEQ ID NO: 1564668 - RNA, 12 nt, Pseudomonas putida KT2440
ugagcuucagcg

SEQ ID NO: 1564669 - RNA, 17 nt, Pseudomonas putida KT2440
ugagcuucagcgcgcca

SEQ ID NO: 1564670 - RNA, 16 nt, Pseudomonas putida KT2440
ugcgaaucugcauggc

SEQ ID NO: 1564671 - RNA, 21 nt, Pseudomonas putida KT2440
ugccuggccacuguugcagcg

SEQ ID NO: 1564672 - RNA, 14 nt, Pseudomonas putida KT2440
ugccuguaggcgcg

SEQ ID NO: 1564673 - RNA, 17 nt, Pseudomonas putida KT2440
ugccuguaggcgcgggu

SEQ ID NO: 1564674 - RNA, 18 nt, Pseudomonas putida KT2440
ugccugugagaucgagcg

SEQ ID NO: 1564675 - RNA, 23 nt, Pseudomonas putida KT2440
ugccugugauuuacgcugggcgu

SEQ ID NO: 1564676 - RNA, 15 nt, Pseudomonas putida KT2440
ugcgacccgcuggcc

SEQ ID NO: 1564677 - RNA, 16 nt, Pseudomonas putida KT2440
ugcgacggcgaaugac

SEQ ID NO: 1564678 - RNA, 15 nt, Pseudomonas putida KT2440
ugcgacugaggcacc

SEQ ID NO: 1564679 - RNA, 16 nt, Pseudomonas putida KT2440
ugcgacugaggcaccg

SEQ ID NO: 1564680 - RNA, 15 nt, Pseudomonas putida KT2440
ugcgagaggcgcuuu

SEQ ID NO: 1564681 - RNA, 15 nt, Pseudomonas putida KT2440
ugcgagacgccacca

SEQ ID NO: 1564682 - RNA, 23 nt, Pseudomonas putida KT2440
ugcgcagguacacgggcaugcca

SEQ ID NO: 1564683 - RNA, 19 nt, Pseudomonas putida KT2440
ugcgcagcuuguugaucuu

SEQ ID NO: 1564684 - RNA, 23 nt, Pseudomonas putida KT2440
ugcgcagcuggucgagcaaggca

SEQ ID NO: 1564685 - RNA, 22 nt, Pseudomonas putida KT2440
ugcgcagguaggggugagggcg

SEQ ID NO: 1564686 - RNA, 12 nt, Pseudomonas putida KT2440
ugcgcagguaua

SEQ ID NO: 1564687 - RNA, 22 nt, Pseudomonas putida KT2440
ugcgcaguacaggcugccgccg

SEQ ID NO: 1564688 - RNA, 20 nt, Pseudomonas putida KT2440
ugcgcauaucccucgcggau

SEQ ID NO: 1564689 - RNA, 13 nt, Pseudomonas putida KT2440
ugcgcaucaccuc

SEQ ID NO: 1564690 - RNA, 15 nt, Pseudomonas putida KT2440
ugcgcaucaccucga

SEQ ID NO: 1564691 - RNA, 17 nt, Pseudomonas putida KT2440
ugcgcaugaaacucgcg

SEQ ID NO: 1564692 - RNA, 12 nt, Pseudomonas putida KT2440
ugcgcaugcgcg

SEQ ID NO: 1564693 - RNA, 14 nt, Pseudomonas putida KT2440
ugcgcaugcccgcg

SEQ ID NO: 1564694 - RNA, 19 nt, Pseudomonas putida KT2440
ugccggucggcguccacug

SEQ ID NO: 1564695 - RNA, 21 nt, Pseudomonas putida KT2440
ugccgguguaguugaccgacg

SEQ ID NO: 1564696 - RNA, 14 nt, Pseudomonas putida KT2440
ugccggucacuggc

SEQ ID NO: 1564697 - RNA, 16 nt, Pseudomonas putida KT2440
ugccggucagcagcau

SEQ ID NO: 1564698 - RNA, 19 nt, Pseudomonas putida KT2440
ugccgggucggccugcucg

SEQ ID NO: 1564699 - RNA, 16 nt, Pseudomonas putida KT2440
ugccgggugcaucggc

SEQ ID NO: 1564700 - RNA, 17 nt, Pseudomonas putida KT2440
ugccgggugcaucggca

SEQ ID NO: 1564701 - RNA, 21 nt, Pseudomonas putida KT2440
ugccggggcugcuuugcagcc

SEQ ID NO: 1564702 - RNA, 22 nt, Pseudomonas putida KT2440
ugccggcuggacaccucccgcg

SEQ ID NO: 1564703 - RNA, 21 nt, Pseudomonas putida KT2440
ugccguccagguccaggccag

SEQ ID NO: 1564704 - RNA, 20 nt, Pseudomonas putida KT2440
ugccgguuugauaacgaauc

SEQ ID NO: 1564705 - RNA, 18 nt, Pseudomonas putida KT2440
ugccgguguucgcgggug

SEQ ID NO: 1564706 - RNA, 15 nt, Pseudomonas putida KT2440
ugccgucgagcaggu

SEQ ID NO: 1564707 - RNA, 12 nt, Pseudomonas putida KT2440
ugccugcugcuc

SEQ ID NO: 1564708 - RNA, 17 nt, Pseudomonas putida KT2440
ugccugcgaauggccgc

SEQ ID NO: 1564709 - RNA, 23 nt, Pseudomonas putida KT2440
ugccuagauaagcgacaaaggcg

SEQ ID NO: 1564710 - RNA, 14 nt, Pseudomonas putida KT2440
ugccucacgcaugc

SEQ ID NO: 1564711 - RNA, 16 nt, Pseudomonas putida KT2440
ugccucaucaggccga

SEQ ID NO: 1564712 - RNA, 14 nt, Pseudomonas putida KT2440
ugcgcggucgaugc

SEQ ID NO: 1564713 - RNA, 18 nt, Pseudomonas putida KT2440
ugcgcgcgcgguucacca

SEQ ID NO: 1564714 - RNA, 21 nt, Pseudomonas putida KT2440
ugcgcgcgcgguucaccagca

SEQ ID NO: 1564715 - RNA, 13 nt, Pseudomonas putida KT2440
ugcgccugccggg

SEQ ID NO: 1564716 - RNA, 12 nt, Pseudomonas putida KT2440
ugcgccugaccg

SEQ ID NO: 1564717 - RNA, 22 nt, Pseudomonas putida KT2440
ugcgccugcugguacagccggc

SEQ ID NO: 1564718 - RNA, 16 nt, Pseudomonas putida KT2440
ugcgccucaugcagca

SEQ ID NO: 1564719 - RNA, 17 nt, Pseudomonas putida KT2440
ugcgccucgcagguaau

SEQ ID NO: 1564720 - RNA, 14 nt, Pseudomonas putida KT2440
ugcgccguggccgc

SEQ ID NO: 1564721 - RNA, 14 nt, Pseudomonas putida KT2440
ugcgcgcgcgacag

SEQ ID NO: 1564722 - RNA, 18 nt, Pseudomonas putida KT2440
ugcgcgcgcgacagcacg

SEQ ID NO: 1564723 - RNA, 21 nt, Pseudomonas putida KT2440
ugcgccuugcuuggcagcggc

SEQ ID NO: 1564724 - RNA, 15 nt, Pseudomonas putida KT2440
ugcgccgcaccaaag

SEQ ID NO: 1564725 - RNA, 13 nt, Pseudomonas putida KT2440
ugcgccaggcgca

SEQ ID NO: 1564726 - RNA, 22 nt, Pseudomonas putida KT2440
ugcgccaguuguaguucccgcg

SEQ ID NO: 1564727 - RNA, 18 nt, Pseudomonas putida KT2440
ugcgccaguacgccagca

SEQ ID NO: 1564728 - RNA, 13 nt, Pseudomonas putida KT2440
ugcgccaggcauu

SEQ ID NO: 1564729 - RNA, 19 nt, Pseudomonas putida KT2440
ugcgccaggcauugcucga

SEQ ID NO: 1564730 - RNA, 20 nt, Pseudomonas putida KT2440
ugcgccaggaucaacugccg

SEQ ID NO: 1564731 - RNA, 23 nt, Pseudomonas putida KT2440
ugcgccgggacagcaccaugcgc

SEQ ID NO: 1564732 - RNA, 14 nt, Pseudomonas putida KT2440
ugcgccggccaagu

SEQ ID NO: 1564733 - RNA, 18 nt, Pseudomonas putida KT2440
ugcgccgcucugcccgcg

SEQ ID NO: 1564734 - RNA, 20 nt, Pseudomonas putida KT2440
ugcgccgcucgcccagcagc

SEQ ID NO: 1564735 - RNA, 13 nt, Pseudomonas putida KT2440
ugcggccaaugca

SEQ ID NO: 1564736 - RNA, 19 nt, Pseudomonas putida KT2440
ugcggcaugaaggcccagc

SEQ ID NO: 1564737 - RNA, 18 nt, Pseudomonas putida KT2440
ugcggcagauccugcagc

SEQ ID NO: 1564738 - RNA, 22 nt, Pseudomonas putida KT2440
ugcggcagauccugcagccgca

SEQ ID NO: 1564739 - RNA, 18 nt, Pseudomonas putida KT2440
ugcggcaggcuggcacgu

SEQ ID NO: 1564740 - RNA, 23 nt, Pseudomonas putida KT2440
ugcggcucaucguaauggccuac

SEQ ID NO: 1564741 - RNA, 23 nt, Pseudomonas putida KT2440
ugcggcuccggcguguccagcag

SEQ ID NO: 1564742 - RNA, 16 nt, Pseudomonas putida KT2440
ugcgcuccaacuggcg

SEQ ID NO: 1564743 - RNA, 14 nt, Pseudomonas putida KT2440
ugcgcuccugguca

SEQ ID NO: 1564744 - RNA, 15 nt, Pseudomonas putida KT2440
ugcgcuccuggucau

SEQ ID NO: 1564745 - RNA, 21 nt, Pseudomonas putida KT2440
ugcgcuccuggucaucgaagc

SEQ ID NO: 1564746 - RNA, 12 nt, Pseudomonas putida KT2440
ugcgcucgacgc

SEQ ID NO: 1564747 - RNA, 22 nt, Pseudomonas putida KT2440
ugcgcucgacgcgcgcagccug

SEQ ID NO: 1564748 - RNA, 21 nt, Pseudomonas putida KT2440
ugcgcucgagcccgccagcag

SEQ ID NO: 1564749 - RNA, 19 nt, Pseudomonas putida KT2440
ugcgcucgucgaacucgcg

SEQ ID NO: 1564750 - RNA, 14 nt, Pseudomonas putida KT2440
ugcgcucgcugccg

SEQ ID NO: 1564751 - RNA, 19 nt, Pseudomonas putida KT2440
ugcgcuacgacccaccgac

SEQ ID NO: 1564752 - RNA, 15 nt, Pseudomonas putida KT2440
ugcggaucaucggca

SEQ ID NO: 1564753 - RNA, 14 nt, Pseudomonas putida KT2440
ugcggauacagcgc

SEQ ID NO: 1564754 - RNA, 18 nt, Pseudomonas putida KT2440
ugcggauaccgcuggccg

SEQ ID NO: 1564755 - RNA, 23 nt, Pseudomonas putida KT2440
ugcggaucuuguauuggccaaga

SEQ ID NO: 1564756 - RNA, 19 nt, Pseudomonas putida KT2440
ugcggcaccgucgccugca

SEQ ID NO: 1564757 - RNA, 22 nt, Pseudomonas putida KT2440
ugcggcaaccaccaacagcacc

SEQ ID NO: 1564758 - RNA, 23 nt, Pseudomonas putida KT2440
ugcccaaguaguguucgccguug

SEQ ID NO: 1564759 - RNA, 23 nt, Pseudomonas putida KT2440
ugcccaccgcugcaaucgagccg

SEQ ID NO: 1564760 - RNA, 18 nt, Pseudomonas putida KT2440
ugcccagcgccaccggca

SEQ ID NO: 1564761 - RNA, 23 nt, Pseudomonas putida KT2440
ugcccacugcguucaucgaacug

SEQ ID NO: 1564762 - RNA, 24 nt, Pseudomonas putida KT2440
ugcccacugcguucaucgaacugc

SEQ ID NO: 1564763 - RNA, 16 nt, Pseudomonas putida KT2440
ugccacgacaccggga

SEQ ID NO: 1564764 - RNA, 21 nt, Pseudomonas putida KT2440
ugccacgauggucacccgcga

SEQ ID NO: 1564765 - RNA, 21 nt, Pseudomonas putida KT2440
ugccacgcaccaccaagucga

SEQ ID NO: 1564766 - RNA, 14 nt, Pseudomonas putida KT2440
ugccagcaguucgc

SEQ ID NO: 1564767 - RNA, 14 nt, Pseudomonas putida KT2440
ugccagcagcuggc

SEQ ID NO: 1564768 - RNA, 22 nt, Pseudomonas putida KT2440
ugccagcgcgcugcgcaaggac

SEQ ID NO: 1564769 - RNA, 14 nt, Pseudomonas putida KT2440
ugccagcgccaauc

SEQ ID NO: 1564770 - RNA, 15 nt, Pseudomonas putida KT2440
ugccagcggccacuu

SEQ ID NO: 1564771 - RNA, 13 nt, Pseudomonas putida KT2440
ugccagccuucga

SEQ ID NO: 1564772 - RNA, 15 nt, Pseudomonas putida KT2440
ugccagccccgcaca

SEQ ID NO: 1564773 - RNA, 22 nt, Pseudomonas putida KT2440
ugcccauaaaagccucagcgcc

SEQ ID NO: 1564774 - RNA, 16 nt, Pseudomonas putida KT2440
ugcccaggugccaggc

SEQ ID NO: 1564775 - RNA, 18 nt, Pseudomonas putida KT2440
ugcccaugcacagcgagc

SEQ ID NO: 1564776 - RNA, 23 nt, Pseudomonas putida KT2440
ugcccauuucugcauguccagcc

SEQ ID NO: 1564777 - RNA, 18 nt, Pseudomonas putida KT2440
ugcccauuccugaaguga

SEQ ID NO: 1564778 - RNA, 14 nt, Pseudomonas putida KT2440
ugcccauggccagg

SEQ ID NO: 1564779 - RNA, 16 nt, Pseudomonas putida KT2440
ugcccauggcgcagcu

SEQ ID NO: 1564780 - RNA, 16 nt, Pseudomonas putida KT2440
ugcccagcucgcuggc

SEQ ID NO: 1564781 - RNA, 17 nt, Pseudomonas putida KT2440
ugcccaggaucacuggc

SEQ ID NO: 1564782 - RNA, 18 nt, Pseudomonas putida KT2440
ugcccaggaucacuggcc

SEQ ID NO: 1564783 - RNA, 20 nt, Pseudomonas putida KT2440
ugcccaggaucacuggccug

SEQ ID NO: 1564784 - RNA, 19 nt, Pseudomonas putida KT2440
ugccccagcaucaacgcug

SEQ ID NO: 1564785 - RNA, 13 nt, Pseudomonas putida KT2440
ugccccaggccca

SEQ ID NO: 1564786 - RNA, 18 nt, Pseudomonas putida KT2440
ugccccacucggcgcugu

SEQ ID NO: 1564787 - RNA, 22 nt, Pseudomonas putida KT2440
ugccccuggcccaucucaauga

SEQ ID NO: 1564788 - RNA, 16 nt, Pseudomonas putida KT2440
ugccccugcgccgcca

SEQ ID NO: 1564789 - RNA, 17 nt, Pseudomonas putida KT2440
ugcccccgucagcggca

SEQ ID NO: 1564790 - RNA, 16 nt, Pseudomonas putida KT2440
ugccccgguccagcac

SEQ ID NO: 1564791 - RNA, 17 nt, Pseudomonas putida KT2440
ugccccgguccagcaca

SEQ ID NO: 1564792 - RNA, 21 nt, Pseudomonas putida KT2440
ugcaccguuuaccaaggcggu

SEQ ID NO: 1564793 - RNA, 23 nt, Pseudomonas putida KT2440
ugcaccgucuggaagucgcgagu

SEQ ID NO: 1564794 - RNA, 17 nt, Pseudomonas putida KT2440
ugcaccuuguuacccgc

SEQ ID NO: 1564795 - RNA, 22 nt, Pseudomonas putida KT2440
ugcacgaacagauggugaugcc

SEQ ID NO: 1564796 - RNA, 14 nt, Pseudomonas putida KT2440
ugcacgccacgccc

SEQ ID NO: 1564797 - RNA, 17 nt, Pseudomonas putida KT2440
ugcacgaucgaccgggu

SEQ ID NO: 1564798 - RNA, 14 nt, Pseudomonas putida KT2440
ugcaguucuuccag

SEQ ID NO: 1564799 - RNA, 19 nt, Pseudomonas putida KT2440
ugcagugguugugcuggcc

SEQ ID NO: 1564800 - RNA, 18 nt, Pseudomonas putida KT2440
ugcauaagcgacacccug

SEQ ID NO: 1564801 - RNA, 14 nt, Pseudomonas putida KT2440
ugcaggucggccag

SEQ ID NO: 1564802 - RNA, 19 nt, Pseudomonas putida KT2440
ugcagguucgaccaccgca

SEQ ID NO: 1564803 - RNA, 15 nt, Pseudomonas putida KT2440
ugcagucaaagccuu

SEQ ID NO: 1564804 - RNA, 16 nt, Pseudomonas putida KT2440
ugcagucaaagccuuu

SEQ ID NO: 1564805 - RNA, 12 nt, Pseudomonas putida KT2440
ugcaguaucgcc

SEQ ID NO: 1564806 - RNA, 14 nt, Pseudomonas putida KT2440
ugcaguaucgcccc

SEQ ID NO: 1564807 - RNA, 21 nt, Pseudomonas putida KT2440
ugcagguugcccucggccacc

SEQ ID NO: 1564808 - RNA, 21 nt, Pseudomonas putida KT2440
ugcaucgucacauccugcucg

SEQ ID NO: 1564809 - RNA, 17 nt, Pseudomonas putida KT2440
ugcauccacaccagcgg

SEQ ID NO: 1564810 - RNA, 21 nt, Pseudomonas putida KT2440
ugcauccgccaugggccugca

SEQ ID NO: 1564811 - RNA, 17 nt, Pseudomonas putida KT2440
ugcaugcaagcagccac

SEQ ID NO: 1564812 - RNA, 15 nt, Pseudomonas putida KT2440
ugcaugaucgacuuc

SEQ ID NO: 1564813 - RNA, 14 nt, Pseudomonas putida KT2440
ugcauggcauucgc

SEQ ID NO: 1564814 - RNA, 17 nt, Pseudomonas putida KT2440
ugcauggcauucgccac

SEQ ID NO: 1564815 - RNA, 15 nt, Pseudomonas putida KT2440
ugccacccaugccac

SEQ ID NO: 1564816 - RNA, 22 nt, Pseudomonas putida KT2440
ugccacccagaucaucaucggc

SEQ ID NO: 1564817 - RNA, 13 nt, Pseudomonas putida KT2440
ugcccggccagca

SEQ ID NO: 1564818 - RNA, 22 nt, Pseudomonas putida KT2440
ugcccggcagguugcuggccuu

SEQ ID NO: 1564819 - RNA, 16 nt, Pseudomonas putida KT2440
ugcccgggaacggcug

SEQ ID NO: 1564820 - RNA, 19 nt, Pseudomonas putida KT2440
ugcccgggcgcaggcagca

SEQ ID NO: 1564821 - RNA, 16 nt, Pseudomonas putida KT2440
ugcccggcucaccgca

SEQ ID NO: 1564822 - RNA, 15 nt, Pseudomonas putida KT2440
ugccgacuccaacug

SEQ ID NO: 1564823 - RNA, 14 nt, Pseudomonas putida KT2440
ugccgaggcgccga

SEQ ID NO: 1564824 - RNA, 13 nt, Pseudomonas putida KT2440
ugccgaucagcac

SEQ ID NO: 1564825 - RNA, 21 nt, Pseudomonas putida KT2440
ugccgcaagcagucccagcac

SEQ ID NO: 1564826 - RNA, 15 nt, Pseudomonas putida KT2440
ugccgcccaucaccg

SEQ ID NO: 1564827 - RNA, 18 nt, Pseudomonas putida KT2440
ugccgcccaucaccggca

SEQ ID NO: 1564828 - RNA, 18 nt, Pseudomonas putida KT2440
ugccggcaauaccggcca

SEQ ID NO: 1564829 - RNA, 17 nt, Pseudomonas putida KT2440
ugccggcauaacggcug

SEQ ID NO: 1564830 - RNA, 23 nt, Pseudomonas putida KT2440
ugccggcauaacggcuggcgcau

SEQ ID NO: 1564831 - RNA, 18 nt, Pseudomonas putida KT2440
ugccggcccaaggcacca

SEQ ID NO: 1564832 - RNA, 18 nt, Pseudomonas putida KT2440
ugccggccucuucgcggg

SEQ ID NO: 1564833 - RNA, 21 nt, Pseudomonas putida KT2440
ugccggccucuucgcgggcaa

SEQ ID NO: 1564834 - RNA, 23 nt, Pseudomonas putida KT2440
ugccggccucuucgcgggcaagc

SEQ ID NO: 1564835 - RNA, 19 nt, Pseudomonas putida KT2440
ugccggccucuucgcgggu

SEQ ID NO: 1564836 - RNA, 20 nt, Pseudomonas putida KT2440
ugccggccucuucgcgggua

SEQ ID NO: 1564837 - RNA, 20 nt, Pseudomonas putida KT2440
ugccggccucuucgcgggug

SEQ ID NO: 1564838 - RNA, 15 nt, Pseudomonas putida KT2440
ugccggcgagcgcgu

SEQ ID NO: 1564839 - RNA, 18 nt, Pseudomonas putida KT2440
ugccgcguuccuuucuca

SEQ ID NO: 1564840 - RNA, 23 nt, Pseudomonas putida KT2440
ugccgcucaccaccaucuugcgu

SEQ ID NO: 1564841 - RNA, 20 nt, Pseudomonas putida KT2440
ugccgcuuuggcagcagccu

SEQ ID NO: 1564842 - RNA, 17 nt, Pseudomonas putida KT2440
ugccgcguucacaucgc

SEQ ID NO: 1564843 - RNA, 22 nt, Pseudomonas putida KT2440
ugccgcuggcuuccucacggca

SEQ ID NO: 1564844 - RNA, 21 nt, Pseudomonas putida KT2440
ugccggaacguuuccagcaac

SEQ ID NO: 1564845 - RNA, 23 nt, Pseudomonas putida KT2440
ucgaugccuacugcuggcgcgac

SEQ ID NO: 1564846 - RNA, 16 nt, Pseudomonas putida KT2440
ucgaugcacagcucgc

SEQ ID NO: 1564847 - RNA, 23 nt, Pseudomonas putida KT2440
ucgauuacaaacggcuuggcugc

SEQ ID NO: 1564848 - RNA, 21 nt, Pseudomonas putida KT2440
ucgauguaggcagcugccuug

SEQ ID NO: 1564849 - RNA, 14 nt, Pseudomonas putida KT2440
ucgauuacccagcg

SEQ ID NO: 1564850 - RNA, 12 nt, Pseudomonas putida KT2440
ucgauucaggcc

SEQ ID NO: 1564851 - RNA, 16 nt, Pseudomonas putida KT2440
ucgaugucuuucgcgu

SEQ ID NO: 1564852 - RNA, 17 nt, Pseudomonas putida KT2440
ucgauguccaggccgaa

SEQ ID NO: 1564853 - RNA, 12 nt, Pseudomonas putida KT2440
ucgauggccagg

SEQ ID NO: 1564854 - RNA, 13 nt, Pseudomonas putida KT2440
ucgauggccagga

SEQ ID NO: 1564855 - RNA, 17 nt, Pseudomonas putida KT2440
ucgauggucuucgccgc

SEQ ID NO: 1564856 - RNA, 12 nt, Pseudomonas putida KT2440
ucgcacacccug

SEQ ID NO: 1564857 - RNA, 16 nt, Pseudomonas putida KT2440
ucgcacagguccagcc

SEQ ID NO: 1564858 - RNA, 11 nt, Pseudomonas putida KT2440
ucgaucggcac

SEQ ID NO: 1564859 - RNA, 14 nt, Pseudomonas putida KT2440
ucgaucccggacag

SEQ ID NO: 1564860 - RNA, 15 nt, Pseudomonas putida KT2440
ucgaugaaggcugcu

SEQ ID NO: 1564861 - RNA, 23 nt, Pseudomonas putida KT2440
ucgaugaaggcugcuucguucac

SEQ ID NO: 1564862 - RNA, 19 nt, Pseudomonas putida KT2440
ucgaucuaugcccggcuca

SEQ ID NO: 1564863 - RNA, 17 nt, Pseudomonas putida KT2440
ucgaucucggccagcag

SEQ ID NO: 1564864 - RNA, 16 nt, Pseudomonas putida KT2440
ucgaucuugccuucgg

SEQ ID NO: 1564865 - RNA, 22 nt, Pseudomonas putida KT2440
ucgaucuucgccggcaucgccu

SEQ ID NO: 1564866 - RNA, 14 nt, Pseudomonas putida KT2440
ucgauacccaggcg

SEQ ID NO: 1564867 - RNA, 19 nt, Pseudomonas putida KT2440
ucgauacccaggcgcgccu

SEQ ID NO: 1564868 - RNA, 16 nt, Pseudomonas putida KT2440
ucgaguaucgccucga

SEQ ID NO: 1564869 - RNA, 18 nt, Pseudomonas putida KT2440
ucgaucagcgccugcuca

SEQ ID NO: 1564870 - RNA, 16 nt, Pseudomonas putida KT2440
ucgaggaucagcgcag

SEQ ID NO: 1564871 - RNA, 20 nt, Pseudomonas putida KT2440
ucgagguacgagucagcgug

SEQ ID NO: 1564872 - RNA, 14 nt, Pseudomonas putida KT2440
ucgagguguacgcg

SEQ ID NO: 1564873 - RNA, 17 nt, Pseudomonas putida KT2440
ucgagcaucugcugcgg

SEQ ID NO: 1564874 - RNA, 20 nt, Pseudomonas putida KT2440
ucgagcaucugcugcggcag

SEQ ID NO: 1564875 - RNA, 23 nt, Pseudomonas putida KT2440
ucgagcaucugcugcggcaggcu

SEQ ID NO: 1564876 - RNA, 22 nt, Pseudomonas putida KT2440
ucgagcaugaucaccgccagcg

SEQ ID NO: 1564877 - RNA, 13 nt, Pseudomonas putida KT2440
ucgagcaccggcu

SEQ ID NO: 1564878 - RNA, 22 nt, Pseudomonas putida KT2440
ucgagcgccugauuacccugcg

SEQ ID NO: 1564879 - RNA, 20 nt, Pseudomonas putida KT2440
ucgagcgccaugagugcagg

SEQ ID NO: 1564880 - RNA, 12 nt, Pseudomonas putida KT2440
ucgagccacuga

SEQ ID NO: 1564881 - RNA, 14 nt, Pseudomonas putida KT2440
ucgagccgaacagc

SEQ ID NO: 1564882 - RNA, 16 nt, Pseudomonas putida KT2440
ucgagcccgccagcag

SEQ ID NO: 1564883 - RNA, 18 nt, Pseudomonas putida KT2440
ucgacgggcauggcaacc

SEQ ID NO: 1564884 - RNA, 16 nt, Pseudomonas putida KT2440
uccggcguguccagca

SEQ ID NO: 1564885 - RNA, 17 nt, Pseudomonas putida KT2440
uccgggccgucaccgcu

SEQ ID NO: 1564886 - RNA, 13 nt, Pseudomonas putida KT2440
uccgguaacggua

SEQ ID NO: 1564887 - RNA, 15 nt, Pseudomonas putida KT2440
ucgacgcggacccgg

SEQ ID NO: 1564888 - RNA, 20 nt, Pseudomonas putida KT2440
ucgacugcacugccagcgcc

SEQ ID NO: 1564889 - RNA, 23 nt, Pseudomonas putida KT2440
ucgacucauuuuguaaaaccgcg

SEQ ID NO: 1564890 - RNA, 17 nt, Pseudomonas putida KT2440
ucgacuucauggucgac

SEQ ID NO: 1564891 - RNA, 15 nt, Pseudomonas putida KT2440
ucgacuucggccauu

SEQ ID NO: 1564892 - RNA, 16 nt, Pseudomonas putida KT2440
ucgagaaaugccucgg

SEQ ID NO: 1564893 - RNA, 16 nt, Pseudomonas putida KT2440
ucgagaaacgccagcu

SEQ ID NO: 1564894 - RNA, 14 nt, Pseudomonas putida KT2440
ucgagaccuugccu

SEQ ID NO: 1564895 - RNA, 18 nt, Pseudomonas putida KT2440
ucgccaccggcauucccg

SEQ ID NO: 1564896 - RNA, 14 nt, Pseudomonas putida KT2440
ucgccacgaacagg

SEQ ID NO: 1564897 - RNA, 12 nt, Pseudomonas putida KT2440
ucgccagcacca

SEQ ID NO: 1564898 - RNA, 20 nt, Pseudomonas putida KT2440
ucgccagcaccaucaggcac

SEQ ID NO: 1564899 - RNA, 21 nt, Pseudomonas putida KT2440
ucgccacauaguaggcaaugc

SEQ ID NO: 1564900 - RNA, 20 nt, Pseudomonas putida KT2440
ucgccacaacccaucacggc

SEQ ID NO: 1564901 - RNA, 17 nt, Pseudomonas putida KT2440
ucgcaugcggccgugaa

SEQ ID NO: 1564902 - RNA, 14 nt, Pseudomonas putida KT2440
ucgcauacagcgca

SEQ ID NO: 1564903 - RNA, 24 nt, Pseudomonas putida KT2440
ucgcagucgaaggggaucagcacg

SEQ ID NO: 1564904 - RNA, 16 nt, Pseudomonas putida KT2440
ucgcagauuuugucau

SEQ ID NO: 1564905 - RNA, 12 nt, Pseudomonas putida KT2440
ucgcacucggca

SEQ ID NO: 1564906 - RNA, 20 nt, Pseudomonas putida KT2440
ucgcccucguucgcgggcac

SEQ ID NO: 1564907 - RNA, 13 nt, Pseudomonas putida KT2440
ucgcccucgcggc

SEQ ID NO: 1564908 - RNA, 20 nt, Pseudomonas putida KT2440
ucgcccucgagugcgcugau

SEQ ID NO: 1564909 - RNA, 21 nt, Pseudomonas putida KT2440
ucgccgcccaguggcacacca

SEQ ID NO: 1564910 - RNA, 22 nt, Pseudomonas putida KT2440
ucgccgcaucguuauccagcac

SEQ ID NO: 1564911 - RNA, 22 nt, Pseudomonas putida KT2440
ucgccgaggaauugcgccagga

SEQ ID NO: 1564912 - RNA, 12 nt, Pseudomonas putida KT2440
ucgccgcaaccg

SEQ ID NO: 1564913 - RNA, 21 nt, Pseudomonas putida KT2440
ucgccaggccuucaucggccu

SEQ ID NO: 1564914 - RNA, 21 nt, Pseudomonas putida KT2440
ucgccagggcucaagacaguc

SEQ ID NO: 1564915 - RNA, 21 nt, Pseudomonas putida KT2440
ucgccagguacaguucccggu

SEQ ID NO: 1564916 - RNA, 18 nt, Pseudomonas putida KT2440
ucgccaggugcgcgucga

SEQ ID NO: 1564917 - RNA, 15 nt, Pseudomonas putida KT2440
ucgccaggaucaccu

SEQ ID NO: 1564918 - RNA, 19 nt, Pseudomonas putida KT2440
ucgccccgccagcgccugg

SEQ ID NO: 1564919 - RNA, 21 nt, Pseudomonas putida KT2440
ucgcccaugcgcgugcguguc

SEQ ID NO: 1564920 - RNA, 22 nt, Pseudomonas putida KT2440
ucgcccaucccggucaccugca

SEQ ID NO: 1564921 - RNA, 14 nt, Pseudomonas putida KT2440
ucgccucgaucaca

SEQ ID NO: 1564922 - RNA, 13 nt, Pseudomonas putida KT2440
ucgccucacagcg

SEQ ID NO: 1564923 - RNA, 17 nt, Pseudomonas putida KT2440
ucgccguuguucacggu

SEQ ID NO: 1564924 - RNA, 13 nt, Pseudomonas putida KT2440
ucgccucgucggc

SEQ ID NO: 1564925 - RNA, 18 nt, Pseudomonas putida KT2440
ucgccucgugcagcugca

SEQ ID NO: 1564926 - RNA, 13 nt, Pseudomonas putida KT2440
ucgccgugcagca

SEQ ID NO: 1564927 - RNA, 15 nt, Pseudomonas putida KT2440
ucgccgggcgcacca

SEQ ID NO: 1564928 - RNA, 18 nt, Pseudomonas putida KT2440
ucgccggcaucgccucca

SEQ ID NO: 1564929 - RNA, 15 nt, Pseudomonas putida KT2440
ucgccgccgccucga

SEQ ID NO: 1564930 - RNA, 11 nt, Pseudomonas putida KT2440
ucgccggcacg

SEQ ID NO: 1564931 - RNA, 23 nt, Pseudomonas putida KT2440
ucgccggcacgcuaccaccuggc

SEQ ID NO: 1564932 - RNA, 24 nt, Pseudomonas putida KT2440
ucgccggcacgcuaccaccuggcu

SEQ ID NO: 1564933 - RNA, 21 nt, Pseudomonas putida KT2440
ucgcgcuaaaggccgcuccug

SEQ ID NO: 1564934 - RNA, 19 nt, Pseudomonas putida KT2440
ucgcgccuucauaggcggc

SEQ ID NO: 1564935 - RNA, 21 nt, Pseudomonas putida KT2440
ucgcgcucuucaucgcgguac

SEQ ID NO: 1564936 - RNA, 14 nt, Pseudomonas putida KT2440
ucgcgcugcagcuc

SEQ ID NO: 1564937 - RNA, 14 nt, Pseudomonas putida KT2440
ucgcgcagggccuu

SEQ ID NO: 1564938 - RNA, 15 nt, Pseudomonas putida KT2440
ucgcgcagggccuug

SEQ ID NO: 1564939 - RNA, 19 nt, Pseudomonas putida KT2440
ucgcgcagggugccggcca

SEQ ID NO: 1564940 - RNA, 22 nt, Pseudomonas putida KT2440
ucgcgcaggguuuucagcgccg

SEQ ID NO: 1564941 - RNA, 18 nt, Pseudomonas putida KT2440
ucgcgcaggucgacaugc

SEQ ID NO: 1564942 - RNA, 12 nt, Pseudomonas putida KT2440
ucgcgcaagccu

SEQ ID NO: 1564943 - RNA, 20 nt, Pseudomonas putida KT2440
ucgcgcaagccuuugcgccu

SEQ ID NO: 1564944 - RNA, 17 nt, Pseudomonas putida KT2440
ucgcgcaacaccgccag

SEQ ID NO: 1564945 - RNA, 19 nt, Pseudomonas putida KT2440
ucgcgcaacaccgccagcg

SEQ ID NO: 1564946 - RNA, 14 nt, Pseudomonas putida KT2440
ucgcgcaacugccc

SEQ ID NO: 1564947 - RNA, 22 nt, Pseudomonas putida KT2440
ucgcgauugaucagcgccucgc

SEQ ID NO: 1564948 - RNA, 15 nt, Pseudomonas putida KT2440
ucgccuuucaggucg

SEQ ID NO: 1564949 - RNA, 22 nt, Pseudomonas putida KT2440
ucgugcugccggucggccugca

SEQ ID NO: 1564950 - RNA, 21 nt, Pseudomonas putida KT2440
ucguuugcgaagguaaccugg

SEQ ID NO: 1564951 - RNA, 17 nt, Pseudomonas putida KT2440
ucuaaaucgaccugcag

SEQ ID NO: 1564952 - RNA, 18 nt, Pseudomonas putida KT2440
ucguuguccagcagcagc

SEQ ID NO: 1564953 - RNA, 18 nt, Pseudomonas putida KT2440
ucguugggccgccuugcg

SEQ ID NO: 1564954 - RNA, 17 nt, Pseudomonas putida KT2440
ucguugguguagucggu

SEQ ID NO: 1564955 - RNA, 19 nt, Pseudomonas putida KT2440
ucucauuguuugcgucggu

SEQ ID NO: 1564956 - RNA, 14 nt, Pseudomonas putida KT2440
ucuagaacucggcg

SEQ ID NO: 1564957 - RNA, 18 nt, Pseudomonas putida KT2440
ucgugaagcaccgccaca

SEQ ID NO: 1564958 - RNA, 18 nt, Pseudomonas putida KT2440
ucgugcaccgucuggacu

SEQ ID NO: 1564959 - RNA, 18 nt, Pseudomonas putida KT2440
ucgucgaacucgcgccca

SEQ ID NO: 1564960 - RNA, 17 nt, Pseudomonas putida KT2440
ucgucgaacaccagggu

SEQ ID NO: 1564961 - RNA, 14 nt, Pseudomonas putida KT2440
ucgucgaacagcau

SEQ ID NO: 1564962 - RNA, 17 nt, Pseudomonas putida KT2440
ucguccagcucgcgcag

SEQ ID NO: 1564963 - RNA, 18 nt, Pseudomonas putida KT2440
ucgguaccuggccgugcc

SEQ ID NO: 1564964 - RNA, 12 nt, Pseudomonas putida KT2440
ucgguacccgcc

SEQ ID NO: 1564965 - RNA, 16 nt, Pseudomonas putida KT2440
ucgguacccgccagca

SEQ ID NO: 1564966 - RNA, 13 nt, Pseudomonas putida KT2440
ucgguaaacaucg

SEQ ID NO: 1564967 - RNA, 15 nt, Pseudomonas putida KT2440
ucggguuuacccgcg

SEQ ID NO: 1564968 - RNA, 20 nt, Pseudomonas putida KT2440
ucgggcuuccagucggccug

SEQ ID NO: 1564969 - RNA, 17 nt, Pseudomonas putida KT2440
ucgggcuggcugcccga

SEQ ID NO: 1564970 - RNA, 16 nt, Pseudomonas putida KT2440
ucgggcaguucgaugc

SEQ ID NO: 1564971 - RNA, 14 nt, Pseudomonas putida KT2440
ucgggccgauggcg

SEQ ID NO: 1564972 - RNA, 14 nt, Pseudomonas putida KT2440
ucgggcgcgucguc

SEQ ID NO: 1564973 - RNA, 23 nt, Pseudomonas putida KT2440
ucgggcgcucgcgguucaucggc

SEQ ID NO: 1564974 - RNA, 22 nt, Pseudomonas putida KT2440
ucggugcuccuuuauuacuaga

SEQ ID NO: 1564975 - RNA, 18 nt, Pseudomonas putida KT2440
ucguagccggcuaucgga

SEQ ID NO: 1564976 - RNA, 24 nt, Pseudomonas putida KT2440
ucguaggagcggguucacccgcga

SEQ ID NO: 1564977 - RNA, 14 nt, Pseudomonas putida KT2440
ucguaggcugcagc

SEQ ID NO: 1564978 - RNA, 13 nt, Pseudomonas putida KT2440
ucgguuucgccgg

SEQ ID NO: 1564979 - RNA, 21 nt, Pseudomonas putida KT2440
ucgucacguuuuuugggagcg

SEQ ID NO: 1564980 - RNA, 22 nt, Pseudomonas putida KT2440
ucgucaccgccccagcgcgcca

SEQ ID NO: 1564981 - RNA, 20 nt, Pseudomonas putida KT2440
ucgucagggucuuccggcag

SEQ ID NO: 1564982 - RNA, 21 nt, Pseudomonas putida KT2440
ucgucaguugcagacgcgcag

SEQ ID NO: 1564983 - RNA, 21 nt, Pseudomonas putida KT2440
ucgucaaaccggcaccggcga

SEQ ID NO: 1564984 - RNA, 16 nt, Pseudomonas putida KT2440
ucggccccucgaccac

SEQ ID NO: 1564985 - RNA, 13 nt, Pseudomonas putida KT2440
ucggccgaugcca

SEQ ID NO: 1564986 - RNA, 22 nt, Pseudomonas putida KT2440
ucggccagcaguucgucgagca

SEQ ID NO: 1564987 - RNA, 18 nt, Pseudomonas putida KT2440
ucggccagcacuacgccg

SEQ ID NO: 1564988 - RNA, 15 nt, Pseudomonas putida KT2440
ucggccaucgacgug

SEQ ID NO: 1564989 - RNA, 16 nt, Pseudomonas putida KT2440
ucggccaucgacgugc

SEQ ID NO: 1564990 - RNA, 16 nt, Pseudomonas putida KT2440
ucggcaugcacggcag

SEQ ID NO: 1564991 - RNA, 17 nt, Pseudomonas putida KT2440
ucggcaugcacggcagc

SEQ ID NO: 1564992 - RNA, 18 nt, Pseudomonas putida KT2440
ucggcaugcacggcagca

SEQ ID NO: 1564993 - RNA, 18 nt, Pseudomonas putida KT2440
ucggcauguucaucaccg

SEQ ID NO: 1564994 - RNA, 20 nt, Pseudomonas putida KT2440
ucggcauguucaucaccggc

SEQ ID NO: 1564995 - RNA, 22 nt, Pseudomonas putida KT2440
ucggcagcacccgcuuggccac

SEQ ID NO: 1564996 - RNA, 12 nt, Pseudomonas putida KT2440
ucggcaccgcac

SEQ ID NO: 1564997 - RNA, 15 nt, Pseudomonas putida KT2440
ucggcacgcccagca

SEQ ID NO: 1564998 - RNA, 21 nt, Pseudomonas putida KT2440
ucggcacgagcaugccgagga

SEQ ID NO: 1564999 - RNA, 19 nt, Pseudomonas putida KT2440
ucggcacgcgccagcagcg

SEQ ID NO: 1565000 - RNA, 15 nt, Pseudomonas putida KT2440
ucggcagagcgccag

SEQ ID NO: 1565001 - RNA, 21 nt, Pseudomonas putida KT2440
ucgcgcugccaggccgggucc

SEQ ID NO: 1565002 - RNA, 18 nt, Pseudomonas putida KT2440
ucgcgcuuggcaccggca

SEQ ID NO: 1565003 - RNA, 22 nt, Pseudomonas putida KT2440
ucgcucagguaggcagcaacgc

SEQ ID NO: 1565004 - RNA, 13 nt, Pseudomonas putida KT2440
ucgcucaccguuc

SEQ ID NO: 1565005 - RNA, 20 nt, Pseudomonas putida KT2440
ucgcucaggcucuugaacug

SEQ ID NO: 1565006 - RNA, 19 nt, Pseudomonas putida KT2440
ucgcuauuccgauacgccg

SEQ ID NO: 1565007 - RNA, 14 nt, Pseudomonas putida KT2440
ucgcucaacuggcu

SEQ ID NO: 1565008 - RNA, 16 nt, Pseudomonas putida KT2440
ucgcugaugcgccgcu

SEQ ID NO: 1565009 - RNA, 17 nt, Pseudomonas putida KT2440
ucgcugcugccuucccg

SEQ ID NO: 1565010 - RNA, 21 nt, Pseudomonas putida KT2440
ucgcuggccugccccagcauc

SEQ ID NO: 1565011 - RNA, 17 nt, Pseudomonas putida KT2440
ucgcugccgccuuggca

SEQ ID NO: 1565012 - RNA, 13 nt, Pseudomonas putida KT2440
ucgcugccgugca

SEQ ID NO: 1565013 - RNA, 17 nt, Pseudomonas putida KT2440
ucggaaugccacccuug

SEQ ID NO: 1565014 - RNA, 15 nt, Pseudomonas putida KT2440
ucggacacgucacug

SEQ ID NO: 1565015 - RNA, 16 nt, Pseudomonas putida KT2440
ucggacagguuggcgc

SEQ ID NO: 1565016 - RNA, 21 nt, Pseudomonas putida KT2440
ucggcgaucagcuucaacugc

SEQ ID NO: 1565017 - RNA, 12 nt, Pseudomonas putida KT2440
ucggccuugcgc

SEQ ID NO: 1565018 - RNA, 14 nt, Pseudomonas putida KT2440
ucggccuugcgcug

SEQ ID NO: 1565019 - RNA, 20 nt, Pseudomonas putida KT2440
ucggcgcgcggcucggccac

SEQ ID NO: 1565020 - RNA, 21 nt, Pseudomonas putida KT2440
ucggcgcgcggcucggccacc

SEQ ID NO: 1565021 - RNA, 22 nt, Pseudomonas putida KT2440
ucggcgcgcggcucggccacca

SEQ ID NO: 1565022 - RNA, 20 nt, Pseudomonas putida KT2440
ucggcgccugugaucgagcg

SEQ ID NO: 1565023 - RNA, 13 nt, Pseudomonas putida KT2440
ucggcgccuucgc

SEQ ID NO: 1565024 - RNA, 17 nt, Pseudomonas putida KT2440
ucggcgccuucgcccga

SEQ ID NO: 1565025 - RNA, 24 nt, Pseudomonas putida KT2440
ucggcgccaggaucgagaccuugc

SEQ ID NO: 1565026 - RNA, 20 nt, Pseudomonas putida KT2440
ucggcguggaacaacggcuc

SEQ ID NO: 1565027 - RNA, 21 nt, Pseudomonas putida KT2440
ucggcugaucucuucagccac

SEQ ID NO: 1565028 - RNA, 16 nt, Pseudomonas putida KT2440
ucggcggccucggucc

SEQ ID NO: 1565029 - RNA, 14 nt, Pseudomonas putida KT2440
ucggcgcgugccgc

SEQ ID NO: 1565030 - RNA, 14 nt, Pseudomonas putida KT2440
ucgggaucaugccg

SEQ ID NO: 1565031 - RNA, 17 nt, Pseudomonas putida KT2440
ucgggauggcaccggca

SEQ ID NO: 1565032 - RNA, 13 nt, Pseudomonas putida KT2440
ucggcuggccauu

SEQ ID NO: 1565033 - RNA, 16 nt, Pseudomonas putida KT2440
gcuuccucacggcagu

SEQ ID NO: 1565034 - RNA, 21 nt, Pseudomonas putida KT2440
gcuuccggcgcugguaggcga

SEQ ID NO: 1565035 - RNA, 20 nt, Pseudomonas putida KT2440
gcuucgcccucguucgcggg

SEQ ID NO: 1565036 - RNA, 23 nt, Pseudomonas putida KT2440
gcuucgcccucguucgcgggcac

SEQ ID NO: 1565037 - RNA, 15 nt, Pseudomonas putida KT2440
gcuucgccagcgcca

SEQ ID NO: 1565038 - RNA, 21 nt, Pseudomonas putida KT2440
gcuucgccagcgccaccgcgc

SEQ ID NO: 1565039 - RNA, 20 nt, Pseudomonas putida KT2440
gcuucgcccguguucgcggg

SEQ ID NO: 1565040 - RNA, 18 nt, Pseudomonas putida KT2440
gcuucgccgguguucgcg

SEQ ID NO: 1565041 - RNA, 19 nt, Pseudomonas putida KT2440
gcuucgccgguguucgcgg

SEQ ID NO: 1565042 - RNA, 20 nt, Pseudomonas putida KT2440
gcuucgccgguguucgcggg

SEQ ID NO: 1565043 - RNA, 16 nt, Pseudomonas putida KT2440
gcuucgaugauccccg

SEQ ID NO: 1565044 - RNA, 16 nt, Pseudomonas putida KT2440
gcuuccuuccuggaag

SEQ ID NO: 1565045 - RNA, 15 nt, Pseudomonas putida KT2440
gcuuccuuguccgcc

SEQ ID NO: 1565046 - RNA, 19 nt, Pseudomonas putida KT2440
gcuuccuuguccgccaaga

SEQ ID NO: 1565047 - RNA, 22 nt, Pseudomonas putida KT2440
gcuucuaccacuggggcuucug

SEQ ID NO: 1565048 - RNA, 20 nt, Pseudomonas putida KT2440
gcuucguccguguucgcgag

SEQ ID NO: 1565049 - RNA, 19 nt, Pseudomonas putida KT2440
gcuucgucggugcccuuca

SEQ ID NO: 1565050 - RNA, 23 nt, Pseudomonas putida KT2440
gcuucgucggugcccuucacugg

SEQ ID NO: 1565051 - RNA, 19 nt, Pseudomonas putida KT2440
gcuucgugcagguugcugg

SEQ ID NO: 1565052 - RNA, 18 nt, Pseudomonas putida KT2440
gcuucugcuucagcucga

SEQ ID NO: 1565053 - RNA, 14 nt, Pseudomonas putida KT2440
gcuucugccguuca

SEQ ID NO: 1565054 - RNA, 13 nt, Pseudomonas putida KT2440
gcuucucggcaaa

SEQ ID NO: 1565055 - RNA, 18 nt, Pseudomonas putida KT2440
gcuucuccagcaagcgcu

SEQ ID NO: 1565056 - RNA, 14 nt, Pseudomonas putida KT2440
gcuucgcggccaag

SEQ ID NO: 1565057 - RNA, 13 nt, Pseudomonas putida KT2440
gcuucgccgcgcu

SEQ ID NO: 1565058 - RNA, 19 nt, Pseudomonas putida KT2440
gcuucgccgcgcuguggcg

SEQ ID NO: 1565059 - RNA, 22 nt, Pseudomonas putida KT2440
gcuucggcggcuuucagcgccg

SEQ ID NO: 1565060 - RNA, 16 nt, Pseudomonas putida KT2440
gcuucguccagguagu

SEQ ID NO: 1565061 - RNA, 14 nt, Pseudomonas putida KT2440
gcuucaucaacgca

SEQ ID NO: 1565062 - RNA, 20 nt, Pseudomonas putida KT2440
gcuucagguaagucagcgag

SEQ ID NO: 1565063 - RNA, 21 nt, Pseudomonas putida KT2440
gcuucagguucacuuccacac

SEQ ID NO: 1565064 - RNA, 16 nt, Pseudomonas putida KT2440
gcuuccaggucgcggu

SEQ ID NO: 1565065 - RNA, 17 nt, Pseudomonas putida KT2440
gcuuccacggcgcgcuu

SEQ ID NO: 1565066 - RNA, 22 nt, Pseudomonas putida KT2440
gcuucauggcgccgaugccguc

SEQ ID NO: 1565067 - RNA, 14 nt, Pseudomonas putida KT2440
gcuucagccuucga

SEQ ID NO: 1565068 - RNA, 20 nt, Pseudomonas putida KT2440
gcuucacccucgcgcagcau

SEQ ID NO: 1565069 - RNA, 16 nt, Pseudomonas putida KT2440
gcuucacugccggcaa

SEQ ID NO: 1565070 - RNA, 12 nt, Pseudomonas putida KT2440
gcuucaacgcga

SEQ ID NO: 1565071 - RNA, 17 nt, Pseudomonas putida KT2440
gcuucacauccaccgcu

SEQ ID NO: 1565072 - RNA, 21 nt, Pseudomonas putida KT2440
gcuucaaaauagucgaaggcu

SEQ ID NO: 1565073 - RNA, 14 nt, Pseudomonas putida KT2440
gcuucaaacccggu

SEQ ID NO: 1565074 - RNA, 15 nt, Pseudomonas putida KT2440
gcuuagcgcgggccu

SEQ ID NO: 1565075 - RNA, 18 nt, Pseudomonas putida KT2440
gcuuacagaugucuggca

SEQ ID NO: 1565076 - RNA, 20 nt, Pseudomonas putida KT2440
gcugggcacggcgcugucgg

SEQ ID NO: 1565077 - RNA, 21 nt, Pseudomonas putida KT2440
gcugggcaucgacaaucggcu

SEQ ID NO: 1565078 - RNA, 22 nt, Pseudomonas putida KT2440
gcugggaauccagugcaggucu

SEQ ID NO: 1565079 - RNA, 15 nt, Pseudomonas putida KT2440
gcuggcuucaaacag

SEQ ID NO: 1565080 - RNA, 19 nt, Pseudomonas putida KT2440
gcuggcuuuggagccugcg

SEQ ID NO: 1565081 - RNA, 23 nt, Pseudomonas putida KT2440
gcugguagagaaugucgcggcua

SEQ ID NO: 1565082 - RNA, 21 nt, Pseudomonas putida KT2440
gcugguaagccucgagcgcuu

SEQ ID NO: 1565083 - RNA, 16 nt, Pseudomonas putida KT2440
gcugguacagccggcu

SEQ ID NO: 1565084 - RNA, 17 nt, Pseudomonas putida KT2440
gcugcugccccaugcga

SEQ ID NO: 1565085 - RNA, 16 nt, Pseudomonas putida KT2440
gcugcugcgcagcccu

SEQ ID NO: 1565086 - RNA, 13 nt, Pseudomonas putida KT2440
gcugcugcgccuc

SEQ ID NO: 1565087 - RNA, 15 nt, Pseudomonas putida KT2440
gcugcugcgccucgc

SEQ ID NO: 1565088 - RNA, 20 nt, Pseudomonas putida KT2440
gcuggcgcucaauggcaccg

SEQ ID NO: 1565089 - RNA, 13 nt, Pseudomonas putida KT2440
gcuggcugccgcg

SEQ ID NO: 1565090 - RNA, 14 nt, Pseudomonas putida KT2440
gcuggcugaucagc

SEQ ID NO: 1565091 - RNA, 14 nt, Pseudomonas putida KT2440
gcuggcucagcgag

SEQ ID NO: 1565092 - RNA, 21 nt, Pseudomonas putida KT2440
gcuggcucaucugccggcgaa

SEQ ID NO: 1565093 - RNA, 20 nt, Pseudomonas putida KT2440
gcuggcucgcugccccaguc

SEQ ID NO: 1565094 - RNA, 13 nt, Pseudomonas putida KT2440
gcuggcuacccgc

SEQ ID NO: 1565095 - RNA, 22 nt, Pseudomonas putida KT2440
gcuggcuacccgcucggccuug

SEQ ID NO: 1565096 - RNA, 18 nt, Pseudomonas putida KT2440
gcugguuagcgucgaugc

SEQ ID NO: 1565097 - RNA, 16 nt, Pseudomonas putida KT2440
gcugguuaugagccua

SEQ ID NO: 1565098 - RNA, 17 nt, Pseudomonas putida KT2440
gcugguccacgguucug

SEQ ID NO: 1565099 - RNA, 22 nt, Pseudomonas putida KT2440
gcugguccacgguucuggcagc

SEQ ID NO: 1565100 - RNA, 19 nt, Pseudomonas putida KT2440
gcuggucagugcacuugcg

SEQ ID NO: 1565101 - RNA, 14 nt, Pseudomonas putida KT2440
gcuguccagcgcau

SEQ ID NO: 1565102 - RNA, 19 nt, Pseudomonas putida KT2440
gcuguagcccaccagguca

SEQ ID NO: 1565103 - RNA, 13 nt, Pseudomonas putida KT2440
gcuguacgcuggc

SEQ ID NO: 1565104 - RNA, 15 nt, Pseudomonas putida KT2440
gcuguacgcuggcca

SEQ ID NO: 1565105 - RNA, 14 nt, Pseudomonas putida KT2440
gcuguacaggugcg

SEQ ID NO: 1565106 - RNA, 16 nt, Pseudomonas putida KT2440
gcuguaauugccaacu

SEQ ID NO: 1565107 - RNA, 19 nt, Pseudomonas putida KT2440
gcugucgaucagacgcucc

SEQ ID NO: 1565108 - RNA, 14 nt, Pseudomonas putida KT2440
gcugucgcagucga

SEQ ID NO: 1565109 - RNA, 21 nt, Pseudomonas putida KT2440
gcugucgaacgcugccugcag

SEQ ID NO: 1565110 - RNA, 12 nt, Pseudomonas putida KT2440
gcugugcugcca

SEQ ID NO: 1565111 - RNA, 14 nt, Pseudomonas putida KT2440
gcuguucaggccgg

SEQ ID NO: 1565112 - RNA, 23 nt, Pseudomonas putida KT2440
gcuguguuaccaguccaaccgca

SEQ ID NO: 1565113 - RNA, 18 nt, Pseudomonas putida KT2440
gcuguuccagaagcggcu

SEQ ID NO: 1565114 - RNA, 15 nt, Pseudomonas putida KT2440
gcuguucgucggccu

SEQ ID NO: 1565115 - RNA, 12 nt, Pseudomonas putida KT2440
gcuguucuucgg

SEQ ID NO: 1565116 - RNA, 12 nt, Pseudomonas putida KT2440
gcuguucgcuga

SEQ ID NO: 1565117 - RNA, 14 nt, Pseudomonas putida KT2440
gcuuugcgucauca

SEQ ID NO: 1565118 - RNA, 16 nt, Pseudomonas putida KT2440
gcuuuggcagcagccu

SEQ ID NO: 1565119 - RNA, 22 nt, Pseudomonas putida KT2440
gcuuugccggccucuucgcggg

SEQ ID NO: 1565120 - RNA, 19 nt, Pseudomonas putida KT2440
gcuuugccgguguucgcgg

SEQ ID NO: 1565121 - RNA, 18 nt, Pseudomonas putida KT2440
gcuuugcgggcacgggca

SEQ ID NO: 1565122 - RNA, 16 nt, Pseudomonas putida KT2440
gcuuugagcaggcgcu

SEQ ID NO: 1565123 - RNA, 12 nt, Pseudomonas putida KT2440
gcuuugcacuga

SEQ ID NO: 1565124 - RNA, 18 nt, Pseudomonas putida KT2440
gcuuugcagauuucgugg

SEQ ID NO: 1565125 - RNA, 20 nt, Pseudomonas putida KT2440
gcuuugcagcccauucgcgg

SEQ ID NO: 1565126 - RNA, 19 nt, Pseudomonas putida KT2440
gcuuugcagcccuucgcgg

SEQ ID NO: 1565127 - RNA, 20 nt, Pseudomonas putida KT2440
gcuuugcagcccuucgcggg

SEQ ID NO: 1565128 - RNA, 17 nt, Pseudomonas putida KT2440
ggaaacccgcgccuacg

SEQ ID NO: 1565129 - RNA, 14 nt, Pseudomonas putida KT2440
gcuuuguuugcugg

SEQ ID NO: 1565130 - RNA, 14 nt, Pseudomonas putida KT2440
ggaaaggucggcgg

SEQ ID NO: 1565131 - RNA, 23 nt, Pseudomonas putida KT2440
ggaaagcccccgccugcuggccg

SEQ ID NO: 1565132 - RNA, 14 nt, Pseudomonas putida KT2440
gcuugaaucagccu

SEQ ID NO: 1565133 - RNA, 14 nt, Pseudomonas putida KT2440
gcuuguucagcugg

SEQ ID NO: 1565134 - RNA, 21 nt, Pseudomonas putida KT2440
gcuuguucagcuggugggcga

SEQ ID NO: 1565135 - RNA, 23 nt, Pseudomonas putida KT2440
gcuuguucagcuggugggcgaug

SEQ ID NO: 1565136 - RNA, 17 nt, Pseudomonas putida KT2440
gcuugugccgcugcgcg

SEQ ID NO: 1565137 - RNA, 20 nt, Pseudomonas putida KT2440
gcuuguggccauugcaggcu

SEQ ID NO: 1565138 - RNA, 14 nt, Pseudomonas putida KT2440
gcuugaagcggccu

SEQ ID NO: 1565139 - RNA, 14 nt, Pseudomonas putida KT2440
gcuugaacaacggc

SEQ ID NO: 1565140 - RNA, 15 nt, Pseudomonas putida KT2440
gcuugaacaacggcg

SEQ ID NO: 1565141 - RNA, 17 nt, Pseudomonas putida KT2440
gcuugaacaacggcgcu

SEQ ID NO: 1565142 - RNA, 21 nt, Pseudomonas putida KT2440
gcuucuucaacaaaucggccu

SEQ ID NO: 1565143 - RNA, 18 nt, Pseudomonas putida KT2440
gcuucuguaccgccguca

SEQ ID NO: 1565144 - RNA, 17 nt, Pseudomonas putida KT2440
gcuucuggcgcguguca

SEQ ID NO: 1565145 - RNA, 17 nt, Pseudomonas putida KT2440
gcuuucugcugugucgg

SEQ ID NO: 1565146 - RNA, 20 nt, Pseudomonas putida KT2440
ggaacagcucgauggccagg

SEQ ID NO: 1565147 - RNA, 15 nt, Pseudomonas putida KT2440
ggaacagcagcaccg

SEQ ID NO: 1565148 - RNA, 19 nt, Pseudomonas putida KT2440
ggaacauacgcaucagcgc

SEQ ID NO: 1565149 - RNA, 20 nt, Pseudomonas putida KT2440
ggaacauacgcaucagcgca

SEQ ID NO: 1565150 - RNA, 23 nt, Pseudomonas putida KT2440
ggaacauacgcaucagcgcagca

SEQ ID NO: 1565151 - RNA, 14 nt, Pseudomonas putida KT2440
ggaacagcgcagcc

SEQ ID NO: 1565152 - RNA, 19 nt, Pseudomonas putida KT2440
ggaaauguucaacagccgc

SEQ ID NO: 1565153 - RNA, 18 nt, Pseudomonas putida KT2440
ggaacacacgcuccgggu

SEQ ID NO: 1565154 - RNA, 22 nt, Pseudomonas putida KT2440
ggaagaucaccuggucgaccga

SEQ ID NO: 1565155 - RNA, 22 nt, Pseudomonas putida KT2440
ggaaguucacacucagccgcug

SEQ ID NO: 1565156 - RNA, 20 nt, Pseudomonas putida KT2440
ggaagugcuucaccuugccu

SEQ ID NO: 1565157 - RNA, 16 nt, Pseudomonas putida KT2440
ggacccacggagucag

SEQ ID NO: 1565158 - RNA, 14 nt, Pseudomonas putida KT2440
ggacccagcgguca

SEQ ID NO: 1565159 - RNA, 20 nt, Pseudomonas putida KT2440
ggacauaccacacaccccag

SEQ ID NO: 1565160 - RNA, 22 nt, Pseudomonas putida KT2440
ggacggucaugcucagcugggc

SEQ ID NO: 1565161 - RNA, 17 nt, Pseudomonas putida KT2440
ggacucgacgucguagg

SEQ ID NO: 1565162 - RNA, 15 nt, Pseudomonas putida KT2440
ggacucgaucugugg

SEQ ID NO: 1565163 - RNA, 20 nt, Pseudomonas putida KT2440
ggagaacgggcugucgagca

SEQ ID NO: 1565164 - RNA, 15 nt, Pseudomonas putida KT2440
gcugcgucagcaucc

SEQ ID NO: 1565165 - RNA, 17 nt, Pseudomonas putida KT2440
gcugcguucaggcagga

SEQ ID NO: 1565166 - RNA, 15 nt, Pseudomonas putida KT2440
gcugcguuuaccggc

SEQ ID NO: 1565167 - RNA, 20 nt, Pseudomonas putida KT2440
gcugcguuuaccggcaccgc

SEQ ID NO: 1565168 - RNA, 20 nt, Pseudomonas putida KT2440
gcugcguugcggucagcgcu

SEQ ID NO: 1565169 - RNA, 14 nt, Pseudomonas putida KT2440
gcugcgcuggccaa

SEQ ID NO: 1565170 - RNA, 18 nt, Pseudomonas putida KT2440
gcugcggauacagcgccc

SEQ ID NO: 1565171 - RNA, 14 nt, Pseudomonas putida KT2440
gcugcggcaugaag

SEQ ID NO: 1565172 - RNA, 15 nt, Pseudomonas putida KT2440
gcugcgccccagguu

SEQ ID NO: 1565173 - RNA, 17 nt, Pseudomonas putida KT2440
gcugcgcccuuugcggg

SEQ ID NO: 1565174 - RNA, 14 nt, Pseudomonas putida KT2440
gcugcgccgaucag

SEQ ID NO: 1565175 - RNA, 13 nt, Pseudomonas putida KT2440
gcugcgcagguau

SEQ ID NO: 1565176 - RNA, 23 nt, Pseudomonas putida KT2440
gcugcgcaguacaggcugccgcc

SEQ ID NO: 1565177 - RNA, 17 nt, Pseudomonas putida KT2440
gcugcgcagcuggucga

SEQ ID NO: 1565178 - RNA, 13 nt, Pseudomonas putida KT2440
gcugcgcagccca

SEQ ID NO: 1565179 - RNA, 20 nt, Pseudomonas putida KT2440
gcugcgcagcccauucgcgg

SEQ ID NO: 1565180 - RNA, 21 nt, Pseudomonas putida KT2440
gcugcgcagcccauucgcggg

SEQ ID NO: 1565181 - RNA, 13 nt, Pseudomonas putida KT2440
gcugcgcagcccu

SEQ ID NO: 1565182 - RNA, 22 nt, Pseudomonas putida KT2440
gcugcgcaaggcauucagcucg

SEQ ID NO: 1565183 - RNA, 14 nt, Pseudomonas putida KT2440
gcugcgcaaggcga

SEQ ID NO: 1565184 - RNA, 15 nt, Pseudomonas putida KT2440
gcugcgcaaggcgag

SEQ ID NO: 1565185 - RNA, 16 nt, Pseudomonas putida KT2440
gcugcgcggcagcccu

SEQ ID NO: 1565186 - RNA, 22 nt, Pseudomonas putida KT2440
gcugcgcggcagcccuucgcgg

SEQ ID NO: 1565187 - RNA, 23 nt, Pseudomonas putida KT2440
gcugcgcggcagcccuucgcggg

SEQ ID NO: 1565188 - RNA, 19 nt, Pseudomonas putida KT2440
gcugcgccugccgggccag

SEQ ID NO: 1565189 - RNA, 16 nt, Pseudomonas putida KT2440
gcugcgcgauucgggg

SEQ ID NO: 1565190 - RNA, 15 nt, Pseudomonas putida KT2440
gcugcgcgccauggc

SEQ ID NO: 1565191 - RNA, 19 nt, Pseudomonas putida KT2440
gcugcgccgguguucgcgg

SEQ ID NO: 1565192 - RNA, 20 nt, Pseudomonas putida KT2440
gcugcgccgguguucgcggg

SEQ ID NO: 1565193 - RNA, 16 nt, Pseudomonas putida KT2440
gcugcgccucgcaggu

SEQ ID NO: 1565194 - RNA, 21 nt, Pseudomonas putida KT2440
gcugccgcccucuugcugcaa

SEQ ID NO: 1565195 - RNA, 14 nt, Pseudomonas putida KT2440
gcugcccaggugcc

SEQ ID NO: 1565196 - RNA, 15 nt, Pseudomonas putida KT2440
gcugcccaggugcca

SEQ ID NO: 1565197 - RNA, 15 nt, Pseudomonas putida KT2440
gcugccaugcaaggc

SEQ ID NO: 1565198 - RNA, 14 nt, Pseudomonas putida KT2440
gcugcccaacgccu

SEQ ID NO: 1565199 - RNA, 21 nt, Pseudomonas putida KT2440
gcugcagcgucgccucggggu

SEQ ID NO: 1565200 - RNA, 15 nt, Pseudomonas putida KT2440
gcugccgucucguca

SEQ ID NO: 1565201 - RNA, 18 nt, Pseudomonas putida KT2440
gcugccguccccaaccgg

SEQ ID NO: 1565202 - RNA, 20 nt, Pseudomonas putida KT2440
gcugccgggcaaagcggguc

SEQ ID NO: 1565203 - RNA, 15 nt, Pseudomonas putida KT2440
gcugccggucggccu

SEQ ID NO: 1565204 - RNA, 20 nt, Pseudomonas putida KT2440
gcugccggucguagcgucuc

SEQ ID NO: 1565205 - RNA, 19 nt, Pseudomonas putida KT2440
gcugccuuuuccugcugca

SEQ ID NO: 1565206 - RNA, 20 nt, Pseudomonas putida KT2440
gcugccuuuuccugcugcaa

SEQ ID NO: 1565207 - RNA, 23 nt, Pseudomonas putida KT2440
gcugccuuuuccugcugcaacaa

SEQ ID NO: 1565208 - RNA, 15 nt, Pseudomonas putida KT2440
gcugcgacacgcgaa

SEQ ID NO: 1565209 - RNA, 18 nt, Pseudomonas putida KT2440
gcugcgacacgcgaaucg

SEQ ID NO: 1565210 - RNA, 20 nt, Pseudomonas putida KT2440
gcugcgaaccuguugaagcg

SEQ ID NO: 1565211 - RNA, 20 nt, Pseudomonas putida KT2440
gcugccuuccaaccagccag

SEQ ID NO: 1565212 - RNA, 17 nt, Pseudomonas putida KT2440
gcugagccaguucacgg

SEQ ID NO: 1565213 - RNA, 15 nt, Pseudomonas putida KT2440
gcugagcagaccagc

SEQ ID NO: 1565214 - RNA, 18 nt, Pseudomonas putida KT2440
gcugaccgccugcgcacg

SEQ ID NO: 1565215 - RNA, 20 nt, Pseudomonas putida KT2440
gcugaccuguucgcgcaaca

SEQ ID NO: 1565216 - RNA, 22 nt, Pseudomonas putida KT2440
gcugaccuguucgcgcaacacu

SEQ ID NO: 1565217 - RNA, 22 nt, Pseudomonas putida KT2440
gcugaugagguuugccaaggca

SEQ ID NO: 1565218 - RNA, 19 nt, Pseudomonas putida KT2440
gcugaugauauuugccacu

SEQ ID NO: 1565219 - RNA, 18 nt, Pseudomonas putida KT2440
gcugaugcgggaccagca

SEQ ID NO: 1565220 - RNA, 22 nt, Pseudomonas putida KT2440
gcugaugcgguagugcaggcga

SEQ ID NO: 1565221 - RNA, 15 nt, Pseudomonas putida KT2440
gcugaucaccgccgc

SEQ ID NO: 1565222 - RNA, 18 nt, Pseudomonas putida KT2440
gcugaucucuucagccac

SEQ ID NO: 1565223 - RNA, 16 nt, Pseudomonas putida KT2440
gcugaucaagcccgcu

SEQ ID NO: 1565224 - RNA, 19 nt, Pseudomonas putida KT2440
gcugaucaagcccgcucgc

SEQ ID NO: 1565225 - RNA, 17 nt, Pseudomonas putida KT2440
gcugauagccgccagca

SEQ ID NO: 1565226 - RNA, 15 nt, Pseudomonas putida KT2440
gcugauaaccugcau

SEQ ID NO: 1565227 - RNA, 20 nt, Pseudomonas putida KT2440
gcugcaaggcagccccugca

SEQ ID NO: 1565228 - RNA, 19 nt, Pseudomonas putida KT2440
gcugcaagcgcaccugcag

SEQ ID NO: 1565229 - RNA, 20 nt, Pseudomonas putida KT2440
gcugaacagccggcccuucu

SEQ ID NO: 1565230 - RNA, 16 nt, Pseudomonas putida KT2440
gcugaacacgcagguc

SEQ ID NO: 1565231 - RNA, 17 nt, Pseudomonas putida KT2440
gcugaacaacuccgggu

SEQ ID NO: 1565232 - RNA, 18 nt, Pseudomonas putida KT2440
gcugaaugcggaaaaggc

SEQ ID NO: 1565233 - RNA, 13 nt, Pseudomonas putida KT2440
gcugaaccugacc

SEQ ID NO: 1565234 - RNA, 20 nt, Pseudomonas putida KT2440
gcugaaccugaccuugcugc

SEQ ID NO: 1565235 - RNA, 14 nt, Pseudomonas putida KT2440
gcugaccaccgugc

SEQ ID NO: 1565236 - RNA, 21 nt, Pseudomonas putida KT2440
gcugaccacgccgaagcgcgc

SEQ ID NO: 1565237 - RNA, 17 nt, Pseudomonas putida KT2440
gcugaccagugucugca

SEQ ID NO: 1565238 - RNA, 18 nt, Pseudomonas putida KT2440
gcucucgaaguagcgcuc

SEQ ID NO: 1565239 - RNA, 14 nt, Pseudomonas putida KT2440
gcucuccucuccca

SEQ ID NO: 1565240 - RNA, 17 nt, Pseudomonas putida KT2440
gcucuccagcagguuca

SEQ ID NO: 1565241 - RNA, 21 nt, Pseudomonas putida KT2440
gcucguugaugaugcgcaccg

SEQ ID NO: 1565242 - RNA, 20 nt, Pseudomonas putida KT2440
gcucgcgguucaucggcaaa

SEQ ID NO: 1565243 - RNA, 16 nt, Pseudomonas putida KT2440
gcucgcugcugccuuc

SEQ ID NO: 1565244 - RNA, 20 nt, Pseudomonas putida KT2440
gcucgcuggccaccagcaug

SEQ ID NO: 1565245 - RNA, 13 nt, Pseudomonas putida KT2440
gcucgcuggcgaa

SEQ ID NO: 1565246 - RNA, 16 nt, Pseudomonas putida KT2440
gcucgcucaggcgcag

SEQ ID NO: 1565247 - RNA, 23 nt, Pseudomonas putida KT2440
gcucgcucaggcgcagcgcaugc

SEQ ID NO: 1565248 - RNA, 15 nt, Pseudomonas putida KT2440
gcucgcucaggcucu

SEQ ID NO: 1565249 - RNA, 12 nt, Pseudomonas putida KT2440
gcucggccagcc

SEQ ID NO: 1565250 - RNA, 14 nt, Pseudomonas putida KT2440
gcucgcgcugcgca

SEQ ID NO: 1565251 - RNA, 13 nt, Pseudomonas putida KT2440
gcucgcggcgcag

SEQ ID NO: 1565252 - RNA, 22 nt, Pseudomonas putida KT2440
gcucgcgcaggguuuucagcgc

SEQ ID NO: 1565253 - RNA, 17 nt, Pseudomonas putida KT2440
gcucgcgcaugaucgcu

SEQ ID NO: 1565254 - RNA, 20 nt, Pseudomonas putida KT2440
gcucgcgcaugaucgcuucg

SEQ ID NO: 1565255 - RNA, 18 nt, Pseudomonas putida KT2440
gcucgcgcaacaaggcca

SEQ ID NO: 1565256 - RNA, 13 nt, Pseudomonas putida KT2440
gcucgcaugagcc

SEQ ID NO: 1565257 - RNA, 18 nt, Pseudomonas putida KT2440
gcucgcccgggucagguc

SEQ ID NO: 1565258 - RNA, 15 nt, Pseudomonas putida KT2440
gcucgcccagcagcc

SEQ ID NO: 1565259 - RNA, 15 nt, Pseudomonas putida KT2440
gcucgccggguucca

SEQ ID NO: 1565260 - RNA, 17 nt, Pseudomonas putida KT2440
gcucgagugcgaaggca

SEQ ID NO: 1565261 - RNA, 16 nt, Pseudomonas putida KT2440
gcucgaucggcaagcc

SEQ ID NO: 1565262 - RNA, 18 nt, Pseudomonas putida KT2440
gcucgaucuugccuucgg

SEQ ID NO: 1565263 - RNA, 18 nt, Pseudomonas putida KT2440
gcucgaucucacaggcga

SEQ ID NO: 1565264 - RNA, 15 nt, Pseudomonas putida KT2440
gcucgaucaggcucu

SEQ ID NO: 1565265 - RNA, 21 nt, Pseudomonas putida KT2440
gcucgaugaucaucccggcga

SEQ ID NO: 1565266 - RNA, 14 nt, Pseudomonas putida KT2440
gcucgaugcgcacg

SEQ ID NO: 1565267 - RNA, 22 nt, Pseudomonas putida KT2440
gcucgauuagcuccaccagcgg

SEQ ID NO: 1565268 - RNA, 18 nt, Pseudomonas putida KT2440
gcucgcagguauccgggu

SEQ ID NO: 1565269 - RNA, 20 nt, Pseudomonas putida KT2440
gcuccgacucgucaauaccg

SEQ ID NO: 1565270 - RNA, 15 nt, Pseudomonas putida KT2440
gcuccgacaggcugu

SEQ ID NO: 1565271 - RNA, 22 nt, Pseudomonas putida KT2440
gcucccucgguuucucaccccg

SEQ ID NO: 1565272 - RNA, 17 nt, Pseudomonas putida KT2440
gcucccucguaggagcg

SEQ ID NO: 1565273 - RNA, 21 nt, Pseudomonas putida KT2440
gcucccucguaggagcggguu

SEQ ID NO: 1565274 - RNA, 12 nt, Pseudomonas putida KT2440
gcucccggcauu

SEQ ID NO: 1565275 - RNA, 17 nt, Pseudomonas putida KT2440
gcucccggcauugccca

SEQ ID NO: 1565276 - RNA, 21 nt, Pseudomonas putida KT2440
gcuccggaucguugcggguca

SEQ ID NO: 1565277 - RNA, 15 nt, Pseudomonas putida KT2440
gcucccacaaaggcc

SEQ ID NO: 1565278 - RNA, 23 nt, Pseudomonas putida KT2440
gcucccacaggaaugucaccgcg

SEQ ID NO: 1565279 - RNA, 15 nt, Pseudomonas putida KT2440
gcucccacaggggau

SEQ ID NO: 1565280 - RNA, 20 nt, Pseudomonas putida KT2440
gcucccacagguaagucaca

SEQ ID NO: 1565281 - RNA, 20 nt, Pseudomonas putida KT2440
gcucccacagguaaugcaca

SEQ ID NO: 1565282 - RNA, 19 nt, Pseudomonas putida KT2440
gcucccacagguacucgca

SEQ ID NO: 1565283 - RNA, 19 nt, Pseudomonas putida KT2440
gcucccacagguccagcgc

SEQ ID NO: 1565284 - RNA, 21 nt, Pseudomonas putida KT2440
gcucccacagguccagcgcag

SEQ ID NO: 1565285 - RNA, 17 nt, Pseudomonas putida KT2440
gcuccaugggcaggccc

SEQ ID NO: 1565286 - RNA, 24 nt, Pseudomonas putida KT2440
gcuccaugggcaggcccagguaac

SEQ ID NO: 1565287 - RNA, 19 nt, Pseudomonas putida KT2440
gcuaccaaccuccagguca

SEQ ID NO: 1565288 - RNA, 19 nt, Pseudomonas putida KT2440
gcuaccagcaguuggcugc

SEQ ID NO: 1565289 - RNA, 17 nt, Pseudomonas putida KT2440
gcucccagaaaggccgc

SEQ ID NO: 1565290 - RNA, 20 nt, Pseudomonas putida KT2440
gcuacagaagccucaccgcc

SEQ ID NO: 1565291 - RNA, 22 nt, Pseudomonas putida KT2440
gcuacagaagccucaccgccgc

SEQ ID NO: 1565292 - RNA, 21 nt, Pseudomonas putida KT2440
gcuacagccccuuccccaggc

SEQ ID NO: 1565293 - RNA, 15 nt, Pseudomonas putida KT2440
gcuaaguuugcccag

SEQ ID NO: 1565294 - RNA, 18 nt, Pseudomonas putida KT2440
gcuaaggcugauaagcaa

SEQ ID NO: 1565295 - RNA, 13 nt, Pseudomonas putida KT2440
gcuaauacccugu

SEQ ID NO: 1565296 - RNA, 16 nt, Pseudomonas putida KT2440
gcucgacgcgggccaa

SEQ ID NO: 1565297 - RNA, 20 nt, Pseudomonas putida KT2440
gcucgacgcgggccaagguc

SEQ ID NO: 1565298 - RNA, 15 nt, Pseudomonas putida KT2440
gcucgacggucaugg

SEQ ID NO: 1565299 - RNA, 19 nt, Pseudomonas putida KT2440
gcucgagaaacgccagcug

SEQ ID NO: 1565300 - RNA, 22 nt, Pseudomonas putida KT2440
gcucgagcccgccagcaggcca

SEQ ID NO: 1565301 - RNA, 12 nt, Pseudomonas putida KT2440
gcucgacgaagg

SEQ ID NO: 1565302 - RNA, 15 nt, Pseudomonas putida KT2440
gcucgacgcgcgcag

SEQ ID NO: 1565303 - RNA, 18 nt, Pseudomonas putida KT2440
gcucgaaugccgcugcug

SEQ ID NO: 1565304 - RNA, 21 nt, Pseudomonas putida KT2440
gcucgaaucaagccugcgcag

SEQ ID NO: 1565305 - RNA, 18 nt, Pseudomonas putida KT2440
gcucgaacucuuccagcu

SEQ ID NO: 1565306 - RNA, 16 nt, Pseudomonas putida KT2440
gcucgacaaacugcug

SEQ ID NO: 1565307 - RNA, 19 nt, Pseudomonas putida KT2440
gcuccuacggaaucugcac

SEQ ID NO: 1565308 - RNA, 13 nt, Pseudomonas putida KT2440
gcuccuacgggca

SEQ ID NO: 1565309 - RNA, 18 nt, Pseudomonas putida KT2440
gcuccgggugcggcauca

SEQ ID NO: 1565310 - RNA, 13 nt, Pseudomonas putida KT2440
gcuccuucuucac

SEQ ID NO: 1565311 - RNA, 20 nt, Pseudomonas putida KT2440
gcuccuucuucacccgcagc

SEQ ID NO: 1565312 - RNA, 21 nt, Pseudomonas putida KT2440
gcuccuugcuguagcccacca

SEQ ID NO: 1565313 - RNA, 23 nt, Pseudomonas putida KT2440
gcuccuuguagauauugaccagc

SEQ ID NO: 1565314 - RNA, 15 nt, Pseudomonas putida KT2440
gcucgaacacuucac

SEQ ID NO: 1565315 - RNA, 17 nt, Pseudomonas putida KT2440
gcuccugcacaacccua

SEQ ID NO: 1565316 - RNA, 19 nt, Pseudomonas putida KT2440
gcuccugcagguaucacgc

SEQ ID NO: 1565317 - RNA, 18 nt, Pseudomonas putida KT2440
gcgguggagggcaccggc

SEQ ID NO: 1565318 - RNA, 14 nt, Pseudomonas putida KT2440
gcggugcacggccu

SEQ ID NO: 1565319 - RNA, 21 nt, Pseudomonas putida KT2440
gcggugcacguagucgucagg

SEQ ID NO: 1565320 - RNA, 13 nt, Pseudomonas putida KT2440
gcggucugcugcg

SEQ ID NO: 1565321 - RNA, 15 nt, Pseudomonas putida KT2440
gcggugauggcgcau

SEQ ID NO: 1565322 - RNA, 18 nt, Pseudomonas putida KT2440
gcggugauggcgcauggc

SEQ ID NO: 1565323 - RNA, 19 nt, Pseudomonas putida KT2440
gcggugauggcgcauggcc

SEQ ID NO: 1565324 - RNA, 16 nt, Pseudomonas putida KT2440
gcguaauagcugguga

SEQ ID NO: 1565325 - RNA, 16 nt, Pseudomonas putida KT2440
gcgguugcccgcugca

SEQ ID NO: 1565326 - RNA, 18 nt, Pseudomonas putida KT2440
gcgguugggcaagugcgu

SEQ ID NO: 1565327 - RNA, 20 nt, Pseudomonas putida KT2440
gcgguuguagaucgccggca

SEQ ID NO: 1565328 - RNA, 19 nt, Pseudomonas putida KT2440
gcgguugccaagcacggcg

SEQ ID NO: 1565329 - RNA, 23 nt, Pseudomonas putida KT2440
gcgguguaucuccaugcugcugc

SEQ ID NO: 1565330 - RNA, 17 nt, Pseudomonas putida KT2440
gcgguggccgcguacca

SEQ ID NO: 1565331 - RNA, 13 nt, Pseudomonas putida KT2440
gcggucaggccaa

SEQ ID NO: 1565332 - RNA, 20 nt, Pseudomonas putida KT2440
gcggucaagcucguccugca

SEQ ID NO: 1565333 - RNA, 19 nt, Pseudomonas putida KT2440
gcgggcuugcccgcgaauc

SEQ ID NO: 1565334 - RNA, 23 nt, Pseudomonas putida KT2440
gcgggcuugcccgcgaaucgccu

SEQ ID NO: 1565335 - RNA, 20 nt, Pseudomonas putida KT2440
gcgggcuugcccgcgaaugg

SEQ ID NO: 1565336 - RNA, 20 nt, Pseudomonas putida KT2440
gcgggcuggcauucaacgcc

SEQ ID NO: 1565337 - RNA, 12 nt, Pseudomonas putida KT2440
gcgguccugcac

SEQ ID NO: 1565338 - RNA, 13 nt, Pseudomonas putida KT2440
gcgguccggugau

SEQ ID NO: 1565339 - RNA, 20 nt, Pseudomonas putida KT2440
gcgguccggacuuggacccc

SEQ ID NO: 1565340 - RNA, 17 nt, Pseudomonas putida KT2440
gcggucggccagcggca

SEQ ID NO: 1565341 - RNA, 20 nt, Pseudomonas putida KT2440
gcggucggucagcaccuggc

SEQ ID NO: 1565342 - RNA, 21 nt, Pseudomonas putida KT2440
gcgucacccgcgccaccagcc

SEQ ID NO: 1565343 - RNA, 17 nt, Pseudomonas putida KT2440
gcgucagccguugacca

SEQ ID NO: 1565344 - RNA, 22 nt, Pseudomonas putida KT2440
gcgucagcgugguaguugucca

SEQ ID NO: 1565345 - RNA, 23 nt, Pseudomonas putida KT2440
gcguccagcagugccaucgccuc

SEQ ID NO: 1565346 - RNA, 14 nt, Pseudomonas putida KT2440
gcguccagcaacag

SEQ ID NO: 1565347 - RNA, 18 nt, Pseudomonas putida KT2440
gcguccagcaacagcugc

SEQ ID NO: 1565348 - RNA, 20 nt, Pseudomonas putida KT2440
gcguccaguucaaugccagc

SEQ ID NO: 1565349 - RNA, 13 nt, Pseudomonas putida KT2440
gcgucauccgcca

SEQ ID NO: 1565350 - RNA, 17 nt, Pseudomonas putida KT2440
gcgucauacucuucgcg

SEQ ID NO: 1565351 - RNA, 19 nt, Pseudomonas putida KT2440
gcgucaugcgguacagcac

SEQ ID NO: 1565352 - RNA, 19 nt, Pseudomonas putida KT2440
gcgucauccugcgcggcca

SEQ ID NO: 1565353 - RNA, 19 nt, Pseudomonas putida KT2440
gcguagccuucagcggccg

SEQ ID NO: 1565354 - RNA, 16 nt, Pseudomonas putida KT2440
gcguagcaggaucugc

SEQ ID NO: 1565355 - RNA, 21 nt, Pseudomonas putida KT2440
gcguagcaggaucugcugcag

SEQ ID NO: 1565356 - RNA, 22 nt, Pseudomonas putida KT2440
gcguagcagguacgcgcaggca

SEQ ID NO: 1565357 - RNA, 22 nt, Pseudomonas putida KT2440
gcguacagcgacaugccggcca

SEQ ID NO: 1565358 - RNA, 13 nt, Pseudomonas putida KT2440
gcguacacugcag

SEQ ID NO: 1565359 - RNA, 14 nt, Pseudomonas putida KT2440
gcguaccuggcugc

SEQ ID NO: 1565360 - RNA, 18 nt, Pseudomonas putida KT2440
gcguacgaauacggucga

SEQ ID NO: 1565361 - RNA, 20 nt, Pseudomonas putida KT2440
gcguaccggcaacccggcag

SEQ ID NO: 1565362 - RNA, 21 nt, Pseudomonas putida KT2440
gcguaguacuccagcagcgca

SEQ ID NO: 1565363 - RNA, 19 nt, Pseudomonas putida KT2440
gcguaguagauaucggccg

SEQ ID NO: 1565364 - RNA, 23 nt, Pseudomonas putida KT2440
gcguauccacauacugcuucugc

SEQ ID NO: 1565365 - RNA, 14 nt, Pseudomonas putida KT2440
gcguauagccaccg

SEQ ID NO: 1565366 - RNA, 19 nt, Pseudomonas putida KT2440
gcguauucggccaccagcc

SEQ ID NO: 1565367 - RNA, 16 nt, Pseudomonas putida KT2440
gcguauccuugcccac

SEQ ID NO: 1565368 - RNA, 14 nt, Pseudomonas putida KT2440
gcgucaaacagccg

SEQ ID NO: 1565369 - RNA, 17 nt, Pseudomonas putida KT2440
gcguauuuuugcgccag

SEQ ID NO: 1565370 - RNA, 20 nt, Pseudomonas putida KT2440
gcguauuuccugagcgguga

SEQ ID NO: 1565371 - RNA, 16 nt, Pseudomonas putida KT2440
gcguauuugaccagcc

SEQ ID NO: 1565372 - RNA, 12 nt, Pseudomonas putida KT2440
gcgugaccagcc

SEQ ID NO: 1565373 - RNA, 23 nt, Pseudomonas putida KT2440
gcgugcaagggauaucaggcccu

SEQ ID NO: 1565374 - RNA, 23 nt, Pseudomonas putida KT2440
gcgugccuugccugggccggugg

SEQ ID NO: 1565375 - RNA, 16 nt, Pseudomonas putida KT2440
gcgugccucgcccagg

SEQ ID NO: 1565376 - RNA, 18 nt, Pseudomonas putida KT2440
gcgugccucgcccagguc

SEQ ID NO: 1565377 - RNA, 21 nt, Pseudomonas putida KT2440
gcgugccgucgagcaggucga

SEQ ID NO: 1565378 - RNA, 18 nt, Pseudomonas putida KT2440
gcgugaaaaaagcgugaa

SEQ ID NO: 1565379 - RNA, 16 nt, Pseudomonas putida KT2440
gcgucuucgccaggug

SEQ ID NO: 1565380 - RNA, 17 nt, Pseudomonas putida KT2440
gcgucuuccacgcccag

SEQ ID NO: 1565381 - RNA, 19 nt, Pseudomonas putida KT2440
gcgugaaauaagaaccggc

SEQ ID NO: 1565382 - RNA, 20 nt, Pseudomonas putida KT2440
gcgucguuggggucgaccgg

SEQ ID NO: 1565383 - RNA, 21 nt, Pseudomonas putida KT2440
gcgucguuggggucgaccgga

SEQ ID NO: 1565384 - RNA, 22 nt, Pseudomonas putida KT2440
gcgucggcgacguugguagaga

SEQ ID NO: 1565385 - RNA, 14 nt, Pseudomonas putida KT2440
gcgucguacaggcc

SEQ ID NO: 1565386 - RNA, 15 nt, Pseudomonas putida KT2440
gcgucguacaggccu

SEQ ID NO: 1565387 - RNA, 17 nt, Pseudomonas putida KT2440
gcgucggcagagcgcca

SEQ ID NO: 1565388 - RNA, 19 nt, Pseudomonas putida KT2440
gcgucgcgaugggcugcaa

SEQ ID NO: 1565389 - RNA, 19 nt, Pseudomonas putida KT2440
gcgucggccaccuggucga

SEQ ID NO: 1565390 - RNA, 16 nt, Pseudomonas putida KT2440
gcgucggccgaugucu

SEQ ID NO: 1565391 - RNA, 21 nt, Pseudomonas putida KT2440
gcgucgcgaucacgcaggccc

SEQ ID NO: 1565392 - RNA, 22 nt, Pseudomonas putida KT2440
gcguugucgacugcacugccag

SEQ ID NO: 1565393 - RNA, 15 nt, Pseudomonas putida KT2440
gcguuguucagcagc

SEQ ID NO: 1565394 - RNA, 19 nt, Pseudomonas putida KT2440
gcguuguucagcagcgaag

SEQ ID NO: 1565395 - RNA, 18 nt, Pseudomonas putida KT2440
gcguuggcugcugaaugc

SEQ ID NO: 1565396 - RNA, 21 nt, Pseudomonas putida KT2440
gcguuggcuucuucgcgggca

SEQ ID NO: 1565397 - RNA, 13 nt, Pseudomonas putida KT2440
gcguuggccaggu

SEQ ID NO: 1565398 - RNA, 23 nt, Pseudomonas putida KT2440
gcguugcggaacauacgcaucag

SEQ ID NO: 1565399 - RNA, 20 nt, Pseudomonas putida KT2440
gcguugcggcccuucgcggg

SEQ ID NO: 1565400 - RNA, 19 nt, Pseudomonas putida KT2440
gcguuugcaacuggcgcag

SEQ ID NO: 1565401 - RNA, 15 nt, Pseudomonas putida KT2440
gcguuuuuugugccu

SEQ ID NO: 1565402 - RNA, 16 nt, Pseudomonas putida KT2440
gcguggcaccggcgaa

SEQ ID NO: 1565403 - RNA, 19 nt, Pseudomonas putida KT2440
gcgugcggggcaucgccga

SEQ ID NO: 1565404 - RNA, 21 nt, Pseudomonas putida KT2440
gcgugugacccaguucgcgga

SEQ ID NO: 1565405 - RNA, 21 nt, Pseudomonas putida KT2440
gcguucagcaagaccagaaac

SEQ ID NO: 1565406 - RNA, 16 nt, Pseudomonas putida KT2440
gcguucacaucgcccu

SEQ ID NO: 1565407 - RNA, 14 nt, Pseudomonas putida KT2440
gcguucucgcucag

SEQ ID NO: 1565408 - RNA, 15 nt, Pseudomonas putida KT2440
gcggcgugaccagcc

SEQ ID NO: 1565409 - RNA, 19 nt, Pseudomonas putida KT2440
gcggcgugcgcccggcaaa

SEQ ID NO: 1565410 - RNA, 16 nt, Pseudomonas putida KT2440
gcggcgaaagccagca

SEQ ID NO: 1565411 - RNA, 17 nt, Pseudomonas putida KT2440
gcggcgaaagccagcag

SEQ ID NO: 1565412 - RNA, 20 nt, Pseudomonas putida KT2440
gcggccuugugucucgaugg

SEQ ID NO: 1565413 - RNA, 21 nt, Pseudomonas putida KT2440
gcggccuugugucucgauggg

SEQ ID NO: 1565414 - RNA, 20 nt, Pseudomonas putida KT2440
gcggccuuggucucgaucag

SEQ ID NO: 1565415 - RNA, 19 nt, Pseudomonas putida KT2440
gcggccuugucgcgaaagg

SEQ ID NO: 1565416 - RNA, 15 nt, Pseudomonas putida KT2440
gcggccuugaccacu

SEQ ID NO: 1565417 - RNA, 17 nt, Pseudomonas putida KT2440
gcggccuugcgucgcga

SEQ ID NO: 1565418 - RNA, 21 nt, Pseudomonas putida KT2440
gcggccuugcgucgcgaaagg

SEQ ID NO: 1565419 - RNA, 11 nt, Pseudomonas putida KT2440
gcggcgcagcg

SEQ ID NO: 1565420 - RNA, 11 nt, Pseudomonas putida KT2440
gcggcgccauc

SEQ ID NO: 1565421 - RNA, 20 nt, Pseudomonas putida KT2440
gcggcggcagcgcgggcaga

SEQ ID NO: 1565422 - RNA, 15 nt, Pseudomonas putida KT2440
gcggcggcaauggcg

SEQ ID NO: 1565423 - RNA, 13 nt, Pseudomonas putida KT2440
gcggcgcggcccu

SEQ ID NO: 1565424 - RNA, 19 nt, Pseudomonas putida KT2440
gcgggccuggagcaaggcg

SEQ ID NO: 1565425 - RNA, 17 nt, Pseudomonas putida KT2440
gcggcucgaugcugcgu

SEQ ID NO: 1565426 - RNA, 22 nt, Pseudomonas putida KT2440
gcggcucucgaaguagcgcucu

SEQ ID NO: 1565427 - RNA, 16 nt, Pseudomonas putida KT2440
gcggcuaagcgccagc

SEQ ID NO: 1565428 - RNA, 16 nt, Pseudomonas putida KT2440
gcggcuuggccgcgaa

SEQ ID NO: 1565429 - RNA, 16 nt, Pseudomonas putida KT2440
gcgggaaggucggcca

SEQ ID NO: 1565430 - RNA, 22 nt, Pseudomonas putida KT2440
gcgggaaggucggccaguuggc

SEQ ID NO: 1565431 - RNA, 16 nt, Pseudomonas putida KT2440
gcgggccaccaggccu

SEQ ID NO: 1565432 - RNA, 14 nt, Pseudomonas putida KT2440
gcgggcaugcccgc

SEQ ID NO: 1565433 - RNA, 20 nt, Pseudomonas putida KT2440
gcgggagcgggcgugcccgc

SEQ ID NO: 1565434 - RNA, 15 nt, Pseudomonas putida KT2440
gcggccgucgcggcu

SEQ ID NO: 1565435 - RNA, 13 nt, Pseudomonas putida KT2440
gcggccggucacc

SEQ ID NO: 1565436 - RNA, 13 nt, Pseudomonas putida KT2440
gcggccgggucga

SEQ ID NO: 1565437 - RNA, 19 nt, Pseudomonas putida KT2440
gcggccggcccccccauca

SEQ ID NO: 1565438 - RNA, 14 nt, Pseudomonas putida KT2440
gcggccugcugccg

SEQ ID NO: 1565439 - RNA, 14 nt, Pseudomonas putida KT2440
gcggccugugccca

SEQ ID NO: 1565440 - RNA, 15 nt, Pseudomonas putida KT2440
gcggccugcuccaca

SEQ ID NO: 1565441 - RNA, 16 nt, Pseudomonas putida KT2440
gcggccugcuccacaa

SEQ ID NO: 1565442 - RNA, 16 nt, Pseudomonas putida KT2440
gcggccucgguccacc

SEQ ID NO: 1565443 - RNA, 21 nt, Pseudomonas putida KT2440
gcggccucguccggugccgcc

SEQ ID NO: 1565444 - RNA, 13 nt, Pseudomonas putida KT2440
gcggccgaagugg

SEQ ID NO: 1565445 - RNA, 19 nt, Pseudomonas putida KT2440
gcggcccuuaaggucaauc

SEQ ID NO: 1565446 - RNA, 20 nt, Pseudomonas putida KT2440
gcggccgcagccccaccucg

SEQ ID NO: 1565447 - RNA, 15 nt, Pseudomonas putida KT2440
gcggccaucgaacac

SEQ ID NO: 1565448 - RNA, 15 nt, Pseudomonas putida KT2440
gcggcccaaucgcca

SEQ ID NO: 1565449 - RNA, 13 nt, Pseudomonas putida KT2440
gcggcccagccag

SEQ ID NO: 1565450 - RNA, 14 nt, Pseudomonas putida KT2440
gcggcccagcccag

SEQ ID NO: 1565451 - RNA, 23 nt, Pseudomonas putida KT2440
gcggcccacagugcuuccagcag

SEQ ID NO: 1565452 - RNA, 21 nt, Pseudomonas putida KT2440
gcggcccauucgcgggcaagc

SEQ ID NO: 1565453 - RNA, 18 nt, Pseudomonas putida KT2440
gcggcccccacgccgacc

SEQ ID NO: 1565454 - RNA, 23 nt, Pseudomonas putida KT2440
gcggccccaggugccaacgguca

SEQ ID NO: 1565455 - RNA, 22 nt, Pseudomonas putida KT2440
gcggccccuucgauucaggccu

SEQ ID NO: 1565456 - RNA, 13 nt, Pseudomonas putida KT2440
gcggccagcgcau

SEQ ID NO: 1565457 - RNA, 15 nt, Pseudomonas putida KT2440
gcgcuuugcguggca

SEQ ID NO: 1565458 - RNA, 22 nt, Pseudomonas putida KT2440
gcggcaguugccugccuugcga

SEQ ID NO: 1565459 - RNA, 16 nt, Pseudomonas putida KT2440
gcggccacagcgccaa

SEQ ID NO: 1565460 - RNA, 20 nt, Pseudomonas putida KT2440
gcggccaaugaucgagcgca

SEQ ID NO: 1565461 - RNA, 23 nt, Pseudomonas putida KT2440
gcggccaaugaucgagcgcaccu

SEQ ID NO: 1565462 - RNA, 19 nt, Pseudomonas putida KT2440
gcggcaugaaggcccagcu

SEQ ID NO: 1565463 - RNA, 16 nt, Pseudomonas putida KT2440
gcggcaugucgaugcg

SEQ ID NO: 1565464 - RNA, 16 nt, Pseudomonas putida KT2440
gcggcauuggcgcgcu

SEQ ID NO: 1565465 - RNA, 15 nt, Pseudomonas putida KT2440
gcgacuucggcgaua

SEQ ID NO: 1565466 - RNA, 17 nt, Pseudomonas putida KT2440
gcgacuuucgggucgcc

SEQ ID NO: 1565467 - RNA, 22 nt, Pseudomonas putida KT2440
gcgacugcagguaguuuuccag

SEQ ID NO: 1565468 - RNA, 17 nt, Pseudomonas putida KT2440
gcgacugcaagcgaugc

SEQ ID NO: 1565469 - RNA, 15 nt, Pseudomonas putida KT2440
gcgacugaggcaccg

SEQ ID NO: 1565470 - RNA, 16 nt, Pseudomonas putida KT2440
gcgacugaagcgcggg

SEQ ID NO: 1565471 - RNA, 17 nt, Pseudomonas putida KT2440
gcgacugaagcgcgggu

SEQ ID NO: 1565472 - RNA, 17 nt, Pseudomonas putida KT2440
gcgacugaauacagcca

SEQ ID NO: 1565473 - RNA, 14 nt, Pseudomonas putida KT2440
gcgacggcgaauga

SEQ ID NO: 1565474 - RNA, 16 nt, Pseudomonas putida KT2440
gcgagaaggcguggug

SEQ ID NO: 1565475 - RNA, 13 nt, Pseudomonas putida KT2440
gcgagcgaacagc

SEQ ID NO: 1565476 - RNA, 14 nt, Pseudomonas putida KT2440
gcgagcgaacagcu

SEQ ID NO: 1565477 - RNA, 23 nt, Pseudomonas putida KT2440
gcgagccgcauuggccgggucga

SEQ ID NO: 1565478 - RNA, 16 nt, Pseudomonas putida KT2440
gcgagccacucggcaa

SEQ ID NO: 1565479 - RNA, 21 nt, Pseudomonas putida KT2440
gcgagcaggucaugcagguca

SEQ ID NO: 1565480 - RNA, 14 nt, Pseudomonas putida KT2440
gcgauaaaccagca

SEQ ID NO: 1565481 - RNA, 20 nt, Pseudomonas putida KT2440
gcgauaaaccagcagcgccu

SEQ ID NO: 1565482 - RNA, 22 nt, Pseudomonas putida KT2440
gcgauaaaccagcagcgccugc

SEQ ID NO: 1565483 - RNA, 15 nt, Pseudomonas putida KT2440
gcgauaccgccaucg

SEQ ID NO: 1565484 - RNA, 22 nt, Pseudomonas putida KT2440
gcgauagaacuccaccagccca

SEQ ID NO: 1565485 - RNA, 20 nt, Pseudomonas putida KT2440
gcgauaaugggucaacggcu

SEQ ID NO: 1565486 - RNA, 15 nt, Pseudomonas putida KT2440
gcgauacucaccgcc

SEQ ID NO: 1565487 - RNA, 16 nt, Pseudomonas putida KT2440
gcgauagggaucaccu

SEQ ID NO: 1565488 - RNA, 16 nt, Pseudomonas putida KT2440
gcgaggaggccgggga

SEQ ID NO: 1565489 - RNA, 17 nt, Pseudomonas putida KT2440
gcgaggaggccggggau

SEQ ID NO: 1565490 - RNA, 19 nt, Pseudomonas putida KT2440
gcgaguauccuccagcccu

SEQ ID NO: 1565491 - RNA, 16 nt, Pseudomonas putida KT2440
gcgaguaaagccagca

SEQ ID NO: 1565492 - RNA, 18 nt, Pseudomonas putida KT2440
gcgaguaaagccagcagc

SEQ ID NO: 1565493 - RNA, 18 nt, Pseudomonas putida KT2440
gcgaguagaucaucagcg

SEQ ID NO: 1565494 - RNA, 20 nt, Pseudomonas putida KT2440
gcgaguagaucaucagcgcc

SEQ ID NO: 1565495 - RNA, 21 nt, Pseudomonas putida KT2440
gcgaguagaucaucagcgcca

SEQ ID NO: 1565496 - RNA, 18 nt, Pseudomonas putida KT2440
gcgagcuuguacacgccu

SEQ ID NO: 1565497 - RNA, 13 nt, Pseudomonas putida KT2440
gcgacagcguugc

SEQ ID NO: 1565498 - RNA, 17 nt, Pseudomonas putida KT2440
gcgacagcucaagcccu

SEQ ID NO: 1565499 - RNA, 20 nt, Pseudomonas putida KT2440
gcgacagcucaagcccugcc

SEQ ID NO: 1565500 - RNA, 16 nt, Pseudomonas putida KT2440
gcgaagcggccccaau

SEQ ID NO: 1565501 - RNA, 13 nt, Pseudomonas putida KT2440
gcgacaggcgucg

SEQ ID NO: 1565502 - RNA, 14 nt, Pseudomonas putida KT2440
gcgacaggcgucgg

SEQ ID NO: 1565503 - RNA, 18 nt, Pseudomonas putida KT2440
gcgacaggcuugaagcug

SEQ ID NO: 1565504 - RNA, 22 nt, Pseudomonas putida KT2440
gcgacaggcuugaagcugcgcu

SEQ ID NO: 1565505 - RNA, 16 nt, Pseudomonas putida KT2440
gcgaccacacugcucg

SEQ ID NO: 1565506 - RNA, 18 nt, Pseudomonas putida KT2440
gcgaccacaggcgcuuga

SEQ ID NO: 1565507 - RNA, 19 nt, Pseudomonas putida KT2440
gcgacccauuugcagcaca

SEQ ID NO: 1565508 - RNA, 14 nt, Pseudomonas putida KT2440
gcgaccgccauuga

SEQ ID NO: 1565509 - RNA, 23 nt, Pseudomonas putida KT2440
gcgaccuucacgccagccguuga

SEQ ID NO: 1565510 - RNA, 17 nt, Pseudomonas putida KT2440
gcgaccgacacgcggca

SEQ ID NO: 1565511 - RNA, 18 nt, Pseudomonas putida KT2440
gcgaccuucgggucgccu

SEQ ID NO: 1565512 - RNA, 16 nt, Pseudomonas putida KT2440
gcgacgaccugcacaa

SEQ ID NO: 1565513 - RNA, 16 nt, Pseudomonas putida KT2440
gcgacgauaccggcgc

SEQ ID NO: 1565514 - RNA, 14 nt, Pseudomonas putida KT2440
gcgacgcagcagcg

SEQ ID NO: 1565515 - RNA, 17 nt, Pseudomonas putida KT2440
gcgacgcagcagcgcga

SEQ ID NO: 1565516 - RNA, 23 nt, Pseudomonas putida KT2440
gcgacgcgcuaccugugggagcg

SEQ ID NO: 1565517 - RNA, 12 nt, Pseudomonas putida KT2440
gcgacgcggcau

SEQ ID NO: 1565518 - RNA, 16 nt, Pseudomonas putida KT2440
gcgacgcugcccagca

SEQ ID NO: 1565519 - RNA, 16 nt, Pseudomonas putida KT2440
gcgaacacagcggccu

SEQ ID NO: 1565520 - RNA, 21 nt, Pseudomonas putida KT2440
gcgaacaccggcagagccggu

SEQ ID NO: 1565521 - RNA, 16 nt, Pseudomonas putida KT2440
gcgaacagcacugcca

SEQ ID NO: 1565522 - RNA, 18 nt, Pseudomonas putida KT2440
gcgaacagcacugccagc

SEQ ID NO: 1565523 - RNA, 13 nt, Pseudomonas putida KT2440
gcgaacacugacu

SEQ ID NO: 1565524 - RNA, 18 nt, Pseudomonas putida KT2440
gcgaacacuuggcagccu

SEQ ID NO: 1565525 - RNA, 17 nt, Pseudomonas putida KT2440
gcgaaagggccggcccu

SEQ ID NO: 1565526 - RNA, 19 nt, Pseudomonas putida KT2440
gcgaaagggccgggccugc

SEQ ID NO: 1565527 - RNA, 17 nt, Pseudomonas putida KT2440
gcgaaacaccagcaaca

SEQ ID NO: 1565528 - RNA, 22 nt, Pseudomonas putida KT2440
gcgaaacaaucggugccggcga

SEQ ID NO: 1565529 - RNA, 18 nt, Pseudomonas putida KT2440
gcgaaacacagcaggcca

SEQ ID NO: 1565530 - RNA, 16 nt, Pseudomonas putida KT2440
gccuuuuuuugccgca

SEQ ID NO: 1565531 - RNA, 14 nt, Pseudomonas putida KT2440
gccuuuucgaacaa

SEQ ID NO: 1565532 - RNA, 18 nt, Pseudomonas putida KT2440
gccuuuucgcggguaaac

SEQ ID NO: 1565533 - RNA, 14 nt, Pseudomonas putida KT2440
gccuuuuucguugg

SEQ ID NO: 1565534 - RNA, 15 nt, Pseudomonas putida KT2440
gccuugccaacggca

SEQ ID NO: 1565535 - RNA, 20 nt, Pseudomonas putida KT2440
gccuugccaacggcacucga

SEQ ID NO: 1565536 - RNA, 17 nt, Pseudomonas putida KT2440
gccuugcgauaccccgc

SEQ ID NO: 1565537 - RNA, 16 nt, Pseudomonas putida KT2440
gccuugcccagcucca

SEQ ID NO: 1565538 - RNA, 18 nt, Pseudomonas putida KT2440
gccuugcccagcuccagc

SEQ ID NO: 1565539 - RNA, 18 nt, Pseudomonas putida KT2440
gccuugcccgaagccacg

SEQ ID NO: 1565540 - RNA, 17 nt, Pseudomonas putida KT2440
gccuuucugcuucgcug

SEQ ID NO: 1565541 - RNA, 20 nt, Pseudomonas putida KT2440
gccuuucugcuucgcugcca

SEQ ID NO: 1565542 - RNA, 16 nt, Pseudomonas putida KT2440
gcgaacaucugcucgg

SEQ ID NO: 1565543 - RNA, 14 nt, Pseudomonas putida KT2440
gcgaaccccaguug

SEQ ID NO: 1565544 - RNA, 20 nt, Pseudomonas putida KT2440
gcgaagaugcguucggcauc

SEQ ID NO: 1565545 - RNA, 19 nt, Pseudomonas putida KT2440
gcgaagcccaguucgcggg

SEQ ID NO: 1565546 - RNA, 17 nt, Pseudomonas putida KT2440
gcgaagcaggcgacgca

SEQ ID NO: 1565547 - RNA, 16 nt, Pseudomonas putida KT2440
gcgaacugcagagccu

SEQ ID NO: 1565548 - RNA, 14 nt, Pseudomonas putida KT2440
gcgaagaggccagc

SEQ ID NO: 1565549 - RNA, 18 nt, Pseudomonas putida KT2440
gcgaagaggccccgacag

SEQ ID NO: 1565550 - RNA, 19 nt, Pseudomonas putida KT2440
gcgaagaggcccgaacaga

SEQ ID NO: 1565551 - RNA, 17 nt, Pseudomonas putida KT2440
gcgaagaggccggcaca

SEQ ID NO: 1565552 - RNA, 17 nt, Pseudomonas putida KT2440
gcgaagaggccggcacu

SEQ ID NO: 1565553 - RNA, 17 nt, Pseudomonas putida KT2440
gcgaacggacaacaccg

SEQ ID NO: 1565554 - RNA, 20 nt, Pseudomonas putida KT2440
gcgaacggacaacaccguug

SEQ ID NO: 1565555 - RNA, 21 nt, Pseudomonas putida KT2440
gccuggcgcgaaaagcugucg

SEQ ID NO: 1565556 - RNA, 18 nt, Pseudomonas putida KT2440
gccuggcgcuugaucagc

SEQ ID NO: 1565557 - RNA, 19 nt, Pseudomonas putida KT2440
gccuggcgcuugaucagcc

SEQ ID NO: 1565558 - RNA, 17 nt, Pseudomonas putida KT2440
gccugucgcgacgggcu

SEQ ID NO: 1565559 - RNA, 13 nt, Pseudomonas putida KT2440
gccuguaggcgcg

SEQ ID NO: 1565560 - RNA, 21 nt, Pseudomonas putida KT2440
gccuguaucggccucuucgcg

SEQ ID NO: 1565561 - RNA, 16 nt, Pseudomonas putida KT2440
gccugucacgccuuca

SEQ ID NO: 1565562 - RNA, 13 nt, Pseudomonas putida KT2440
gccuguccaggca

SEQ ID NO: 1565563 - RNA, 14 nt, Pseudomonas putida KT2440
gccuguccaggcaa

SEQ ID NO: 1565564 - RNA, 21 nt, Pseudomonas putida KT2440
gccuguaccgaccucuucgcg

SEQ ID NO: 1565565 - RNA, 21 nt, Pseudomonas putida KT2440
gccuguaccgcccucuucgcg

SEQ ID NO: 1565566 - RNA, 16 nt, Pseudomonas putida KT2440
gccugguuuucgcucg

SEQ ID NO: 1565567 - RNA, 20 nt, Pseudomonas putida KT2440
gccugguuuucgcucgccgg

SEQ ID NO: 1565568 - RNA, 17 nt, Pseudomonas putida KT2440
gccuugaucaggcccug

SEQ ID NO: 1565569 - RNA, 19 nt, Pseudomonas putida KT2440
gccuugaucaggcccugcu

SEQ ID NO: 1565570 - RNA, 22 nt, Pseudomonas putida KT2440
gccuugaucaggggccgcgcag

SEQ ID NO: 1565571 - RNA, 19 nt, Pseudomonas putida KT2440
gccuugaccagcuugugca

SEQ ID NO: 1565572 - RNA, 17 nt, Pseudomonas putida KT2440
gccuugaagcuggccgu

SEQ ID NO: 1565573 - RNA, 14 nt, Pseudomonas putida KT2440
gccuucuucgaugu

SEQ ID NO: 1565574 - RNA, 20 nt, Pseudomonas putida KT2440
gccuguggggcaacugcgcg

SEQ ID NO: 1565575 - RNA, 13 nt, Pseudomonas putida KT2440
gccugugucgaac

SEQ ID NO: 1565576 - RNA, 21 nt, Pseudomonas putida KT2440
gccugugcuggccucuucgcg

SEQ ID NO: 1565577 - RNA, 20 nt, Pseudomonas putida KT2440
gccugucuggccucuucgcg

SEQ ID NO: 1565578 - RNA, 16 nt, Pseudomonas putida KT2440
gccugugcauguccag

SEQ ID NO: 1565579 - RNA, 23 nt, Pseudomonas putida KT2440
gccuguguuuucccaauccucag

SEQ ID NO: 1565580 - RNA, 21 nt, Pseudomonas putida KT2440
gccuguuccggcccuuucgcg

SEQ ID NO: 1565581 - RNA, 22 nt, Pseudomonas putida KT2440
gccuguuccggcccuuucgcgg

SEQ ID NO: 1565582 - RNA, 16 nt, Pseudomonas putida KT2440
gccuucagcagccggu

SEQ ID NO: 1565583 - RNA, 18 nt, Pseudomonas putida KT2440
gccuucagugcuucacag

SEQ ID NO: 1565584 - RNA, 21 nt, Pseudomonas putida KT2440
gccuucaaacacuucaucucg

SEQ ID NO: 1565585 - RNA, 13 nt, Pseudomonas putida KT2440
gccugcucgcugg

SEQ ID NO: 1565586 - RNA, 15 nt, Pseudomonas putida KT2440
gccugcucgcuggcu

SEQ ID NO: 1565587 - RNA, 17 nt, Pseudomonas putida KT2440
gccugcucgcuggcuug

SEQ ID NO: 1565588 - RNA, 13 nt, Pseudomonas putida KT2440
gccugcugccagg

SEQ ID NO: 1565589 - RNA, 16 nt, Pseudomonas putida KT2440
gccugcugcaacagcu

SEQ ID NO: 1565590 - RNA, 23 nt, Pseudomonas putida KT2440
gccugcugcaacagcucauccag

SEQ ID NO: 1565591 - RNA, 20 nt, Pseudomonas putida KT2440
gccuggccauaguugaccag

SEQ ID NO: 1565592 - RNA, 23 nt, Pseudomonas putida KT2440
gccuggccacuguugcagcgcca

SEQ ID NO: 1565593 - RNA, 15 nt, Pseudomonas putida KT2440
gccugcuggcggcug

SEQ ID NO: 1565594 - RNA, 14 nt, Pseudomonas putida KT2440
gccugcuggccgcg

SEQ ID NO: 1565595 - RNA, 16 nt, Pseudomonas putida KT2440
gccuggccugcaugcu

SEQ ID NO: 1565596 - RNA, 18 nt, Pseudomonas putida KT2440
gccuggccugcaugcuca

SEQ ID NO: 1565597 - RNA, 23 nt, Pseudomonas putida KT2440
gccuggccgguguggccaaggcg

SEQ ID NO: 1565598 - RNA, 16 nt, Pseudomonas putida KT2440
gccugcgccagugccu

SEQ ID NO: 1565599 - RNA, 16 nt, Pseudomonas putida KT2440
gccugcgcccaaucac

SEQ ID NO: 1565600 - RNA, 16 nt, Pseudomonas putida KT2440
gccugcccgguacgca

SEQ ID NO: 1565601 - RNA, 15 nt, Pseudomonas putida KT2440
gccucgcugaccagu

SEQ ID NO: 1565602 - RNA, 17 nt, Pseudomonas putida KT2440
gccugccgggccagggu

SEQ ID NO: 1565603 - RNA, 17 nt, Pseudomonas putida KT2440
gccugccgggucaaggc

SEQ ID NO: 1565604 - RNA, 19 nt, Pseudomonas putida KT2440
gccugccgggucaaggcca

SEQ ID NO: 1565605 - RNA, 15 nt, Pseudomonas putida KT2440
gccugcgaaaggcgc

SEQ ID NO: 1565606 - RNA, 14 nt, Pseudomonas putida KT2440
gccugccuggcccu

SEQ ID NO: 1565607 - RNA, 16 nt, Pseudomonas putida KT2440
gccugcgaauggccgc

SEQ ID NO: 1565608 - RNA, 14 nt, Pseudomonas putida KT2440
gccugcgcaggcgc

SEQ ID NO: 1565609 - RNA, 19 nt, Pseudomonas putida KT2440
gccucaccgacccacaggc

SEQ ID NO: 1565610 - RNA, 18 nt, Pseudomonas putida KT2440
gccucacauucaccgcca

SEQ ID NO: 1565611 - RNA, 16 nt, Pseudomonas putida KT2440
gccucaccuccaccga

SEQ ID NO: 1565612 - RNA, 22 nt, Pseudomonas putida KT2440
gccucacgcaucugcgcuaccu

SEQ ID NO: 1565613 - RNA, 18 nt, Pseudomonas putida KT2440
gccucgaccacgaucuug

SEQ ID NO: 1565614 - RNA, 19 nt, Pseudomonas putida KT2440
gccuccucgcgggcaaacc

SEQ ID NO: 1565615 - RNA, 15 nt, Pseudomonas putida KT2440
gccuccugaagggcc

SEQ ID NO: 1565616 - RNA, 21 nt, Pseudomonas putida KT2440
gccucgagcgcuuucagccgu

SEQ ID NO: 1565617 - RNA, 17 nt, Pseudomonas putida KT2440
gccucgacccgcuggcg

SEQ ID NO: 1565618 - RNA, 14 nt, Pseudomonas putida KT2440
gccucgcagguaau

SEQ ID NO: 1565619 - RNA, 15 nt, Pseudomonas putida KT2440
gccucgcccagguca

SEQ ID NO: 1565620 - RNA, 19 nt, Pseudomonas putida KT2440
gccucgcccuugucagccg

SEQ ID NO: 1565621 - RNA, 21 nt, Pseudomonas putida KT2440
gccucgcccuugucagccgcc

SEQ ID NO: 1565622 - RNA, 22 nt, Pseudomonas putida KT2440
gccucgccauaagcugucagca

SEQ ID NO: 1565623 - RNA, 15 nt, Pseudomonas putida KT2440
gccucgauagcagcg

SEQ ID NO: 1565624 - RNA, 19 nt, Pseudomonas putida KT2440
gccucgaugugcgugaaca

SEQ ID NO: 1565625 - RNA, 14 nt, Pseudomonas putida KT2440
gccucgccguacuc

SEQ ID NO: 1565626 - RNA, 12 nt, Pseudomonas putida KT2440
gccucgcgcaac

SEQ ID NO: 1565627 - RNA, 15 nt, Pseudomonas putida KT2440
gccucgcgcaacacc

SEQ ID NO: 1565628 - RNA, 18 nt, Pseudomonas putida KT2440
gccucgcgcaacaccgcc

SEQ ID NO: 1565629 - RNA, 19 nt, Pseudomonas putida KT2440
gccucgcgcaacaccgcca

SEQ ID NO: 1565630 - RNA, 18 nt, Pseudomonas putida KT2440
gccguuguacaagcuggc

SEQ ID NO: 1565631 - RNA, 19 nt, Pseudomonas putida KT2440
gccguuguacaagcuggca

SEQ ID NO: 1565632 - RNA, 16 nt, Pseudomonas putida KT2440
gccuaucaggccuucg

SEQ ID NO: 1565633 - RNA, 17 nt, Pseudomonas putida KT2440
gccuaucaggccuucgg

SEQ ID NO: 1565634 - RNA, 21 nt, Pseudomonas putida KT2440
gccuaugaaaccgagcgccgc

SEQ ID NO: 1565635 - RNA, 17 nt, Pseudomonas putida KT2440
gccuauguacucggcgc

SEQ ID NO: 1565636 - RNA, 22 nt, Pseudomonas putida KT2440
gccguuuauugguuugacgcug

SEQ ID NO: 1565637 - RNA, 15 nt, Pseudomonas putida KT2440
gccguugaggccgaa

SEQ ID NO: 1565638 - RNA, 17 nt, Pseudomonas putida KT2440
gccguugaggccgaaca

SEQ ID NO: 1565639 - RNA, 21 nt, Pseudomonas putida KT2440
gccguugccgcccggggcgug

SEQ ID NO: 1565640 - RNA, 12 nt, Pseudomonas putida KT2440
gccgugcggcca

SEQ ID NO: 1565641 - RNA, 15 nt, Pseudomonas putida KT2440
gccgugcggccaaag

SEQ ID NO: 1565642 - RNA, 16 nt, Pseudomonas putida KT2440
gccgugcucuucgugg

SEQ ID NO: 1565643 - RNA, 13 nt, Pseudomonas putida KT2440
gccgugccugggu

SEQ ID NO: 1565644 - RNA, 22 nt, Pseudomonas putida KT2440
gccgucgauuacccagcgcgaa

SEQ ID NO: 1565645 - RNA, 19 nt, Pseudomonas putida KT2440
gccgugaguggccucgaac

SEQ ID NO: 1565646 - RNA, 15 nt, Pseudomonas putida KT2440
gccgugcaacgccgg

SEQ ID NO: 1565647 - RNA, 14 nt, Pseudomonas putida KT2440
gccgugaucgccgg

SEQ ID NO: 1565648 - RNA, 20 nt, Pseudomonas putida KT2440
gccgugaugguaucugccag

SEQ ID NO: 1565649 - RNA, 21 nt, Pseudomonas putida KT2440
gccgucuuuuccgugcaaccg

SEQ ID NO: 1565650 - RNA, 23 nt, Pseudomonas putida KT2440
gccgucuuuuccgugcaaccgcu

SEQ ID NO: 1565651 - RNA, 20 nt, Pseudomonas putida KT2440
gccgucucgucacuggcugc

SEQ ID NO: 1565652 - RNA, 20 nt, Pseudomonas putida KT2440
gccguccagcugagcgccau

SEQ ID NO: 1565653 - RNA, 20 nt, Pseudomonas putida KT2440
gccgguguucgcgggcaugc

SEQ ID NO: 1565654 - RNA, 17 nt, Pseudomonas putida KT2440
gccgguguggccaaggc

SEQ ID NO: 1565655 - RNA, 22 nt, Pseudomonas putida KT2440
gccgguguggccaaggcggcga

SEQ ID NO: 1565656 - RNA, 20 nt, Pseudomonas putida KT2440
gccgguguucuucaggcaaa

SEQ ID NO: 1565657 - RNA, 16 nt, Pseudomonas putida KT2440
gccguccaauagccau

SEQ ID NO: 1565658 - RNA, 19 nt, Pseudomonas putida KT2440
gccguccaauagccauucc

SEQ ID NO: 1565659 - RNA, 18 nt, Pseudomonas putida KT2440
gccgucaccgcugccgau

SEQ ID NO: 1565660 - RNA, 20 nt, Pseudomonas putida KT2440
gccggucuugucugacagca

SEQ ID NO: 1565661 - RNA, 21 nt, Pseudomonas putida KT2440
gccggucuugucugacagcag

SEQ ID NO: 1565662 - RNA, 14 nt, Pseudomonas putida KT2440
gccggugccaucca

SEQ ID NO: 1565663 - RNA, 13 nt, Pseudomonas putida KT2440
gccggugccgaag

SEQ ID NO: 1565664 - RNA, 15 nt, Pseudomonas putida KT2440
gccgguggugaccuc

SEQ ID NO: 1565665 - RNA, 20 nt, Pseudomonas putida KT2440
gccgguggggugucuggugu

SEQ ID NO: 1565666 - RNA, 14 nt, Pseudomonas putida KT2440
gccggugggcaaca

SEQ ID NO: 1565667 - RNA, 22 nt, Pseudomonas putida KT2440
gccggugggcaacagcugcgcg

SEQ ID NO: 1565668 - RNA, 23 nt, Pseudomonas putida KT2440
gccggugggcaacagcugcgcga

SEQ ID NO: 1565669 - RNA, 20 nt, Pseudomonas putida KT2440
gccggucaccgaccaucggc

SEQ ID NO: 1565670 - RNA, 21 nt, Pseudomonas putida KT2440
gccggucaccgaccaucggca

SEQ ID NO: 1565671 - RNA, 16 nt, Pseudomonas putida KT2440
gccgguagcugcgcag

SEQ ID NO: 1565672 - RNA, 17 nt, Pseudomonas putida KT2440
gccgguaggugcucaag

SEQ ID NO: 1565673 - RNA, 22 nt, Pseudomonas putida KT2440
gccgguacagccuaccaacgca

SEQ ID NO: 1565674 - RNA, 11 nt, Pseudomonas putida KT2440
gccgguaccgc

SEQ ID NO: 1565675 - RNA, 22 nt, Pseudomonas putida KT2440
gccggguuuuuugugccugugu

SEQ ID NO: 1565676 - RNA, 19 nt, Pseudomonas putida KT2440
gccggucuguucggcaagg

SEQ ID NO: 1565677 - RNA, 20 nt, Pseudomonas putida KT2440
gccggucuguucggcaaggu

SEQ ID NO: 1565678 - RNA, 16 nt, Pseudomonas putida KT2440
gccggucauccagcag

SEQ ID NO: 1565679 - RNA, 15 nt, Pseudomonas putida KT2440
gccggucagcagcau

SEQ ID NO: 1565680 - RNA, 15 nt, Pseudomonas putida KT2440
gccggggccaggcgc

SEQ ID NO: 1565681 - RNA, 13 nt, Pseudomonas putida KT2440
gccggggcaugcg

SEQ ID NO: 1565682 - RNA, 21 nt, Pseudomonas putida KT2440
gccgggcucggccggggcaac

SEQ ID NO: 1565683 - RNA, 21 nt, Pseudomonas putida KT2440
gccgggcugcaaagcgggcaa

SEQ ID NO: 1565684 - RNA, 18 nt, Pseudomonas putida KT2440
gccgggguaauggcgcug

SEQ ID NO: 1565685 - RNA, 21 nt, Pseudomonas putida KT2440
gccgggguaauggcgcuggau

SEQ ID NO: 1565686 - RNA, 17 nt, Pseudomonas putida KT2440
gccgggcacaucaccag

SEQ ID NO: 1565687 - RNA, 21 nt, Pseudomonas putida KT2440
gccgggcacaucaccagcagc

SEQ ID NO: 1565688 - RNA, 22 nt, Pseudomonas putida KT2440
gccgggcacaucaccagcagcu

SEQ ID NO: 1565689 - RNA, 20 nt, Pseudomonas putida KT2440
gccgggccaacuugcgcagu

SEQ ID NO: 1565690 - RNA, 12 nt, Pseudomonas putida KT2440
gccgggcaugca

SEQ ID NO: 1565691 - RNA, 16 nt, Pseudomonas putida KT2440
gccggccagcggcaug

SEQ ID NO: 1565692 - RNA, 16 nt, Pseudomonas putida KT2440
gccggcccauucgcgg

SEQ ID NO: 1565693 - RNA, 17 nt, Pseudomonas putida KT2440
gccggcccauucgcggg

SEQ ID NO: 1565694 - RNA, 20 nt, Pseudomonas putida KT2440
gccgggccuugaccagcaac

SEQ ID NO: 1565695 - RNA, 21 nt, Pseudomonas putida KT2440
gccgggccugacgugcgcggg

SEQ ID NO: 1565696 - RNA, 18 nt, Pseudomonas putida KT2440
gccgggcguaggcgcauc

SEQ ID NO: 1565697 - RNA, 18 nt, Pseudomonas putida KT2440
gcgccuggguggcgcggu

SEQ ID NO: 1565698 - RNA, 18 nt, Pseudomonas putida KT2440
gcgccuucauaggcggcc

SEQ ID NO: 1565699 - RNA, 23 nt, Pseudomonas putida KT2440
gcgccuucauaggcggccacggc

SEQ ID NO: 1565700 - RNA, 17 nt, Pseudomonas putida KT2440
gcgccucccccagcgcg

SEQ ID NO: 1565701 - RNA, 14 nt, Pseudomonas putida KT2440
gcgccuccagcagc

SEQ ID NO: 1565702 - RNA, 14 nt, Pseudomonas putida KT2440
gcgccuccagcagg

SEQ ID NO: 1565703 - RNA, 23 nt, Pseudomonas putida KT2440
gcgccuccagcaggggcagaugc

SEQ ID NO: 1565704 - RNA, 22 nt, Pseudomonas putida KT2440
gcgccucgaucccgccgccaga

SEQ ID NO: 1565705 - RNA, 15 nt, Pseudomonas putida KT2440
gcgccucgcagguaa

SEQ ID NO: 1565706 - RNA, 22 nt, Pseudomonas putida KT2440
gcgccggacuucuucaacgcgg

SEQ ID NO: 1565707 - RNA, 24 nt, Pseudomonas putida KT2440
gcgccuacaacauaccgcugggca

SEQ ID NO: 1565708 - RNA, 18 nt, Pseudomonas putida KT2440
gcgccuaucaggccuucg

SEQ ID NO: 1565709 - RNA, 17 nt, Pseudomonas putida KT2440
gcgccuacaggcaaccg

SEQ ID NO: 1565710 - RNA, 15 nt, Pseudomonas putida KT2440
gcgccuacaggcccc

SEQ ID NO: 1565711 - RNA, 16 nt, Pseudomonas putida KT2440
gcgccuacaggcccca

SEQ ID NO: 1565712 - RNA, 18 nt, Pseudomonas putida KT2440
gcgccuacgacgauugcg

SEQ ID NO: 1565713 - RNA, 19 nt, Pseudomonas putida KT2440
gcgccuaucagaucgagcg

SEQ ID NO: 1565714 - RNA, 13 nt, Pseudomonas putida KT2440
gcgccuaucaggc

SEQ ID NO: 1565715 - RNA, 20 nt, Pseudomonas putida KT2440
gcgcgacuccugugggagcg

SEQ ID NO: 1565716 - RNA, 18 nt, Pseudomonas putida KT2440
gcgcgagagcgacgcgcu

SEQ ID NO: 1565717 - RNA, 15 nt, Pseudomonas putida KT2440
gcgcgaccaucaccg

SEQ ID NO: 1565718 - RNA, 23 nt, Pseudomonas putida KT2440
gcgcgaccaucaccgccagcaug

SEQ ID NO: 1565719 - RNA, 19 nt, Pseudomonas putida KT2440
gcgccuugcgcacgccggu

SEQ ID NO: 1565720 - RNA, 19 nt, Pseudomonas putida KT2440
gcgccuugauuaccagcgc

SEQ ID NO: 1565721 - RNA, 22 nt, Pseudomonas putida KT2440
gcgccuugauuaccagcgcccc

SEQ ID NO: 1565722 - RNA, 18 nt, Pseudomonas putida KT2440
gcgccuucgcccgaccgc

SEQ ID NO: 1565723 - RNA, 13 nt, Pseudomonas putida KT2440
gcgccuucgcugg

SEQ ID NO: 1565724 - RNA, 14 nt, Pseudomonas putida KT2440
gcgccuucgcuggc

SEQ ID NO: 1565725 - RNA, 14 nt, Pseudomonas putida KT2440
gcgcgcaucagccg

SEQ ID NO: 1565726 - RNA, 13 nt, Pseudomonas putida KT2440
gcgcgcccgcgaa

SEQ ID NO: 1565727 - RNA, 20 nt, Pseudomonas putida KT2440
gcgcgcccgcggcccacagu

SEQ ID NO: 1565728 - RNA, 20 nt, Pseudomonas putida KT2440
gcgcgcccgcucccacaggu

SEQ ID NO: 1565729 - RNA, 17 nt, Pseudomonas putida KT2440
gcgcgccugcaccugac

SEQ ID NO: 1565730 - RNA, 16 nt, Pseudomonas putida KT2440
gcgcgccuccagcuga

SEQ ID NO: 1565731 - RNA, 16 nt, Pseudomonas putida KT2440
gcgcgcgguucaccag

SEQ ID NO: 1565732 - RNA, 16 nt, Pseudomonas putida KT2440
gcgcgcugagcagguu

SEQ ID NO: 1565733 - RNA, 17 nt, Pseudomonas putida KT2440
gcgcgcuucagggucgg

SEQ ID NO: 1565734 - RNA, 19 nt, Pseudomonas putida KT2440
gcgcggaacacacgcuccg

SEQ ID NO: 1565735 - RNA, 15 nt, Pseudomonas putida KT2440
gcgcucguaggcugc

SEQ ID NO: 1565736 - RNA, 23 nt, Pseudomonas putida KT2440
gcgcucguaggcuucacgcgcca

SEQ ID NO: 1565737 - RNA, 15 nt, Pseudomonas putida KT2440
gcgcucgguugaugc

SEQ ID NO: 1565738 - RNA, 20 nt, Pseudomonas putida KT2440
gcgcucguugcgagcgaaca

SEQ ID NO: 1565739 - RNA, 21 nt, Pseudomonas putida KT2440
gcgcucguugcgagcgaacag

SEQ ID NO: 1565740 - RNA, 14 nt, Pseudomonas putida KT2440
gcgcugagcgacag

SEQ ID NO: 1565741 - RNA, 18 nt, Pseudomonas putida KT2440
gcgcugauaccgaacuug

SEQ ID NO: 1565742 - RNA, 15 nt, Pseudomonas putida KT2440
gcgcugaucaagccc

SEQ ID NO: 1565743 - RNA, 23 nt, Pseudomonas putida KT2440
gcgcucgggggugcacagcgucc

SEQ ID NO: 1565744 - RNA, 24 nt, Pseudomonas putida KT2440
gcgcucgggggugcacagcgucca

SEQ ID NO: 1565745 - RNA, 20 nt, Pseudomonas putida KT2440
gcgcucggucucacaggcgc

SEQ ID NO: 1565746 - RNA, 16 nt, Pseudomonas putida KT2440
gcgcuccauccagucg

SEQ ID NO: 1565747 - RNA, 20 nt, Pseudomonas putida KT2440
gcgcuccauguaacgcucca

SEQ ID NO: 1565748 - RNA, 16 nt, Pseudomonas putida KT2440
gcgcucccaggccucg

SEQ ID NO: 1565749 - RNA, 16 nt, Pseudomonas putida KT2440
gcgcuggccaauggca

SEQ ID NO: 1565750 - RNA, 14 nt, Pseudomonas putida KT2440
gcgcuggaucuugc

SEQ ID NO: 1565751 - RNA, 21 nt, Pseudomonas putida KT2440
gcgcuggaucuugcugaacag

SEQ ID NO: 1565752 - RNA, 15 nt, Pseudomonas putida KT2440
gcgcugggcguccag

SEQ ID NO: 1565753 - RNA, 15 nt, Pseudomonas putida KT2440
gcgcugcaaucaccg

SEQ ID NO: 1565754 - RNA, 23 nt, Pseudomonas putida KT2440
gcgcugccugcuggcggcugagc

SEQ ID NO: 1565755 - RNA, 23 nt, Pseudomonas putida KT2440
gcgcuucagggucgggcacaggc

SEQ ID NO: 1565756 - RNA, 19 nt, Pseudomonas putida KT2440
gcgcuucaccuucguuugc

SEQ ID NO: 1565757 - RNA, 20 nt, Pseudomonas putida KT2440
gcgcuguggcgcccggcgcu

SEQ ID NO: 1565758 - RNA, 16 nt, Pseudomonas putida KT2440
gcgcugucggucagca

SEQ ID NO: 1565759 - RNA, 17 nt, Pseudomonas putida KT2440
gcgcugucggcgcggau

SEQ ID NO: 1565760 - RNA, 14 nt, Pseudomonas putida KT2440
gcgcuguccagcgc

SEQ ID NO: 1565761 - RNA, 16 nt, Pseudomonas putida KT2440
gcgcuguccagcgcau

SEQ ID NO: 1565762 - RNA, 21 nt, Pseudomonas putida KT2440
gcgcuguccagcgcaucaacg

SEQ ID NO: 1565763 - RNA, 16 nt, Pseudomonas putida KT2440
gcgcuggugcaggcgu

SEQ ID NO: 1565764 - RNA, 21 nt, Pseudomonas putida KT2440
gcgcuuucucuuugaucagcg

SEQ ID NO: 1565765 - RNA, 21 nt, Pseudomonas putida KT2440
gcgcuuggaaauguucaacag

SEQ ID NO: 1565766 - RNA, 23 nt, Pseudomonas putida KT2440
gcgcuuggaaauguucaacagcc

SEQ ID NO: 1565767 - RNA, 14 nt, Pseudomonas putida KT2440
gcgcuuggccaggg

SEQ ID NO: 1565768 - RNA, 13 nt, Pseudomonas putida KT2440
gcgcuuggcaccg

SEQ ID NO: 1565769 - RNA, 22 nt, Pseudomonas putida KT2440
gcgcuuggcaccggcagcagca

SEQ ID NO: 1565770 - RNA, 22 nt, Pseudomonas putida KT2440
gcgcuugaucugccaggcacca

SEQ ID NO: 1565771 - RNA, 17 nt, Pseudomonas putida KT2440
gcgcuugcccgccgaau

SEQ ID NO: 1565772 - RNA, 16 nt, Pseudomonas putida KT2440
gcgcuugagcguggca

SEQ ID NO: 1565773 - RNA, 20 nt, Pseudomonas putida KT2440
gcgcuugaagggggcuacga

SEQ ID NO: 1565774 - RNA, 16 nt, Pseudomonas putida KT2440
gcgcuucgaucgccgg

SEQ ID NO: 1565775 - RNA, 18 nt, Pseudomonas putida KT2440
gcgcuucgaucgccggca

SEQ ID NO: 1565776 - RNA, 15 nt, Pseudomonas putida KT2440
gcgcgucugauagcc

SEQ ID NO: 1565777 - RNA, 16 nt, Pseudomonas putida KT2440
gcgcguuggcgaucga

SEQ ID NO: 1565778 - RNA, 15 nt, Pseudomonas putida KT2440
gcgcucaauggcacc

SEQ ID NO: 1565779 - RNA, 18 nt, Pseudomonas putida KT2440
gcgcucaaccagccgccu

SEQ ID NO: 1565780 - RNA, 20 nt, Pseudomonas putida KT2440
gcgcuaaaccugugggagcg

SEQ ID NO: 1565781 - RNA, 22 nt, Pseudomonas putida KT2440
gcgcggguaaauguucucgccg

SEQ ID NO: 1565782 - RNA, 15 nt, Pseudomonas putida KT2440
gcgcggugaccagcg

SEQ ID NO: 1565783 - RNA, 21 nt, Pseudomonas putida KT2440
gcgcggugaccagcggcagca

SEQ ID NO: 1565784 - RNA, 13 nt, Pseudomonas putida KT2440
gcgcguacagcga

SEQ ID NO: 1565785 - RNA, 15 nt, Pseudomonas putida KT2440
gcgcguacagcgaca

SEQ ID NO: 1565786 - RNA, 17 nt, Pseudomonas putida KT2440
gcgcggugccggcagcu

SEQ ID NO: 1565787 - RNA, 22 nt, Pseudomonas putida KT2440
gcgcggcaaccugcucgcucag

SEQ ID NO: 1565788 - RNA, 18 nt, Pseudomonas putida KT2440
gcgcggcacaacgcgcca

SEQ ID NO: 1565789 - RNA, 23 nt, Pseudomonas putida KT2440
gcgcggacccuugugugggccuu

SEQ ID NO: 1565790 - RNA, 13 nt, Pseudomonas putida KT2440
gcgcggcagcccu

SEQ ID NO: 1565791 - RNA, 23 nt, Pseudomonas putida KT2440
gcgcaucauccaccacccuggca

SEQ ID NO: 1565792 - RNA, 13 nt, Pseudomonas putida KT2440
gcgcaucaagcgg

SEQ ID NO: 1565793 - RNA, 12 nt, Pseudomonas putida KT2440
gcgcauccagca

SEQ ID NO: 1565794 - RNA, 20 nt, Pseudomonas putida KT2440
gcgcaucccuuguaggagcu

SEQ ID NO: 1565795 - RNA, 13 nt, Pseudomonas putida KT2440
gcgcaucgaccgg

SEQ ID NO: 1565796 - RNA, 15 nt, Pseudomonas putida KT2440
gcgcaucgaccggca

SEQ ID NO: 1565797 - RNA, 17 nt, Pseudomonas putida KT2440
gcgcauccucggugcgc

SEQ ID NO: 1565798 - RNA, 20 nt, Pseudomonas putida KT2440
gcgcaguaccuguggcagcg

SEQ ID NO: 1565799 - RNA, 23 nt, Pseudomonas putida KT2440
gcgcaguacaggcugccgccgaa

SEQ ID NO: 1565800 - RNA, 19 nt, Pseudomonas putida KT2440
gcgcagguuguucggcagg

SEQ ID NO: 1565801 - RNA, 15 nt, Pseudomonas putida KT2440
gcgcagguccaggcg

SEQ ID NO: 1565802 - RNA, 13 nt, Pseudomonas putida KT2440
gcgcaggucgugc

SEQ ID NO: 1565803 - RNA, 17 nt, Pseudomonas putida KT2440
gcgcaggucgacaugca

SEQ ID NO: 1565804 - RNA, 20 nt, Pseudomonas putida KT2440
gcgcagggugccggccagcg

SEQ ID NO: 1565805 - RNA, 17 nt, Pseudomonas putida KT2440
gcgcaggguggcgcuga

SEQ ID NO: 1565806 - RNA, 19 nt, Pseudomonas putida KT2440
gcgcagggugugcugcugc

SEQ ID NO: 1565807 - RNA, 16 nt, Pseudomonas putida KT2440
gcgcaggguguucagg

SEQ ID NO: 1565808 - RNA, 20 nt, Pseudomonas putida KT2440
gcgcagcggccccuuucacg

SEQ ID NO: 1565809 - RNA, 14 nt, Pseudomonas putida KT2440
gcgcaggcgcugca

SEQ ID NO: 1565810 - RNA, 18 nt, Pseudomonas putida KT2440
gcgcaggcagcgauggcc

SEQ ID NO: 1565811 - RNA, 12 nt, Pseudomonas putida KT2440
gcgcaggcagcu

SEQ ID NO: 1565812 - RNA, 13 nt, Pseudomonas putida KT2440
gcgcaggcagcuc

SEQ ID NO: 1565813 - RNA, 24 nt, Pseudomonas putida KT2440
gcgcaggccgacaacagcaugcuc

SEQ ID NO: 1565814 - RNA, 12 nt, Pseudomonas putida KT2440
gcgcaggccgcu

SEQ ID NO: 1565815 - RNA, 16 nt, Pseudomonas putida KT2440
gcgcaggccgcuggcc

SEQ ID NO: 1565816 - RNA, 19 nt, Pseudomonas putida KT2440
gcgcaggaacaggcugaug

SEQ ID NO: 1565817 - RNA, 13 nt, Pseudomonas putida KT2440
gcgcagccuggcc

SEQ ID NO: 1565818 - RNA, 15 nt, Pseudomonas putida KT2440
gcgcagccuggcccu

SEQ ID NO: 1565819 - RNA, 13 nt, Pseudomonas putida KT2440
gcgcagccguucu

SEQ ID NO: 1565820 - RNA, 18 nt, Pseudomonas putida KT2440
gcgcagcccauucgcggg

SEQ ID NO: 1565821 - RNA, 23 nt, Pseudomonas putida KT2440
gcgcagcccccaccgggcuggca

SEQ ID NO: 1565822 - RNA, 11 nt, Pseudomonas putida KT2440
gcgcagcgcag

SEQ ID NO: 1565823 - RNA, 16 nt, Pseudomonas putida KT2440
gcgcagcgcacggcug

SEQ ID NO: 1565824 - RNA, 16 nt, Pseudomonas putida KT2440
gcgcagcagcaggccc

SEQ ID NO: 1565825 - RNA, 14 nt, Pseudomonas putida KT2440
gcgcagcaggucca

SEQ ID NO: 1565826 - RNA, 13 nt, Pseudomonas putida KT2440
gcgcagcaucugc

SEQ ID NO: 1565827 - RNA, 18 nt, Pseudomonas putida KT2440
gcgcagccaaucggcgcc

SEQ ID NO: 1565828 - RNA, 16 nt, Pseudomonas putida KT2440
gcgcagcaaggucgcc

SEQ ID NO: 1565829 - RNA, 22 nt, Pseudomonas putida KT2440
gcgcagcaauacgcacaggcgc

SEQ ID NO: 1565830 - RNA, 24 nt, Pseudomonas putida KT2440
gcgcagcaauacgcacaggcgcag

SEQ ID NO: 1565831 - RNA, 18 nt, Pseudomonas putida KT2440
gcgcagcaccgugggcgc

SEQ ID NO: 1565832 - RNA, 19 nt, Pseudomonas putida KT2440
gcgcagcaccgugggcgcu

SEQ ID NO: 1565833 - RNA, 13 nt, Pseudomonas putida KT2440
gcgcacguagcgc

SEQ ID NO: 1565834 - RNA, 16 nt, Pseudomonas putida KT2440
gcgcacgguaggugau

SEQ ID NO: 1565835 - RNA, 17 nt, Pseudomonas putida KT2440
gcgcacugaacagcgcc

SEQ ID NO: 1565836 - RNA, 19 nt, Pseudomonas putida KT2440
gcgcacugaacagcgccuu

SEQ ID NO: 1565837 - RNA, 18 nt, Pseudomonas putida KT2440
gcgcacugaauacaccag

SEQ ID NO: 1565838 - RNA, 22 nt, Pseudomonas putida KT2440
gcgcacugaauacaccagcuug

SEQ ID NO: 1565839 - RNA, 17 nt, Pseudomonas putida KT2440
gcgcagacgggcgacgg

SEQ ID NO: 1565840 - RNA, 16 nt, Pseudomonas putida KT2440
gcgcacuucguagcgc

SEQ ID NO: 1565841 - RNA, 13 nt, Pseudomonas putida KT2440
gcgcacuugccag

SEQ ID NO: 1565842 - RNA, 16 nt, Pseudomonas putida KT2440
gcgcacuuggccugcu

SEQ ID NO: 1565843 - RNA, 20 nt, Pseudomonas putida KT2440
gcgcacuuguuccagccgcg

SEQ ID NO: 1565844 - RNA, 19 nt, Pseudomonas putida KT2440
gcgcagagcgccccggcaa

SEQ ID NO: 1565845 - RNA, 21 nt, Pseudomonas putida KT2440
gcgcaccaucggcuccagcgc

SEQ ID NO: 1565846 - RNA, 22 nt, Pseudomonas putida KT2440
gcgaucacauaaggcagcagcu

SEQ ID NO: 1565847 - RNA, 16 nt, Pseudomonas putida KT2440
gcgcacgcgcucugca

SEQ ID NO: 1565848 - RNA, 18 nt, Pseudomonas putida KT2440
gcgcacggaaggcaucga

SEQ ID NO: 1565849 - RNA, 17 nt, Pseudomonas putida KT2440
gcgcacgcugcccaggu

SEQ ID NO: 1565850 - RNA, 18 nt, Pseudomonas putida KT2440
gcgcacgaauacgcucga

SEQ ID NO: 1565851 - RNA, 14 nt, Pseudomonas putida KT2440
gcgcacgcaucugc

SEQ ID NO: 1565852 - RNA, 17 nt, Pseudomonas putida KT2440
gcgcacgcaucugcacc

SEQ ID NO: 1565853 - RNA, 22 nt, Pseudomonas putida KT2440
gcgcacgcaucugcaccggcag

SEQ ID NO: 1565854 - RNA, 16 nt, Pseudomonas putida KT2440
gcgcaccuugugcacg

SEQ ID NO: 1565855 - RNA, 17 nt, Pseudomonas putida KT2440
gcgcaccuuggcgucca

SEQ ID NO: 1565856 - RNA, 20 nt, Pseudomonas putida KT2440
gcgcaccuuguauucgagcu

SEQ ID NO: 1565857 - RNA, 21 nt, Pseudomonas putida KT2440
gcgcaccuggauguugugcga

SEQ ID NO: 1565858 - RNA, 15 nt, Pseudomonas putida KT2440
gcgcaccucgaccgc

SEQ ID NO: 1565859 - RNA, 14 nt, Pseudomonas putida KT2440
gcgcaccgcugacc

SEQ ID NO: 1565860 - RNA, 17 nt, Pseudomonas putida KT2440
gcgccagaaucccuucg

SEQ ID NO: 1565861 - RNA, 15 nt, Pseudomonas putida KT2440
gcgccagcaagcgca

SEQ ID NO: 1565862 - RNA, 21 nt, Pseudomonas putida KT2440
gcgcaucgggccgauggcgca

SEQ ID NO: 1565863 - RNA, 15 nt, Pseudomonas putida KT2440
gcgccagccgcgggu

SEQ ID NO: 1565864 - RNA, 19 nt, Pseudomonas putida KT2440
gcgccaggaguucugcaca

SEQ ID NO: 1565865 - RNA, 18 nt, Pseudomonas putida KT2440
gcgccaggcauugcucga

SEQ ID NO: 1565866 - RNA, 19 nt, Pseudomonas putida KT2440
gcgccaggcauugcucgau

SEQ ID NO: 1565867 - RNA, 22 nt, Pseudomonas putida KT2440
gcgccaguacgccagcagcgca

SEQ ID NO: 1565868 - RNA, 23 nt, Pseudomonas putida KT2440
gcgccaguacgccagcagcgcau

SEQ ID NO: 1565869 - RNA, 13 nt, Pseudomonas putida KT2440
gcgcccaggccca

SEQ ID NO: 1565870 - RNA, 17 nt, Pseudomonas putida KT2440
gcgccccacuuccagcg

SEQ ID NO: 1565871 - RNA, 20 nt, Pseudomonas putida KT2440
gcgccccacuuccagcgaca

SEQ ID NO: 1565872 - RNA, 15 nt, Pseudomonas putida KT2440
gcgccccagguugca

SEQ ID NO: 1565873 - RNA, 17 nt, Pseudomonas putida KT2440
gcgcccgaacaacaggu

SEQ ID NO: 1565874 - RNA, 22 nt, Pseudomonas putida KT2440
gcgccaguucgacgcugcuguc

SEQ ID NO: 1565875 - RNA, 16 nt, Pseudomonas putida KT2440
gcgcccaaucggguaa

SEQ ID NO: 1565876 - RNA, 19 nt, Pseudomonas putida KT2440
gcgcccaaucggguaaaac

SEQ ID NO: 1565877 - RNA, 14 nt, Pseudomonas putida KT2440
gcgcccaaugcagc

SEQ ID NO: 1565878 - RNA, 10 nt, Pseudomonas putida KT2440
gcgcccagau

SEQ ID NO: 1565879 - RNA, 18 nt, Pseudomonas putida KT2440
gcgcccagaucagcagca

SEQ ID NO: 1565880 - RNA, 19 nt, Pseudomonas putida KT2440
gcgcccacgcggguccagc

SEQ ID NO: 1565881 - RNA, 20 nt, Pseudomonas putida KT2440
gcgcccacgcggguccagcg

SEQ ID NO: 1565882 - RNA, 21 nt, Pseudomonas putida KT2440
gcgcccacgcggguccagcgc

SEQ ID NO: 1565883 - RNA, 21 nt, Pseudomonas putida KT2440
gcgcccaccgguuugaagcca

SEQ ID NO: 1565884 - RNA, 15 nt, Pseudomonas putida KT2440
gcgccgcgcccauga

SEQ ID NO: 1565885 - RNA, 21 nt, Pseudomonas putida KT2440
gcgccgccaacucgccauuca

SEQ ID NO: 1565886 - RNA, 22 nt, Pseudomonas putida KT2440
gcgccgccaaccccuccagcac

SEQ ID NO: 1565887 - RNA, 12 nt, Pseudomonas putida KT2440
gcgccgcggcca

SEQ ID NO: 1565888 - RNA, 12 nt, Pseudomonas putida KT2440
gcgccgcugcuc

SEQ ID NO: 1565889 - RNA, 17 nt, Pseudomonas putida KT2440
gcgccgcucgcccagca

SEQ ID NO: 1565890 - RNA, 18 nt, Pseudomonas putida KT2440
gcgccgauugcugccgac

SEQ ID NO: 1565891 - RNA, 20 nt, Pseudomonas putida KT2440
gcgccgauugcugccgaccu

SEQ ID NO: 1565892 - RNA, 17 nt, Pseudomonas putida KT2440
gcgccgcagguccaccu

SEQ ID NO: 1565893 - RNA, 19 nt, Pseudomonas putida KT2440
gcgccgaugaagcaggccg

SEQ ID NO: 1565894 - RNA, 22 nt, Pseudomonas putida KT2440
gcgccgaugaagcaggccgagu

SEQ ID NO: 1565895 - RNA, 20 nt, Pseudomonas putida KT2440
gcgccgagcgagugaccuug

SEQ ID NO: 1565896 - RNA, 22 nt, Pseudomonas putida KT2440
gcgccgagcgcggcgcccagca

SEQ ID NO: 1565897 - RNA, 20 nt, Pseudomonas putida KT2440
gcgccgacccugugggagcg

SEQ ID NO: 1565898 - RNA, 12 nt, Pseudomonas putida KT2440
gcgccgaccagu

SEQ ID NO: 1565899 - RNA, 13 nt, Pseudomonas putida KT2440
gcgccgaccagua

SEQ ID NO: 1565900 - RNA, 18 nt, Pseudomonas putida KT2440
gcgccgaacgaauagccg

SEQ ID NO: 1565901 - RNA, 17 nt, Pseudomonas putida KT2440
gcgcccgcaacagaucc

SEQ ID NO: 1565902 - RNA, 18 nt, Pseudomonas putida KT2440
gcgcccgcggcccacagu

SEQ ID NO: 1565903 - RNA, 16 nt, Pseudomonas putida KT2440
gucgaccgcuauggcg

SEQ ID NO: 1565904 - RNA, 11 nt, Pseudomonas putida KT2440
gucgaccagca

SEQ ID NO: 1565905 - RNA, 13 nt, Pseudomonas putida KT2440
gucgaccagcagc

SEQ ID NO: 1565906 - RNA, 20 nt, Pseudomonas putida KT2440
gucgacaaaguugccgauga

SEQ ID NO: 1565907 - RNA, 14 nt, Pseudomonas putida KT2440
gucgacucgaugcc

SEQ ID NO: 1565908 - RNA, 11 nt, Pseudomonas putida KT2440
gucgacgaaca

SEQ ID NO: 1565909 - RNA, 20 nt, Pseudomonas putida KT2440
gucgaucacaugcggcaccg

SEQ ID NO: 1565910 - RNA, 20 nt, Pseudomonas putida KT2440
gucgccaaauucgaccagca

SEQ ID NO: 1565911 - RNA, 20 nt, Pseudomonas putida KT2440
gucgccacaccacagcugca

SEQ ID NO: 1565912 - RNA, 15 nt, Pseudomonas putida KT2440
gucgccaaacaguug

SEQ ID NO: 1565913 - RNA, 16 nt, Pseudomonas putida KT2440
gucgaugucugccgcu

SEQ ID NO: 1565914 - RNA, 17 nt, Pseudomonas putida KT2440
gucgauguccaggccga

SEQ ID NO: 1565915 - RNA, 13 nt, Pseudomonas putida KT2440
gucgaugcugcug

SEQ ID NO: 1565916 - RNA, 17 nt, Pseudomonas putida KT2440
gucgaucauuuccgggu

SEQ ID NO: 1565917 - RNA, 13 nt, Pseudomonas putida KT2440
gucgauccaggug

SEQ ID NO: 1565918 - RNA, 14 nt, Pseudomonas putida KT2440
gucgaucagcgaca

SEQ ID NO: 1565919 - RNA, 15 nt, Pseudomonas putida KT2440
gucgaucacgggcaa

SEQ ID NO: 1565920 - RNA, 16 nt, Pseudomonas putida KT2440
gucgccaggaucaccu

SEQ ID NO: 1565921 - RNA, 20 nt, Pseudomonas putida KT2440
gucgccgaaccccaccagca

SEQ ID NO: 1565922 - RNA, 15 nt, Pseudomonas putida KT2440
gucgcgaugggcugc

SEQ ID NO: 1565923 - RNA, 22 nt, Pseudomonas putida KT2440
gucgcgacgauggacagcccaa

SEQ ID NO: 1565924 - RNA, 19 nt, Pseudomonas putida KT2440
gucgcgauaggggcccgca

SEQ ID NO: 1565925 - RNA, 14 nt, Pseudomonas putida KT2440
gucgcgaaagggcc

SEQ ID NO: 1565926 - RNA, 14 nt, Pseudomonas putida KT2440
gucgcgggccagcc

SEQ ID NO: 1565927 - RNA, 19 nt, Pseudomonas putida KT2440
gucgcucaacuccauggcc

SEQ ID NO: 1565928 - RNA, 23 nt, Pseudomonas putida KT2440
gucgcucaacuccauggccaggg

SEQ ID NO: 1565929 - RNA, 15 nt, Pseudomonas putida KT2440
gucgcuaucggcagg

SEQ ID NO: 1565930 - RNA, 21 nt, Pseudomonas putida KT2440
gucgcuaucggcaggcuggau

SEQ ID NO: 1565931 - RNA, 12 nt, Pseudomonas putida KT2440
gucgcuggagcg

SEQ ID NO: 1565932 - RNA, 18 nt, Pseudomonas putida KT2440
guccagcucuggucaccu

SEQ ID NO: 1565933 - RNA, 17 nt, Pseudomonas putida KT2440
guccagcugagcgccau

SEQ ID NO: 1565934 - RNA, 15 nt, Pseudomonas putida KT2440
guccagcucgucgag

SEQ ID NO: 1565935 - RNA, 17 nt, Pseudomonas putida KT2440
guccagcucgucgagca

SEQ ID NO: 1565936 - RNA, 22 nt, Pseudomonas putida KT2440
guccagcucgcgcagggcaucg

SEQ ID NO: 1565937 - RNA, 12 nt, Pseudomonas putida KT2440
guccagcucgcg

SEQ ID NO: 1565938 - RNA, 15 nt, Pseudomonas putida KT2440
gucagcaccuggcag

SEQ ID NO: 1565939 - RNA, 22 nt, Pseudomonas putida KT2440
gucacgcuccuucgccacgaac

SEQ ID NO: 1565940 - RNA, 17 nt, Pseudomonas putida KT2440
gucacggcugaagaagc

SEQ ID NO: 1565941 - RNA, 22 nt, Pseudomonas putida KT2440
guccagucaggccguagcgcug

SEQ ID NO: 1565942 - RNA, 15 nt, Pseudomonas putida KT2440
guccagugcggugga

SEQ ID NO: 1565943 - RNA, 18 nt, Pseudomonas putida KT2440
guccaguucaaugccagc

SEQ ID NO: 1565944 - RNA, 19 nt, Pseudomonas putida KT2440
guccaguucaaugccagca

SEQ ID NO: 1565945 - RNA, 15 nt, Pseudomonas putida KT2440
guccgccgcgcugac

SEQ ID NO: 1565946 - RNA, 17 nt, Pseudomonas putida KT2440
guccgcgaagcagacaa

SEQ ID NO: 1565947 - RNA, 17 nt, Pseudomonas putida KT2440
gucccugcccgaucgcc

SEQ ID NO: 1565948 - RNA, 17 nt, Pseudomonas putida KT2440
guccgcccuugccacca

SEQ ID NO: 1565949 - RNA, 14 nt, Pseudomonas putida KT2440
guccgacaaugcca

SEQ ID NO: 1565950 - RNA, 16 nt, Pseudomonas putida KT2440
guccgacaaugccagc

SEQ ID NO: 1565951 - RNA, 21 nt, Pseudomonas putida KT2440
guccgcucuucucgucguagc

SEQ ID NO: 1565952 - RNA, 20 nt, Pseudomonas putida KT2440
guccggacuuggaccccgaa

SEQ ID NO: 1565953 - RNA, 18 nt, Pseudomonas putida KT2440
guccugcaaaggcccuuu

SEQ ID NO: 1565954 - RNA, 15 nt, Pseudomonas putida KT2440
guccugcaacucggc

SEQ ID NO: 1565955 - RNA, 14 nt, Pseudomonas putida KT2440
guccugcagcggca

SEQ ID NO: 1565956 - RNA, 15 nt, Pseudomonas putida KT2440
guccugcagcggcaa

SEQ ID NO: 1565957 - RNA, 19 nt, Pseudomonas putida KT2440
guccugcagcggcaaggua

SEQ ID NO: 1565958 - RNA, 22 nt, Pseudomonas putida KT2440
guccucgacgggcaggcgguug

SEQ ID NO: 1565959 - RNA, 21 nt, Pseudomonas putida KT2440
guccugguccgaggucagcac

SEQ ID NO: 1565960 - RNA, 15 nt, Pseudomonas putida KT2440
guccuggucgcgggc

SEQ ID NO: 1565961 - RNA, 16 nt, Pseudomonas putida KT2440
guccuugcuggccacc

SEQ ID NO: 1565962 - RNA, 15 nt, Pseudomonas putida KT2440
guccuuucgcgacac

SEQ ID NO: 1565963 - RNA, 20 nt, Pseudomonas putida KT2440
guccugcgauagaucagcga

SEQ ID NO: 1565964 - RNA, 15 nt, Pseudomonas putida KT2440
guccugcgcgcuuga

SEQ ID NO: 1565965 - RNA, 23 nt, Pseudomonas putida KT2440
guccugcccccaaugggcaccgg

SEQ ID NO: 1565966 - RNA, 22 nt, Pseudomonas putida KT2440
guccuggaaaagcaaggcucag

SEQ ID NO: 1565967 - RNA, 14 nt, Pseudomonas putida KT2440
guccugcugcaggc

SEQ ID NO: 1565968 - RNA, 17 nt, Pseudomonas putida KT2440
guccugcugcaggcucu

SEQ ID NO: 1565969 - RNA, 14 nt, Pseudomonas putida KT2440
guccuggacccgca

SEQ ID NO: 1565970 - RNA, 18 nt, Pseudomonas putida KT2440
gucgaaggugucgaugcc

SEQ ID NO: 1565971 - RNA, 15 nt, Pseudomonas putida KT2440
gucgaauacaccgcc

SEQ ID NO: 1565972 - RNA, 17 nt, Pseudomonas putida KT2440
gucgaaguggaucacgg

SEQ ID NO: 1565973 - RNA, 22 nt, Pseudomonas putida KT2440
gucgaaggucaggcgcgugccu

SEQ ID NO: 1565974 - RNA, 12 nt, Pseudomonas putida KT2440
gucgaagcgcac

SEQ ID NO: 1565975 - RNA, 16 nt, Pseudomonas putida KT2440
gucgaaccacugaugc

SEQ ID NO: 1565976 - RNA, 22 nt, Pseudomonas putida KT2440
gucgaaccacugaugcgcgucc

SEQ ID NO: 1565977 - RNA, 16 nt, Pseudomonas putida KT2440
gucgaacaacuugugc

SEQ ID NO: 1565978 - RNA, 18 nt, Pseudomonas putida KT2440
gucgaacagcugaucgcc

SEQ ID NO: 1565979 - RNA, 12 nt, Pseudomonas putida KT2440
gucgaaccugcc

SEQ ID NO: 1565980 - RNA, 19 nt, Pseudomonas putida KT2440
gucgaacuccuugucgcaa

SEQ ID NO: 1565981 - RNA, 14 nt, Pseudomonas putida KT2440
gucgugagccugca

SEQ ID NO: 1565982 - RNA, 14 nt, Pseudomonas putida KT2440
gucguggcgcuggc

SEQ ID NO: 1565983 - RNA, 18 nt, Pseudomonas putida KT2440
gucguguaggauucgaac

SEQ ID NO: 1565984 - RNA, 17 nt, Pseudomonas putida KT2440
gucguucggcaucgacg

SEQ ID NO: 1565985 - RNA, 19 nt, Pseudomonas putida KT2440
gucucgaaccacagcacgc

SEQ ID NO: 1565986 - RNA, 22 nt, Pseudomonas putida KT2440
gucucgaucuaugcccggcuca

SEQ ID NO: 1565987 - RNA, 17 nt, Pseudomonas putida KT2440
gucuggaucugaggcga

SEQ ID NO: 1565988 - RNA, 14 nt, Pseudomonas putida KT2440
gucugcugcggccg

SEQ ID NO: 1565989 - RNA, 21 nt, Pseudomonas putida KT2440
gucugcgcgguaaugaccugg

SEQ ID NO: 1565990 - RNA, 13 nt, Pseudomonas putida KT2440
gugaagaucgccg

SEQ ID NO: 1565991 - RNA, 19 nt, Pseudomonas putida KT2440
gugaagaucgccgcgcuga

SEQ ID NO: 1565992 - RNA, 12 nt, Pseudomonas putida KT2440
gugaagccaggg

SEQ ID NO: 1565993 - RNA, 15 nt, Pseudomonas putida KT2440
gugaagccgaccacu

SEQ ID NO: 1565994 - RNA, 19 nt, Pseudomonas putida KT2440
gugaagccgaccacuucga

SEQ ID NO: 1565995 - RNA, 19 nt, Pseudomonas putida KT2440
gugaagucauucgccggca

SEQ ID NO: 1565996 - RNA, 18 nt, Pseudomonas putida KT2440
gugaaguugcggcauagc

SEQ ID NO: 1565997 - RNA, 20 nt, Pseudomonas putida KT2440
gugaaggccaggaacagcgc

SEQ ID NO: 1565998 - RNA, 22 nt, Pseudomonas putida KT2440
gugaaggccaggaacagcgcag

SEQ ID NO: 1565999 - RNA, 15 nt, Pseudomonas putida KT2440
gucuucgaucucggc

SEQ ID NO: 1566000 - RNA, 16 nt, Pseudomonas putida KT2440
gucugguguugaccuc

SEQ ID NO: 1566001 - RNA, 15 nt, Pseudomonas putida KT2440
gucuucguugucgcc

SEQ ID NO: 1566002 - RNA, 16 nt, Pseudomonas putida KT2440
gucuucguacaugcgc

SEQ ID NO: 1566003 - RNA, 21 nt, Pseudomonas putida KT2440
gugacccguguaggagcgggu

SEQ ID NO: 1566004 - RNA, 14 nt, Pseudomonas putida KT2440
gugacaagcugcgc

SEQ ID NO: 1566005 - RNA, 15 nt, Pseudomonas putida KT2440
gugaaucgcgcuugc

SEQ ID NO: 1566006 - RNA, 14 nt, Pseudomonas putida KT2440
gucgguaugcgccc

SEQ ID NO: 1566007 - RNA, 19 nt, Pseudomonas putida KT2440
gucgggaauugcagcccgc

SEQ ID NO: 1566008 - RNA, 22 nt, Pseudomonas putida KT2440
gucggggugaggggauucgaac

SEQ ID NO: 1566009 - RNA, 22 nt, Pseudomonas putida KT2440
gucggcucgucgaacagcauga

SEQ ID NO: 1566010 - RNA, 17 nt, Pseudomonas putida KT2440
gucggcguagcgcuuga

SEQ ID NO: 1566011 - RNA, 17 nt, Pseudomonas putida KT2440
gucggcgucagcguggu

SEQ ID NO: 1566012 - RNA, 20 nt, Pseudomonas putida KT2440
gucggcgucagcgugguagu

SEQ ID NO: 1566013 - RNA, 12 nt, Pseudomonas putida KT2440
gucggcguagcc

SEQ ID NO: 1566014 - RNA, 17 nt, Pseudomonas putida KT2440
gucggcagagcgccagc

SEQ ID NO: 1566015 - RNA, 15 nt, Pseudomonas putida KT2440
gucggcauacagcuc

SEQ ID NO: 1566016 - RNA, 20 nt, Pseudomonas putida KT2440
gucggcagcucaaccgacac

SEQ ID NO: 1566017 - RNA, 17 nt, Pseudomonas putida KT2440
gucgucagggucuuccg

SEQ ID NO: 1566018 - RNA, 23 nt, Pseudomonas putida KT2440
gucgucgaccgcgaccaugguga

SEQ ID NO: 1566019 - RNA, 23 nt, Pseudomonas putida KT2440
gucguacggcgucaguucgacgc

SEQ ID NO: 1566020 - RNA, 17 nt, Pseudomonas putida KT2440
gugauacagcacgcgca

SEQ ID NO: 1566021 - RNA, 15 nt, Pseudomonas putida KT2440
gugaucgcgcuggca

SEQ ID NO: 1566022 - RNA, 21 nt, Pseudomonas putida KT2440
gugaggucgggaauugcagcc

SEQ ID NO: 1566023 - RNA, 18 nt, Pseudomonas putida KT2440
gugaguggcccuggagcg

SEQ ID NO: 1566024 - RNA, 21 nt, Pseudomonas putida KT2440
gugauuugaacuugcgcauca

SEQ ID NO: 1566025 - RNA, 23 nt, Pseudomonas putida KT2440
gugauggcgcauggccuggucga

SEQ ID NO: 1566026 - RNA, 21 nt, Pseudomonas putida KT2440
gugcaggaucuucaugccauu

SEQ ID NO: 1566027 - RNA, 18 nt, Pseudomonas putida KT2440
gugcacgggccgauugcc

SEQ ID NO: 1566028 - RNA, 19 nt, Pseudomonas putida KT2440
gugcacuggcaggccuugu

SEQ ID NO: 1566029 - RNA, 17 nt, Pseudomonas putida KT2440
gugcacgacgucgucga

SEQ ID NO: 1566030 - RNA, 21 nt, Pseudomonas putida KT2440
gugcaaucaggucucccgccc

SEQ ID NO: 1566031 - RNA, 18 nt, Pseudomonas putida KT2440
gugcaauaccagccuggc

SEQ ID NO: 1566032 - RNA, 20 nt, Pseudomonas putida KT2440
gugcaaggaucaccaaggcu

SEQ ID NO: 1566033 - RNA, 14 nt, Pseudomonas putida KT2440
gugcaaagcgcccc

SEQ ID NO: 1566034 - RNA, 18 nt, Pseudomonas putida KT2440
gugcaacagcgccuggcg

SEQ ID NO: 1566035 - RNA, 21 nt, Pseudomonas putida KT2440
gugcaaaaccugccggugcgc

SEQ ID NO: 1566036 - RNA, 21 nt, Pseudomonas putida KT2440
gugaccgguuuuggcaggccg

SEQ ID NO: 1566037 - RNA, 16 nt, Pseudomonas putida KT2440
gugagaucgagcgccg

SEQ ID NO: 1566038 - RNA, 19 nt, Pseudomonas putida KT2440
gugacuggaacugguugac

SEQ ID NO: 1566039 - RNA, 16 nt, Pseudomonas putida KT2440
gugacuaguggccacu

SEQ ID NO: 1566040 - RNA, 13 nt, Pseudomonas putida KT2440
gugacgcuggucg

SEQ ID NO: 1566041 - RNA, 16 nt, Pseudomonas putida KT2440
gugcggcaaucgggau

SEQ ID NO: 1566042 - RNA, 15 nt, Pseudomonas putida KT2440
gugcgcaccuuggcg

SEQ ID NO: 1566043 - RNA, 18 nt, Pseudomonas putida KT2440
gugccguauggcguugcu

SEQ ID NO: 1566044 - RNA, 20 nt, Pseudomonas putida KT2440
gugcgaguauccuccagccc

SEQ ID NO: 1566045 - RNA, 21 nt, Pseudomonas putida KT2440
gugccgaagucauccauggca

SEQ ID NO: 1566046 - RNA, 20 nt, Pseudomonas putida KT2440
gugcccgugguacacggcau

SEQ ID NO: 1566047 - RNA, 17 nt, Pseudomonas putida KT2440
gugcccguagcggauaa

SEQ ID NO: 1566048 - RNA, 14 nt, Pseudomonas putida KT2440
gugccagaccacgg

SEQ ID NO: 1566049 - RNA, 16 nt, Pseudomonas putida KT2440
gugcagguggauguug

SEQ ID NO: 1566050 - RNA, 18 nt, Pseudomonas putida KT2440
gugccaccuucagcgggu

SEQ ID NO: 1566051 - RNA, 14 nt, Pseudomonas putida KT2440
gugcagggcguugc

SEQ ID NO: 1566052 - RNA, 21 nt, Pseudomonas putida KT2440
gugcaggucgauguccaggcc

SEQ ID NO: 1566053 - RNA, 14 nt, Pseudomonas putida KT2440
gugcagguucgacc

SEQ ID NO: 1566054 - RNA, 18 nt, Pseudomonas putida KT2440
gugcagguucgaccaccg

SEQ ID NO: 1566055 - RNA, 20 nt, Pseudomonas putida KT2440
gugcagguugauccagcccu

SEQ ID NO: 1566056 - RNA, 19 nt, Pseudomonas putida KT2440
gugccggcuggacaccucc

SEQ ID NO: 1566057 - RNA, 23 nt, Pseudomonas putida KT2440
gugccgcaagcagucccagcacc

SEQ ID NO: 1566058 - RNA, 17 nt, Pseudomonas putida KT2440
guaccacacauccgggu

SEQ ID NO: 1566059 - RNA, 20 nt, Pseudomonas putida KT2440
guacauguuggucagcgccu

SEQ ID NO: 1566060 - RNA, 18 nt, Pseudomonas putida KT2440
guacauagaacagcauca

SEQ ID NO: 1566061 - RNA, 16 nt, Pseudomonas putida KT2440
guacaugaucggguuc

SEQ ID NO: 1566062 - RNA, 19 nt, Pseudomonas putida KT2440
guacaugcgaacgcaggcg

SEQ ID NO: 1566063 - RNA, 19 nt, Pseudomonas putida KT2440
guacauggccgccaaggcg

SEQ ID NO: 1566064 - RNA, 21 nt, Pseudomonas putida KT2440
guacacgccuuaguucaccca

SEQ ID NO: 1566065 - RNA, 16 nt, Pseudomonas putida KT2440
guacacugcaggagcg

SEQ ID NO: 1566066 - RNA, 18 nt, Pseudomonas putida KT2440
guacagcucacgcagcca

SEQ ID NO: 1566067 - RNA, 21 nt, Pseudomonas putida KT2440
guacagaucgauccccugcaa

SEQ ID NO: 1566068 - RNA, 19 nt, Pseudomonas putida KT2440
guacaccccgaccaaggcc

SEQ ID NO: 1566069 - RNA, 20 nt, Pseudomonas putida KT2440
guacaccccgaccaaggcca

SEQ ID NO: 1566070 - RNA, 12 nt, Pseudomonas putida KT2440
guaauuggccgg

SEQ ID NO: 1566071 - RNA, 22 nt, Pseudomonas putida KT2440
guaacgggcaaggcuggcaacc

SEQ ID NO: 1566072 - RNA, 24 nt, Pseudomonas putida KT2440
gguuggccauguugucgaagcgca

SEQ ID NO: 1566073 - RNA, 16 nt, Pseudomonas putida KT2440
gguuggacagcgcccg

SEQ ID NO: 1566074 - RNA, 16 nt, Pseudomonas putida KT2440
gguugcguugaccugc

SEQ ID NO: 1566075 - RNA, 16 nt, Pseudomonas putida KT2440
gguugcucaggcgcuc

SEQ ID NO: 1566076 - RNA, 15 nt, Pseudomonas putida KT2440
gguuggccgccgcca

SEQ ID NO: 1566077 - RNA, 16 nt, Pseudomonas putida KT2440
gguuggcuuguccagc

SEQ ID NO: 1566078 - RNA, 14 nt, Pseudomonas putida KT2440
gguugugcuggccc

SEQ ID NO: 1566079 - RNA, 16 nt, Pseudomonas putida KT2440
guaacgauugcaucuc

SEQ ID NO: 1566080 - RNA, 14 nt, Pseudomonas putida KT2440
gguuugcuccgcga

SEQ ID NO: 1566081 - RNA, 18 nt, Pseudomonas putida KT2440
gguuugcccgcgaagagg

SEQ ID NO: 1566082 - RNA, 12 nt, Pseudomonas putida KT2440
gguuuucgcggu

SEQ ID NO: 1566083 - RNA, 13 nt, Pseudomonas putida KT2440
gguuuucggcgcc

SEQ ID NO: 1566084 - RNA, 18 nt, Pseudomonas putida KT2440
gguuuuggcaggccguca

SEQ ID NO: 1566085 - RNA, 17 nt, Pseudomonas putida KT2440
gguuuuuugccugauca

SEQ ID NO: 1566086 - RNA, 15 nt, Pseudomonas putida KT2440
gguggucagccaggc

SEQ ID NO: 1566087 - RNA, 17 nt, Pseudomonas putida KT2440
ggugucgaacaccaccg

SEQ ID NO: 1566088 - RNA, 14 nt, Pseudomonas putida KT2440
gguguccuugucgg

SEQ ID NO: 1566089 - RNA, 19 nt, Pseudomonas putida KT2440
ggugucgacgacaguaccu

SEQ ID NO: 1566090 - RNA, 12 nt, Pseudomonas putida KT2440
ggugucaccgcg

SEQ ID NO: 1566091 - RNA, 16 nt, Pseudomonas putida KT2440
ggugucaccgcgagca

SEQ ID NO: 1566092 - RNA, 21 nt, Pseudomonas putida KT2440
gguguaguugaccgacgccag

SEQ ID NO: 1566093 - RNA, 19 nt, Pseudomonas putida KT2440
ggugugcagcaacaccgcg

SEQ ID NO: 1566094 - RNA, 20 nt, Pseudomonas putida KT2440
ggugugcgccgucaccagcg

SEQ ID NO: 1566095 - RNA, 16 nt, Pseudomonas putida KT2440
gguuaaaagccaacug

SEQ ID NO: 1566096 - RNA, 19 nt, Pseudomonas putida KT2440
gguuauacgccgccgaggc

SEQ ID NO: 1566097 - RNA, 12 nt, Pseudomonas putida KT2440
gguggcaucacc

SEQ ID NO: 1566098 - RNA, 12 nt, Pseudomonas putida KT2440
gguggcagaaca

SEQ ID NO: 1566099 - RNA, 14 nt, Pseudomonas putida KT2440
gguggcugcacugc

SEQ ID NO: 1566100 - RNA, 17 nt, Pseudomonas putida KT2440
gguggcugccacgggca

SEQ ID NO: 1566101 - RNA, 13 nt, Pseudomonas putida KT2440
gguggcugccagc

SEQ ID NO: 1566102 - RNA, 20 nt, Pseudomonas putida KT2440
ggugggcaacagcugcgcga

SEQ ID NO: 1566103 - RNA, 17 nt, Pseudomonas putida KT2440
gguggcuggcaccggcu

SEQ ID NO: 1566104 - RNA, 22 nt, Pseudomonas putida KT2440
ggugcuaccaaccuccagguca

SEQ ID NO: 1566105 - RNA, 20 nt, Pseudomonas putida KT2440
ggugcuccaggccugcggca

SEQ ID NO: 1566106 - RNA, 14 nt, Pseudomonas putida KT2440
ggugcucagccacg

SEQ ID NO: 1566107 - RNA, 13 nt, Pseudomonas putida KT2440
ggugcagcggcag

SEQ ID NO: 1566108 - RNA, 15 nt, Pseudomonas putida KT2440
ggugcagcgggaugu

SEQ ID NO: 1566109 - RNA, 21 nt, Pseudomonas putida KT2440
ggugcagcugaugagguuugc

SEQ ID NO: 1566110 - RNA, 17 nt, Pseudomonas putida KT2440
gguggauggcaccggcu

SEQ ID NO: 1566111 - RNA, 14 nt, Pseudomonas putida KT2440
ggugcugggcauga

SEQ ID NO: 1566112 - RNA, 14 nt, Pseudomonas putida KT2440
gucacccgcgacca

SEQ ID NO: 1566113 - RNA, 17 nt, Pseudomonas putida KT2440
gucacccguggcagccc

SEQ ID NO: 1566114 - RNA, 18 nt, Pseudomonas putida KT2440
gucacccguggcagcccc

SEQ ID NO: 1566115 - RNA, 13 nt, Pseudomonas putida KT2440
gucaccgcggcaa

SEQ ID NO: 1566116 - RNA, 17 nt, Pseudomonas putida KT2440
gucaccgccccagcgcg

SEQ ID NO: 1566117 - RNA, 18 nt, Pseudomonas putida KT2440
gucaaccccuugcgggaa

SEQ ID NO: 1566118 - RNA, 21 nt, Pseudomonas putida KT2440
guauggcucagugucagcggc

SEQ ID NO: 1566119 - RNA, 20 nt, Pseudomonas putida KT2440
guauggcaggcugacccgcu

SEQ ID NO: 1566120 - RNA, 16 nt, Pseudomonas putida KT2440
guauggccgagcagga

SEQ ID NO: 1566121 - RNA, 13 nt, Pseudomonas putida KT2440
guaugcagguacc

SEQ ID NO: 1566122 - RNA, 16 nt, Pseudomonas putida KT2440
guaugggcgacgaagg

SEQ ID NO: 1566123 - RNA, 18 nt, Pseudomonas putida KT2440
guaucgaucaggaaggca

SEQ ID NO: 1566124 - RNA, 24 nt, Pseudomonas putida KT2440
guaguccccaucacgcagcgcgga

SEQ ID NO: 1566125 - RNA, 23 nt, Pseudomonas putida KT2440
guagcuguuaggcuugacgaccg

SEQ ID NO: 1566126 - RNA, 17 nt, Pseudomonas putida KT2440
guagcgcccggacaacu

SEQ ID NO: 1566127 - RNA, 18 nt, Pseudomonas putida KT2440
guagcggcggcaauggcg

SEQ ID NO: 1566128 - RNA, 16 nt, Pseudomonas putida KT2440
guagcggccagcccgc

SEQ ID NO: 1566129 - RNA, 16 nt, Pseudomonas putida KT2440
guagcgagcaccggca

SEQ ID NO: 1566130 - RNA, 17 nt, Pseudomonas putida KT2440
guagcgauaaggcuugc

SEQ ID NO: 1566131 - RNA, 19 nt, Pseudomonas putida KT2440
guagcacaagggccagguc

SEQ ID NO: 1566132 - RNA, 22 nt, Pseudomonas putida KT2440
guagccagucugcuccaccgca

SEQ ID NO: 1566133 - RNA, 13 nt, Pseudomonas putida KT2440
guagccaccugau

SEQ ID NO: 1566134 - RNA, 16 nt, Pseudomonas putida KT2440
guacgucguacgccga

SEQ ID NO: 1566135 - RNA, 13 nt, Pseudomonas putida KT2440
guacuccagcagc

SEQ ID NO: 1566136 - RNA, 22 nt, Pseudomonas putida KT2440
guacgccggcgcacgcaugcgc

SEQ ID NO: 1566137 - RNA, 13 nt, Pseudomonas putida KT2440
guaccuucggcga

SEQ ID NO: 1566138 - RNA, 21 nt, Pseudomonas putida KT2440
guaccuggaauaccaccucac

SEQ ID NO: 1566139 - RNA, 13 nt, Pseudomonas putida KT2440
guaccuggccgcg

SEQ ID NO: 1566140 - RNA, 19 nt, Pseudomonas putida KT2440
guaccugugggagcgggcu

SEQ ID NO: 1566141 - RNA, 17 nt, Pseudomonas putida KT2440
guacgagucagcgugcc

SEQ ID NO: 1566142 - RNA, 18 nt, Pseudomonas putida KT2440
guacgaugcugcgggcgu

SEQ ID NO: 1566143 - RNA, 22 nt, Pseudomonas putida KT2440
guacccaggugaugcaggcaau

SEQ ID NO: 1566144 - RNA, 18 nt, Pseudomonas putida KT2440
guaccccucgacgccuug

SEQ ID NO: 1566145 - RNA, 22 nt, Pseudomonas putida KT2440
guaccgcccucuucgcgggcau

SEQ ID NO: 1566146 - RNA, 16 nt, Pseudomonas putida KT2440
guaccgccucgggggc

SEQ ID NO: 1566147 - RNA, 22 nt, Pseudomonas putida KT2440
guaccggccucuucgcgggcaa

SEQ ID NO: 1566148 - RNA, 16 nt, Pseudomonas putida KT2440
guaccguugcggauca

SEQ ID NO: 1566149 - RNA, 16 nt, Pseudomonas putida KT2440
guaccgggcggccacc

SEQ ID NO: 1566150 - RNA, 22 nt, Pseudomonas putida KT2440
guaccgucggcacgagcaugcc

SEQ ID NO: 1566151 - RNA, 21 nt, Pseudomonas putida KT2440
ggguggagauuggucggcagg

SEQ ID NO: 1566152 - RNA, 13 nt, Pseudomonas putida KT2440
ggguguccugcaa

SEQ ID NO: 1566153 - RNA, 14 nt, Pseudomonas putida KT2440
gggcguaaagcgcc

SEQ ID NO: 1566154 - RNA, 16 nt, Pseudomonas putida KT2440
gggcgucaucacccgg

SEQ ID NO: 1566155 - RNA, 20 nt, Pseudomonas putida KT2440
gggugaucgccucgugcagc

SEQ ID NO: 1566156 - RNA, 18 nt, Pseudomonas putida KT2440
gggugccgcggauguggu

SEQ ID NO: 1566157 - RNA, 15 nt, Pseudomonas putida KT2440
gggugccgacguggu

SEQ ID NO: 1566158 - RNA, 19 nt, Pseudomonas putida KT2440
gggugcacacgucgccugg

SEQ ID NO: 1566159 - RNA, 12 nt, Pseudomonas putida KT2440
gggugcauggcu

SEQ ID NO: 1566160 - RNA, 16 nt, Pseudomonas putida KT2440
gguaaaggucacaggu

SEQ ID NO: 1566161 - RNA, 17 nt, Pseudomonas putida KT2440
gguaaaggugcccugcu

SEQ ID NO: 1566162 - RNA, 19 nt, Pseudomonas putida KT2440
gguaacacggugaucgcau

SEQ ID NO: 1566163 - RNA, 18 nt, Pseudomonas putida KT2440
gguaacgguaauggccgg

SEQ ID NO: 1566164 - RNA, 17 nt, Pseudomonas putida KT2440
gguaacguggacagcag

SEQ ID NO: 1566165 - RNA, 16 nt, Pseudomonas putida KT2440
gguacagcacccaggu

SEQ ID NO: 1566166 - RNA, 15 nt, Pseudomonas putida KT2440
gguaauccaccagcc

SEQ ID NO: 1566167 - RNA, 23 nt, Pseudomonas putida KT2440
gguaauccaccagccgccguacc

SEQ ID NO: 1566168 - RNA, 15 nt, Pseudomonas putida KT2440
gguaauuggccggca

SEQ ID NO: 1566169 - RNA, 14 nt, Pseudomonas putida KT2440
ggguuugcagcuca

SEQ ID NO: 1566170 - RNA, 19 nt, Pseudomonas putida KT2440
gguaaacccauuccuacag

SEQ ID NO: 1566171 - RNA, 19 nt, Pseudomonas putida KT2440
gguaaacccgcgccuacag

SEQ ID NO: 1566172 - RNA, 20 nt, Pseudomonas putida KT2440
gguaaacccgcuccuacaag

SEQ ID NO: 1566173 - RNA, 21 nt, Pseudomonas putida KT2440
gguaaacccgcuccuacaaug

SEQ ID NO: 1566174 - RNA, 19 nt, Pseudomonas putida KT2440
gguaaacccgcuccuacag

SEQ ID NO: 1566175 - RNA, 19 nt, Pseudomonas putida KT2440
gguaaacccgcuccuacgg

SEQ ID NO: 1566176 - RNA, 15 nt, Pseudomonas putida KT2440
ggguuggacccaggc

SEQ ID NO: 1566177 - RNA, 20 nt, Pseudomonas putida KT2440
ggguuggcgucggcaccggc

SEQ ID NO: 1566178 - RNA, 17 nt, Pseudomonas putida KT2440
ggguuuacccgcgaagc

SEQ ID NO: 1566179 - RNA, 18 nt, Pseudomonas putida KT2440
ggguuuacccgcgaaugg

SEQ ID NO: 1566180 - RNA, 18 nt, Pseudomonas putida KT2440
ggguuuaccugcgaauac

SEQ ID NO: 1566181 - RNA, 18 nt, Pseudomonas putida KT2440
ggguguuuccaccccggc

SEQ ID NO: 1566182 - RNA, 18 nt, Pseudomonas putida KT2440
ggguucacccgcgaaugc

SEQ ID NO: 1566183 - RNA, 14 nt, Pseudomonas putida KT2440
ggucagcaccagcu

SEQ ID NO: 1566184 - RNA, 16 nt, Pseudomonas putida KT2440
ggucacguagaacagg

SEQ ID NO: 1566185 - RNA, 18 nt, Pseudomonas putida KT2440
ggucacggcauccccgcc

SEQ ID NO: 1566186 - RNA, 14 nt, Pseudomonas putida KT2440
gguauccaucacca

SEQ ID NO: 1566187 - RNA, 15 nt, Pseudomonas putida KT2440
gguauccaucaccau

SEQ ID NO: 1566188 - RNA, 16 nt, Pseudomonas putida KT2440
gguauucacaccugcc

SEQ ID NO: 1566189 - RNA, 20 nt, Pseudomonas putida KT2440
gguauggcaggcugacccgc

SEQ ID NO: 1566190 - RNA, 20 nt, Pseudomonas putida KT2440
ggucaaacguauccgccgca

SEQ ID NO: 1566191 - RNA, 17 nt, Pseudomonas putida KT2440
ggucaaggccagcgccu

SEQ ID NO: 1566192 - RNA, 20 nt, Pseudomonas putida KT2440
gguaccgucgaucagcuucu

SEQ ID NO: 1566193 - RNA, 14 nt, Pseudomonas putida KT2440
gguacgagucagcg

SEQ ID NO: 1566194 - RNA, 22 nt, Pseudomonas putida KT2440
gguagaucugcucuucgccgcc

SEQ ID NO: 1566195 - RNA, 13 nt, Pseudomonas putida KT2440
gguagacccgcuc

SEQ ID NO: 1566196 - RNA, 20 nt, Pseudomonas putida KT2440
gguagagcacgaccuugcca

SEQ ID NO: 1566197 - RNA, 18 nt, Pseudomonas putida KT2440
gguacuugugugccugcu

SEQ ID NO: 1566198 - RNA, 15 nt, Pseudomonas putida KT2440
gguaggcccagccca

SEQ ID NO: 1566199 - RNA, 16 nt, Pseudomonas putida KT2440
gguaggcccagcccag

SEQ ID NO: 1566200 - RNA, 17 nt, Pseudomonas putida KT2440
gguagcggcugggcgcg

SEQ ID NO: 1566201 - RNA, 11 nt, Pseudomonas putida KT2440
gguagcggcag

SEQ ID NO: 1566202 - RNA, 17 nt, Pseudomonas putida KT2440
gguagccugcugacgca

SEQ ID NO: 1566203 - RNA, 13 nt, Pseudomonas putida KT2440
gguauagcgacag

SEQ ID NO: 1566204 - RNA, 21 nt, Pseudomonas putida KT2440
gguauaggccccgaaugcacg

SEQ ID NO: 1566205 - RNA, 19 nt, Pseudomonas putida KT2440
gguaggucaccaucagccg

SEQ ID NO: 1566206 - RNA, 15 nt, Pseudomonas putida KT2440
ggucguugaucggcu

SEQ ID NO: 1566207 - RNA, 16 nt, Pseudomonas putida KT2440
ggucgucgcccaggcg

SEQ ID NO: 1566208 - RNA, 22 nt, Pseudomonas putida KT2440
ggucugcuccaguugcaagccu

SEQ ID NO: 1566209 - RNA, 16 nt, Pseudomonas putida KT2440
ggucggccugcacuac

SEQ ID NO: 1566210 - RNA, 18 nt, Pseudomonas putida KT2440
ggucgguagggaucaccg

SEQ ID NO: 1566211 - RNA, 13 nt, Pseudomonas putida KT2440
ggucuugccgguc

SEQ ID NO: 1566212 - RNA, 19 nt, Pseudomonas putida KT2440
ggugacaaaggccggcacc

SEQ ID NO: 1566213 - RNA, 23 nt, Pseudomonas putida KT2440
ggugaaucagccccagccgguca

SEQ ID NO: 1566214 - RNA, 13 nt, Pseudomonas putida KT2440
ggugacugccagc

SEQ ID NO: 1566215 - RNA, 23 nt, Pseudomonas putida KT2440
ggugaucaacaaaccgacccugc

SEQ ID NO: 1566216 - RNA, 21 nt, Pseudomonas putida KT2440
ggugaugguugaagaugcgcg

SEQ ID NO: 1566217 - RNA, 22 nt, Pseudomonas putida KT2440
ggugauggucaccuuguccagc

SEQ ID NO: 1566218 - RNA, 18 nt, Pseudomonas putida KT2440
ggugcagcaacagguaca

SEQ ID NO: 1566219 - RNA, 14 nt, Pseudomonas putida KT2440
ggugcagauccagg

SEQ ID NO: 1566220 - RNA, 13 nt, Pseudomonas putida KT2440
ggucagcaucacc

SEQ ID NO: 1566221 - RNA, 16 nt, Pseudomonas putida KT2440
ggucagcaucaccgcg

SEQ ID NO: 1566222 - RNA, 18 nt, Pseudomonas putida KT2440
ggucagccagaugcgccg

SEQ ID NO: 1566223 - RNA, 24 nt, Pseudomonas putida KT2440
ggucagcagcaccgccaccaugcu

SEQ ID NO: 1566224 - RNA, 17 nt, Pseudomonas putida KT2440
ggucaguuugacgguga

SEQ ID NO: 1566225 - RNA, 21 nt, Pseudomonas putida KT2440
ggucaguuugacggugaauuc

SEQ ID NO: 1566226 - RNA, 13 nt, Pseudomonas putida KT2440
ggucauacagccc

SEQ ID NO: 1566227 - RNA, 18 nt, Pseudomonas putida KT2440
ggucaguaccuggccgcg

SEQ ID NO: 1566228 - RNA, 21 nt, Pseudomonas putida KT2440
ggucagucgagucgacaguga

SEQ ID NO: 1566229 - RNA, 13 nt, Pseudomonas putida KT2440
ggucauccagcag

SEQ ID NO: 1566230 - RNA, 15 nt, Pseudomonas putida KT2440
ggucauccaggcugg

SEQ ID NO: 1566231 - RNA, 18 nt, Pseudomonas putida KT2440
gguccuguuugccgaggu

SEQ ID NO: 1566232 - RNA, 13 nt, Pseudomonas putida KT2440
ggucgaacagccc

SEQ ID NO: 1566233 - RNA, 18 nt, Pseudomonas putida KT2440
ggucgaaaagccgcggua

SEQ ID NO: 1566234 - RNA, 21 nt, Pseudomonas putida KT2440
gguccaccgccagugcgguga

SEQ ID NO: 1566235 - RNA, 20 nt, Pseudomonas putida KT2440
ggucccugacucgaccgccg

SEQ ID NO: 1566236 - RNA, 15 nt, Pseudomonas putida KT2440
gguccgccucgauca

SEQ ID NO: 1566237 - RNA, 21 nt, Pseudomonas putida KT2440
ggucgcgguucgacugccgcu

SEQ ID NO: 1566238 - RNA, 19 nt, Pseudomonas putida KT2440
ggucgcggugcagcgggau

SEQ ID NO: 1566239 - RNA, 21 nt, Pseudomonas putida KT2440
ggucgcgugccgccaguucgc

SEQ ID NO: 1566240 - RNA, 17 nt, Pseudomonas putida KT2440
ggucgcgggccagccca

SEQ ID NO: 1566241 - RNA, 22 nt, Pseudomonas putida KT2440
ggucgcgacgauggacagccca

SEQ ID NO: 1566242 - RNA, 20 nt, Pseudomonas putida KT2440
ggucgaaccaguacugggcg

SEQ ID NO: 1566243 - RNA, 20 nt, Pseudomonas putida KT2440
ggucgaaccggucugcacgc

SEQ ID NO: 1566244 - RNA, 19 nt, Pseudomonas putida KT2440
ggucgaagcucagguagcg

SEQ ID NO: 1566245 - RNA, 14 nt, Pseudomonas putida KT2440
ggucgagcugccca

SEQ ID NO: 1566246 - RNA, 20 nt, Pseudomonas putida KT2440
ggucgacaccaggaucaggu

SEQ ID NO: 1566247 - RNA, 14 nt, Pseudomonas putida KT2440
ggccucaauuccag

SEQ ID NO: 1566248 - RNA, 19 nt, Pseudomonas putida KT2440
ggccucggcgaucgccagg

SEQ ID NO: 1566249 - RNA, 16 nt, Pseudomonas putida KT2440
ggccugcccgguacgc

SEQ ID NO: 1566250 - RNA, 17 nt, Pseudomonas putida KT2440
ggccugggucagcuggu

SEQ ID NO: 1566251 - RNA, 16 nt, Pseudomonas putida KT2440
ggccugcgcuccagca

SEQ ID NO: 1566252 - RNA, 17 nt, Pseudomonas putida KT2440
ggccugcacgaucgacc

SEQ ID NO: 1566253 - RNA, 20 nt, Pseudomonas putida KT2440
ggccugcaccauuugggcua

SEQ ID NO: 1566254 - RNA, 23 nt, Pseudomonas putida KT2440
ggcgaaauacccaacuccagcgc

SEQ ID NO: 1566255 - RNA, 23 nt, Pseudomonas putida KT2440
ggccuuggucucgaucagcgagu

SEQ ID NO: 1566256 - RNA, 20 nt, Pseudomonas putida KT2440
ggccuuguuauccaggcugg

SEQ ID NO: 1566257 - RNA, 16 nt, Pseudomonas putida KT2440
ggccuuuucgcgggca

SEQ ID NO: 1566258 - RNA, 17 nt, Pseudomonas putida KT2440
ggcgaagacggcagauc

SEQ ID NO: 1566259 - RNA, 14 nt, Pseudomonas putida KT2440
ggcgaauccagcag

SEQ ID NO: 1566260 - RNA, 22 nt, Pseudomonas putida KT2440
ggcgaauccagccggcccggcu

SEQ ID NO: 1566261 - RNA, 15 nt, Pseudomonas putida KT2440
ggccgucagcagcag

SEQ ID NO: 1566262 - RNA, 19 nt, Pseudomonas putida KT2440
ggccgucagcagcaggcgc

SEQ ID NO: 1566263 - RNA, 13 nt, Pseudomonas putida KT2440
ggccgucaccgcu

SEQ ID NO: 1566264 - RNA, 17 nt, Pseudomonas putida KT2440
ggccgucaccgcugccg

SEQ ID NO: 1566265 - RNA, 20 nt, Pseudomonas putida KT2440
ggccguccagcugagcgcca

SEQ ID NO: 1566266 - RNA, 13 nt, Pseudomonas putida KT2440
ggccgucgcggcu

SEQ ID NO: 1566267 - RNA, 20 nt, Pseudomonas putida KT2440
ggccggugggcaacagcugc

SEQ ID NO: 1566268 - RNA, 16 nt, Pseudomonas putida KT2440
ggccgggauggcaguu

SEQ ID NO: 1566269 - RNA, 15 nt, Pseudomonas putida KT2440
ggccggcaucgcagc

SEQ ID NO: 1566270 - RNA, 18 nt, Pseudomonas putida KT2440
ggccgcuugcaaccgacg

SEQ ID NO: 1566271 - RNA, 15 nt, Pseudomonas putida KT2440
ggccgcuuggcggcc

SEQ ID NO: 1566272 - RNA, 15 nt, Pseudomonas putida KT2440
ggccgcuugcugauc

SEQ ID NO: 1566273 - RNA, 17 nt, Pseudomonas putida KT2440
ggccgcuugcugaucaa

SEQ ID NO: 1566274 - RNA, 13 nt, Pseudomonas putida KT2440
ggccggaacaggc

SEQ ID NO: 1566275 - RNA, 22 nt, Pseudomonas putida KT2440
ggccggcacagacaccgcaaau

SEQ ID NO: 1566276 - RNA, 18 nt, Pseudomonas putida KT2440
ggccggcacaggaaggca

SEQ ID NO: 1566277 - RNA, 11 nt, Pseudomonas putida KT2440
ggccggcaacg

SEQ ID NO: 1566278 - RNA, 17 nt, Pseudomonas putida KT2440
ggccggccaccagugcu

SEQ ID NO: 1566279 - RNA, 21 nt, Pseudomonas putida KT2440
ggccggcaggcccggcccuuu

SEQ ID NO: 1566280 - RNA, 21 nt, Pseudomonas putida KT2440
ggccgcugaacaacuccgggu

SEQ ID NO: 1566281 - RNA, 14 nt, Pseudomonas putida KT2440
ggccgcuucgcgga

SEQ ID NO: 1566282 - RNA, 15 nt, Pseudomonas putida KT2440
ggccgcuucgcggau

SEQ ID NO: 1566283 - RNA, 16 nt, Pseudomonas putida KT2440
ggccgcuuccaggaac

SEQ ID NO: 1566284 - RNA, 15 nt, Pseudomonas putida KT2440
ggccgcgcagccuuu

SEQ ID NO: 1566285 - RNA, 20 nt, Pseudomonas putida KT2440
ggccgcgacgaugaucaggu

SEQ ID NO: 1566286 - RNA, 13 nt, Pseudomonas putida KT2440
ggccgccuugcgg

SEQ ID NO: 1566287 - RNA, 23 nt, Pseudomonas putida KT2440
ggccgccuuggcuuccugcuggc

SEQ ID NO: 1566288 - RNA, 13 nt, Pseudomonas putida KT2440
ggccgcgacgcgg

SEQ ID NO: 1566289 - RNA, 14 nt, Pseudomonas putida KT2440
ggccgcgacgcggc

SEQ ID NO: 1566290 - RNA, 17 nt, Pseudomonas putida KT2440
ggccgaaggccguggca

SEQ ID NO: 1566291 - RNA, 16 nt, Pseudomonas putida KT2440
ggccgaaggggcgggu

SEQ ID NO: 1566292 - RNA, 23 nt, Pseudomonas putida KT2440
ggccgaaguggcggcucgcugaa

SEQ ID NO: 1566293 - RNA, 14 nt, Pseudomonas putida KT2440
ggccgaaggcgcug

SEQ ID NO: 1566294 - RNA, 14 nt, Pseudomonas putida KT2440
ggcccuuggcagcg

SEQ ID NO: 1566295 - RNA, 23 nt, Pseudomonas putida KT2440
ggccgaaaaaaucaugcgcuggc

SEQ ID NO: 1566296 - RNA, 16 nt, Pseudomonas putida KT2440
ggcccuuucgcgggua

SEQ ID NO: 1566297 - RNA, 17 nt, Pseudomonas putida KT2440
ggcccuuucgcggguaa

SEQ ID NO: 1566298 - RNA, 17 nt, Pseudomonas putida KT2440
ggcccuuucgcggguga

SEQ ID NO: 1566299 - RNA, 19 nt, Pseudomonas putida KT2440
ggccgaaacgcgacagggc

SEQ ID NO: 1566300 - RNA, 15 nt, Pseudomonas putida KT2440
ggccgaacaccgcca

SEQ ID NO: 1566301 - RNA, 21 nt, Pseudomonas putida KT2440
ggcccugcucacgcagcucgg

SEQ ID NO: 1566302 - RNA, 13 nt, Pseudomonas putida KT2440
ggcccugcugcuu

SEQ ID NO: 1566303 - RNA, 24 nt, Pseudomonas putida KT2440
ggcccuguacauccagcuccagca

SEQ ID NO: 1566304 - RNA, 17 nt, Pseudomonas putida KT2440
ggcccuguagagcgccu

SEQ ID NO: 1566305 - RNA, 15 nt, Pseudomonas putida KT2440
ggcccugugggagcg

SEQ ID NO: 1566306 - RNA, 20 nt, Pseudomonas putida KT2440
ggcccuguguaggagcgggu

SEQ ID NO: 1566307 - RNA, 21 nt, Pseudomonas putida KT2440
ggcccugacgccagcgcuggg

SEQ ID NO: 1566308 - RNA, 23 nt, Pseudomonas putida KT2440
ggcccugaacuuggccuccagca

SEQ ID NO: 1566309 - RNA, 15 nt, Pseudomonas putida KT2440
ggcccugaccgcggu

SEQ ID NO: 1566310 - RNA, 19 nt, Pseudomonas putida KT2440
ggcccugaccgcggugcug

SEQ ID NO: 1566311 - RNA, 12 nt, Pseudomonas putida KT2440
ggcccgcugcgc

SEQ ID NO: 1566312 - RNA, 16 nt, Pseudomonas putida KT2440
ggcccgcuugcgcggu

SEQ ID NO: 1566313 - RNA, 20 nt, Pseudomonas putida KT2440
ggcccggcugaaaccgcgaa

SEQ ID NO: 1566314 - RNA, 18 nt, Pseudomonas putida KT2440
ggcccauaccguuucgau

SEQ ID NO: 1566315 - RNA, 22 nt, Pseudomonas putida KT2440
ggcccaugacguucuucggcag

SEQ ID NO: 1566316 - RNA, 17 nt, Pseudomonas putida KT2440
ggcccauucgcgggcaa

SEQ ID NO: 1566317 - RNA, 15 nt, Pseudomonas putida KT2440
ggcccaggggcaggu

SEQ ID NO: 1566318 - RNA, 17 nt, Pseudomonas putida KT2440
ggcccaguuucgccagu

SEQ ID NO: 1566319 - RNA, 19 nt, Pseudomonas putida KT2440
ggcccagcuacgcgagcca

SEQ ID NO: 1566320 - RNA, 21 nt, Pseudomonas putida KT2440
ggccgccugaccugugcugaa

SEQ ID NO: 1566321 - RNA, 14 nt, Pseudomonas putida KT2440
ggccgccucccagg

SEQ ID NO: 1566322 - RNA, 20 nt, Pseudomonas putida KT2440
ggccgccuccugcugcugca

SEQ ID NO: 1566323 - RNA, 13 nt, Pseudomonas putida KT2440
ggccgcaaggccg

SEQ ID NO: 1566324 - RNA, 17 nt, Pseudomonas putida KT2440
ggccgaugggcaggcca

SEQ ID NO: 1566325 - RNA, 16 nt, Pseudomonas putida KT2440
ggccgccaacagcgca

SEQ ID NO: 1566326 - RNA, 16 nt, Pseudomonas putida KT2440
ggccgcauccaugccg

SEQ ID NO: 1566327 - RNA, 15 nt, Pseudomonas putida KT2440
ggccgccacaugcug

SEQ ID NO: 1566328 - RNA, 14 nt, Pseudomonas putida KT2440
ggccgccaagcggc

SEQ ID NO: 1566329 - RNA, 19 nt, Pseudomonas putida KT2440
ggcaaccggagcgacuucg

SEQ ID NO: 1566330 - RNA, 17 nt, Pseudomonas putida KT2440
ggcaaccacauggccgu

SEQ ID NO: 1566331 - RNA, 18 nt, Pseudomonas putida KT2440
ggcaaccacauggccguu

SEQ ID NO: 1566332 - RNA, 14 nt, Pseudomonas putida KT2440
ggcaacaccagcag

SEQ ID NO: 1566333 - RNA, 14 nt, Pseudomonas putida KT2440
ggauuugccgguga

SEQ ID NO: 1566334 - RNA, 22 nt, Pseudomonas putida KT2440
ggauuuucaccuucgagccacc

SEQ ID NO: 1566335 - RNA, 20 nt, Pseudomonas putida KT2440
ggcaaacccgcgccuacagg

SEQ ID NO: 1566336 - RNA, 17 nt, Pseudomonas putida KT2440
ggcaaacccggccagca

SEQ ID NO: 1566337 - RNA, 20 nt, Pseudomonas putida KT2440
ggcaaacccggccagcaggu

SEQ ID NO: 1566338 - RNA, 14 nt, Pseudomonas putida KT2440
ggauuccgacaagg

SEQ ID NO: 1566339 - RNA, 15 nt, Pseudomonas putida KT2440
ggauuccgacaaggg

SEQ ID NO: 1566340 - RNA, 14 nt, Pseudomonas putida KT2440
ggcaacugcgccug

SEQ ID NO: 1566341 - RNA, 17 nt, Pseudomonas putida KT2440
ggcaacgucaucggccc

SEQ ID NO: 1566342 - RNA, 15 nt, Pseudomonas putida KT2440
ggcaagcccgcgaag

SEQ ID NO: 1566343 - RNA, 15 nt, Pseudomonas putida KT2440
ggcaagcccauggcu

SEQ ID NO: 1566344 - RNA, 19 nt, Pseudomonas putida KT2440
ggcaagcaaucagaacguc

SEQ ID NO: 1566345 - RNA, 14 nt, Pseudomonas putida KT2440
ggcaagguauucga

SEQ ID NO: 1566346 - RNA, 20 nt, Pseudomonas putida KT2440
ggcaagggcggaggcuucga

SEQ ID NO: 1566347 - RNA, 17 nt, Pseudomonas putida KT2440
ggcaaggugggguugac

SEQ ID NO: 1566348 - RNA, 14 nt, Pseudomonas putida KT2440
ggcaaguggaagcg

SEQ ID NO: 1566349 - RNA, 23 nt, Pseudomonas putida KT2440
ggcaauaaaaaaccccggcacag

SEQ ID NO: 1566350 - RNA, 20 nt, Pseudomonas putida KT2440
ggcaauaccggccacgcgcg

SEQ ID NO: 1566351 - RNA, 17 nt, Pseudomonas putida KT2440
ggcaaggcgaucuggcg

SEQ ID NO: 1566352 - RNA, 19 nt, Pseudomonas putida KT2440
ggcacaaccgaacccgcug

SEQ ID NO: 1566353 - RNA, 14 nt, Pseudomonas putida KT2440
ggcaauggccugca

SEQ ID NO: 1566354 - RNA, 15 nt, Pseudomonas putida KT2440
ggcaauggcgaaccg

SEQ ID NO: 1566355 - RNA, 19 nt, Pseudomonas putida KT2440
ggcaauggcgcgaacaggg

SEQ ID NO: 1566356 - RNA, 17 nt, Pseudomonas putida KT2440
ggcaaugcucgccugcu

SEQ ID NO: 1566357 - RNA, 13 nt, Pseudomonas putida KT2440
ggcaauggcguca

SEQ ID NO: 1566358 - RNA, 22 nt, Pseudomonas putida KT2440
ggcaauguaaugcgccgucgcc

SEQ ID NO: 1566359 - RNA, 18 nt, Pseudomonas putida KT2440
ggcaaucugcucgacgaa

SEQ ID NO: 1566360 - RNA, 20 nt, Pseudomonas putida KT2440
ggcaaucuucuugccgguac

SEQ ID NO: 1566361 - RNA, 15 nt, Pseudomonas putida KT2440
ggcaaugaucagccc

SEQ ID NO: 1566362 - RNA, 19 nt, Pseudomonas putida KT2440
ggcaaucgggaucaugccg

SEQ ID NO: 1566363 - RNA, 18 nt, Pseudomonas putida KT2440
ggcaaucggcaggccggc

SEQ ID NO: 1566364 - RNA, 22 nt, Pseudomonas putida KT2440
ggcaaucggcaggccggccacc

SEQ ID NO: 1566365 - RNA, 14 nt, Pseudomonas putida KT2440
ggcaaucagcgaca

SEQ ID NO: 1566366 - RNA, 22 nt, Pseudomonas putida KT2440
ggcaaucgcgcccgguggcgcg

SEQ ID NO: 1566367 - RNA, 19 nt, Pseudomonas putida KT2440
ggcaaucgccaggcgcacc

SEQ ID NO: 1566368 - RNA, 13 nt, Pseudomonas putida KT2440
ggcaaucgacaac

SEQ ID NO: 1566369 - RNA, 15 nt, Pseudomonas putida KT2440
ggcaaucgccaaggu

SEQ ID NO: 1566370 - RNA, 19 nt, Pseudomonas putida KT2440
ggcacgggccagcgcggua

SEQ ID NO: 1566371 - RNA, 22 nt, Pseudomonas putida KT2440
ggcacggcugaaaugcccgcaa

SEQ ID NO: 1566372 - RNA, 17 nt, Pseudomonas putida KT2440
ggcacggcugcccugca

SEQ ID NO: 1566373 - RNA, 22 nt, Pseudomonas putida KT2440
ggcacggcgcugucggucagca

SEQ ID NO: 1566374 - RNA, 21 nt, Pseudomonas putida KT2440
ggcacugaccacuucaagcac

SEQ ID NO: 1566375 - RNA, 23 nt, Pseudomonas putida KT2440
ggcacuaccaggcccaacagcgc

SEQ ID NO: 1566376 - RNA, 16 nt, Pseudomonas putida KT2440
ggcacuaagcgaaaca

SEQ ID NO: 1566377 - RNA, 22 nt, Pseudomonas putida KT2440
ggcacuaagcgaaacaccagca

SEQ ID NO: 1566378 - RNA, 13 nt, Pseudomonas putida KT2440
ggcacgguugcgc

SEQ ID NO: 1566379 - RNA, 17 nt, Pseudomonas putida KT2440
ggcacgccaaucaccug

SEQ ID NO: 1566380 - RNA, 20 nt, Pseudomonas putida KT2440
ggcacgauccugugggagcg

SEQ ID NO: 1566381 - RNA, 19 nt, Pseudomonas putida KT2440
ggcacccuggcgguugacc

SEQ ID NO: 1566382 - RNA, 15 nt, Pseudomonas putida KT2440
ggcaccgacggcggu

SEQ ID NO: 1566383 - RNA, 13 nt, Pseudomonas putida KT2440
ggcaccgaucacc

SEQ ID NO: 1566384 - RNA, 20 nt, Pseudomonas putida KT2440
ggcaccgaucaccugggcga

SEQ ID NO: 1566385 - RNA, 17 nt, Pseudomonas putida KT2440
ggcaccggcagcagcaa

SEQ ID NO: 1566386 - RNA, 17 nt, Pseudomonas putida KT2440
ggcacccagccagcgau

SEQ ID NO: 1566387 - RNA, 22 nt, Pseudomonas putida KT2440
ggcacccacagcgccugcugcu

SEQ ID NO: 1566388 - RNA, 18 nt, Pseudomonas putida KT2440
ggcaccaguuccagggcg

SEQ ID NO: 1566389 - RNA, 19 nt, Pseudomonas putida KT2440
ggcaccagauucaagcccg

SEQ ID NO: 1566390 - RNA, 19 nt, Pseudomonas putida KT2440
ggcaccagcaccagcuccu

SEQ ID NO: 1566391 - RNA, 19 nt, Pseudomonas putida KT2440
ggcacaccuggugcgccuu

SEQ ID NO: 1566392 - RNA, 12 nt, Pseudomonas putida KT2440
ggcacaggccca

SEQ ID NO: 1566393 - RNA, 15 nt, Pseudomonas putida KT2440
ggcacaggcccagca

SEQ ID NO: 1566394 - RNA, 17 nt, Pseudomonas putida KT2440
ggcacaggcccagcaac

SEQ ID NO: 1566395 - RNA, 13 nt, Pseudomonas putida KT2440
ggcacacgcacca

SEQ ID NO: 1566396 - RNA, 22 nt, Pseudomonas putida KT2440
ggcacuucguuacccucggcau

SEQ ID NO: 1566397 - RNA, 23 nt, Pseudomonas putida KT2440
ggcacuuggcauuggccugggcc

SEQ ID NO: 1566398 - RNA, 14 nt, Pseudomonas putida KT2440
ggcacuugggaucg

SEQ ID NO: 1566399 - RNA, 16 nt, Pseudomonas putida KT2440
ggcacuugggaucgau

SEQ ID NO: 1566400 - RNA, 18 nt, Pseudomonas putida KT2440
ggcacuugggaucgaugc

SEQ ID NO: 1566401 - RNA, 17 nt, Pseudomonas putida KT2440
ggcacuguaggcaaaca

SEQ ID NO: 1566402 - RNA, 15 nt, Pseudomonas putida KT2440
ggcacuggcgcgaug

SEQ ID NO: 1566403 - RNA, 23 nt, Pseudomonas putida KT2440
ggcacugcccaagccauccacca

SEQ ID NO: 1566404 - RNA, 13 nt, Pseudomonas putida KT2440
ggcagaacaucgc

SEQ ID NO: 1566405 - RNA, 16 nt, Pseudomonas putida KT2440
ggcagaacaucgccca

SEQ ID NO: 1566406 - RNA, 15 nt, Pseudomonas putida KT2440
ggcagacacaggcgc

SEQ ID NO: 1566407 - RNA, 17 nt, Pseudomonas putida KT2440
ggcagcgggcucgccca

SEQ ID NO: 1566408 - RNA, 18 nt, Pseudomonas putida KT2440
ggcagcggcuuggccgcg

SEQ ID NO: 1566409 - RNA, 13 nt, Pseudomonas putida KT2440
ggcagggcacacu

SEQ ID NO: 1566410 - RNA, 18 nt, Pseudomonas putida KT2440
ggcaggcugugcggcaac

SEQ ID NO: 1566411 - RNA, 15 nt, Pseudomonas putida KT2440
ggcagggccggcccu

SEQ ID NO: 1566412 - RNA, 19 nt, Pseudomonas putida KT2440
ggcaugccccucgaacagc

SEQ ID NO: 1566413 - RNA, 20 nt, Pseudomonas putida KT2440
ggcaugcgucuggcggcccu

SEQ ID NO: 1566414 - RNA, 16 nt, Pseudomonas putida KT2440
ggcaugaauaaccugg

SEQ ID NO: 1566415 - RNA, 22 nt, Pseudomonas putida KT2440
ggcaucggccuggggcaggccc

SEQ ID NO: 1566416 - RNA, 17 nt, Pseudomonas putida KT2440
ggcaucggcgccuucgc

SEQ ID NO: 1566417 - RNA, 12 nt, Pseudomonas putida KT2440
ggcaucggcgcc

SEQ ID NO: 1566418 - RNA, 18 nt, Pseudomonas putida KT2440
ggcaucggucaccgggua

SEQ ID NO: 1566419 - RNA, 16 nt, Pseudomonas putida KT2440
ggcaucgggcaaggcg

SEQ ID NO: 1566420 - RNA, 17 nt, Pseudomonas putida KT2440
ggcaucgaacagcuugc

SEQ ID NO: 1566421 - RNA, 16 nt, Pseudomonas putida KT2440
ggcaucgacgaugccg

SEQ ID NO: 1566422 - RNA, 19 nt, Pseudomonas putida KT2440
ggcagucuucaagcucgaa

SEQ ID NO: 1566423 - RNA, 22 nt, Pseudomonas putida KT2440
ggcauccacacccugcgaaguc

SEQ ID NO: 1566424 - RNA, 17 nt, Pseudomonas putida KT2440
ggcagucacccaccggc

SEQ ID NO: 1566425 - RNA, 18 nt, Pseudomonas putida KT2440
ggcaguacauagaacagc

SEQ ID NO: 1566426 - RNA, 13 nt, Pseudomonas putida KT2440
ggcaggucagcga

SEQ ID NO: 1566427 - RNA, 14 nt, Pseudomonas putida KT2440
ggcaguaggccacc

SEQ ID NO: 1566428 - RNA, 20 nt, Pseudomonas putida KT2440
ggccagcgucagggucucgc

SEQ ID NO: 1566429 - RNA, 18 nt, Pseudomonas putida KT2440
ggccagcucauccagccg

SEQ ID NO: 1566430 - RNA, 22 nt, Pseudomonas putida KT2440
ggccagcguuuguaaguaggcg

SEQ ID NO: 1566431 - RNA, 16 nt, Pseudomonas putida KT2440
ggccagcuucucggca

SEQ ID NO: 1566432 - RNA, 16 nt, Pseudomonas putida KT2440
ggccaggaacagcgca

SEQ ID NO: 1566433 - RNA, 15 nt, Pseudomonas putida KT2440
ggccagcuucgacga

SEQ ID NO: 1566434 - RNA, 20 nt, Pseudomonas putida KT2440
ggccagcgccugcugccagg

SEQ ID NO: 1566435 - RNA, 18 nt, Pseudomonas putida KT2440
ggccagcaggucagcacg

SEQ ID NO: 1566436 - RNA, 20 nt, Pseudomonas putida KT2440
ggccagcaggucaggcccuu

SEQ ID NO: 1566437 - RNA, 19 nt, Pseudomonas putida KT2440
ggccagcagguugaacagg

SEQ ID NO: 1566438 - RNA, 22 nt, Pseudomonas putida KT2440
ggccagcgcgguagcugccgcg

SEQ ID NO: 1566439 - RNA, 14 nt, Pseudomonas putida KT2440
ggccagcacgaaca

SEQ ID NO: 1566440 - RNA, 16 nt, Pseudomonas putida KT2440
ggccagcacgaacagc

SEQ ID NO: 1566441 - RNA, 18 nt, Pseudomonas putida KT2440
ggccagcacgaacagcaa

SEQ ID NO: 1566442 - RNA, 17 nt, Pseudomonas putida KT2440
ggccacguugaucgucg

SEQ ID NO: 1566443 - RNA, 21 nt, Pseudomonas putida KT2440
ggccaccuugccaucggccau

SEQ ID NO: 1566444 - RNA, 18 nt, Pseudomonas putida KT2440
ggccacggccgaguccuu

SEQ ID NO: 1566445 - RNA, 19 nt, Pseudomonas putida KT2440
ggccacgguguauccagcc

SEQ ID NO: 1566446 - RNA, 17 nt, Pseudomonas putida KT2440
ggccaccgccucggcua

SEQ ID NO: 1566447 - RNA, 16 nt, Pseudomonas putida KT2440
ggccaccuggucgaau

SEQ ID NO: 1566448 - RNA, 14 nt, Pseudomonas putida KT2440
ggccacccgcguuu

SEQ ID NO: 1566449 - RNA, 20 nt, Pseudomonas putida KT2440
ggccacccuccgggucaggc

SEQ ID NO: 1566450 - RNA, 17 nt, Pseudomonas putida KT2440
ggccaaccacgccugcg

SEQ ID NO: 1566451 - RNA, 21 nt, Pseudomonas putida KT2440
ggccaacauucacggcgucga

SEQ ID NO: 1566452 - RNA, 20 nt, Pseudomonas putida KT2440
ggcauuuuucgaacagcucu

SEQ ID NO: 1566453 - RNA, 16 nt, Pseudomonas putida KT2440
ggcgcgucccccggua

SEQ ID NO: 1566454 - RNA, 23 nt, Pseudomonas putida KT2440
ggcgcggugauggcgcauggccu

SEQ ID NO: 1566455 - RNA, 16 nt, Pseudomonas putida KT2440
ggcgcggugaggcaac

SEQ ID NO: 1566456 - RNA, 19 nt, Pseudomonas putida KT2440
ggcgcggguuuacccgcga

SEQ ID NO: 1566457 - RNA, 20 nt, Pseudomonas putida KT2440
ggcgcggguuuacccgcgaa

SEQ ID NO: 1566458 - RNA, 19 nt, Pseudomonas putida KT2440
ggcgcggguuugcccgcga

SEQ ID NO: 1566459 - RNA, 20 nt, Pseudomonas putida KT2440
ggcgcggguuugcccgcgaa

SEQ ID NO: 1566460 - RNA, 20 nt, Pseudomonas putida KT2440
ggcgcggguuugcccgcgag

SEQ ID NO: 1566461 - RNA, 18 nt, Pseudomonas putida KT2440
ggcgcgggcacccuggcg

SEQ ID NO: 1566462 - RNA, 17 nt, Pseudomonas putida KT2440
ggcgcgaccaucaccgc

SEQ ID NO: 1566463 - RNA, 22 nt, Pseudomonas putida KT2440
ggcgcgaccaucaccgccagca

SEQ ID NO: 1566464 - RNA, 17 nt, Pseudomonas putida KT2440
ggcgcgaauuuccgggu

SEQ ID NO: 1566465 - RNA, 21 nt, Pseudomonas putida KT2440
ggcgcggcccaguuucgccag

SEQ ID NO: 1566466 - RNA, 22 nt, Pseudomonas putida KT2440
ggcgcggcagcaugaacagcgc

SEQ ID NO: 1566467 - RNA, 16 nt, Pseudomonas putida KT2440
ggcgcuuccuggccuu

SEQ ID NO: 1566468 - RNA, 20 nt, Pseudomonas putida KT2440
ggcgcuuggaaauguucaac

SEQ ID NO: 1566469 - RNA, 22 nt, Pseudomonas putida KT2440
ggcgcuucagguaagucagcga

SEQ ID NO: 1566470 - RNA, 16 nt, Pseudomonas putida KT2440
ggcgcuugaucagccu

SEQ ID NO: 1566471 - RNA, 18 nt, Pseudomonas putida KT2440
ggcgcuugaucugccagg

SEQ ID NO: 1566472 - RNA, 16 nt, Pseudomonas putida KT2440
ggcgcuggacagcggc

SEQ ID NO: 1566473 - RNA, 13 nt, Pseudomonas putida KT2440
ggcgcuggccagg

SEQ ID NO: 1566474 - RNA, 14 nt, Pseudomonas putida KT2440
ggcgcuccagcagg

SEQ ID NO: 1566475 - RNA, 20 nt, Pseudomonas putida KT2440
ggcggauguuggccacgaaa

SEQ ID NO: 1566476 - RNA, 23 nt, Pseudomonas putida KT2440
ggcgguaaacguggucagccacg

SEQ ID NO: 1566477 - RNA, 19 nt, Pseudomonas putida KT2440
ggcgguaacagggguucga

SEQ ID NO: 1566478 - RNA, 17 nt, Pseudomonas putida KT2440
ggcggcucuugcagcga

SEQ ID NO: 1566479 - RNA, 18 nt, Pseudomonas putida KT2440
ggcggcucuugcagcgag

SEQ ID NO: 1566480 - RNA, 12 nt, Pseudomonas putida KT2440
ggcgggccugcu

SEQ ID NO: 1566481 - RNA, 16 nt, Pseudomonas putida KT2440
ggcggcuuucagcgcc

SEQ ID NO: 1566482 - RNA, 17 nt, Pseudomonas putida KT2440
ggcggcuuucagcgccg

SEQ ID NO: 1566483 - RNA, 13 nt, Pseudomonas putida KT2440
ggcgccaucgccc

SEQ ID NO: 1566484 - RNA, 16 nt, Pseudomonas putida KT2440
ggcgccauaggcuugc

SEQ ID NO: 1566485 - RNA, 23 nt, Pseudomonas putida KT2440
ggcgccaaucaucgccagcagcg

SEQ ID NO: 1566486 - RNA, 16 nt, Pseudomonas putida KT2440
ggcgcauccucggugc

SEQ ID NO: 1566487 - RNA, 21 nt, Pseudomonas putida KT2440
ggcgcauccucggugcgcggu

SEQ ID NO: 1566488 - RNA, 16 nt, Pseudomonas putida KT2440
ggcgcaucuuccagca

SEQ ID NO: 1566489 - RNA, 19 nt, Pseudomonas putida KT2440
ggcgcauugauagcggcag

SEQ ID NO: 1566490 - RNA, 19 nt, Pseudomonas putida KT2440
ggcgcaggcugucgaacag

SEQ ID NO: 1566491 - RNA, 13 nt, Pseudomonas putida KT2440
ggcgcaggccgac

SEQ ID NO: 1566492 - RNA, 16 nt, Pseudomonas putida KT2440
ggcgcaggccgacaac

SEQ ID NO: 1566493 - RNA, 21 nt, Pseudomonas putida KT2440
ggcgcaggccgacaacagcau

SEQ ID NO: 1566494 - RNA, 19 nt, Pseudomonas putida KT2440
ggcgcacucucgucaccug

SEQ ID NO: 1566495 - RNA, 17 nt, Pseudomonas putida KT2440
ggcgcagcgcaugcucg

SEQ ID NO: 1566496 - RNA, 22 nt, Pseudomonas putida KT2440
ggcgcaacucagcgcagcuucu

SEQ ID NO: 1566497 - RNA, 11 nt, Pseudomonas putida KT2440
ggcgcaagccg

SEQ ID NO: 1566498 - RNA, 14 nt, Pseudomonas putida KT2440
ggcgcaauaucgag

SEQ ID NO: 1566499 - RNA, 18 nt, Pseudomonas putida KT2440
ggcgcacguacuccacca

SEQ ID NO: 1566500 - RNA, 15 nt, Pseudomonas putida KT2440
ggcgaauggcaggug

SEQ ID NO: 1566501 - RNA, 22 nt, Pseudomonas putida KT2440
ggcgaaugcgcccggccagguc

SEQ ID NO: 1566502 - RNA, 13 nt, Pseudomonas putida KT2440
ggcgaugcgcaca

SEQ ID NO: 1566503 - RNA, 23 nt, Pseudomonas putida KT2440
ggcgcaaauugcccggccagcga

SEQ ID NO: 1566504 - RNA, 15 nt, Pseudomonas putida KT2440
ggcgauggucaaccg

SEQ ID NO: 1566505 - RNA, 16 nt, Pseudomonas putida KT2440
ggcgcccugcaaaggc

SEQ ID NO: 1566506 - RNA, 22 nt, Pseudomonas putida KT2440
ggcgccgccagcugcugcccca

SEQ ID NO: 1566507 - RNA, 16 nt, Pseudomonas putida KT2440
ggcgccgccaggcagc

SEQ ID NO: 1566508 - RNA, 22 nt, Pseudomonas putida KT2440
ggcgccgccgaacucuggcaac

SEQ ID NO: 1566509 - RNA, 15 nt, Pseudomonas putida KT2440
ggcgccgaugccguc

SEQ ID NO: 1566510 - RNA, 11 nt, Pseudomonas putida KT2440
ggcgccgagcc

SEQ ID NO: 1566511 - RNA, 17 nt, Pseudomonas putida KT2440
ggcgccgaccgaaccgg

SEQ ID NO: 1566512 - RNA, 15 nt, Pseudomonas putida KT2440
ggcgccguugcccuu

SEQ ID NO: 1566513 - RNA, 19 nt, Pseudomonas putida KT2440
ggcgccuugauuaccagcg

SEQ ID NO: 1566514 - RNA, 21 nt, Pseudomonas putida KT2440
ggcgccugccgggucaaggcc

SEQ ID NO: 1566515 - RNA, 20 nt, Pseudomonas putida KT2440
ggcgccuaucagaucgagcg

SEQ ID NO: 1566516 - RNA, 13 nt, Pseudomonas putida KT2440
ggcgccuccagca

SEQ ID NO: 1566517 - RNA, 13 nt, Pseudomonas putida KT2440
ggcgccggccgca

SEQ ID NO: 1566518 - RNA, 12 nt, Pseudomonas putida KT2440
ggcuggccagac

SEQ ID NO: 1566519 - RNA, 14 nt, Pseudomonas putida KT2440
ggcuggcagccggc

SEQ ID NO: 1566520 - RNA, 12 nt, Pseudomonas putida KT2440
ggcuggcaaccc

SEQ ID NO: 1566521 - RNA, 18 nt, Pseudomonas putida KT2440
ggcuggacaagccaacca

SEQ ID NO: 1566522 - RNA, 21 nt, Pseudomonas putida KT2440
ggcuggacaccucccgcgcau

SEQ ID NO: 1566523 - RNA, 21 nt, Pseudomonas putida KT2440
ggcugcguugcggucagcgcu

SEQ ID NO: 1566524 - RNA, 20 nt, Pseudomonas putida KT2440
ggcugcguuuaccggcaccg

SEQ ID NO: 1566525 - RNA, 12 nt, Pseudomonas putida KT2440
ggcugcugcgca

SEQ ID NO: 1566526 - RNA, 20 nt, Pseudomonas putida KT2440
ggcugcuuugcagcccuucg

SEQ ID NO: 1566527 - RNA, 13 nt, Pseudomonas putida KT2440
ggcuggcgcaugc

SEQ ID NO: 1566528 - RNA, 23 nt, Pseudomonas putida KT2440
ggcugcgccgaucaggaaggccu

SEQ ID NO: 1566529 - RNA, 18 nt, Pseudomonas putida KT2440
ggcugcgcaucaggcugc

SEQ ID NO: 1566530 - RNA, 12 nt, Pseudomonas putida KT2440
ggcugcgcggca

SEQ ID NO: 1566531 - RNA, 20 nt, Pseudomonas putida KT2440
ggcugcgcggcagcccuucg

SEQ ID NO: 1566532 - RNA, 17 nt, Pseudomonas putida KT2440
ggcugcgcuugagccuu

SEQ ID NO: 1566533 - RNA, 21 nt, Pseudomonas putida KT2440
ggcugcccucgggcagccuuu

SEQ ID NO: 1566534 - RNA, 15 nt, Pseudomonas putida KT2440
ggcugccuacccagg

SEQ ID NO: 1566535 - RNA, 20 nt, Pseudomonas putida KT2440
ggcugccuggcccgcuacga

SEQ ID NO: 1566536 - RNA, 17 nt, Pseudomonas putida KT2440
ggcugccuucgcucagg

SEQ ID NO: 1566537 - RNA, 15 nt, Pseudomonas putida KT2440
ggcugccgccgaaca

SEQ ID NO: 1566538 - RNA, 17 nt, Pseudomonas putida KT2440
ggcugccgccgaacaug

SEQ ID NO: 1566539 - RNA, 21 nt, Pseudomonas putida KT2440
ggcugaugguggucggcagcu

SEQ ID NO: 1566540 - RNA, 17 nt, Pseudomonas putida KT2440
ggcugaugcgcuggccc

SEQ ID NO: 1566541 - RNA, 16 nt, Pseudomonas putida KT2440
ggcugcaaagcagccc

SEQ ID NO: 1566542 - RNA, 15 nt, Pseudomonas putida KT2440
ggcugcacugccgca

SEQ ID NO: 1566543 - RNA, 13 nt, Pseudomonas putida KT2440
ggcugcacuggca

SEQ ID NO: 1566544 - RNA, 13 nt, Pseudomonas putida KT2440
ggcugcacugggc

SEQ ID NO: 1566545 - RNA, 16 nt, Pseudomonas putida KT2440
ggcugcacuucgauac

SEQ ID NO: 1566546 - RNA, 23 nt, Pseudomonas putida KT2440
ggcugcaggucggccagcucggc

SEQ ID NO: 1566547 - RNA, 14 nt, Pseudomonas putida KT2440
ggcugcagcgaaca

SEQ ID NO: 1566548 - RNA, 16 nt, Pseudomonas putida KT2440
ggcugccaaucaaccc

SEQ ID NO: 1566549 - RNA, 22 nt, Pseudomonas putida KT2440
ggcugaucagcaugucccgggu

SEQ ID NO: 1566550 - RNA, 12 nt, Pseudomonas putida KT2440
ggcugagccggc

SEQ ID NO: 1566551 - RNA, 12 nt, Pseudomonas putida KT2440
ggcugacgccag

SEQ ID NO: 1566552 - RNA, 20 nt, Pseudomonas putida KT2440
ggcugacgccaguuggucaa

SEQ ID NO: 1566553 - RNA, 22 nt, Pseudomonas putida KT2440
ggcuccaggugaaucagcggca

SEQ ID NO: 1566554 - RNA, 16 nt, Pseudomonas putida KT2440
ggcuccgcgcaagcgg

SEQ ID NO: 1566555 - RNA, 22 nt, Pseudomonas putida KT2440
ggcugaaauggcggcccagcca

SEQ ID NO: 1566556 - RNA, 16 nt, Pseudomonas putida KT2440
ggcugaaaccgcgaau

SEQ ID NO: 1566557 - RNA, 20 nt, Pseudomonas putida KT2440
ggcucuugaacugggcaucc

SEQ ID NO: 1566558 - RNA, 19 nt, Pseudomonas putida KT2440
ggcucuugaggucggcgcg

SEQ ID NO: 1566559 - RNA, 20 nt, Pseudomonas putida KT2440
ggcucugcuccagcugcucg

SEQ ID NO: 1566560 - RNA, 23 nt, Pseudomonas putida KT2440
ggcucugcuugagcgcagcgacg

SEQ ID NO: 1566561 - RNA, 23 nt, Pseudomonas putida KT2440
ggcucugggcaaaaucgaccagg

SEQ ID NO: 1566562 - RNA, 12 nt, Pseudomonas putida KT2440
ggcggucguagc

SEQ ID NO: 1566563 - RNA, 23 nt, Pseudomonas putida KT2440
ggcgugaaaaaagcgugaaugca

SEQ ID NO: 1566564 - RNA, 16 nt, Pseudomonas putida KT2440
ggcgugaaauccucaa

SEQ ID NO: 1566565 - RNA, 15 nt, Pseudomonas putida KT2440
ggcgucuuccaggug

SEQ ID NO: 1566566 - RNA, 14 nt, Pseudomonas putida KT2440
ggcgucuucgccag

SEQ ID NO: 1566567 - RNA, 13 nt, Pseudomonas putida KT2440
ggcgucggcgacg

SEQ ID NO: 1566568 - RNA, 16 nt, Pseudomonas putida KT2440
ggcgucggucagcgag

SEQ ID NO: 1566569 - RNA, 14 nt, Pseudomonas putida KT2440
ggcgucguacaggc

SEQ ID NO: 1566570 - RNA, 17 nt, Pseudomonas putida KT2440
ggcguucaucgaaggcc

SEQ ID NO: 1566571 - RNA, 14 nt, Pseudomonas putida KT2440
ggcguuccagccag

SEQ ID NO: 1566572 - RNA, 14 nt, Pseudomonas putida KT2440
ggcguugucagccu

SEQ ID NO: 1566573 - RNA, 13 nt, Pseudomonas putida KT2440
ggcgugccgucca

SEQ ID NO: 1566574 - RNA, 18 nt, Pseudomonas putida KT2440
ggcgugccgucgagcagg

SEQ ID NO: 1566575 - RNA, 22 nt, Pseudomonas putida KT2440
ggcgugcgcugcauggcggcac

SEQ ID NO: 1566576 - RNA, 16 nt, Pseudomonas putida KT2440
ggcuauucuccuugga

SEQ ID NO: 1566577 - RNA, 18 nt, Pseudomonas putida KT2440
ggcuaucucaggccaguu

SEQ ID NO: 1566578 - RNA, 19 nt, Pseudomonas putida KT2440
ggcuaucucaggccaguuc

SEQ ID NO: 1566579 - RNA, 18 nt, Pseudomonas putida KT2440
ggcucacagcccgggcau

SEQ ID NO: 1566580 - RNA, 18 nt, Pseudomonas putida KT2440
ggcucacacccaggcucg

SEQ ID NO: 1566581 - RNA, 13 nt, Pseudomonas putida KT2440
ggcuagaugcugg

SEQ ID NO: 1566582 - RNA, 14 nt, Pseudomonas putida KT2440
ggcuagaugcuggu

SEQ ID NO: 1566583 - RNA, 16 nt, Pseudomonas putida KT2440
ggcuagccacggcggu

SEQ ID NO: 1566584 - RNA, 18 nt, Pseudomonas putida KT2440
gggccggcacaggcuuac

SEQ ID NO: 1566585 - RNA, 13 nt, Pseudomonas putida KT2440
gggccggcccuuu

SEQ ID NO: 1566586 - RNA, 16 nt, Pseudomonas putida KT2440
gggccggcgcccugca

SEQ ID NO: 1566587 - RNA, 19 nt, Pseudomonas putida KT2440
gggccgcguugcggcccuu

SEQ ID NO: 1566588 - RNA, 20 nt, Pseudomonas putida KT2440
gggccgcuacgcgccccuuu

SEQ ID NO: 1566589 - RNA, 21 nt, Pseudomonas putida KT2440
gggcgaauucgagcuggucau

SEQ ID NO: 1566590 - RNA, 15 nt, Pseudomonas putida KT2440
gggcaggcccggcag

SEQ ID NO: 1566591 - RNA, 17 nt, Pseudomonas putida KT2440
gggcagggugucgacga

SEQ ID NO: 1566592 - RNA, 18 nt, Pseudomonas putida KT2440
gggccgcgcagccuuuga

SEQ ID NO: 1566593 - RNA, 18 nt, Pseudomonas putida KT2440
gggcgacagacagggccu

SEQ ID NO: 1566594 - RNA, 17 nt, Pseudomonas putida KT2440
gggcgaucuccugcagg

SEQ ID NO: 1566595 - RNA, 16 nt, Pseudomonas putida KT2440
gggcgcgcccgcgaag

SEQ ID NO: 1566596 - RNA, 22 nt, Pseudomonas putida KT2440
gggcgcuugcccgcgaauggcc

SEQ ID NO: 1566597 - RNA, 19 nt, Pseudomonas putida KT2440
gggcggagauuggccagca

SEQ ID NO: 1566598 - RNA, 18 nt, Pseudomonas putida KT2440
gggcgcguguagcccgcu

SEQ ID NO: 1566599 - RNA, 17 nt, Pseudomonas putida KT2440
ggcuggugaagcccuuc

SEQ ID NO: 1566600 - RNA, 20 nt, Pseudomonas putida KT2440
ggcuggcuuacaucaugccg

SEQ ID NO: 1566601 - RNA, 17 nt, Pseudomonas putida KT2440
ggcugggccccaggcgg

SEQ ID NO: 1566602 - RNA, 19 nt, Pseudomonas putida KT2440
ggcugggccccaggcggug

SEQ ID NO: 1566603 - RNA, 16 nt, Pseudomonas putida KT2440
ggcugggucacccagg

SEQ ID NO: 1566604 - RNA, 14 nt, Pseudomonas putida KT2440
ggcuucuucgugcg

SEQ ID NO: 1566605 - RNA, 17 nt, Pseudomonas putida KT2440
ggcuucguggugcuggc

SEQ ID NO: 1566606 - RNA, 21 nt, Pseudomonas putida KT2440
ggcuucguccguguucgcgag

SEQ ID NO: 1566607 - RNA, 23 nt, Pseudomonas putida KT2440
ggcuucguccguguucgcgagga

SEQ ID NO: 1566608 - RNA, 23 nt, Pseudomonas putida KT2440
ggcuugaccguuugcagcgucca

SEQ ID NO: 1566609 - RNA, 15 nt, Pseudomonas putida KT2440
gggacagccacaugc

SEQ ID NO: 1566610 - RNA, 19 nt, Pseudomonas putida KT2440
gggacagccacaugccagc

SEQ ID NO: 1566611 - RNA, 24 nt, Pseudomonas putida KT2440
gggaagugcacugccuggcucagg

SEQ ID NO: 1566612 - RNA, 15 nt, Pseudomonas putida KT2440
gggaaaccuccggca

SEQ ID NO: 1566613 - RNA, 22 nt, Pseudomonas putida KT2440
ggcuuguucagcuggugggcga

SEQ ID NO: 1566614 - RNA, 14 nt, Pseudomonas putida KT2440
ggcuuguucggcau

SEQ ID NO: 1566615 - RNA, 21 nt, Pseudomonas putida KT2440
ggcuuguucggcaucggugcu

SEQ ID NO: 1566616 - RNA, 19 nt, Pseudomonas putida KT2440
ggcuugucuuccggcaggu

SEQ ID NO: 1566617 - RNA, 18 nt, Pseudomonas putida KT2440
ggcuuguccuuguugacc

SEQ ID NO: 1566618 - RNA, 18 nt, Pseudomonas putida KT2440
ggcuuugcgucaucauca

SEQ ID NO: 1566619 - RNA, 16 nt, Pseudomonas putida KT2440
ggcuuugccauucucg

SEQ ID NO: 1566620 - RNA, 12 nt, Pseudomonas putida KT2440
ggcuuugccggc

SEQ ID NO: 1566621 - RNA, 22 nt, Pseudomonas putida KT2440
gggcagccacgcuccagucgug

SEQ ID NO: 1566622 - RNA, 19 nt, Pseudomonas putida KT2440
gggcacgcccgcucccaca

SEQ ID NO: 1566623 - RNA, 22 nt, Pseudomonas putida KT2440
gggcacgcccgcucccacagga

SEQ ID NO: 1566624 - RNA, 12 nt, Pseudomonas putida KT2440
gggaucagcacg

SEQ ID NO: 1566625 - RNA, 16 nt, Pseudomonas putida KT2440
gggauuguucccacag

SEQ ID NO: 1566626 - RNA, 19 nt, Pseudomonas putida KT2440
gggcaaagaacagcgcgga

SEQ ID NO: 1566627 - RNA, 16 nt, Pseudomonas putida KT2440
cucguuacugguggac

SEQ ID NO: 1566628 - RNA, 13 nt, Pseudomonas putida KT2440
cucuggcgugcac

SEQ ID NO: 1566629 - RNA, 16 nt, Pseudomonas putida KT2440
cucuggucaccuucgu

SEQ ID NO: 1566630 - RNA, 19 nt, Pseudomonas putida KT2440
cucuggucgaucuucagcg

SEQ ID NO: 1566631 - RNA, 17 nt, Pseudomonas putida KT2440
cucuuccaccguacccc

SEQ ID NO: 1566632 - RNA, 13 nt, Pseudomonas putida KT2440
cucuuccuggcug

SEQ ID NO: 1566633 - RNA, 16 nt, Pseudomonas putida KT2440
cucuucgaagacgccg

SEQ ID NO: 1566634 - RNA, 14 nt, Pseudomonas putida KT2440
cucuucgcgggcaa

SEQ ID NO: 1566635 - RNA, 14 nt, Pseudomonas putida KT2440
cucuucgcgggcac

SEQ ID NO: 1566636 - RNA, 19 nt, Pseudomonas putida KT2440
cucuucgcgggcaugcccg

SEQ ID NO: 1566637 - RNA, 12 nt, Pseudomonas putida KT2440
cucuucgcgggu

SEQ ID NO: 1566638 - RNA, 13 nt, Pseudomonas putida KT2440
cucuuagcgggca

SEQ ID NO: 1566639 - RNA, 22 nt, Pseudomonas putida KT2440
cucuucaccguacuugcugcag

SEQ ID NO: 1566640 - RNA, 15 nt, Pseudomonas putida KT2440
cucuucuggggugau

SEQ ID NO: 1566641 - RNA, 22 nt, Pseudomonas putida KT2440
cucuucuuucagguaacgggca

SEQ ID NO: 1566642 - RNA, 15 nt, Pseudomonas putida KT2440
cugaaacccauccac

SEQ ID NO: 1566643 - RNA, 19 nt, Pseudomonas putida KT2440
cugaacaaggccuggccca

SEQ ID NO: 1566644 - RNA, 14 nt, Pseudomonas putida KT2440
cugaacaccugcca

SEQ ID NO: 1566645 - RNA, 21 nt, Pseudomonas putida KT2440
cugaacacgcucaugaacagc

SEQ ID NO: 1566646 - RNA, 14 nt, Pseudomonas putida KT2440
cucguagagcuugg

SEQ ID NO: 1566647 - RNA, 16 nt, Pseudomonas putida KT2440
cucggucugguaaccc

SEQ ID NO: 1566648 - RNA, 17 nt, Pseudomonas putida KT2440
cucguccaggcccugca

SEQ ID NO: 1566649 - RNA, 17 nt, Pseudomonas putida KT2440
cucgguacccgccagca

SEQ ID NO: 1566650 - RNA, 18 nt, Pseudomonas putida KT2440
cucgguacccgccagcaa

SEQ ID NO: 1566651 - RNA, 13 nt, Pseudomonas putida KT2440
cucgguacgcacu

SEQ ID NO: 1566652 - RNA, 18 nt, Pseudomonas putida KT2440
cucgguaucggccagccg

SEQ ID NO: 1566653 - RNA, 19 nt, Pseudomonas putida KT2440
cucgguaucggccagccgu

SEQ ID NO: 1566654 - RNA, 15 nt, Pseudomonas putida KT2440
cucggucagguacuc

SEQ ID NO: 1566655 - RNA, 11 nt, Pseudomonas putida KT2440
cucggucaggc

SEQ ID NO: 1566656 - RNA, 14 nt, Pseudomonas putida KT2440
cucggucgccgagc

SEQ ID NO: 1566657 - RNA, 20 nt, Pseudomonas putida KT2440
cugaugccucaucaggccga

SEQ ID NO: 1566658 - RNA, 22 nt, Pseudomonas putida KT2440
cugaugcucaagcgccagggca

SEQ ID NO: 1566659 - RNA, 20 nt, Pseudomonas putida KT2440
cugaugcuucugcuucagcu

SEQ ID NO: 1566660 - RNA, 22 nt, Pseudomonas putida KT2440
cugaugcgcuggcccuugccau

SEQ ID NO: 1566661 - RNA, 15 nt, Pseudomonas putida KT2440
cugaugcggacccag

SEQ ID NO: 1566662 - RNA, 16 nt, Pseudomonas putida KT2440
cugagguucagcgcac

SEQ ID NO: 1566663 - RNA, 17 nt, Pseudomonas putida KT2440
cugcaagccggcgaaca

SEQ ID NO: 1566664 - RNA, 21 nt, Pseudomonas putida KT2440
cugcaagccggcgaacagcac

SEQ ID NO: 1566665 - RNA, 22 nt, Pseudomonas putida KT2440
cugcaagcgaugcacgccagca

SEQ ID NO: 1566666 - RNA, 19 nt, Pseudomonas putida KT2440
cugcaagcucgacaaaucc

SEQ ID NO: 1566667 - RNA, 13 nt, Pseudomonas putida KT2440
cugcaaugccgcu

SEQ ID NO: 1566668 - RNA, 19 nt, Pseudomonas putida KT2440
cugcaaucagcucacaggc

SEQ ID NO: 1566669 - RNA, 17 nt, Pseudomonas putida KT2440
cugcaaugcagccccuu

SEQ ID NO: 1566670 - RNA, 18 nt, Pseudomonas putida KT2440
cugcaauucgcuguacag

SEQ ID NO: 1566671 - RNA, 17 nt, Pseudomonas putida KT2440
cugcaccggcagcgcaa

SEQ ID NO: 1566672 - RNA, 16 nt, Pseudomonas putida KT2440
cugaugggucuugccg

SEQ ID NO: 1566673 - RNA, 14 nt, Pseudomonas putida KT2440
cugauguacaagga

SEQ ID NO: 1566674 - RNA, 17 nt, Pseudomonas putida KT2440
cugacgaacaacgccac

SEQ ID NO: 1566675 - RNA, 14 nt, Pseudomonas putida KT2440
cugaccuguucgcg

SEQ ID NO: 1566676 - RNA, 16 nt, Pseudomonas putida KT2440
cugacgcaggguagcc

SEQ ID NO: 1566677 - RNA, 13 nt, Pseudomonas putida KT2440
cugacgcaagcgc

SEQ ID NO: 1566678 - RNA, 15 nt, Pseudomonas putida KT2440
cugacgccagcgcug

SEQ ID NO: 1566679 - RNA, 15 nt, Pseudomonas putida KT2440
cugacgccgccagcg

SEQ ID NO: 1566680 - RNA, 18 nt, Pseudomonas putida KT2440
cugacgccgccagcgcuc

SEQ ID NO: 1566681 - RNA, 13 nt, Pseudomonas putida KT2440
cugaacagcgccu

SEQ ID NO: 1566682 - RNA, 23 nt, Pseudomonas putida KT2440
cugaacagcaucagccaugggca

SEQ ID NO: 1566683 - RNA, 19 nt, Pseudomonas putida KT2440
cugaagccaguacgcgccu

SEQ ID NO: 1566684 - RNA, 14 nt, Pseudomonas putida KT2440
cugaaggugcugua

SEQ ID NO: 1566685 - RNA, 15 nt, Pseudomonas putida KT2440
cugacgcgccagguc

SEQ ID NO: 1566686 - RNA, 20 nt, Pseudomonas putida KT2440
cugacgcgccaggucuuccu

SEQ ID NO: 1566687 - RNA, 19 nt, Pseudomonas putida KT2440
cugagcagguuguccaccg

SEQ ID NO: 1566688 - RNA, 15 nt, Pseudomonas putida KT2440
cugagcuaacgaccc

SEQ ID NO: 1566689 - RNA, 22 nt, Pseudomonas putida KT2440
cugagcaccacauacggcgcac

SEQ ID NO: 1566690 - RNA, 18 nt, Pseudomonas putida KT2440
cucccgcgcaugcugcca

SEQ ID NO: 1566691 - RNA, 15 nt, Pseudomonas putida KT2440
cuccccaucagcagc

SEQ ID NO: 1566692 - RNA, 21 nt, Pseudomonas putida KT2440
cuccggguacuucucgaccag

SEQ ID NO: 1566693 - RNA, 16 nt, Pseudomonas putida KT2440
cuccgggucaggccga

SEQ ID NO: 1566694 - RNA, 14 nt, Pseudomonas putida KT2440
cuccgggugcuccu

SEQ ID NO: 1566695 - RNA, 17 nt, Pseudomonas putida KT2440
cuccgucugcucugcca

SEQ ID NO: 1566696 - RNA, 17 nt, Pseudomonas putida KT2440
cuccucaccgcaggcau

SEQ ID NO: 1566697 - RNA, 23 nt, Pseudomonas putida KT2440
cuccuacaagguaccccaccggc

SEQ ID NO: 1566698 - RNA, 20 nt, Pseudomonas putida KT2440
cuccuacacgcggccugugc

SEQ ID NO: 1566699 - RNA, 18 nt, Pseudomonas putida KT2440
cuccuacgaaagccgcgu

SEQ ID NO: 1566700 - RNA, 20 nt, Pseudomonas putida KT2440
cuccuacggaaucugcaccg

SEQ ID NO: 1566701 - RNA, 18 nt, Pseudomonas putida KT2440
cuccuacgggggggcgca

SEQ ID NO: 1566702 - RNA, 20 nt, Pseudomonas putida KT2440
cuccugcaacccgucagugc

SEQ ID NO: 1566703 - RNA, 17 nt, Pseudomonas putida KT2440
cuccuggguaacccgcu

SEQ ID NO: 1566704 - RNA, 14 nt, Pseudomonas putida KT2440
cucgaccaagccug

SEQ ID NO: 1566705 - RNA, 18 nt, Pseudomonas putida KT2440
cucgacaagccgcugggc

SEQ ID NO: 1566706 - RNA, 14 nt, Pseudomonas putida KT2440
cucgacaacccgcg

SEQ ID NO: 1566707 - RNA, 16 nt, Pseudomonas putida KT2440
cucgacguugagccag

SEQ ID NO: 1566708 - RNA, 19 nt, Pseudomonas putida KT2440
cucgacccgcuggcgaccg

SEQ ID NO: 1566709 - RNA, 19 nt, Pseudomonas putida KT2440
cucgacccgucgcugccaa

SEQ ID NO: 1566710 - RNA, 16 nt, Pseudomonas putida KT2440
cucgaccgccgcacag

SEQ ID NO: 1566711 - RNA, 18 nt, Pseudomonas putida KT2440
cucgacccacggcugaac

SEQ ID NO: 1566712 - RNA, 14 nt, Pseudomonas putida KT2440
cucgacccagccac

SEQ ID NO: 1566713 - RNA, 20 nt, Pseudomonas putida KT2440
cucgacccccuugccagcau

SEQ ID NO: 1566714 - RNA, 20 nt, Pseudomonas putida KT2440
cucgacccgcccgccaugca

SEQ ID NO: 1566715 - RNA, 21 nt, Pseudomonas putida KT2440
cucgacccgccgguugcgcag

SEQ ID NO: 1566716 - RNA, 16 nt, Pseudomonas putida KT2440
cucgaccagaucagcc

SEQ ID NO: 1566717 - RNA, 14 nt, Pseudomonas putida KT2440
cucgaccagcgcca

SEQ ID NO: 1566718 - RNA, 21 nt, Pseudomonas putida KT2440
cucgaucaacgugguaaugcg

SEQ ID NO: 1566719 - RNA, 17 nt, Pseudomonas putida KT2440
cucgaucccgccgccag

SEQ ID NO: 1566720 - RNA, 18 nt, Pseudomonas putida KT2440
cucgaucccgccgccaga

SEQ ID NO: 1566721 - RNA, 21 nt, Pseudomonas putida KT2440
cucgaugcggucuuccagcgg

SEQ ID NO: 1566722 - RNA, 13 nt, Pseudomonas putida KT2440
cucgaugcugcgu

SEQ ID NO: 1566723 - RNA, 14 nt, Pseudomonas putida KT2440
cucgauggccagga

SEQ ID NO: 1566724 - RNA, 19 nt, Pseudomonas putida KT2440
cucgaugcaauccgccaca

SEQ ID NO: 1566725 - RNA, 23 nt, Pseudomonas putida KT2440
cucgaugccuuugcaaagcgcac

SEQ ID NO: 1566726 - RNA, 22 nt, Pseudomonas putida KT2440
cucgaucuugccuucggccaca

SEQ ID NO: 1566727 - RNA, 16 nt, Pseudomonas putida KT2440
cucggcgagccgccag

SEQ ID NO: 1566728 - RNA, 19 nt, Pseudomonas putida KT2440
cucgggaauuguacgaccc

SEQ ID NO: 1566729 - RNA, 18 nt, Pseudomonas putida KT2440
cucggcguagcagguacg

SEQ ID NO: 1566730 - RNA, 14 nt, Pseudomonas putida KT2440
cucggcuacgaacc

SEQ ID NO: 1566731 - RNA, 14 nt, Pseudomonas putida KT2440
cucgcgcauggccg

SEQ ID NO: 1566732 - RNA, 21 nt, Pseudomonas putida KT2440
cucgcgccuugaggaccuugc

SEQ ID NO: 1566733 - RNA, 22 nt, Pseudomonas putida KT2440
cucgccguacucggucugguaa

SEQ ID NO: 1566734 - RNA, 17 nt, Pseudomonas putida KT2440
cucgccggguuccacca

SEQ ID NO: 1566735 - RNA, 20 nt, Pseudomonas putida KT2440
cucgauuuccaccggcuugc

SEQ ID NO: 1566736 - RNA, 15 nt, Pseudomonas putida KT2440
cucgcgguggaucgc

SEQ ID NO: 1566737 - RNA, 14 nt, Pseudomonas putida KT2440
cucgcgcugcgcag

SEQ ID NO: 1566738 - RNA, 18 nt, Pseudomonas putida KT2440
cucgcgcugcgcagccaa

SEQ ID NO: 1566739 - RNA, 16 nt, Pseudomonas putida KT2440
cucgcgcuuuucaucu

SEQ ID NO: 1566740 - RNA, 19 nt, Pseudomonas putida KT2440
cucgcucaggcgcagcgca

SEQ ID NO: 1566741 - RNA, 20 nt, Pseudomonas putida KT2440
cucggccacaucggcaaguu

SEQ ID NO: 1566742 - RNA, 18 nt, Pseudomonas putida KT2440
cucggccaccuggccuuc

SEQ ID NO: 1566743 - RNA, 18 nt, Pseudomonas putida KT2440
cucggcauguucaucacc

SEQ ID NO: 1566744 - RNA, 20 nt, Pseudomonas putida KT2440
cucgcugucguccagcucgc

SEQ ID NO: 1566745 - RNA, 21 nt, Pseudomonas putida KT2440
cucgcuuuccaaaccugcgac

SEQ ID NO: 1566746 - RNA, 20 nt, Pseudomonas putida KT2440
cucgcuuuccuugcacgcga

SEQ ID NO: 1566747 - RNA, 18 nt, Pseudomonas putida KT2440
cuccacggcaaucggcag

SEQ ID NO: 1566748 - RNA, 14 nt, Pseudomonas putida KT2440
cuccacugugcccg

SEQ ID NO: 1566749 - RNA, 24 nt, Pseudomonas putida KT2440
cuccacugugcccgccaggcgcaa

SEQ ID NO: 1566750 - RNA, 17 nt, Pseudomonas putida KT2440
cuccagcaacugcgccg

SEQ ID NO: 1566751 - RNA, 23 nt, Pseudomonas putida KT2440
cuccaggugaaucagcggcaggc

SEQ ID NO: 1566752 - RNA, 14 nt, Pseudomonas putida KT2440
cuccaggugcacca

SEQ ID NO: 1566753 - RNA, 19 nt, Pseudomonas putida KT2440
cuccaggugcaccaacacu

SEQ ID NO: 1566754 - RNA, 15 nt, Pseudomonas putida KT2440
cuccagcacccgcuu

SEQ ID NO: 1566755 - RNA, 18 nt, Pseudomonas putida KT2440
cuccagguggaucggcgu

SEQ ID NO: 1566756 - RNA, 14 nt, Pseudomonas putida KT2440
cuccagcacccgcu

SEQ ID NO: 1566757 - RNA, 16 nt, Pseudomonas putida KT2440
cuccaguuguugggca

SEQ ID NO: 1566758 - RNA, 23 nt, Pseudomonas putida KT2440
cuccccaccaucaauacgcugga

SEQ ID NO: 1566759 - RNA, 17 nt, Pseudomonas putida KT2440
cucauaaugcuccgcca

SEQ ID NO: 1566760 - RNA, 16 nt, Pseudomonas putida KT2440
cucaucaccggcguug

SEQ ID NO: 1566761 - RNA, 13 nt, Pseudomonas putida KT2440
cucaucaccucgg

SEQ ID NO: 1566762 - RNA, 17 nt, Pseudomonas putida KT2440
cucaucacucuugcgcc

SEQ ID NO: 1566763 - RNA, 19 nt, Pseudomonas putida KT2440
cucauagcuuucaggcgca

SEQ ID NO: 1566764 - RNA, 20 nt, Pseudomonas putida KT2440
cucauacccuuugccaucca

SEQ ID NO: 1566765 - RNA, 20 nt, Pseudomonas putida KT2440
cucauaguaaggcuggucgc

SEQ ID NO: 1566766 - RNA, 16 nt, Pseudomonas putida KT2440
cuccaaccccagcgca

SEQ ID NO: 1566767 - RNA, 23 nt, Pseudomonas putida KT2440
cuccaacaaucgcgucagcaccg

SEQ ID NO: 1566768 - RNA, 16 nt, Pseudomonas putida KT2440
cuccaagugccgugca

SEQ ID NO: 1566769 - RNA, 17 nt, Pseudomonas putida KT2440
cucaucaggccgaaggc

SEQ ID NO: 1566770 - RNA, 19 nt, Pseudomonas putida KT2440
cucaucaccaggcccgcaa

SEQ ID NO: 1566771 - RNA, 14 nt, Pseudomonas putida KT2440
cuccacccaccuug

SEQ ID NO: 1566772 - RNA, 16 nt, Pseudomonas putida KT2440
cuccaccaggccacgu

SEQ ID NO: 1566773 - RNA, 20 nt, Pseudomonas putida KT2440
cuccaccagcggcucgcuca

SEQ ID NO: 1566774 - RNA, 16 nt, Pseudomonas putida KT2440
cuccacacucgacgcu

SEQ ID NO: 1566775 - RNA, 21 nt, Pseudomonas putida KT2440
cuccaccgauccuuggcgaag

SEQ ID NO: 1566776 - RNA, 18 nt, Pseudomonas putida KT2440
cucagaaucagcuugcca

SEQ ID NO: 1566777 - RNA, 22 nt, Pseudomonas putida KT2440
cucacgcaacucuaccucacug

SEQ ID NO: 1566778 - RNA, 23 nt, Pseudomonas putida KT2440
cucacgcauggccgaggucuggu

SEQ ID NO: 1566779 - RNA, 20 nt, Pseudomonas putida KT2440
cucacuggcauccagcgcca

SEQ ID NO: 1566780 - RNA, 23 nt, Pseudomonas putida KT2440
cucagcacauucagcagcgccug

SEQ ID NO: 1566781 - RNA, 19 nt, Pseudomonas putida KT2440
cucagccacgcuggcaccc

SEQ ID NO: 1566782 - RNA, 16 nt, Pseudomonas putida KT2440
cucagcaacugggcaa

SEQ ID NO: 1566783 - RNA, 23 nt, Pseudomonas putida KT2440
cucagcgugacgauggccaccag

SEQ ID NO: 1566784 - RNA, 23 nt, Pseudomonas putida KT2440
cucagcucuucaucccugaccga

SEQ ID NO: 1566785 - RNA, 13 nt, Pseudomonas putida KT2440
cucagcugcugcu

SEQ ID NO: 1566786 - RNA, 11 nt, Pseudomonas putida KT2440
cucaggcgcuc

SEQ ID NO: 1566787 - RNA, 22 nt, Pseudomonas putida KT2440
cucaggcgcuccagcagggucg

SEQ ID NO: 1566788 - RNA, 19 nt, Pseudomonas putida KT2440
cucaggcgcagcgcaugcu

SEQ ID NO: 1566789 - RNA, 14 nt, Pseudomonas putida KT2440
cucaggccuucgcc

SEQ ID NO: 1566790 - RNA, 21 nt, Pseudomonas putida KT2440
cucaggccuucgccacugcca

SEQ ID NO: 1566791 - RNA, 21 nt, Pseudomonas putida KT2440
cucaggccuugcucgaaugcc

SEQ ID NO: 1566792 - RNA, 19 nt, Pseudomonas putida KT2440
cucaccugguaccccucga

SEQ ID NO: 1566793 - RNA, 19 nt, Pseudomonas putida KT2440
cucaccuuaucggccggca

SEQ ID NO: 1566794 - RNA, 19 nt, Pseudomonas putida KT2440
cucaccgcagcccagcgcc

SEQ ID NO: 1566795 - RNA, 13 nt, Pseudomonas putida KT2440
cuauuuaccuguc

SEQ ID NO: 1566796 - RNA, 20 nt, Pseudomonas putida KT2440
cuaccugugggagcgggcgu

SEQ ID NO: 1566797 - RNA, 15 nt, Pseudomonas putida KT2440
cuacgcaaggugcca

SEQ ID NO: 1566798 - RNA, 18 nt, Pseudomonas putida KT2440
cuacgagacgguggcugc

SEQ ID NO: 1566799 - RNA, 14 nt, Pseudomonas putida KT2440
cuacgcacccgcac

SEQ ID NO: 1566800 - RNA, 16 nt, Pseudomonas putida KT2440
cuacgccggccaaggu

SEQ ID NO: 1566801 - RNA, 17 nt, Pseudomonas putida KT2440
cuacgcgccagcaugga

SEQ ID NO: 1566802 - RNA, 21 nt, Pseudomonas putida KT2440
cuacgcgagccaccgucgaac

SEQ ID NO: 1566803 - RNA, 19 nt, Pseudomonas putida KT2440
cuacggcgucgacaccguu

SEQ ID NO: 1566804 - RNA, 17 nt, Pseudomonas putida KT2440
cuacggcgggccaucug

SEQ ID NO: 1566805 - RNA, 16 nt, Pseudomonas putida KT2440
cuagcuaucucaagcc

SEQ ID NO: 1566806 - RNA, 16 nt, Pseudomonas putida KT2440
cuauggggugagcggc

SEQ ID NO: 1566807 - RNA, 20 nt, Pseudomonas putida KT2440
cuauguacucggcgcucaag

SEQ ID NO: 1566808 - RNA, 17 nt, Pseudomonas putida KT2440
cuaucgccagcaggccg

SEQ ID NO: 1566809 - RNA, 18 nt, Pseudomonas putida KT2440
cuaucgcucuggcacuca

SEQ ID NO: 1566810 - RNA, 17 nt, Pseudomonas putida KT2440
cuaucgaggggcaggcg

SEQ ID NO: 1566811 - RNA, 20 nt, Pseudomonas putida KT2440
cuauccugugggagcgggcu

SEQ ID NO: 1566812 - RNA, 18 nt, Pseudomonas putida KT2440
cuaccaacgcagcaugcg

SEQ ID NO: 1566813 - RNA, 19 nt, Pseudomonas putida KT2440
cuaccaacgcagcaugcgg

SEQ ID NO: 1566814 - RNA, 22 nt, Pseudomonas putida KT2440
cuacccccuccuccagcauggc

SEQ ID NO: 1566815 - RNA, 15 nt, Pseudomonas putida KT2440
cuacccagccgggca

SEQ ID NO: 1566816 - RNA, 13 nt, Pseudomonas putida KT2440
cuacccaggcaac

SEQ ID NO: 1566817 - RNA, 18 nt, Pseudomonas putida KT2440
cuaccacguuauccagcu

SEQ ID NO: 1566818 - RNA, 13 nt, Pseudomonas putida KT2440
cuaagcgccagca

SEQ ID NO: 1566819 - RNA, 21 nt, Pseudomonas putida KT2440
cuaaguuugcccagcgcugca

SEQ ID NO: 1566820 - RNA, 15 nt, Pseudomonas putida KT2440
cguugcugguguggc

SEQ ID NO: 1566821 - RNA, 23 nt, Pseudomonas putida KT2440
cguugcccccagccggucaucca

SEQ ID NO: 1566822 - RNA, 21 nt, Pseudomonas putida KT2440
cguugccagaaaaguuggcca

SEQ ID NO: 1566823 - RNA, 20 nt, Pseudomonas putida KT2440
cguugcagucguuguccagg

SEQ ID NO: 1566824 - RNA, 12 nt, Pseudomonas putida KT2440
cguugcagccau

SEQ ID NO: 1566825 - RNA, 16 nt, Pseudomonas putida KT2440
cguugaucagcgacac

SEQ ID NO: 1566826 - RNA, 14 nt, Pseudomonas putida KT2440
cguugaugcgugau

SEQ ID NO: 1566827 - RNA, 19 nt, Pseudomonas putida KT2440
cgugcucguccuugccguc

SEQ ID NO: 1566828 - RNA, 15 nt, Pseudomonas putida KT2440
cgugcucggcacugc

SEQ ID NO: 1566829 - RNA, 22 nt, Pseudomonas putida KT2440
cguucccgccauguugcgcagc

SEQ ID NO: 1566830 - RNA, 15 nt, Pseudomonas putida KT2440
cguggaacaacggcu

SEQ ID NO: 1566831 - RNA, 17 nt, Pseudomonas putida KT2440
cguggaaaaggcgcugu

SEQ ID NO: 1566832 - RNA, 16 nt, Pseudomonas putida KT2440
cguuccugggcguucu

SEQ ID NO: 1566833 - RNA, 20 nt, Pseudomonas putida KT2440
cguucggguugauggucuug

SEQ ID NO: 1566834 - RNA, 15 nt, Pseudomonas putida KT2440
cguucgguguccuug

SEQ ID NO: 1566835 - RNA, 20 nt, Pseudomonas putida KT2440
cguuucggcggccugcagcu

SEQ ID NO: 1566836 - RNA, 14 nt, Pseudomonas putida KT2440
cguuuggcagugcc

SEQ ID NO: 1566837 - RNA, 14 nt, Pseudomonas putida KT2440
cguuugcuggccug

SEQ ID NO: 1566838 - RNA, 17 nt, Pseudomonas putida KT2440
cuaaaucgaccugcagg

SEQ ID NO: 1566839 - RNA, 20 nt, Pseudomonas putida KT2440
cuaaagccgcaccuacaggg

SEQ ID NO: 1566840 - RNA, 15 nt, Pseudomonas putida KT2440
cguuguaagccauga

SEQ ID NO: 1566841 - RNA, 23 nt, Pseudomonas putida KT2440
cguuguagcgcgguccggugaua

SEQ ID NO: 1566842 - RNA, 12 nt, Pseudomonas putida KT2440
cguuguccagca

SEQ ID NO: 1566843 - RNA, 14 nt, Pseudomonas putida KT2440
cguugguggugcgc

SEQ ID NO: 1566844 - RNA, 14 nt, Pseudomonas putida KT2440
cguugguguccuug

SEQ ID NO: 1566845 - RNA, 15 nt, Pseudomonas putida KT2440
cguuguccgacagcu

SEQ ID NO: 1566846 - RNA, 13 nt, Pseudomonas putida KT2440
cguugucgacugc

SEQ ID NO: 1566847 - RNA, 15 nt, Pseudomonas putida KT2440
cguugucgacugcac

SEQ ID NO: 1566848 - RNA, 21 nt, Pseudomonas putida KT2440
cguugucgccuuucaggucga

SEQ ID NO: 1566849 - RNA, 23 nt, Pseudomonas putida KT2440
cguuucauucaagaaugcccggg

SEQ ID NO: 1566850 - RNA, 23 nt, Pseudomonas putida KT2440
cgucguccgcagucccguuggcc

SEQ ID NO: 1566851 - RNA, 20 nt, Pseudomonas putida KT2440
cgucgucauguucguucggc

SEQ ID NO: 1566852 - RNA, 15 nt, Pseudomonas putida KT2440
cgucgucagcuuccg

SEQ ID NO: 1566853 - RNA, 21 nt, Pseudomonas putida KT2440
cgucguggccuucgcgggcuc

SEQ ID NO: 1566854 - RNA, 15 nt, Pseudomonas putida KT2440
cgucuggcgcggcac

SEQ ID NO: 1566855 - RNA, 20 nt, Pseudomonas putida KT2440
cgucuucgggugagcgcgau

SEQ ID NO: 1566856 - RNA, 18 nt, Pseudomonas putida KT2440
cgucuggacugggaaacc

SEQ ID NO: 1566857 - RNA, 17 nt, Pseudomonas putida KT2440
cgucugccgcagccccg

SEQ ID NO: 1566858 - RNA, 15 nt, Pseudomonas putida KT2440
cgucucgaacggcgc

SEQ ID NO: 1566859 - RNA, 17 nt, Pseudomonas putida KT2440
cgucgguuuccucgacg

SEQ ID NO: 1566860 - RNA, 18 nt, Pseudomonas putida KT2440
cgucgguuuccucgacgc

SEQ ID NO: 1566861 - RNA, 17 nt, Pseudomonas putida KT2440
cgugccugcugcucgcu

SEQ ID NO: 1566862 - RNA, 13 nt, Pseudomonas putida KT2440
cgugccugguugc

SEQ ID NO: 1566863 - RNA, 15 nt, Pseudomonas putida KT2440
cgugccuucaccagc

SEQ ID NO: 1566864 - RNA, 14 nt, Pseudomonas putida KT2440
cgugccuuccagcu

SEQ ID NO: 1566865 - RNA, 15 nt, Pseudomonas putida KT2440
cgugcggggcaucgc

SEQ ID NO: 1566866 - RNA, 16 nt, Pseudomonas putida KT2440
cgugcucaggcggcca

SEQ ID NO: 1566867 - RNA, 17 nt, Pseudomonas putida KT2440
cgugcuacgcgcggggu

SEQ ID NO: 1566868 - RNA, 19 nt, Pseudomonas putida KT2440
cgugcaggcggcgacaacc

SEQ ID NO: 1566869 - RNA, 20 nt, Pseudomonas putida KT2440
cgugcaggggucugugcagc

SEQ ID NO: 1566870 - RNA, 15 nt, Pseudomonas putida KT2440
cgugcaggucagcgu

SEQ ID NO: 1566871 - RNA, 17 nt, Pseudomonas putida KT2440
cgugccgucgagcaggu

SEQ ID NO: 1566872 - RNA, 16 nt, Pseudomonas putida KT2440
cgugccucgcccaggu

SEQ ID NO: 1566873 - RNA, 20 nt, Pseudomonas putida KT2440
cgugccucgcgcauggccgc

SEQ ID NO: 1566874 - RNA, 18 nt, Pseudomonas putida KT2440
cgugauagaccugcaagu

SEQ ID NO: 1566875 - RNA, 23 nt, Pseudomonas putida KT2440
cgugauagauaucaagcaugcgu

SEQ ID NO: 1566876 - RNA, 23 nt, Pseudomonas putida KT2440
cgucuuugagggucagcuggccu

SEQ ID NO: 1566877 - RNA, 23 nt, Pseudomonas putida KT2440
cgugaagucgguggucaccagca

SEQ ID NO: 1566878 - RNA, 15 nt, Pseudomonas putida KT2440
cgugacggcgauggc

SEQ ID NO: 1566879 - RNA, 17 nt, Pseudomonas putida KT2440
cgugaggugcgcuucaa

SEQ ID NO: 1566880 - RNA, 23 nt, Pseudomonas putida KT2440
cgucagucgccaaccgccagcag

SEQ ID NO: 1566881 - RNA, 12 nt, Pseudomonas putida KT2440
cgucaucacccg

SEQ ID NO: 1566882 - RNA, 16 nt, Pseudomonas putida KT2440
cgucccagcaggcaca

SEQ ID NO: 1566883 - RNA, 12 nt, Pseudomonas putida KT2440
cguccauggcgc

SEQ ID NO: 1566884 - RNA, 17 nt, Pseudomonas putida KT2440
cgucccugcccgaucgc

SEQ ID NO: 1566885 - RNA, 18 nt, Pseudomonas putida KT2440
cguccuugccguccaggu

SEQ ID NO: 1566886 - RNA, 21 nt, Pseudomonas putida KT2440
cguccuugccguccaggucca

SEQ ID NO: 1566887 - RNA, 17 nt, Pseudomonas putida KT2440
cguccuugacgaugacc

SEQ ID NO: 1566888 - RNA, 15 nt, Pseudomonas putida KT2440
cguccuggguaauca

SEQ ID NO: 1566889 - RNA, 16 nt, Pseudomonas putida KT2440
cguccuggucacggcc

SEQ ID NO: 1566890 - RNA, 22 nt, Pseudomonas putida KT2440
cgucgacaaaccgcacccggcu

SEQ ID NO: 1566891 - RNA, 16 nt, Pseudomonas putida KT2440
cgucgagccgggucca

SEQ ID NO: 1566892 - RNA, 23 nt, Pseudomonas putida KT2440
cgucgagccggguccacccggua

SEQ ID NO: 1566893 - RNA, 11 nt, Pseudomonas putida KT2440
cgucgccugca

SEQ ID NO: 1566894 - RNA, 14 nt, Pseudomonas putida KT2440
cgucgcgcuggccg

SEQ ID NO: 1566895 - RNA, 14 nt, Pseudomonas putida KT2440
cgucgccagcggca

SEQ ID NO: 1566896 - RNA, 16 nt, Pseudomonas putida KT2440
cgucgccagcggcaaa

SEQ ID NO: 1566897 - RNA, 13 nt, Pseudomonas putida KT2440
cgucgcuucaucg

SEQ ID NO: 1566898 - RNA, 19 nt, Pseudomonas putida KT2440
cgucgcuucaucggcuggc

SEQ ID NO: 1566899 - RNA, 15 nt, Pseudomonas putida KT2440
cgucgcuggccagcu

SEQ ID NO: 1566900 - RNA, 15 nt, Pseudomonas putida KT2440
cgucggcaccggcga

SEQ ID NO: 1566901 - RNA, 18 nt, Pseudomonas putida KT2440
cgucggcaccggcgacgc

SEQ ID NO: 1566902 - RNA, 16 nt, Pseudomonas putida KT2440
cgucggcagccaugcu

SEQ ID NO: 1566903 - RNA, 15 nt, Pseudomonas putida KT2440
cgucggcagagcgcc

SEQ ID NO: 1566904 - RNA, 17 nt, Pseudomonas putida KT2440
cgucggcagagcgccag

SEQ ID NO: 1566905 - RNA, 19 nt, Pseudomonas putida KT2440
cgucggcagagcgccagca

SEQ ID NO: 1566906 - RNA, 20 nt, Pseudomonas putida KT2440
cgucggcagagcgccagcau

SEQ ID NO: 1566907 - RNA, 11 nt, Pseudomonas putida KT2440
cgucggcaccg

SEQ ID NO: 1566908 - RNA, 15 nt, Pseudomonas putida KT2440
cgucacggcgcgggu

SEQ ID NO: 1566909 - RNA, 14 nt, Pseudomonas putida KT2440
cgucaccgugcacg

SEQ ID NO: 1566910 - RNA, 22 nt, Pseudomonas putida KT2440
cgucaccgucaucgggaacucg

SEQ ID NO: 1566911 - RNA, 17 nt, Pseudomonas putida KT2440
cgucaccgcugccgauc

SEQ ID NO: 1566912 - RNA, 20 nt, Pseudomonas putida KT2440
cgucagcggcaacaccagca

SEQ ID NO: 1566913 - RNA, 13 nt, Pseudomonas putida KT2440
cgucagcuugcaa

SEQ ID NO: 1566914 - RNA, 18 nt, Pseudomonas putida KT2440
cgucacugcagaucacca

SEQ ID NO: 1566915 - RNA, 15 nt, Pseudomonas putida KT2440
cgucacuggcugcug

SEQ ID NO: 1566916 - RNA, 17 nt, Pseudomonas putida KT2440
cgucacuggcugcugcg

SEQ ID NO: 1566917 - RNA, 16 nt, Pseudomonas putida KT2440
cgucacugaugcgcca

SEQ ID NO: 1566918 - RNA, 21 nt, Pseudomonas putida KT2440
cgucacaucgguuucgccggu

SEQ ID NO: 1566919 - RNA, 14 nt, Pseudomonas putida KT2440
cgucacaugcgcca

SEQ ID NO: 1566920 - RNA, 15 nt, Pseudomonas putida KT2440
cgucaauuguugucc

SEQ ID NO: 1566921 - RNA, 19 nt, Pseudomonas putida KT2440
cguagcacaagggccaggu

SEQ ID NO: 1566922 - RNA, 18 nt, Pseudomonas putida KT2440
cguagaugccguaguagc

SEQ ID NO: 1566923 - RNA, 22 nt, Pseudomonas putida KT2440
cguacccgccaccccaggccac

SEQ ID NO: 1566924 - RNA, 23 nt, Pseudomonas putida KT2440
cguacaucggguaagccaugcgc

SEQ ID NO: 1566925 - RNA, 15 nt, Pseudomonas putida KT2440
cguacaucagccucg

SEQ ID NO: 1566926 - RNA, 20 nt, Pseudomonas putida KT2440
cggugugcucggcgaugccg

SEQ ID NO: 1566927 - RNA, 13 nt, Pseudomonas putida KT2440
cgguguggcaaau

SEQ ID NO: 1566928 - RNA, 14 nt, Pseudomonas putida KT2440
cggugugggcgaag

SEQ ID NO: 1566929 - RNA, 14 nt, Pseudomonas putida KT2440
cgguuaagcgccac

SEQ ID NO: 1566930 - RNA, 16 nt, Pseudomonas putida KT2440
cgguuaagcgccacca

SEQ ID NO: 1566931 - RNA, 20 nt, Pseudomonas putida KT2440
cgguugaccagggcgucgaa

SEQ ID NO: 1566932 - RNA, 17 nt, Pseudomonas putida KT2440
cgguucuggucacccag

SEQ ID NO: 1566933 - RNA, 15 nt, Pseudomonas putida KT2440
cgguuucucacagcg

SEQ ID NO: 1566934 - RNA, 23 nt, Pseudomonas putida KT2440
cgguuucguaagcgcugcgcagg

SEQ ID NO: 1566935 - RNA, 13 nt, Pseudomonas putida KT2440
cgguuugcuccgc

SEQ ID NO: 1566936 - RNA, 20 nt, Pseudomonas putida KT2440
cguacacugcaggagcgggc

SEQ ID NO: 1566937 - RNA, 21 nt, Pseudomonas putida KT2440
cguacacugcaggagcgggca

SEQ ID NO: 1566938 - RNA, 21 nt, Pseudomonas putida KT2440
cgguuuguccuggccgaugcg

SEQ ID NO: 1566939 - RNA, 13 nt, Pseudomonas putida KT2440
cggugaugcgcac

SEQ ID NO: 1566940 - RNA, 21 nt, Pseudomonas putida KT2440
cggugaugcgcccuucgcgga

SEQ ID NO: 1566941 - RNA, 16 nt, Pseudomonas putida KT2440
cggugaguaaagccgc

SEQ ID NO: 1566942 - RNA, 12 nt, Pseudomonas putida KT2440
cggugacgaccu

SEQ ID NO: 1566943 - RNA, 23 nt, Pseudomonas putida KT2440
cggugccgccugggucaggcgua

SEQ ID NO: 1566944 - RNA, 22 nt, Pseudomonas putida KT2440
cggugccgaagucauccauggc

SEQ ID NO: 1566945 - RNA, 17 nt, Pseudomonas putida KT2440
cggugcccuugccgccc

SEQ ID NO: 1566946 - RNA, 12 nt, Pseudomonas putida KT2440
cggugcagaccu

SEQ ID NO: 1566947 - RNA, 17 nt, Pseudomonas putida KT2440
cggugccaauaaccggc

SEQ ID NO: 1566948 - RNA, 19 nt, Pseudomonas putida KT2440
cggugccaauaaccggcac

SEQ ID NO: 1566949 - RNA, 16 nt, Pseudomonas putida KT2440
cggugcacccacuggc

SEQ ID NO: 1566950 - RNA, 18 nt, Pseudomonas putida KT2440
cggugcagaacguacugg

SEQ ID NO: 1566951 - RNA, 20 nt, Pseudomonas putida KT2440
cggugcacggccugcaucca

SEQ ID NO: 1566952 - RNA, 19 nt, Pseudomonas putida KT2440
cgguggaaauuggccagca

SEQ ID NO: 1566953 - RNA, 14 nt, Pseudomonas putida KT2440
cgguggcggcagca

SEQ ID NO: 1566954 - RNA, 15 nt, Pseudomonas putida KT2440
cgguggcggccagcg

SEQ ID NO: 1566955 - RNA, 23 nt, Pseudomonas putida KT2440
cgguggcgccuugauuaccagcg

SEQ ID NO: 1566956 - RNA, 15 nt, Pseudomonas putida KT2440
cgguggccugagccg

SEQ ID NO: 1566957 - RNA, 19 nt, Pseudomonas putida KT2440
cgguggcugccagcgcgcu

SEQ ID NO: 1566958 - RNA, 22 nt, Pseudomonas putida KT2440
cgguggcugccagcgcgcugcg

SEQ ID NO: 1566959 - RNA, 20 nt, Pseudomonas putida KT2440
cggugggcaacagcugcgcg

SEQ ID NO: 1566960 - RNA, 19 nt, Pseudomonas putida KT2440
cgguggcucuccucuccca

SEQ ID NO: 1566961 - RNA, 23 nt, Pseudomonas putida KT2440
cggugccggcagcucgcgcugcg

SEQ ID NO: 1566962 - RNA, 12 nt, Pseudomonas putida KT2440
cggugcgcugcu

SEQ ID NO: 1566963 - RNA, 15 nt, Pseudomonas putida KT2440
cggugcugccgaggc

SEQ ID NO: 1566964 - RNA, 21 nt, Pseudomonas putida KT2440
cggugcguaggagcgggucua

SEQ ID NO: 1566965 - RNA, 22 nt, Pseudomonas putida KT2440
cggugcguacucgaccacuguc

SEQ ID NO: 1566966 - RNA, 15 nt, Pseudomonas putida KT2440
cggugcucaggcuca

SEQ ID NO: 1566967 - RNA, 19 nt, Pseudomonas putida KT2440
cggugcggcgacagggcga

SEQ ID NO: 1566968 - RNA, 20 nt, Pseudomonas putida KT2440
cggugcggcgacagggcgaa

SEQ ID NO: 1566969 - RNA, 15 nt, Pseudomonas putida KT2440
cugucgucagcucag

SEQ ID NO: 1566970 - RNA, 21 nt, Pseudomonas putida KT2440
cugucgagcuuggcguccaca

SEQ ID NO: 1566971 - RNA, 18 nt, Pseudomonas putida KT2440
cugucgaacaggcugccg

SEQ ID NO: 1566972 - RNA, 21 nt, Pseudomonas putida KT2440
cugucgaacaggcugccgcgg

SEQ ID NO: 1566973 - RNA, 18 nt, Pseudomonas putida KT2440
cuguccgggcucgucacg

SEQ ID NO: 1566974 - RNA, 21 nt, Pseudomonas putida KT2440
cuguccgggcucgucacgggu

SEQ ID NO: 1566975 - RNA, 17 nt, Pseudomonas putida KT2440
cuguccuggguuacggc

SEQ ID NO: 1566976 - RNA, 13 nt, Pseudomonas putida KT2440
cugucagcgccag

SEQ ID NO: 1566977 - RNA, 22 nt, Pseudomonas putida KT2440
cugucaaucuugcgcacgcgcu

SEQ ID NO: 1566978 - RNA, 15 nt, Pseudomonas putida KT2440
cugucacccgcugca

SEQ ID NO: 1566979 - RNA, 19 nt, Pseudomonas putida KT2440
cugucacccgcugcacguc

SEQ ID NO: 1566980 - RNA, 16 nt, Pseudomonas putida KT2440
cugucacccuugggca

SEQ ID NO: 1566981 - RNA, 22 nt, Pseudomonas putida KT2440
cugucacccuugggcaccagcu

SEQ ID NO: 1566982 - RNA, 17 nt, Pseudomonas putida KT2440
cuguauggcgucugcgu

SEQ ID NO: 1566983 - RNA, 11 nt, Pseudomonas putida KT2440
cuggucgaccg

SEQ ID NO: 1566984 - RNA, 20 nt, Pseudomonas putida KT2440
cuggucgaaggucaggcgcg

SEQ ID NO: 1566985 - RNA, 16 nt, Pseudomonas putida KT2440
cuggucgaaugcgugc

SEQ ID NO: 1566986 - RNA, 20 nt, Pseudomonas putida KT2440
cuggucgaaugcgugcaacg

SEQ ID NO: 1566987 - RNA, 16 nt, Pseudomonas putida KT2440
cuguggguaacccugc

SEQ ID NO: 1566988 - RNA, 13 nt, Pseudomonas putida KT2440
cuguggggcugac

SEQ ID NO: 1566989 - RNA, 15 nt, Pseudomonas putida KT2440
cugugggagcggccu

SEQ ID NO: 1566990 - RNA, 20 nt, Pseudomonas putida KT2440
cugugggagcgggcuugccc

SEQ ID NO: 1566991 - RNA, 17 nt, Pseudomonas putida KT2440
cuguguaggagcggguu

SEQ ID NO: 1566992 - RNA, 21 nt, Pseudomonas putida KT2440
cuguguccacccccgcuccua

SEQ ID NO: 1566993 - RNA, 22 nt, Pseudomonas putida KT2440
cuguguccacccccgcuccuac

SEQ ID NO: 1566994 - RNA, 21 nt, Pseudomonas putida KT2440
cugugcuuugagcaggcgcuc

SEQ ID NO: 1566995 - RNA, 13 nt, Pseudomonas putida KT2440
cugugcggcuggc

SEQ ID NO: 1566996 - RNA, 17 nt, Pseudomonas putida KT2440
cugugaggccagcggga

SEQ ID NO: 1566997 - RNA, 23 nt, Pseudomonas putida KT2440
cugugaggccuucagcgcggcaa

SEQ ID NO: 1566998 - RNA, 16 nt, Pseudomonas putida KT2440
cugugaagccagggca

SEQ ID NO: 1566999 - RNA, 17 nt, Pseudomonas putida KT2440
cugugaagccagggcaa

SEQ ID NO: 1567000 - RNA, 19 nt, Pseudomonas putida KT2440
cugugaagccagggcaagc

SEQ ID NO: 1567001 - RNA, 17 nt, Pseudomonas putida KT2440
cugucuagccgccugcc

SEQ ID NO: 1567002 - RNA, 16 nt, Pseudomonas putida KT2440
cugucuuccagggcaa

SEQ ID NO: 1567003 - RNA, 16 nt, Pseudomonas putida KT2440
cuucaacgcggcuucg

SEQ ID NO: 1567004 - RNA, 23 nt, Pseudomonas putida KT2440
cuucaagcagcgaaugcagcucg

SEQ ID NO: 1567005 - RNA, 13 nt, Pseudomonas putida KT2440
cuucaauggcacc

SEQ ID NO: 1567006 - RNA, 19 nt, Pseudomonas putida KT2440
cuuacuuggucaccgucac

SEQ ID NO: 1567007 - RNA, 18 nt, Pseudomonas putida KT2440
cuguuguccccgccgugc

SEQ ID NO: 1567008 - RNA, 19 nt, Pseudomonas putida KT2440
cuguuguccccgccgugca

SEQ ID NO: 1567009 - RNA, 22 nt, Pseudomonas putida KT2440
cuguugucggccagaucggcca

SEQ ID NO: 1567010 - RNA, 16 nt, Pseudomonas putida KT2440
cuguuggcacggcuga

SEQ ID NO: 1567011 - RNA, 14 nt, Pseudomonas putida KT2440
cuguuggcagccac

SEQ ID NO: 1567012 - RNA, 16 nt, Pseudomonas putida KT2440
cuguuggcgcgacaug

SEQ ID NO: 1567013 - RNA, 18 nt, Pseudomonas putida KT2440
cuuacagguagugcgcgg

SEQ ID NO: 1567014 - RNA, 20 nt, Pseudomonas putida KT2440
cuuacaggucguaaucgccc

SEQ ID NO: 1567015 - RNA, 23 nt, Pseudomonas putida KT2440
cuuaccaguaguucucgacagcc

SEQ ID NO: 1567016 - RNA, 16 nt, Pseudomonas putida KT2440
cuuacagaugcugcug

SEQ ID NO: 1567017 - RNA, 20 nt, Pseudomonas putida KT2440
cuuacagaugucuggcauca

SEQ ID NO: 1567018 - RNA, 21 nt, Pseudomonas putida KT2440
cuucgaacaauucuuccagcu

SEQ ID NO: 1567019 - RNA, 20 nt, Pseudomonas putida KT2440
cuucgaacacccgcuugccu

SEQ ID NO: 1567020 - RNA, 17 nt, Pseudomonas putida KT2440
cuucgacaaccggggca

SEQ ID NO: 1567021 - RNA, 17 nt, Pseudomonas putida KT2440
cuucgacgaagaagccu

SEQ ID NO: 1567022 - RNA, 14 nt, Pseudomonas putida KT2440
cuucgacaguucaa

SEQ ID NO: 1567023 - RNA, 23 nt, Pseudomonas putida KT2440
cuucgacggucggcaguuugccg

SEQ ID NO: 1567024 - RNA, 20 nt, Pseudomonas putida KT2440
cuucgcaggcacgcccgcuc

SEQ ID NO: 1567025 - RNA, 14 nt, Pseudomonas putida KT2440
cuuccuuguaggcc

SEQ ID NO: 1567026 - RNA, 14 nt, Pseudomonas putida KT2440
cuuccggcaggucg

SEQ ID NO: 1567027 - RNA, 17 nt, Pseudomonas putida KT2440
cuucccguucgcggucg

SEQ ID NO: 1567028 - RNA, 21 nt, Pseudomonas putida KT2440
cuuccaccgggaagcaggucu

SEQ ID NO: 1567029 - RNA, 15 nt, Pseudomonas putida KT2440
cuuccaccgccucga

SEQ ID NO: 1567030 - RNA, 18 nt, Pseudomonas putida KT2440
cuucacccgcagcaacag

SEQ ID NO: 1567031 - RNA, 18 nt, Pseudomonas putida KT2440
cuucacccucgcgcagca

SEQ ID NO: 1567032 - RNA, 16 nt, Pseudomonas putida KT2440
cuuccagccugcagca

SEQ ID NO: 1567033 - RNA, 15 nt, Pseudomonas putida KT2440
cuuccagcaucgccc

SEQ ID NO: 1567034 - RNA, 16 nt, Pseudomonas putida KT2440
cuuccagaccagacag

SEQ ID NO: 1567035 - RNA, 13 nt, Pseudomonas putida KT2440
cuuccaccugcgc

SEQ ID NO: 1567036 - RNA, 17 nt, Pseudomonas putida KT2440
cuucccgggaaaagccu

SEQ ID NO: 1567037 - RNA, 16 nt, Pseudomonas putida KT2440
cuucccggcaccgcuu

SEQ ID NO: 1567038 - RNA, 18 nt, Pseudomonas putida KT2440
cuucccggccuggcgcag

SEQ ID NO: 1567039 - RNA, 15 nt, Pseudomonas putida KT2440
cuucccccgggcuug

SEQ ID NO: 1567040 - RNA, 15 nt, Pseudomonas putida KT2440
cuuccccuuggcgac

SEQ ID NO: 1567041 - RNA, 16 nt, Pseudomonas putida KT2440
cuucuguuugugccag

SEQ ID NO: 1567042 - RNA, 17 nt, Pseudomonas putida KT2440
cuucugcggccagggca

SEQ ID NO: 1567043 - RNA, 14 nt, Pseudomonas putida KT2440
cuucugccguucac

SEQ ID NO: 1567044 - RNA, 13 nt, Pseudomonas putida KT2440
cuucuucaagcac

SEQ ID NO: 1567045 - RNA, 17 nt, Pseudomonas putida KT2440
cuucuugccgguaccgc

SEQ ID NO: 1567046 - RNA, 21 nt, Pseudomonas putida KT2440
cuucuugacgggugaccaggc

SEQ ID NO: 1567047 - RNA, 18 nt, Pseudomonas putida KT2440
cuucuucgcggguaaacc

SEQ ID NO: 1567048 - RNA, 13 nt, Pseudomonas putida KT2440
cuucuccagcaag

SEQ ID NO: 1567049 - RNA, 14 nt, Pseudomonas putida KT2440
cuucuccagcucgc

SEQ ID NO: 1567050 - RNA, 21 nt, Pseudomonas putida KT2440
cuucucauaggguguugcccu

SEQ ID NO: 1567051 - RNA, 13 nt, Pseudomonas putida KT2440
cuucgguggcuca

SEQ ID NO: 1567052 - RNA, 20 nt, Pseudomonas putida KT2440
cuucgcccucguucgcgggc

SEQ ID NO: 1567053 - RNA, 22 nt, Pseudomonas putida KT2440
cuucgcccucguucgcgggcac

SEQ ID NO: 1567054 - RNA, 15 nt, Pseudomonas putida KT2440
cuucgcccuucagcg

SEQ ID NO: 1567055 - RNA, 16 nt, Pseudomonas putida KT2440
gaaaaacgcggaucgu

SEQ ID NO: 1567056 - RNA, 16 nt, Pseudomonas putida KT2440
cuuuggccguagccag

SEQ ID NO: 1567057 - RNA, 18 nt, Pseudomonas putida KT2440
cuuuggucgcggcgcugg

SEQ ID NO: 1567058 - RNA, 21 nt, Pseudomonas putida KT2440
cuuuggucgcggcgcuggccg

SEQ ID NO: 1567059 - RNA, 13 nt, Pseudomonas putida KT2440
cuuugucgaugcc

SEQ ID NO: 1567060 - RNA, 21 nt, Pseudomonas putida KT2440
cuuuguuguuguacuggcuga

SEQ ID NO: 1567061 - RNA, 13 nt, Pseudomonas putida KT2440
gaaaaggcgcugu

SEQ ID NO: 1567062 - RNA, 17 nt, Pseudomonas putida KT2440
gaaaccaucaaucaacu

SEQ ID NO: 1567063 - RNA, 14 nt, Pseudomonas putida KT2440
gaaacccggcgcag

SEQ ID NO: 1567064 - RNA, 19 nt, Pseudomonas putida KT2440
gaaaccaugcaggucgacg

SEQ ID NO: 1567065 - RNA, 19 nt, Pseudomonas putida KT2440
gaaaccacaguggguggca

SEQ ID NO: 1567066 - RNA, 11 nt, Pseudomonas putida KT2440
gaaaccggcaa

SEQ ID NO: 1567067 - RNA, 12 nt, Pseudomonas putida KT2440
gaaaccggcaaa

SEQ ID NO: 1567068 - RNA, 15 nt, Pseudomonas putida KT2440
gaaaccgcgugccga

SEQ ID NO: 1567069 - RNA, 14 nt, Pseudomonas putida KT2440
cuugucccaggcca

SEQ ID NO: 1567070 - RNA, 16 nt, Pseudomonas putida KT2440
cuuguccagcaggcca

SEQ ID NO: 1567071 - RNA, 18 nt, Pseudomonas putida KT2440
cuuguaggcgcggguuug

SEQ ID NO: 1567072 - RNA, 17 nt, Pseudomonas putida KT2440
cuuguauucgagcuuga

SEQ ID NO: 1567073 - RNA, 20 nt, Pseudomonas putida KT2440
cuuucagcgccgcuucagcc

SEQ ID NO: 1567074 - RNA, 15 nt, Pseudomonas putida KT2440
cuuucaggcacagca

SEQ ID NO: 1567075 - RNA, 19 nt, Pseudomonas putida KT2440
cuuucagguaacgggcaag

SEQ ID NO: 1567076 - RNA, 20 nt, Pseudomonas putida KT2440
cuuucagguuccaagcgucg

SEQ ID NO: 1567077 - RNA, 16 nt, Pseudomonas putida KT2440
cuuuccaccuggccac

SEQ ID NO: 1567078 - RNA, 15 nt, Pseudomonas putida KT2440
cuuuccacgccucga

SEQ ID NO: 1567079 - RNA, 22 nt, Pseudomonas putida KT2440
cuuuccagcuguacgcuggcca

SEQ ID NO: 1567080 - RNA, 15 nt, Pseudomonas putida KT2440
cuuucgaccucgauu

SEQ ID NO: 1567081 - RNA, 14 nt, Pseudomonas putida KT2440
cuuugcggacgaac

SEQ ID NO: 1567082 - RNA, 15 nt, Pseudomonas putida KT2440
cuuuggcuaucagcc

SEQ ID NO: 1567083 - RNA, 16 nt, Pseudomonas putida KT2440
cuuuggcugcaggucg

SEQ ID NO: 1567084 - RNA, 21 nt, Pseudomonas putida KT2440
cuuugcucuucaccugaccau

SEQ ID NO: 1567085 - RNA, 18 nt, Pseudomonas putida KT2440
cuuugcugccugugccgg

SEQ ID NO: 1567086 - RNA, 13 nt, Pseudomonas putida KT2440
cuuugcaccccuu

SEQ ID NO: 1567087 - RNA, 14 nt, Pseudomonas putida KT2440
cuuugcacccgcgc

SEQ ID NO: 1567088 - RNA, 18 nt, Pseudomonas putida KT2440
cuuucggcagcacccgcu

SEQ ID NO: 1567089 - RNA, 23 nt, Pseudomonas putida KT2440
cuuucggcagcacccgcuuggcc

SEQ ID NO: 1567090 - RNA, 21 nt, Pseudomonas putida KT2440
cuuucucaggcgcgccgauca

SEQ ID NO: 1567091 - RNA, 13 nt, Pseudomonas putida KT2440
cuuucgcggguaa

SEQ ID NO: 1567092 - RNA, 20 nt, Pseudomonas putida KT2440
cuuucgcggguaaacccgcc

SEQ ID NO: 1567093 - RNA, 20 nt, Pseudomonas putida KT2440
cuuucgcgggugaacccgcu

SEQ ID NO: 1567094 - RNA, 21 nt, Pseudomonas putida KT2440
cuugcagcgccgcauccagca

SEQ ID NO: 1567095 - RNA, 18 nt, Pseudomonas putida KT2440
cuugcaccugucccagcu

SEQ ID NO: 1567096 - RNA, 16 nt, Pseudomonas putida KT2440
cuugcagaaacgccau

SEQ ID NO: 1567097 - RNA, 15 nt, Pseudomonas putida KT2440
cuugcaguaucgccc

SEQ ID NO: 1567098 - RNA, 22 nt, Pseudomonas putida KT2440
cuugcagguagcgcccgggcau

SEQ ID NO: 1567099 - RNA, 20 nt, Pseudomonas putida KT2440
cuugccaccaucgaccuggc

SEQ ID NO: 1567100 - RNA, 20 nt, Pseudomonas putida KT2440
cuugccagcuuggucagggc

SEQ ID NO: 1567101 - RNA, 20 nt, Pseudomonas putida KT2440
cuugccauaacuccagcgcc

SEQ ID NO: 1567102 - RNA, 14 nt, Pseudomonas putida KT2440
cuugccaacggcac

SEQ ID NO: 1567103 - RNA, 15 nt, Pseudomonas putida KT2440
cuugccaacggcacu

SEQ ID NO: 1567104 - RNA, 22 nt, Pseudomonas putida KT2440
cuugccaacggcacucgaagca

SEQ ID NO: 1567105 - RNA, 20 nt, Pseudomonas putida KT2440
cuugaucuugguggucagcc

SEQ ID NO: 1567106 - RNA, 22 nt, Pseudomonas putida KT2440
cuugaucaggggccgcgcagcg

SEQ ID NO: 1567107 - RNA, 15 nt, Pseudomonas putida KT2440
cuugaugggccagaa

SEQ ID NO: 1567108 - RNA, 17 nt, Pseudomonas putida KT2440
cuugaccauggcgauga

SEQ ID NO: 1567109 - RNA, 15 nt, Pseudomonas putida KT2440
cuugaagacaucgau

SEQ ID NO: 1567110 - RNA, 18 nt, Pseudomonas putida KT2440
cuugaacggccgucaccu

SEQ ID NO: 1567111 - RNA, 16 nt, Pseudomonas putida KT2440
cuugaccuugucagca

SEQ ID NO: 1567112 - RNA, 23 nt, Pseudomonas putida KT2440
cuugaccccuucaucacccaguu

SEQ ID NO: 1567113 - RNA, 18 nt, Pseudomonas putida KT2440
cuugaccguuugcagcgu

SEQ ID NO: 1567114 - RNA, 24 nt, Pseudomonas putida KT2440
cuugaguucccaggcagccuccag

SEQ ID NO: 1567115 - RNA, 16 nt, Pseudomonas putida KT2440
cuugaggucuucgauc

SEQ ID NO: 1567116 - RNA, 19 nt, Pseudomonas putida KT2440
cuugagguccgccucgauc

SEQ ID NO: 1567117 - RNA, 23 nt, Pseudomonas putida KT2440
cuugagggccucuucgcggguaa

SEQ ID NO: 1567118 - RNA, 18 nt, Pseudomonas putida KT2440
cuugagcgccgcgcccau

SEQ ID NO: 1567119 - RNA, 17 nt, Pseudomonas putida KT2440
cuugacgaucgccagcc

SEQ ID NO: 1567120 - RNA, 19 nt, Pseudomonas putida KT2440
cuugacgaucgccagcccc

SEQ ID NO: 1567121 - RNA, 14 nt, Pseudomonas putida KT2440
cuugacgggugacc

SEQ ID NO: 1567122 - RNA, 18 nt, Pseudomonas putida KT2440
cuugacggugcgcgccag

SEQ ID NO: 1567123 - RNA, 23 nt, Pseudomonas putida KT2440
cuuggcagcaccgcugccagcug

SEQ ID NO: 1567124 - RNA, 13 nt, Pseudomonas putida KT2440
cuuggcagccucg

SEQ ID NO: 1567125 - RNA, 18 nt, Pseudomonas putida KT2440
cuuggcaccggcagcagc

SEQ ID NO: 1567126 - RNA, 19 nt, Pseudomonas putida KT2440
cuuggcaccggcagcagca

SEQ ID NO: 1567127 - RNA, 20 nt, Pseudomonas putida KT2440
cuuggcaccuaucgcugccg

SEQ ID NO: 1567128 - RNA, 22 nt, Pseudomonas putida KT2440
cuuggcaccuaucgcugccgcc

SEQ ID NO: 1567129 - RNA, 15 nt, Pseudomonas putida KT2440
cuuggccugcgggaa

SEQ ID NO: 1567130 - RNA, 15 nt, Pseudomonas putida KT2440
cuuggccuuggcagc

SEQ ID NO: 1567131 - RNA, 18 nt, Pseudomonas putida KT2440
cuuggcgaugaugugcgc

SEQ ID NO: 1567132 - RNA, 18 nt, Pseudomonas putida KT2440
cuuggcguaauccagcug

SEQ ID NO: 1567133 - RNA, 21 nt, Pseudomonas putida KT2440
cuuggcggcggaucggcgugg

SEQ ID NO: 1567134 - RNA, 14 nt, Pseudomonas putida KT2440
cuuggcucgacgcg

SEQ ID NO: 1567135 - RNA, 16 nt, Pseudomonas putida KT2440
cuuggcuuucggcgca

SEQ ID NO: 1567136 - RNA, 17 nt, Pseudomonas putida KT2440
cuuggcuuucggcgcac

SEQ ID NO: 1567137 - RNA, 21 nt, Pseudomonas putida KT2440
cuuggcuuuugccacuucacc

SEQ ID NO: 1567138 - RNA, 12 nt, Pseudomonas putida KT2440
cuugggaucgau

SEQ ID NO: 1567139 - RNA, 17 nt, Pseudomonas putida KT2440
cuuggcguuggcugccg

SEQ ID NO: 1567140 - RNA, 17 nt, Pseudomonas putida KT2440
cuugggcgaggacagca

SEQ ID NO: 1567141 - RNA, 22 nt, Pseudomonas putida KT2440
cuuggguaacacggugaucgca

SEQ ID NO: 1567142 - RNA, 15 nt, Pseudomonas putida KT2440
cuugcggcgacgcac

SEQ ID NO: 1567143 - RNA, 14 nt, Pseudomonas putida KT2440
cuugccgguaccgc

SEQ ID NO: 1567144 - RNA, 24 nt, Pseudomonas putida KT2440
cuugccggccuugaccucgaccag

SEQ ID NO: 1567145 - RNA, 18 nt, Pseudomonas putida KT2440
cuugccgcugcggaucau

SEQ ID NO: 1567146 - RNA, 17 nt, Pseudomonas putida KT2440
cuugcggugcaugcgca

SEQ ID NO: 1567147 - RNA, 17 nt, Pseudomonas putida KT2440
cuuggacaccaggcugg

SEQ ID NO: 1567148 - RNA, 18 nt, Pseudomonas putida KT2440
cuuggacaccaggcuggu

SEQ ID NO: 1567149 - RNA, 16 nt, Pseudomonas putida KT2440
cuuggaguugcucgag

SEQ ID NO: 1567150 - RNA, 20 nt, Pseudomonas putida KT2440
cuuggaguugcucgagugcg

SEQ ID NO: 1567151 - RNA, 20 nt, Pseudomonas putida KT2440
cugcggucgagcugcccacc

SEQ ID NO: 1567152 - RNA, 20 nt, Pseudomonas putida KT2440
cugcgguguguuugucgaca

SEQ ID NO: 1567153 - RNA, 14 nt, Pseudomonas putida KT2440
cugcggggcagccc

SEQ ID NO: 1567154 - RNA, 17 nt, Pseudomonas putida KT2440
cugcggcugcucgauca

SEQ ID NO: 1567155 - RNA, 21 nt, Pseudomonas putida KT2440
cugcguauuuuugcgccaggc

SEQ ID NO: 1567156 - RNA, 19 nt, Pseudomonas putida KT2440
cugcgucucuuccuccauc

SEQ ID NO: 1567157 - RNA, 20 nt, Pseudomonas putida KT2440
cugcuaaaggcauucgcggg

SEQ ID NO: 1567158 - RNA, 18 nt, Pseudomonas putida KT2440
cugcuaggauucagcacg

SEQ ID NO: 1567159 - RNA, 15 nt, Pseudomonas putida KT2440
cugcucaaucaacca

SEQ ID NO: 1567160 - RNA, 13 nt, Pseudomonas putida KT2440
cugcguggugccu

SEQ ID NO: 1567161 - RNA, 15 nt, Pseudomonas putida KT2440
cugcgugauggcagc

SEQ ID NO: 1567162 - RNA, 14 nt, Pseudomonas putida KT2440
cugcgugcugugca

SEQ ID NO: 1567163 - RNA, 15 nt, Pseudomonas putida KT2440
cugcgugcugugcac

SEQ ID NO: 1567164 - RNA, 14 nt, Pseudomonas putida KT2440
cugcguuucgcugg

SEQ ID NO: 1567165 - RNA, 17 nt, Pseudomonas putida KT2440
cugcucaucugcgccag

SEQ ID NO: 1567166 - RNA, 14 nt, Pseudomonas putida KT2440
cugcuccacaaucu

SEQ ID NO: 1567167 - RNA, 16 nt, Pseudomonas putida KT2440
cugcuccacccgugca

SEQ ID NO: 1567168 - RNA, 21 nt, Pseudomonas putida KT2440
cugcucauacugcugacccgg

SEQ ID NO: 1567169 - RNA, 20 nt, Pseudomonas putida KT2440
cugcucauccaccacacgcc

SEQ ID NO: 1567170 - RNA, 16 nt, Pseudomonas putida KT2440
cugcuccggaauccgc

SEQ ID NO: 1567171 - RNA, 13 nt, Pseudomonas putida KT2440
cugcucgccaucu

SEQ ID NO: 1567172 - RNA, 14 nt, Pseudomonas putida KT2440
cugcucguccauca

SEQ ID NO: 1567173 - RNA, 18 nt, Pseudomonas putida KT2440
cugcucguccaucaccgc

SEQ ID NO: 1567174 - RNA, 20 nt, Pseudomonas putida KT2440
cugcugacccggaaucggcu

SEQ ID NO: 1567175 - RNA, 21 nt, Pseudomonas putida KT2440
cugcugacccggaaucggcuu

SEQ ID NO: 1567176 - RNA, 21 nt, Pseudomonas putida KT2440
cugcugccaggccgcacgcgc

SEQ ID NO: 1567177 - RNA, 22 nt, Pseudomonas putida KT2440
cugcugccccaugcgaacugca

SEQ ID NO: 1567178 - RNA, 20 nt, Pseudomonas putida KT2440
cugcugcccguugcgcauca

SEQ ID NO: 1567179 - RNA, 14 nt, Pseudomonas putida KT2440
cugcugcggcaggc

SEQ ID NO: 1567180 - RNA, 23 nt, Pseudomonas putida KT2440
cugcugaaugcggaaaaggccgg

SEQ ID NO: 1567181 - RNA, 18 nt, Pseudomonas putida KT2440
cugcugacaccgcugccg

SEQ ID NO: 1567182 - RNA, 19 nt, Pseudomonas putida KT2440
cugcugacaccgcugccgg

SEQ ID NO: 1567183 - RNA, 20 nt, Pseudomonas putida KT2440
cugcucuggcccgaacagca

SEQ ID NO: 1567184 - RNA, 18 nt, Pseudomonas putida KT2440
cugcaccuuguuacccgc

SEQ ID NO: 1567185 - RNA, 19 nt, Pseudomonas putida KT2440
cugcaccuuguuacccgca

SEQ ID NO: 1567186 - RNA, 18 nt, Pseudomonas putida KT2440
cugcaccuggcugagguu

SEQ ID NO: 1567187 - RNA, 17 nt, Pseudomonas putida KT2440
cugcgauagaucagcga

SEQ ID NO: 1567188 - RNA, 16 nt, Pseudomonas putida KT2440
cugcgcaucacccgcc

SEQ ID NO: 1567189 - RNA, 14 nt, Pseudomonas putida KT2440
cugcgccaaagcga

SEQ ID NO: 1567190 - RNA, 15 nt, Pseudomonas putida KT2440
cugcgccaccggccu

SEQ ID NO: 1567191 - RNA, 12 nt, Pseudomonas putida KT2440
cugcgcacggaa

SEQ ID NO: 1567192 - RNA, 18 nt, Pseudomonas putida KT2440
cugcgcacggaaggcauc

SEQ ID NO: 1567193 - RNA, 23 nt, Pseudomonas putida KT2440
cugcgcacgaauacgcucgacca

SEQ ID NO: 1567194 - RNA, 20 nt, Pseudomonas putida KT2440
cugcgcacgaccauuggcgu

SEQ ID NO: 1567195 - RNA, 21 nt, Pseudomonas putida KT2440
cugcgcagcccauucgcgggu

SEQ ID NO: 1567196 - RNA, 20 nt, Pseudomonas putida KT2440
cugcgccgccuccaccggga

SEQ ID NO: 1567197 - RNA, 14 nt, Pseudomonas putida KT2440
cugcgccguggccg

SEQ ID NO: 1567198 - RNA, 17 nt, Pseudomonas putida KT2440
cugcgccugccgggcca

SEQ ID NO: 1567199 - RNA, 16 nt, Pseudomonas putida KT2440
cugcgccugcugguac

SEQ ID NO: 1567200 - RNA, 17 nt, Pseudomonas putida KT2440
cugcgcccuuugcgggu

SEQ ID NO: 1567201 - RNA, 17 nt, Pseudomonas putida KT2440
cugcgccaggcauugcu

SEQ ID NO: 1567202 - RNA, 23 nt, Pseudomonas putida KT2440
cugcgccaggcauugcucgauua

SEQ ID NO: 1567203 - RNA, 19 nt, Pseudomonas putida KT2440
cugcgcccaguagcgccac

SEQ ID NO: 1567204 - RNA, 21 nt, Pseudomonas putida KT2440
cugcgcccaguagcgccacca

SEQ ID NO: 1567205 - RNA, 14 nt, Pseudomonas putida KT2440
cugcgcccaaucac

SEQ ID NO: 1567206 - RNA, 15 nt, Pseudomonas putida KT2440
cugcgcccaaucggg

SEQ ID NO: 1567207 - RNA, 22 nt, Pseudomonas putida KT2440
cugcgccagugccuucaggcac

SEQ ID NO: 1567208 - RNA, 16 nt, Pseudomonas putida KT2440
cugcgcuccagcagcu

SEQ ID NO: 1567209 - RNA, 18 nt, Pseudomonas putida KT2440
cugcgcggguucugguug

SEQ ID NO: 1567210 - RNA, 20 nt, Pseudomonas putida KT2440
cugcgcgguaaugaccugga

SEQ ID NO: 1567211 - RNA, 17 nt, Pseudomonas putida KT2440
cugcgcggccggucgaa

SEQ ID NO: 1567212 - RNA, 16 nt, Pseudomonas putida KT2440
cugcgcggccuugccg

SEQ ID NO: 1567213 - RNA, 18 nt, Pseudomonas putida KT2440
cugcggcgaaagccagca

SEQ ID NO: 1567214 - RNA, 14 nt, Pseudomonas putida KT2440
cugcggccaggccg

SEQ ID NO: 1567215 - RNA, 19 nt, Pseudomonas putida KT2440
cugcggcccauucgcgggc

SEQ ID NO: 1567216 - RNA, 17 nt, Pseudomonas putida KT2440
cugcgcuucaagcaggu

SEQ ID NO: 1567217 - RNA, 19 nt, Pseudomonas putida KT2440
cugcgcuucaagcagguaa

SEQ ID NO: 1567218 - RNA, 16 nt, Pseudomonas putida KT2440
cugcgcuugcaccagg

SEQ ID NO: 1567219 - RNA, 22 nt, Pseudomonas putida KT2440
cugcgcuugcgaccgaugccca

SEQ ID NO: 1567220 - RNA, 23 nt, Pseudomonas putida KT2440
cugcgcuuugcguggcaccggcg

SEQ ID NO: 1567221 - RNA, 19 nt, Pseudomonas putida KT2440
cugcgcugguacagcagga

SEQ ID NO: 1567222 - RNA, 13 nt, Pseudomonas putida KT2440
cugcgcucgaucc

SEQ ID NO: 1567223 - RNA, 17 nt, Pseudomonas putida KT2440
cugcggauacagcgccc

SEQ ID NO: 1567224 - RNA, 18 nt, Pseudomonas putida KT2440
cugcggauacagcgccca

SEQ ID NO: 1567225 - RNA, 13 nt, Pseudomonas putida KT2440
cugggccucauca

SEQ ID NO: 1567226 - RNA, 16 nt, Pseudomonas putida KT2440
cugggccucaucaucg

SEQ ID NO: 1567227 - RNA, 15 nt, Pseudomonas putida KT2440
cuggcugucgaaggc

SEQ ID NO: 1567228 - RNA, 16 nt, Pseudomonas putida KT2440
cuggcugucgaaggcu

SEQ ID NO: 1567229 - RNA, 22 nt, Pseudomonas putida KT2440
cugggccgguccuuucgcgggu

SEQ ID NO: 1567230 - RNA, 23 nt, Pseudomonas putida KT2440
cugggcgaacgccugcagggccu

SEQ ID NO: 1567231 - RNA, 20 nt, Pseudomonas putida KT2440
cugggcgagccacucggcaa

SEQ ID NO: 1567232 - RNA, 16 nt, Pseudomonas putida KT2440
cuggcuguaccggccu

SEQ ID NO: 1567233 - RNA, 18 nt, Pseudomonas putida KT2440
cuggcugagguucagcgc

SEQ ID NO: 1567234 - RNA, 21 nt, Pseudomonas putida KT2440
cuggcugagguucagcgcacc

SEQ ID NO: 1567235 - RNA, 17 nt, Pseudomonas putida KT2440
cuggcugaucagcaugu

SEQ ID NO: 1567236 - RNA, 12 nt, Pseudomonas putida KT2440
cuggcugcgggu

SEQ ID NO: 1567237 - RNA, 23 nt, Pseudomonas putida KT2440
cuggcugccgcggguggcuucgu

SEQ ID NO: 1567238 - RNA, 13 nt, Pseudomonas putida KT2440
cuggcugccgcug

SEQ ID NO: 1567239 - RNA, 20 nt, Pseudomonas putida KT2440
cuggcugccgcugaccaccg

SEQ ID NO: 1567240 - RNA, 23 nt, Pseudomonas putida KT2440
cuggcugccuucgcucaggugca

SEQ ID NO: 1567241 - RNA, 18 nt, Pseudomonas putida KT2440
cugggcgaugaucgccug

SEQ ID NO: 1567242 - RNA, 13 nt, Pseudomonas putida KT2440
cugggcgaucaca

SEQ ID NO: 1567243 - RNA, 16 nt, Pseudomonas putida KT2440
cugggcgcggcgggca

SEQ ID NO: 1567244 - RNA, 14 nt, Pseudomonas putida KT2440
cuggggcuucugcc

SEQ ID NO: 1567245 - RNA, 16 nt, Pseudomonas putida KT2440
cuggggcuucugccgg

SEQ ID NO: 1567246 - RNA, 20 nt, Pseudomonas putida KT2440
cuggggcugcaccgcagccc

SEQ ID NO: 1567247 - RNA, 21 nt, Pseudomonas putida KT2440
cugggucaggcguaugugcac

SEQ ID NO: 1567248 - RNA, 15 nt, Pseudomonas putida KT2440
cuggguccaggcaca

SEQ ID NO: 1567249 - RNA, 17 nt, Pseudomonas putida KT2440
cuggucaucgaagccaa

SEQ ID NO: 1567250 - RNA, 15 nt, Pseudomonas putida KT2440
cuggucaugcagcgg

SEQ ID NO: 1567251 - RNA, 18 nt, Pseudomonas putida KT2440
cuggucacucugccgccc

SEQ ID NO: 1567252 - RNA, 18 nt, Pseudomonas putida KT2440
cuggucacccugacgcug

SEQ ID NO: 1567253 - RNA, 20 nt, Pseudomonas putida KT2440
cuggcggaucugacggcgcu

SEQ ID NO: 1567254 - RNA, 17 nt, Pseudomonas putida KT2440
cuggcgcuugaucagcc

SEQ ID NO: 1567255 - RNA, 16 nt, Pseudomonas putida KT2440
cuggcgcuuuccagcu

SEQ ID NO: 1567256 - RNA, 18 nt, Pseudomonas putida KT2440
cuggcgcucaauggcacc

SEQ ID NO: 1567257 - RNA, 21 nt, Pseudomonas putida KT2440
cuggccguguucgacgaucga

SEQ ID NO: 1567258 - RNA, 12 nt, Pseudomonas putida KT2440
cuggccgugccg

SEQ ID NO: 1567259 - RNA, 14 nt, Pseudomonas putida KT2440
cuggccguccagcu

SEQ ID NO: 1567260 - RNA, 22 nt, Pseudomonas putida KT2440
cuggccggggccgcuuggcggc

SEQ ID NO: 1567261 - RNA, 18 nt, Pseudomonas putida KT2440
cuggccgguguggccaag

SEQ ID NO: 1567262 - RNA, 24 nt, Pseudomonas putida KT2440
cuggcucgaucuuguuggucaggc

SEQ ID NO: 1567263 - RNA, 17 nt, Pseudomonas putida KT2440
cuggcuacagaucagcc

SEQ ID NO: 1567264 - RNA, 20 nt, Pseudomonas putida KT2440
cuggcucuucaacaccagca

SEQ ID NO: 1567265 - RNA, 18 nt, Pseudomonas putida KT2440
cuggcucggugugcaccu

SEQ ID NO: 1567266 - RNA, 18 nt, Pseudomonas putida KT2440
cuggcguauuuccugagc

SEQ ID NO: 1567267 - RNA, 12 nt, Pseudomonas putida KT2440
cuggcgucgaug

SEQ ID NO: 1567268 - RNA, 12 nt, Pseudomonas putida KT2440
cuggcgugcacc

SEQ ID NO: 1567269 - RNA, 21 nt, Pseudomonas putida KT2440
cugcugcugucgguaccuggc

SEQ ID NO: 1567270 - RNA, 13 nt, Pseudomonas putida KT2440
cugcuggcgaaga

SEQ ID NO: 1567271 - RNA, 23 nt, Pseudomonas putida KT2440
cugcuggcccgcgaugccgacag

SEQ ID NO: 1567272 - RNA, 17 nt, Pseudomonas putida KT2440
cugcuuccuugcgcacg

SEQ ID NO: 1567273 - RNA, 18 nt, Pseudomonas putida KT2440
cugcuucaucugcgccug

SEQ ID NO: 1567274 - RNA, 20 nt, Pseudomonas putida KT2440
cugcuucacgggucaugcca

SEQ ID NO: 1567275 - RNA, 22 nt, Pseudomonas putida KT2440
cugcuucacgggucaugccacc

SEQ ID NO: 1567276 - RNA, 20 nt, Pseudomonas putida KT2440
cugcuuaucggcugaccuga

SEQ ID NO: 1567277 - RNA, 15 nt, Pseudomonas putida KT2440
cugcuguagcgccca

SEQ ID NO: 1567278 - RNA, 16 nt, Pseudomonas putida KT2440
cugcugguacaugccg

SEQ ID NO: 1567279 - RNA, 19 nt, Pseudomonas putida KT2440
cugcugguucaucgacugg

SEQ ID NO: 1567280 - RNA, 23 nt, Pseudomonas putida KT2440
cugcugguccucgacgggcaggc

SEQ ID NO: 1567281 - RNA, 11 nt, Pseudomonas putida KT2440
cugcuggucgc

SEQ ID NO: 1567282 - RNA, 16 nt, Pseudomonas putida KT2440
cuggaaccccauccac

SEQ ID NO: 1567283 - RNA, 18 nt, Pseudomonas putida KT2440
cuggaacgcuuggccaga

SEQ ID NO: 1567284 - RNA, 15 nt, Pseudomonas putida KT2440
cuggaacugcugcac

SEQ ID NO: 1567285 - RNA, 20 nt, Pseudomonas putida KT2440
cuggacccaaucgcugugca

SEQ ID NO: 1567286 - RNA, 21 nt, Pseudomonas putida KT2440
cuggacccaaucgcugugcaa

SEQ ID NO: 1567287 - RNA, 17 nt, Pseudomonas putida KT2440
cugcuugagcgcagcga

SEQ ID NO: 1567288 - RNA, 22 nt, Pseudomonas putida KT2440
cugcuugaccauggcgaugaac

SEQ ID NO: 1567289 - RNA, 17 nt, Pseudomonas putida KT2440
cugcuugccgcuggcau

SEQ ID NO: 1567290 - RNA, 19 nt, Pseudomonas putida KT2440
cugcuugcucugugcaugc

SEQ ID NO: 1567291 - RNA, 12 nt, Pseudomonas putida KT2440
cugcuucgcggg

SEQ ID NO: 1567292 - RNA, 23 nt, Pseudomonas putida KT2440
cugcuuguggucgacgucggcgu

SEQ ID NO: 1567293 - RNA, 15 nt, Pseudomonas putida KT2440
cugcuuucaggugcu

SEQ ID NO: 1567294 - RNA, 14 nt, Pseudomonas putida KT2440
cugcuuugcagccc

SEQ ID NO: 1567295 - RNA, 15 nt, Pseudomonas putida KT2440
cuggccgcugcgccc

SEQ ID NO: 1567296 - RNA, 19 nt, Pseudomonas putida KT2440
cuggccgcccgccucgaca

SEQ ID NO: 1567297 - RNA, 18 nt, Pseudomonas putida KT2440
cuggccgcaaccugggca

SEQ ID NO: 1567298 - RNA, 14 nt, Pseudomonas putida KT2440
cuggccgaugccca

SEQ ID NO: 1567299 - RNA, 13 nt, Pseudomonas putida KT2440
cuggccgacguca

SEQ ID NO: 1567300 - RNA, 18 nt, Pseudomonas putida KT2440
cuggcccacccggcugaa

SEQ ID NO: 1567301 - RNA, 21 nt, Pseudomonas putida KT2440
cuggcccacgccuuccaccgg

SEQ ID NO: 1567302 - RNA, 23 nt, Pseudomonas putida KT2440
cuggccauaguugaccagcacca

SEQ ID NO: 1567303 - RNA, 19 nt, Pseudomonas putida KT2440
cuggccauccagucgauca

SEQ ID NO: 1567304 - RNA, 22 nt, Pseudomonas putida KT2440
cuggccauccagucgaucagcg

SEQ ID NO: 1567305 - RNA, 19 nt, Pseudomonas putida KT2440
cuggcauagcaguccugca

SEQ ID NO: 1567306 - RNA, 22 nt, Pseudomonas putida KT2440
cuggcauaguccaggaagcagg

SEQ ID NO: 1567307 - RNA, 22 nt, Pseudomonas putida KT2440
cuggcauccggcagcucaccgg

SEQ ID NO: 1567308 - RNA, 13 nt, Pseudomonas putida KT2440
cuggcauccagcg

SEQ ID NO: 1567309 - RNA, 19 nt, Pseudomonas putida KT2440
cuggcauccagcgccacca

SEQ ID NO: 1567310 - RNA, 18 nt, Pseudomonas putida KT2440
cuggcaugccccucgaac

SEQ ID NO: 1567311 - RNA, 13 nt, Pseudomonas putida KT2440
cuggccaccagca

SEQ ID NO: 1567312 - RNA, 19 nt, Pseudomonas putida KT2440
cuggccacauggaucagcu

SEQ ID NO: 1567313 - RNA, 21 nt, Pseudomonas putida KT2440
cuggccaguuguucgucgagc

SEQ ID NO: 1567314 - RNA, 15 nt, Pseudomonas putida KT2440
cuggccaagcggcuc

SEQ ID NO: 1567315 - RNA, 20 nt, Pseudomonas putida KT2440
cuggccaauuucuacccgcc

SEQ ID NO: 1567316 - RNA, 19 nt, Pseudomonas putida KT2440
cuggccaauugcgccauca

SEQ ID NO: 1567317 - RNA, 17 nt, Pseudomonas putida KT2440
cuggcaauccagcguga

SEQ ID NO: 1567318 - RNA, 20 nt, Pseudomonas putida KT2440
cuggcacaggcuacgcagca

SEQ ID NO: 1567319 - RNA, 17 nt, Pseudomonas putida KT2440
cuggacauaucgcugau

SEQ ID NO: 1567320 - RNA, 22 nt, Pseudomonas putida KT2440
gaauugacccagucagcgccga

SEQ ID NO: 1567321 - RNA, 14 nt, Pseudomonas putida KT2440
gaaugcgcucgaaa

SEQ ID NO: 1567322 - RNA, 17 nt, Pseudomonas putida KT2440
gaauagcaagcgccaau

SEQ ID NO: 1567323 - RNA, 23 nt, Pseudomonas putida KT2440
gaauaguagaagcagaucaucau

SEQ ID NO: 1567324 - RNA, 14 nt, Pseudomonas putida KT2440
gaaucgcggucuug

SEQ ID NO: 1567325 - RNA, 14 nt, Pseudomonas putida KT2440
gaaggugucgaugc

SEQ ID NO: 1567326 - RNA, 17 nt, Pseudomonas putida KT2440
gaagguguucaccacgc

SEQ ID NO: 1567327 - RNA, 16 nt, Pseudomonas putida KT2440
gaagguggccggcaac

SEQ ID NO: 1567328 - RNA, 17 nt, Pseudomonas putida KT2440
gaaggcuccagcaccga

SEQ ID NO: 1567329 - RNA, 19 nt, Pseudomonas putida KT2440
gaaggggaucagcacgcga

SEQ ID NO: 1567330 - RNA, 17 nt, Pseudomonas putida KT2440
gaaggggcggguggagg

SEQ ID NO: 1567331 - RNA, 20 nt, Pseudomonas putida KT2440
gaagguaucggccauggccg

SEQ ID NO: 1567332 - RNA, 19 nt, Pseudomonas putida KT2440
gaaggucacgcccaucagg

SEQ ID NO: 1567333 - RNA, 15 nt, Pseudomonas putida KT2440
gaagucauccauggc

SEQ ID NO: 1567334 - RNA, 19 nt, Pseudomonas putida KT2440
gaagucacuuugucgaugc

SEQ ID NO: 1567335 - RNA, 15 nt, Pseudomonas putida KT2440
gaaguaggcaaacgg

SEQ ID NO: 1567336 - RNA, 16 nt, Pseudomonas putida KT2440
gaaguaggcaaacggc

SEQ ID NO: 1567337 - RNA, 20 nt, Pseudomonas putida KT2440
gaagucgagcgccgcccgca

SEQ ID NO: 1567338 - RNA, 21 nt, Pseudomonas putida KT2440
gaagucggcguagcgcuugaa

SEQ ID NO: 1567339 - RNA, 20 nt, Pseudomonas putida KT2440
gaagugggcuugcccgcgaa

SEQ ID NO: 1567340 - RNA, 19 nt, Pseudomonas putida KT2440
gaaguggcggcucgcugaa

SEQ ID NO: 1567341 - RNA, 20 nt, Pseudomonas putida KT2440
gaagugaucaaugucgagca

SEQ ID NO: 1567342 - RNA, 14 nt, Pseudomonas putida KT2440
gaagugccaaggcu

SEQ ID NO: 1567343 - RNA, 16 nt, Pseudomonas putida KT2440
gaaguugagcaccggc

SEQ ID NO: 1567344 - RNA, 15 nt, Pseudomonas putida KT2440
gaaguggugguagaa

SEQ ID NO: 1567345 - RNA, 21 nt, Pseudomonas putida KT2440
gaaguuaccgcccgcccgacg

SEQ ID NO: 1567346 - RNA, 13 nt, Pseudomonas putida KT2440
gaccaacgccagu

SEQ ID NO: 1567347 - RNA, 15 nt, Pseudomonas putida KT2440
gaccaacgccaguug

SEQ ID NO: 1567348 - RNA, 17 nt, Pseudomonas putida KT2440
gaccaaaaaucuuaacu

SEQ ID NO: 1567349 - RNA, 14 nt, Pseudomonas putida KT2440
gaccaagcaacgca

SEQ ID NO: 1567350 - RNA, 15 nt, Pseudomonas putida KT2440
gaccaaggccaacug

SEQ ID NO: 1567351 - RNA, 14 nt, Pseudomonas putida KT2440
gaccaauccagccc

SEQ ID NO: 1567352 - RNA, 15 nt, Pseudomonas putida KT2440
gaccaauccagcccu

SEQ ID NO: 1567353 - RNA, 22 nt, Pseudomonas putida KT2440
gacaugcaccacgccaccaugc

SEQ ID NO: 1567354 - RNA, 23 nt, Pseudomonas putida KT2440
gacagcuucugguuguaagcguc

SEQ ID NO: 1567355 - RNA, 14 nt, Pseudomonas putida KT2440
gacagcugcggcau

SEQ ID NO: 1567356 - RNA, 18 nt, Pseudomonas putida KT2440
gacagcguugcuccagcu

SEQ ID NO: 1567357 - RNA, 13 nt, Pseudomonas putida KT2440
gacagcucaagcc

SEQ ID NO: 1567358 - RNA, 16 nt, Pseudomonas putida KT2440
gacaucaccaggccgg

SEQ ID NO: 1567359 - RNA, 20 nt, Pseudomonas putida KT2440
gacaaagcucaaaugcuggc

SEQ ID NO: 1567360 - RNA, 12 nt, Pseudomonas putida KT2440
gacaaaggccgg

SEQ ID NO: 1567361 - RNA, 19 nt, Pseudomonas putida KT2440
gacaaacguaccagccgca

SEQ ID NO: 1567362 - RNA, 17 nt, Pseudomonas putida KT2440
gaauuggccggcgcuga

SEQ ID NO: 1567363 - RNA, 20 nt, Pseudomonas putida KT2440
gacacugccaucucgccaag

SEQ ID NO: 1567364 - RNA, 13 nt, Pseudomonas putida KT2440
gacagccacaugc

SEQ ID NO: 1567365 - RNA, 19 nt, Pseudomonas putida KT2440
gacagccacaugccagcua

SEQ ID NO: 1567366 - RNA, 18 nt, Pseudomonas putida KT2440
gaagcccguacagaccgc

SEQ ID NO: 1567367 - RNA, 13 nt, Pseudomonas putida KT2440
gaagcccgugcca

SEQ ID NO: 1567368 - RNA, 22 nt, Pseudomonas putida KT2440
gaagccgaucuuggugaugcug

SEQ ID NO: 1567369 - RNA, 17 nt, Pseudomonas putida KT2440
gaagccaugagcgagcu

SEQ ID NO: 1567370 - RNA, 20 nt, Pseudomonas putida KT2440
gaagccaguacgcgccugca

SEQ ID NO: 1567371 - RNA, 18 nt, Pseudomonas putida KT2440
gaagcagacaacgcggcg

SEQ ID NO: 1567372 - RNA, 14 nt, Pseudomonas putida KT2440
gaagaugguuucca

SEQ ID NO: 1567373 - RNA, 15 nt, Pseudomonas putida KT2440
gaagccuuggccuug

SEQ ID NO: 1567374 - RNA, 18 nt, Pseudomonas putida KT2440
gaagcgcaccaguguagu

SEQ ID NO: 1567375 - RNA, 13 nt, Pseudomonas putida KT2440
gaagcgcaccucg

SEQ ID NO: 1567376 - RNA, 14 nt, Pseudomonas putida KT2440
gaagcgccgcaggu

SEQ ID NO: 1567377 - RNA, 20 nt, Pseudomonas putida KT2440
gaagccuucacggauggcag

SEQ ID NO: 1567378 - RNA, 15 nt, Pseudomonas putida KT2440
gaagccuucaucacg

SEQ ID NO: 1567379 - RNA, 16 nt, Pseudomonas putida KT2440
gaaggcaggucagcga

SEQ ID NO: 1567380 - RNA, 17 nt, Pseudomonas putida KT2440
gaaggcauccacaccgu

SEQ ID NO: 1567381 - RNA, 13 nt, Pseudomonas putida KT2440
gaaggccagcaaa

SEQ ID NO: 1567382 - RNA, 16 nt, Pseudomonas putida KT2440
gaaggccagccgagcc

SEQ ID NO: 1567383 - RNA, 14 nt, Pseudomonas putida KT2440
gaagcuggccagcc

SEQ ID NO: 1567384 - RNA, 17 nt, Pseudomonas putida KT2440
gaagcuuggggcgaugu

SEQ ID NO: 1567385 - RNA, 19 nt, Pseudomonas putida KT2440
gaagcuguagucaccaccg

SEQ ID NO: 1567386 - RNA, 18 nt, Pseudomonas putida KT2440
gaaggccguggcaaggcc

SEQ ID NO: 1567387 - RNA, 22 nt, Pseudomonas putida KT2440
gaaggccucacgcaucugcgcu

SEQ ID NO: 1567388 - RNA, 15 nt, Pseudomonas putida KT2440
gaagcggaaguucac

SEQ ID NO: 1567389 - RNA, 20 nt, Pseudomonas putida KT2440
gaagcggcuaccgcugcgca

SEQ ID NO: 1567390 - RNA, 21 nt, Pseudomonas putida KT2440
gaagcgguacaccucaucacg

SEQ ID NO: 1567391 - RNA, 19 nt, Pseudomonas putida KT2440
gaagcgggcgugcccgcga

SEQ ID NO: 1567392 - RNA, 15 nt, Pseudomonas putida KT2440
gaagcugcagcagcu

SEQ ID NO: 1567393 - RNA, 16 nt, Pseudomonas putida KT2440
gaagcucuggucgauc

SEQ ID NO: 1567394 - RNA, 17 nt, Pseudomonas putida KT2440
gaagcucuccagcaggu

SEQ ID NO: 1567395 - RNA, 13 nt, Pseudomonas putida KT2440
gaagcuccaggcg

SEQ ID NO: 1567396 - RNA, 22 nt, Pseudomonas putida KT2440
gaagcguuuacugcugaugcgg

SEQ ID NO: 1567397 - RNA, 22 nt, Pseudomonas putida KT2440
gaacgcuuggccagaaacggcg

SEQ ID NO: 1567398 - RNA, 21 nt, Pseudomonas putida KT2440
gaacgcugccugcaggcugcc

SEQ ID NO: 1567399 - RNA, 12 nt, Pseudomonas putida KT2440
gaacgcagcgcc

SEQ ID NO: 1567400 - RNA, 18 nt, Pseudomonas putida KT2440
gaacgcagcgccgccaac

SEQ ID NO: 1567401 - RNA, 14 nt, Pseudomonas putida KT2440
gaacgcgguaagca

SEQ ID NO: 1567402 - RNA, 16 nt, Pseudomonas putida KT2440
gaacgauucugccagc

SEQ ID NO: 1567403 - RNA, 15 nt, Pseudomonas putida KT2440
gaacgaggacugcac

SEQ ID NO: 1567404 - RNA, 18 nt, Pseudomonas putida KT2440
gaaaccguuggucagcga

SEQ ID NO: 1567405 - RNA, 13 nt, Pseudomonas putida KT2440
gaagaggccagua

SEQ ID NO: 1567406 - RNA, 20 nt, Pseudomonas putida KT2440
gaagaggccaguaccagcag

SEQ ID NO: 1567407 - RNA, 13 nt, Pseudomonas putida KT2440
gaagaggcccgaa

SEQ ID NO: 1567408 - RNA, 20 nt, Pseudomonas putida KT2440
gaagaggcccgaacagacaa

SEQ ID NO: 1567409 - RNA, 20 nt, Pseudomonas putida KT2440
gaagaggccgguacaggcuu

SEQ ID NO: 1567410 - RNA, 14 nt, Pseudomonas putida KT2440
gaagagggcgacac

SEQ ID NO: 1567411 - RNA, 16 nt, Pseudomonas putida KT2440
gaagauacccgccacc

SEQ ID NO: 1567412 - RNA, 16 nt, Pseudomonas putida KT2440
gaagaucaccuggucg

SEQ ID NO: 1567413 - RNA, 17 nt, Pseudomonas putida KT2440
gaagaucgguacaugcg

SEQ ID NO: 1567414 - RNA, 23 nt, Pseudomonas putida KT2440
gaagaagucauccggcgcggccu

SEQ ID NO: 1567415 - RNA, 23 nt, Pseudomonas putida KT2440
gaagacgaaauacuuacguacag

SEQ ID NO: 1567416 - RNA, 21 nt, Pseudomonas putida KT2440
gaagacgcacacuccccucga

SEQ ID NO: 1567417 - RNA, 18 nt, Pseudomonas putida KT2440
gaagacgcucgacagcaa

SEQ ID NO: 1567418 - RNA, 11 nt, Pseudomonas putida KT2440
gaagaacuccu

SEQ ID NO: 1567419 - RNA, 16 nt, Pseudomonas putida KT2440
gaacguggugcgggcc

SEQ ID NO: 1567420 - RNA, 20 nt, Pseudomonas putida KT2440
gacgaugccguacaccaugc

SEQ ID NO: 1567421 - RNA, 13 nt, Pseudomonas putida KT2440
gacgaugauggcc

SEQ ID NO: 1567422 - RNA, 14 nt, Pseudomonas putida KT2440
gacgaugaggccgg

SEQ ID NO: 1567423 - RNA, 18 nt, Pseudomonas putida KT2440
gacgcaaggccgcuccca

SEQ ID NO: 1567424 - RNA, 18 nt, Pseudomonas putida KT2440
gacgcaaaaaacccggcg

SEQ ID NO: 1567425 - RNA, 23 nt, Pseudomonas putida KT2440
gacgaucaccagguugcgugccu

SEQ ID NO: 1567426 - RNA, 17 nt, Pseudomonas putida KT2440
gacgaucgagccgguca

SEQ ID NO: 1567427 - RNA, 13 nt, Pseudomonas putida KT2440
gacgcgcgcuggc

SEQ ID NO: 1567428 - RNA, 21 nt, Pseudomonas putida KT2440
gacgcggaacuggcugaccag

SEQ ID NO: 1567429 - RNA, 16 nt, Pseudomonas putida KT2440
gacgccgccauccugg

SEQ ID NO: 1567430 - RNA, 22 nt, Pseudomonas putida KT2440
gacgccgcagugacacggcgau

SEQ ID NO: 1567431 - RNA, 12 nt, Pseudomonas putida KT2440
gacgccaccaag

SEQ ID NO: 1567432 - RNA, 13 nt, Pseudomonas putida KT2440
gacgccaccuucg

SEQ ID NO: 1567433 - RNA, 23 nt, Pseudomonas putida KT2440
gacggcauggccgaagcggucgu

SEQ ID NO: 1567434 - RNA, 18 nt, Pseudomonas putida KT2440
gacgcuccagacgcugua

SEQ ID NO: 1567435 - RNA, 13 nt, Pseudomonas putida KT2440
gacggcgcugcug

SEQ ID NO: 1567436 - RNA, 15 nt, Pseudomonas putida KT2440
gacgggaagugcacu

SEQ ID NO: 1567437 - RNA, 17 nt, Pseudomonas putida KT2440
gacgggaagugcacugc

SEQ ID NO: 1567438 - RNA, 22 nt, Pseudomonas putida KT2440
gacgggaagugcacugccuggc

SEQ ID NO: 1567439 - RNA, 22 nt, Pseudomonas putida KT2440
gacggcgaagucacaccaucgg

SEQ ID NO: 1567440 - RNA, 22 nt, Pseudomonas putida KT2440
gacggcgaggugauugaaggca

SEQ ID NO: 1567441 - RNA, 18 nt, Pseudomonas putida KT2440
gacguagugacgcggauc

SEQ ID NO: 1567442 - RNA, 13 nt, Pseudomonas putida KT2440
gacgggcauggug

SEQ ID NO: 1567443 - RNA, 19 nt, Pseudomonas putida KT2440
gacggugcgccugaacagc

SEQ ID NO: 1567444 - RNA, 11 nt, Pseudomonas putida KT2440
gacgagccagu

SEQ ID NO: 1567445 - RNA, 15 nt, Pseudomonas putida KT2440
gacgaacccuugacc

SEQ ID NO: 1567446 - RNA, 22 nt, Pseudomonas putida KT2440
gaccguuucauugccgugcucg

SEQ ID NO: 1567447 - RNA, 14 nt, Pseudomonas putida KT2440
gaccggcacugcac

SEQ ID NO: 1567448 - RNA, 19 nt, Pseudomonas putida KT2440
gaccugccagucgcacagg

SEQ ID NO: 1567449 - RNA, 19 nt, Pseudomonas putida KT2440
gaccugcaacgucgccacg

SEQ ID NO: 1567450 - RNA, 21 nt, Pseudomonas putida KT2440
gaccucgaccaggcgcucgcu

SEQ ID NO: 1567451 - RNA, 22 nt, Pseudomonas putida KT2440
gaccucgacccgcccgccaugc

SEQ ID NO: 1567452 - RNA, 19 nt, Pseudomonas putida KT2440
gaccucgaugcccuccagc

SEQ ID NO: 1567453 - RNA, 22 nt, Pseudomonas putida KT2440
gaccuccgagucuccgcgcuug

SEQ ID NO: 1567454 - RNA, 16 nt, Pseudomonas putida KT2440
gaccucagccgugguu

SEQ ID NO: 1567455 - RNA, 16 nt, Pseudomonas putida KT2440
gacccgcgucagcuca

SEQ ID NO: 1567456 - RNA, 19 nt, Pseudomonas putida KT2440
gacccgcgucucgccgcug

SEQ ID NO: 1567457 - RNA, 12 nt, Pseudomonas putida KT2440
gacccgccuggu

SEQ ID NO: 1567458 - RNA, 16 nt, Pseudomonas putida KT2440
gacccccuugccagca

SEQ ID NO: 1567459 - RNA, 16 nt, Pseudomonas putida KT2440
gacccagcggucagca

SEQ ID NO: 1567460 - RNA, 16 nt, Pseudomonas putida KT2440
gacccaguucgcggau

SEQ ID NO: 1567461 - RNA, 17 nt, Pseudomonas putida KT2440
gacccaguucgcggauc

SEQ ID NO: 1567462 - RNA, 22 nt, Pseudomonas putida KT2440
gacccaaucgcugugcaacagc

SEQ ID NO: 1567463 - RNA, 14 nt, Pseudomonas putida KT2440
gacccacaggcaca

SEQ ID NO: 1567464 - RNA, 15 nt, Pseudomonas putida KT2440
gacccacaggcacag

SEQ ID NO: 1567465 - RNA, 16 nt, Pseudomonas putida KT2440
gaccaccgccaaggca

SEQ ID NO: 1567466 - RNA, 18 nt, Pseudomonas putida KT2440
gaccaccgccaaggcacg

SEQ ID NO: 1567467 - RNA, 21 nt, Pseudomonas putida KT2440
gaccacccggugacggcaucg

SEQ ID NO: 1567468 - RNA, 23 nt, Pseudomonas putida KT2440
gaccgccauugacuaccagguag

SEQ ID NO: 1567469 - RNA, 17 nt, Pseudomonas putida KT2440
gaccgccgcccagguca

SEQ ID NO: 1567470 - RNA, 19 nt, Pseudomonas putida KT2440
gaccgaaccggcgcuggcc

SEQ ID NO: 1567471 - RNA, 19 nt, Pseudomonas putida KT2440
gacccugugggagcgggcu

SEQ ID NO: 1567472 - RNA, 19 nt, Pseudomonas putida KT2440
gaccgcgcauuugcuccag

SEQ ID NO: 1567473 - RNA, 15 nt, Pseudomonas putida KT2440
gaccgccugcgcacg

SEQ ID NO: 1567474 - RNA, 20 nt, Pseudomonas putida KT2440
gaccgccugcgcacggcgcu

SEQ ID NO: 1567475 - RNA, 21 nt, Pseudomonas putida KT2440
gccaccgccacugaccagccc

SEQ ID NO: 1567476 - RNA, 21 nt, Pseudomonas putida KT2440
gccaccgacuccggcaaggca

SEQ ID NO: 1567477 - RNA, 19 nt, Pseudomonas putida KT2440
gccaccgcacucugcugcu

SEQ ID NO: 1567478 - RNA, 16 nt, Pseudomonas putida KT2440
gccaccgaucucgcca

SEQ ID NO: 1567479 - RNA, 20 nt, Pseudomonas putida KT2440
gccaccgaaggcgucacccg

SEQ ID NO: 1567480 - RNA, 23 nt, Pseudomonas putida KT2440
gccaccgacauuguaggcggcaa

SEQ ID NO: 1567481 - RNA, 20 nt, Pseudomonas putida KT2440
gccaccggcgcugcguuggc

SEQ ID NO: 1567482 - RNA, 13 nt, Pseudomonas putida KT2440
gccaccggcagca

SEQ ID NO: 1567483 - RNA, 22 nt, Pseudomonas putida KT2440
gccaccggcauucccggcgcca

SEQ ID NO: 1567484 - RNA, 18 nt, Pseudomonas putida KT2440
gccaccggccacgcgcag

SEQ ID NO: 1567485 - RNA, 16 nt, Pseudomonas putida KT2440
gccaccggacagaauc

SEQ ID NO: 1567486 - RNA, 14 nt, Pseudomonas putida KT2440
gccaccgucgaaca

SEQ ID NO: 1567487 - RNA, 22 nt, Pseudomonas putida KT2440
gccaccucgacccccuugccag

SEQ ID NO: 1567488 - RNA, 18 nt, Pseudomonas putida KT2440
gccaccguugcgcucgag

SEQ ID NO: 1567489 - RNA, 13 nt, Pseudomonas putida KT2440
gccaccguggcaa

SEQ ID NO: 1567490 - RNA, 16 nt, Pseudomonas putida KT2440
gccaccgugagcaugg

SEQ ID NO: 1567491 - RNA, 14 nt, Pseudomonas putida KT2440
gccaccaucgccgg

SEQ ID NO: 1567492 - RNA, 19 nt, Pseudomonas putida KT2440
gccaccaucuugcccaggg

SEQ ID NO: 1567493 - RNA, 22 nt, Pseudomonas putida KT2440
gccaccaucuugcccagggcug

SEQ ID NO: 1567494 - RNA, 21 nt, Pseudomonas putida KT2440
gccaccaugaacagcacgccc

SEQ ID NO: 1567495 - RNA, 16 nt, Pseudomonas putida KT2440
gccaccagugccgggu

SEQ ID NO: 1567496 - RNA, 18 nt, Pseudomonas putida KT2440
gccaccaugcucaccgcc

SEQ ID NO: 1567497 - RNA, 14 nt, Pseudomonas putida KT2440
gccaccaucgaccu

SEQ ID NO: 1567498 - RNA, 16 nt, Pseudomonas putida KT2440
gccaccaggccuuuga

SEQ ID NO: 1567499 - RNA, 14 nt, Pseudomonas putida KT2440
gccaccaggcgcgg

SEQ ID NO: 1567500 - RNA, 19 nt, Pseudomonas putida KT2440
gccaccaggcgcggcagca

SEQ ID NO: 1567501 - RNA, 21 nt, Pseudomonas putida KT2440
gccaccccgcaaagcccugcc

SEQ ID NO: 1567502 - RNA, 16 nt, Pseudomonas putida KT2440
gccacccccgccgcca

SEQ ID NO: 1567503 - RNA, 21 nt, Pseudomonas putida KT2440
gccacccagaacagccacagc

SEQ ID NO: 1567504 - RNA, 14 nt, Pseudomonas putida KT2440
gccaccccaggcca

SEQ ID NO: 1567505 - RNA, 17 nt, Pseudomonas putida KT2440
gccacccaccacggccu

SEQ ID NO: 1567506 - RNA, 15 nt, Pseudomonas putida KT2440
gccacccggcugcau

SEQ ID NO: 1567507 - RNA, 20 nt, Pseudomonas putida KT2440
gccacccggcugcauccacc

SEQ ID NO: 1567508 - RNA, 17 nt, Pseudomonas putida KT2440
gccacccggaccagcgc

SEQ ID NO: 1567509 - RNA, 21 nt, Pseudomonas putida KT2440
gccacccgaacaaaacccuuc

SEQ ID NO: 1567510 - RNA, 17 nt, Pseudomonas putida KT2440
gccaccagcauggcguc

SEQ ID NO: 1567511 - RNA, 22 nt, Pseudomonas putida KT2440
gccaccagcaccugcagguaca

SEQ ID NO: 1567512 - RNA, 19 nt, Pseudomonas putida KT2440
gccaccagcaucaacaggu

SEQ ID NO: 1567513 - RNA, 19 nt, Pseudomonas putida KT2440
gccaccacgucacgcacca

SEQ ID NO: 1567514 - RNA, 21 nt, Pseudomonas putida KT2440
gccaccacccgcugggugcgc

SEQ ID NO: 1567515 - RNA, 16 nt, Pseudomonas putida KT2440
gccaauaacucgcagc

SEQ ID NO: 1567516 - RNA, 18 nt, Pseudomonas putida KT2440
gccaaucaaccgcuuggc

SEQ ID NO: 1567517 - RNA, 14 nt, Pseudomonas putida KT2440
gccaaggucagcaa

SEQ ID NO: 1567518 - RNA, 20 nt, Pseudomonas putida KT2440
gccaagguccagccacgaau

SEQ ID NO: 1567519 - RNA, 22 nt, Pseudomonas putida KT2440
gccaaggguuugccaggcgcag

SEQ ID NO: 1567520 - RNA, 21 nt, Pseudomonas putida KT2440
gccaaucaucgccagcagcgc

SEQ ID NO: 1567521 - RNA, 23 nt, Pseudomonas putida KT2440
gccaaucaucgccagcagcgcuc

SEQ ID NO: 1567522 - RNA, 16 nt, Pseudomonas putida KT2440
gccaaucaccugcaca

SEQ ID NO: 1567523 - RNA, 23 nt, Pseudomonas putida KT2440
gccaagccaccgccaccaucggc

SEQ ID NO: 1567524 - RNA, 18 nt, Pseudomonas putida KT2440
gccaagcccacacaccgc

SEQ ID NO: 1567525 - RNA, 17 nt, Pseudomonas putida KT2440
gccaagccgcugccaca

SEQ ID NO: 1567526 - RNA, 23 nt, Pseudomonas putida KT2440
gccaagccggcuuugcgucauca

SEQ ID NO: 1567527 - RNA, 18 nt, Pseudomonas putida KT2440
gccaaggcggcgaucgac

SEQ ID NO: 1567528 - RNA, 13 nt, Pseudomonas putida KT2440
gccaaggcguggc

SEQ ID NO: 1567529 - RNA, 17 nt, Pseudomonas putida KT2440
gccaagcggccccagau

SEQ ID NO: 1567530 - RNA, 16 nt, Pseudomonas putida KT2440
gcaucgaacuccugca

SEQ ID NO: 1567531 - RNA, 22 nt, Pseudomonas putida KT2440
gcaucgaacuccugcaccgaag

SEQ ID NO: 1567532 - RNA, 19 nt, Pseudomonas putida KT2440
gcauccuggucacucugcc

SEQ ID NO: 1567533 - RNA, 18 nt, Pseudomonas putida KT2440
gccaacuccccacccagg

SEQ ID NO: 1567534 - RNA, 19 nt, Pseudomonas putida KT2440
gccaagcacgcacaguggu

SEQ ID NO: 1567535 - RNA, 19 nt, Pseudomonas putida KT2440
gccaacuguuucugcucuu

SEQ ID NO: 1567536 - RNA, 13 nt, Pseudomonas putida KT2440
gcauccagcgcca

SEQ ID NO: 1567537 - RNA, 12 nt, Pseudomonas putida KT2440
gcauccaggcgu

SEQ ID NO: 1567538 - RNA, 16 nt, Pseudomonas putida KT2440
gcauccugcgugcugu

SEQ ID NO: 1567539 - RNA, 14 nt, Pseudomonas putida KT2440
gcauccugcacugc

SEQ ID NO: 1567540 - RNA, 19 nt, Pseudomonas putida KT2440
gccacacugucccggcaca

SEQ ID NO: 1567541 - RNA, 20 nt, Pseudomonas putida KT2440
gccacacugucccggcacaa

SEQ ID NO: 1567542 - RNA, 17 nt, Pseudomonas putida KT2440
gccacagcgccaacgcc

SEQ ID NO: 1567543 - RNA, 16 nt, Pseudomonas putida KT2440
gccaccaagcccuucu

SEQ ID NO: 1567544 - RNA, 15 nt, Pseudomonas putida KT2440
gccacauggaucagc

SEQ ID NO: 1567545 - RNA, 18 nt, Pseudomonas putida KT2440
gccaccacacuggucacg

SEQ ID NO: 1567546 - RNA, 19 nt, Pseudomonas putida KT2440
gccaccacacuggucacgc

SEQ ID NO: 1567547 - RNA, 17 nt, Pseudomonas putida KT2440
gccaccaaaggccuuga

SEQ ID NO: 1567548 - RNA, 18 nt, Pseudomonas putida KT2440
gccacauaguaggcaaug

SEQ ID NO: 1567549 - RNA, 20 nt, Pseudomonas putida KT2440
gccacauaguaggcaaugcc

SEQ ID NO: 1567550 - RNA, 21 nt, Pseudomonas putida KT2440
gccacauccucugcccgcaag

SEQ ID NO: 1567551 - RNA, 15 nt, Pseudomonas putida KT2440
gccacauccgcgcau

SEQ ID NO: 1567552 - RNA, 17 nt, Pseudomonas putida KT2440
gccacaugcccgcggcu

SEQ ID NO: 1567553 - RNA, 22 nt, Pseudomonas putida KT2440
gccacaugaaggccguaggcca

SEQ ID NO: 1567554 - RNA, 14 nt, Pseudomonas putida KT2440
gccacaucggcaag

SEQ ID NO: 1567555 - RNA, 15 nt, Pseudomonas putida KT2440
gccacaucggcaagu

SEQ ID NO: 1567556 - RNA, 22 nt, Pseudomonas putida KT2440
gccaauggcaaucccccgcuca

SEQ ID NO: 1567557 - RNA, 23 nt, Pseudomonas putida KT2440
gccaauuucaacgcucgcgcaug

SEQ ID NO: 1567558 - RNA, 19 nt, Pseudomonas putida KT2440
gccacaccugccaggccaa

SEQ ID NO: 1567559 - RNA, 20 nt, Pseudomonas putida KT2440
gccacaacccuugcagcgcc

SEQ ID NO: 1567560 - RNA, 13 nt, Pseudomonas putida KT2440
gccacaccacagc

SEQ ID NO: 1567561 - RNA, 16 nt, Pseudomonas putida KT2440
gccacaccacagcugc

SEQ ID NO: 1567562 - RNA, 15 nt, Pseudomonas putida KT2440
gccagcccugccgag

SEQ ID NO: 1567563 - RNA, 14 nt, Pseudomonas putida KT2440
gccagcaggccacc

SEQ ID NO: 1567564 - RNA, 18 nt, Pseudomonas putida KT2440
gccagcaggccaccggca

SEQ ID NO: 1567565 - RNA, 23 nt, Pseudomonas putida KT2440
gccagcaggcccggcccauucgc

SEQ ID NO: 1567566 - RNA, 17 nt, Pseudomonas putida KT2440
gccagcaggacgauacc

SEQ ID NO: 1567567 - RNA, 22 nt, Pseudomonas putida KT2440
gccagcaggacgauaccguugu

SEQ ID NO: 1567568 - RNA, 13 nt, Pseudomonas putida KT2440
gccagcaggccgc

SEQ ID NO: 1567569 - RNA, 19 nt, Pseudomonas putida KT2440
gccagcaggccgccgacga

SEQ ID NO: 1567570 - RNA, 14 nt, Pseudomonas putida KT2440
gccagcagcuccau

SEQ ID NO: 1567571 - RNA, 16 nt, Pseudomonas putida KT2440
gccagcagcuccauac

SEQ ID NO: 1567572 - RNA, 12 nt, Pseudomonas putida KT2440
gccagcagcgcg

SEQ ID NO: 1567573 - RNA, 12 nt, Pseudomonas putida KT2440
gccagcagcccc

SEQ ID NO: 1567574 - RNA, 13 nt, Pseudomonas putida KT2440
gccagcagccugu

SEQ ID NO: 1567575 - RNA, 13 nt, Pseudomonas putida KT2440
gccagcagcgcgu

SEQ ID NO: 1567576 - RNA, 14 nt, Pseudomonas putida KT2440
gccagcagcuggcu

SEQ ID NO: 1567577 - RNA, 18 nt, Pseudomonas putida KT2440
gccagcagcuggcuuguc

SEQ ID NO: 1567578 - RNA, 13 nt, Pseudomonas putida KT2440
gccagcagcuggu

SEQ ID NO: 1567579 - RNA, 16 nt, Pseudomonas putida KT2440
gccagcagcuggucgu

SEQ ID NO: 1567580 - RNA, 15 nt, Pseudomonas putida KT2440
gccagcgcaucggcc

SEQ ID NO: 1567581 - RNA, 23 nt, Pseudomonas putida KT2440
gccagcgcaucggccacuucgcg

SEQ ID NO: 1567582 - RNA, 16 nt, Pseudomonas putida KT2440
gccagccggcgcauca

SEQ ID NO: 1567583 - RNA, 14 nt, Pseudomonas putida KT2440
gccagcuucgacga

SEQ ID NO: 1567584 - RNA, 18 nt, Pseudomonas putida KT2440
gccaggaacagcgcagcc

SEQ ID NO: 1567585 - RNA, 16 nt, Pseudomonas putida KT2440
gccagcuaucucccag

SEQ ID NO: 1567586 - RNA, 15 nt, Pseudomonas putida KT2440
gccagcguuuccggg

SEQ ID NO: 1567587 - RNA, 18 nt, Pseudomonas putida KT2440
gccagcguuuccggguug

SEQ ID NO: 1567588 - RNA, 14 nt, Pseudomonas putida KT2440
gccagcucauccag

SEQ ID NO: 1567589 - RNA, 23 nt, Pseudomonas putida KT2440
gccagcuccuggcucaguggcug

SEQ ID NO: 1567590 - RNA, 16 nt, Pseudomonas putida KT2440
gccagcugcgcacgca

SEQ ID NO: 1567591 - RNA, 23 nt, Pseudomonas putida KT2440
gccagcgcgcugcgcaaggacga

SEQ ID NO: 1567592 - RNA, 17 nt, Pseudomonas putida KT2440
gccagcgguccggcccu

SEQ ID NO: 1567593 - RNA, 13 nt, Pseudomonas putida KT2440
gccagcggugcca

SEQ ID NO: 1567594 - RNA, 22 nt, Pseudomonas putida KT2440
gccagcgggucgucgcccaggc

SEQ ID NO: 1567595 - RNA, 16 nt, Pseudomonas putida KT2440
gccagagcgcgccacg

SEQ ID NO: 1567596 - RNA, 18 nt, Pseudomonas putida KT2440
gccagagcgcgccacgca

SEQ ID NO: 1567597 - RNA, 14 nt, Pseudomonas putida KT2440
gccacuucgucgag

SEQ ID NO: 1567598 - RNA, 14 nt, Pseudomonas putida KT2440
gccacuucgcggaa

SEQ ID NO: 1567599 - RNA, 23 nt, Pseudomonas putida KT2440
gccacuucuuccacgcgcucacg

SEQ ID NO: 1567600 - RNA, 13 nt, Pseudomonas putida KT2440
gccagcaccagcg

SEQ ID NO: 1567601 - RNA, 12 nt, Pseudomonas putida KT2440
gccagcaacgca

SEQ ID NO: 1567602 - RNA, 16 nt, Pseudomonas putida KT2440
gccagcaacgcagcca

SEQ ID NO: 1567603 - RNA, 18 nt, Pseudomonas putida KT2440
gccagcaacgcagccagg

SEQ ID NO: 1567604 - RNA, 19 nt, Pseudomonas putida KT2440
gccagcaccgaaccggcga

SEQ ID NO: 1567605 - RNA, 19 nt, Pseudomonas putida KT2440
gccagcacgaacagcaaca

SEQ ID NO: 1567606 - RNA, 14 nt, Pseudomonas putida KT2440
gccagcaccuggcg

SEQ ID NO: 1567607 - RNA, 15 nt, Pseudomonas putida KT2440
gccagcacggccagc

SEQ ID NO: 1567608 - RNA, 20 nt, Pseudomonas putida KT2440
gccagcacggccagcaccga

SEQ ID NO: 1567609 - RNA, 14 nt, Pseudomonas putida KT2440
gccagcagauggcu

SEQ ID NO: 1567610 - RNA, 21 nt, Pseudomonas putida KT2440
gccagcagauggcucaucgcc

SEQ ID NO: 1567611 - RNA, 15 nt, Pseudomonas putida KT2440
gccacuucaugggcc

SEQ ID NO: 1567612 - RNA, 14 nt, Pseudomonas putida KT2440
gccacuggucgccu

SEQ ID NO: 1567613 - RNA, 16 nt, Pseudomonas putida KT2440
gccacuguugcagcgc

SEQ ID NO: 1567614 - RNA, 17 nt, Pseudomonas putida KT2440
gccacuguugcagcgcc

SEQ ID NO: 1567615 - RNA, 18 nt, Pseudomonas putida KT2440
gccacuguugcagcgcca

SEQ ID NO: 1567616 - RNA, 20 nt, Pseudomonas putida KT2440
gccacuguugcagcgccagu

SEQ ID NO: 1567617 - RNA, 17 nt, Pseudomonas putida KT2440
gccacggucuggcgcag

SEQ ID NO: 1567618 - RNA, 16 nt, Pseudomonas putida KT2440
gccaccuucagcgggu

SEQ ID NO: 1567619 - RNA, 13 nt, Pseudomonas putida KT2440
gccacgaacaggc

SEQ ID NO: 1567620 - RNA, 13 nt, Pseudomonas putida KT2440
gccacgaccacga

SEQ ID NO: 1567621 - RNA, 22 nt, Pseudomonas putida KT2440
gccacgaauuucaaggcgccga

SEQ ID NO: 1567622 - RNA, 16 nt, Pseudomonas putida KT2440
gccacgacaccgggau

SEQ ID NO: 1567623 - RNA, 19 nt, Pseudomonas putida KT2440
gccaccuguugccgcuucg

SEQ ID NO: 1567624 - RNA, 19 nt, Pseudomonas putida KT2440
gccaccuggcugcgggugc

SEQ ID NO: 1567625 - RNA, 15 nt, Pseudomonas putida KT2440
gccaccucgcuaccc

SEQ ID NO: 1567626 - RNA, 22 nt, Pseudomonas putida KT2440
gccaccugauguacaaggaccu

SEQ ID NO: 1567627 - RNA, 20 nt, Pseudomonas putida KT2440
gccacgcccuuuuucaccag

SEQ ID NO: 1567628 - RNA, 20 nt, Pseudomonas putida KT2440
gccacgcccgguugcaccga

SEQ ID NO: 1567629 - RNA, 20 nt, Pseudomonas putida KT2440
gccacgcccgucaccuugcc

SEQ ID NO: 1567630 - RNA, 15 nt, Pseudomonas putida KT2440
gccacgccgccagau

SEQ ID NO: 1567631 - RNA, 15 nt, Pseudomonas putida KT2440
gccacggaucaccug

SEQ ID NO: 1567632 - RNA, 17 nt, Pseudomonas putida KT2440
gccacggaucaccuggc

SEQ ID NO: 1567633 - RNA, 15 nt, Pseudomonas putida KT2440
gcccacugcagccau

SEQ ID NO: 1567634 - RNA, 15 nt, Pseudomonas putida KT2440
gcccacucacgcaac

SEQ ID NO: 1567635 - RNA, 16 nt, Pseudomonas putida KT2440
gcccacggcgaugguc

SEQ ID NO: 1567636 - RNA, 23 nt, Pseudomonas putida KT2440
gcccagcaacagccccaucacca

SEQ ID NO: 1567637 - RNA, 15 nt, Pseudomonas putida KT2440
gcccagaucagcagc

SEQ ID NO: 1567638 - RNA, 12 nt, Pseudomonas putida KT2440
gcccagccagcg

SEQ ID NO: 1567639 - RNA, 22 nt, Pseudomonas putida KT2440
gcccagccccgagcaaagcccg

SEQ ID NO: 1567640 - RNA, 15 nt, Pseudomonas putida KT2440
gcccagccaccgacg

SEQ ID NO: 1567641 - RNA, 14 nt, Pseudomonas putida KT2440
gcccagcagguaca

SEQ ID NO: 1567642 - RNA, 22 nt, Pseudomonas putida KT2440
gcccagcagguagacgaugccg

SEQ ID NO: 1567643 - RNA, 20 nt, Pseudomonas putida KT2440
gcccagccaacccucgaccu

SEQ ID NO: 1567644 - RNA, 13 nt, Pseudomonas putida KT2440
gcccagcagccaa

SEQ ID NO: 1567645 - RNA, 13 nt, Pseudomonas putida KT2440
gcccagcagcccc

SEQ ID NO: 1567646 - RNA, 20 nt, Pseudomonas putida KT2440
gcccaccgcauugcaggcca

SEQ ID NO: 1567647 - RNA, 22 nt, Pseudomonas putida KT2440
gcccaccgaucacggggcgacg

SEQ ID NO: 1567648 - RNA, 16 nt, Pseudomonas putida KT2440
gcccacccggcugaaa

SEQ ID NO: 1567649 - RNA, 15 nt, Pseudomonas putida KT2440
gcccaccgcguuggc

SEQ ID NO: 1567650 - RNA, 15 nt, Pseudomonas putida KT2440
gcccaccgcugcaau

SEQ ID NO: 1567651 - RNA, 17 nt, Pseudomonas putida KT2440
gcccaccgucaggcuca

SEQ ID NO: 1567652 - RNA, 20 nt, Pseudomonas putida KT2440
gcccacgaucucacgcgcca

SEQ ID NO: 1567653 - RNA, 13 nt, Pseudomonas putida KT2440
gcccacgccgcug

SEQ ID NO: 1567654 - RNA, 16 nt, Pseudomonas putida KT2440
gcccacgccgcuggua

SEQ ID NO: 1567655 - RNA, 19 nt, Pseudomonas putida KT2440
gcccacgcggguccagcgc

SEQ ID NO: 1567656 - RNA, 19 nt, Pseudomonas putida KT2440
gccaugcuuuccaggucgg

SEQ ID NO: 1567657 - RNA, 18 nt, Pseudomonas putida KT2440
gccaugcgcaggcagcga

SEQ ID NO: 1567658 - RNA, 18 nt, Pseudomonas putida KT2440
gccauggccgaucuucag

SEQ ID NO: 1567659 - RNA, 15 nt, Pseudomonas putida KT2440
gccauggccgagcca

SEQ ID NO: 1567660 - RNA, 18 nt, Pseudomonas putida KT2440
gcccacaaguccgaacuc

SEQ ID NO: 1567661 - RNA, 13 nt, Pseudomonas putida KT2440
gcccacacggcaa

SEQ ID NO: 1567662 - RNA, 20 nt, Pseudomonas putida KT2440
gcccacacggcaagccacgc

SEQ ID NO: 1567663 - RNA, 21 nt, Pseudomonas putida KT2440
gcccacagugcuuccagcagg

SEQ ID NO: 1567664 - RNA, 21 nt, Pseudomonas putida KT2440
gcccacagugucccggccagg

SEQ ID NO: 1567665 - RNA, 18 nt, Pseudomonas putida KT2440
gcccacaggggcuguaua

SEQ ID NO: 1567666 - RNA, 19 nt, Pseudomonas putida KT2440
gccagugcgcccgaggcaa

SEQ ID NO: 1567667 - RNA, 17 nt, Pseudomonas putida KT2440
gccagugaccgcuggcg

SEQ ID NO: 1567668 - RNA, 15 nt, Pseudomonas putida KT2440
gccagugcggugacc

SEQ ID NO: 1567669 - RNA, 17 nt, Pseudomonas putida KT2440
gccaguuguccgggugu

SEQ ID NO: 1567670 - RNA, 17 nt, Pseudomonas putida KT2440
gccaguuugugcucgag

SEQ ID NO: 1567671 - RNA, 19 nt, Pseudomonas putida KT2440
gccaguugccccaggccca

SEQ ID NO: 1567672 - RNA, 23 nt, Pseudomonas putida KT2440
gccaguuucaccugaccaucagc

SEQ ID NO: 1567673 - RNA, 22 nt, Pseudomonas putida KT2440
gccaguuggcguauuuuggcag

SEQ ID NO: 1567674 - RNA, 16 nt, Pseudomonas putida KT2440
gccaguuccucggccu

SEQ ID NO: 1567675 - RNA, 14 nt, Pseudomonas putida KT2440
gccaguaaggcuug

SEQ ID NO: 1567676 - RNA, 15 nt, Pseudomonas putida KT2440
gccaguaaggcuugc

SEQ ID NO: 1567677 - RNA, 15 nt, Pseudomonas putida KT2440
gccagguuguucagu

SEQ ID NO: 1567678 - RNA, 19 nt, Pseudomonas putida KT2440
gccagguuggcccugaacu

SEQ ID NO: 1567679 - RNA, 17 nt, Pseudomonas putida KT2440
gccaguacgccagcagc

SEQ ID NO: 1567680 - RNA, 16 nt, Pseudomonas putida KT2440
gccaguagcaaucagg

SEQ ID NO: 1567681 - RNA, 23 nt, Pseudomonas putida KT2440
gccagucgcacagguccagccgc

SEQ ID NO: 1567682 - RNA, 22 nt, Pseudomonas putida KT2440
gccagcuuuuagacauugagca

SEQ ID NO: 1567683 - RNA, 22 nt, Pseudomonas putida KT2440
gccaggagaacacccagcgcau

SEQ ID NO: 1567684 - RNA, 20 nt, Pseudomonas putida KT2440
gccaugcccgcccgggcuuu

SEQ ID NO: 1567685 - RNA, 13 nt, Pseudomonas putida KT2440
gccaugccggcaa

SEQ ID NO: 1567686 - RNA, 17 nt, Pseudomonas putida KT2440
gccaucucaaucgcaug

SEQ ID NO: 1567687 - RNA, 15 nt, Pseudomonas putida KT2440
gccaucucgccaagc

SEQ ID NO: 1567688 - RNA, 17 nt, Pseudomonas putida KT2440
gccaucgaggaaguggc

SEQ ID NO: 1567689 - RNA, 22 nt, Pseudomonas putida KT2440
gccauccuugaagaacaccugc

SEQ ID NO: 1567690 - RNA, 21 nt, Pseudomonas putida KT2440
gccauccucggccaauggcag

SEQ ID NO: 1567691 - RNA, 16 nt, Pseudomonas putida KT2440
gccauccucggccagg

SEQ ID NO: 1567692 - RNA, 20 nt, Pseudomonas putida KT2440
gccauccucggccaggccca

SEQ ID NO: 1567693 - RNA, 23 nt, Pseudomonas putida KT2440
gccauccguuacaauaccgacaa

SEQ ID NO: 1567694 - RNA, 18 nt, Pseudomonas putida KT2440
gccauaacuccagcgcca

SEQ ID NO: 1567695 - RNA, 19 nt, Pseudomonas putida KT2440
gccauaacuccagcgccag

SEQ ID NO: 1567696 - RNA, 22 nt, Pseudomonas putida KT2440
gccccugcuugaccauggcgau

SEQ ID NO: 1567697 - RNA, 13 nt, Pseudomonas putida KT2440
gccccuggaaccc

SEQ ID NO: 1567698 - RNA, 14 nt, Pseudomonas putida KT2440
gccccugccagcac

SEQ ID NO: 1567699 - RNA, 14 nt, Pseudomonas putida KT2440
gccccugcacauca

SEQ ID NO: 1567700 - RNA, 22 nt, Pseudomonas putida KT2440
gccccugcacaucacgcgaccu

SEQ ID NO: 1567701 - RNA, 19 nt, Pseudomonas putida KT2440
gccccugauaggacugcuu

SEQ ID NO: 1567702 - RNA, 16 nt, Pseudomonas putida KT2440
gccccgugcuacgcgc

SEQ ID NO: 1567703 - RNA, 17 nt, Pseudomonas putida KT2440
gccccguauacccaucg

SEQ ID NO: 1567704 - RNA, 20 nt, Pseudomonas putida KT2440
gccccggugcauccaacgcu

SEQ ID NO: 1567705 - RNA, 16 nt, Pseudomonas putida KT2440
gccccggucagcagga

SEQ ID NO: 1567706 - RNA, 14 nt, Pseudomonas putida KT2440
gccccgguccagca

SEQ ID NO: 1567707 - RNA, 15 nt, Pseudomonas putida KT2440
gccccgguccagcac

SEQ ID NO: 1567708 - RNA, 14 nt, Pseudomonas putida KT2440
gccccgcaggccgc

SEQ ID NO: 1567709 - RNA, 15 nt, Pseudomonas putida KT2440
gccccgcaugcucgc

SEQ ID NO: 1567710 - RNA, 20 nt, Pseudomonas putida KT2440
gccccgccaacaacaagcgc

SEQ ID NO: 1567711 - RNA, 22 nt, Pseudomonas putida KT2440
gccccgccaacaacaagcgcug

SEQ ID NO: 1567712 - RNA, 13 nt, Pseudomonas putida KT2440
gccccgcccaggu

SEQ ID NO: 1567713 - RNA, 21 nt, Pseudomonas putida KT2440
gcccgagcccccgcugcucga

SEQ ID NO: 1567714 - RNA, 15 nt, Pseudomonas putida KT2440
gcccgaucaccgcga

SEQ ID NO: 1567715 - RNA, 14 nt, Pseudomonas putida KT2440
gccccugguaccga

SEQ ID NO: 1567716 - RNA, 15 nt, Pseudomonas putida KT2440
gcccgcagcgcuucg

SEQ ID NO: 1567717 - RNA, 17 nt, Pseudomonas putida KT2440
gcccgcagcgcuucgau

SEQ ID NO: 1567718 - RNA, 13 nt, Pseudomonas putida KT2440
gcccgcaacagau

SEQ ID NO: 1567719 - RNA, 18 nt, Pseudomonas putida KT2440
gcccgcaacagaucccgc

SEQ ID NO: 1567720 - RNA, 15 nt, Pseudomonas putida KT2440
gcccgcaaagcagcg

SEQ ID NO: 1567721 - RNA, 20 nt, Pseudomonas putida KT2440
gcccgaucgccucgcuggcg

SEQ ID NO: 1567722 - RNA, 18 nt, Pseudomonas putida KT2440
gcccgaugggcgucgccu

SEQ ID NO: 1567723 - RNA, 13 nt, Pseudomonas putida KT2440
gcccgcaggugcg

SEQ ID NO: 1567724 - RNA, 21 nt, Pseudomonas putida KT2440
gcccgcaggugcggcgcgacu

SEQ ID NO: 1567725 - RNA, 22 nt, Pseudomonas putida KT2440
gcccgcaucaaacgaugcgggc

SEQ ID NO: 1567726 - RNA, 20 nt, Pseudomonas putida KT2440
gcccgccauaucaggauugc

SEQ ID NO: 1567727 - RNA, 16 nt, Pseudomonas putida KT2440
gcccgcccacaugcga

SEQ ID NO: 1567728 - RNA, 14 nt, Pseudomonas putida KT2440
gcccgccaggcgca

SEQ ID NO: 1567729 - RNA, 21 nt, Pseudomonas putida KT2440
gcccgccgccaguuucaccug

SEQ ID NO: 1567730 - RNA, 14 nt, Pseudomonas putida KT2440
gcccgcccagccca

SEQ ID NO: 1567731 - RNA, 16 nt, Pseudomonas putida KT2440
gcccgcccagcuggcu

SEQ ID NO: 1567732 - RNA, 14 nt, Pseudomonas putida KT2440
gcccgccggcacuu

SEQ ID NO: 1567733 - RNA, 17 nt, Pseudomonas putida KT2440
gcccaucaggaacagcu

SEQ ID NO: 1567734 - RNA, 18 nt, Pseudomonas putida KT2440
gcccaucaggaacagcuc

SEQ ID NO: 1567735 - RNA, 19 nt, Pseudomonas putida KT2440
gcccaucaggaacagcucg

SEQ ID NO: 1567736 - RNA, 16 nt, Pseudomonas putida KT2440
gcccauaccgccguau

SEQ ID NO: 1567737 - RNA, 16 nt, Pseudomonas putida KT2440
gcccaucccgcuucgc

SEQ ID NO: 1567738 - RNA, 14 nt, Pseudomonas putida KT2440
gcccaguucggaca

SEQ ID NO: 1567739 - RNA, 20 nt, Pseudomonas putida KT2440
gcccaguacgccacccagau

SEQ ID NO: 1567740 - RNA, 17 nt, Pseudomonas putida KT2440
gcccagguuauacgccg

SEQ ID NO: 1567741 - RNA, 21 nt, Pseudomonas putida KT2440
gcccagguuauacgccgccga

SEQ ID NO: 1567742 - RNA, 21 nt, Pseudomonas putida KT2440
gcccagguugccucaucaccu

SEQ ID NO: 1567743 - RNA, 23 nt, Pseudomonas putida KT2440
gcccaggucaaacguauccgccg

SEQ ID NO: 1567744 - RNA, 20 nt, Pseudomonas putida KT2440
gcccagcgucgucugcguga

SEQ ID NO: 1567745 - RNA, 17 nt, Pseudomonas putida KT2440
gcccagcucgcuggcca

SEQ ID NO: 1567746 - RNA, 18 nt, Pseudomonas putida KT2440
gcccagcucgcuggccac

SEQ ID NO: 1567747 - RNA, 14 nt, Pseudomonas putida KT2440
gcccagcuccagca

SEQ ID NO: 1567748 - RNA, 16 nt, Pseudomonas putida KT2440
gcccaggcgcaucacg

SEQ ID NO: 1567749 - RNA, 22 nt, Pseudomonas putida KT2440
gcccaugcccagcucgcuggcc

SEQ ID NO: 1567750 - RNA, 23 nt, Pseudomonas putida KT2440
gcccaugcccagcucgcuggcca

SEQ ID NO: 1567751 - RNA, 15 nt, Pseudomonas putida KT2440
gccccaccucggcga

SEQ ID NO: 1567752 - RNA, 11 nt, Pseudomonas putida KT2440
gcccauggcca

SEQ ID NO: 1567753 - RNA, 14 nt, Pseudomonas putida KT2440
gcccaugaacagca

SEQ ID NO: 1567754 - RNA, 17 nt, Pseudomonas putida KT2440
gccccagacaaucaccu

SEQ ID NO: 1567755 - RNA, 14 nt, Pseudomonas putida KT2440
gccccagaccauca

SEQ ID NO: 1567756 - RNA, 17 nt, Pseudomonas putida KT2440
gccccacucgcgcagca

SEQ ID NO: 1567757 - RNA, 20 nt, Pseudomonas putida KT2440
gccccacucgcgcagcacau

SEQ ID NO: 1567758 - RNA, 14 nt, Pseudomonas putida KT2440
gccccagcagcgcu

SEQ ID NO: 1567759 - RNA, 17 nt, Pseudomonas putida KT2440
gccccagcagcgcuucg

SEQ ID NO: 1567760 - RNA, 12 nt, Pseudomonas putida KT2440
gccccaggcggu

SEQ ID NO: 1567761 - RNA, 23 nt, Pseudomonas putida KT2440
gccccgcaccgcggaugcgccug

SEQ ID NO: 1567762 - RNA, 19 nt, Pseudomonas putida KT2440
gccccgcacaucacggcgc

SEQ ID NO: 1567763 - RNA, 21 nt, Pseudomonas putida KT2440
gccccgcaccagaccagcagc

SEQ ID NO: 1567764 - RNA, 20 nt, Pseudomonas putida KT2440
gcccccgcugcacaggccag

SEQ ID NO: 1567765 - RNA, 13 nt, Pseudomonas putida KT2440
gccccgauacagc

SEQ ID NO: 1567766 - RNA, 15 nt, Pseudomonas putida KT2440
gccccgauacagcgc

SEQ ID NO: 1567767 - RNA, 17 nt, Pseudomonas putida KT2440
gcccccgccugcuggcc

SEQ ID NO: 1567768 - RNA, 17 nt, Pseudomonas putida KT2440
gcccccgauuccaaggu

SEQ ID NO: 1567769 - RNA, 17 nt, Pseudomonas putida KT2440
gccccccuguaggagcg

SEQ ID NO: 1567770 - RNA, 21 nt, Pseudomonas putida KT2440
gccccccuguaggagcggguu

SEQ ID NO: 1567771 - RNA, 13 nt, Pseudomonas putida KT2440
gccccaucaccag

SEQ ID NO: 1567772 - RNA, 17 nt, Pseudomonas putida KT2440
gccccagggaucgaugc

SEQ ID NO: 1567773 - RNA, 23 nt, Pseudomonas putida KT2440
gccccaggguguuguucacgggu

SEQ ID NO: 1567774 - RNA, 20 nt, Pseudomonas putida KT2440
gccccagucauccgggccgu

SEQ ID NO: 1567775 - RNA, 19 nt, Pseudomonas putida KT2440
gccgaaacguagucgacca

SEQ ID NO: 1567776 - RNA, 15 nt, Pseudomonas putida KT2440
gcccuuugguacugc

SEQ ID NO: 1567777 - RNA, 20 nt, Pseudomonas putida KT2440
gccgaacagcacgauaccgg

SEQ ID NO: 1567778 - RNA, 17 nt, Pseudomonas putida KT2440
gccgaaccaccgaugcu

SEQ ID NO: 1567779 - RNA, 14 nt, Pseudomonas putida KT2440
gccgaaccagcaga

SEQ ID NO: 1567780 - RNA, 20 nt, Pseudomonas putida KT2440
gcccuguuucuucaaggccg

SEQ ID NO: 1567781 - RNA, 16 nt, Pseudomonas putida KT2440
gcccuuacaggucgua

SEQ ID NO: 1567782 - RNA, 15 nt, Pseudomonas putida KT2440
gcccuucaugcgccc

SEQ ID NO: 1567783 - RNA, 18 nt, Pseudomonas putida KT2440
gcccuuccugaguauucu

SEQ ID NO: 1567784 - RNA, 15 nt, Pseudomonas putida KT2440
gcccuucacgcucau

SEQ ID NO: 1567785 - RNA, 22 nt, Pseudomonas putida KT2440
gcccuucacuguggucauccag

SEQ ID NO: 1567786 - RNA, 13 nt, Pseudomonas putida KT2440
gcccuucgcgggc

SEQ ID NO: 1567787 - RNA, 15 nt, Pseudomonas putida KT2440
gcccuucucgcucag

SEQ ID NO: 1567788 - RNA, 23 nt, Pseudomonas putida KT2440
gcccuucugcgccaaagcgagca

SEQ ID NO: 1567789 - RNA, 19 nt, Pseudomonas putida KT2440
gcccuuuuucaccaggcgg

SEQ ID NO: 1567790 - RNA, 20 nt, Pseudomonas putida KT2440
gcccuuuuucaccaggcggu

SEQ ID NO: 1567791 - RNA, 13 nt, Pseudomonas putida KT2440
gcccuuucgcggg

SEQ ID NO: 1567792 - RNA, 18 nt, Pseudomonas putida KT2440
gcccuuucgcggguaaac

SEQ ID NO: 1567793 - RNA, 20 nt, Pseudomonas putida KT2440
gcccuuucgcgggugaaccc

SEQ ID NO: 1567794 - RNA, 14 nt, Pseudomonas putida KT2440
gcccuugucgaaca

SEQ ID NO: 1567795 - RNA, 13 nt, Pseudomonas putida KT2440
gcccuuggcagcg

SEQ ID NO: 1567796 - RNA, 23 nt, Pseudomonas putida KT2440
gcccuugaugaucaggucggcgg

SEQ ID NO: 1567797 - RNA, 18 nt, Pseudomonas putida KT2440
gcccuggcggccacggca

SEQ ID NO: 1567798 - RNA, 17 nt, Pseudomonas putida KT2440
gcccuggcccgccgcca

SEQ ID NO: 1567799 - RNA, 17 nt, Pseudomonas putida KT2440
gcccuggaugacacgga

SEQ ID NO: 1567800 - RNA, 18 nt, Pseudomonas putida KT2440
gcccuggaugacacggau

SEQ ID NO: 1567801 - RNA, 22 nt, Pseudomonas putida KT2440
gcccuggaugacacggauggca

SEQ ID NO: 1567802 - RNA, 21 nt, Pseudomonas putida KT2440
gcccugggcgagcaggugacc

SEQ ID NO: 1567803 - RNA, 22 nt, Pseudomonas putida KT2440
gcccugggcgagcaggugaccc

SEQ ID NO: 1567804 - RNA, 15 nt, Pseudomonas putida KT2440
gcccuguacauccag

SEQ ID NO: 1567805 - RNA, 15 nt, Pseudomonas putida KT2440
gcccuguagagcgcc

SEQ ID NO: 1567806 - RNA, 17 nt, Pseudomonas putida KT2440
gcccuguagagcgccuu

SEQ ID NO: 1567807 - RNA, 20 nt, Pseudomonas putida KT2440
gcccugugggagcggccuug

SEQ ID NO: 1567808 - RNA, 21 nt, Pseudomonas putida KT2440
gcccugugggagcgggcgugc

SEQ ID NO: 1567809 - RNA, 16 nt, Pseudomonas putida KT2440
gcccuguguaggagcg

SEQ ID NO: 1567810 - RNA, 19 nt, Pseudomonas putida KT2440
gcccuguguaggagcgggu

SEQ ID NO: 1567811 - RNA, 15 nt, Pseudomonas putida KT2440
gcccgguuccagcgc

SEQ ID NO: 1567812 - RNA, 16 nt, Pseudomonas putida KT2440
gcccgguuccagcgca

SEQ ID NO: 1567813 - RNA, 16 nt, Pseudomonas putida KT2440
gcccguaggagcgggu

SEQ ID NO: 1567814 - RNA, 18 nt, Pseudomonas putida KT2440
gcccguaugcauccgcca

SEQ ID NO: 1567815 - RNA, 18 nt, Pseudomonas putida KT2440
gcccgucugcgugcaccc

SEQ ID NO: 1567816 - RNA, 16 nt, Pseudomonas putida KT2440
gcccgucuggcugcaa

SEQ ID NO: 1567817 - RNA, 21 nt, Pseudomonas putida KT2440
gcccgucuggcugcaaggucc

SEQ ID NO: 1567818 - RNA, 18 nt, Pseudomonas putida KT2440
gcccggugaagucaccga

SEQ ID NO: 1567819 - RNA, 18 nt, Pseudomonas putida KT2440
gcccuccgguucugccgg

SEQ ID NO: 1567820 - RNA, 17 nt, Pseudomonas putida KT2440
gcccucauucgcccgca

SEQ ID NO: 1567821 - RNA, 15 nt, Pseudomonas putida KT2440
gcccguugagggugg

SEQ ID NO: 1567822 - RNA, 20 nt, Pseudomonas putida KT2440
gcccguugcgcaucaccucg

SEQ ID NO: 1567823 - RNA, 23 nt, Pseudomonas putida KT2440
gcccguuacguaagucaggccga

SEQ ID NO: 1567824 - RNA, 18 nt, Pseudomonas putida KT2440
gcccguguucgcgggcaa

SEQ ID NO: 1567825 - RNA, 20 nt, Pseudomonas putida KT2440
gcccguggcccucagcccag

SEQ ID NO: 1567826 - RNA, 18 nt, Pseudomonas putida KT2440
gcccgugccgcaucagcc

SEQ ID NO: 1567827 - RNA, 19 nt, Pseudomonas putida KT2440
gcccgugccgcaucagccg

SEQ ID NO: 1567828 - RNA, 17 nt, Pseudomonas putida KT2440
gcccgugccauccaccg

SEQ ID NO: 1567829 - RNA, 14 nt, Pseudomonas putida KT2440
gcccuggacaaucu

SEQ ID NO: 1567830 - RNA, 21 nt, Pseudomonas putida KT2440
gcccugcuggccaaucuccac

SEQ ID NO: 1567831 - RNA, 14 nt, Pseudomonas putida KT2440
gcccugcugccgca

SEQ ID NO: 1567832 - RNA, 22 nt, Pseudomonas putida KT2440
gcccugcccucgacaaucgcca

SEQ ID NO: 1567833 - RNA, 20 nt, Pseudomonas putida KT2440
gcccugcucguccaucaccg

SEQ ID NO: 1567834 - RNA, 21 nt, Pseudomonas putida KT2440
gcccugcucacgcagcucggu

SEQ ID NO: 1567835 - RNA, 13 nt, Pseudomonas putida KT2440
gcccugcagcgcu

SEQ ID NO: 1567836 - RNA, 23 nt, Pseudomonas putida KT2440
gcccugcagcuucccggccuggc

SEQ ID NO: 1567837 - RNA, 17 nt, Pseudomonas putida KT2440
gcccugaucccggccgu

SEQ ID NO: 1567838 - RNA, 18 nt, Pseudomonas putida KT2440
gcccugaucccggccguu

SEQ ID NO: 1567839 - RNA, 19 nt, Pseudomonas putida KT2440
gcccugaucugccccucga

SEQ ID NO: 1567840 - RNA, 22 nt, Pseudomonas putida KT2440
gcccugaucugccccucgauca

SEQ ID NO: 1567841 - RNA, 19 nt, Pseudomonas putida KT2440
gcccugccgccuucuccag

SEQ ID NO: 1567842 - RNA, 20 nt, Pseudomonas putida KT2440
gcccugcauaugcagggccu

SEQ ID NO: 1567843 - RNA, 23 nt, Pseudomonas putida KT2440
gcccucgaugucuuccagaccag

SEQ ID NO: 1567844 - RNA, 15 nt, Pseudomonas putida KT2440
gcccucgagugcgcu

SEQ ID NO: 1567845 - RNA, 19 nt, Pseudomonas putida KT2440
gcccucgagugcgcugauc

SEQ ID NO: 1567846 - RNA, 16 nt, Pseudomonas putida KT2440
gcccugacgccagcgc

SEQ ID NO: 1567847 - RNA, 14 nt, Pseudomonas putida KT2440
gcccugacaggcga

SEQ ID NO: 1567848 - RNA, 22 nt, Pseudomonas putida KT2440
gcccugaacuuggccuccagca

SEQ ID NO: 1567849 - RNA, 14 nt, Pseudomonas putida KT2440
gcccugaacagggc

SEQ ID NO: 1567850 - RNA, 16 nt, Pseudomonas putida KT2440
gcccucuucgcgggca

SEQ ID NO: 1567851 - RNA, 17 nt, Pseudomonas putida KT2440
gcccucguucgcgggca

SEQ ID NO: 1567852 - RNA, 15 nt, Pseudomonas putida KT2440
gcccucugcguggua

SEQ ID NO: 1567853 - RNA, 16 nt, Pseudomonas putida KT2440
gccgaucgaagcagca

SEQ ID NO: 1567854 - RNA, 18 nt, Pseudomonas putida KT2440
gccgaucgaagcagcagc

SEQ ID NO: 1567855 - RNA, 12 nt, Pseudomonas putida KT2440
gccgaucaccag

SEQ ID NO: 1567856 - RNA, 15 nt, Pseudomonas putida KT2440
gccgaucaccagcac

SEQ ID NO: 1567857 - RNA, 23 nt, Pseudomonas putida KT2440
gccgaucagguugcccagcaugc

SEQ ID NO: 1567858 - RNA, 18 nt, Pseudomonas putida KT2440
gccgaucacaccggcaau

SEQ ID NO: 1567859 - RNA, 19 nt, Pseudomonas putida KT2440
gccgaguccuugcgugccu

SEQ ID NO: 1567860 - RNA, 17 nt, Pseudomonas putida KT2440
gccgauagccagcuggc

SEQ ID NO: 1567861 - RNA, 16 nt, Pseudomonas putida KT2440
gccgagcugaugccgg

SEQ ID NO: 1567862 - RNA, 17 nt, Pseudomonas putida KT2440
gccgagcugaugccgga

SEQ ID NO: 1567863 - RNA, 12 nt, Pseudomonas putida KT2440
gccgaggcaccg

SEQ ID NO: 1567864 - RNA, 21 nt, Pseudomonas putida KT2440
gccgaguaaccggcggcgaac

SEQ ID NO: 1567865 - RNA, 16 nt, Pseudomonas putida KT2440
gccgaggcgccgacga

SEQ ID NO: 1567866 - RNA, 19 nt, Pseudomonas putida KT2440
gccgaugaagcaggccgag

SEQ ID NO: 1567867 - RNA, 14 nt, Pseudomonas putida KT2440
gccgauggccaaua

SEQ ID NO: 1567868 - RNA, 14 nt, Pseudomonas putida KT2440
gccgauggcgcaaa

SEQ ID NO: 1567869 - RNA, 16 nt, Pseudomonas putida KT2440
gccgaugcuaccaagc

SEQ ID NO: 1567870 - RNA, 14 nt, Pseudomonas putida KT2440
gccgcaaggccgcu

SEQ ID NO: 1567871 - RNA, 21 nt, Pseudomonas putida KT2440
gccgcacaaggccgcucccac

SEQ ID NO: 1567872 - RNA, 16 nt, Pseudomonas putida KT2440
gccgcaauggcgccau

SEQ ID NO: 1567873 - RNA, 22 nt, Pseudomonas putida KT2440
gccgcaauggucuuaccaguag

SEQ ID NO: 1567874 - RNA, 13 nt, Pseudomonas putida KT2440
gccgacgaugccc

SEQ ID NO: 1567875 - RNA, 20 nt, Pseudomonas putida KT2440
gccgacgauuucugccguug

SEQ ID NO: 1567876 - RNA, 16 nt, Pseudomonas putida KT2440
gccgacucuucaccag

SEQ ID NO: 1567877 - RNA, 21 nt, Pseudomonas putida KT2440
gccgacuggcgcaccagcggc

SEQ ID NO: 1567878 - RNA, 15 nt, Pseudomonas putida KT2440
gccgacuccaacgcg

SEQ ID NO: 1567879 - RNA, 22 nt, Pseudomonas putida KT2440
gccgacccugugggagcgggcu

SEQ ID NO: 1567880 - RNA, 21 nt, Pseudomonas putida KT2440
gccgaccgaaccggcgcuggc

SEQ ID NO: 1567881 - RNA, 22 nt, Pseudomonas putida KT2440
gccgaccgaaccggcgcuggcc

SEQ ID NO: 1567882 - RNA, 18 nt, Pseudomonas putida KT2440
gccgacccgggccagcca

SEQ ID NO: 1567883 - RNA, 14 nt, Pseudomonas putida KT2440
gccgaaggccuuca

SEQ ID NO: 1567884 - RNA, 12 nt, Pseudomonas putida KT2440
gccgaaggccgu

SEQ ID NO: 1567885 - RNA, 12 nt, Pseudomonas putida KT2440
gccgcgcuggcg

SEQ ID NO: 1567886 - RNA, 11 nt, Pseudomonas putida KT2440
gccgcgcuggc

SEQ ID NO: 1567887 - RNA, 17 nt, Pseudomonas putida KT2440
gccgcggguaccaccug

SEQ ID NO: 1567888 - RNA, 22 nt, Pseudomonas putida KT2440
gccgcggguaguccggcacguu

SEQ ID NO: 1567889 - RNA, 20 nt, Pseudomonas putida KT2440
gccgcguaccagcagggcca

SEQ ID NO: 1567890 - RNA, 13 nt, Pseudomonas putida KT2440
gccgcucaccggc

SEQ ID NO: 1567891 - RNA, 17 nt, Pseudomonas putida KT2440
gccgcucaccaccaucu

SEQ ID NO: 1567892 - RNA, 19 nt, Pseudomonas putida KT2440
gccgcucguacuggucgag

SEQ ID NO: 1567893 - RNA, 15 nt, Pseudomonas putida KT2440
gccgcugcugcgccu

SEQ ID NO: 1567894 - RNA, 21 nt, Pseudomonas putida KT2440
gccgcugcugcgccucgcagg

SEQ ID NO: 1567895 - RNA, 22 nt, Pseudomonas putida KT2440
gccgcugcugcgccucgcaggu

SEQ ID NO: 1567896 - RNA, 19 nt, Pseudomonas putida KT2440
gccggcaagcuggucaggu

SEQ ID NO: 1567897 - RNA, 14 nt, Pseudomonas putida KT2440
gccggcaauaccgg

SEQ ID NO: 1567898 - RNA, 15 nt, Pseudomonas putida KT2440
gccggcaacggccac

SEQ ID NO: 1567899 - RNA, 18 nt, Pseudomonas putida KT2440
gccggcacagacaccgca

SEQ ID NO: 1567900 - RNA, 19 nt, Pseudomonas putida KT2440
gccggcagcaaggcaucca

SEQ ID NO: 1567901 - RNA, 15 nt, Pseudomonas putida KT2440
gccggcacggccggu

SEQ ID NO: 1567902 - RNA, 21 nt, Pseudomonas putida KT2440
gccggcaacgaacuugcggaa

SEQ ID NO: 1567903 - RNA, 20 nt, Pseudomonas putida KT2440
gccggcaacgauacccacgc

SEQ ID NO: 1567904 - RNA, 17 nt, Pseudomonas putida KT2440
gccggccagcgccugca

SEQ ID NO: 1567905 - RNA, 23 nt, Pseudomonas putida KT2440
gccggcccaaggcaccaacugca

SEQ ID NO: 1567906 - RNA, 12 nt, Pseudomonas putida KT2440
gccggcauggcg

SEQ ID NO: 1567907 - RNA, 13 nt, Pseudomonas putida KT2440
gccggcauggcgg

SEQ ID NO: 1567908 - RNA, 17 nt, Pseudomonas putida KT2440
gccggcauggcgguggc

SEQ ID NO: 1567909 - RNA, 13 nt, Pseudomonas putida KT2440
gccggcaucgcca

SEQ ID NO: 1567910 - RNA, 16 nt, Pseudomonas putida KT2440
gccggcaucgccucca

SEQ ID NO: 1567911 - RNA, 14 nt, Pseudomonas putida KT2440
gccggacucacccg

SEQ ID NO: 1567912 - RNA, 21 nt, Pseudomonas putida KT2440
gccgcugucauccugcguggc

SEQ ID NO: 1567913 - RNA, 14 nt, Pseudomonas putida KT2440
gccgcugggcuuca

SEQ ID NO: 1567914 - RNA, 20 nt, Pseudomonas putida KT2440
gccgcuggcccuucgcggaa

SEQ ID NO: 1567915 - RNA, 21 nt, Pseudomonas putida KT2440
gccgcuggcccuucgcggaag

SEQ ID NO: 1567916 - RNA, 22 nt, Pseudomonas putida KT2440
gccgccgaacucuggcaacagc

SEQ ID NO: 1567917 - RNA, 13 nt, Pseudomonas putida KT2440
gccgcccagguca

SEQ ID NO: 1567918 - RNA, 21 nt, Pseudomonas putida KT2440
gccgcccaguggcacaccaug

SEQ ID NO: 1567919 - RNA, 14 nt, Pseudomonas putida KT2440
gccgccauccucgg

SEQ ID NO: 1567920 - RNA, 15 nt, Pseudomonas putida KT2440
gccgccagcgcucca

SEQ ID NO: 1567921 - RNA, 19 nt, Pseudomonas putida KT2440
gccgccagcggcaguugca

SEQ ID NO: 1567922 - RNA, 18 nt, Pseudomonas putida KT2440
gccgccaggauggcaccg

SEQ ID NO: 1567923 - RNA, 20 nt, Pseudomonas putida KT2440
gccgcagccucuucggccag

SEQ ID NO: 1567924 - RNA, 14 nt, Pseudomonas putida KT2440
gccgcagccaugcc

SEQ ID NO: 1567925 - RNA, 16 nt, Pseudomonas putida KT2440
gccgcagccaugccgc

SEQ ID NO: 1567926 - RNA, 13 nt, Pseudomonas putida KT2440
gccgccgcuggcg

SEQ ID NO: 1567927 - RNA, 14 nt, Pseudomonas putida KT2440
gccgccgcugcgag

SEQ ID NO: 1567928 - RNA, 21 nt, Pseudomonas putida KT2440
gccgccgcugccagcagggca

SEQ ID NO: 1567929 - RNA, 15 nt, Pseudomonas putida KT2440
gccgccgacgaucag

SEQ ID NO: 1567930 - RNA, 14 nt, Pseudomonas putida KT2440
gccgccgaccaggu

SEQ ID NO: 1567931 - RNA, 16 nt, Pseudomonas putida KT2440
gccgccgaggcaccgg

SEQ ID NO: 1567932 - RNA, 18 nt, Pseudomonas putida KT2440
gccgccgauagcagcacc

SEQ ID NO: 1567933 - RNA, 14 nt, Pseudomonas putida KT2440
gccgcgcagggcgu

SEQ ID NO: 1567934 - RNA, 20 nt, Pseudomonas putida KT2440
gccgcgcccagugcgcgcaa

SEQ ID NO: 1567935 - RNA, 16 nt, Pseudomonas putida KT2440
gccgcgcccucuuccg

SEQ ID NO: 1567936 - RNA, 23 nt, Pseudomonas putida KT2440
gccgccgggguaauggcgcugga

SEQ ID NO: 1567937 - RNA, 15 nt, Pseudomonas putida KT2440
gccgccuggcucacc

SEQ ID NO: 1567938 - RNA, 17 nt, Pseudomonas putida KT2440
gccgcgaacgccccgaa

SEQ ID NO: 1567939 - RNA, 11 nt, Pseudomonas putida KT2440
gcacccaggug

SEQ ID NO: 1567940 - RNA, 14 nt, Pseudomonas putida KT2440
gcacccaggccacg

SEQ ID NO: 1567941 - RNA, 23 nt, Pseudomonas putida KT2440
gcacccacagagacaccgcaggu

SEQ ID NO: 1567942 - RNA, 15 nt, Pseudomonas putida KT2440
gcacccacagcgccu

SEQ ID NO: 1567943 - RNA, 15 nt, Pseudomonas putida KT2440
gcacccagccagcga

SEQ ID NO: 1567944 - RNA, 14 nt, Pseudomonas putida KT2440
gcacccaucggcgc

SEQ ID NO: 1567945 - RNA, 17 nt, Pseudomonas putida KT2440
gcacccgcaagcgccga

SEQ ID NO: 1567946 - RNA, 17 nt, Pseudomonas putida KT2440
gcacccgaccacccucg

SEQ ID NO: 1567947 - RNA, 16 nt, Pseudomonas putida KT2440
gcaccccgaacgcggu

SEQ ID NO: 1567948 - RNA, 18 nt, Pseudomonas putida KT2440
gcaccccuuucuccagca

SEQ ID NO: 1567949 - RNA, 20 nt, Pseudomonas putida KT2440
gcaccgaccgugcauacacc

SEQ ID NO: 1567950 - RNA, 21 nt, Pseudomonas putida KT2440
gcaccgaccacgguaccggca

SEQ ID NO: 1567951 - RNA, 20 nt, Pseudomonas putida KT2440
gcaccgaaggccgccggcaa

SEQ ID NO: 1567952 - RNA, 21 nt, Pseudomonas putida KT2440
gcacccgcgaguucaugguca

SEQ ID NO: 1567953 - RNA, 13 nt, Pseudomonas putida KT2440
gcacccgccagcc

SEQ ID NO: 1567954 - RNA, 18 nt, Pseudomonas putida KT2440
gcacccuggcgguugacc

SEQ ID NO: 1567955 - RNA, 17 nt, Pseudomonas putida KT2440
gcaccgggcacuuggca

SEQ ID NO: 1567956 - RNA, 18 nt, Pseudomonas putida KT2440
gcaccggcgugccgucga

SEQ ID NO: 1567957 - RNA, 19 nt, Pseudomonas putida KT2440
gcaccggcgccaaucaucg

SEQ ID NO: 1567958 - RNA, 13 nt, Pseudomonas putida KT2440
gcaccgcugacca

SEQ ID NO: 1567959 - RNA, 15 nt, Pseudomonas putida KT2440
gcaccgcugaccaca

SEQ ID NO: 1567960 - RNA, 23 nt, Pseudomonas putida KT2440
gcaccgccgcccacgccggcaac

SEQ ID NO: 1567961 - RNA, 19 nt, Pseudomonas putida KT2440
gcaccgcguaucaggcauc

SEQ ID NO: 1567962 - RNA, 15 nt, Pseudomonas putida KT2440
gcaccgggcgggugc

SEQ ID NO: 1567963 - RNA, 22 nt, Pseudomonas putida KT2440
gcaccgguaccgcucugcgcca

SEQ ID NO: 1567964 - RNA, 17 nt, Pseudomonas putida KT2440
gcaccgguucgccccca

SEQ ID NO: 1567965 - RNA, 17 nt, Pseudomonas putida KT2440
gcaccugacgagcgaaa

SEQ ID NO: 1567966 - RNA, 18 nt, Pseudomonas putida KT2440
gcaccugacgcaagcgcg

SEQ ID NO: 1567967 - RNA, 18 nt, Pseudomonas putida KT2440
gcaccucggccagugcgc

SEQ ID NO: 1567968 - RNA, 18 nt, Pseudomonas putida KT2440
gcacgggccagcgcggua

SEQ ID NO: 1567969 - RNA, 21 nt, Pseudomonas putida KT2440
gcacggcgcugucggucagca

SEQ ID NO: 1567970 - RNA, 17 nt, Pseudomonas putida KT2440
gcacgcuaccaccuggc

SEQ ID NO: 1567971 - RNA, 16 nt, Pseudomonas putida KT2440
gcacgcuggcugugau

SEQ ID NO: 1567972 - RNA, 21 nt, Pseudomonas putida KT2440
gcacgcuggcugugauacagc

SEQ ID NO: 1567973 - RNA, 22 nt, Pseudomonas putida KT2440
gcacgucacugcagaucaccag

SEQ ID NO: 1567974 - RNA, 22 nt, Pseudomonas putida KT2440
gcacgugauaccugggcuggag

SEQ ID NO: 1567975 - RNA, 22 nt, Pseudomonas putida KT2440
gcacgcaacaggucgaccugcc

SEQ ID NO: 1567976 - RNA, 13 nt, Pseudomonas putida KT2440
gcacgcgggccgu

SEQ ID NO: 1567977 - RNA, 19 nt, Pseudomonas putida KT2440
gcacgccgguaucacccag

SEQ ID NO: 1567978 - RNA, 17 nt, Pseudomonas putida KT2440
gcacgccgccgauaccg

SEQ ID NO: 1567979 - RNA, 21 nt, Pseudomonas putida KT2440
gcaccuggcggcccgccggca

SEQ ID NO: 1567980 - RNA, 15 nt, Pseudomonas putida KT2440
gcacgaucagcagca

SEQ ID NO: 1567981 - RNA, 16 nt, Pseudomonas putida KT2440
gcacgaucagcagcaa

SEQ ID NO: 1567982 - RNA, 20 nt, Pseudomonas putida KT2440
gcacgacugaacaccugcca

SEQ ID NO: 1567983 - RNA, 21 nt, Pseudomonas putida KT2440
gcacgaucauggggaugccga

SEQ ID NO: 1567984 - RNA, 13 nt, Pseudomonas putida KT2440
gcacgaucgaccg

SEQ ID NO: 1567985 - RNA, 20 nt, Pseudomonas putida KT2440
gcacgaucgaccggguaauc

SEQ ID NO: 1567986 - RNA, 23 nt, Pseudomonas putida KT2440
gcacgaucgaccggguaaucgcc

SEQ ID NO: 1567987 - RNA, 23 nt, Pseudomonas putida KT2440
gcaaucgagccgaacagcaggca

SEQ ID NO: 1567988 - RNA, 15 nt, Pseudomonas putida KT2440
gcaaucgccaggcgc

SEQ ID NO: 1567989 - RNA, 23 nt, Pseudomonas putida KT2440
gcaaucgccaggcgcaccgccgg

SEQ ID NO: 1567990 - RNA, 14 nt, Pseudomonas putida KT2440
gcaaucgccaaggu

SEQ ID NO: 1567991 - RNA, 15 nt, Pseudomonas putida KT2440
gcaaucgggauggca

SEQ ID NO: 1567992 - RNA, 22 nt, Pseudomonas putida KT2440
gcaaucggguacacgccacgga

SEQ ID NO: 1567993 - RNA, 14 nt, Pseudomonas putida KT2440
gcaaucgucgguga

SEQ ID NO: 1567994 - RNA, 17 nt, Pseudomonas putida KT2440
gcaaucggcagcgcgca

SEQ ID NO: 1567995 - RNA, 15 nt, Pseudomonas putida KT2440
gcaaucgcgcccggu

SEQ ID NO: 1567996 - RNA, 17 nt, Pseudomonas putida KT2440
gcaauggcgcgaacagg

SEQ ID NO: 1567997 - RNA, 15 nt, Pseudomonas putida KT2440
gcaaugggcacaauu

SEQ ID NO: 1567998 - RNA, 12 nt, Pseudomonas putida KT2440
gcaauggccggg

SEQ ID NO: 1567999 - RNA, 20 nt, Pseudomonas putida KT2440
gcaaugcccgcucgcugcga

SEQ ID NO: 1568000 - RNA, 18 nt, Pseudomonas putida KT2440
gcaaugucagcggcauca

SEQ ID NO: 1568001 - RNA, 24 nt, Pseudomonas putida KT2440
gcaaacgcaggugcgcacgcugcc

SEQ ID NO: 1568002 - RNA, 16 nt, Pseudomonas putida KT2440
gcaauacaacgaucag

SEQ ID NO: 1568003 - RNA, 15 nt, Pseudomonas putida KT2440
gcaauaccggccacg

SEQ ID NO: 1568004 - RNA, 20 nt, Pseudomonas putida KT2440
gcaauaccgugcuugcgggc

SEQ ID NO: 1568005 - RNA, 13 nt, Pseudomonas putida KT2440
gcacacuggccac

SEQ ID NO: 1568006 - RNA, 16 nt, Pseudomonas putida KT2440
gcacagacaccgcaaa

SEQ ID NO: 1568007 - RNA, 12 nt, Pseudomonas putida KT2440
gcacagaacaau

SEQ ID NO: 1568008 - RNA, 19 nt, Pseudomonas putida KT2440
gcacaagaccguuccgcaa

SEQ ID NO: 1568009 - RNA, 15 nt, Pseudomonas putida KT2440
gcacaaccacugcaa

SEQ ID NO: 1568010 - RNA, 18 nt, Pseudomonas putida KT2440
gcacaccuggugcgccuu

SEQ ID NO: 1568011 - RNA, 18 nt, Pseudomonas putida KT2440
gcacacgcuccagguagu

SEQ ID NO: 1568012 - RNA, 18 nt, Pseudomonas putida KT2440
gcacacgguuuccaggcg

SEQ ID NO: 1568013 - RNA, 17 nt, Pseudomonas putida KT2440
gcacacugcccagcagc

SEQ ID NO: 1568014 - RNA, 17 nt, Pseudomonas putida KT2440
gcacaggcuacgcagca

SEQ ID NO: 1568015 - RNA, 13 nt, Pseudomonas putida KT2440
gcacaggcccaaa

SEQ ID NO: 1568016 - RNA, 14 nt, Pseudomonas putida KT2440
gcacaggcccagca

SEQ ID NO: 1568017 - RNA, 14 nt, Pseudomonas putida KT2440
gcacaggcauaccg

SEQ ID NO: 1568018 - RNA, 15 nt, Pseudomonas putida KT2440
gcacagcgcggaaca

SEQ ID NO: 1568019 - RNA, 22 nt, Pseudomonas putida KT2440
gcacagcucccucguaggagcg

SEQ ID NO: 1568020 - RNA, 18 nt, Pseudomonas putida KT2440
gcacagcucgcgcugcca

SEQ ID NO: 1568021 - RNA, 17 nt, Pseudomonas putida KT2440
gcacagcugccggccag

SEQ ID NO: 1568022 - RNA, 20 nt, Pseudomonas putida KT2440
gcacagcugccggccagcgc

SEQ ID NO: 1568023 - RNA, 16 nt, Pseudomonas putida KT2440
gcacagcgagcagccu

SEQ ID NO: 1568024 - RNA, 18 nt, Pseudomonas putida KT2440
gcacagcgagcagccugg

SEQ ID NO: 1568025 - RNA, 20 nt, Pseudomonas putida KT2440
gcacaucacggcgcaggccg

SEQ ID NO: 1568026 - RNA, 21 nt, Pseudomonas putida KT2440
gcacaucacggcgcaggccga

SEQ ID NO: 1568027 - RNA, 15 nt, Pseudomonas putida KT2440
gcacaucaccagcag

SEQ ID NO: 1568028 - RNA, 16 nt, Pseudomonas putida KT2440
gcacaucaccagcagc

SEQ ID NO: 1568029 - RNA, 18 nt, Pseudomonas putida KT2440
gcacauacaaaaugugcc

SEQ ID NO: 1568030 - RNA, 17 nt, Pseudomonas putida KT2440
gcacauccacauuaccg

SEQ ID NO: 1568031 - RNA, 22 nt, Pseudomonas putida KT2440
gcacaggcuuacaacugcucca

SEQ ID NO: 1568032 - RNA, 17 nt, Pseudomonas putida KT2440
gcacauagcccugcucg

SEQ ID NO: 1568033 - RNA, 19 nt, Pseudomonas putida KT2440
gcaccaucggcuccagcgc

SEQ ID NO: 1568034 - RNA, 22 nt, Pseudomonas putida KT2440
gcaccaucagagcgccagcaag

SEQ ID NO: 1568035 - RNA, 16 nt, Pseudomonas putida KT2440
gcaccaucaggcacag

SEQ ID NO: 1568036 - RNA, 20 nt, Pseudomonas putida KT2440
gcaccaucaggcacaggcca

SEQ ID NO: 1568037 - RNA, 17 nt, Pseudomonas putida KT2440
gcacccaccgcagguca

SEQ ID NO: 1568038 - RNA, 18 nt, Pseudomonas putida KT2440
gcaccaggucgcggugca

SEQ ID NO: 1568039 - RNA, 19 nt, Pseudomonas putida KT2440
gcaccagguccagcguggc

SEQ ID NO: 1568040 - RNA, 22 nt, Pseudomonas putida KT2440
gcaccagggcuggcagcgggua

SEQ ID NO: 1568041 - RNA, 17 nt, Pseudomonas putida KT2440
gcaccagcgcgaucacc

SEQ ID NO: 1568042 - RNA, 19 nt, Pseudomonas putida KT2440
gcaccagcuccuggccgcc

SEQ ID NO: 1568043 - RNA, 16 nt, Pseudomonas putida KT2440
gcaccacccaccagca

SEQ ID NO: 1568044 - RNA, 18 nt, Pseudomonas putida KT2440
gcaccacccaccagcagu

SEQ ID NO: 1568045 - RNA, 18 nt, Pseudomonas putida KT2440
gcaccacaucauccauga

SEQ ID NO: 1568046 - RNA, 22 nt, Pseudomonas putida KT2440
gcaccaccaagucgauuuucac

SEQ ID NO: 1568047 - RNA, 13 nt, Pseudomonas putida KT2440
gcaccaacgccga

SEQ ID NO: 1568048 - RNA, 15 nt, Pseudomonas putida KT2440
gcaccaacuggucgg

SEQ ID NO: 1568049 - RNA, 17 nt, Pseudomonas putida KT2440
gcacaugccugcacugg

SEQ ID NO: 1568050 - RNA, 16 nt, Pseudomonas putida KT2440
gcacaucuugcugaug

SEQ ID NO: 1568051 - RNA, 18 nt, Pseudomonas putida KT2440
gcacauuucacagcaaaa

SEQ ID NO: 1568052 - RNA, 17 nt, Pseudomonas putida KT2440
gcacauucagcagcgcc

SEQ ID NO: 1568053 - RNA, 22 nt, Pseudomonas putida KT2440
gcaccaccccggggcgcuccag

SEQ ID NO: 1568054 - RNA, 14 nt, Pseudomonas putida KT2440
gcaccagaccagca

SEQ ID NO: 1568055 - RNA, 17 nt, Pseudomonas putida KT2440
gcaccagaccagcagca

SEQ ID NO: 1568056 - RNA, 18 nt, Pseudomonas putida KT2440
gcaccacuggaugacgcc

SEQ ID NO: 1568057 - RNA, 18 nt, Pseudomonas putida KT2440
gcaccacggaaggccacg

SEQ ID NO: 1568058 - RNA, 13 nt, Pseudomonas putida KT2440
gcaccacggcagu

SEQ ID NO: 1568059 - RNA, 16 nt, Pseudomonas putida KT2440
gcaccacguccggcca

SEQ ID NO: 1568060 - RNA, 19 nt, Pseudomonas putida KT2440
gcaccacguccggccagca

SEQ ID NO: 1568061 - RNA, 21 nt, Pseudomonas putida KT2440
gcaccacguccggccagcaac

SEQ ID NO: 1568062 - RNA, 19 nt, Pseudomonas putida KT2440
gcaccacggcggcgaucag

SEQ ID NO: 1568063 - RNA, 22 nt, Pseudomonas putida KT2440
gcaguaccuguggcagcggcuu

SEQ ID NO: 1568064 - RNA, 16 nt, Pseudomonas putida KT2440
gcaguaucgccccggu

SEQ ID NO: 1568065 - RNA, 16 nt, Pseudomonas putida KT2440
gcagucacccaccggc

SEQ ID NO: 1568066 - RNA, 15 nt, Pseudomonas putida KT2440
gcagggucuucucag

SEQ ID NO: 1568067 - RNA, 21 nt, Pseudomonas putida KT2440
gcagggucgcgccccaagcgg

SEQ ID NO: 1568068 - RNA, 22 nt, Pseudomonas putida KT2440
gcagggucgccugaacgcugcg

SEQ ID NO: 1568069 - RNA, 17 nt, Pseudomonas putida KT2440
gcagguugaugugcagg

SEQ ID NO: 1568070 - RNA, 15 nt, Pseudomonas putida KT2440
gcagguuguccaccg

SEQ ID NO: 1568071 - RNA, 15 nt, Pseudomonas putida KT2440
gcaggguagccccga

SEQ ID NO: 1568072 - RNA, 22 nt, Pseudomonas putida KT2440
gcagggccuccauacgcuggug

SEQ ID NO: 1568073 - RNA, 15 nt, Pseudomonas putida KT2440
gcaggggucugugca

SEQ ID NO: 1568074 - RNA, 18 nt, Pseudomonas putida KT2440
gcagucccagcaccgcga

SEQ ID NO: 1568075 - RNA, 16 nt, Pseudomonas putida KT2440
gcagucaugggccaug

SEQ ID NO: 1568076 - RNA, 20 nt, Pseudomonas putida KT2440
gcagucgaccgggcagaccu

SEQ ID NO: 1568077 - RNA, 23 nt, Pseudomonas putida KT2440
gcagucgaucccgaggucagcag

SEQ ID NO: 1568078 - RNA, 23 nt, Pseudomonas putida KT2440
gcagugaugccgugguucaucac

SEQ ID NO: 1568079 - RNA, 17 nt, Pseudomonas putida KT2440
gcagugguugugcuggc

SEQ ID NO: 1568080 - RNA, 16 nt, Pseudomonas putida KT2440
gcaguguacauggccg

SEQ ID NO: 1568081 - RNA, 15 nt, Pseudomonas putida KT2440
gcaguggcggugacc

SEQ ID NO: 1568082 - RNA, 17 nt, Pseudomonas putida KT2440
gcagugaucuggcgcag

SEQ ID NO: 1568083 - RNA, 17 nt, Pseudomonas putida KT2440
gcagucuugugcugcga

SEQ ID NO: 1568084 - RNA, 18 nt, Pseudomonas putida KT2440
gcagucuugugcugcgag

SEQ ID NO: 1568085 - RNA, 14 nt, Pseudomonas putida KT2440
gcagucguugucca

SEQ ID NO: 1568086 - RNA, 20 nt, Pseudomonas putida KT2440
gcagucguuguccagguggu

SEQ ID NO: 1568087 - RNA, 21 nt, Pseudomonas putida KT2440
gcagugaacuccaacgccggc

SEQ ID NO: 1568088 - RNA, 20 nt, Pseudomonas putida KT2440
gcagugacacggcgaugcgc

SEQ ID NO: 1568089 - RNA, 18 nt, Pseudomonas putida KT2440
gcaguucgcacagcucga

SEQ ID NO: 1568090 - RNA, 14 nt, Pseudomonas putida KT2440
gcauacagcuggcc

SEQ ID NO: 1568091 - RNA, 19 nt, Pseudomonas putida KT2440
gcauacaggaccaggccga

SEQ ID NO: 1568092 - RNA, 20 nt, Pseudomonas putida KT2440
gcaguucgcgcaccaucggc

SEQ ID NO: 1568093 - RNA, 19 nt, Pseudomonas putida KT2440
gcaguucauccggcggcau

SEQ ID NO: 1568094 - RNA, 13 nt, Pseudomonas putida KT2440
gcauaccgcaaca

SEQ ID NO: 1568095 - RNA, 15 nt, Pseudomonas putida KT2440
gcaucaacaggucgc

SEQ ID NO: 1568096 - RNA, 19 nt, Pseudomonas putida KT2440
gcaucaacaggucgccgcu

SEQ ID NO: 1568097 - RNA, 15 nt, Pseudomonas putida KT2440
gcauaugcagggccu

SEQ ID NO: 1568098 - RNA, 21 nt, Pseudomonas putida KT2440
gcaucaacucacuuucagcgc

SEQ ID NO: 1568099 - RNA, 17 nt, Pseudomonas putida KT2440
gcaucagugcaggugca

SEQ ID NO: 1568100 - RNA, 14 nt, Pseudomonas putida KT2440
gcaucagcgcagca

SEQ ID NO: 1568101 - RNA, 15 nt, Pseudomonas putida KT2440
gcaucagcgcagcau

SEQ ID NO: 1568102 - RNA, 17 nt, Pseudomonas putida KT2440
gcauccacacgcugcug

SEQ ID NO: 1568103 - RNA, 15 nt, Pseudomonas putida KT2440
gcauccagcagggug

SEQ ID NO: 1568104 - RNA, 22 nt, Pseudomonas putida KT2440
gcauccagcaggguggccagca

SEQ ID NO: 1568105 - RNA, 17 nt, Pseudomonas putida KT2440
gcaucauccugcucgac

SEQ ID NO: 1568106 - RNA, 21 nt, Pseudomonas putida KT2440
gcaucauccugcucgacaagc

SEQ ID NO: 1568107 - RNA, 15 nt, Pseudomonas putida KT2440
gcaggcaauccucga

SEQ ID NO: 1568108 - RNA, 15 nt, Pseudomonas putida KT2440
gcaggcacacccgga

SEQ ID NO: 1568109 - RNA, 23 nt, Pseudomonas putida KT2440
gcaggccauauugcugagccagu

SEQ ID NO: 1568110 - RNA, 18 nt, Pseudomonas putida KT2440
gcaggcccagcagguaca

SEQ ID NO: 1568111 - RNA, 13 nt, Pseudomonas putida KT2440
gcaggcccaggua

SEQ ID NO: 1568112 - RNA, 21 nt, Pseudomonas putida KT2440
gcaggcccagguaacugccga

SEQ ID NO: 1568113 - RNA, 18 nt, Pseudomonas putida KT2440
gcaggcccggcagguuga

SEQ ID NO: 1568114 - RNA, 21 nt, Pseudomonas putida KT2440
gcaggcccggcccauucgcgg

SEQ ID NO: 1568115 - RNA, 21 nt, Pseudomonas putida KT2440
gcaggcccggcccuuucgcgg

SEQ ID NO: 1568116 - RNA, 23 nt, Pseudomonas putida KT2440
gcaggccuggguacgccgaaauu

SEQ ID NO: 1568117 - RNA, 20 nt, Pseudomonas putida KT2440
gcagggaacugcgcgagcca

SEQ ID NO: 1568118 - RNA, 13 nt, Pseudomonas putida KT2440
gcagggacugucg

SEQ ID NO: 1568119 - RNA, 22 nt, Pseudomonas putida KT2440
gcagggcacgccaaucaccugc

SEQ ID NO: 1568120 - RNA, 22 nt, Pseudomonas putida KT2440
gcagggcccccgauuccaaggu

SEQ ID NO: 1568121 - RNA, 15 nt, Pseudomonas putida KT2440
gcaggcuucaugacu

SEQ ID NO: 1568122 - RNA, 22 nt, Pseudomonas putida KT2440
gcaggcuucaaggccacgcggu

SEQ ID NO: 1568123 - RNA, 16 nt, Pseudomonas putida KT2440
gcaggcugucgaacag

SEQ ID NO: 1568124 - RNA, 17 nt, Pseudomonas putida KT2440
gcaggcugucgaacagg

SEQ ID NO: 1568125 - RNA, 18 nt, Pseudomonas putida KT2440
gcaggcugcgugccugcu

SEQ ID NO: 1568126 - RNA, 14 nt, Pseudomonas putida KT2440
gcaggcggcgacaa

SEQ ID NO: 1568127 - RNA, 22 nt, Pseudomonas putida KT2440
gcaggaacaaccugaacaaggc

SEQ ID NO: 1568128 - RNA, 16 nt, Pseudomonas putida KT2440
gcaggaaccuccguug

SEQ ID NO: 1568129 - RNA, 16 nt, Pseudomonas putida KT2440
gcagcuugcagcgccg

SEQ ID NO: 1568130 - RNA, 18 nt, Pseudomonas putida KT2440
gcagcuugcagcgccgag

SEQ ID NO: 1568131 - RNA, 14 nt, Pseudomonas putida KT2440
gcagcuuggccauu

SEQ ID NO: 1568132 - RNA, 13 nt, Pseudomonas putida KT2440
gcagcuggucgag

SEQ ID NO: 1568133 - RNA, 12 nt, Pseudomonas putida KT2440
gcagcuggcuug

SEQ ID NO: 1568134 - RNA, 17 nt, Pseudomonas putida KT2440
gcagcuggcgcaaauug

SEQ ID NO: 1568135 - RNA, 16 nt, Pseudomonas putida KT2440
gcagcuuccgccacca

SEQ ID NO: 1568136 - RNA, 17 nt, Pseudomonas putida KT2440
gcagcuugaggcccaug

SEQ ID NO: 1568137 - RNA, 14 nt, Pseudomonas putida KT2440
gcagcuugaacaac

SEQ ID NO: 1568138 - RNA, 17 nt, Pseudomonas putida KT2440
gcagcuugaacaacggc

SEQ ID NO: 1568139 - RNA, 19 nt, Pseudomonas putida KT2440
gcagcuugaacaacggcgc

SEQ ID NO: 1568140 - RNA, 21 nt, Pseudomonas putida KT2440
gcaggacuacaucuucgcgcu

SEQ ID NO: 1568141 - RNA, 13 nt, Pseudomonas putida KT2440
gcaggagcggcuu

SEQ ID NO: 1568142 - RNA, 15 nt, Pseudomonas putida KT2440
gcaggagcugaacug

SEQ ID NO: 1568143 - RNA, 20 nt, Pseudomonas putida KT2440
gcaggagcugaacugcucuc

SEQ ID NO: 1568144 - RNA, 17 nt, Pseudomonas putida KT2440
gcaggaucaugugcgcc

SEQ ID NO: 1568145 - RNA, 22 nt, Pseudomonas putida KT2440
gcaggaucgcaagcuggcgcaa

SEQ ID NO: 1568146 - RNA, 22 nt, Pseudomonas putida KT2440
gcaggaucugcugcagcauggc

SEQ ID NO: 1568147 - RNA, 20 nt, Pseudomonas putida KT2440
gcaggauggugacugccagc

SEQ ID NO: 1568148 - RNA, 22 nt, Pseudomonas putida KT2440
gcaggaugucgacguaggcgaa

SEQ ID NO: 1568149 - RNA, 22 nt, Pseudomonas putida KT2440
gcagcacaucacacagcggcag

SEQ ID NO: 1568150 - RNA, 23 nt, Pseudomonas putida KT2440
gcagcacccggucgccgacggca

SEQ ID NO: 1568151 - RNA, 24 nt, Pseudomonas putida KT2440
gcagcacccggucgccgacggcau

SEQ ID NO: 1568152 - RNA, 21 nt, Pseudomonas putida KT2440
gcagcacaggucucgaacgcu

SEQ ID NO: 1568153 - RNA, 16 nt, Pseudomonas putida KT2440
gcagcacacuccacga

SEQ ID NO: 1568154 - RNA, 15 nt, Pseudomonas putida KT2440
gcagauccaggugcc

SEQ ID NO: 1568155 - RNA, 16 nt, Pseudomonas putida KT2440
gcagaucacgcaaccu

SEQ ID NO: 1568156 - RNA, 18 nt, Pseudomonas putida KT2440
gcagauaaccuggcucgg

SEQ ID NO: 1568157 - RNA, 19 nt, Pseudomonas putida KT2440
gcagagucguucugccggu

SEQ ID NO: 1568158 - RNA, 17 nt, Pseudomonas putida KT2440
gcacucgccgauaaagc

SEQ ID NO: 1568159 - RNA, 22 nt, Pseudomonas putida KT2440
gcagcaugaacagcgcugcgag

SEQ ID NO: 1568160 - RNA, 18 nt, Pseudomonas putida KT2440
gcagcauggcgucggcga

SEQ ID NO: 1568161 - RNA, 19 nt, Pseudomonas putida KT2440
gcagcaucaccgcgucgau

SEQ ID NO: 1568162 - RNA, 21 nt, Pseudomonas putida KT2440
gcagccagcaucucggccagu

SEQ ID NO: 1568163 - RNA, 12 nt, Pseudomonas putida KT2440
gcagccaccacg

SEQ ID NO: 1568164 - RNA, 14 nt, Pseudomonas putida KT2440
gcagccacgauagc

SEQ ID NO: 1568165 - RNA, 21 nt, Pseudomonas putida KT2440
gcagccacgauagcgucagca

SEQ ID NO: 1568166 - RNA, 18 nt, Pseudomonas putida KT2440
gcagcacuuccucggcac

SEQ ID NO: 1568167 - RNA, 15 nt, Pseudomonas putida KT2440
gcagcaggccgcuga

SEQ ID NO: 1568168 - RNA, 11 nt, Pseudomonas putida KT2440
gcagcaggccg

SEQ ID NO: 1568169 - RNA, 17 nt, Pseudomonas putida KT2440
gcagcacuucgaucagg

SEQ ID NO: 1568170 - RNA, 12 nt, Pseudomonas putida KT2440
gcagcagugcca

SEQ ID NO: 1568171 - RNA, 18 nt, Pseudomonas putida KT2440
gcagcaguggcaagccga

SEQ ID NO: 1568172 - RNA, 15 nt, Pseudomonas putida KT2440
gcagcagugccagca

SEQ ID NO: 1568173 - RNA, 17 nt, Pseudomonas putida KT2440
gcagcucgcgcugcgca

SEQ ID NO: 1568174 - RNA, 22 nt, Pseudomonas putida KT2440
gcagcucggugaacagguugcg

SEQ ID NO: 1568175 - RNA, 19 nt, Pseudomonas putida KT2440
gcagcucuuuugccgggaa

SEQ ID NO: 1568176 - RNA, 17 nt, Pseudomonas putida KT2440
gcagcuccagcguuugc

SEQ ID NO: 1568177 - RNA, 12 nt, Pseudomonas putida KT2440
gcagcucaccgg

SEQ ID NO: 1568178 - RNA, 15 nt, Pseudomonas putida KT2440
gcagcucagccagca

SEQ ID NO: 1568179 - RNA, 16 nt, Pseudomonas putida KT2440
gcagcguuguucacca

SEQ ID NO: 1568180 - RNA, 19 nt, Pseudomonas putida KT2440
gcagcguucucgguguaga

SEQ ID NO: 1568181 - RNA, 14 nt, Pseudomonas putida KT2440
gcagcgugggugua

SEQ ID NO: 1568182 - RNA, 12 nt, Pseudomonas putida KT2440
gcagcggcaagg

SEQ ID NO: 1568183 - RNA, 11 nt, Pseudomonas putida KT2440
gcagcggcaag

SEQ ID NO: 1568184 - RNA, 20 nt, Pseudomonas putida KT2440
gcagcgcuucgaucagcgcc

SEQ ID NO: 1568185 - RNA, 17 nt, Pseudomonas putida KT2440
gcagcgcuucgaucgcc

SEQ ID NO: 1568186 - RNA, 21 nt, Pseudomonas putida KT2440
gcagcgcgcaggucgugcuug

SEQ ID NO: 1568187 - RNA, 13 nt, Pseudomonas putida KT2440
gcagccagggccu

SEQ ID NO: 1568188 - RNA, 15 nt, Pseudomonas putida KT2440
gcagccguucccggg

SEQ ID NO: 1568189 - RNA, 16 nt, Pseudomonas putida KT2440
gcagcgaucagcgcag

SEQ ID NO: 1568190 - RNA, 18 nt, Pseudomonas putida KT2440
gcagcgaucagcgcagaa

SEQ ID NO: 1568191 - RNA, 18 nt, Pseudomonas putida KT2440
gcagcgaucagugccuug

SEQ ID NO: 1568192 - RNA, 21 nt, Pseudomonas putida KT2440
gcagcgaucagugccuugacc

SEQ ID NO: 1568193 - RNA, 16 nt, Pseudomonas putida KT2440
gcagccugacgcgccg

SEQ ID NO: 1568194 - RNA, 14 nt, Pseudomonas putida KT2440
gcagccugccaggu

SEQ ID NO: 1568195 - RNA, 15 nt, Pseudomonas putida KT2440
gcagccugccagguc

SEQ ID NO: 1568196 - RNA, 16 nt, Pseudomonas putida KT2440
gcagccugccagguca

SEQ ID NO: 1568197 - RNA, 18 nt, Pseudomonas putida KT2440
gcagccugccaggucacc

SEQ ID NO: 1568198 - RNA, 14 nt, Pseudomonas putida KT2440
gcagcgacggcgaa

SEQ ID NO: 1568199 - RNA, 18 nt, Pseudomonas putida KT2440
gauggcguccuugacgau

SEQ ID NO: 1568200 - RNA, 13 nt, Pseudomonas putida KT2440
gauggugugcagc

SEQ ID NO: 1568201 - RNA, 16 nt, Pseudomonas putida KT2440
gauguacggcagaacg

SEQ ID NO: 1568202 - RNA, 16 nt, Pseudomonas putida KT2440
gauguacgccagguga

SEQ ID NO: 1568203 - RNA, 14 nt, Pseudomonas putida KT2440
gauguccaggccga

SEQ ID NO: 1568204 - RNA, 16 nt, Pseudomonas putida KT2440
gauguuggccaucacu

SEQ ID NO: 1568205 - RNA, 20 nt, Pseudomonas putida KT2440
gauuccgggcugcugcgcag

SEQ ID NO: 1568206 - RNA, 11 nt, Pseudomonas putida KT2440
gauucaggccu

SEQ ID NO: 1568207 - RNA, 14 nt, Pseudomonas putida KT2440
gauuacaagggccu

SEQ ID NO: 1568208 - RNA, 21 nt, Pseudomonas putida KT2440
gauugccgcagcugcggucga

SEQ ID NO: 1568209 - RNA, 16 nt, Pseudomonas putida KT2440
gauugaucagcgccuc

SEQ ID NO: 1568210 - RNA, 14 nt, Pseudomonas putida KT2440
gauuggccagcagg

SEQ ID NO: 1568211 - RNA, 17 nt, Pseudomonas putida KT2440
gauuggccagcaggccc

SEQ ID NO: 1568212 - RNA, 15 nt, Pseudomonas putida KT2440
gcaaaaucgaccagg

SEQ ID NO: 1568213 - RNA, 19 nt, Pseudomonas putida KT2440
gcaaaaaacccggcgcaag

SEQ ID NO: 1568214 - RNA, 18 nt, Pseudomonas putida KT2440
gcaaaaccugagucaggc

SEQ ID NO: 1568215 - RNA, 17 nt, Pseudomonas putida KT2440
gcaaaaccugccggugc

SEQ ID NO: 1568216 - RNA, 13 nt, Pseudomonas putida KT2440
gaugcuucgcggg

SEQ ID NO: 1568217 - RNA, 17 nt, Pseudomonas putida KT2440
gaugcgguugcaggacu

SEQ ID NO: 1568218 - RNA, 14 nt, Pseudomonas putida KT2440
gaugcgguugcccg

SEQ ID NO: 1568219 - RNA, 12 nt, Pseudomonas putida KT2440
gaugcugcgggc

SEQ ID NO: 1568220 - RNA, 16 nt, Pseudomonas putida KT2440
gaugcugcgggcguug

SEQ ID NO: 1568221 - RNA, 22 nt, Pseudomonas putida KT2440
gaugcgguaggcacggucggua

SEQ ID NO: 1568222 - RNA, 22 nt, Pseudomonas putida KT2440
gaugcggacccagcggucagca

SEQ ID NO: 1568223 - RNA, 15 nt, Pseudomonas putida KT2440
gaugcgcgugcauuu

SEQ ID NO: 1568224 - RNA, 20 nt, Pseudomonas putida KT2440
gaugcgcuggcccuugccau

SEQ ID NO: 1568225 - RNA, 22 nt, Pseudomonas putida KT2440
gaugcgcuucauccagcgggau

SEQ ID NO: 1568226 - RNA, 15 nt, Pseudomonas putida KT2440
gauggccaggaacag

SEQ ID NO: 1568227 - RNA, 16 nt, Pseudomonas putida KT2440
gauggccaggaacagc

SEQ ID NO: 1568228 - RNA, 17 nt, Pseudomonas putida KT2440
gauggacagcccaaggc

SEQ ID NO: 1568229 - RNA, 17 nt, Pseudomonas putida KT2440
gauggcggaucagcgcg

SEQ ID NO: 1568230 - RNA, 18 nt, Pseudomonas putida KT2440
gauggcggugaugcgcuc

SEQ ID NO: 1568231 - RNA, 14 nt, Pseudomonas putida KT2440
gauggcggcuucaa

SEQ ID NO: 1568232 - RNA, 18 nt, Pseudomonas putida KT2440
gaugcgcacggcaucggc

SEQ ID NO: 1568233 - RNA, 15 nt, Pseudomonas putida KT2440
gaugcgcacaccgcu

SEQ ID NO: 1568234 - RNA, 23 nt, Pseudomonas putida KT2440
gaugcgcaagcaaccgggggcuu

SEQ ID NO: 1568235 - RNA, 16 nt, Pseudomonas putida KT2440
gaugccagcggugcca

SEQ ID NO: 1568236 - RNA, 17 nt, Pseudomonas putida KT2440
gaugcccuccagcccug

SEQ ID NO: 1568237 - RNA, 20 nt, Pseudomonas putida KT2440
gaugcccgggccuucaaccu

SEQ ID NO: 1568238 - RNA, 14 nt, Pseudomonas putida KT2440
gaucccgaugcgcu

SEQ ID NO: 1568239 - RNA, 11 nt, Pseudomonas putida KT2440
gaucccgacaa

SEQ ID NO: 1568240 - RNA, 19 nt, Pseudomonas putida KT2440
gaucccgcgaggucaggua

SEQ ID NO: 1568241 - RNA, 21 nt, Pseudomonas putida KT2440
gauccgguguaggagcggguu

SEQ ID NO: 1568242 - RNA, 13 nt, Pseudomonas putida KT2440
gauccccggcgac

SEQ ID NO: 1568243 - RNA, 16 nt, Pseudomonas putida KT2440
gaucacgucggcguca

SEQ ID NO: 1568244 - RNA, 17 nt, Pseudomonas putida KT2440
gauccaggugcgcaccu

SEQ ID NO: 1568245 - RNA, 20 nt, Pseudomonas putida KT2440
gaucacgcaggcccagcagg

SEQ ID NO: 1568246 - RNA, 16 nt, Pseudomonas putida KT2440
gaucacccagucaccu

SEQ ID NO: 1568247 - RNA, 17 nt, Pseudomonas putida KT2440
gaucacccuuggccacc

SEQ ID NO: 1568248 - RNA, 21 nt, Pseudomonas putida KT2440
gaucgccucgugcagcugcac

SEQ ID NO: 1568249 - RNA, 14 nt, Pseudomonas putida KT2440
gaucgccuccaggc

SEQ ID NO: 1568250 - RNA, 22 nt, Pseudomonas putida KT2440
gaucgccuccaggcguugcggg

SEQ ID NO: 1568251 - RNA, 17 nt, Pseudomonas putida KT2440
gaucgcucucgcuuuug

SEQ ID NO: 1568252 - RNA, 22 nt, Pseudomonas putida KT2440
gaucggccggcggauagccccg

SEQ ID NO: 1568253 - RNA, 17 nt, Pseudomonas putida KT2440
gaucgugcaccgucugg

SEQ ID NO: 1568254 - RNA, 13 nt, Pseudomonas putida KT2440
gaucguuguagga

SEQ ID NO: 1568255 - RNA, 20 nt, Pseudomonas putida KT2440
gaucguuguaggagcgggcu

SEQ ID NO: 1568256 - RNA, 21 nt, Pseudomonas putida KT2440
gaucucgccagccugcagcgc

SEQ ID NO: 1568257 - RNA, 22 nt, Pseudomonas putida KT2440
gaucuggcggaaugucggcguu

SEQ ID NO: 1568258 - RNA, 13 nt, Pseudomonas putida KT2440
gaucuugcuggcc

SEQ ID NO: 1568259 - RNA, 16 nt, Pseudomonas putida KT2440
gaucucgcgcauccgg

SEQ ID NO: 1568260 - RNA, 19 nt, Pseudomonas putida KT2440
gaucucggccagcaggcca

SEQ ID NO: 1568261 - RNA, 22 nt, Pseudomonas putida KT2440
gaucugcguacaccgacgccga

SEQ ID NO: 1568262 - RNA, 14 nt, Pseudomonas putida KT2440
gaucugcugcagca

SEQ ID NO: 1568263 - RNA, 14 nt, Pseudomonas putida KT2440
gaugaugcuggucg

SEQ ID NO: 1568264 - RNA, 20 nt, Pseudomonas putida KT2440
gaugauauuugccacucagg

SEQ ID NO: 1568265 - RNA, 20 nt, Pseudomonas putida KT2440
gaugaugguugacagcgcuu

SEQ ID NO: 1568266 - RNA, 16 nt, Pseudomonas putida KT2440
gaugauaccgaacagc

SEQ ID NO: 1568267 - RNA, 18 nt, Pseudomonas putida KT2440
gaugacuggccggagcug

SEQ ID NO: 1568268 - RNA, 13 nt, Pseudomonas putida KT2440
gaugagccuucac

SEQ ID NO: 1568269 - RNA, 13 nt, Pseudomonas putida KT2440
gagcgaugcgcug

SEQ ID NO: 1568270 - RNA, 15 nt, Pseudomonas putida KT2440
gagcgcccaccaauu

SEQ ID NO: 1568271 - RNA, 14 nt, Pseudomonas putida KT2440
gagcgccagcaucg

SEQ ID NO: 1568272 - RNA, 15 nt, Pseudomonas putida KT2440
gagccugcacccagg

SEQ ID NO: 1568273 - RNA, 20 nt, Pseudomonas putida KT2440
gagccuggccgguguggcca

SEQ ID NO: 1568274 - RNA, 19 nt, Pseudomonas putida KT2440
gagcgacgcugccgcaccu

SEQ ID NO: 1568275 - RNA, 16 nt, Pseudomonas putida KT2440
gagcgacuucgaccac

SEQ ID NO: 1568276 - RNA, 21 nt, Pseudomonas putida KT2440
gagcgccgcgcgggcggcgcu

SEQ ID NO: 1568277 - RNA, 15 nt, Pseudomonas putida KT2440
gagcgccgcccgcgu

SEQ ID NO: 1568278 - RNA, 19 nt, Pseudomonas putida KT2440
gagcgggucuacccgcgaa

SEQ ID NO: 1568279 - RNA, 20 nt, Pseudomonas putida KT2440
gagcgggucuacccgcgaaa

SEQ ID NO: 1568280 - RNA, 18 nt, Pseudomonas putida KT2440
gagcggguucacccgcga

SEQ ID NO: 1568281 - RNA, 22 nt, Pseudomonas putida KT2440
gagcggguucacccgcgaagca

SEQ ID NO: 1568282 - RNA, 20 nt, Pseudomonas putida KT2440
gagcggguucacccgcgaau

SEQ ID NO: 1568283 - RNA, 20 nt, Pseudomonas putida KT2440
gagcggguuuacccgcgaag

SEQ ID NO: 1568284 - RNA, 20 nt, Pseudomonas putida KT2440
gagcggguuuucucgcgaau

SEQ ID NO: 1568285 - RNA, 19 nt, Pseudomonas putida KT2440
gagcgggcgcgcccgcgaa

SEQ ID NO: 1568286 - RNA, 13 nt, Pseudomonas putida KT2440
gagcgggcgacgc

SEQ ID NO: 1568287 - RNA, 19 nt, Pseudomonas putida KT2440
gagcgggcgugccugcgaa

SEQ ID NO: 1568288 - RNA, 19 nt, Pseudomonas putida KT2440
gagcgggcuuacccgcgaa

SEQ ID NO: 1568289 - RNA, 19 nt, Pseudomonas putida KT2440
gagcgggcuugcccgcgaa

SEQ ID NO: 1568290 - RNA, 20 nt, Pseudomonas putida KT2440
gagcgggcuugcccgcgaac

SEQ ID NO: 1568291 - RNA, 13 nt, Pseudomonas putida KT2440
gagcgggucagcc

SEQ ID NO: 1568292 - RNA, 19 nt, Pseudomonas putida KT2440
gagcgggcaugcccgcgaa

SEQ ID NO: 1568293 - RNA, 20 nt, Pseudomonas putida KT2440
gagcgggcaugcccgcgaag

SEQ ID NO: 1568294 - RNA, 15 nt, Pseudomonas putida KT2440
gagcucaaccagcug

SEQ ID NO: 1568295 - RNA, 23 nt, Pseudomonas putida KT2440
gagcucaaccagcugcguggcau

SEQ ID NO: 1568296 - RNA, 19 nt, Pseudomonas putida KT2440
gagcucagcgugacgaugg

SEQ ID NO: 1568297 - RNA, 21 nt, Pseudomonas putida KT2440
gagcgucaaccaggcgcagca

SEQ ID NO: 1568298 - RNA, 14 nt, Pseudomonas putida KT2440
gagcuacagccccu

SEQ ID NO: 1568299 - RNA, 14 nt, Pseudomonas putida KT2440
gagccggguccacc

SEQ ID NO: 1568300 - RNA, 19 nt, Pseudomonas putida KT2440
gagccggguccacccggua

SEQ ID NO: 1568301 - RNA, 12 nt, Pseudomonas putida KT2440
gagccggugcca

SEQ ID NO: 1568302 - RNA, 14 nt, Pseudomonas putida KT2440
gagccgcugccaaa

SEQ ID NO: 1568303 - RNA, 14 nt, Pseudomonas putida KT2440
gagccggcgcuggg

SEQ ID NO: 1568304 - RNA, 16 nt, Pseudomonas putida KT2440
gagcccgccagcaggc

SEQ ID NO: 1568305 - RNA, 15 nt, Pseudomonas putida KT2440
gagcccggguugacc

SEQ ID NO: 1568306 - RNA, 16 nt, Pseudomonas putida KT2440
gagcccugugggagcg

SEQ ID NO: 1568307 - RNA, 20 nt, Pseudomonas putida KT2440
gagcccugugggagcgggca

SEQ ID NO: 1568308 - RNA, 12 nt, Pseudomonas putida KT2440
gagccagccgcg

SEQ ID NO: 1568309 - RNA, 13 nt, Pseudomonas putida KT2440
gagccccaccagg

SEQ ID NO: 1568310 - RNA, 23 nt, Pseudomonas putida KT2440
gagccagaucauggcgguccacc

SEQ ID NO: 1568311 - RNA, 13 nt, Pseudomonas putida KT2440
gagccaaggccgc

SEQ ID NO: 1568312 - RNA, 13 nt, Pseudomonas putida KT2440
gagccaccggcau

SEQ ID NO: 1568313 - RNA, 20 nt, Pseudomonas putida KT2440
gagccaauuucaacgcucgc

SEQ ID NO: 1568314 - RNA, 22 nt, Pseudomonas putida KT2440
gagccaaccgcuucaccgcgca

SEQ ID NO: 1568315 - RNA, 14 nt, Pseudomonas putida KT2440
gagcaugaucaccg

SEQ ID NO: 1568316 - RNA, 18 nt, Pseudomonas putida KT2440
gagcaugaucaccgccag

SEQ ID NO: 1568317 - RNA, 12 nt, Pseudomonas putida KT2440
gagcaugccgag

SEQ ID NO: 1568318 - RNA, 15 nt, Pseudomonas putida KT2440
gagcaucggcguugc

SEQ ID NO: 1568319 - RNA, 15 nt, Pseudomonas putida KT2440
gagcaucggcucgca

SEQ ID NO: 1568320 - RNA, 19 nt, Pseudomonas putida KT2440
gagcaucgcguacgaagcu

SEQ ID NO: 1568321 - RNA, 14 nt, Pseudomonas putida KT2440
gagcagguugucca

SEQ ID NO: 1568322 - RNA, 11 nt, Pseudomonas putida KT2440
gaucaaugccc

SEQ ID NO: 1568323 - RNA, 15 nt, Pseudomonas putida KT2440
gaucaccagcucgcc

SEQ ID NO: 1568324 - RNA, 14 nt, Pseudomonas putida KT2440
gauacuccggcaac

SEQ ID NO: 1568325 - RNA, 15 nt, Pseudomonas putida KT2440
gauacuccggcaacc

SEQ ID NO: 1568326 - RNA, 14 nt, Pseudomonas putida KT2440
gauagggcugcggg

SEQ ID NO: 1568327 - RNA, 15 nt, Pseudomonas putida KT2440
gaguugccuucgauc

SEQ ID NO: 1568328 - RNA, 17 nt, Pseudomonas putida KT2440
gauaaccuggcucggcu

SEQ ID NO: 1568329 - RNA, 18 nt, Pseudomonas putida KT2440
gaguccaggucgcggagc

SEQ ID NO: 1568330 - RNA, 11 nt, Pseudomonas putida KT2440
gaggccgucgu

SEQ ID NO: 1568331 - RNA, 21 nt, Pseudomonas putida KT2440
gaggcacaaaaaagcccggca

SEQ ID NO: 1568332 - RNA, 21 nt, Pseudomonas putida KT2440
gaggcguuggccgaaggccgu

SEQ ID NO: 1568333 - RNA, 22 nt, Pseudomonas putida KT2440
gagggaagggcgucugcuccgc

SEQ ID NO: 1568334 - RNA, 13 nt, Pseudomonas putida KT2440
gaguacgaucagc

SEQ ID NO: 1568335 - RNA, 15 nt, Pseudomonas putida KT2440
gaguaaagccgaucg

SEQ ID NO: 1568336 - RNA, 19 nt, Pseudomonas putida KT2440
gaguagaucaucagcgcca

SEQ ID NO: 1568337 - RNA, 22 nt, Pseudomonas putida KT2440
gagucagggcuuuuuccagcgc

SEQ ID NO: 1568338 - RNA, 17 nt, Pseudomonas putida KT2440
gagucaggcgcccugcc

SEQ ID NO: 1568339 - RNA, 20 nt, Pseudomonas putida KT2440
gagucaacaauuuucgacca

SEQ ID NO: 1568340 - RNA, 14 nt, Pseudomonas putida KT2440
gaggguggcaaugc

SEQ ID NO: 1568341 - RNA, 17 nt, Pseudomonas putida KT2440
gagcugggcacggcgcu

SEQ ID NO: 1568342 - RNA, 21 nt, Pseudomonas putida KT2440
gagcuggagaucuugucgacc

SEQ ID NO: 1568343 - RNA, 19 nt, Pseudomonas putida KT2440
gagcuggagccggaucgac

SEQ ID NO: 1568344 - RNA, 10 nt, Pseudomonas putida KT2440
gagcuggccg

SEQ ID NO: 1568345 - RNA, 17 nt, Pseudomonas putida KT2440
gagcuuggcguccacag

SEQ ID NO: 1568346 - RNA, 14 nt, Pseudomonas putida KT2440
gagcuguuucaugc

SEQ ID NO: 1568347 - RNA, 19 nt, Pseudomonas putida KT2440
gagcuguuucaugcugcga

SEQ ID NO: 1568348 - RNA, 13 nt, Pseudomonas putida KT2440
gagcuucaacgcg

SEQ ID NO: 1568349 - RNA, 21 nt, Pseudomonas putida KT2440
gagcuucgucggugcccuuca

SEQ ID NO: 1568350 - RNA, 13 nt, Pseudomonas putida KT2440
gagcuugcucgcg

SEQ ID NO: 1568351 - RNA, 16 nt, Pseudomonas putida KT2440
gaggaccugcguuggg

SEQ ID NO: 1568352 - RNA, 21 nt, Pseudomonas putida KT2440
gaggacaacaaggacugccug

SEQ ID NO: 1568353 - RNA, 21 nt, Pseudomonas putida KT2440
gaggaguccagcugcaucagg

SEQ ID NO: 1568354 - RNA, 15 nt, Pseudomonas putida KT2440
cgggcgcaggcagca

SEQ ID NO: 1568355 - RNA, 20 nt, Pseudomonas putida KT2440
cgggcggagauuggccagca

SEQ ID NO: 1568356 - RNA, 18 nt, Pseudomonas putida KT2440
cgggcggaacuggcccug

SEQ ID NO: 1568357 - RNA, 21 nt, Pseudomonas putida KT2440
cgggcggaaugcucgucacca

SEQ ID NO: 1568358 - RNA, 24 nt, Pseudomonas putida KT2440
cgggcgcucgcgguucaucggcaa

SEQ ID NO: 1568359 - RNA, 14 nt, Pseudomonas putida KT2440
cgggcgcgauugcc

SEQ ID NO: 1568360 - RNA, 23 nt, Pseudomonas putida KT2440
cgggcgugccugcgaauggccgc

SEQ ID NO: 1568361 - RNA, 14 nt, Pseudomonas putida KT2440
cgggcgugcccgcg

SEQ ID NO: 1568362 - RNA, 23 nt, Pseudomonas putida KT2440
cgggcgugcccgcgaacaaggcu

SEQ ID NO: 1568363 - RNA, 18 nt, Pseudomonas putida KT2440
cgggcgugcccgcgaagg

SEQ ID NO: 1568364 - RNA, 19 nt, Pseudomonas putida KT2440
cgggcgggugcauggcucg

SEQ ID NO: 1568365 - RNA, 16 nt, Pseudomonas putida KT2440
cgggcggccaccggcc

SEQ ID NO: 1568366 - RNA, 19 nt, Pseudomonas putida KT2440
cgggccgucaccgcugccg

SEQ ID NO: 1568367 - RNA, 14 nt, Pseudomonas putida KT2440
cgggccaccaggcc

SEQ ID NO: 1568368 - RNA, 20 nt, Pseudomonas putida KT2440
cgggcccaggcauuuccaca

SEQ ID NO: 1568369 - RNA, 13 nt, Pseudomonas putida KT2440
cgggccaccaccg

SEQ ID NO: 1568370 - RNA, 19 nt, Pseudomonas putida KT2440
cgggccaccaccgcguaca

SEQ ID NO: 1568371 - RNA, 19 nt, Pseudomonas putida KT2440
cgggccaccaaaggccuug

SEQ ID NO: 1568372 - RNA, 21 nt, Pseudomonas putida KT2440
cgggcaugcaggucgaccugc

SEQ ID NO: 1568373 - RNA, 18 nt, Pseudomonas putida KT2440
cgggcaugcccgcgaagg

SEQ ID NO: 1568374 - RNA, 14 nt, Pseudomonas putida KT2440
cgggcaugcccgcu

SEQ ID NO: 1568375 - RNA, 14 nt, Pseudomonas putida KT2440
cgggcaggccaugc

SEQ ID NO: 1568376 - RNA, 21 nt, Pseudomonas putida KT2440
cgggcagcgggcucgcccaca

SEQ ID NO: 1568377 - RNA, 18 nt, Pseudomonas putida KT2440
cgggcacugcccggcguu

SEQ ID NO: 1568378 - RNA, 17 nt, Pseudomonas putida KT2440
cgggcacaggcccagca

SEQ ID NO: 1568379 - RNA, 22 nt, Pseudomonas putida KT2440
cgggcacaggccgcgcaugaug

SEQ ID NO: 1568380 - RNA, 16 nt, Pseudomonas putida KT2440
cgggcacaccuggugc

SEQ ID NO: 1568381 - RNA, 18 nt, Pseudomonas putida KT2440
cgggcacaccuggugcgc

SEQ ID NO: 1568382 - RNA, 20 nt, Pseudomonas putida KT2440
cgggcacaccuggugcgccu

SEQ ID NO: 1568383 - RNA, 17 nt, Pseudomonas putida KT2440
cgggaaguccgccagga

SEQ ID NO: 1568384 - RNA, 13 nt, Pseudomonas putida KT2440
cgggcaauggcca

SEQ ID NO: 1568385 - RNA, 21 nt, Pseudomonas putida KT2440
cggucaaggugguuucgccgu

SEQ ID NO: 1568386 - RNA, 21 nt, Pseudomonas putida KT2440
cgguagggaucaccgccagca

SEQ ID NO: 1568387 - RNA, 12 nt, Pseudomonas putida KT2440
cgguaguccugc

SEQ ID NO: 1568388 - RNA, 15 nt, Pseudomonas putida KT2440
cgguacgacgcacca

SEQ ID NO: 1568389 - RNA, 16 nt, Pseudomonas putida KT2440
cgguaccguucgccag

SEQ ID NO: 1568390 - RNA, 14 nt, Pseudomonas putida KT2440
cgguaccggccagc

SEQ ID NO: 1568391 - RNA, 22 nt, Pseudomonas putida KT2440
cggguugcucaggcgcuccagc

SEQ ID NO: 1568392 - RNA, 17 nt, Pseudomonas putida KT2440
cgggucuuuucuucgcc

SEQ ID NO: 1568393 - RNA, 20 nt, Pseudomonas putida KT2440
cgggugaacccgcuccuacg

SEQ ID NO: 1568394 - RNA, 19 nt, Pseudomonas putida KT2440
cgggugaaccgcgccuaca

SEQ ID NO: 1568395 - RNA, 18 nt, Pseudomonas putida KT2440
cgggugaccaggcccagc

SEQ ID NO: 1568396 - RNA, 20 nt, Pseudomonas putida KT2440
cggguucagguacagcagcu

SEQ ID NO: 1568397 - RNA, 22 nt, Pseudomonas putida KT2440
cggguucugcaggaugucgacg

SEQ ID NO: 1568398 - RNA, 15 nt, Pseudomonas putida KT2440
cgggcugcucccgca

SEQ ID NO: 1568399 - RNA, 18 nt, Pseudomonas putida KT2440
cgggcugcaaagcgggca

SEQ ID NO: 1568400 - RNA, 23 nt, Pseudomonas putida KT2440
cgggcugcaaagcgggcaacugc

SEQ ID NO: 1568401 - RNA, 12 nt, Pseudomonas putida KT2440
cgggcugcugcc

SEQ ID NO: 1568402 - RNA, 19 nt, Pseudomonas putida KT2440
cgggcugcugccgccccaa

SEQ ID NO: 1568403 - RNA, 14 nt, Pseudomonas putida KT2440
cgggcugcugcgca

SEQ ID NO: 1568404 - RNA, 22 nt, Pseudomonas putida KT2440
cgggguguugcuugucccaggc

SEQ ID NO: 1568405 - RNA, 19 nt, Pseudomonas putida KT2440
cggggcugcuuugcagccc

SEQ ID NO: 1568406 - RNA, 15 nt, Pseudomonas putida KT2440
cgggguagaccuucu

SEQ ID NO: 1568407 - RNA, 15 nt, Pseudomonas putida KT2440
cgggggugcacagcg

SEQ ID NO: 1568408 - RNA, 22 nt, Pseudomonas putida KT2440
cgggucgcugccgugcagguca

SEQ ID NO: 1568409 - RNA, 18 nt, Pseudomonas putida KT2440
cgggucggccugcucgcu

SEQ ID NO: 1568410 - RNA, 11 nt, Pseudomonas putida KT2440
cggguccaccc

SEQ ID NO: 1568411 - RNA, 18 nt, Pseudomonas putida KT2440
cggguccaccucugcggc

SEQ ID NO: 1568412 - RNA, 20 nt, Pseudomonas putida KT2440
cggguccaccucugcggccu

SEQ ID NO: 1568413 - RNA, 20 nt, Pseudomonas putida KT2440
cggguaaacccgcgccuacg

SEQ ID NO: 1568414 - RNA, 20 nt, Pseudomonas putida KT2440
cggguaaacccgcuccuacu

SEQ ID NO: 1568415 - RNA, 13 nt, Pseudomonas putida KT2440
cgggguuggugcc

SEQ ID NO: 1568416 - RNA, 18 nt, Pseudomonas putida KT2440
cggguaagccaugcgcag

SEQ ID NO: 1568417 - RNA, 20 nt, Pseudomonas putida KT2440
cggcgcucgaucucacaggc

SEQ ID NO: 1568418 - RNA, 21 nt, Pseudomonas putida KT2440
cggcgcguggggucugcccgg

SEQ ID NO: 1568419 - RNA, 21 nt, Pseudomonas putida KT2440
cggcgcgguucuucgccugca

SEQ ID NO: 1568420 - RNA, 23 nt, Pseudomonas putida KT2440
cggcgcgguucuucgccugcagc

SEQ ID NO: 1568421 - RNA, 15 nt, Pseudomonas putida KT2440
cggcgcaucgacggg

SEQ ID NO: 1568422 - RNA, 23 nt, Pseudomonas putida KT2440
cggcgccaggaucgagaccuugc

SEQ ID NO: 1568423 - RNA, 14 nt, Pseudomonas putida KT2440
cggcgccaggccuu

SEQ ID NO: 1568424 - RNA, 18 nt, Pseudomonas putida KT2440
cggcgcuggacagguaga

SEQ ID NO: 1568425 - RNA, 19 nt, Pseudomonas putida KT2440
cggcgcuggugcaggcguu

SEQ ID NO: 1568426 - RNA, 23 nt, Pseudomonas putida KT2440
cggcgcugagcgacagcaucugc

SEQ ID NO: 1568427 - RNA, 20 nt, Pseudomonas putida KT2440
cggcgcuugaucugccaggc

SEQ ID NO: 1568428 - RNA, 23 nt, Pseudomonas putida KT2440
cggcgcuugaucugccaggcacc

SEQ ID NO: 1568429 - RNA, 21 nt, Pseudomonas putida KT2440
cggcgcuuuucuucgcugcug

SEQ ID NO: 1568430 - RNA, 14 nt, Pseudomonas putida KT2440
cggcggccucgguc

SEQ ID NO: 1568431 - RNA, 18 nt, Pseudomonas putida KT2440
cggcggggcccggacagg

SEQ ID NO: 1568432 - RNA, 14 nt, Pseudomonas putida KT2440
cggcggccgagggu

SEQ ID NO: 1568433 - RNA, 14 nt, Pseudomonas putida KT2440
cggcggccagcacg

SEQ ID NO: 1568434 - RNA, 15 nt, Pseudomonas putida KT2440
cggcggcaacggugg

SEQ ID NO: 1568435 - RNA, 18 nt, Pseudomonas putida KT2440
cggcggauguuggccacg

SEQ ID NO: 1568436 - RNA, 23 nt, Pseudomonas putida KT2440
cggcggcauccaggcgggcgaag

SEQ ID NO: 1568437 - RNA, 21 nt, Pseudomonas putida KT2440
cggcgucgaacaacggcagcg

SEQ ID NO: 1568438 - RNA, 15 nt, Pseudomonas putida KT2440
cggcguugaccgagg

SEQ ID NO: 1568439 - RNA, 14 nt, Pseudomonas putida KT2440
cggcguguccagca

SEQ ID NO: 1568440 - RNA, 17 nt, Pseudomonas putida KT2440
cggcguguccagcaggu

SEQ ID NO: 1568441 - RNA, 19 nt, Pseudomonas putida KT2440
cggcgugagcaucggcguu

SEQ ID NO: 1568442 - RNA, 14 nt, Pseudomonas putida KT2440
cggcgugcaccacg

SEQ ID NO: 1568443 - RNA, 17 nt, Pseudomonas putida KT2440
cggcucaacagcaggug

SEQ ID NO: 1568444 - RNA, 22 nt, Pseudomonas putida KT2440
cggcuccaggcacaggcgcaca

SEQ ID NO: 1568445 - RNA, 18 nt, Pseudomonas putida KT2440
cggcuccaccugcuccag

SEQ ID NO: 1568446 - RNA, 22 nt, Pseudomonas putida KT2440
cggcuccaccgaaaucagcaac

SEQ ID NO: 1568447 - RNA, 22 nt, Pseudomonas putida KT2440
cggcguuuucguuuacacggua

SEQ ID NO: 1568448 - RNA, 14 nt, Pseudomonas putida KT2440
cggcuagcgccuga

SEQ ID NO: 1568449 - RNA, 16 nt, Pseudomonas putida KT2440
cggcuagcgccugaca

SEQ ID NO: 1568450 - RNA, 14 nt, Pseudomonas putida KT2440
cggcguuugcgagc

SEQ ID NO: 1568451 - RNA, 22 nt, Pseudomonas putida KT2440
cggcguuugcgagcgcgggcag

SEQ ID NO: 1568452 - RNA, 15 nt, Pseudomonas putida KT2440
cggcguuggcuucca

SEQ ID NO: 1568453 - RNA, 16 nt, Pseudomonas putida KT2440
cgggaaaagccugcca

SEQ ID NO: 1568454 - RNA, 23 nt, Pseudomonas putida KT2440
cgggaaaagccugccagguccga

SEQ ID NO: 1568455 - RNA, 23 nt, Pseudomonas putida KT2440
cggcuuguucuguuucaccagca

SEQ ID NO: 1568456 - RNA, 17 nt, Pseudomonas putida KT2440
cggcuucagguucacuu

SEQ ID NO: 1568457 - RNA, 19 nt, Pseudomonas putida KT2440
cggcuuccagcgauggcgg

SEQ ID NO: 1568458 - RNA, 14 nt, Pseudomonas putida KT2440
cggcuuccagggcu

SEQ ID NO: 1568459 - RNA, 19 nt, Pseudomonas putida KT2440
cggcugggccccaggcggu

SEQ ID NO: 1568460 - RNA, 12 nt, Pseudomonas putida KT2440
cggcuggcuucg

SEQ ID NO: 1568461 - RNA, 18 nt, Pseudomonas putida KT2440
cggcuggugucggccagg

SEQ ID NO: 1568462 - RNA, 17 nt, Pseudomonas putida KT2440
cggcuguccagcaaggg

SEQ ID NO: 1568463 - RNA, 16 nt, Pseudomonas putida KT2440
cggcuguucgcagcac

SEQ ID NO: 1568464 - RNA, 15 nt, Pseudomonas putida KT2440
cggcucccggcuacg

SEQ ID NO: 1568465 - RNA, 18 nt, Pseudomonas putida KT2440
cggcucuucuuucaggua

SEQ ID NO: 1568466 - RNA, 14 nt, Pseudomonas putida KT2440
cggcucugccggug

SEQ ID NO: 1568467 - RNA, 16 nt, Pseudomonas putida KT2440
cggcugaacuuccagg

SEQ ID NO: 1568468 - RNA, 13 nt, Pseudomonas putida KT2440
cggcugaaaccgc

SEQ ID NO: 1568469 - RNA, 19 nt, Pseudomonas putida KT2440
cggcugaaaccgcgaaucg

SEQ ID NO: 1568470 - RNA, 15 nt, Pseudomonas putida KT2440
cggcugaagaagcua

SEQ ID NO: 1568471 - RNA, 21 nt, Pseudomonas putida KT2440
cggcugcgccgguguucgcgg

SEQ ID NO: 1568472 - RNA, 15 nt, Pseudomonas putida KT2440
cggcuggcagcuugc

SEQ ID NO: 1568473 - RNA, 14 nt, Pseudomonas putida KT2440
cggcugcucgauca

SEQ ID NO: 1568474 - RNA, 20 nt, Pseudomonas putida KT2440
cggcugcucgaucagguuga

SEQ ID NO: 1568475 - RNA, 15 nt, Pseudomonas putida KT2440
cggacccagcgguca

SEQ ID NO: 1568476 - RNA, 23 nt, Pseudomonas putida KT2440
cggacccuugugugggccuugcu

SEQ ID NO: 1568477 - RNA, 11 nt, Pseudomonas putida KT2440
cggaccgcaua

SEQ ID NO: 1568478 - RNA, 19 nt, Pseudomonas putida KT2440
cggacgacgcgaaugauga

SEQ ID NO: 1568479 - RNA, 15 nt, Pseudomonas putida KT2440
cggaccagcgccgca

SEQ ID NO: 1568480 - RNA, 19 nt, Pseudomonas putida KT2440
cggaccagcgccgcaucgc

SEQ ID NO: 1568481 - RNA, 16 nt, Pseudomonas putida KT2440
cggaccaccugggcca

SEQ ID NO: 1568482 - RNA, 20 nt, Pseudomonas putida KT2440
cggaccaccugggccaguac

SEQ ID NO: 1568483 - RNA, 13 nt, Pseudomonas putida KT2440
cgcuggugcaggc

SEQ ID NO: 1568484 - RNA, 14 nt, Pseudomonas putida KT2440
cgcuggugcagugg

SEQ ID NO: 1568485 - RNA, 20 nt, Pseudomonas putida KT2440
cgcugguucauugccaacag

SEQ ID NO: 1568486 - RNA, 14 nt, Pseudomonas putida KT2440
cgcuguacaccagg

SEQ ID NO: 1568487 - RNA, 17 nt, Pseudomonas putida KT2440
cggaggcuucgaugauc

SEQ ID NO: 1568488 - RNA, 13 nt, Pseudomonas putida KT2440
cggagcugguggu

SEQ ID NO: 1568489 - RNA, 17 nt, Pseudomonas putida KT2440
cggaucgugacggucug

SEQ ID NO: 1568490 - RNA, 19 nt, Pseudomonas putida KT2440
cggaucgugacggucugcc

SEQ ID NO: 1568491 - RNA, 19 nt, Pseudomonas putida KT2440
cggaucagcgcguccagca

SEQ ID NO: 1568492 - RNA, 13 nt, Pseudomonas putida KT2440
cggaucgauguac

SEQ ID NO: 1568493 - RNA, 18 nt, Pseudomonas putida KT2440
cggacggguuucgccgua

SEQ ID NO: 1568494 - RNA, 17 nt, Pseudomonas putida KT2440
cggagcgacuucgacca

SEQ ID NO: 1568495 - RNA, 16 nt, Pseudomonas putida KT2440
cggagauuggccagca

SEQ ID NO: 1568496 - RNA, 17 nt, Pseudomonas putida KT2440
cggcaagccacgccaga

SEQ ID NO: 1568497 - RNA, 22 nt, Pseudomonas putida KT2440
cggcaagcccauggcuggcagc

SEQ ID NO: 1568498 - RNA, 21 nt, Pseudomonas putida KT2440
cggcaaggcguaccggcaacc

SEQ ID NO: 1568499 - RNA, 14 nt, Pseudomonas putida KT2440
cggcaagcugguca

SEQ ID NO: 1568500 - RNA, 14 nt, Pseudomonas putida KT2440
cggcaacuccucca

SEQ ID NO: 1568501 - RNA, 14 nt, Pseudomonas putida KT2440
cggaugcgcaagca

SEQ ID NO: 1568502 - RNA, 17 nt, Pseudomonas putida KT2440
cggcaccaucuucgaca

SEQ ID NO: 1568503 - RNA, 11 nt, Pseudomonas putida KT2440
cggcaccaucu

SEQ ID NO: 1568504 - RNA, 17 nt, Pseudomonas putida KT2440
cggcacccaauagccca

SEQ ID NO: 1568505 - RNA, 18 nt, Pseudomonas putida KT2440
cggcaauggcccgcucca

SEQ ID NO: 1568506 - RNA, 21 nt, Pseudomonas putida KT2440
cggcaaugcgcgcgaaggccc

SEQ ID NO: 1568507 - RNA, 17 nt, Pseudomonas putida KT2440
cggcaaucugcagcagc

SEQ ID NO: 1568508 - RNA, 16 nt, Pseudomonas putida KT2440
cggcaaucugcccaca

SEQ ID NO: 1568509 - RNA, 24 nt, Pseudomonas putida KT2440
cggcaaucaggcugaucaccgccg

SEQ ID NO: 1568510 - RNA, 22 nt, Pseudomonas putida KT2440
cggcaauacaacgaucagcgcc

SEQ ID NO: 1568511 - RNA, 14 nt, Pseudomonas putida KT2440
cggcaauaccggcc

SEQ ID NO: 1568512 - RNA, 15 nt, Pseudomonas putida KT2440
cggcaauccgcugga

SEQ ID NO: 1568513 - RNA, 14 nt, Pseudomonas putida KT2440
cggcaaucgccagg

SEQ ID NO: 1568514 - RNA, 18 nt, Pseudomonas putida KT2440
cggcaaucgccgggcgca

SEQ ID NO: 1568515 - RNA, 13 nt, Pseudomonas putida KT2440
cggcaaucgccag

SEQ ID NO: 1568516 - RNA, 15 nt, Pseudomonas putida KT2440
cggcacucgaagcac

SEQ ID NO: 1568517 - RNA, 16 nt, Pseudomonas putida KT2440
cggcacuccagcgagu

SEQ ID NO: 1568518 - RNA, 17 nt, Pseudomonas putida KT2440
cggcagcacgucggcgc

SEQ ID NO: 1568519 - RNA, 17 nt, Pseudomonas putida KT2440
cggcagcaccugccagc

SEQ ID NO: 1568520 - RNA, 14 nt, Pseudomonas putida KT2440
cggcacugcacgcu

SEQ ID NO: 1568521 - RNA, 14 nt, Pseudomonas putida KT2440
cggcagcaggccaa

SEQ ID NO: 1568522 - RNA, 19 nt, Pseudomonas putida KT2440
cggcaccuuugcaggugcc

SEQ ID NO: 1568523 - RNA, 20 nt, Pseudomonas putida KT2440
cggcaccuuugcaggugccg

SEQ ID NO: 1568524 - RNA, 16 nt, Pseudomonas putida KT2440
cggcacgagcaugccg

SEQ ID NO: 1568525 - RNA, 19 nt, Pseudomonas putida KT2440
cggcacggcgugcuccaca

SEQ ID NO: 1568526 - RNA, 16 nt, Pseudomonas putida KT2440
cggcacguuggugccg

SEQ ID NO: 1568527 - RNA, 19 nt, Pseudomonas putida KT2440
cggcacguuggugccgguc

SEQ ID NO: 1568528 - RNA, 22 nt, Pseudomonas putida KT2440
cggcacguuggugccggucggc

SEQ ID NO: 1568529 - RNA, 18 nt, Pseudomonas putida KT2440
cggcaguggccgaguugg

SEQ ID NO: 1568530 - RNA, 22 nt, Pseudomonas putida KT2440
cggcaguugcaggcgcagggug

SEQ ID NO: 1568531 - RNA, 14 nt, Pseudomonas putida KT2440
cggcaguugccugc

SEQ ID NO: 1568532 - RNA, 15 nt, Pseudomonas putida KT2440
cggcauaacggcugg

SEQ ID NO: 1568533 - RNA, 19 nt, Pseudomonas putida KT2440
cggcauaacggcuggcgca

SEQ ID NO: 1568534 - RNA, 16 nt, Pseudomonas putida KT2440
cggcaggucgaugauc

SEQ ID NO: 1568535 - RNA, 15 nt, Pseudomonas putida KT2440
cggcagguaggccca

SEQ ID NO: 1568536 - RNA, 20 nt, Pseudomonas putida KT2440
cggcagcucgcgcugcgcag

SEQ ID NO: 1568537 - RNA, 17 nt, Pseudomonas putida KT2440
cggcagcucgagcaugc

SEQ ID NO: 1568538 - RNA, 24 nt, Pseudomonas putida KT2440
cggcagcucaaccgacaccagacg

SEQ ID NO: 1568539 - RNA, 22 nt, Pseudomonas putida KT2440
cggcauugggcggggugaucga

SEQ ID NO: 1568540 - RNA, 12 nt, Pseudomonas putida KT2440
cggcaugcgccg

SEQ ID NO: 1568541 - RNA, 14 nt, Pseudomonas putida KT2440
cggcaugcgcguau

SEQ ID NO: 1568542 - RNA, 23 nt, Pseudomonas putida KT2440
cggcaucaugauggucacgcggc

SEQ ID NO: 1568543 - RNA, 19 nt, Pseudomonas putida KT2440
cggcauccccgccagugac

SEQ ID NO: 1568544 - RNA, 14 nt, Pseudomonas putida KT2440
cggcauccgccuca

SEQ ID NO: 1568545 - RNA, 14 nt, Pseudomonas putida KT2440
cggcaugcagcggc

SEQ ID NO: 1568546 - RNA, 16 nt, Pseudomonas putida KT2440
cggcaucgacgaugcc

SEQ ID NO: 1568547 - RNA, 21 nt, Pseudomonas putida KT2440
cggcaucgacgaugccguaca

SEQ ID NO: 1568548 - RNA, 16 nt, Pseudomonas putida KT2440
cggccaccugccccag

SEQ ID NO: 1568549 - RNA, 18 nt, Pseudomonas putida KT2440
cggccaccugccccagcg

SEQ ID NO: 1568550 - RNA, 14 nt, Pseudomonas putida KT2440
cggccacccggacc

SEQ ID NO: 1568551 - RNA, 19 nt, Pseudomonas putida KT2440
cggccaccauguacugcag

SEQ ID NO: 1568552 - RNA, 17 nt, Pseudomonas putida KT2440
cggccaacgcugcucgg

SEQ ID NO: 1568553 - RNA, 22 nt, Pseudomonas putida KT2440
cggccaacgacaggucggcgau

SEQ ID NO: 1568554 - RNA, 17 nt, Pseudomonas putida KT2440
cggccaacaacgacugg

SEQ ID NO: 1568555 - RNA, 20 nt, Pseudomonas putida KT2440
cggccaaagcuguugaaggc

SEQ ID NO: 1568556 - RNA, 20 nt, Pseudomonas putida KT2440
cggccgccuccugcugcugc

SEQ ID NO: 1568557 - RNA, 19 nt, Pseudomonas putida KT2440
cggccgccaggauggcacc

SEQ ID NO: 1568558 - RNA, 16 nt, Pseudomonas putida KT2440
cggccgcuucgcggau

SEQ ID NO: 1568559 - RNA, 21 nt, Pseudomonas putida KT2440
cggccgcuucgcggaucaacc

SEQ ID NO: 1568560 - RNA, 21 nt, Pseudomonas putida KT2440
cggccgcuccagcucggcugg

SEQ ID NO: 1568561 - RNA, 20 nt, Pseudomonas putida KT2440
cggccgcucaccggccagcg

SEQ ID NO: 1568562 - RNA, 14 nt, Pseudomonas putida KT2440
cggcccuuucgcgg

SEQ ID NO: 1568563 - RNA, 16 nt, Pseudomonas putida KT2440
cggcccuuucgcgggu

SEQ ID NO: 1568564 - RNA, 20 nt, Pseudomonas putida KT2440
cggcccuuucgcggguaaac

SEQ ID NO: 1568565 - RNA, 20 nt, Pseudomonas putida KT2440
cggccgaagugauggccugg

SEQ ID NO: 1568566 - RNA, 20 nt, Pseudomonas putida KT2440
cggccgacucuucaccagcu

SEQ ID NO: 1568567 - RNA, 21 nt, Pseudomonas putida KT2440
cggcccuguguaggagcgggu

SEQ ID NO: 1568568 - RNA, 13 nt, Pseudomonas putida KT2440
cggcccugccggc

SEQ ID NO: 1568569 - RNA, 15 nt, Pseudomonas putida KT2440
cggcccugaucgguu

SEQ ID NO: 1568570 - RNA, 16 nt, Pseudomonas putida KT2440
cggcccggcuggccac

SEQ ID NO: 1568571 - RNA, 21 nt, Pseudomonas putida KT2440
cggccccuuccgaccggucau

SEQ ID NO: 1568572 - RNA, 14 nt, Pseudomonas putida KT2440
cggccccuggaacc

SEQ ID NO: 1568573 - RNA, 16 nt, Pseudomonas putida KT2440
cggcccaugucgauca

SEQ ID NO: 1568574 - RNA, 21 nt, Pseudomonas putida KT2440
cggcccaugucgaucagcggc

SEQ ID NO: 1568575 - RNA, 23 nt, Pseudomonas putida KT2440
cggcccaucccgcuucgccagcg

SEQ ID NO: 1568576 - RNA, 15 nt, Pseudomonas putida KT2440
cggcccauuccgggu

SEQ ID NO: 1568577 - RNA, 14 nt, Pseudomonas putida KT2440
cggcccauucgcgg

SEQ ID NO: 1568578 - RNA, 15 nt, Pseudomonas putida KT2440
cggcccauucgcggg

SEQ ID NO: 1568579 - RNA, 17 nt, Pseudomonas putida KT2440
cggcccauucgcgggug

SEQ ID NO: 1568580 - RNA, 11 nt, Pseudomonas putida KT2440
cggcccggcau

SEQ ID NO: 1568581 - RNA, 22 nt, Pseudomonas putida KT2440
cggccaguaaggaucgcgcagc

SEQ ID NO: 1568582 - RNA, 22 nt, Pseudomonas putida KT2440
cggccaguaccaggucgccagc

SEQ ID NO: 1568583 - RNA, 23 nt, Pseudomonas putida KT2440
cggccaguaccaggucgccagca

SEQ ID NO: 1568584 - RNA, 17 nt, Pseudomonas putida KT2440
cggccagugaagcucga

SEQ ID NO: 1568585 - RNA, 21 nt, Pseudomonas putida KT2440
cggccaccuggccuuccagcu

SEQ ID NO: 1568586 - RNA, 15 nt, Pseudomonas putida KT2440
cggccaccuggucga

SEQ ID NO: 1568587 - RNA, 15 nt, Pseudomonas putida KT2440
cggccaguuguccgg

SEQ ID NO: 1568588 - RNA, 16 nt, Pseudomonas putida KT2440
cggccaguugccccag

SEQ ID NO: 1568589 - RNA, 18 nt, Pseudomonas putida KT2440
cggccaguugccccaggc

SEQ ID NO: 1568590 - RNA, 15 nt, Pseudomonas putida KT2440
cggccguggguccug

SEQ ID NO: 1568591 - RNA, 14 nt, Pseudomonas putida KT2440
cggccggcucgcca

SEQ ID NO: 1568592 - RNA, 13 nt, Pseudomonas putida KT2440
cggccugcagcuu

SEQ ID NO: 1568593 - RNA, 22 nt, Pseudomonas putida KT2440
cggccugcagcuuuugcgcagc

SEQ ID NO: 1568594 - RNA, 20 nt, Pseudomonas putida KT2440
cggccugcccgguacgcaga

SEQ ID NO: 1568595 - RNA, 14 nt, Pseudomonas putida KT2440
cggccugcacuacc

SEQ ID NO: 1568596 - RNA, 18 nt, Pseudomonas putida KT2440
cggccugaugccucauca

SEQ ID NO: 1568597 - RNA, 20 nt, Pseudomonas putida KT2440
cggccugaugccucaucagg

SEQ ID NO: 1568598 - RNA, 21 nt, Pseudomonas putida KT2440
cggccugaugccucaucaggc

SEQ ID NO: 1568599 - RNA, 14 nt, Pseudomonas putida KT2440
cggccucuucgcgg

SEQ ID NO: 1568600 - RNA, 17 nt, Pseudomonas putida KT2440
cggccucuucgcgggca

SEQ ID NO: 1568601 - RNA, 16 nt, Pseudomonas putida KT2440
cggccucuucgcgggu

SEQ ID NO: 1568602 - RNA, 18 nt, Pseudomonas putida KT2440
cggccucuucgcggguaa

SEQ ID NO: 1568603 - RNA, 18 nt, Pseudomonas putida KT2440
cggccucgauagcagcgc

SEQ ID NO: 1568604 - RNA, 15 nt, Pseudomonas putida KT2440
cggccuccucgauga

SEQ ID NO: 1568605 - RNA, 16 nt, Pseudomonas putida KT2440
cggccuccucgcgggc

SEQ ID NO: 1568606 - RNA, 14 nt, Pseudomonas putida KT2440
cggcgaagacggca

SEQ ID NO: 1568607 - RNA, 21 nt, Pseudomonas putida KT2440
cggcgaaugcugcagauugca

SEQ ID NO: 1568608 - RNA, 14 nt, Pseudomonas putida KT2440
cggcgaaaagccgg

SEQ ID NO: 1568609 - RNA, 20 nt, Pseudomonas putida KT2440
cggccuuuucauccggcgca

SEQ ID NO: 1568610 - RNA, 15 nt, Pseudomonas putida KT2440
cggccuuuucgcgcu

SEQ ID NO: 1568611 - RNA, 22 nt, Pseudomonas putida KT2440
cggccuuucugcuucgcugcca

SEQ ID NO: 1568612 - RNA, 19 nt, Pseudomonas putida KT2440
cggccuuggccgcuggccc

SEQ ID NO: 1568613 - RNA, 15 nt, Pseudomonas putida KT2440
cggccuggcgcaggu

SEQ ID NO: 1568614 - RNA, 20 nt, Pseudomonas putida KT2440
cggcgaggugauugaaggca

SEQ ID NO: 1568615 - RNA, 23 nt, Pseudomonas putida KT2440
cggcgaugugguuuuccuugauc

SEQ ID NO: 1568616 - RNA, 16 nt, Pseudomonas putida KT2440
cggcgcacccggcugg

SEQ ID NO: 1568617 - RNA, 15 nt, Pseudomonas putida KT2440
cggcgcacgcaugcg

SEQ ID NO: 1568618 - RNA, 17 nt, Pseudomonas putida KT2440
cggcgcacgcaugcgcg

SEQ ID NO: 1568619 - RNA, 15 nt, Pseudomonas putida KT2440
cggcgcaccgcuugc

SEQ ID NO: 1568620 - RNA, 16 nt, Pseudomonas putida KT2440
cggcgcacucucguca

SEQ ID NO: 1568621 - RNA, 19 nt, Pseudomonas putida KT2440
cggcgcacucucgucaccu

SEQ ID NO: 1568622 - RNA, 15 nt, Pseudomonas putida KT2440
cggcgcaggccgaca

SEQ ID NO: 1568623 - RNA, 19 nt, Pseudomonas putida KT2440
cggcgcagggugucggugg

SEQ ID NO: 1568624 - RNA, 18 nt, Pseudomonas putida KT2440
cggcgauacucaccgccg

SEQ ID NO: 1568625 - RNA, 22 nt, Pseudomonas putida KT2440
cggcgauacuuggccaucagcu

SEQ ID NO: 1568626 - RNA, 16 nt, Pseudomonas putida KT2440
cggcgauauggcucca

SEQ ID NO: 1568627 - RNA, 19 nt, Pseudomonas putida KT2440
cggcgauauggcuccacca

SEQ ID NO: 1568628 - RNA, 16 nt, Pseudomonas putida KT2440
cggcgauggucaaccg

SEQ ID NO: 1568629 - RNA, 23 nt, Pseudomonas putida KT2440
cggcgaugcgccccccaggcggu

SEQ ID NO: 1568630 - RNA, 15 nt, Pseudomonas putida KT2440
cgccggcgccgugcu

SEQ ID NO: 1568631 - RNA, 20 nt, Pseudomonas putida KT2440
cgccggcgucggcgcgcaac

SEQ ID NO: 1568632 - RNA, 14 nt, Pseudomonas putida KT2440
cgccggguccacca

SEQ ID NO: 1568633 - RNA, 13 nt, Pseudomonas putida KT2440
cgccgccgucggg

SEQ ID NO: 1568634 - RNA, 20 nt, Pseudomonas putida KT2440
cgccgcuucgcggccaagcc

SEQ ID NO: 1568635 - RNA, 23 nt, Pseudomonas putida KT2440
cgccgcuucagccuuuuccagcu

SEQ ID NO: 1568636 - RNA, 20 nt, Pseudomonas putida KT2440
cgccgcugaccacgccgaag

SEQ ID NO: 1568637 - RNA, 16 nt, Pseudomonas putida KT2440
cgccgcucugcccgcg

SEQ ID NO: 1568638 - RNA, 14 nt, Pseudomonas putida KT2440
cgccgcugccagca

SEQ ID NO: 1568639 - RNA, 13 nt, Pseudomonas putida KT2440
cgccggccaaggu

SEQ ID NO: 1568640 - RNA, 19 nt, Pseudomonas putida KT2440
cgccggccaaguggccuug

SEQ ID NO: 1568641 - RNA, 14 nt, Pseudomonas putida KT2440
cgccguggugccgg

SEQ ID NO: 1568642 - RNA, 21 nt, Pseudomonas putida KT2440
cgccgguguucuucaggcaaa

SEQ ID NO: 1568643 - RNA, 15 nt, Pseudomonas putida KT2440
cgccgguguaccauc

SEQ ID NO: 1568644 - RNA, 16 nt, Pseudomonas putida KT2440
cgccucggcacugcac

SEQ ID NO: 1568645 - RNA, 19 nt, Pseudomonas putida KT2440
cgccucccccuccacuguc

SEQ ID NO: 1568646 - RNA, 14 nt, Pseudomonas putida KT2440
cgccuccagcagcg

SEQ ID NO: 1568647 - RNA, 23 nt, Pseudomonas putida KT2440
cgccuccagcagcgacaccagcg

SEQ ID NO: 1568648 - RNA, 20 nt, Pseudomonas putida KT2440
cgccguuguucacggucagg

SEQ ID NO: 1568649 - RNA, 17 nt, Pseudomonas putida KT2440
cgccugcaggcccaggu

SEQ ID NO: 1568650 - RNA, 23 nt, Pseudomonas putida KT2440
cgccugcagcgcgucauccgcca

SEQ ID NO: 1568651 - RNA, 18 nt, Pseudomonas putida KT2440
cgccugcaagucaggcga

SEQ ID NO: 1568652 - RNA, 14 nt, Pseudomonas putida KT2440
cgccugcaccuggc

SEQ ID NO: 1568653 - RNA, 23 nt, Pseudomonas putida KT2440
cgccugcauggcaugcaggaggu

SEQ ID NO: 1568654 - RNA, 18 nt, Pseudomonas putida KT2440
cgccugcaguucgcugcg

SEQ ID NO: 1568655 - RNA, 14 nt, Pseudomonas putida KT2440
cgccugcgccagcg

SEQ ID NO: 1568656 - RNA, 14 nt, Pseudomonas putida KT2440
cgccucgucggcgc

SEQ ID NO: 1568657 - RNA, 22 nt, Pseudomonas putida KT2440
cgccuguuucggguaggucacc

SEQ ID NO: 1568658 - RNA, 22 nt, Pseudomonas putida KT2440
cgccuguuucucacguucgcca

SEQ ID NO: 1568659 - RNA, 13 nt, Pseudomonas putida KT2440
cgccuguaccuca

SEQ ID NO: 1568660 - RNA, 21 nt, Pseudomonas putida KT2440
cgccugugagaucgagcgccg

SEQ ID NO: 1568661 - RNA, 23 nt, Pseudomonas putida KT2440
cgccuguccgggcucgucacggg

SEQ ID NO: 1568662 - RNA, 20 nt, Pseudomonas putida KT2440
cgccuggacgguauaggccc

SEQ ID NO: 1568663 - RNA, 22 nt, Pseudomonas putida KT2440
cgccuggacgguauaggccccg

SEQ ID NO: 1568664 - RNA, 24 nt, Pseudomonas putida KT2440
cgccuggcgagaaggcguggugca

SEQ ID NO: 1568665 - RNA, 19 nt, Pseudomonas putida KT2440
cgccuggugccagcggcca

SEQ ID NO: 1568666 - RNA, 20 nt, Pseudomonas putida KT2440
cgccuggugccagcggccac

SEQ ID NO: 1568667 - RNA, 15 nt, Pseudomonas putida KT2440
cgccugggggucgcc

SEQ ID NO: 1568668 - RNA, 15 nt, Pseudomonas putida KT2440
cgccuggcgccugcg

SEQ ID NO: 1568669 - RNA, 14 nt, Pseudomonas putida KT2440
cgccuucuccagcu

SEQ ID NO: 1568670 - RNA, 19 nt, Pseudomonas putida KT2440
cgccuugcgucggccgaug

SEQ ID NO: 1568671 - RNA, 23 nt, Pseudomonas putida KT2440
cgccuugagguugccguuggcgu

SEQ ID NO: 1568672 - RNA, 20 nt, Pseudomonas putida KT2440
cgccuugaggaccuugcggg

SEQ ID NO: 1568673 - RNA, 14 nt, Pseudomonas putida KT2440
cgccuugaucguca

SEQ ID NO: 1568674 - RNA, 14 nt, Pseudomonas putida KT2440
cgcgaacaccggca

SEQ ID NO: 1568675 - RNA, 14 nt, Pseudomonas putida KT2440
cgcgaacaggcccu

SEQ ID NO: 1568676 - RNA, 14 nt, Pseudomonas putida KT2440
cgcgaagcaggcug

SEQ ID NO: 1568677 - RNA, 15 nt, Pseudomonas putida KT2440
cgcgaagaggccagg

SEQ ID NO: 1568678 - RNA, 13 nt, Pseudomonas putida KT2440
cgcgaagaggccg

SEQ ID NO: 1568679 - RNA, 23 nt, Pseudomonas putida KT2440
cgcgaagaggccggccccggcaa

SEQ ID NO: 1568680 - RNA, 22 nt, Pseudomonas putida KT2440
cgcgaagaggccgguacugccc

SEQ ID NO: 1568681 - RNA, 16 nt, Pseudomonas putida KT2440
cgcgaagcggccaacc

SEQ ID NO: 1568682 - RNA, 16 nt, Pseudomonas putida KT2440
cgcgaaggcuccagca

SEQ ID NO: 1568683 - RNA, 18 nt, Pseudomonas putida KT2440
cgcgaagggccgcaacgc

SEQ ID NO: 1568684 - RNA, 15 nt, Pseudomonas putida KT2440
cgcgaagggcugccg

SEQ ID NO: 1568685 - RNA, 22 nt, Pseudomonas putida KT2440
cgcgaauguucucggucacgac

SEQ ID NO: 1568686 - RNA, 19 nt, Pseudomonas putida KT2440
cgcgacaccugcuucgcgg

SEQ ID NO: 1568687 - RNA, 16 nt, Pseudomonas putida KT2440
cgcgaccacaggcgcu

SEQ ID NO: 1568688 - RNA, 22 nt, Pseudomonas putida KT2440
cgccgcccuuggugcaccagcu

SEQ ID NO: 1568689 - RNA, 19 nt, Pseudomonas putida KT2440
cgccgccgaggcaccggua

SEQ ID NO: 1568690 - RNA, 15 nt, Pseudomonas putida KT2440
cgccgccgcugacca

SEQ ID NO: 1568691 - RNA, 23 nt, Pseudomonas putida KT2440
cgccgccgcugaccacgccgaag

SEQ ID NO: 1568692 - RNA, 20 nt, Pseudomonas putida KT2440
cgccgcagcaguuggccgac

SEQ ID NO: 1568693 - RNA, 16 nt, Pseudomonas putida KT2440
cgccgccagcgcucca

SEQ ID NO: 1568694 - RNA, 17 nt, Pseudomonas putida KT2440
cgccgccaggcggucgc

SEQ ID NO: 1568695 - RNA, 13 nt, Pseudomonas putida KT2440
cgccgccagggca

SEQ ID NO: 1568696 - RNA, 14 nt, Pseudomonas putida KT2440
cgccgcccaguggc

SEQ ID NO: 1568697 - RNA, 14 nt, Pseudomonas putida KT2440
cgccgcccagguca

SEQ ID NO: 1568698 - RNA, 16 nt, Pseudomonas putida KT2440
cgccgcccagcucuuu

SEQ ID NO: 1568699 - RNA, 15 nt, Pseudomonas putida KT2440
cgccgauugcugccg

SEQ ID NO: 1568700 - RNA, 16 nt, Pseudomonas putida KT2440
cgccgauugcugccga

SEQ ID NO: 1568701 - RNA, 20 nt, Pseudomonas putida KT2440
cgccgcaaagacugccaagu

SEQ ID NO: 1568702 - RNA, 13 nt, Pseudomonas putida KT2440
cgccgcaacggcc

SEQ ID NO: 1568703 - RNA, 16 nt, Pseudomonas putida KT2440
cgccgcaacggccgaa

SEQ ID NO: 1568704 - RNA, 18 nt, Pseudomonas putida KT2440
cgccgcaccgucgauguc

SEQ ID NO: 1568705 - RNA, 22 nt, Pseudomonas putida KT2440
cgccgauguccuugcuggccac

SEQ ID NO: 1568706 - RNA, 20 nt, Pseudomonas putida KT2440
cgccgaugaguugucugccg

SEQ ID NO: 1568707 - RNA, 21 nt, Pseudomonas putida KT2440
cgccgaugaguugucugccga

SEQ ID NO: 1568708 - RNA, 23 nt, Pseudomonas putida KT2440
cgccgaugaguugucugccgaag

SEQ ID NO: 1568709 - RNA, 17 nt, Pseudomonas putida KT2440
cgcccuugucagccgcc

SEQ ID NO: 1568710 - RNA, 14 nt, Pseudomonas putida KT2440
cgcccuuucacggc

SEQ ID NO: 1568711 - RNA, 16 nt, Pseudomonas putida KT2440
cgcccuuugguacugc

SEQ ID NO: 1568712 - RNA, 21 nt, Pseudomonas putida KT2440
cgcccuuugguacugcgccgg

SEQ ID NO: 1568713 - RNA, 15 nt, Pseudomonas putida KT2440
cgcccuuuuucacca

SEQ ID NO: 1568714 - RNA, 18 nt, Pseudomonas putida KT2440
cgcccuuuuucaccaggc

SEQ ID NO: 1568715 - RNA, 15 nt, Pseudomonas putida KT2440
cgccgaaacguaguc

SEQ ID NO: 1568716 - RNA, 22 nt, Pseudomonas putida KT2440
cgccgaaauuaccuuacugcag

SEQ ID NO: 1568717 - RNA, 14 nt, Pseudomonas putida KT2440
cgcccugcccucga

SEQ ID NO: 1568718 - RNA, 21 nt, Pseudomonas putida KT2440
cgcccggcgucgaacaacggc

SEQ ID NO: 1568719 - RNA, 18 nt, Pseudomonas putida KT2440
cgcccgggucaggucgcu

SEQ ID NO: 1568720 - RNA, 15 nt, Pseudomonas putida KT2440
cgcccuggcaugcug

SEQ ID NO: 1568721 - RNA, 14 nt, Pseudomonas putida KT2440
cgcccugcugccgc

SEQ ID NO: 1568722 - RNA, 16 nt, Pseudomonas putida KT2440
cgcccugcugccgcac

SEQ ID NO: 1568723 - RNA, 21 nt, Pseudomonas putida KT2440
cgcccuugagcuucagcgcgc

SEQ ID NO: 1568724 - RNA, 11 nt, Pseudomonas putida KT2440
cgcccuugccc

SEQ ID NO: 1568725 - RNA, 17 nt, Pseudomonas putida KT2440
cgccgacgaugcccgau

SEQ ID NO: 1568726 - RNA, 18 nt, Pseudomonas putida KT2440
cgccgacggcauggccga

SEQ ID NO: 1568727 - RNA, 16 nt, Pseudomonas putida KT2440
cgccgaccgcgcgcac

SEQ ID NO: 1568728 - RNA, 19 nt, Pseudomonas putida KT2440
cgccgacccugugggagcg

SEQ ID NO: 1568729 - RNA, 19 nt, Pseudomonas putida KT2440
cgccgaccgaaccggcgcu

SEQ ID NO: 1568730 - RNA, 19 nt, Pseudomonas putida KT2440
cgccgaggaauugcgccag

SEQ ID NO: 1568731 - RNA, 16 nt, Pseudomonas putida KT2440
cgccgaggcaccggua

SEQ ID NO: 1568732 - RNA, 17 nt, Pseudomonas putida KT2440
cgccgaucacaccggca

SEQ ID NO: 1568733 - RNA, 19 nt, Pseudomonas putida KT2440
cgccgagcauccgcgccac

SEQ ID NO: 1568734 - RNA, 22 nt, Pseudomonas putida KT2440
cgccgagcauccgcgccacuuc

SEQ ID NO: 1568735 - RNA, 19 nt, Pseudomonas putida KT2440
cgccgagcauuacaggcag

SEQ ID NO: 1568736 - RNA, 22 nt, Pseudomonas putida KT2440
cgccauuggccgcgcgcccauc

SEQ ID NO: 1568737 - RNA, 24 nt, Pseudomonas putida KT2440
cgcccaacccagccagcgacagca

SEQ ID NO: 1568738 - RNA, 21 nt, Pseudomonas putida KT2440
cgcccaaccccagcgcguaca

SEQ ID NO: 1568739 - RNA, 20 nt, Pseudomonas putida KT2440
cgcccaaccccaggcgcaca

SEQ ID NO: 1568740 - RNA, 17 nt, Pseudomonas putida KT2440
cgccauucuucuccagg

SEQ ID NO: 1568741 - RNA, 14 nt, Pseudomonas putida KT2440
cgccauugaugccg

SEQ ID NO: 1568742 - RNA, 16 nt, Pseudomonas putida KT2440
cgccaugugcgcccga

SEQ ID NO: 1568743 - RNA, 15 nt, Pseudomonas putida KT2440
cgccauucaccagcu

SEQ ID NO: 1568744 - RNA, 17 nt, Pseudomonas putida KT2440
cgccauguugcgcagca

SEQ ID NO: 1568745 - RNA, 21 nt, Pseudomonas putida KT2440
cgccauguugcgcagcaaucc

SEQ ID NO: 1568746 - RNA, 20 nt, Pseudomonas putida KT2440
cgccaggaguucugcacagc

SEQ ID NO: 1568747 - RNA, 18 nt, Pseudomonas putida KT2440
cgccaggcauuccccggu

SEQ ID NO: 1568748 - RNA, 14 nt, Pseudomonas putida KT2440
cgccaggcauugcu

SEQ ID NO: 1568749 - RNA, 14 nt, Pseudomonas putida KT2440
cgccaggaucggca

SEQ ID NO: 1568750 - RNA, 14 nt, Pseudomonas putida KT2440
cgccaggauggcac

SEQ ID NO: 1568751 - RNA, 15 nt, Pseudomonas putida KT2440
cgccaggauggcacc

SEQ ID NO: 1568752 - RNA, 19 nt, Pseudomonas putida KT2440
cgccaggauggcaccgauc

SEQ ID NO: 1568753 - RNA, 18 nt, Pseudomonas putida KT2440
cgccauggccuggcgggu

SEQ ID NO: 1568754 - RNA, 19 nt, Pseudomonas putida KT2440
cgccauggccuggcggguu

SEQ ID NO: 1568755 - RNA, 22 nt, Pseudomonas putida KT2440
cgccauggucgcguuguucagc

SEQ ID NO: 1568756 - RNA, 17 nt, Pseudomonas putida KT2440
cgcccagcagcaacgca

SEQ ID NO: 1568757 - RNA, 14 nt, Pseudomonas putida KT2440
cgcccagcccauga

SEQ ID NO: 1568758 - RNA, 15 nt, Pseudomonas putida KT2440
cgcccagcuggcuca

SEQ ID NO: 1568759 - RNA, 16 nt, Pseudomonas putida KT2440
cgcccaccagcugcac

SEQ ID NO: 1568760 - RNA, 15 nt, Pseudomonas putida KT2440
cgcccaccaccagcc

SEQ ID NO: 1568761 - RNA, 18 nt, Pseudomonas putida KT2440
cgcccaccaccagcccga

SEQ ID NO: 1568762 - RNA, 19 nt, Pseudomonas putida KT2440
cgcccaccaauuacucggc

SEQ ID NO: 1568763 - RNA, 14 nt, Pseudomonas putida KT2440
cgcccacacggcaa

SEQ ID NO: 1568764 - RNA, 15 nt, Pseudomonas putida KT2440
cgcccagcaacugcg

SEQ ID NO: 1568765 - RNA, 16 nt, Pseudomonas putida KT2440
cgcccagcaacugcgc

SEQ ID NO: 1568766 - RNA, 14 nt, Pseudomonas putida KT2440
cgcccagaucagca

SEQ ID NO: 1568767 - RNA, 21 nt, Pseudomonas putida KT2440
cgcccagaucagcagcaccga

SEQ ID NO: 1568768 - RNA, 14 nt, Pseudomonas putida KT2440
cgcccagaugaguu

SEQ ID NO: 1568769 - RNA, 15 nt, Pseudomonas putida KT2440
cgcccacgccggcaa

SEQ ID NO: 1568770 - RNA, 23 nt, Pseudomonas putida KT2440
cgcccacgccggcaaccccugca

SEQ ID NO: 1568771 - RNA, 21 nt, Pseudomonas putida KT2440
cgcccacgaucucacgcgcca

SEQ ID NO: 1568772 - RNA, 16 nt, Pseudomonas putida KT2440
cgcccgcugcuuccgg

SEQ ID NO: 1568773 - RNA, 15 nt, Pseudomonas putida KT2440
cgcccgcugcgccgc

SEQ ID NO: 1568774 - RNA, 19 nt, Pseudomonas putida KT2440
cgcccgcucccacagguaa

SEQ ID NO: 1568775 - RNA, 20 nt, Pseudomonas putida KT2440
cgcccgcucccacaggugca

SEQ ID NO: 1568776 - RNA, 21 nt, Pseudomonas putida KT2440
cgcccggccuguuuggccgca

SEQ ID NO: 1568777 - RNA, 15 nt, Pseudomonas putida KT2440
cgcccggccagguca

SEQ ID NO: 1568778 - RNA, 13 nt, Pseudomonas putida KT2440
cgcccggccacgu

SEQ ID NO: 1568779 - RNA, 23 nt, Pseudomonas putida KT2440
cgccccugcguccccggguccac

SEQ ID NO: 1568780 - RNA, 19 nt, Pseudomonas putida KT2440
cgccccuacgcugguucug

SEQ ID NO: 1568781 - RNA, 13 nt, Pseudomonas putida KT2440
cgccccugccagc

SEQ ID NO: 1568782 - RNA, 20 nt, Pseudomonas putida KT2440
cgcccccagccuugaggcug

SEQ ID NO: 1568783 - RNA, 15 nt, Pseudomonas putida KT2440
cgccccgugcccgau

SEQ ID NO: 1568784 - RNA, 17 nt, Pseudomonas putida KT2440
cgcccgcgaaaugccca

SEQ ID NO: 1568785 - RNA, 18 nt, Pseudomonas putida KT2440
cgcccgccugcgccagcg

SEQ ID NO: 1568786 - RNA, 13 nt, Pseudomonas putida KT2440
cgcccgccugcgc

SEQ ID NO: 1568787 - RNA, 12 nt, Pseudomonas putida KT2440
cgcccgcccgac

SEQ ID NO: 1568788 - RNA, 16 nt, Pseudomonas putida KT2440
cgcccgccagguagcg

SEQ ID NO: 1568789 - RNA, 14 nt, Pseudomonas putida KT2440
cgcccagugcgcgc

SEQ ID NO: 1568790 - RNA, 17 nt, Pseudomonas putida KT2440
cgcccagugcgcgcaac

SEQ ID NO: 1568791 - RNA, 19 nt, Pseudomonas putida KT2440
cgcccagguuauacgccgc

SEQ ID NO: 1568792 - RNA, 12 nt, Pseudomonas putida KT2440
cgcccaggcgcu

SEQ ID NO: 1568793 - RNA, 16 nt, Pseudomonas putida KT2440
cgcccaucucaggccc

SEQ ID NO: 1568794 - RNA, 23 nt, Pseudomonas putida KT2440
cgcccaguggcacaccaugggca

SEQ ID NO: 1568795 - RNA, 16 nt, Pseudomonas putida KT2440
cgcccaucaccggcac

SEQ ID NO: 1568796 - RNA, 14 nt, Pseudomonas putida KT2440
cgcccaguucagcu

SEQ ID NO: 1568797 - RNA, 18 nt, Pseudomonas putida KT2440
cgcccaguucagcucgcu

SEQ ID NO: 1568798 - RNA, 14 nt, Pseudomonas putida KT2440
cgccccagguggcu

SEQ ID NO: 1568799 - RNA, 13 nt, Pseudomonas putida KT2440
cgcccccacgggc

SEQ ID NO: 1568800 - RNA, 14 nt, Pseudomonas putida KT2440
cgcccccacgggca

SEQ ID NO: 1568801 - RNA, 12 nt, Pseudomonas putida KT2440
cgcccccaucgc

SEQ ID NO: 1568802 - RNA, 20 nt, Pseudomonas putida KT2440
cgccccacucgcgcagcaca

SEQ ID NO: 1568803 - RNA, 15 nt, Pseudomonas putida KT2440
cgccccaggagggcu

SEQ ID NO: 1568804 - RNA, 15 nt, Pseudomonas putida KT2440
cgcccauggcuccac

SEQ ID NO: 1568805 - RNA, 22 nt, Pseudomonas putida KT2440
cgcccauuuccgggcaaugcag

SEQ ID NO: 1568806 - RNA, 19 nt, Pseudomonas putida KT2440
cgccccaagcgccugacgc

SEQ ID NO: 1568807 - RNA, 20 nt, Pseudomonas putida KT2440
cgcucgaagauauccgccug

SEQ ID NO: 1568808 - RNA, 21 nt, Pseudomonas putida KT2440
cgcucgaagauauccgccuga

SEQ ID NO: 1568809 - RNA, 19 nt, Pseudomonas putida KT2440
cgcucgaagucguccacgc

SEQ ID NO: 1568810 - RNA, 15 nt, Pseudomonas putida KT2440
cgcuccuucaccagg

SEQ ID NO: 1568811 - RNA, 15 nt, Pseudomonas putida KT2440
cgcucgauaugccgc

SEQ ID NO: 1568812 - RNA, 17 nt, Pseudomonas putida KT2440
cgcucgauaugccgccg

SEQ ID NO: 1568813 - RNA, 19 nt, Pseudomonas putida KT2440
cgcucgagcccgccagcag

SEQ ID NO: 1568814 - RNA, 14 nt, Pseudomonas putida KT2440
cgcucgacgcgcgc

SEQ ID NO: 1568815 - RNA, 11 nt, Pseudomonas putida KT2440
cgcucgacagc

SEQ ID NO: 1568816 - RNA, 12 nt, Pseudomonas putida KT2440
cgcucgacagca

SEQ ID NO: 1568817 - RNA, 12 nt, Pseudomonas putida KT2440
cgcucgaccaga

SEQ ID NO: 1568818 - RNA, 17 nt, Pseudomonas putida KT2440
cgcuccuacaaagcggc

SEQ ID NO: 1568819 - RNA, 15 nt, Pseudomonas putida KT2440
cgcuccuacaacggc

SEQ ID NO: 1568820 - RNA, 20 nt, Pseudomonas putida KT2440
cgcuccuacaauggauugca

SEQ ID NO: 1568821 - RNA, 20 nt, Pseudomonas putida KT2440
cgcuccuacaggauggccgc

SEQ ID NO: 1568822 - RNA, 14 nt, Pseudomonas putida KT2440
cgcuccuacaggcc

SEQ ID NO: 1568823 - RNA, 16 nt, Pseudomonas putida KT2440
cgcuccuacagguucu

SEQ ID NO: 1568824 - RNA, 20 nt, Pseudomonas putida KT2440
cgcuccuacgggcaaccgca

SEQ ID NO: 1568825 - RNA, 21 nt, Pseudomonas putida KT2440
cgcuccuacgggcgagcgcgc

SEQ ID NO: 1568826 - RNA, 19 nt, Pseudomonas putida KT2440
cgcucccacgaggaccugc

SEQ ID NO: 1568827 - RNA, 20 nt, Pseudomonas putida KT2440
cgcguuucggcggccugcag

SEQ ID NO: 1568828 - RNA, 11 nt, Pseudomonas putida KT2440
cgcucaugccc

SEQ ID NO: 1568829 - RNA, 15 nt, Pseudomonas putida KT2440
cgcucaugaacagcg

SEQ ID NO: 1568830 - RNA, 16 nt, Pseudomonas putida KT2440
cgcucaugaacagcgc

SEQ ID NO: 1568831 - RNA, 15 nt, Pseudomonas putida KT2440
cgcucauguccaggu

SEQ ID NO: 1568832 - RNA, 18 nt, Pseudomonas putida KT2440
cgcuccaguggugcaagg

SEQ ID NO: 1568833 - RNA, 15 nt, Pseudomonas putida KT2440
cgcucccacaggggc

SEQ ID NO: 1568834 - RNA, 20 nt, Pseudomonas putida KT2440
cgcucccacagguaaugcac

SEQ ID NO: 1568835 - RNA, 21 nt, Pseudomonas putida KT2440
cgcucccacagguccagcgca

SEQ ID NO: 1568836 - RNA, 15 nt, Pseudomonas putida KT2440
cgcucccacaggugc

SEQ ID NO: 1568837 - RNA, 12 nt, Pseudomonas putida KT2440
cgcuccaggcgg

SEQ ID NO: 1568838 - RNA, 15 nt, Pseudomonas putida KT2440
cgcuccaggcggcca

SEQ ID NO: 1568839 - RNA, 20 nt, Pseudomonas putida KT2440
cgcuccaggcggccagccaa

SEQ ID NO: 1568840 - RNA, 20 nt, Pseudomonas putida KT2440
cgcuccagcagggucgccug

SEQ ID NO: 1568841 - RNA, 19 nt, Pseudomonas putida KT2440
cgcugacucagcggccuuu

SEQ ID NO: 1568842 - RNA, 18 nt, Pseudomonas putida KT2440
cgcugaguggcaugacca

SEQ ID NO: 1568843 - RNA, 21 nt, Pseudomonas putida KT2440
cgcugaccgggucgacgcgca

SEQ ID NO: 1568844 - RNA, 12 nt, Pseudomonas putida KT2440
cgcucguccagg

SEQ ID NO: 1568845 - RNA, 23 nt, Pseudomonas putida KT2440
cgcucguccaggcccugcagcgc

SEQ ID NO: 1568846 - RNA, 21 nt, Pseudomonas putida KT2440
cgcucugcggcccauucgcgg

SEQ ID NO: 1568847 - RNA, 14 nt, Pseudomonas putida KT2440
cgcucgcccagcag

SEQ ID NO: 1568848 - RNA, 18 nt, Pseudomonas putida KT2440
cgcucgcccagcagccaa

SEQ ID NO: 1568849 - RNA, 21 nt, Pseudomonas putida KT2440
cgcucgccacacaaauccagg

SEQ ID NO: 1568850 - RNA, 14 nt, Pseudomonas putida KT2440
cgcucgauccugug

SEQ ID NO: 1568851 - RNA, 20 nt, Pseudomonas putida KT2440
cgcucggucucacaggcgcu

SEQ ID NO: 1568852 - RNA, 20 nt, Pseudomonas putida KT2440
cgcucguaggcuucacgcgc

SEQ ID NO: 1568853 - RNA, 15 nt, Pseudomonas putida KT2440
cgcugcccaggugcc

SEQ ID NO: 1568854 - RNA, 19 nt, Pseudomonas putida KT2440
cgcugcccaggugccaggc

SEQ ID NO: 1568855 - RNA, 20 nt, Pseudomonas putida KT2440
cgcugaucaagcccgcucgc

SEQ ID NO: 1568856 - RNA, 15 nt, Pseudomonas putida KT2440
cgcugccgaucagca

SEQ ID NO: 1568857 - RNA, 15 nt, Pseudomonas putida KT2440
cgcugcccgggcaaa

SEQ ID NO: 1568858 - RNA, 17 nt, Pseudomonas putida KT2440
cgcugcgacucgcggcc

SEQ ID NO: 1568859 - RNA, 13 nt, Pseudomonas putida KT2440
cgcugcgccugcc

SEQ ID NO: 1568860 - RNA, 16 nt, Pseudomonas putida KT2440
cgcugcgccugccggg

SEQ ID NO: 1568861 - RNA, 15 nt, Pseudomonas putida KT2440
cgcugccugcuggcg

SEQ ID NO: 1568862 - RNA, 21 nt, Pseudomonas putida KT2440
cgcugccgucucgucacuggc

SEQ ID NO: 1568863 - RNA, 19 nt, Pseudomonas putida KT2440
cgcugcgcgguaaacggga

SEQ ID NO: 1568864 - RNA, 14 nt, Pseudomonas putida KT2440
cgcugcgcuggcca

SEQ ID NO: 1568865 - RNA, 20 nt, Pseudomonas putida KT2440
cgcugcggcacaccacgcca

SEQ ID NO: 1568866 - RNA, 11 nt, Pseudomonas putida KT2440
cgcugcggccg

SEQ ID NO: 1568867 - RNA, 12 nt, Pseudomonas putida KT2440
cgcugcggcgaa

SEQ ID NO: 1568868 - RNA, 20 nt, Pseudomonas putida KT2440
cgcugcggcgaaagccagca

SEQ ID NO: 1568869 - RNA, 14 nt, Pseudomonas putida KT2440
cgcugcuacgccgc

SEQ ID NO: 1568870 - RNA, 14 nt, Pseudomonas putida KT2440
cgcugcgugaccgc

SEQ ID NO: 1568871 - RNA, 17 nt, Pseudomonas putida KT2440
cgcugcgucaggccaug

SEQ ID NO: 1568872 - RNA, 12 nt, Pseudomonas putida KT2440
cgcuggcgacga

SEQ ID NO: 1568873 - RNA, 15 nt, Pseudomonas putida KT2440
cgcuggcgaaacaau

SEQ ID NO: 1568874 - RNA, 16 nt, Pseudomonas putida KT2440
cgcuggccgcacccag

SEQ ID NO: 1568875 - RNA, 18 nt, Pseudomonas putida KT2440
cgcuggccgcacccagca

SEQ ID NO: 1568876 - RNA, 23 nt, Pseudomonas putida KT2440
cgcuggccgcacccagcaggccg

SEQ ID NO: 1568877 - RNA, 15 nt, Pseudomonas putida KT2440
cgcugggcaucgaca

SEQ ID NO: 1568878 - RNA, 13 nt, Pseudomonas putida KT2440
cgcugggcacccu

SEQ ID NO: 1568879 - RNA, 15 nt, Pseudomonas putida KT2440
cgcugggcacccuga

SEQ ID NO: 1568880 - RNA, 23 nt, Pseudomonas putida KT2440
cgcuggucgcgcagauggcagac

SEQ ID NO: 1568881 - RNA, 14 nt, Pseudomonas putida KT2440
cgcugcuuccggcu

SEQ ID NO: 1568882 - RNA, 13 nt, Pseudomonas putida KT2440
cgcugcuggcgcu

SEQ ID NO: 1568883 - RNA, 16 nt, Pseudomonas putida KT2440
cgcugcuggcgcucca

SEQ ID NO: 1568884 - RNA, 20 nt, Pseudomonas putida KT2440
cgcugcugguccucgacggg

SEQ ID NO: 1568885 - RNA, 16 nt, Pseudomonas putida KT2440
cgcugcugcuggccgc

SEQ ID NO: 1568886 - RNA, 17 nt, Pseudomonas putida KT2440
cgcuggacuugccuugg

SEQ ID NO: 1568887 - RNA, 22 nt, Pseudomonas putida KT2440
cgcuggaauuauuggccagcaa

SEQ ID NO: 1568888 - RNA, 21 nt, Pseudomonas putida KT2440
cgcuggcacaggcuacgcagc

SEQ ID NO: 1568889 - RNA, 18 nt, Pseudomonas putida KT2440
cgcuggcacccacgcgcu

SEQ ID NO: 1568890 - RNA, 22 nt, Pseudomonas putida KT2440
cgcuggcauccaccaggucggu

SEQ ID NO: 1568891 - RNA, 22 nt, Pseudomonas putida KT2440
cgcuggccaaggccucuaccgc

SEQ ID NO: 1568892 - RNA, 14 nt, Pseudomonas putida KT2440
cgcguucaugccgg

SEQ ID NO: 1568893 - RNA, 15 nt, Pseudomonas putida KT2440
cgcguucacaucgcc

SEQ ID NO: 1568894 - RNA, 15 nt, Pseudomonas putida KT2440
cgcgugguccugaug

SEQ ID NO: 1568895 - RNA, 15 nt, Pseudomonas putida KT2440
cgcguuggcagcacc

SEQ ID NO: 1568896 - RNA, 12 nt, Pseudomonas putida KT2440
cgcguuguucag

SEQ ID NO: 1568897 - RNA, 18 nt, Pseudomonas putida KT2440
cgcguuguucagcagcga

SEQ ID NO: 1568898 - RNA, 19 nt, Pseudomonas putida KT2440
cgcguuguucagcagcgaa

SEQ ID NO: 1568899 - RNA, 14 nt, Pseudomonas putida KT2440
cgcguugcggaaca

SEQ ID NO: 1568900 - RNA, 20 nt, Pseudomonas putida KT2440
cgcgucucuuucaggcacag

SEQ ID NO: 1568901 - RNA, 20 nt, Pseudomonas putida KT2440
cgcguccuggacccgcagca

SEQ ID NO: 1568902 - RNA, 22 nt, Pseudomonas putida KT2440
cgcguccuggacccgcagcagg

SEQ ID NO: 1568903 - RNA, 14 nt, Pseudomonas putida KT2440
cgcgucgauacgcu

SEQ ID NO: 1568904 - RNA, 19 nt, Pseudomonas putida KT2440
cgcgucccccgguaccagc

SEQ ID NO: 1568905 - RNA, 21 nt, Pseudomonas putida KT2440
cgcgucccccgguaccagcag

SEQ ID NO: 1568906 - RNA, 14 nt, Pseudomonas putida KT2440
cgcguccagcaaca

SEQ ID NO: 1568907 - RNA, 22 nt, Pseudomonas putida KT2440
cgcguccagcaacagcugccgg

SEQ ID NO: 1568908 - RNA, 18 nt, Pseudomonas putida KT2440
cgcgucagcucaagcgcu

SEQ ID NO: 1568909 - RNA, 17 nt, Pseudomonas putida KT2440
cgcgucauccgccaaca

SEQ ID NO: 1568910 - RNA, 16 nt, Pseudomonas putida KT2440
cgcgucaucugcgcac

SEQ ID NO: 1568911 - RNA, 20 nt, Pseudomonas putida KT2440
cgcgucauacucuucgcggg

SEQ ID NO: 1568912 - RNA, 14 nt, Pseudomonas putida KT2440
cgcggggcccgacc

SEQ ID NO: 1568913 - RNA, 22 nt, Pseudomonas putida KT2440
cgcgggcucguuauccgcgagu

SEQ ID NO: 1568914 - RNA, 20 nt, Pseudomonas putida KT2440
cgcggguaagcccgcuccua

SEQ ID NO: 1568915 - RNA, 20 nt, Pseudomonas putida KT2440
cgcggguagacccgcuccua

SEQ ID NO: 1568916 - RNA, 21 nt, Pseudomonas putida KT2440
cgcggguagacccgcuccuac

SEQ ID NO: 1568917 - RNA, 20 nt, Pseudomonas putida KT2440
cgcggguccagcgcggccac

SEQ ID NO: 1568918 - RNA, 20 nt, Pseudomonas putida KT2440
cgcgggugaacccgcuccua

SEQ ID NO: 1568919 - RNA, 21 nt, Pseudomonas putida KT2440
cgcgggugaacccgcuccuac

SEQ ID NO: 1568920 - RNA, 20 nt, Pseudomonas putida KT2440
cgcgggugaacccgcuccug

SEQ ID NO: 1568921 - RNA, 21 nt, Pseudomonas putida KT2440
cgcgggugaacccgcuccugc

SEQ ID NO: 1568922 - RNA, 14 nt, Pseudomonas putida KT2440
cgcggucagcgaau

SEQ ID NO: 1568923 - RNA, 17 nt, Pseudomonas putida KT2440
cgcgguuucugcaacca

SEQ ID NO: 1568924 - RNA, 20 nt, Pseudomonas putida KT2440
cgcgguuucugcaaccacga

SEQ ID NO: 1568925 - RNA, 15 nt, Pseudomonas putida KT2440
cgcggugauggcgca

SEQ ID NO: 1568926 - RNA, 16 nt, Pseudomonas putida KT2440
cgcggucugcggcagc

SEQ ID NO: 1568927 - RNA, 14 nt, Pseudomonas putida KT2440
cgcguacagcugcu

SEQ ID NO: 1568928 - RNA, 19 nt, Pseudomonas putida KT2440
cgcguaguacuccagcagc

SEQ ID NO: 1568929 - RNA, 17 nt, Pseudomonas putida KT2440
cgcgccgccacauccag

SEQ ID NO: 1568930 - RNA, 16 nt, Pseudomonas putida KT2440
cgcgccgccaggcggu

SEQ ID NO: 1568931 - RNA, 21 nt, Pseudomonas putida KT2440
cgcgccaugccccuaccgcca

SEQ ID NO: 1568932 - RNA, 16 nt, Pseudomonas putida KT2440
cgcgccauggccuggc

SEQ ID NO: 1568933 - RNA, 15 nt, Pseudomonas putida KT2440
cgcgcccacgcgggu

SEQ ID NO: 1568934 - RNA, 18 nt, Pseudomonas putida KT2440
cgcgccgauugcugccga

SEQ ID NO: 1568935 - RNA, 20 nt, Pseudomonas putida KT2440
cgcgcccagugcgcgcaaca

SEQ ID NO: 1568936 - RNA, 16 nt, Pseudomonas putida KT2440
cgcgcccggcuugccc

SEQ ID NO: 1568937 - RNA, 19 nt, Pseudomonas putida KT2440
cgcgcccugcucauccagc

SEQ ID NO: 1568938 - RNA, 14 nt, Pseudomonas putida KT2440
cgcgccagcggcca

SEQ ID NO: 1568939 - RNA, 19 nt, Pseudomonas putida KT2440
cgcgccagcggccagcgcc

SEQ ID NO: 1568940 - RNA, 14 nt, Pseudomonas putida KT2440
cgcgccagcagcgc

SEQ ID NO: 1568941 - RNA, 15 nt, Pseudomonas putida KT2440
cgcgccagcagcgcg

SEQ ID NO: 1568942 - RNA, 12 nt, Pseudomonas putida KT2440
cgcgccagcagg

SEQ ID NO: 1568943 - RNA, 11 nt, Pseudomonas putida KT2440
cgcgccagcau

SEQ ID NO: 1568944 - RNA, 22 nt, Pseudomonas putida KT2440
cgcgccagcauggaccaucagg

SEQ ID NO: 1568945 - RNA, 18 nt, Pseudomonas putida KT2440
cgcgccaggguugcaucg

SEQ ID NO: 1568946 - RNA, 19 nt, Pseudomonas putida KT2440
cgcgccaggguugcaucgc

SEQ ID NO: 1568947 - RNA, 21 nt, Pseudomonas putida KT2440
cgcgccaggguugcaucgcgc

SEQ ID NO: 1568948 - RNA, 16 nt, Pseudomonas putida KT2440
cgcgccagcgcaugca

SEQ ID NO: 1568949 - RNA, 16 nt, Pseudomonas putida KT2440
cgcgccaggucggaca

SEQ ID NO: 1568950 - RNA, 16 nt, Pseudomonas putida KT2440
cgcgccaucaaggccg

SEQ ID NO: 1568951 - RNA, 21 nt, Pseudomonas putida KT2440
cgcgccaguucgacgcugcug

SEQ ID NO: 1568952 - RNA, 15 nt, Pseudomonas putida KT2440
cgcgccaucagcugc

SEQ ID NO: 1568953 - RNA, 15 nt, Pseudomonas putida KT2440
cgcgccagcuccaca

SEQ ID NO: 1568954 - RNA, 16 nt, Pseudomonas putida KT2440
cgcgccagcuccgaca

SEQ ID NO: 1568955 - RNA, 16 nt, Pseudomonas putida KT2440
cgcgccagggcaacgg

SEQ ID NO: 1568956 - RNA, 18 nt, Pseudomonas putida KT2440
cgcgccacauagcuggca

SEQ ID NO: 1568957 - RNA, 21 nt, Pseudomonas putida KT2440
cgcgccaccgggcgcgauugc

SEQ ID NO: 1568958 - RNA, 19 nt, Pseudomonas putida KT2440
cgcgccacgcaccagggcu

SEQ ID NO: 1568959 - RNA, 23 nt, Pseudomonas putida KT2440
cgcgcaugaaaaagccggcaacg

SEQ ID NO: 1568960 - RNA, 21 nt, Pseudomonas putida KT2440
cgcgcaugaaggacaucacca

SEQ ID NO: 1568961 - RNA, 22 nt, Pseudomonas putida KT2440
cgcgcaugaaggacaucaccag

SEQ ID NO: 1568962 - RNA, 24 nt, Pseudomonas putida KT2440
cgcgcaugaaggacaucaccaggc

SEQ ID NO: 1568963 - RNA, 16 nt, Pseudomonas putida KT2440
cgcgcaugcugccagg

SEQ ID NO: 1568964 - RNA, 21 nt, Pseudomonas putida KT2440
cgcgcaugaugaaguggcgca

SEQ ID NO: 1568965 - RNA, 22 nt, Pseudomonas putida KT2440
cgcgcaugaugaaguggcgcag

SEQ ID NO: 1568966 - RNA, 17 nt, Pseudomonas putida KT2440
cgcgcauuugcuccagg

SEQ ID NO: 1568967 - RNA, 20 nt, Pseudomonas putida KT2440
cgcgcaagccuuugcgccuu

SEQ ID NO: 1568968 - RNA, 20 nt, Pseudomonas putida KT2440
cgcgcacgguaggugaugcg

SEQ ID NO: 1568969 - RNA, 21 nt, Pseudomonas putida KT2440
cgcgcaccaccugaugcacca

SEQ ID NO: 1568970 - RNA, 12 nt, Pseudomonas putida KT2440
cgcgcaggccac

SEQ ID NO: 1568971 - RNA, 15 nt, Pseudomonas putida KT2440
cgcgcaggccacggu

SEQ ID NO: 1568972 - RNA, 13 nt, Pseudomonas putida KT2440
cgcgcagcaucug

SEQ ID NO: 1568973 - RNA, 13 nt, Pseudomonas putida KT2440
cgcgcaucagccg

SEQ ID NO: 1568974 - RNA, 15 nt, Pseudomonas putida KT2440
cgcgcauccacaggc

SEQ ID NO: 1568975 - RNA, 14 nt, Pseudomonas putida KT2440
cgcgcauccagcag

SEQ ID NO: 1568976 - RNA, 19 nt, Pseudomonas putida KT2440
cgcgcaucccuuguaggag

SEQ ID NO: 1568977 - RNA, 14 nt, Pseudomonas putida KT2440
cgcgcagggccuug

SEQ ID NO: 1568978 - RNA, 15 nt, Pseudomonas putida KT2440
cgcgcagggcaucgc

SEQ ID NO: 1568979 - RNA, 13 nt, Pseudomonas putida KT2440
cgcgcaggcgcug

SEQ ID NO: 1568980 - RNA, 24 nt, Pseudomonas putida KT2440
cgcgcaggguuuucagcgccgcaa

SEQ ID NO: 1568981 - RNA, 16 nt, Pseudomonas putida KT2440
cgcggccgaaacgcga

SEQ ID NO: 1568982 - RNA, 14 nt, Pseudomonas putida KT2440
cgcggcgcccuggc

SEQ ID NO: 1568983 - RNA, 15 nt, Pseudomonas putida KT2440
cgcggcgcuggccgg

SEQ ID NO: 1568984 - RNA, 14 nt, Pseudomonas putida KT2440
cgcggcgcccagca

SEQ ID NO: 1568985 - RNA, 17 nt, Pseudomonas putida KT2440
cgcggcgcccagcaaca

SEQ ID NO: 1568986 - RNA, 14 nt, Pseudomonas putida KT2440
cgcggccugcucca

SEQ ID NO: 1568987 - RNA, 22 nt, Pseudomonas putida KT2440
cgcggcaugucgaugcggugcu

SEQ ID NO: 1568988 - RNA, 21 nt, Pseudomonas putida KT2440
cgcggccaagccgcugccaca

SEQ ID NO: 1568989 - RNA, 22 nt, Pseudomonas putida KT2440
cgcggccaagccgcugccacag

SEQ ID NO: 1568990 - RNA, 22 nt, Pseudomonas putida KT2440
cgcggcaaccugcacuaucugc

SEQ ID NO: 1568991 - RNA, 19 nt, Pseudomonas putida KT2440
cgcggcaagcccgcuccua

SEQ ID NO: 1568992 - RNA, 18 nt, Pseudomonas putida KT2440
cgcggcaauccgcuggaa

SEQ ID NO: 1568993 - RNA, 14 nt, Pseudomonas putida KT2440
cgcggacccggcau

SEQ ID NO: 1568994 - RNA, 13 nt, Pseudomonas putida KT2440
cgcggcagcagca

SEQ ID NO: 1568995 - RNA, 17 nt, Pseudomonas putida KT2440
cgcggcagcagcagccc

SEQ ID NO: 1568996 - RNA, 19 nt, Pseudomonas putida KT2440
cgcggcagcccuucgcggg

SEQ ID NO: 1568997 - RNA, 13 nt, Pseudomonas putida KT2440
cgcggcaccggcu

SEQ ID NO: 1568998 - RNA, 23 nt, Pseudomonas putida KT2440
cgcgcugacgcagggccucgaug

SEQ ID NO: 1568999 - RNA, 20 nt, Pseudomonas putida KT2440
cgcgcugcgcaaggacgacg

SEQ ID NO: 1569000 - RNA, 12 nt, Pseudomonas putida KT2440
cgcgcugcgcag

SEQ ID NO: 1569001 - RNA, 21 nt, Pseudomonas putida KT2440
cgcgcuuugugcacaagcugc

SEQ ID NO: 1569002 - RNA, 20 nt, Pseudomonas putida KT2440
cgcgcuuuucaucuucaucg

SEQ ID NO: 1569003 - RNA, 15 nt, Pseudomonas putida KT2440
cgcgcuuuuccagca

SEQ ID NO: 1569004 - RNA, 21 nt, Pseudomonas putida KT2440
cgcgcuuggcaccggcagcag

SEQ ID NO: 1569005 - RNA, 14 nt, Pseudomonas putida KT2440
cgcgcuuggccagg

SEQ ID NO: 1569006 - RNA, 13 nt, Pseudomonas putida KT2440
cgcgcuucccggg

SEQ ID NO: 1569007 - RNA, 15 nt, Pseudomonas putida KT2440
cgcgcuucagggucg

SEQ ID NO: 1569008 - RNA, 14 nt, Pseudomonas putida KT2440
cgcgcuggcacugc

SEQ ID NO: 1569009 - RNA, 15 nt, Pseudomonas putida KT2440
cgcgcggcgcaucgc

SEQ ID NO: 1569010 - RNA, 21 nt, Pseudomonas putida KT2440
cgcgcgggcaauggccacacg

SEQ ID NO: 1569011 - RNA, 17 nt, Pseudomonas putida KT2440
cgcgcgguuaagcgcca

SEQ ID NO: 1569012 - RNA, 15 nt, Pseudomonas putida KT2440
cgcgccgugccaggu

SEQ ID NO: 1569013 - RNA, 12 nt, Pseudomonas putida KT2440
cgcgccuccagc

SEQ ID NO: 1569014 - RNA, 13 nt, Pseudomonas putida KT2440
cgcgccuacaggc

SEQ ID NO: 1569015 - RNA, 13 nt, Pseudomonas putida KT2440
cgcgccuccagcu

SEQ ID NO: 1569016 - RNA, 15 nt, Pseudomonas putida KT2440
ccggcauaccaucuu

SEQ ID NO: 1569017 - RNA, 21 nt, Pseudomonas putida KT2440
ccggcauaccaucuucugcag

SEQ ID NO: 1569018 - RNA, 19 nt, Pseudomonas putida KT2440
ccggcauaacggcuggcgc

SEQ ID NO: 1569019 - RNA, 15 nt, Pseudomonas putida KT2440
ccggaauccgcacac

SEQ ID NO: 1569020 - RNA, 16 nt, Pseudomonas putida KT2440
ccggaauccgcacacg

SEQ ID NO: 1569021 - RNA, 12 nt, Pseudomonas putida KT2440
ccggcaucgcca

SEQ ID NO: 1569022 - RNA, 20 nt, Pseudomonas putida KT2440
ccggcaucauccugcuggcc

SEQ ID NO: 1569023 - RNA, 16 nt, Pseudomonas putida KT2440
ccggaauagaacacug

SEQ ID NO: 1569024 - RNA, 23 nt, Pseudomonas putida KT2440
ccgcuggcugaucucacggccau

SEQ ID NO: 1569025 - RNA, 21 nt, Pseudomonas putida KT2440
ccgcugggcuucuucgugcgc

SEQ ID NO: 1569026 - RNA, 17 nt, Pseudomonas putida KT2440
ccggccaacaacgacug

SEQ ID NO: 1569027 - RNA, 14 nt, Pseudomonas putida KT2440
ccggccaagcgccg

SEQ ID NO: 1569028 - RNA, 12 nt, Pseudomonas putida KT2440
ccggccagguca

SEQ ID NO: 1569029 - RNA, 14 nt, Pseudomonas putida KT2440
ccggccaguggccu

SEQ ID NO: 1569030 - RNA, 23 nt, Pseudomonas putida KT2440
ccggcauucccggcgccaugccc

SEQ ID NO: 1569031 - RNA, 14 nt, Pseudomonas putida KT2440
ccggcccugugccg

SEQ ID NO: 1569032 - RNA, 17 nt, Pseudomonas putida KT2440
ccggcccuucugcugcu

SEQ ID NO: 1569033 - RNA, 19 nt, Pseudomonas putida KT2440
ccggcccugccuaccaccg

SEQ ID NO: 1569034 - RNA, 20 nt, Pseudomonas putida KT2440
ccggccgaagugauggccug

SEQ ID NO: 1569035 - RNA, 19 nt, Pseudomonas putida KT2440
ccggccgacacaccaaugg

SEQ ID NO: 1569036 - RNA, 22 nt, Pseudomonas putida KT2440
ccggccgcgguaaagaacauga

SEQ ID NO: 1569037 - RNA, 22 nt, Pseudomonas putida KT2440
ccggccgcucaccggccagcgc

SEQ ID NO: 1569038 - RNA, 19 nt, Pseudomonas putida KT2440
ccggccgcgccaccgggcg

SEQ ID NO: 1569039 - RNA, 15 nt, Pseudomonas putida KT2440
ccggcccugaaggcc

SEQ ID NO: 1569040 - RNA, 15 nt, Pseudomonas putida KT2440
ccggcccugaucggu

SEQ ID NO: 1569041 - RNA, 15 nt, Pseudomonas putida KT2440
ccggcccggcuggcc

SEQ ID NO: 1569042 - RNA, 13 nt, Pseudomonas putida KT2440
ccggccccagggu

SEQ ID NO: 1569043 - RNA, 23 nt, Pseudomonas putida KT2440
ccggccccacgcaguuggccauc

SEQ ID NO: 1569044 - RNA, 14 nt, Pseudomonas putida KT2440
ccggccccugcucg

SEQ ID NO: 1569045 - RNA, 14 nt, Pseudomonas putida KT2440
ccggcgcaggucga

SEQ ID NO: 1569046 - RNA, 18 nt, Pseudomonas putida KT2440
ccggcgcaucgacgggca

SEQ ID NO: 1569047 - RNA, 12 nt, Pseudomonas putida KT2440
ccggcgcagcau

SEQ ID NO: 1569048 - RNA, 17 nt, Pseudomonas putida KT2440
ccggcgaucugucaggu

SEQ ID NO: 1569049 - RNA, 16 nt, Pseudomonas putida KT2440
ccggcgauacucaccg

SEQ ID NO: 1569050 - RNA, 21 nt, Pseudomonas putida KT2440
ccggcgauacuuggccaucag

SEQ ID NO: 1569051 - RNA, 17 nt, Pseudomonas putida KT2440
ccggccguggguccugc

SEQ ID NO: 1569052 - RNA, 13 nt, Pseudomonas putida KT2440
ccggccucggccg

SEQ ID NO: 1569053 - RNA, 13 nt, Pseudomonas putida KT2440
ccggcgaacagca

SEQ ID NO: 1569054 - RNA, 14 nt, Pseudomonas putida KT2440
ccggcgaacagcac

SEQ ID NO: 1569055 - RNA, 17 nt, Pseudomonas putida KT2440
ccggcgaacagcacugc

SEQ ID NO: 1569056 - RNA, 16 nt, Pseudomonas putida KT2440
ccggccuuggccgcug

SEQ ID NO: 1569057 - RNA, 19 nt, Pseudomonas putida KT2440
ccggccuuggccgcuggcc

SEQ ID NO: 1569058 - RNA, 21 nt, Pseudomonas putida KT2440
ccggccuuggcgcggcggaua

SEQ ID NO: 1569059 - RNA, 22 nt, Pseudomonas putida KT2440
ccggccuuggcgcggcggauaa

SEQ ID NO: 1569060 - RNA, 21 nt, Pseudomonas putida KT2440
ccggccuugccgcuggcgaug

SEQ ID NO: 1569061 - RNA, 19 nt, Pseudomonas putida KT2440
ccggccuguugcgcacugc

SEQ ID NO: 1569062 - RNA, 21 nt, Pseudomonas putida KT2440
ccggccuguugcgcacugccg

SEQ ID NO: 1569063 - RNA, 13 nt, Pseudomonas putida KT2440
ccggccuggcgca

SEQ ID NO: 1569064 - RNA, 14 nt, Pseudomonas putida KT2440
ccggccucuucgcg

SEQ ID NO: 1569065 - RNA, 23 nt, Pseudomonas putida KT2440
ccggccucuucgcggccuugccc

SEQ ID NO: 1569066 - RNA, 18 nt, Pseudomonas putida KT2440
ccggccucuucgcgggca

SEQ ID NO: 1569067 - RNA, 20 nt, Pseudomonas putida KT2440
ccggcgucccggccagcgac

SEQ ID NO: 1569068 - RNA, 13 nt, Pseudomonas putida KT2440
ccggcgucgaaca

SEQ ID NO: 1569069 - RNA, 16 nt, Pseudomonas putida KT2440
ccggcguguccagcag

SEQ ID NO: 1569070 - RNA, 12 nt, Pseudomonas putida KT2440
ccggcgucgauc

SEQ ID NO: 1569071 - RNA, 15 nt, Pseudomonas putida KT2440
ccggcggcggcguga

SEQ ID NO: 1569072 - RNA, 13 nt, Pseudomonas putida KT2440
ccggcggccagca

SEQ ID NO: 1569073 - RNA, 14 nt, Pseudomonas putida KT2440
ccggcggccagcac

SEQ ID NO: 1569074 - RNA, 24 nt, Pseudomonas putida KT2440
ccggcuugcgcccguaacggucac

SEQ ID NO: 1569075 - RNA, 14 nt, Pseudomonas putida KT2440
ccggcuugcuccaa

SEQ ID NO: 1569076 - RNA, 16 nt, Pseudomonas putida KT2440
ccgggaaaagccugcc

SEQ ID NO: 1569077 - RNA, 18 nt, Pseudomonas putida KT2440
ccgggaaaagccugccag

SEQ ID NO: 1569078 - RNA, 16 nt, Pseudomonas putida KT2440
ccggcuuguagccggc

SEQ ID NO: 1569079 - RNA, 21 nt, Pseudomonas putida KT2440
ccggcuggaagcuucgcggau

SEQ ID NO: 1569080 - RNA, 22 nt, Pseudomonas putida KT2440
ccggcuggaagcuucgcggaua

SEQ ID NO: 1569081 - RNA, 22 nt, Pseudomonas putida KT2440
ccggcuggauggcgcggugagg

SEQ ID NO: 1569082 - RNA, 11 nt, Pseudomonas putida KT2440
ccggcuucgcc

SEQ ID NO: 1569083 - RNA, 22 nt, Pseudomonas putida KT2440
ccggcuucuaccacuggggcuu

SEQ ID NO: 1569084 - RNA, 17 nt, Pseudomonas putida KT2440
ccggcugcggguaaugc

SEQ ID NO: 1569085 - RNA, 13 nt, Pseudomonas putida KT2440
ccggcugcagcag

SEQ ID NO: 1569086 - RNA, 18 nt, Pseudomonas putida KT2440
ccggcucgcaugagccgg

SEQ ID NO: 1569087 - RNA, 14 nt, Pseudomonas putida KT2440
ccggcucgccauug

SEQ ID NO: 1569088 - RNA, 16 nt, Pseudomonas putida KT2440
ccggcuccgcgcaagc

SEQ ID NO: 1569089 - RNA, 16 nt, Pseudomonas putida KT2440
ccggcguucaggcgcg

SEQ ID NO: 1569090 - RNA, 22 nt, Pseudomonas putida KT2440
ccggcguuggcuuccacggcgc

SEQ ID NO: 1569091 - RNA, 17 nt, Pseudomonas putida KT2440
ccggggaucuugcuggc

SEQ ID NO: 1569092 - RNA, 12 nt, Pseudomonas putida KT2440
ccggggcaugcg

SEQ ID NO: 1569093 - RNA, 21 nt, Pseudomonas putida KT2440
ccggggguggcgagcagguca

SEQ ID NO: 1569094 - RNA, 22 nt, Pseudomonas putida KT2440
ccggggcucacagcccgggcau

SEQ ID NO: 1569095 - RNA, 23 nt, Pseudomonas putida KT2440
ccggguaaucagcuugaacacga

SEQ ID NO: 1569096 - RNA, 16 nt, Pseudomonas putida KT2440
ccggguacuucucgac

SEQ ID NO: 1569097 - RNA, 22 nt, Pseudomonas putida KT2440
ccggguagaucauuaccugcag

SEQ ID NO: 1569098 - RNA, 20 nt, Pseudomonas putida KT2440
ccgggucaaggccagcgccu

SEQ ID NO: 1569099 - RNA, 13 nt, Pseudomonas putida KT2440
ccggguccagcaa

SEQ ID NO: 1569100 - RNA, 20 nt, Pseudomonas putida KT2440
ccgggcgggugcauggcucg

SEQ ID NO: 1569101 - RNA, 21 nt, Pseudomonas putida KT2440
ccgggcgguugucgaccuggc

SEQ ID NO: 1569102 - RNA, 13 nt, Pseudomonas putida KT2440
ccgggcgcaccac

SEQ ID NO: 1569103 - RNA, 21 nt, Pseudomonas putida KT2440
ccgggcgcaccacgaucacgc

SEQ ID NO: 1569104 - RNA, 16 nt, Pseudomonas putida KT2440
ccgggcgcaggcagca

SEQ ID NO: 1569105 - RNA, 13 nt, Pseudomonas putida KT2440
ccgggcugcugcg

SEQ ID NO: 1569106 - RNA, 22 nt, Pseudomonas putida KT2440
ccgggagggcuuugcccuccua

SEQ ID NO: 1569107 - RNA, 20 nt, Pseudomonas putida KT2440
ccgggaugcucugcagcagc

SEQ ID NO: 1569108 - RNA, 18 nt, Pseudomonas putida KT2440
ccgggcacaucaccagca

SEQ ID NO: 1569109 - RNA, 21 nt, Pseudomonas putida KT2440
ccgggcacaucaccagcagcu

SEQ ID NO: 1569110 - RNA, 18 nt, Pseudomonas putida KT2440
ccgguucucgcgaaccgg

SEQ ID NO: 1569111 - RNA, 19 nt, Pseudomonas putida KT2440
ccgguucugccggggcaug

SEQ ID NO: 1569112 - RNA, 20 nt, Pseudomonas putida KT2440
ccgguguaccauccaguacc

SEQ ID NO: 1569113 - RNA, 18 nt, Pseudomonas putida KT2440
ccgguguaguugaccgac

SEQ ID NO: 1569114 - RNA, 19 nt, Pseudomonas putida KT2440
ccgguguccuggcgucgcc

SEQ ID NO: 1569115 - RNA, 18 nt, Pseudomonas putida KT2440
ccggugcauccaacgcug

SEQ ID NO: 1569116 - RNA, 16 nt, Pseudomonas putida KT2440
ccguccaacgggcgga

SEQ ID NO: 1569117 - RNA, 14 nt, Pseudomonas putida KT2440
ccgucaggcaaacg

SEQ ID NO: 1569118 - RNA, 15 nt, Pseudomonas putida KT2440
ccgucagcggcaaca

SEQ ID NO: 1569119 - RNA, 13 nt, Pseudomonas putida KT2440
ccgucaccagcgu

SEQ ID NO: 1569120 - RNA, 19 nt, Pseudomonas putida KT2440
ccgguuggggacggcagcc

SEQ ID NO: 1569121 - RNA, 17 nt, Pseudomonas putida KT2440
ccgguuucucgcagcag

SEQ ID NO: 1569122 - RNA, 18 nt, Pseudomonas putida KT2440
ccgguuucucgcagcagc

SEQ ID NO: 1569123 - RNA, 20 nt, Pseudomonas putida KT2440
ccgguuucucgcagcagcac

SEQ ID NO: 1569124 - RNA, 13 nt, Pseudomonas putida KT2440
ccguacaccaugc

SEQ ID NO: 1569125 - RNA, 13 nt, Pseudomonas putida KT2440
ccgucgaccaggc

SEQ ID NO: 1569126 - RNA, 14 nt, Pseudomonas putida KT2440
ccgucgaccaggca

SEQ ID NO: 1569127 - RNA, 21 nt, Pseudomonas putida KT2440
ccgucgacuuuugccacccga

SEQ ID NO: 1569128 - RNA, 23 nt, Pseudomonas putida KT2440
ccgucgaacguccgcucuucucg

SEQ ID NO: 1569129 - RNA, 17 nt, Pseudomonas putida KT2440
ccgucgaaugcgacuga

SEQ ID NO: 1569130 - RNA, 11 nt, Pseudomonas putida KT2440
ccgucggccuc

SEQ ID NO: 1569131 - RNA, 18 nt, Pseudomonas putida KT2440
ccgucuuccucgacccag

SEQ ID NO: 1569132 - RNA, 17 nt, Pseudomonas putida KT2440
ccgucucugaccggcac

SEQ ID NO: 1569133 - RNA, 21 nt, Pseudomonas putida KT2440
ccgucucugaccggcacugca

SEQ ID NO: 1569134 - RNA, 14 nt, Pseudomonas putida KT2440
ccgugcuugcgggc

SEQ ID NO: 1569135 - RNA, 23 nt, Pseudomonas putida KT2440
ccgugcuugcgggcaaggucgau

SEQ ID NO: 1569136 - RNA, 17 nt, Pseudomonas putida KT2440
ccgugcuguguuucgcc

SEQ ID NO: 1569137 - RNA, 14 nt, Pseudomonas putida KT2440
ccgugcucggccuu

SEQ ID NO: 1569138 - RNA, 16 nt, Pseudomonas putida KT2440
ccgugcccaccagcgc

SEQ ID NO: 1569139 - RNA, 12 nt, Pseudomonas putida KT2440
ccgugccaggug

SEQ ID NO: 1569140 - RNA, 21 nt, Pseudomonas putida KT2440
ccgugcccgcccacgccgcug

SEQ ID NO: 1569141 - RNA, 16 nt, Pseudomonas putida KT2440
ccgugcccggcauccg

SEQ ID NO: 1569142 - RNA, 21 nt, Pseudomonas putida KT2440
ccgugcccggcauccgccuca

SEQ ID NO: 1569143 - RNA, 20 nt, Pseudomonas putida KT2440
ccgugaauccggggccgcaa

SEQ ID NO: 1569144 - RNA, 15 nt, Pseudomonas putida KT2440
ccgucuuuuccgugc

SEQ ID NO: 1569145 - RNA, 11 nt, Pseudomonas putida KT2440
ccgugaagacg

SEQ ID NO: 1569146 - RNA, 17 nt, Pseudomonas putida KT2440
ccguggcaggcaguucg

SEQ ID NO: 1569147 - RNA, 15 nt, Pseudomonas putida KT2440
ccguggcaacgccac

SEQ ID NO: 1569148 - RNA, 14 nt, Pseudomonas putida KT2440
ccguuaacacaggu

SEQ ID NO: 1569149 - RNA, 14 nt, Pseudomonas putida KT2440
ccguguucccagca

SEQ ID NO: 1569150 - RNA, 17 nt, Pseudomonas putida KT2440
ccguguugcagcggguu

SEQ ID NO: 1569151 - RNA, 19 nt, Pseudomonas putida KT2440
ccguguugcagcggguuug

SEQ ID NO: 1569152 - RNA, 14 nt, Pseudomonas putida KT2440
ccuccugccggggu

SEQ ID NO: 1569153 - RNA, 21 nt, Pseudomonas putida KT2440
ccuccugauguaggagcgggu

SEQ ID NO: 1569154 - RNA, 22 nt, Pseudomonas putida KT2440
ccuccugauguaggagcggguu

SEQ ID NO: 1569155 - RNA, 17 nt, Pseudomonas putida KT2440
ccuccuaucgcgacaca

SEQ ID NO: 1569156 - RNA, 18 nt, Pseudomonas putida KT2440
ccuccucgcgggcaaacc

SEQ ID NO: 1569157 - RNA, 14 nt, Pseudomonas putida KT2440
ccuccguugcugcg

SEQ ID NO: 1569158 - RNA, 16 nt, Pseudomonas putida KT2440
ccuccggcccaucccg

SEQ ID NO: 1569159 - RNA, 12 nt, Pseudomonas putida KT2440
ccucgaucccgc

SEQ ID NO: 1569160 - RNA, 21 nt, Pseudomonas putida KT2440
ccucgaugucuuccagaccag

SEQ ID NO: 1569161 - RNA, 19 nt, Pseudomonas putida KT2440
ccucgaugcggucuuccag

SEQ ID NO: 1569162 - RNA, 14 nt, Pseudomonas putida KT2440
ccucgcaugcggcc

SEQ ID NO: 1569163 - RNA, 16 nt, Pseudomonas putida KT2440
ccucgcccaccagcug

SEQ ID NO: 1569164 - RNA, 19 nt, Pseudomonas putida KT2440
ccucgcccaccagcugcac

SEQ ID NO: 1569165 - RNA, 14 nt, Pseudomonas putida KT2440
ccucgcccagguca

SEQ ID NO: 1569166 - RNA, 20 nt, Pseudomonas putida KT2440
ccucauucaaagccugcucc

SEQ ID NO: 1569167 - RNA, 19 nt, Pseudomonas putida KT2440
ccucaucaggccgaaggcc

SEQ ID NO: 1569168 - RNA, 17 nt, Pseudomonas putida KT2440
ccucauaguaaggcugg

SEQ ID NO: 1569169 - RNA, 17 nt, Pseudomonas putida KT2440
ccucauaaggguaucgg

SEQ ID NO: 1569170 - RNA, 12 nt, Pseudomonas putida KT2440
ccuccacccggu

SEQ ID NO: 1569171 - RNA, 14 nt, Pseudomonas putida KT2440
ccucagccaggcug

SEQ ID NO: 1569172 - RNA, 22 nt, Pseudomonas putida KT2440
ccguucacguucaacgccguac

SEQ ID NO: 1569173 - RNA, 14 nt, Pseudomonas putida KT2440
ccuacaggcaaccg

SEQ ID NO: 1569174 - RNA, 16 nt, Pseudomonas putida KT2440
ccuagaacaggcggcu

SEQ ID NO: 1569175 - RNA, 21 nt, Pseudomonas putida KT2440
ccuagauaagcgacaaaggcg

SEQ ID NO: 1569176 - RNA, 14 nt, Pseudomonas putida KT2440
ccuacccaggcaac

SEQ ID NO: 1569177 - RNA, 19 nt, Pseudomonas putida KT2440
ccuacgcccccagccuuga

SEQ ID NO: 1569178 - RNA, 15 nt, Pseudomonas putida KT2440
ccuacgacgggcuga

SEQ ID NO: 1569179 - RNA, 18 nt, Pseudomonas putida KT2440
ccugcagccguugcuggg

SEQ ID NO: 1569180 - RNA, 17 nt, Pseudomonas putida KT2440
ccugcagagcucagcgu

SEQ ID NO: 1569181 - RNA, 13 nt, Pseudomonas putida KT2440
ccugauugccugg

SEQ ID NO: 1569182 - RNA, 20 nt, Pseudomonas putida KT2440
ccugcacuaccucgcucagg

SEQ ID NO: 1569183 - RNA, 20 nt, Pseudomonas putida KT2440
ccugcacuggccucuucgcg

SEQ ID NO: 1569184 - RNA, 15 nt, Pseudomonas putida KT2440
ccugcacugggcgaa

SEQ ID NO: 1569185 - RNA, 22 nt, Pseudomonas putida KT2440
ccugcaugcucaucgcggccga

SEQ ID NO: 1569186 - RNA, 19 nt, Pseudomonas putida KT2440
ccugcauccacaccagcgg

SEQ ID NO: 1569187 - RNA, 22 nt, Pseudomonas putida KT2440
ccugcagcucagccagcaagcg

SEQ ID NO: 1569188 - RNA, 18 nt, Pseudomonas putida KT2440
ccugcagcgcgucauccg

SEQ ID NO: 1569189 - RNA, 13 nt, Pseudomonas putida KT2440
ccugcagcggcaa

SEQ ID NO: 1569190 - RNA, 15 nt, Pseudomonas putida KT2440
ccugccagccuucga

SEQ ID NO: 1569191 - RNA, 21 nt, Pseudomonas putida KT2440
ccugcccgaucgccucgcugg

SEQ ID NO: 1569192 - RNA, 17 nt, Pseudomonas putida KT2440
ccugcccggcguucagg

SEQ ID NO: 1569193 - RNA, 18 nt, Pseudomonas putida KT2440
ccugcccgggaacggcug

SEQ ID NO: 1569194 - RNA, 21 nt, Pseudomonas putida KT2440
ccugccccagcaucaacgcug

SEQ ID NO: 1569195 - RNA, 23 nt, Pseudomonas putida KT2440
ccugaucagacuuugcggacgaa

SEQ ID NO: 1569196 - RNA, 19 nt, Pseudomonas putida KT2440
ccugacacauaggcagcca

SEQ ID NO: 1569197 - RNA, 20 nt, Pseudomonas putida KT2440
ccucggcgccauaggcuugc

SEQ ID NO: 1569198 - RNA, 18 nt, Pseudomonas putida KT2440
ccucuggcgugcaccugu

SEQ ID NO: 1569199 - RNA, 14 nt, Pseudomonas putida KT2440
ccucugugggagcg

SEQ ID NO: 1569200 - RNA, 22 nt, Pseudomonas putida KT2440
ccucuucaccgucggcgcugau

SEQ ID NO: 1569201 - RNA, 22 nt, Pseudomonas putida KT2440
ccucgguggcucuccucuccca

SEQ ID NO: 1569202 - RNA, 13 nt, Pseudomonas putida KT2440
ccucguaggagcg

SEQ ID NO: 1569203 - RNA, 18 nt, Pseudomonas putida KT2440
ccucuucgcggguaaacc

SEQ ID NO: 1569204 - RNA, 19 nt, Pseudomonas putida KT2440
ccucuucgcgggugaaccc

SEQ ID NO: 1569205 - RNA, 12 nt, Pseudomonas putida KT2440
ccucuugcugca

SEQ ID NO: 1569206 - RNA, 18 nt, Pseudomonas putida KT2440
ccugaacaaggccuggcc

SEQ ID NO: 1569207 - RNA, 20 nt, Pseudomonas putida KT2440
ccugaacaaggccuggccca

SEQ ID NO: 1569208 - RNA, 16 nt, Pseudomonas putida KT2440
ccugaacgaugcccgg

SEQ ID NO: 1569209 - RNA, 18 nt, Pseudomonas putida KT2440
ccgauagcgugaagcggc

SEQ ID NO: 1569210 - RNA, 13 nt, Pseudomonas putida KT2440
ccgauacagcgcg

SEQ ID NO: 1569211 - RNA, 21 nt, Pseudomonas putida KT2440
ccgauacagcgcgccgccgau

SEQ ID NO: 1569212 - RNA, 16 nt, Pseudomonas putida KT2440
ccgaucacaccggcaa

SEQ ID NO: 1569213 - RNA, 16 nt, Pseudomonas putida KT2440
ccgaucauugcugcgg

SEQ ID NO: 1569214 - RNA, 23 nt, Pseudomonas putida KT2440
ccgaucauugcugcgguaccggc

SEQ ID NO: 1569215 - RNA, 17 nt, Pseudomonas putida KT2440
ccgaucgccucgcuggc

SEQ ID NO: 1569216 - RNA, 23 nt, Pseudomonas putida KT2440
ccgauccucugugggagcggccu

SEQ ID NO: 1569217 - RNA, 14 nt, Pseudomonas putida KT2440
ccgauccuuggcga

SEQ ID NO: 1569218 - RNA, 16 nt, Pseudomonas putida KT2440
ccgaucgaagcagcag

SEQ ID NO: 1569219 - RNA, 17 nt, Pseudomonas putida KT2440
ccgaucgaagcagcagc

SEQ ID NO: 1569220 - RNA, 19 nt, Pseudomonas putida KT2440
ccgauuccuugcagcgccg

SEQ ID NO: 1569221 - RNA, 17 nt, Pseudomonas putida KT2440
ccgauuccaagguauca

SEQ ID NO: 1569222 - RNA, 22 nt, Pseudomonas putida KT2440
ccgaugucggcgugcaccacgg

SEQ ID NO: 1569223 - RNA, 16 nt, Pseudomonas putida KT2440
ccgaugaguugucugc

SEQ ID NO: 1569224 - RNA, 18 nt, Pseudomonas putida KT2440
ccgaugaguugucugccg

SEQ ID NO: 1569225 - RNA, 21 nt, Pseudomonas putida KT2440
ccgaugaguugucugccgaag

SEQ ID NO: 1569226 - RNA, 16 nt, Pseudomonas putida KT2440
ccgaugaagcaggccg

SEQ ID NO: 1569227 - RNA, 18 nt, Pseudomonas putida KT2440
ccgaugaagcaggccgag

SEQ ID NO: 1569228 - RNA, 20 nt, Pseudomonas putida KT2440
ccgcaccacgggcggcucac

SEQ ID NO: 1569229 - RNA, 23 nt, Pseudomonas putida KT2440
ccgcacaucacggcgcaggccga

SEQ ID NO: 1569230 - RNA, 22 nt, Pseudomonas putida KT2440
ccgcaacacauuauccaccagg

SEQ ID NO: 1569231 - RNA, 22 nt, Pseudomonas putida KT2440
ccgcaacaccugccgcagcugg

SEQ ID NO: 1569232 - RNA, 13 nt, Pseudomonas putida KT2440
ccgcaacccagcc

SEQ ID NO: 1569233 - RNA, 17 nt, Pseudomonas putida KT2440
ccgcaacccagccccag

SEQ ID NO: 1569234 - RNA, 15 nt, Pseudomonas putida KT2440
ccgcaaccgaugaac

SEQ ID NO: 1569235 - RNA, 22 nt, Pseudomonas putida KT2440
ccgcaacgcaucguccuugcag

SEQ ID NO: 1569236 - RNA, 23 nt, Pseudomonas putida KT2440
ccgccaccuuguucgagcgccau

SEQ ID NO: 1569237 - RNA, 22 nt, Pseudomonas putida KT2440
ccgccagaucaucggguagcga

SEQ ID NO: 1569238 - RNA, 21 nt, Pseudomonas putida KT2440
ccgccagacuucauaggcugg

SEQ ID NO: 1569239 - RNA, 18 nt, Pseudomonas putida KT2440
ccgcauuggccgggucga

SEQ ID NO: 1569240 - RNA, 13 nt, Pseudomonas putida KT2440
ccgcauccagcac

SEQ ID NO: 1569241 - RNA, 18 nt, Pseudomonas putida KT2440
ccgccaccccaggccacu

SEQ ID NO: 1569242 - RNA, 16 nt, Pseudomonas putida KT2440
ccgccaaaccccagca

SEQ ID NO: 1569243 - RNA, 19 nt, Pseudomonas putida KT2440
ccgccaaaccccagcaagg

SEQ ID NO: 1569244 - RNA, 23 nt, Pseudomonas putida KT2440
ccgccaggaagucgauguucagc

SEQ ID NO: 1569245 - RNA, 22 nt, Pseudomonas putida KT2440
ccgccaggauggcaccgaucac

SEQ ID NO: 1569246 - RNA, 20 nt, Pseudomonas putida KT2440
ccgccagcgugcccgccaca

SEQ ID NO: 1569247 - RNA, 15 nt, Pseudomonas putida KT2440
ccgccaggcggucgc

SEQ ID NO: 1569248 - RNA, 18 nt, Pseudomonas putida KT2440
ccgccaggcucuccagcc

SEQ ID NO: 1569249 - RNA, 23 nt, Pseudomonas putida KT2440
ccgccauaucaggauugccgcag

SEQ ID NO: 1569250 - RNA, 16 nt, Pseudomonas putida KT2440
ccgccagcccgccaca

SEQ ID NO: 1569251 - RNA, 22 nt, Pseudomonas putida KT2440
ccgccagcccgccacaccgaag

SEQ ID NO: 1569252 - RNA, 15 nt, Pseudomonas putida KT2440
ccgccagcggcaagc

SEQ ID NO: 1569253 - RNA, 17 nt, Pseudomonas putida KT2440
ccgccagcgcuccagca

SEQ ID NO: 1569254 - RNA, 17 nt, Pseudomonas putida KT2440
ccgccagcaauugcgag

SEQ ID NO: 1569255 - RNA, 21 nt, Pseudomonas putida KT2440
ccgcauaucauagaucucgac

SEQ ID NO: 1569256 - RNA, 18 nt, Pseudomonas putida KT2440
ccgcaucaaacgaugcgg

SEQ ID NO: 1569257 - RNA, 16 nt, Pseudomonas putida KT2440
ccgcauauacgccggc

SEQ ID NO: 1569258 - RNA, 16 nt, Pseudomonas putida KT2440
ccgcaucaucacgcgc

SEQ ID NO: 1569259 - RNA, 19 nt, Pseudomonas putida KT2440
ccgcagugaaguugcggca

SEQ ID NO: 1569260 - RNA, 15 nt, Pseudomonas putida KT2440
ccgcagugcacgcgg

SEQ ID NO: 1569261 - RNA, 16 nt, Pseudomonas putida KT2440
ccgcagguccaccugg

SEQ ID NO: 1569262 - RNA, 22 nt, Pseudomonas putida KT2440
ccgcaguacuuauaagcagcaa

SEQ ID NO: 1569263 - RNA, 20 nt, Pseudomonas putida KT2440
ccgcagucccgccauauucg

SEQ ID NO: 1569264 - RNA, 16 nt, Pseudomonas putida KT2440
ccgcagucccguuggc

SEQ ID NO: 1569265 - RNA, 18 nt, Pseudomonas putida KT2440
ccgcagucccguuggccc

SEQ ID NO: 1569266 - RNA, 17 nt, Pseudomonas putida KT2440
ccgcaggggcugcgcaa

SEQ ID NO: 1569267 - RNA, 18 nt, Pseudomonas putida KT2440
ccgcaggaauaacuggcc

SEQ ID NO: 1569268 - RNA, 22 nt, Pseudomonas putida KT2440
ccgcaggaauaacuggcccgaa

SEQ ID NO: 1569269 - RNA, 20 nt, Pseudomonas putida KT2440
ccgcagcuucaacuccacca

SEQ ID NO: 1569270 - RNA, 17 nt, Pseudomonas putida KT2440
ccgcagcugcggucgag

SEQ ID NO: 1569271 - RNA, 12 nt, Pseudomonas putida KT2440
ccgcacccagca

SEQ ID NO: 1569272 - RNA, 15 nt, Pseudomonas putida KT2440
ccgcacccaggugcg

SEQ ID NO: 1569273 - RNA, 15 nt, Pseudomonas putida KT2440
ccgcaccagaccagc

SEQ ID NO: 1569274 - RNA, 16 nt, Pseudomonas putida KT2440
ccgcaccagaccagca

SEQ ID NO: 1569275 - RNA, 17 nt, Pseudomonas putida KT2440
ccgagcauuacaggcag

SEQ ID NO: 1569276 - RNA, 22 nt, Pseudomonas putida KT2440
ccgagcauuacaggcagaucga

SEQ ID NO: 1569277 - RNA, 13 nt, Pseudomonas putida KT2440
ccgagccuuccgg

SEQ ID NO: 1569278 - RNA, 20 nt, Pseudomonas putida KT2440
ccgagcgagugaccuuggcu

SEQ ID NO: 1569279 - RNA, 20 nt, Pseudomonas putida KT2440
ccgagcgccgugcucggccu

SEQ ID NO: 1569280 - RNA, 19 nt, Pseudomonas putida KT2440
ccgagcgcggcgcccagca

SEQ ID NO: 1569281 - RNA, 16 nt, Pseudomonas putida KT2440
ccgagcugcccaagua

SEQ ID NO: 1569282 - RNA, 17 nt, Pseudomonas putida KT2440
ccgagcugauccgccug

SEQ ID NO: 1569283 - RNA, 21 nt, Pseudomonas putida KT2440
ccgaggcgaauggcaggugau

SEQ ID NO: 1569284 - RNA, 15 nt, Pseudomonas putida KT2440
ccgaggccggguuuu

SEQ ID NO: 1569285 - RNA, 20 nt, Pseudomonas putida KT2440
ccgagggugaggugcugcag

SEQ ID NO: 1569286 - RNA, 18 nt, Pseudomonas putida KT2440
ccgaggucugcgcgggaa

SEQ ID NO: 1569287 - RNA, 23 nt, Pseudomonas putida KT2440
ccgaguaccgucggcacgagcau

SEQ ID NO: 1569288 - RNA, 14 nt, Pseudomonas putida KT2440
ccgaguaaccggcg

SEQ ID NO: 1569289 - RNA, 16 nt, Pseudomonas putida KT2440
ccgagugcccgcgcag

SEQ ID NO: 1569290 - RNA, 13 nt, Pseudomonas putida KT2440
ccgaguugccggu

SEQ ID NO: 1569291 - RNA, 19 nt, Pseudomonas putida KT2440
ccgauaaagguugcccggc

SEQ ID NO: 1569292 - RNA, 21 nt, Pseudomonas putida KT2440
ccgagaagcagaacaucaggu

SEQ ID NO: 1569293 - RNA, 18 nt, Pseudomonas putida KT2440
ccgagaugaucgcggcaa

SEQ ID NO: 1569294 - RNA, 21 nt, Pseudomonas putida KT2440
ccgagcaaggcgcagccaauc

SEQ ID NO: 1569295 - RNA, 22 nt, Pseudomonas putida KT2440
ccgacuagauaaccaaccccug

SEQ ID NO: 1569296 - RNA, 20 nt, Pseudomonas putida KT2440
ccgacucuacugcccgcagc

SEQ ID NO: 1569297 - RNA, 19 nt, Pseudomonas putida KT2440
ccgacuccaacgcgccgau

SEQ ID NO: 1569298 - RNA, 13 nt, Pseudomonas putida KT2440
ccgacuggcuggc

SEQ ID NO: 1569299 - RNA, 18 nt, Pseudomonas putida KT2440
ccgacgccggccugccgc

SEQ ID NO: 1569300 - RNA, 15 nt, Pseudomonas putida KT2440
ccgacgccgaucaau

SEQ ID NO: 1569301 - RNA, 18 nt, Pseudomonas putida KT2440
ccgacaagccacguucug

SEQ ID NO: 1569302 - RNA, 18 nt, Pseudomonas putida KT2440
ccgacaacagcaugcuca

SEQ ID NO: 1569303 - RNA, 12 nt, Pseudomonas putida KT2440
ccgacaacagcu

SEQ ID NO: 1569304 - RNA, 17 nt, Pseudomonas putida KT2440
ccgacaaagaagcgccg

SEQ ID NO: 1569305 - RNA, 22 nt, Pseudomonas putida KT2440
ccgacaaagaagcgccgcaggu

SEQ ID NO: 1569306 - RNA, 19 nt, Pseudomonas putida KT2440
ccgacaacgguguggccag

SEQ ID NO: 1569307 - RNA, 15 nt, Pseudomonas putida KT2440
ccgacaaugccagca

SEQ ID NO: 1569308 - RNA, 17 nt, Pseudomonas putida KT2440
ccgacggcauggccgaa

SEQ ID NO: 1569309 - RNA, 18 nt, Pseudomonas putida KT2440
ccgacggcauggccgaag

SEQ ID NO: 1569310 - RNA, 14 nt, Pseudomonas putida KT2440
ccgcggaucgcgcc

SEQ ID NO: 1569311 - RNA, 19 nt, Pseudomonas putida KT2440
ccgcgccuacgacggccug

SEQ ID NO: 1569312 - RNA, 22 nt, Pseudomonas putida KT2440
ccgcgccuacgacggccugcgc

SEQ ID NO: 1569313 - RNA, 19 nt, Pseudomonas putida KT2440
ccgcgccuacagcggccug

SEQ ID NO: 1569314 - RNA, 16 nt, Pseudomonas putida KT2440
ccgcgccuacaggcaa

SEQ ID NO: 1569315 - RNA, 23 nt, Pseudomonas putida KT2440
ccgcgcaucauccaccacccugg

SEQ ID NO: 1569316 - RNA, 15 nt, Pseudomonas putida KT2440
ccgcgccgcccagcu

SEQ ID NO: 1569317 - RNA, 14 nt, Pseudomonas putida KT2440
ccgcgccuugcgca

SEQ ID NO: 1569318 - RNA, 17 nt, Pseudomonas putida KT2440
ccgcucgaacaagcgcg

SEQ ID NO: 1569319 - RNA, 17 nt, Pseudomonas putida KT2440
ccgcuccugcggucagc

SEQ ID NO: 1569320 - RNA, 17 nt, Pseudomonas putida KT2440
ccgcuccucggccguaa

SEQ ID NO: 1569321 - RNA, 20 nt, Pseudomonas putida KT2440
ccgcucguacgucgccuggu

SEQ ID NO: 1569322 - RNA, 18 nt, Pseudomonas putida KT2440
ccgcguuggccaggucga

SEQ ID NO: 1569323 - RNA, 19 nt, Pseudomonas putida KT2440
ccgcuccuacaagguaccc

SEQ ID NO: 1569324 - RNA, 20 nt, Pseudomonas putida KT2440
ccgcuccuacaggauggccg

SEQ ID NO: 1569325 - RNA, 22 nt, Pseudomonas putida KT2440
ccgcuccuacaggauggccgca

SEQ ID NO: 1569326 - RNA, 21 nt, Pseudomonas putida KT2440
ccgcuccuaccggggggcuca

SEQ ID NO: 1569327 - RNA, 18 nt, Pseudomonas putida KT2440
ccgcuccuacggccgaca

SEQ ID NO: 1569328 - RNA, 19 nt, Pseudomonas putida KT2440
ccgcuccuacgggcaaccg

SEQ ID NO: 1569329 - RNA, 24 nt, Pseudomonas putida KT2440
ccgcuccuacgggcgagcgcgcag

SEQ ID NO: 1569330 - RNA, 21 nt, Pseudomonas putida KT2440
ccgcuccuacgggggggcgca

SEQ ID NO: 1569331 - RNA, 19 nt, Pseudomonas putida KT2440
ccgcuccuacuacggccug

SEQ ID NO: 1569332 - RNA, 19 nt, Pseudomonas putida KT2440
ccgcugacaaugcgacuga

SEQ ID NO: 1569333 - RNA, 18 nt, Pseudomonas putida KT2440
ccgcugaccacgccgaag

SEQ ID NO: 1569334 - RNA, 21 nt, Pseudomonas putida KT2440
ccgcugaccgggucgacgcgc

SEQ ID NO: 1569335 - RNA, 17 nt, Pseudomonas putida KT2440
ccgcucucacagggacc

SEQ ID NO: 1569336 - RNA, 19 nt, Pseudomonas putida KT2440
ccgcuggccgcacccagca

SEQ ID NO: 1569337 - RNA, 12 nt, Pseudomonas putida KT2440
ccgcuggccgga

SEQ ID NO: 1569338 - RNA, 11 nt, Pseudomonas putida KT2440
ccgcuggaccu

SEQ ID NO: 1569339 - RNA, 18 nt, Pseudomonas putida KT2440
ccgcuggcauccaccagg

SEQ ID NO: 1569340 - RNA, 20 nt, Pseudomonas putida KT2440
ccgcuggcauccaccagguc

SEQ ID NO: 1569341 - RNA, 20 nt, Pseudomonas putida KT2440
ccgcugcuuccggcugguac

SEQ ID NO: 1569342 - RNA, 14 nt, Pseudomonas putida KT2440
ccgcugcugcggca

SEQ ID NO: 1569343 - RNA, 13 nt, Pseudomonas putida KT2440
ccgcgugacgcgg

SEQ ID NO: 1569344 - RNA, 15 nt, Pseudomonas putida KT2440
ccgcguucacaucgc

SEQ ID NO: 1569345 - RNA, 18 nt, Pseudomonas putida KT2440
ccgcggcugaacacgcuc

SEQ ID NO: 1569346 - RNA, 19 nt, Pseudomonas putida KT2440
ccgcggcugacgaagcgcc

SEQ ID NO: 1569347 - RNA, 21 nt, Pseudomonas putida KT2440
ccgcgguggauggcacgggcu

SEQ ID NO: 1569348 - RNA, 15 nt, Pseudomonas putida KT2440
ccgccggguggguga

SEQ ID NO: 1569349 - RNA, 15 nt, Pseudomonas putida KT2440
ccgccggccauucau

SEQ ID NO: 1569350 - RNA, 17 nt, Pseudomonas putida KT2440
ccgcccuagcgguccgg

SEQ ID NO: 1569351 - RNA, 20 nt, Pseudomonas putida KT2440
ccgcccguaugcauccgcca

SEQ ID NO: 1569352 - RNA, 23 nt, Pseudomonas putida KT2440
ccgcccguaugcauccgccaugg

SEQ ID NO: 1569353 - RNA, 14 nt, Pseudomonas putida KT2440
ccgcccuccagccg

SEQ ID NO: 1569354 - RNA, 13 nt, Pseudomonas putida KT2440
ccgccgacgaugc

SEQ ID NO: 1569355 - RNA, 14 nt, Pseudomonas putida KT2440
ccgcccucuacgaa

SEQ ID NO: 1569356 - RNA, 18 nt, Pseudomonas putida KT2440
ccgccugaaucuugcgcg

SEQ ID NO: 1569357 - RNA, 22 nt, Pseudomonas putida KT2440
ccgccucgucgauguagaugcc

SEQ ID NO: 1569358 - RNA, 16 nt, Pseudomonas putida KT2440
ccgccuccacggucag

SEQ ID NO: 1569359 - RNA, 21 nt, Pseudomonas putida KT2440
ccgccgguuucucgcagcagc

SEQ ID NO: 1569360 - RNA, 13 nt, Pseudomonas putida KT2440
ccgcgaagcggcc

SEQ ID NO: 1569361 - RNA, 19 nt, Pseudomonas putida KT2440
ccgcgaaggcuccagcacc

SEQ ID NO: 1569362 - RNA, 22 nt, Pseudomonas putida KT2440
ccgcgaaggggccggcacaggc

SEQ ID NO: 1569363 - RNA, 20 nt, Pseudomonas putida KT2440
ccgcgaauacgguagcggca

SEQ ID NO: 1569364 - RNA, 19 nt, Pseudomonas putida KT2440
ccgcgaauacggucgcggc

SEQ ID NO: 1569365 - RNA, 16 nt, Pseudomonas putida KT2440
ccgcgaaugggccgca

SEQ ID NO: 1569366 - RNA, 18 nt, Pseudomonas putida KT2440
ccgcgaaucgccuucagc

SEQ ID NO: 1569367 - RNA, 17 nt, Pseudomonas putida KT2440
ccgcgaaucguccugga

SEQ ID NO: 1569368 - RNA, 18 nt, Pseudomonas putida KT2440
ccgcgaagcaggcgacgc

SEQ ID NO: 1569369 - RNA, 14 nt, Pseudomonas putida KT2440
ccgcgaagcaggcu

SEQ ID NO: 1569370 - RNA, 14 nt, Pseudomonas putida KT2440
ccgcgaagcagaca

SEQ ID NO: 1569371 - RNA, 18 nt, Pseudomonas putida KT2440
ccgcgaagcagacaacgc

SEQ ID NO: 1569372 - RNA, 20 nt, Pseudomonas putida KT2440
ccgcgaagaagacaccgcgg

SEQ ID NO: 1569373 - RNA, 22 nt, Pseudomonas putida KT2440
ccgcgaagaggccagcacaggc

SEQ ID NO: 1569374 - RNA, 21 nt, Pseudomonas putida KT2440
ccgcgaagaggccaguaccag

SEQ ID NO: 1569375 - RNA, 16 nt, Pseudomonas putida KT2440
ccgcgaagaggcccga

SEQ ID NO: 1569376 - RNA, 17 nt, Pseudomonas putida KT2440
ccgcgaagaggccggca

SEQ ID NO: 1569377 - RNA, 18 nt, Pseudomonas putida KT2440
ccgcgaagaggccggcaa

SEQ ID NO: 1569378 - RNA, 19 nt, Pseudomonas putida KT2440
ccgcgaagagggcgacacc

SEQ ID NO: 1569379 - RNA, 18 nt, Pseudomonas putida KT2440
ccgcgaaacacagcaggc

SEQ ID NO: 1569380 - RNA, 17 nt, Pseudomonas putida KT2440
ccgcgaaagggccagca

SEQ ID NO: 1569381 - RNA, 17 nt, Pseudomonas putida KT2440
ccgcgaaagggccagua

SEQ ID NO: 1569382 - RNA, 12 nt, Pseudomonas putida KT2440
ccgccugcgcac

SEQ ID NO: 1569383 - RNA, 15 nt, Pseudomonas putida KT2440
ccgccugcgccagcg

SEQ ID NO: 1569384 - RNA, 18 nt, Pseudomonas putida KT2440
ccgcgcaaaucgccgcau

SEQ ID NO: 1569385 - RNA, 20 nt, Pseudomonas putida KT2440
ccgcgaugccgacagccacc

SEQ ID NO: 1569386 - RNA, 13 nt, Pseudomonas putida KT2440
ccgcgcagcggcc

SEQ ID NO: 1569387 - RNA, 14 nt, Pseudomonas putida KT2440
ccgcgcagcuucca

SEQ ID NO: 1569388 - RNA, 13 nt, Pseudomonas putida KT2440
ccgcgcaggcggc

SEQ ID NO: 1569389 - RNA, 16 nt, Pseudomonas putida KT2440
ccgcgauaucagcgcc

SEQ ID NO: 1569390 - RNA, 14 nt, Pseudomonas putida KT2440
cgaacugaugaccg

SEQ ID NO: 1569391 - RNA, 18 nt, Pseudomonas putida KT2440
cgaagcccgugccaucca

SEQ ID NO: 1569392 - RNA, 22 nt, Pseudomonas putida KT2440
cgaagccgacccgggccagcca

SEQ ID NO: 1569393 - RNA, 22 nt, Pseudomonas putida KT2440
cgaagccguugaggccgaacac

SEQ ID NO: 1569394 - RNA, 19 nt, Pseudomonas putida KT2440
cgaaggcaauguggccgau

SEQ ID NO: 1569395 - RNA, 21 nt, Pseudomonas putida KT2440
cgaagcuugcagucaccuggc

SEQ ID NO: 1569396 - RNA, 15 nt, Pseudomonas putida KT2440
cgaagcuaucgccag

SEQ ID NO: 1569397 - RNA, 21 nt, Pseudomonas putida KT2440
cgaagcugucuucuuucgaca

SEQ ID NO: 1569398 - RNA, 19 nt, Pseudomonas putida KT2440
cgaacguuucgucauccac

SEQ ID NO: 1569399 - RNA, 20 nt, Pseudomonas putida KT2440
cgaacuccgcgagggcauca

SEQ ID NO: 1569400 - RNA, 16 nt, Pseudomonas putida KT2440
cgaacuccccaccagg

SEQ ID NO: 1569401 - RNA, 18 nt, Pseudomonas putida KT2440
cgaacucaugcuccugcg

SEQ ID NO: 1569402 - RNA, 23 nt, Pseudomonas putida KT2440
cgaacacaaucgguucgcccggu

SEQ ID NO: 1569403 - RNA, 19 nt, Pseudomonas putida KT2440
cgaacaacggcagcgacag

SEQ ID NO: 1569404 - RNA, 20 nt, Pseudomonas putida KT2440
cgaacaccggcagagccggu

SEQ ID NO: 1569405 - RNA, 14 nt, Pseudomonas putida KT2440
cgaaccuacgacca

SEQ ID NO: 1569406 - RNA, 22 nt, Pseudomonas putida KT2440
cgaaccuggcguacccgucgcu

SEQ ID NO: 1569407 - RNA, 15 nt, Pseudomonas putida KT2440
cgaaccggcgaucag

SEQ ID NO: 1569408 - RNA, 17 nt, Pseudomonas putida KT2440
cgaaccggcgcuggcca

SEQ ID NO: 1569409 - RNA, 22 nt, Pseudomonas putida KT2440
cgaaccggcgcuggccaggcuu

SEQ ID NO: 1569410 - RNA, 14 nt, Pseudomonas putida KT2440
cgaauugacccagu

SEQ ID NO: 1569411 - RNA, 21 nt, Pseudomonas putida KT2440
cgacaaaugccgguuugcggc

SEQ ID NO: 1569412 - RNA, 14 nt, Pseudomonas putida KT2440
cgacaaaucccgca

SEQ ID NO: 1569413 - RNA, 19 nt, Pseudomonas putida KT2440
cgaauuucugcaacagcuc

SEQ ID NO: 1569414 - RNA, 17 nt, Pseudomonas putida KT2440
cgacaacccgcgcugcc

SEQ ID NO: 1569415 - RNA, 16 nt, Pseudomonas putida KT2440
cgacaacagcaugcuc

SEQ ID NO: 1569416 - RNA, 13 nt, Pseudomonas putida KT2440
cgacaacggcugg

SEQ ID NO: 1569417 - RNA, 17 nt, Pseudomonas putida KT2440
cgaaggcuccagcaccg

SEQ ID NO: 1569418 - RNA, 18 nt, Pseudomonas putida KT2440
cgaaggccgccggcaacu

SEQ ID NO: 1569419 - RNA, 15 nt, Pseudomonas putida KT2440
cgaaggccuuggcca

SEQ ID NO: 1569420 - RNA, 17 nt, Pseudomonas putida KT2440
cgaauagcgcgagcugg

SEQ ID NO: 1569421 - RNA, 20 nt, Pseudomonas putida KT2440
cgaauccagcaggcuugcca

SEQ ID NO: 1569422 - RNA, 18 nt, Pseudomonas putida KT2440
cgaaucagcgccuccagg

SEQ ID NO: 1569423 - RNA, 16 nt, Pseudomonas putida KT2440
cgaaucaagccugcgc

SEQ ID NO: 1569424 - RNA, 21 nt, Pseudomonas putida KT2440
cgaauaucgccgaacgggcca

SEQ ID NO: 1569425 - RNA, 20 nt, Pseudomonas putida KT2440
cgacauccagcgccgccaug

SEQ ID NO: 1569426 - RNA, 22 nt, Pseudomonas putida KT2440
cgacauccagcgccgccaugca

SEQ ID NO: 1569427 - RNA, 22 nt, Pseudomonas putida KT2440
cgacaucgaagcagugcugcca

SEQ ID NO: 1569428 - RNA, 20 nt, Pseudomonas putida KT2440
cgacaggugccucugcugcg

SEQ ID NO: 1569429 - RNA, 18 nt, Pseudomonas putida KT2440
cgacaggugcggcagcuc

SEQ ID NO: 1569430 - RNA, 16 nt, Pseudomonas putida KT2440
cgacagguccaccgcu

SEQ ID NO: 1569431 - RNA, 17 nt, Pseudomonas putida KT2440
cgacagguccaccgcuu

SEQ ID NO: 1569432 - RNA, 18 nt, Pseudomonas putida KT2440
cgacagcaucaucaggcc

SEQ ID NO: 1569433 - RNA, 19 nt, Pseudomonas putida KT2440
cgacagcaucggcagguca

SEQ ID NO: 1569434 - RNA, 13 nt, Pseudomonas putida KT2440
cgacaggccguga

SEQ ID NO: 1569435 - RNA, 23 nt, Pseudomonas putida KT2440
cgacaggcuguguggccggccau

SEQ ID NO: 1569436 - RNA, 15 nt, Pseudomonas putida KT2440
cgacaggggcgcaga

SEQ ID NO: 1569437 - RNA, 18 nt, Pseudomonas putida KT2440
cgacagguaguuggccgg

SEQ ID NO: 1569438 - RNA, 17 nt, Pseudomonas putida KT2440
cgacaagguacucagcg

SEQ ID NO: 1569439 - RNA, 20 nt, Pseudomonas putida KT2440
cgacaagguagcggccagcc

SEQ ID NO: 1569440 - RNA, 23 nt, Pseudomonas putida KT2440
cgacaagauaacaccccccagca

SEQ ID NO: 1569441 - RNA, 15 nt, Pseudomonas putida KT2440
cgacaaucgccaggu

SEQ ID NO: 1569442 - RNA, 19 nt, Pseudomonas putida KT2440
cgacaauacgcacauagcc

SEQ ID NO: 1569443 - RNA, 14 nt, Pseudomonas putida KT2440
cgacaaugccagca

SEQ ID NO: 1569444 - RNA, 14 nt, Pseudomonas putida KT2440
cgacacagucgucg

SEQ ID NO: 1569445 - RNA, 19 nt, Pseudomonas putida KT2440
cgacacagucgucggcacg

SEQ ID NO: 1569446 - RNA, 22 nt, Pseudomonas putida KT2440
cgacacuuacgauuucagcggu

SEQ ID NO: 1569447 - RNA, 18 nt, Pseudomonas putida KT2440
cgacacugaucucgcgca

SEQ ID NO: 1569448 - RNA, 22 nt, Pseudomonas putida KT2440
cgacagcacgggcacacuggcc

SEQ ID NO: 1569449 - RNA, 23 nt, Pseudomonas putida KT2440
cgacagcacgggcacacuggcca

SEQ ID NO: 1569450 - RNA, 16 nt, Pseudomonas putida KT2440
ccuugaguucccaggc

SEQ ID NO: 1569451 - RNA, 20 nt, Pseudomonas putida KT2440
ccuugaguucccaggcagcc

SEQ ID NO: 1569452 - RNA, 23 nt, Pseudomonas putida KT2440
ccuugaucaggaaggcgucguac

SEQ ID NO: 1569453 - RNA, 12 nt, Pseudomonas putida KT2440
ccuugauacgcc

SEQ ID NO: 1569454 - RNA, 19 nt, Pseudomonas putida KT2440
ccuugccccgcaggccgcc

SEQ ID NO: 1569455 - RNA, 23 nt, Pseudomonas putida KT2440
ccuucgccaagguccagccacga

SEQ ID NO: 1569456 - RNA, 18 nt, Pseudomonas putida KT2440
ccuucgcgggcacgcccg

SEQ ID NO: 1569457 - RNA, 13 nt, Pseudomonas putida KT2440
ccuucgcgggcuc

SEQ ID NO: 1569458 - RNA, 19 nt, Pseudomonas putida KT2440
ccuucaggcgcucaccccg

SEQ ID NO: 1569459 - RNA, 15 nt, Pseudomonas putida KT2440
ccuucaggcgcuggu

SEQ ID NO: 1569460 - RNA, 12 nt, Pseudomonas putida KT2440
ccuucaucgccg

SEQ ID NO: 1569461 - RNA, 12 nt, Pseudomonas putida KT2440
ccuucagcagcc

SEQ ID NO: 1569462 - RNA, 15 nt, Pseudomonas putida KT2440
ccuucaccaccaggu

SEQ ID NO: 1569463 - RNA, 19 nt, Pseudomonas putida KT2440
ccuguaguacacgaggaua

SEQ ID NO: 1569464 - RNA, 17 nt, Pseudomonas putida KT2440
ccuguagccccgcuggu

SEQ ID NO: 1569465 - RNA, 12 nt, Pseudomonas putida KT2440
ccuguaggagcg

SEQ ID NO: 1569466 - RNA, 16 nt, Pseudomonas putida KT2440
ccuguaggagcgggcu

SEQ ID NO: 1569467 - RNA, 17 nt, Pseudomonas putida KT2440
ccuguaggagcgggcuu

SEQ ID NO: 1569468 - RNA, 19 nt, Pseudomonas putida KT2440
ccuguaggagcggguuuac

SEQ ID NO: 1569469 - RNA, 23 nt, Pseudomonas putida KT2440
ccuguaggagcggguuuacccgc

SEQ ID NO: 1569470 - RNA, 18 nt, Pseudomonas putida KT2440
ccuguaggaucggguuua

SEQ ID NO: 1569471 - RNA, 19 nt, Pseudomonas putida KT2440
ccuguaggaucggguuuac

SEQ ID NO: 1569472 - RNA, 19 nt, Pseudomonas putida KT2440
ccuguaggcgcggguuugc

SEQ ID NO: 1569473 - RNA, 16 nt, Pseudomonas putida KT2440
ccuguccaggcaauca

SEQ ID NO: 1569474 - RNA, 20 nt, Pseudomonas putida KT2440
ccuguccaggcaaucacuga

SEQ ID NO: 1569475 - RNA, 16 nt, Pseudomonas putida KT2440
ccuuggcagcgcugca

SEQ ID NO: 1569476 - RNA, 15 nt, Pseudomonas putida KT2440
ccuuggacgcuggca

SEQ ID NO: 1569477 - RNA, 21 nt, Pseudomonas putida KT2440
ccuugcuguagcccaccaggu

SEQ ID NO: 1569478 - RNA, 16 nt, Pseudomonas putida KT2440
ccuuggacaccaggcu

SEQ ID NO: 1569479 - RNA, 14 nt, Pseudomonas putida KT2440
ccuugccagugauc

SEQ ID NO: 1569480 - RNA, 16 nt, Pseudomonas putida KT2440
ccuugcugcagcaggc

SEQ ID NO: 1569481 - RNA, 17 nt, Pseudomonas putida KT2440
ccuugcugcagcaggcu

SEQ ID NO: 1569482 - RNA, 20 nt, Pseudomonas putida KT2440
ccuugcuggaacugcugcac

SEQ ID NO: 1569483 - RNA, 14 nt, Pseudomonas putida KT2440
ccuugcucggccag

SEQ ID NO: 1569484 - RNA, 17 nt, Pseudomonas putida KT2440
ccuugcucggccagccg

SEQ ID NO: 1569485 - RNA, 23 nt, Pseudomonas putida KT2440
ccuugcgugccucagccaggcug

SEQ ID NO: 1569486 - RNA, 13 nt, Pseudomonas putida KT2440
cgaaaaaccgcuc

SEQ ID NO: 1569487 - RNA, 22 nt, Pseudomonas putida KT2440
ccuuucgcgccaguucgacgcu

SEQ ID NO: 1569488 - RNA, 17 nt, Pseudomonas putida KT2440
ccuuucgcggguaaacc

SEQ ID NO: 1569489 - RNA, 20 nt, Pseudomonas putida KT2440
ccuuucugcuuccacucggu

SEQ ID NO: 1569490 - RNA, 18 nt, Pseudomonas putida KT2440
ccuuuauuacuagauggc

SEQ ID NO: 1569491 - RNA, 24 nt, Pseudomonas putida KT2440
cgaaacgcaggcucugcgccagca

SEQ ID NO: 1569492 - RNA, 17 nt, Pseudomonas putida KT2440
cgaaaccgucaugcaga

SEQ ID NO: 1569493 - RNA, 20 nt, Pseudomonas putida KT2440
cgaaaccaugcaggucgacg

SEQ ID NO: 1569494 - RNA, 16 nt, Pseudomonas putida KT2440
cgaaaaggccugcacu

SEQ ID NO: 1569495 - RNA, 13 nt, Pseudomonas putida KT2440
cgaaacaccagca

SEQ ID NO: 1569496 - RNA, 13 nt, Pseudomonas putida KT2440
cgaaagggccgca

SEQ ID NO: 1569497 - RNA, 20 nt, Pseudomonas putida KT2440
ccugggaagcugcagcagcu

SEQ ID NO: 1569498 - RNA, 14 nt, Pseudomonas putida KT2440
ccuggggcaggccc

SEQ ID NO: 1569499 - RNA, 23 nt, Pseudomonas putida KT2440
ccugggcuucaugcugcugcagc

SEQ ID NO: 1569500 - RNA, 13 nt, Pseudomonas putida KT2440
ccugggucagcug

SEQ ID NO: 1569501 - RNA, 22 nt, Pseudomonas putida KT2440
ccuggguuacggcggccugcug

SEQ ID NO: 1569502 - RNA, 18 nt, Pseudomonas putida KT2440
ccugggucugcgggucgu

SEQ ID NO: 1569503 - RNA, 17 nt, Pseudomonas putida KT2440
ccuggggguggguugac

SEQ ID NO: 1569504 - RNA, 16 nt, Pseudomonas putida KT2440
ccuggugccagcggcc

SEQ ID NO: 1569505 - RNA, 23 nt, Pseudomonas putida KT2440
ccuggucuucguuacgcccggca

SEQ ID NO: 1569506 - RNA, 13 nt, Pseudomonas putida KT2440
ccugguuggccag

SEQ ID NO: 1569507 - RNA, 20 nt, Pseudomonas putida KT2440
ccuguaccggccuuuucgcg

SEQ ID NO: 1569508 - RNA, 12 nt, Pseudomonas putida KT2440
ccuguacccgcu

SEQ ID NO: 1569509 - RNA, 20 nt, Pseudomonas putida KT2440
ccuguaacucagcuuacgcc

SEQ ID NO: 1569510 - RNA, 19 nt, Pseudomonas putida KT2440
ccuguagagcgccuugucg

SEQ ID NO: 1569511 - RNA, 12 nt, Pseudomonas putida KT2440
ccuggcgacacu

SEQ ID NO: 1569512 - RNA, 16 nt, Pseudomonas putida KT2440
ccuggccguguucgac

SEQ ID NO: 1569513 - RNA, 16 nt, Pseudomonas putida KT2440
ccuggcucgaucacga

SEQ ID NO: 1569514 - RNA, 21 nt, Pseudomonas putida KT2440
ccuggcucuucaacaccagca

SEQ ID NO: 1569515 - RNA, 23 nt, Pseudomonas putida KT2440
ccuggcugcgggugcccgggcuu

SEQ ID NO: 1569516 - RNA, 18 nt, Pseudomonas putida KT2440
ccuggcggcccgccggca

SEQ ID NO: 1569517 - RNA, 20 nt, Pseudomonas putida KT2440
ccuggcggaacgacagcuug

SEQ ID NO: 1569518 - RNA, 16 nt, Pseudomonas putida KT2440
ccuggcgcaguucguc

SEQ ID NO: 1569519 - RNA, 21 nt, Pseudomonas putida KT2440
ccuggcgguaaacguggucag

SEQ ID NO: 1569520 - RNA, 16 nt, Pseudomonas putida KT2440
ccugccgaggccaugu

SEQ ID NO: 1569521 - RNA, 18 nt, Pseudomonas putida KT2440
ccugccgcgauaagcgcg

SEQ ID NO: 1569522 - RNA, 23 nt, Pseudomonas putida KT2440
ccugccgcugauaaccugcauug

SEQ ID NO: 1569523 - RNA, 15 nt, Pseudomonas putida KT2440
ccuggccgcugcgcc

SEQ ID NO: 1569524 - RNA, 22 nt, Pseudomonas putida KT2440
ccuggcccgccgccaccagcgc

SEQ ID NO: 1569525 - RNA, 19 nt, Pseudomonas putida KT2440
ccugccuugcgauaccccg

SEQ ID NO: 1569526 - RNA, 19 nt, Pseudomonas putida KT2440
ccuggcccgaacgcagcgc

SEQ ID NO: 1569527 - RNA, 14 nt, Pseudomonas putida KT2440
ccugccuggcccuc

SEQ ID NO: 1569528 - RNA, 19 nt, Pseudomonas putida KT2440
cgacguucuugccgguggu

SEQ ID NO: 1569529 - RNA, 21 nt, Pseudomonas putida KT2440
cgacgggaagugcacugccug

SEQ ID NO: 1569530 - RNA, 12 nt, Pseudomonas putida KT2440
cgacuucaaugc

SEQ ID NO: 1569531 - RNA, 23 nt, Pseudomonas putida KT2440
cgacucacgcucguuguccagca

SEQ ID NO: 1569532 - RNA, 16 nt, Pseudomonas putida KT2440
cgacuggaaggcgcug

SEQ ID NO: 1569533 - RNA, 15 nt, Pseudomonas putida KT2440
cgacguuuaccugca

SEQ ID NO: 1569534 - RNA, 17 nt, Pseudomonas putida KT2440
cgacguuuaccugcagc

SEQ ID NO: 1569535 - RNA, 23 nt, Pseudomonas putida KT2440
cgacuugugcauccugcacugca

SEQ ID NO: 1569536 - RNA, 16 nt, Pseudomonas putida KT2440
cgacuucgaccacggc

SEQ ID NO: 1569537 - RNA, 14 nt, Pseudomonas putida KT2440
cgagcggccugacu

SEQ ID NO: 1569538 - RNA, 13 nt, Pseudomonas putida KT2440
cgagcggccuugu

SEQ ID NO: 1569539 - RNA, 23 nt, Pseudomonas putida KT2440
cgagcgccugauuacccugcgcc

SEQ ID NO: 1569540 - RNA, 17 nt, Pseudomonas putida KT2440
cgagcggagcugguggu

SEQ ID NO: 1569541 - RNA, 18 nt, Pseudomonas putida KT2440
cgagcgcuuucagccguu

SEQ ID NO: 1569542 - RNA, 13 nt, Pseudomonas putida KT2440
cgagccgcugcca

SEQ ID NO: 1569543 - RNA, 14 nt, Pseudomonas putida KT2440
cgagccagccaggu

SEQ ID NO: 1569544 - RNA, 14 nt, Pseudomonas putida KT2440
cgagccacucggca

SEQ ID NO: 1569545 - RNA, 12 nt, Pseudomonas putida KT2440
cgagccaaccgc

SEQ ID NO: 1569546 - RNA, 22 nt, Pseudomonas putida KT2440
cgagccauaugaaaaggcccug

SEQ ID NO: 1569547 - RNA, 22 nt, Pseudomonas putida KT2440
cgagcagguucaggcgcagcac

SEQ ID NO: 1569548 - RNA, 17 nt, Pseudomonas putida KT2440
cgagaaugcugcgcagc

SEQ ID NO: 1569549 - RNA, 13 nt, Pseudomonas putida KT2440
cgagacgccacca

SEQ ID NO: 1569550 - RNA, 16 nt, Pseudomonas putida KT2440
cgagacgaucaccagg

SEQ ID NO: 1569551 - RNA, 21 nt, Pseudomonas putida KT2440
cgagcacacccggcguacucu

SEQ ID NO: 1569552 - RNA, 15 nt, Pseudomonas putida KT2440
cgaccgcaccggcca

SEQ ID NO: 1569553 - RNA, 20 nt, Pseudomonas putida KT2440
cgaccgcaccggccaccgug

SEQ ID NO: 1569554 - RNA, 15 nt, Pseudomonas putida KT2440
cgacccgucgcugcc

SEQ ID NO: 1569555 - RNA, 16 nt, Pseudomonas putida KT2440
cgacccgucgcugcca

SEQ ID NO: 1569556 - RNA, 15 nt, Pseudomonas putida KT2440
cgacccgggccagcc

SEQ ID NO: 1569557 - RNA, 20 nt, Pseudomonas putida KT2440
cgacaugcaccacgccacca

SEQ ID NO: 1569558 - RNA, 15 nt, Pseudomonas putida KT2440
cgacccgccgguugc

SEQ ID NO: 1569559 - RNA, 20 nt, Pseudomonas putida KT2440
cgacccggaaaauggucggg

SEQ ID NO: 1569560 - RNA, 20 nt, Pseudomonas putida KT2440
cgacccggauaccgacccua

SEQ ID NO: 1569561 - RNA, 15 nt, Pseudomonas putida KT2440
cgacccgcgucagcu

SEQ ID NO: 1569562 - RNA, 19 nt, Pseudomonas putida KT2440
cgacccggccgcuccagcu

SEQ ID NO: 1569563 - RNA, 14 nt, Pseudomonas putida KT2440
cgaccggcaggcgc

SEQ ID NO: 1569564 - RNA, 19 nt, Pseudomonas putida KT2440
cgaccgguggcgccuugau

SEQ ID NO: 1569565 - RNA, 21 nt, Pseudomonas putida KT2440
cgaccggucauacauccagcu

SEQ ID NO: 1569566 - RNA, 23 nt, Pseudomonas putida KT2440
cgaccggcguguugccgcugugc

SEQ ID NO: 1569567 - RNA, 23 nt, Pseudomonas putida KT2440
cgaccggcucaacagcaggugca

SEQ ID NO: 1569568 - RNA, 18 nt, Pseudomonas putida KT2440
cgaccgggcagaccugcu

SEQ ID NO: 1569569 - RNA, 12 nt, Pseudomonas putida KT2440
cgaccgccagcc

SEQ ID NO: 1569570 - RNA, 17 nt, Pseudomonas putida KT2440
cgaccgccagcccgcca

SEQ ID NO: 1569571 - RNA, 13 nt, Pseudomonas putida KT2440
cgacgauggccac

SEQ ID NO: 1569572 - RNA, 15 nt, Pseudomonas putida KT2440
cgacgauggccacca

SEQ ID NO: 1569573 - RNA, 21 nt, Pseudomonas putida KT2440
cgacgauggccaccagcaccu

SEQ ID NO: 1569574 - RNA, 18 nt, Pseudomonas putida KT2440
cgacgaugaggcgaugca

SEQ ID NO: 1569575 - RNA, 14 nt, Pseudomonas putida KT2440
cgacgcggugcucg

SEQ ID NO: 1569576 - RNA, 23 nt, Pseudomonas putida KT2440
cgacgcgguggagggcaccggcu

SEQ ID NO: 1569577 - RNA, 21 nt, Pseudomonas putida KT2440
cgacgcgggccaaggucagca

SEQ ID NO: 1569578 - RNA, 17 nt, Pseudomonas putida KT2440
cgacgcgacccguccag

SEQ ID NO: 1569579 - RNA, 17 nt, Pseudomonas putida KT2440
cgaccgucgcuggacgc

SEQ ID NO: 1569580 - RNA, 17 nt, Pseudomonas putida KT2440
cgaccuggcccgcuugc

SEQ ID NO: 1569581 - RNA, 16 nt, Pseudomonas putida KT2440
cgaccuggcucuucaa

SEQ ID NO: 1569582 - RNA, 18 nt, Pseudomonas putida KT2440
cgaccuuggacgcuggca

SEQ ID NO: 1569583 - RNA, 20 nt, Pseudomonas putida KT2440
cgaccuuggacgcuggcagc

SEQ ID NO: 1569584 - RNA, 13 nt, Pseudomonas putida KT2440
cgaccuuggcgac

SEQ ID NO: 1569585 - RNA, 15 nt, Pseudomonas putida KT2440
cgacgacacggcugc

SEQ ID NO: 1569586 - RNA, 12 nt, Pseudomonas putida KT2440
cgacgaucgccg

SEQ ID NO: 1569587 - RNA, 15 nt, Pseudomonas putida KT2440
cgacgagccaguucg

SEQ ID NO: 1569588 - RNA, 23 nt, Pseudomonas putida KT2440
cgaucuccccaccaucaauacgc

SEQ ID NO: 1569589 - RNA, 15 nt, Pseudomonas putida KT2440
cgaucuauucgaccc

SEQ ID NO: 1569590 - RNA, 15 nt, Pseudomonas putida KT2440
cgaucgagccgguca

SEQ ID NO: 1569591 - RNA, 18 nt, Pseudomonas putida KT2440
cgaugacccuuccagccc

SEQ ID NO: 1569592 - RNA, 15 nt, Pseudomonas putida KT2440
cgaucuucagcgcau

SEQ ID NO: 1569593 - RNA, 14 nt, Pseudomonas putida KT2440
cgaucucgccagcc

SEQ ID NO: 1569594 - RNA, 17 nt, Pseudomonas putida KT2440
cgaucuggaucacugcc

SEQ ID NO: 1569595 - RNA, 17 nt, Pseudomonas putida KT2440
cgaucugccugccucaa

SEQ ID NO: 1569596 - RNA, 21 nt, Pseudomonas putida KT2440
cgaugcccaccuuggcgguga

SEQ ID NO: 1569597 - RNA, 18 nt, Pseudomonas putida KT2440
cgaugcacagcucgcgcu

SEQ ID NO: 1569598 - RNA, 16 nt, Pseudomonas putida KT2440
cgaugcacgccagcau

SEQ ID NO: 1569599 - RNA, 15 nt, Pseudomonas putida KT2440
cgaugccaagcaccg

SEQ ID NO: 1569600 - RNA, 14 nt, Pseudomonas putida KT2440
cgaugaccuugccu

SEQ ID NO: 1569601 - RNA, 14 nt, Pseudomonas putida KT2440
cgaugcgcuggcac

SEQ ID NO: 1569602 - RNA, 15 nt, Pseudomonas putida KT2440
cgaugcgcuggcaca

SEQ ID NO: 1569603 - RNA, 13 nt, Pseudomonas putida KT2440
cgaugcggccaca

SEQ ID NO: 1569604 - RNA, 14 nt, Pseudomonas putida KT2440
cgaugccguacacc

SEQ ID NO: 1569605 - RNA, 15 nt, Pseudomonas putida KT2440
cgaugcgcacaccgc

SEQ ID NO: 1569606 - RNA, 19 nt, Pseudomonas putida KT2440
cgauguguguccaccaccg

SEQ ID NO: 1569607 - RNA, 21 nt, Pseudomonas putida KT2440
cgauguagaugccguucggcc

SEQ ID NO: 1569608 - RNA, 18 nt, Pseudomonas putida KT2440
cgauguaggcagcugccu

SEQ ID NO: 1569609 - RNA, 17 nt, Pseudomonas putida KT2440
cgauguccaggccgaaa

SEQ ID NO: 1569610 - RNA, 16 nt, Pseudomonas putida KT2440
cgaugggcacuggcca

SEQ ID NO: 1569611 - RNA, 14 nt, Pseudomonas putida KT2440
cgaugggcaggcca

SEQ ID NO: 1569612 - RNA, 15 nt, Pseudomonas putida KT2440
cgaugggcaggccau

SEQ ID NO: 1569613 - RNA, 18 nt, Pseudomonas putida KT2440
cgaugggcaugccgcgca

SEQ ID NO: 1569614 - RNA, 19 nt, Pseudomonas putida KT2440
cgaugggcaugccgcgcac

SEQ ID NO: 1569615 - RNA, 22 nt, Pseudomonas putida KT2440
cgaugguggcugcacugccgca

SEQ ID NO: 1569616 - RNA, 19 nt, Pseudomonas putida KT2440
cgaugggugcaaaaccugc

SEQ ID NO: 1569617 - RNA, 22 nt, Pseudomonas putida KT2440
cgaugguacagcucacuggcca

SEQ ID NO: 1569618 - RNA, 21 nt, Pseudomonas putida KT2440
cgauggcgcaaacccucggcc

SEQ ID NO: 1569619 - RNA, 12 nt, Pseudomonas putida KT2440
cgauggccacca

SEQ ID NO: 1569620 - RNA, 21 nt, Pseudomonas putida KT2440
cgauggauggcaccggcuuug

SEQ ID NO: 1569621 - RNA, 15 nt, Pseudomonas putida KT2440
cgauuucaccggcuu

SEQ ID NO: 1569622 - RNA, 16 nt, Pseudomonas putida KT2440
cgauugaucagcgccu

SEQ ID NO: 1569623 - RNA, 17 nt, Pseudomonas putida KT2440
cgauugaucagcgccuc

SEQ ID NO: 1569624 - RNA, 17 nt, Pseudomonas putida KT2440
cgauucugccagcuccu

SEQ ID NO: 1569625 - RNA, 15 nt, Pseudomonas putida KT2440
cgauguugucaaagc

SEQ ID NO: 1569626 - RNA, 19 nt, Pseudomonas putida KT2440
cgcaacgcggccccggcua

SEQ ID NO: 1569627 - RNA, 14 nt, Pseudomonas putida KT2440
cgcaacgcggcccu

SEQ ID NO: 1569628 - RNA, 14 nt, Pseudomonas putida KT2440
cgcaacgcuuggca

SEQ ID NO: 1569629 - RNA, 20 nt, Pseudomonas putida KT2440
cgcaacagaucccgcuccuc

SEQ ID NO: 1569630 - RNA, 21 nt, Pseudomonas putida KT2440
cgcaaaugcaccccugccacc

SEQ ID NO: 1569631 - RNA, 20 nt, Pseudomonas putida KT2440
cgcaaaugcugccaugcaag

SEQ ID NO: 1569632 - RNA, 17 nt, Pseudomonas putida KT2440
cgcaaaugguuguccac

SEQ ID NO: 1569633 - RNA, 21 nt, Pseudomonas putida KT2440
cgcaacaaccccgucgccuca

SEQ ID NO: 1569634 - RNA, 21 nt, Pseudomonas putida KT2440
cgcaaagcggcccccacgccg

SEQ ID NO: 1569635 - RNA, 20 nt, Pseudomonas putida KT2440
cgcaaagcggcccccagcaa

SEQ ID NO: 1569636 - RNA, 14 nt, Pseudomonas putida KT2440
cgauuucgugcacu

SEQ ID NO: 1569637 - RNA, 15 nt, Pseudomonas putida KT2440
cgagguugcgcucca

SEQ ID NO: 1569638 - RNA, 19 nt, Pseudomonas putida KT2440
cgagguguacgcgaaggcg

SEQ ID NO: 1569639 - RNA, 15 nt, Pseudomonas putida KT2440
cgaguacgaucagcc

SEQ ID NO: 1569640 - RNA, 14 nt, Pseudomonas putida KT2440
cgagucgccuucac

SEQ ID NO: 1569641 - RNA, 12 nt, Pseudomonas putida KT2440
cgagugcucgaa

SEQ ID NO: 1569642 - RNA, 19 nt, Pseudomonas putida KT2440
cgaguggccgaaggcgcuc

SEQ ID NO: 1569643 - RNA, 18 nt, Pseudomonas putida KT2440
cgagugcguagccuucag

SEQ ID NO: 1569644 - RNA, 23 nt, Pseudomonas putida KT2440
cgagugcguagccuucagcggcc

SEQ ID NO: 1569645 - RNA, 14 nt, Pseudomonas putida KT2440
cgaggguggucuug

SEQ ID NO: 1569646 - RNA, 23 nt, Pseudomonas putida KT2440
cgaggucagcaccagcucaucca

SEQ ID NO: 1569647 - RNA, 16 nt, Pseudomonas putida KT2440
cgagggcaugggccac

SEQ ID NO: 1569648 - RNA, 14 nt, Pseudomonas putida KT2440
cgaggcguuggcca

SEQ ID NO: 1569649 - RNA, 21 nt, Pseudomonas putida KT2440
cgaggcguuggccgaaggccg

SEQ ID NO: 1569650 - RNA, 20 nt, Pseudomonas putida KT2440
cgagcgggugccgcagcacc

SEQ ID NO: 1569651 - RNA, 21 nt, Pseudomonas putida KT2440
cgagcgggugccgcagcaccg

SEQ ID NO: 1569652 - RNA, 16 nt, Pseudomonas putida KT2440
cgagcgguugcacggc

SEQ ID NO: 1569653 - RNA, 17 nt, Pseudomonas putida KT2440
cgagggugaacccaccg

SEQ ID NO: 1569654 - RNA, 19 nt, Pseudomonas putida KT2440
cgaggggacgaucugcagc

SEQ ID NO: 1569655 - RNA, 19 nt, Pseudomonas putida KT2440
cgaucacuuccuggccgcc

SEQ ID NO: 1569656 - RNA, 22 nt, Pseudomonas putida KT2440
cgaucacuccugguuggccagu

SEQ ID NO: 1569657 - RNA, 13 nt, Pseudomonas putida KT2440
cgaucacucggca

SEQ ID NO: 1569658 - RNA, 17 nt, Pseudomonas putida KT2440
cgaucagcagcaaaggu

SEQ ID NO: 1569659 - RNA, 16 nt, Pseudomonas putida KT2440
cgaucagcgccgaacc

SEQ ID NO: 1569660 - RNA, 15 nt, Pseudomonas putida KT2440
cgaucagcgccugcu

SEQ ID NO: 1569661 - RNA, 22 nt, Pseudomonas putida KT2440
cgaucagcuuaacgcuuggcca

SEQ ID NO: 1569662 - RNA, 15 nt, Pseudomonas putida KT2440
cgaucagcggcgcca

SEQ ID NO: 1569663 - RNA, 19 nt, Pseudomonas putida KT2440
cgaucagggaugcuggaca

SEQ ID NO: 1569664 - RNA, 15 nt, Pseudomonas putida KT2440
cgauccgcgccauca

SEQ ID NO: 1569665 - RNA, 16 nt, Pseudomonas putida KT2440
cgaucccgaugcgcuu

SEQ ID NO: 1569666 - RNA, 17 nt, Pseudomonas putida KT2440
cgaucccgaggucagca

SEQ ID NO: 1569667 - RNA, 12 nt, Pseudomonas putida KT2440
cgaucaggucga

SEQ ID NO: 1569668 - RNA, 17 nt, Pseudomonas putida KT2440
cgaucauuuccggcacg

SEQ ID NO: 1569669 - RNA, 15 nt, Pseudomonas putida KT2440
cgaucaugucgccgu

SEQ ID NO: 1569670 - RNA, 23 nt, Pseudomonas putida KT2440
cgauagacaaaaaaaucggccgc

SEQ ID NO: 1569671 - RNA, 18 nt, Pseudomonas putida KT2440
cgauacuugcagcggauu

SEQ ID NO: 1569672 - RNA, 16 nt, Pseudomonas putida KT2440
cgauacuccggcaacc

SEQ ID NO: 1569673 - RNA, 18 nt, Pseudomonas putida KT2440
cgauacucacccgcuugc

SEQ ID NO: 1569674 - RNA, 20 nt, Pseudomonas putida KT2440
cgauacucacccgcuugcca

SEQ ID NO: 1569675 - RNA, 22 nt, Pseudomonas putida KT2440
cgaucaaaugaucgccagcggu

SEQ ID NO: 1569676 - RNA, 20 nt, Pseudomonas putida KT2440
cgauaccccgcugccugcgc

SEQ ID NO: 1569677 - RNA, 18 nt, Pseudomonas putida KT2440
cgauacgccgacagcggc

SEQ ID NO: 1569678 - RNA, 17 nt, Pseudomonas putida KT2440
cgauaccuggguccagg

SEQ ID NO: 1569679 - RNA, 19 nt, Pseudomonas putida KT2440
cgauaccgaccauuugcca

SEQ ID NO: 1569680 - RNA, 15 nt, Pseudomonas putida KT2440
cgauaccgccaucga

SEQ ID NO: 1569681 - RNA, 15 nt, Pseudomonas putida KT2440
cgauaccgcccaggu

SEQ ID NO: 1569682 - RNA, 15 nt, Pseudomonas putida KT2440
cgauacccaggcgcg

SEQ ID NO: 1569683 - RNA, 14 nt, Pseudomonas putida KT2440
cgaguugccuucga

SEQ ID NO: 1569684 - RNA, 15 nt, Pseudomonas putida KT2440
cgccaccgccgugcc

SEQ ID NO: 1569685 - RNA, 17 nt, Pseudomonas putida KT2440
cgccaccccggcuugcu

SEQ ID NO: 1569686 - RNA, 21 nt, Pseudomonas putida KT2440
cgccacgcaccagggcuggca

SEQ ID NO: 1569687 - RNA, 18 nt, Pseudomonas putida KT2440
cgccaccggcauucccgg

SEQ ID NO: 1569688 - RNA, 19 nt, Pseudomonas putida KT2440
cgccacuucccguucgcgg

SEQ ID NO: 1569689 - RNA, 12 nt, Pseudomonas putida KT2440
cgccacuggcga

SEQ ID NO: 1569690 - RNA, 23 nt, Pseudomonas putida KT2440
cgccacggcggcauccaggcggg

SEQ ID NO: 1569691 - RNA, 19 nt, Pseudomonas putida KT2440
cgccacggugccgaacagc

SEQ ID NO: 1569692 - RNA, 15 nt, Pseudomonas putida KT2440
cgccagcaggccacc

SEQ ID NO: 1569693 - RNA, 16 nt, Pseudomonas putida KT2440
cgccagcaggccaccg

SEQ ID NO: 1569694 - RNA, 18 nt, Pseudomonas putida KT2440
cgccagcaggccaccggc

SEQ ID NO: 1569695 - RNA, 22 nt, Pseudomonas putida KT2440
cgccagcaggccaccggcagca

SEQ ID NO: 1569696 - RNA, 14 nt, Pseudomonas putida KT2440
cgccagcagcgcau

SEQ ID NO: 1569697 - RNA, 23 nt, Pseudomonas putida KT2440
cgccagcagcggguuccccagca

SEQ ID NO: 1569698 - RNA, 19 nt, Pseudomonas putida KT2440
cgccagccaguacggcagc

SEQ ID NO: 1569699 - RNA, 23 nt, Pseudomonas putida KT2440
cgccagcccgccaagggucgaca

SEQ ID NO: 1569700 - RNA, 13 nt, Pseudomonas putida KT2440
cgccagcggcagu

SEQ ID NO: 1569701 - RNA, 13 nt, Pseudomonas putida KT2440
cgccagcggcucg

SEQ ID NO: 1569702 - RNA, 17 nt, Pseudomonas putida KT2440
cgccagcggcucgacca

SEQ ID NO: 1569703 - RNA, 24 nt, Pseudomonas putida KT2440
cgccagcggcguguaguagcucca

SEQ ID NO: 1569704 - RNA, 12 nt, Pseudomonas putida KT2440
cgccagcugcug

SEQ ID NO: 1569705 - RNA, 22 nt, Pseudomonas putida KT2440
cgccagcugcugccccaugcga

SEQ ID NO: 1569706 - RNA, 21 nt, Pseudomonas putida KT2440
cgcagguucgaauccugcuga

SEQ ID NO: 1569707 - RNA, 16 nt, Pseudomonas putida KT2440
cgcaguaacaggcgca

SEQ ID NO: 1569708 - RNA, 14 nt, Pseudomonas putida KT2440
cgcaggugcgcacg

SEQ ID NO: 1569709 - RNA, 23 nt, Pseudomonas putida KT2440
cgcaggugcgcacgcugcccagg

SEQ ID NO: 1569710 - RNA, 16 nt, Pseudomonas putida KT2440
cgcaucgacaggucca

SEQ ID NO: 1569711 - RNA, 20 nt, Pseudomonas putida KT2440
cgcaucguccuugcagggca

SEQ ID NO: 1569712 - RNA, 22 nt, Pseudomonas putida KT2440
cgcaugaaaaagccggcaacga

SEQ ID NO: 1569713 - RNA, 16 nt, Pseudomonas putida KT2440
cgcaugcuuggcgaag

SEQ ID NO: 1569714 - RNA, 19 nt, Pseudomonas putida KT2440
cgcaugcuuggcgaagguc

SEQ ID NO: 1569715 - RNA, 21 nt, Pseudomonas putida KT2440
cgcauugcaggccagcgucgu

SEQ ID NO: 1569716 - RNA, 21 nt, Pseudomonas putida KT2440
cgccaccaaccggccaguggc

SEQ ID NO: 1569717 - RNA, 23 nt, Pseudomonas putida KT2440
cgccaccaagcccuucucgcuca

SEQ ID NO: 1569718 - RNA, 17 nt, Pseudomonas putida KT2440
cgccacauagcuggcac

SEQ ID NO: 1569719 - RNA, 20 nt, Pseudomonas putida KT2440
cgccacauagcuggcacugc

SEQ ID NO: 1569720 - RNA, 15 nt, Pseudomonas putida KT2440
cgccaccaucgacuc

SEQ ID NO: 1569721 - RNA, 21 nt, Pseudomonas putida KT2440
cgccaccaugcucggccagcu

SEQ ID NO: 1569722 - RNA, 16 nt, Pseudomonas putida KT2440
cgccaccccaggccac

SEQ ID NO: 1569723 - RNA, 19 nt, Pseudomonas putida KT2440
cgccaacuccuugcgcauc

SEQ ID NO: 1569724 - RNA, 13 nt, Pseudomonas putida KT2440
cgcauuuucauca

SEQ ID NO: 1569725 - RNA, 19 nt, Pseudomonas putida KT2440
cgccaaggccucgaacagc

SEQ ID NO: 1569726 - RNA, 13 nt, Pseudomonas putida KT2440
cgccacaccacag

SEQ ID NO: 1569727 - RNA, 17 nt, Pseudomonas putida KT2440
cgccacaccacagcugc

SEQ ID NO: 1569728 - RNA, 21 nt, Pseudomonas putida KT2440
cgccacaccacagcugcacau

SEQ ID NO: 1569729 - RNA, 16 nt, Pseudomonas putida KT2440
cgccacacccgcuaca

SEQ ID NO: 1569730 - RNA, 19 nt, Pseudomonas putida KT2440
cgccacacccgcuacaccg

SEQ ID NO: 1569731 - RNA, 18 nt, Pseudomonas putida KT2440
cgccacacugucccggca

SEQ ID NO: 1569732 - RNA, 21 nt, Pseudomonas putida KT2440
cgcaggccacgguaggccuug

SEQ ID NO: 1569733 - RNA, 17 nt, Pseudomonas putida KT2440
cgcaggcauacaggacc

SEQ ID NO: 1569734 - RNA, 20 nt, Pseudomonas putida KT2440
cgcaggcauacaggaccagg

SEQ ID NO: 1569735 - RNA, 16 nt, Pseudomonas putida KT2440
cgcaggcagcgauggc

SEQ ID NO: 1569736 - RNA, 20 nt, Pseudomonas putida KT2440
cgcaggcagcgauggccgug

SEQ ID NO: 1569737 - RNA, 20 nt, Pseudomonas putida KT2440
cgcaggcacgcccgcuccca

SEQ ID NO: 1569738 - RNA, 22 nt, Pseudomonas putida KT2440
cgcaggauauccacacccgcca

SEQ ID NO: 1569739 - RNA, 19 nt, Pseudomonas putida KT2440
cgcaggaucaugugcgcca

SEQ ID NO: 1569740 - RNA, 23 nt, Pseudomonas putida KT2440
cgcagggcccccgauuccaaggu

SEQ ID NO: 1569741 - RNA, 13 nt, Pseudomonas putida KT2440
cgcaggucgccau

SEQ ID NO: 1569742 - RNA, 18 nt, Pseudomonas putida KT2440
cgcaggcuucaaggccac

SEQ ID NO: 1569743 - RNA, 18 nt, Pseudomonas putida KT2440
cgcaggcugucgaacagg

SEQ ID NO: 1569744 - RNA, 18 nt, Pseudomonas putida KT2440
cgcaggcgguuggccaug

SEQ ID NO: 1569745 - RNA, 20 nt, Pseudomonas putida KT2440
cgcaggcucaucuaccagcu

SEQ ID NO: 1569746 - RNA, 18 nt, Pseudomonas putida KT2440
cgcaggcucugcgccagc

SEQ ID NO: 1569747 - RNA, 19 nt, Pseudomonas putida KT2440
cgcaggcucugcgccagca

SEQ ID NO: 1569748 - RNA, 20 nt, Pseudomonas putida KT2440
cgcaggcucugcgccagcag

SEQ ID NO: 1569749 - RNA, 18 nt, Pseudomonas putida KT2440
cgcaggcuaugccgguca

SEQ ID NO: 1569750 - RNA, 16 nt, Pseudomonas putida KT2440
cgcaggccagcgcaca

SEQ ID NO: 1569751 - RNA, 12 nt, Pseudomonas putida KT2440
cgcaggccgaca

SEQ ID NO: 1569752 - RNA, 23 nt, Pseudomonas putida KT2440
cgcaggccgcagccucuucggcc

SEQ ID NO: 1569753 - RNA, 23 nt, Pseudomonas putida KT2440
cgcagccauaguuuugugccacc

SEQ ID NO: 1569754 - RNA, 14 nt, Pseudomonas putida KT2440
cgcagccaccagcu

SEQ ID NO: 1569755 - RNA, 16 nt, Pseudomonas putida KT2440
cgcagcgacgaccugc

SEQ ID NO: 1569756 - RNA, 19 nt, Pseudomonas putida KT2440
cgcagcgacgaccugcaca

SEQ ID NO: 1569757 - RNA, 20 nt, Pseudomonas putida KT2440
cgcagccucuucggccagca

SEQ ID NO: 1569758 - RNA, 17 nt, Pseudomonas putida KT2440
cgcagccguucuggcca

SEQ ID NO: 1569759 - RNA, 14 nt, Pseudomonas putida KT2440
cgcagccuugugcu

SEQ ID NO: 1569760 - RNA, 17 nt, Pseudomonas putida KT2440
cgcagccuugugcugcg

SEQ ID NO: 1569761 - RNA, 19 nt, Pseudomonas putida KT2440
cgcagcagcaggcccgcca

SEQ ID NO: 1569762 - RNA, 13 nt, Pseudomonas putida KT2440
cgcagcagcaccg

SEQ ID NO: 1569763 - RNA, 19 nt, Pseudomonas putida KT2440
cgcagcacuuccucggcac

SEQ ID NO: 1569764 - RNA, 23 nt, Pseudomonas putida KT2440
cgcacuucuguggaaaaccgcuc

SEQ ID NO: 1569765 - RNA, 18 nt, Pseudomonas putida KT2440
cgcacuugaucuugcgcc

SEQ ID NO: 1569766 - RNA, 12 nt, Pseudomonas putida KT2440
cgcacuugccag

SEQ ID NO: 1569767 - RNA, 18 nt, Pseudomonas putida KT2440
cgcacuucguagcgcccg

SEQ ID NO: 1569768 - RNA, 15 nt, Pseudomonas putida KT2440
cgcacguagcgcccg

SEQ ID NO: 1569769 - RNA, 20 nt, Pseudomonas putida KT2440
cgcacgggucaccucaucga

SEQ ID NO: 1569770 - RNA, 13 nt, Pseudomonas putida KT2440
cgcacguuggccg

SEQ ID NO: 1569771 - RNA, 22 nt, Pseudomonas putida KT2440
cgcacgugggucgggaacagcu

SEQ ID NO: 1569772 - RNA, 23 nt, Pseudomonas putida KT2440
cgcacgugggucgggaacagcuc

SEQ ID NO: 1569773 - RNA, 13 nt, Pseudomonas putida KT2440
cgcacugcugccg

SEQ ID NO: 1569774 - RNA, 14 nt, Pseudomonas putida KT2440
cgcacugcugccgc

SEQ ID NO: 1569775 - RNA, 15 nt, Pseudomonas putida KT2440
cgcacugcugccgcc

SEQ ID NO: 1569776 - RNA, 13 nt, Pseudomonas putida KT2440
cgcacuggucaac

SEQ ID NO: 1569777 - RNA, 14 nt, Pseudomonas putida KT2440
cgcacuccccauca

SEQ ID NO: 1569778 - RNA, 22 nt, Pseudomonas putida KT2440
cgcacuccccaucagcagcugc

SEQ ID NO: 1569779 - RNA, 14 nt, Pseudomonas putida KT2440
cgcacucugcugcu

SEQ ID NO: 1569780 - RNA, 22 nt, Pseudomonas putida KT2440
cgcacggccuccaccaccugca

SEQ ID NO: 1569781 - RNA, 16 nt, Pseudomonas putida KT2440
cgcacggcuucgcgca

SEQ ID NO: 1569782 - RNA, 20 nt, Pseudomonas putida KT2440
cgcacgcgccucuugcaccu

SEQ ID NO: 1569783 - RNA, 20 nt, Pseudomonas putida KT2440
cgcaagccgcugucgguaaa

SEQ ID NO: 1569784 - RNA, 19 nt, Pseudomonas putida KT2440
cgcaacgcgccauggccug

SEQ ID NO: 1569785 - RNA, 21 nt, Pseudomonas putida KT2440
cgcaagcgguugcccgcugca

SEQ ID NO: 1569786 - RNA, 18 nt, Pseudomonas putida KT2440
cgcaagcguucgagcauc

SEQ ID NO: 1569787 - RNA, 20 nt, Pseudomonas putida KT2440
cgcaagcuccagggugcgcg

SEQ ID NO: 1569788 - RNA, 17 nt, Pseudomonas putida KT2440
cgcaagcugcaccgcca

SEQ ID NO: 1569789 - RNA, 15 nt, Pseudomonas putida KT2440
cgcaccgcuugcgca

SEQ ID NO: 1569790 - RNA, 15 nt, Pseudomonas putida KT2440
cgcacgaacagcggc

SEQ ID NO: 1569791 - RNA, 21 nt, Pseudomonas putida KT2440
cgcaccuuggcguccagguaa

SEQ ID NO: 1569792 - RNA, 15 nt, Pseudomonas putida KT2440
cgcaccuugugcacg

SEQ ID NO: 1569793 - RNA, 21 nt, Pseudomonas putida KT2440
cgcacgaauacgcucgaccag

SEQ ID NO: 1569794 - RNA, 15 nt, Pseudomonas putida KT2440
cgcaccucggccagu

SEQ ID NO: 1569795 - RNA, 14 nt, Pseudomonas putida KT2440
cgcaccgugcacca

SEQ ID NO: 1569796 - RNA, 22 nt, Pseudomonas putida KT2440
cgcaccgugcaccagcaccacc

SEQ ID NO: 1569797 - RNA, 13 nt, Pseudomonas putida KT2440
cgcaccuccugcg

SEQ ID NO: 1569798 - RNA, 15 nt, Pseudomonas putida KT2440
cgcaccucgaccgca

SEQ ID NO: 1569799 - RNA, 20 nt, Pseudomonas putida KT2440
cgcaccuacagggauugcgc

SEQ ID NO: 1569800 - RNA, 14 nt, Pseudomonas putida KT2440
cagcgacgaccugc

SEQ ID NO: 1569801 - RNA, 17 nt, Pseudomonas putida KT2440
cagcgacaacggcuggc

SEQ ID NO: 1569802 - RNA, 21 nt, Pseudomonas putida KT2440
cagcgacaacggcuggcggaa

SEQ ID NO: 1569803 - RNA, 15 nt, Pseudomonas putida KT2440
cagcgaauagcaaca

SEQ ID NO: 1569804 - RNA, 18 nt, Pseudomonas putida KT2440
cagccucuucggccagca

SEQ ID NO: 1569805 - RNA, 15 nt, Pseudomonas putida KT2440
cagccugacgcgccg

SEQ ID NO: 1569806 - RNA, 19 nt, Pseudomonas putida KT2440
cagccguggcaacgccaca

SEQ ID NO: 1569807 - RNA, 14 nt, Pseudomonas putida KT2440
cagccucguaagcg

SEQ ID NO: 1569808 - RNA, 20 nt, Pseudomonas putida KT2440
cagccguccucgacccaguc

SEQ ID NO: 1569809 - RNA, 13 nt, Pseudomonas putida KT2440
cagccggccuugc

SEQ ID NO: 1569810 - RNA, 14 nt, Pseudomonas putida KT2440
cagccggccuugcu

SEQ ID NO: 1569811 - RNA, 19 nt, Pseudomonas putida KT2440
cagccggcccggcuggcca

SEQ ID NO: 1569812 - RNA, 15 nt, Pseudomonas putida KT2440
cagccgcugcugcag

SEQ ID NO: 1569813 - RNA, 22 nt, Pseudomonas putida KT2440
cagccgcucgagaaacgccagc

SEQ ID NO: 1569814 - RNA, 23 nt, Pseudomonas putida KT2440
cagccgcgggcucguuauccgcg

SEQ ID NO: 1569815 - RNA, 12 nt, Pseudomonas putida KT2440
cagccgcggcac

SEQ ID NO: 1569816 - RNA, 16 nt, Pseudomonas putida KT2440
cagccgcgcugacgca

SEQ ID NO: 1569817 - RNA, 17 nt, Pseudomonas putida KT2440
cagccgcgccaggucgg

SEQ ID NO: 1569818 - RNA, 16 nt, Pseudomonas putida KT2440
cagccgccacgaccac

SEQ ID NO: 1569819 - RNA, 16 nt, Pseudomonas putida KT2440
cagccgcccgaacggg

SEQ ID NO: 1569820 - RNA, 14 nt, Pseudomonas putida KT2440
cagccgccgccugu

SEQ ID NO: 1569821 - RNA, 13 nt, Pseudomonas putida KT2440
cagccgcaccugc

SEQ ID NO: 1569822 - RNA, 17 nt, Pseudomonas putida KT2440
cagccgcacccaggcca

SEQ ID NO: 1569823 - RNA, 23 nt, Pseudomonas putida KT2440
cagcccugccgaggccaugugcu

SEQ ID NO: 1569824 - RNA, 13 nt, Pseudomonas putida KT2440
cagcccucagugc

SEQ ID NO: 1569825 - RNA, 19 nt, Pseudomonas putida KT2440
cagcccggcguucgaaagc

SEQ ID NO: 1569826 - RNA, 19 nt, Pseudomonas putida KT2440
cagccccaacccaccagca

SEQ ID NO: 1569827 - RNA, 19 nt, Pseudomonas putida KT2440
cagccccaaccuuccagca

SEQ ID NO: 1569828 - RNA, 12 nt, Pseudomonas putida KT2440
cagccccaaggu

SEQ ID NO: 1569829 - RNA, 13 nt, Pseudomonas putida KT2440
cagccccacgccc

SEQ ID NO: 1569830 - RNA, 15 nt, Pseudomonas putida KT2440
cagcccgcaccggcc

SEQ ID NO: 1569831 - RNA, 19 nt, Pseudomonas putida KT2440
cagcccgccacaccgaagc

SEQ ID NO: 1569832 - RNA, 20 nt, Pseudomonas putida KT2440
cagcccgcccacaugcgagc

SEQ ID NO: 1569833 - RNA, 22 nt, Pseudomonas putida KT2440
cagcccaguagaucgcgccagu

SEQ ID NO: 1569834 - RNA, 16 nt, Pseudomonas putida KT2440
cagcccauccagggcu

SEQ ID NO: 1569835 - RNA, 14 nt, Pseudomonas putida KT2440
cagcccagcgccag

SEQ ID NO: 1569836 - RNA, 14 nt, Pseudomonas putida KT2440
cagcccaaacagca

SEQ ID NO: 1569837 - RNA, 15 nt, Pseudomonas putida KT2440
cagcccaccacgaac

SEQ ID NO: 1569838 - RNA, 22 nt, Pseudomonas putida KT2440
cagcccaaggcuggccagacga

SEQ ID NO: 1569839 - RNA, 17 nt, Pseudomonas putida KT2440
cagccaggcacuggcca

SEQ ID NO: 1569840 - RNA, 21 nt, Pseudomonas putida KT2440
cagccaggauuuucagcgcga

SEQ ID NO: 1569841 - RNA, 19 nt, Pseudomonas putida KT2440
cagccaggcacagaucaac

SEQ ID NO: 1569842 - RNA, 23 nt, Pseudomonas putida KT2440
cagcaucacgccgcgcuggcgcg

SEQ ID NO: 1569843 - RNA, 16 nt, Pseudomonas putida KT2440
cagcauccaaagccaa

SEQ ID NO: 1569844 - RNA, 21 nt, Pseudomonas putida KT2440
cagcaucaaugcaggaucugg

SEQ ID NO: 1569845 - RNA, 14 nt, Pseudomonas putida KT2440
cagcaucaccgcgc

SEQ ID NO: 1569846 - RNA, 13 nt, Pseudomonas putida KT2440
cagcauccagcca

SEQ ID NO: 1569847 - RNA, 15 nt, Pseudomonas putida KT2440
cagcaugaacagcgc

SEQ ID NO: 1569848 - RNA, 16 nt, Pseudomonas putida KT2440
cagcaugaacagcgcu

SEQ ID NO: 1569849 - RNA, 21 nt, Pseudomonas putida KT2440
cagcaugaacgcagcuuccgc

SEQ ID NO: 1569850 - RNA, 13 nt, Pseudomonas putida KT2440
cagcaggccauac

SEQ ID NO: 1569851 - RNA, 23 nt, Pseudomonas putida KT2440
cagcaggccauauugcugagcca

SEQ ID NO: 1569852 - RNA, 14 nt, Pseudomonas putida KT2440
cagcaggccaccgg

SEQ ID NO: 1569853 - RNA, 18 nt, Pseudomonas putida KT2440
cagcaggccaccggcagc

SEQ ID NO: 1569854 - RNA, 13 nt, Pseudomonas putida KT2440
cagcaggaacagc

SEQ ID NO: 1569855 - RNA, 18 nt, Pseudomonas putida KT2440
cagcagcuugaacaacgg

SEQ ID NO: 1569856 - RNA, 17 nt, Pseudomonas putida KT2440
cagcagcuugcagcgcc

SEQ ID NO: 1569857 - RNA, 13 nt, Pseudomonas putida KT2440
cagcaggacgaua

SEQ ID NO: 1569858 - RNA, 14 nt, Pseudomonas putida KT2440
cagcaggauggcca

SEQ ID NO: 1569859 - RNA, 22 nt, Pseudomonas putida KT2440
cagcaggauggccaugaucgcc

SEQ ID NO: 1569860 - RNA, 13 nt, Pseudomonas putida KT2440
cagcaugcugguu

SEQ ID NO: 1569861 - RNA, 18 nt, Pseudomonas putida KT2440
cagcaugcgggggcccca

SEQ ID NO: 1569862 - RNA, 16 nt, Pseudomonas putida KT2440
cagcaugcccagcgcc

SEQ ID NO: 1569863 - RNA, 17 nt, Pseudomonas putida KT2440
cagcaugccccgggugc

SEQ ID NO: 1569864 - RNA, 14 nt, Pseudomonas putida KT2440
cagcaugcgaagcc

SEQ ID NO: 1569865 - RNA, 23 nt, Pseudomonas putida KT2440
cagcauggccgaaaccagccccu

SEQ ID NO: 1569866 - RNA, 22 nt, Pseudomonas putida KT2440
cagccaaaaaaaccccagggca

SEQ ID NO: 1569867 - RNA, 17 nt, Pseudomonas putida KT2440
cagccagacgaccagca

SEQ ID NO: 1569868 - RNA, 11 nt, Pseudomonas putida KT2440
cagccaacggc

SEQ ID NO: 1569869 - RNA, 17 nt, Pseudomonas putida KT2440
cagccagauauggaagc

SEQ ID NO: 1569870 - RNA, 16 nt, Pseudomonas putida KT2440
cagcagcagcgcaccg

SEQ ID NO: 1569871 - RNA, 20 nt, Pseudomonas putida KT2440
cagcagacugaauuggccgg

SEQ ID NO: 1569872 - RNA, 21 nt, Pseudomonas putida KT2440
cagcacgccguugcggucggu

SEQ ID NO: 1569873 - RNA, 12 nt, Pseudomonas putida KT2440
cagcacgcgcau

SEQ ID NO: 1569874 - RNA, 17 nt, Pseudomonas putida KT2440
cagcagcgacaccagcg

SEQ ID NO: 1569875 - RNA, 20 nt, Pseudomonas putida KT2440
cagcagcaugaauagcgcac

SEQ ID NO: 1569876 - RNA, 13 nt, Pseudomonas putida KT2440
cagcagcaggccc

SEQ ID NO: 1569877 - RNA, 12 nt, Pseudomonas putida KT2440
cagcagcgccug

SEQ ID NO: 1569878 - RNA, 14 nt, Pseudomonas putida KT2440
cagcagcgccugca

SEQ ID NO: 1569879 - RNA, 23 nt, Pseudomonas putida KT2440
cagcagcucccgagccaggaaga

SEQ ID NO: 1569880 - RNA, 19 nt, Pseudomonas putida KT2440
cagcagcucuuuugccggg

SEQ ID NO: 1569881 - RNA, 14 nt, Pseudomonas putida KT2440
cagcagcugccgga

SEQ ID NO: 1569882 - RNA, 17 nt, Pseudomonas putida KT2440
cagcacgaaggccagca

SEQ ID NO: 1569883 - RNA, 14 nt, Pseudomonas putida KT2440
cagcaccugccgcu

SEQ ID NO: 1569884 - RNA, 23 nt, Pseudomonas putida KT2440
cagcaccugggcgucaucacccg

SEQ ID NO: 1569885 - RNA, 14 nt, Pseudomonas putida KT2440
cagcaccugacgca

SEQ ID NO: 1569886 - RNA, 16 nt, Pseudomonas putida KT2440
cagcacgaugacgaac

SEQ ID NO: 1569887 - RNA, 15 nt, Pseudomonas putida KT2440
cagcacgcaggccag

SEQ ID NO: 1569888 - RNA, 16 nt, Pseudomonas putida KT2440
cagcacgcaggccagc

SEQ ID NO: 1569889 - RNA, 16 nt, Pseudomonas putida KT2440
cagcacgauaccggcg

SEQ ID NO: 1569890 - RNA, 14 nt, Pseudomonas putida KT2440
cagcaccuccugca

SEQ ID NO: 1569891 - RNA, 17 nt, Pseudomonas putida KT2440
cagcaccgacuggcgua

SEQ ID NO: 1569892 - RNA, 17 nt, Pseudomonas putida KT2440
cagcaccgccauggcca

SEQ ID NO: 1569893 - RNA, 17 nt, Pseudomonas putida KT2440
cagcaccccagcaccac

SEQ ID NO: 1569894 - RNA, 23 nt, Pseudomonas putida KT2440
cagcaccaucaggcacaggccag

SEQ ID NO: 1569895 - RNA, 18 nt, Pseudomonas putida KT2440
cagcaccacccaccagca

SEQ ID NO: 1569896 - RNA, 18 nt, Pseudomonas putida KT2440
cagcaaucugcugguuca

SEQ ID NO: 1569897 - RNA, 15 nt, Pseudomonas putida KT2440
cagcacaagacugcu

SEQ ID NO: 1569898 - RNA, 14 nt, Pseudomonas putida KT2440
cagcacaagccgac

SEQ ID NO: 1569899 - RNA, 19 nt, Pseudomonas putida KT2440
cagcacaaggcucaagcgc

SEQ ID NO: 1569900 - RNA, 14 nt, Pseudomonas putida KT2440
cagcacaaggcugc

SEQ ID NO: 1569901 - RNA, 17 nt, Pseudomonas putida KT2440
cagcacacccagcacga

SEQ ID NO: 1569902 - RNA, 21 nt, Pseudomonas putida KT2440
cagcacacccagcacgaaggc

SEQ ID NO: 1569903 - RNA, 14 nt, Pseudomonas putida KT2440
cagcacacuccacg

SEQ ID NO: 1569904 - RNA, 22 nt, Pseudomonas putida KT2440
cagcacaccgcgcaccucgacc

SEQ ID NO: 1569905 - RNA, 14 nt, Pseudomonas putida KT2440
cagcaccaaccgcg

SEQ ID NO: 1569906 - RNA, 22 nt, Pseudomonas putida KT2440
cagcaacuccccccgcgccaga

SEQ ID NO: 1569907 - RNA, 15 nt, Pseudomonas putida KT2440
cagcaacgcagccag

SEQ ID NO: 1569908 - RNA, 14 nt, Pseudomonas putida KT2440
cagcaacgccgagc

SEQ ID NO: 1569909 - RNA, 16 nt, Pseudomonas putida KT2440
cagauucgccaaggcc

SEQ ID NO: 1569910 - RNA, 23 nt, Pseudomonas putida KT2440
cagcaacgcgauauucagugcgc

SEQ ID NO: 1569911 - RNA, 13 nt, Pseudomonas putida KT2440
cagcaaccucgag

SEQ ID NO: 1569912 - RNA, 16 nt, Pseudomonas putida KT2440
cagcaaccugcugggc

SEQ ID NO: 1569913 - RNA, 22 nt, Pseudomonas putida KT2440
cagaugucuggcaucaaugcaa

SEQ ID NO: 1569914 - RNA, 14 nt, Pseudomonas putida KT2440
cagauggugaugcc

SEQ ID NO: 1569915 - RNA, 17 nt, Pseudomonas putida KT2440
cagaucaucaugcccaa

SEQ ID NO: 1569916 - RNA, 19 nt, Pseudomonas putida KT2440
cagaucaccagcucgcccg

SEQ ID NO: 1569917 - RNA, 17 nt, Pseudomonas putida KT2440
cagaucacccuuggcca

SEQ ID NO: 1569918 - RNA, 20 nt, Pseudomonas putida KT2440
cagaucagaacgaggcguug

SEQ ID NO: 1569919 - RNA, 19 nt, Pseudomonas putida KT2440
cacgaugccuucgaccacc

SEQ ID NO: 1569920 - RNA, 21 nt, Pseudomonas putida KT2440
cacgcaccaugucccaguuca

SEQ ID NO: 1569921 - RNA, 12 nt, Pseudomonas putida KT2440
cacgcacagugg

SEQ ID NO: 1569922 - RNA, 13 nt, Pseudomonas putida KT2440
cacgcacaucacg

SEQ ID NO: 1569923 - RNA, 15 nt, Pseudomonas putida KT2440
cacgcacaucggcaa

SEQ ID NO: 1569924 - RNA, 21 nt, Pseudomonas putida KT2440
cacgaugaaauacagcucgau

SEQ ID NO: 1569925 - RNA, 17 nt, Pseudomonas putida KT2440
cacgaucucgucacugc

SEQ ID NO: 1569926 - RNA, 21 nt, Pseudomonas putida KT2440
cacgaugcccauggcgcagcu

SEQ ID NO: 1569927 - RNA, 21 nt, Pseudomonas putida KT2440
cacgaugaucugccguuguuc

SEQ ID NO: 1569928 - RNA, 16 nt, Pseudomonas putida KT2440
cacgaucucacgcgcc

SEQ ID NO: 1569929 - RNA, 16 nt, Pseudomonas putida KT2440
cacgauagcgucagca

SEQ ID NO: 1569930 - RNA, 13 nt, Pseudomonas putida KT2440
cacgaucacucgu

SEQ ID NO: 1569931 - RNA, 20 nt, Pseudomonas putida KT2440
cacgacugaacaccugccag

SEQ ID NO: 1569932 - RNA, 14 nt, Pseudomonas putida KT2440
cacgacgauggcca

SEQ ID NO: 1569933 - RNA, 12 nt, Pseudomonas putida KT2440
cacgcaggccca

SEQ ID NO: 1569934 - RNA, 12 nt, Pseudomonas putida KT2440
cacgcaggccag

SEQ ID NO: 1569935 - RNA, 14 nt, Pseudomonas putida KT2440
cacgcaccucggcc

SEQ ID NO: 1569936 - RNA, 18 nt, Pseudomonas putida KT2440
cacgcaugccgaugucgg

SEQ ID NO: 1569937 - RNA, 20 nt, Pseudomonas putida KT2440
cacgccaccaugcucggcca

SEQ ID NO: 1569938 - RNA, 23 nt, Pseudomonas putida KT2440
cacgccaccaugcucggccagcu

SEQ ID NO: 1569939 - RNA, 16 nt, Pseudomonas putida KT2440
cacgccaaucaccugc

SEQ ID NO: 1569940 - RNA, 16 nt, Pseudomonas putida KT2440
cacgcaggucuugccc

SEQ ID NO: 1569941 - RNA, 21 nt, Pseudomonas putida KT2440
cacgcaugcgcgacagcauca

SEQ ID NO: 1569942 - RNA, 15 nt, Pseudomonas putida KT2440
cacgcaugucagggg

SEQ ID NO: 1569943 - RNA, 16 nt, Pseudomonas putida KT2440
cacgccacggaacauc

SEQ ID NO: 1569944 - RNA, 19 nt, Pseudomonas putida KT2440
cacgccacggaacaucgag

SEQ ID NO: 1569945 - RNA, 19 nt, Pseudomonas putida KT2440
cacgccagcagcguuguuc

SEQ ID NO: 1569946 - RNA, 23 nt, Pseudomonas putida KT2440
cacgccagccaguacggcagcca

SEQ ID NO: 1569947 - RNA, 14 nt, Pseudomonas putida KT2440
cacgcccgccggca

SEQ ID NO: 1569948 - RNA, 14 nt, Pseudomonas putida KT2440
cacgcccggcaccu

SEQ ID NO: 1569949 - RNA, 16 nt, Pseudomonas putida KT2440
cacgcccggcaccugc

SEQ ID NO: 1569950 - RNA, 15 nt, Pseudomonas putida KT2440
cacgcccuugcccca

SEQ ID NO: 1569951 - RNA, 20 nt, Pseudomonas putida KT2440
cacgcccuuuuucaccaggc

SEQ ID NO: 1569952 - RNA, 23 nt, Pseudomonas putida KT2440
cacgcccuuuuucaccaggcggu

SEQ ID NO: 1569953 - RNA, 23 nt, Pseudomonas putida KT2440
cacgcccuggcccgccgccacca

SEQ ID NO: 1569954 - RNA, 13 nt, Pseudomonas putida KT2440
cacgccgcugcca

SEQ ID NO: 1569955 - RNA, 19 nt, Pseudomonas putida KT2440
cacgccgcugccaaccggc

SEQ ID NO: 1569956 - RNA, 20 nt, Pseudomonas putida KT2440
cacgccgcugccaaccggcu

SEQ ID NO: 1569957 - RNA, 20 nt, Pseudomonas putida KT2440
cacgccgcugcggcugcucg

SEQ ID NO: 1569958 - RNA, 19 nt, Pseudomonas putida KT2440
cacgcgaaucgccagggcu

SEQ ID NO: 1569959 - RNA, 20 nt, Pseudomonas putida KT2440
caccucguccagguugagca

SEQ ID NO: 1569960 - RNA, 14 nt, Pseudomonas putida KT2440
caccucggaugcca

SEQ ID NO: 1569961 - RNA, 16 nt, Pseudomonas putida KT2440
caccucggcaccgcac

SEQ ID NO: 1569962 - RNA, 21 nt, Pseudomonas putida KT2440
caccugcagguaaugcgccgc

SEQ ID NO: 1569963 - RNA, 19 nt, Pseudomonas putida KT2440
caccugcagguacagcagc

SEQ ID NO: 1569964 - RNA, 15 nt, Pseudomonas putida KT2440
caccugcagcgcguu

SEQ ID NO: 1569965 - RNA, 19 nt, Pseudomonas putida KT2440
caccugccacacacccggg

SEQ ID NO: 1569966 - RNA, 18 nt, Pseudomonas putida KT2440
caccugcuucgcgggcac

SEQ ID NO: 1569967 - RNA, 19 nt, Pseudomonas putida KT2440
caccuggaauucgcugcgc

SEQ ID NO: 1569968 - RNA, 19 nt, Pseudomonas putida KT2440
caccuggauguugugcgaa

SEQ ID NO: 1569969 - RNA, 15 nt, Pseudomonas putida KT2440
caccugcgccuugcu

SEQ ID NO: 1569970 - RNA, 22 nt, Pseudomonas putida KT2440
caccugggcgucaucacccggg

SEQ ID NO: 1569971 - RNA, 14 nt, Pseudomonas putida KT2440
caccugggccagua

SEQ ID NO: 1569972 - RNA, 18 nt, Pseudomonas putida KT2440
caccuggcugcgggugcc

SEQ ID NO: 1569973 - RNA, 18 nt, Pseudomonas putida KT2440
caccugguaccccucgac

SEQ ID NO: 1569974 - RNA, 21 nt, Pseudomonas putida KT2440
caccugguaggucacuucagu

SEQ ID NO: 1569975 - RNA, 16 nt, Pseudomonas putida KT2440
caccuguuccacgacc

SEQ ID NO: 1569976 - RNA, 16 nt, Pseudomonas putida KT2440
caccuguugccgcuuc

SEQ ID NO: 1569977 - RNA, 14 nt, Pseudomonas putida KT2440
caccugucccagcu

SEQ ID NO: 1569978 - RNA, 16 nt, Pseudomonas putida KT2440
caccugucccagcugg

SEQ ID NO: 1569979 - RNA, 18 nt, Pseudomonas putida KT2440
caccugucccagcuggca

SEQ ID NO: 1569980 - RNA, 22 nt, Pseudomonas putida KT2440
caccuucgagccaccggcauag

SEQ ID NO: 1569981 - RNA, 15 nt, Pseudomonas putida KT2440
caccugugcaggcgu

SEQ ID NO: 1569982 - RNA, 16 nt, Pseudomonas putida KT2440
caccuucguccuugag

SEQ ID NO: 1569983 - RNA, 18 nt, Pseudomonas putida KT2440
caccuguuucaacgggua

SEQ ID NO: 1569984 - RNA, 21 nt, Pseudomonas putida KT2440
caccuuacuugcacaucccag

SEQ ID NO: 1569985 - RNA, 13 nt, Pseudomonas putida KT2440
caccuucacgcca

SEQ ID NO: 1569986 - RNA, 19 nt, Pseudomonas putida KT2440
caccuugcccaaccguucc

SEQ ID NO: 1569987 - RNA, 16 nt, Pseudomonas putida KT2440
caccuugaugcgcgag

SEQ ID NO: 1569988 - RNA, 20 nt, Pseudomonas putida KT2440
caccuugaugcgcgagcugg

SEQ ID NO: 1569989 - RNA, 13 nt, Pseudomonas putida KT2440
caccuuggccgcc

SEQ ID NO: 1569990 - RNA, 19 nt, Pseudomonas putida KT2440
caccuuggccgcccggaug

SEQ ID NO: 1569991 - RNA, 16 nt, Pseudomonas putida KT2440
caccuuguuacccgca

SEQ ID NO: 1569992 - RNA, 16 nt, Pseudomonas putida KT2440
caccuuguccagcagg

SEQ ID NO: 1569993 - RNA, 17 nt, Pseudomonas putida KT2440
caccuuguauucgagcu

SEQ ID NO: 1569994 - RNA, 17 nt, Pseudomonas putida KT2440
caccuuggugcgcgcau

SEQ ID NO: 1569995 - RNA, 15 nt, Pseudomonas putida KT2440
cacgaaucgggucca

SEQ ID NO: 1569996 - RNA, 17 nt, Pseudomonas putida KT2440
cacgaauggguggcagc

SEQ ID NO: 1569997 - RNA, 17 nt, Pseudomonas putida KT2440
cacgacaggggcgcaga

SEQ ID NO: 1569998 - RNA, 23 nt, Pseudomonas putida KT2440
cacgacaccgggauacugcgcac

SEQ ID NO: 1569999 - RNA, 13 nt, Pseudomonas putida KT2440
cacgaacagccag

SEQ ID NO: 1570000 - RNA, 15 nt, Pseudomonas putida KT2440
cacgaacagcggcaa

SEQ ID NO: 1570001 - RNA, 17 nt, Pseudomonas putida KT2440
cacgaacaucagcagga

SEQ ID NO: 1570002 - RNA, 14 nt, Pseudomonas putida KT2440
cacgaagcgcggca

SEQ ID NO: 1570003 - RNA, 21 nt, Pseudomonas putida KT2440
cacgaagccguugaggccgaa

SEQ ID NO: 1570004 - RNA, 21 nt, Pseudomonas putida KT2440
cacuccgggugaucauucagg

SEQ ID NO: 1570005 - RNA, 14 nt, Pseudomonas putida KT2440
cacgucgguggcga

SEQ ID NO: 1570006 - RNA, 16 nt, Pseudomonas putida KT2440
cacugacaaagccugc

SEQ ID NO: 1570007 - RNA, 21 nt, Pseudomonas putida KT2440
cacugacaaagccugcaccca

SEQ ID NO: 1570008 - RNA, 22 nt, Pseudomonas putida KT2440
cacugacaaagccugcacccag

SEQ ID NO: 1570009 - RNA, 15 nt, Pseudomonas putida KT2440
cacugaacgcaauau

SEQ ID NO: 1570010 - RNA, 20 nt, Pseudomonas putida KT2440
cacugccuggcucaggcgcu

SEQ ID NO: 1570011 - RNA, 15 nt, Pseudomonas putida KT2440
cacugccugcaugcg

SEQ ID NO: 1570012 - RNA, 13 nt, Pseudomonas putida KT2440
cacugccggcaaa

SEQ ID NO: 1570013 - RNA, 23 nt, Pseudomonas putida KT2440
cacugccgugaucgccgggcgca

SEQ ID NO: 1570014 - RNA, 22 nt, Pseudomonas putida KT2440
cacugcuguuccagaagcggcu

SEQ ID NO: 1570015 - RNA, 22 nt, Pseudomonas putida KT2440
cacugcggguaaagcccgcagu

SEQ ID NO: 1570016 - RNA, 22 nt, Pseudomonas putida KT2440
cacugcgcuugcgaccgaugcc

SEQ ID NO: 1570017 - RNA, 15 nt, Pseudomonas putida KT2440
cacugcgcgccguug

SEQ ID NO: 1570018 - RNA, 18 nt, Pseudomonas putida KT2440
cacugcgcgccguugcac

SEQ ID NO: 1570019 - RNA, 18 nt, Pseudomonas putida KT2440
cacugaccacuucaagca

SEQ ID NO: 1570020 - RNA, 21 nt, Pseudomonas putida KT2440
cacugaguaacucaccugguu

SEQ ID NO: 1570021 - RNA, 20 nt, Pseudomonas putida KT2440
cacugagucaaucgauguac

SEQ ID NO: 1570022 - RNA, 22 nt, Pseudomonas putida KT2440
cacugaucgggauuacaugaug

SEQ ID NO: 1570023 - RNA, 17 nt, Pseudomonas putida KT2440
cacugccagcaccuggc

SEQ ID NO: 1570024 - RNA, 19 nt, Pseudomonas putida KT2440
cacugccaucucgccaagc

SEQ ID NO: 1570025 - RNA, 20 nt, Pseudomonas putida KT2440
cacugcauuggccacgccca

SEQ ID NO: 1570026 - RNA, 16 nt, Pseudomonas putida KT2440
cacugcagaucaccag

SEQ ID NO: 1570027 - RNA, 13 nt, Pseudomonas putida KT2440
cagaaggcugcgu

SEQ ID NO: 1570028 - RNA, 15 nt, Pseudomonas putida KT2440
cagaagggcugguag

SEQ ID NO: 1570029 - RNA, 15 nt, Pseudomonas putida KT2440
cagaacacggugaca

SEQ ID NO: 1570030 - RNA, 14 nt, Pseudomonas putida KT2440
cagaaccgccagca

SEQ ID NO: 1570031 - RNA, 16 nt, Pseudomonas putida KT2440
cagaaccgccagcacc

SEQ ID NO: 1570032 - RNA, 23 nt, Pseudomonas putida KT2440
cacuuggccccagggaucgaugc

SEQ ID NO: 1570033 - RNA, 16 nt, Pseudomonas putida KT2440
cacuugggaucgaugc

SEQ ID NO: 1570034 - RNA, 16 nt, Pseudomonas putida KT2440
cacuuggaaaacagcg

SEQ ID NO: 1570035 - RNA, 16 nt, Pseudomonas putida KT2440
cacuuccauggcaucg

SEQ ID NO: 1570036 - RNA, 14 nt, Pseudomonas putida KT2440
cacuuugucgaugc

SEQ ID NO: 1570037 - RNA, 17 nt, Pseudomonas putida KT2440
cacuggcaacggguagc

SEQ ID NO: 1570038 - RNA, 18 nt, Pseudomonas putida KT2440
cacuggaugacgccgcag

SEQ ID NO: 1570039 - RNA, 13 nt, Pseudomonas putida KT2440
cacuggcaggccu

SEQ ID NO: 1570040 - RNA, 14 nt, Pseudomonas putida KT2440
cacuggcaggcuca

SEQ ID NO: 1570041 - RNA, 16 nt, Pseudomonas putida KT2440
cacuggggguucgcca

SEQ ID NO: 1570042 - RNA, 20 nt, Pseudomonas putida KT2440
cacugggcgauggcgucgac

SEQ ID NO: 1570043 - RNA, 11 nt, Pseudomonas putida KT2440
cacuggcuucc

SEQ ID NO: 1570044 - RNA, 14 nt, Pseudomonas putida KT2440
cacuggcugcugcg

SEQ ID NO: 1570045 - RNA, 20 nt, Pseudomonas putida KT2440
cacugugcccgccaggcgca

SEQ ID NO: 1570046 - RNA, 23 nt, Pseudomonas putida KT2440
cacugucaaucuugcgcacgcgc

SEQ ID NO: 1570047 - RNA, 14 nt, Pseudomonas putida KT2440
cacuguugcagcgc

SEQ ID NO: 1570048 - RNA, 22 nt, Pseudomonas putida KT2440
cacuguugcuggcgacgcugcc

SEQ ID NO: 1570049 - RNA, 19 nt, Pseudomonas putida KT2440
cacugugcuggggccagcc

SEQ ID NO: 1570050 - RNA, 20 nt, Pseudomonas putida KT2440
cacuuacaaccccaaccuca

SEQ ID NO: 1570051 - RNA, 20 nt, Pseudomonas putida KT2440
cacuucaaguucguuggcga

SEQ ID NO: 1570052 - RNA, 17 nt, Pseudomonas putida KT2440
cacuuccaacacccgga

SEQ ID NO: 1570053 - RNA, 13 nt, Pseudomonas putida KT2440
cacgcgaucggca

SEQ ID NO: 1570054 - RNA, 20 nt, Pseudomonas putida KT2440
cacgcgacgggaagugcacu

SEQ ID NO: 1570055 - RNA, 15 nt, Pseudomonas putida KT2440
cacgcgccaaccgcg

SEQ ID NO: 1570056 - RNA, 19 nt, Pseudomonas putida KT2440
cacgcgccagcagcgcgug

SEQ ID NO: 1570057 - RNA, 12 nt, Pseudomonas putida KT2440
cacgcgccaggu

SEQ ID NO: 1570058 - RNA, 15 nt, Pseudomonas putida KT2440
cacgcgccaggucgg

SEQ ID NO: 1570059 - RNA, 20 nt, Pseudomonas putida KT2440
cacgcgcccggugcaagcca

SEQ ID NO: 1570060 - RNA, 18 nt, Pseudomonas putida KT2440
cacgcgcccugugggagc

SEQ ID NO: 1570061 - RNA, 13 nt, Pseudomonas putida KT2440
cacggcaagccug

SEQ ID NO: 1570062 - RNA, 22 nt, Pseudomonas putida KT2440
cacggcaccagcaccagcuccu

SEQ ID NO: 1570063 - RNA, 23 nt, Pseudomonas putida KT2440
cacggagucagugugaccuucaa

SEQ ID NO: 1570064 - RNA, 22 nt, Pseudomonas putida KT2440
cacggcguccaggcccgccaga

SEQ ID NO: 1570065 - RNA, 13 nt, Pseudomonas putida KT2440
cacggcguagggc

SEQ ID NO: 1570066 - RNA, 17 nt, Pseudomonas putida KT2440
cacggcgguucugcgca

SEQ ID NO: 1570067 - RNA, 19 nt, Pseudomonas putida KT2440
cacggcgguucugcgcacg

SEQ ID NO: 1570068 - RNA, 20 nt, Pseudomonas putida KT2440
cacggcgcaggccgacaaca

SEQ ID NO: 1570069 - RNA, 17 nt, Pseudomonas putida KT2440
cacgucgccugggcauu

SEQ ID NO: 1570070 - RNA, 18 nt, Pseudomonas putida KT2440
cacgucgcgauugaucag

SEQ ID NO: 1570071 - RNA, 19 nt, Pseudomonas putida KT2440
cacguccuggucacggcca

SEQ ID NO: 1570072 - RNA, 22 nt, Pseudomonas putida KT2440
cacguccagccccgcaccgcgg

SEQ ID NO: 1570073 - RNA, 16 nt, Pseudomonas putida KT2440
cacgguguauccagcc

SEQ ID NO: 1570074 - RNA, 17 nt, Pseudomonas putida KT2440
cacggcugcccugcaug

SEQ ID NO: 1570075 - RNA, 14 nt, Pseudomonas putida KT2440
cacggcugucacca

SEQ ID NO: 1570076 - RNA, 15 nt, Pseudomonas putida KT2440
cacggcuucgcgcau

SEQ ID NO: 1570077 - RNA, 14 nt, Pseudomonas putida KT2440
cacggcgucgagca

SEQ ID NO: 1570078 - RNA, 20 nt, Pseudomonas putida KT2440
cacggugacaaaggccggca

SEQ ID NO: 1570079 - RNA, 14 nt, Pseudomonas putida KT2440
cacgggucaugcca

SEQ ID NO: 1570080 - RNA, 15 nt, Pseudomonas putida KT2440
cacgguaccggcaau

SEQ ID NO: 1570081 - RNA, 17 nt, Pseudomonas putida KT2440
cacgguaggugaugcgg

SEQ ID NO: 1570082 - RNA, 20 nt, Pseudomonas putida KT2440
caguuggcggcgcagcgcac

SEQ ID NO: 1570083 - RNA, 20 nt, Pseudomonas putida KT2440
caguuccggcaggucgauga

SEQ ID NO: 1570084 - RNA, 18 nt, Pseudomonas putida KT2440
caguuccaugucgugcug

SEQ ID NO: 1570085 - RNA, 22 nt, Pseudomonas putida KT2440
caguugcagacgcgcagcacuu

SEQ ID NO: 1570086 - RNA, 14 nt, Pseudomonas putida KT2440
caguucagcgcccg

SEQ ID NO: 1570087 - RNA, 19 nt, Pseudomonas putida KT2440
caguucauggcucacaccc

SEQ ID NO: 1570088 - RNA, 14 nt, Pseudomonas putida KT2440
caguuccaccggca

SEQ ID NO: 1570089 - RNA, 17 nt, Pseudomonas putida KT2440
caguucacgcaggcgca

SEQ ID NO: 1570090 - RNA, 13 nt, Pseudomonas putida KT2440
caguucaaagcga

SEQ ID NO: 1570091 - RNA, 16 nt, Pseudomonas putida KT2440
cagucgccuucguaca

SEQ ID NO: 1570092 - RNA, 14 nt, Pseudomonas putida KT2440
cagucgccaaccgc

SEQ ID NO: 1570093 - RNA, 17 nt, Pseudomonas putida KT2440
cagucgccccgccagcg

SEQ ID NO: 1570094 - RNA, 18 nt, Pseudomonas putida KT2440
cagucgccgauacccgca

SEQ ID NO: 1570095 - RNA, 17 nt, Pseudomonas putida KT2440
cagugccguggcaggca

SEQ ID NO: 1570096 - RNA, 17 nt, Pseudomonas putida KT2440
cagugccuucaggcaca

SEQ ID NO: 1570097 - RNA, 15 nt, Pseudomonas putida KT2440
cagugccugggucag

SEQ ID NO: 1570098 - RNA, 14 nt, Pseudomonas putida KT2440
cagugccugaccgg

SEQ ID NO: 1570099 - RNA, 16 nt, Pseudomonas putida KT2440
cagugccuggaugcgg

SEQ ID NO: 1570100 - RNA, 17 nt, Pseudomonas putida KT2440
cauaguugaccagcacc

SEQ ID NO: 1570101 - RNA, 13 nt, Pseudomonas putida KT2440
cauacuuggccga

SEQ ID NO: 1570102 - RNA, 14 nt, Pseudomonas putida KT2440
cauacggucgauga

SEQ ID NO: 1570103 - RNA, 14 nt, Pseudomonas putida KT2440
cauaccgcugggca

SEQ ID NO: 1570104 - RNA, 16 nt, Pseudomonas putida KT2440
cauaccgagaaugaaa

SEQ ID NO: 1570105 - RNA, 17 nt, Pseudomonas putida KT2440
cauacucuucgcgggcu

SEQ ID NO: 1570106 - RNA, 23 nt, Pseudomonas putida KT2440
caguugguagagcacgaccuugc

SEQ ID NO: 1570107 - RNA, 20 nt, Pseudomonas putida KT2440
caguuggcguccagcagugc

SEQ ID NO: 1570108 - RNA, 17 nt, Pseudomonas putida KT2440
caguuguaguucccgcg

SEQ ID NO: 1570109 - RNA, 19 nt, Pseudomonas putida KT2440
caguuguccaggcugcgca

SEQ ID NO: 1570110 - RNA, 18 nt, Pseudomonas putida KT2440
caguuucaccugaccauc

SEQ ID NO: 1570111 - RNA, 17 nt, Pseudomonas putida KT2440
caguuuucaaugcugcu

SEQ ID NO: 1570112 - RNA, 18 nt, Pseudomonas putida KT2440
caguuucgcgacgaggcc

SEQ ID NO: 1570113 - RNA, 19 nt, Pseudomonas putida KT2440
caguuugcuuuuucgagca

SEQ ID NO: 1570114 - RNA, 18 nt, Pseudomonas putida KT2440
cauacaggaccaggccga

SEQ ID NO: 1570115 - RNA, 18 nt, Pseudomonas putida KT2440
cauacagggccuggcgcg

SEQ ID NO: 1570116 - RNA, 15 nt, Pseudomonas putida KT2440
cauacagcgccucca

SEQ ID NO: 1570117 - RNA, 13 nt, Pseudomonas putida KT2440
cauaacggcuggc

SEQ ID NO: 1570118 - RNA, 18 nt, Pseudomonas putida KT2440
cauccgcaccccaaggcu

SEQ ID NO: 1570119 - RNA, 21 nt, Pseudomonas putida KT2440
caucccgcuucgccagcgcca

SEQ ID NO: 1570120 - RNA, 21 nt, Pseudomonas putida KT2440
cauccaccgccccaagcgccu

SEQ ID NO: 1570121 - RNA, 13 nt, Pseudomonas putida KT2440
cauccaccuguga

SEQ ID NO: 1570122 - RNA, 15 nt, Pseudomonas putida KT2440
cauccacccacuugg

SEQ ID NO: 1570123 - RNA, 16 nt, Pseudomonas putida KT2440
cauccaccacccuggc

SEQ ID NO: 1570124 - RNA, 19 nt, Pseudomonas putida KT2440
cauccacaaucagcacugu

SEQ ID NO: 1570125 - RNA, 21 nt, Pseudomonas putida KT2440
cauccaacgcugccuugccca

SEQ ID NO: 1570126 - RNA, 15 nt, Pseudomonas putida KT2440
caucauggcggugaa

SEQ ID NO: 1570127 - RNA, 15 nt, Pseudomonas putida KT2440
caucagaccgccgau

SEQ ID NO: 1570128 - RNA, 17 nt, Pseudomonas putida KT2440
caucacuuccggcugca

SEQ ID NO: 1570129 - RNA, 15 nt, Pseudomonas putida KT2440
caucaugccgcccau

SEQ ID NO: 1570130 - RNA, 14 nt, Pseudomonas putida KT2440
caucauccugcugg

SEQ ID NO: 1570131 - RNA, 17 nt, Pseudomonas putida KT2440
caucaucagcaggcagu

SEQ ID NO: 1570132 - RNA, 16 nt, Pseudomonas putida KT2440
caucacccgcgaaugc

SEQ ID NO: 1570133 - RNA, 15 nt, Pseudomonas putida KT2440
caucaccggcaggug

SEQ ID NO: 1570134 - RNA, 12 nt, Pseudomonas putida KT2440
caucacuacucc

SEQ ID NO: 1570135 - RNA, 23 nt, Pseudomonas putida KT2440
caucacuagaucucgcuucaugg

SEQ ID NO: 1570136 - RNA, 22 nt, Pseudomonas putida KT2440
caucaccacccccagcgaccag

SEQ ID NO: 1570137 - RNA, 16 nt, Pseudomonas putida KT2440
cauauccgcaccgggc

SEQ ID NO: 1570138 - RNA, 23 nt, Pseudomonas putida KT2440
cauauccuuuguaggagcgggcu

SEQ ID NO: 1570139 - RNA, 16 nt, Pseudomonas putida KT2440
cagggugccagaccac

SEQ ID NO: 1570140 - RNA, 21 nt, Pseudomonas putida KT2440
caggguggccagcaaggcaau

SEQ ID NO: 1570141 - RNA, 14 nt, Pseudomonas putida KT2440
cagggucagggcca

SEQ ID NO: 1570142 - RNA, 23 nt, Pseudomonas putida KT2440
cagggucgggcacaggcccagca

SEQ ID NO: 1570143 - RNA, 13 nt, Pseudomonas putida KT2440
cagggucugcgcu

SEQ ID NO: 1570144 - RNA, 17 nt, Pseudomonas putida KT2440
cagggucugcgcuucaa

SEQ ID NO: 1570145 - RNA, 19 nt, Pseudomonas putida KT2440
cagggguagcgucaacugc

SEQ ID NO: 1570146 - RNA, 23 nt, Pseudomonas putida KT2440
cagggucgccugaacgcugcgcg

SEQ ID NO: 1570147 - RNA, 22 nt, Pseudomonas putida KT2440
cagguagccuuccagcuccuuc

SEQ ID NO: 1570148 - RNA, 15 nt, Pseudomonas putida KT2440
cagguagcgauugcg

SEQ ID NO: 1570149 - RNA, 18 nt, Pseudomonas putida KT2440
cagguagcgcccgggcau

SEQ ID NO: 1570150 - RNA, 19 nt, Pseudomonas putida KT2440
cagguagcgcccgggcauc

SEQ ID NO: 1570151 - RNA, 19 nt, Pseudomonas putida KT2440
cagguaguacggcaggcga

SEQ ID NO: 1570152 - RNA, 17 nt, Pseudomonas putida KT2440
cagguaauccagcucgu

SEQ ID NO: 1570153 - RNA, 19 nt, Pseudomonas putida KT2440
cagguacacgggcaugcca

SEQ ID NO: 1570154 - RNA, 20 nt, Pseudomonas putida KT2440
cagguacacgggcaugccau

SEQ ID NO: 1570155 - RNA, 21 nt, Pseudomonas putida KT2440
cagguacgaaaaggccugcac

SEQ ID NO: 1570156 - RNA, 20 nt, Pseudomonas putida KT2440
cagguaaaaaucaugcaguu

SEQ ID NO: 1570157 - RNA, 20 nt, Pseudomonas putida KT2440
caggguucgccgucagccuu

SEQ ID NO: 1570158 - RNA, 19 nt, Pseudomonas putida KT2440
cagggugucgguggcggcc

SEQ ID NO: 1570159 - RNA, 19 nt, Pseudomonas putida KT2440
cagggcgaucuccugcagg

SEQ ID NO: 1570160 - RNA, 21 nt, Pseudomonas putida KT2440
caggcgcggugccggcagcuc

SEQ ID NO: 1570161 - RNA, 18 nt, Pseudomonas putida KT2440
caggggugccuucgagca

SEQ ID NO: 1570162 - RNA, 22 nt, Pseudomonas putida KT2440
cagggcuuucuucucuugcccg

SEQ ID NO: 1570163 - RNA, 15 nt, Pseudomonas putida KT2440
caggggccgcgcagc

SEQ ID NO: 1570164 - RNA, 17 nt, Pseudomonas putida KT2440
cagggcgcuugcccgcg

SEQ ID NO: 1570165 - RNA, 21 nt, Pseudomonas putida KT2440
cagggcgcgaaaagccugcac

SEQ ID NO: 1570166 - RNA, 20 nt, Pseudomonas putida KT2440
cagguccaguucgcgcaagc

SEQ ID NO: 1570167 - RNA, 13 nt, Pseudomonas putida KT2440
cagguccaggcca

SEQ ID NO: 1570168 - RNA, 16 nt, Pseudomonas putida KT2440
cagguccaggccagcu

SEQ ID NO: 1570169 - RNA, 21 nt, Pseudomonas putida KT2440
cagguccggaaacucacgcgc

SEQ ID NO: 1570170 - RNA, 22 nt, Pseudomonas putida KT2440
cagguccggaaacucacgcgcc

SEQ ID NO: 1570171 - RNA, 14 nt, Pseudomonas putida KT2440
caggucgacaccca

SEQ ID NO: 1570172 - RNA, 20 nt, Pseudomonas putida KT2440
caggucgacgauacccagcg

SEQ ID NO: 1570173 - RNA, 16 nt, Pseudomonas putida KT2440
cagguaugugagcugc

SEQ ID NO: 1570174 - RNA, 19 nt, Pseudomonas putida KT2440
cagguaugugagcugcgcg

SEQ ID NO: 1570175 - RNA, 19 nt, Pseudomonas putida KT2440
cagguagugcgcggccgug

SEQ ID NO: 1570176 - RNA, 16 nt, Pseudomonas putida KT2440
caggucaugaugcccg

SEQ ID NO: 1570177 - RNA, 20 nt, Pseudomonas putida KT2440
caggucaucgaagaucagca

SEQ ID NO: 1570178 - RNA, 18 nt, Pseudomonas putida KT2440
caggucagcguugccgau

SEQ ID NO: 1570179 - RNA, 19 nt, Pseudomonas putida KT2440
caggucauaguucuggcug

SEQ ID NO: 1570180 - RNA, 21 nt, Pseudomonas putida KT2440
caggucgguagggaucaccgc

SEQ ID NO: 1570181 - RNA, 20 nt, Pseudomonas putida KT2440
caggucgaucccgccgagca

SEQ ID NO: 1570182 - RNA, 13 nt, Pseudomonas putida KT2440
caggucgauccgg

SEQ ID NO: 1570183 - RNA, 17 nt, Pseudomonas putida KT2440
caggucgaucgcaacgu

SEQ ID NO: 1570184 - RNA, 17 nt, Pseudomonas putida KT2440
caggucgaccgagaagc

SEQ ID NO: 1570185 - RNA, 17 nt, Pseudomonas putida KT2440
caggucggucagcaccg

SEQ ID NO: 1570186 - RNA, 14 nt, Pseudomonas putida KT2440
caggugcaggagca

SEQ ID NO: 1570187 - RNA, 22 nt, Pseudomonas putida KT2440
caggugcagguacugcaugugc

SEQ ID NO: 1570188 - RNA, 14 nt, Pseudomonas putida KT2440
caggugccaacggu

SEQ ID NO: 1570189 - RNA, 22 nt, Pseudomonas putida KT2440
caggugccaacggucagacgcg

SEQ ID NO: 1570190 - RNA, 18 nt, Pseudomonas putida KT2440
caggugcgaaucgacgcg

SEQ ID NO: 1570191 - RNA, 16 nt, Pseudomonas putida KT2440
cagucagucggcugcu

SEQ ID NO: 1570192 - RNA, 16 nt, Pseudomonas putida KT2440
caguacuuauaagcag

SEQ ID NO: 1570193 - RNA, 17 nt, Pseudomonas putida KT2440
cagucccagcaccgcga

SEQ ID NO: 1570194 - RNA, 15 nt, Pseudomonas putida KT2440
cagguugugucgggc

SEQ ID NO: 1570195 - RNA, 14 nt, Pseudomonas putida KT2440
cagguugguggugc

SEQ ID NO: 1570196 - RNA, 23 nt, Pseudomonas putida KT2440
cagguggugguccccuucgucga

SEQ ID NO: 1570197 - RNA, 12 nt, Pseudomonas putida KT2440
cagguugcugcc

SEQ ID NO: 1570198 - RNA, 17 nt, Pseudomonas putida KT2440
cagguuggacagcgccc

SEQ ID NO: 1570199 - RNA, 15 nt, Pseudomonas putida KT2440
caguacaacgucaca

SEQ ID NO: 1570200 - RNA, 15 nt, Pseudomonas putida KT2440
caguacaugaucggg

SEQ ID NO: 1570201 - RNA, 22 nt, Pseudomonas putida KT2440
caguaccgcgccuccagcuggc

SEQ ID NO: 1570202 - RNA, 19 nt, Pseudomonas putida KT2440
caguaccuuggcguaggcc

SEQ ID NO: 1570203 - RNA, 18 nt, Pseudomonas putida KT2440
caguacgccagcagcgca

SEQ ID NO: 1570204 - RNA, 21 nt, Pseudomonas putida KT2440
cagguuuucucgucuggcgcg

SEQ ID NO: 1570205 - RNA, 16 nt, Pseudomonas putida KT2440
caggcccaccaccggu

SEQ ID NO: 1570206 - RNA, 23 nt, Pseudomonas putida KT2440
caggcccaccagucugcucagcc

SEQ ID NO: 1570207 - RNA, 23 nt, Pseudomonas putida KT2440
caggccauacagggccuggcgcg

SEQ ID NO: 1570208 - RNA, 20 nt, Pseudomonas putida KT2440
caggccauauugcugagcca

SEQ ID NO: 1570209 - RNA, 16 nt, Pseudomonas putida KT2440
caggccauggugcacg

SEQ ID NO: 1570210 - RNA, 21 nt, Pseudomonas putida KT2440
caggccaucuaagccuccaga

SEQ ID NO: 1570211 - RNA, 15 nt, Pseudomonas putida KT2440
caggccaucagcagc

SEQ ID NO: 1570212 - RNA, 19 nt, Pseudomonas putida KT2440
caggccgauggcgaugggu

SEQ ID NO: 1570213 - RNA, 14 nt, Pseudomonas putida KT2440
caggccgaugccaa

SEQ ID NO: 1570214 - RNA, 12 nt, Pseudomonas putida KT2440
caggccgcagcc

SEQ ID NO: 1570215 - RNA, 16 nt, Pseudomonas putida KT2440
caggccgaugggcagg

SEQ ID NO: 1570216 - RNA, 12 nt, Pseudomonas putida KT2440
caggcaugccag

SEQ ID NO: 1570217 - RNA, 15 nt, Pseudomonas putida KT2440
caggcaugccagcag

SEQ ID NO: 1570218 - RNA, 16 nt, Pseudomonas putida KT2440
caggcaugccagcagc

SEQ ID NO: 1570219 - RNA, 19 nt, Pseudomonas putida KT2440
caggcaugccagcagcugg

SEQ ID NO: 1570220 - RNA, 20 nt, Pseudomonas putida KT2440
caggcauugcccgcgauagc

SEQ ID NO: 1570221 - RNA, 19 nt, Pseudomonas putida KT2440
caggcauuguugcaacgca

SEQ ID NO: 1570222 - RNA, 23 nt, Pseudomonas putida KT2440
caggcauuguugcaacgcagcgc

SEQ ID NO: 1570223 - RNA, 15 nt, Pseudomonas putida KT2440
caggcaguaggccac

SEQ ID NO: 1570224 - RNA, 16 nt, Pseudomonas putida KT2440
caggcaguaggccacc

SEQ ID NO: 1570225 - RNA, 16 nt, Pseudomonas putida KT2440
caggcaggaacuggcu

SEQ ID NO: 1570226 - RNA, 16 nt, Pseudomonas putida KT2440
caggcaguuucaggcg

SEQ ID NO: 1570227 - RNA, 18 nt, Pseudomonas putida KT2440
caggcaucacgucacagc

SEQ ID NO: 1570228 - RNA, 17 nt, Pseudomonas putida KT2440
caggcauaccgcaacac

SEQ ID NO: 1570229 - RNA, 15 nt, Pseudomonas putida KT2440
caggccagccaggua

SEQ ID NO: 1570230 - RNA, 22 nt, Pseudomonas putida KT2440
caggccagccccagcggcagca

SEQ ID NO: 1570231 - RNA, 16 nt, Pseudomonas putida KT2440
caggccaccggcagca

SEQ ID NO: 1570232 - RNA, 21 nt, Pseudomonas putida KT2440
caggccaccggcagcaccugc

SEQ ID NO: 1570233 - RNA, 19 nt, Pseudomonas putida KT2440
caggccaaguacggccagc

SEQ ID NO: 1570234 - RNA, 20 nt, Pseudomonas putida KT2440
caggccaaguacggccagca

SEQ ID NO: 1570235 - RNA, 19 nt, Pseudomonas putida KT2440
caggccaaugcccaugccc

SEQ ID NO: 1570236 - RNA, 16 nt, Pseudomonas putida KT2440
caggccuuguuccacg

SEQ ID NO: 1570237 - RNA, 17 nt, Pseudomonas putida KT2440
caggccuuucagcgccc

SEQ ID NO: 1570238 - RNA, 13 nt, Pseudomonas putida KT2440
caggcgcagcagc

SEQ ID NO: 1570239 - RNA, 18 nt, Pseudomonas putida KT2440
caggcgcagcacgccguu

SEQ ID NO: 1570240 - RNA, 21 nt, Pseudomonas putida KT2440
caggcgcagcacgccguugcg

SEQ ID NO: 1570241 - RNA, 14 nt, Pseudomonas putida KT2440
caggcgcgccugca

SEQ ID NO: 1570242 - RNA, 17 nt, Pseudomonas putida KT2440
caggcgcgccugcaccu

SEQ ID NO: 1570243 - RNA, 17 nt, Pseudomonas putida KT2440
caggcgcggcagcauga

SEQ ID NO: 1570244 - RNA, 18 nt, Pseudomonas putida KT2440
caggcgcgcuaccggacu

SEQ ID NO: 1570245 - RNA, 19 nt, Pseudomonas putida KT2440
caggcgcaggcucuccacg

SEQ ID NO: 1570246 - RNA, 20 nt, Pseudomonas putida KT2440
caggcgcagggugugcugcu

SEQ ID NO: 1570247 - RNA, 21 nt, Pseudomonas putida KT2440
caggcgcagggugugcugcug

SEQ ID NO: 1570248 - RNA, 19 nt, Pseudomonas putida KT2440
caggccugaaacgcccuug

SEQ ID NO: 1570249 - RNA, 14 nt, Pseudomonas putida KT2440
caggccugcggcca

SEQ ID NO: 1570250 - RNA, 12 nt, Pseudomonas putida KT2440
caggccgccuug

SEQ ID NO: 1570251 - RNA, 20 nt, Pseudomonas putida KT2440
caggaugccaaggaucagcu

SEQ ID NO: 1570252 - RNA, 21 nt, Pseudomonas putida KT2440
caggaugccaaggaucagcuc

SEQ ID NO: 1570253 - RNA, 19 nt, Pseudomonas putida KT2440
caggaucuccucggccagc

SEQ ID NO: 1570254 - RNA, 20 nt, Pseudomonas putida KT2440
caggaucuccucggccagcg

SEQ ID NO: 1570255 - RNA, 17 nt, Pseudomonas putida KT2440
caggcagaagguaggca

SEQ ID NO: 1570256 - RNA, 14 nt, Pseudomonas putida KT2440
caggcagaccacgc

SEQ ID NO: 1570257 - RNA, 15 nt, Pseudomonas putida KT2440
caggcacuggccagc

SEQ ID NO: 1570258 - RNA, 21 nt, Pseudomonas putida KT2440
caggauggcaaagcgcagcaa

SEQ ID NO: 1570259 - RNA, 19 nt, Pseudomonas putida KT2440
caggauggccgcaggccca

SEQ ID NO: 1570260 - RNA, 21 nt, Pseudomonas putida KT2440
caggcagcgauggccgugcaa

SEQ ID NO: 1570261 - RNA, 15 nt, Pseudomonas putida KT2440
caggcagccuccagg

SEQ ID NO: 1570262 - RNA, 19 nt, Pseudomonas putida KT2440
caggcagccugccagguca

SEQ ID NO: 1570263 - RNA, 14 nt, Pseudomonas putida KT2440
caggcagcacaugc

SEQ ID NO: 1570264 - RNA, 20 nt, Pseudomonas putida KT2440
caggagcgagcaagcucgcu

SEQ ID NO: 1570265 - RNA, 19 nt, Pseudomonas putida KT2440
caggaucaugugcgccacu

SEQ ID NO: 1570266 - RNA, 19 nt, Pseudomonas putida KT2440
caggacgauggugaaggcc

SEQ ID NO: 1570267 - RNA, 22 nt, Pseudomonas putida KT2440
caggaagauguguuggccggac

SEQ ID NO: 1570268 - RNA, 22 nt, Pseudomonas putida KT2440
caggaagaaggcauccagggcg

SEQ ID NO: 1570269 - RNA, 18 nt, Pseudomonas putida KT2440
caggacggauacaccaga

SEQ ID NO: 1570270 - RNA, 13 nt, Pseudomonas putida KT2440
cagcuccuggcuc

SEQ ID NO: 1570271 - RNA, 20 nt, Pseudomonas putida KT2440
cagcuccucugccgacaaac

SEQ ID NO: 1570272 - RNA, 20 nt, Pseudomonas putida KT2440
cagcuccuucgcuucgcgca

SEQ ID NO: 1570273 - RNA, 23 nt, Pseudomonas putida KT2440
cagcugccggaacguuuccagca

SEQ ID NO: 1570274 - RNA, 18 nt, Pseudomonas putida KT2440
cagcugccggccagcgcc

SEQ ID NO: 1570275 - RNA, 22 nt, Pseudomonas putida KT2440
cagcuggcgcaugacuuccagg

SEQ ID NO: 1570276 - RNA, 18 nt, Pseudomonas putida KT2440
cagcuggcuggugacaac

SEQ ID NO: 1570277 - RNA, 13 nt, Pseudomonas putida KT2440
cagcugcggucga

SEQ ID NO: 1570278 - RNA, 22 nt, Pseudomonas putida KT2440
cagcugcggucgagcugcccac

SEQ ID NO: 1570279 - RNA, 14 nt, Pseudomonas putida KT2440
cagcugcggcuggg

SEQ ID NO: 1570280 - RNA, 17 nt, Pseudomonas putida KT2440
cagcuguacgcuggcca

SEQ ID NO: 1570281 - RNA, 22 nt, Pseudomonas putida KT2440
cagcuguacgcuggccaaggcc

SEQ ID NO: 1570282 - RNA, 23 nt, Pseudomonas putida KT2440
cagcuguugcuguuggcgcgaca

SEQ ID NO: 1570283 - RNA, 23 nt, Pseudomonas putida KT2440
cagcugugcugccauaagcccaa

SEQ ID NO: 1570284 - RNA, 15 nt, Pseudomonas putida KT2440
cagcuugucgaccag

SEQ ID NO: 1570285 - RNA, 17 nt, Pseudomonas putida KT2440
cagcuuggucagggcaa

SEQ ID NO: 1570286 - RNA, 20 nt, Pseudomonas putida KT2440
cagcuucccggccuggcgca

SEQ ID NO: 1570287 - RNA, 20 nt, Pseudomonas putida KT2440
cagcuuccgccaccacgaac

SEQ ID NO: 1570288 - RNA, 14 nt, Pseudomonas putida KT2440
cagcuucagccagg

SEQ ID NO: 1570289 - RNA, 18 nt, Pseudomonas putida KT2440
cagcuucauggcgccgau

SEQ ID NO: 1570290 - RNA, 22 nt, Pseudomonas putida KT2440
cagcuuuggcugcaggucggcc

SEQ ID NO: 1570291 - RNA, 12 nt, Pseudomonas putida KT2440
caggaacagcgc

SEQ ID NO: 1570292 - RNA, 17 nt, Pseudomonas putida KT2440
caggaacagcggcagca

SEQ ID NO: 1570293 - RNA, 18 nt, Pseudomonas putida KT2440
cagcuugugcagcgacgg

SEQ ID NO: 1570294 - RNA, 22 nt, Pseudomonas putida KT2440
cagcuugugccgcggcuccagg

SEQ ID NO: 1570295 - RNA, 20 nt, Pseudomonas putida KT2440
cagcuuuuagacauugagca

SEQ ID NO: 1570296 - RNA, 15 nt, Pseudomonas putida KT2440
cagcuuguugccagc

SEQ ID NO: 1570297 - RNA, 13 nt, Pseudomonas putida KT2440
cagcgcgcugagc

SEQ ID NO: 1570298 - RNA, 18 nt, Pseudomonas putida KT2440
cagcgcggaacacacgcu

SEQ ID NO: 1570299 - RNA, 17 nt, Pseudomonas putida KT2440
cagcgcggugaccagcg

SEQ ID NO: 1570300 - RNA, 19 nt, Pseudomonas putida KT2440
cagcgcggugaccagcggc

SEQ ID NO: 1570301 - RNA, 14 nt, Pseudomonas putida KT2440
cagcgcgucauccg

SEQ ID NO: 1570302 - RNA, 22 nt, Pseudomonas putida KT2440
cagcgcguacagcgacaugccg

SEQ ID NO: 1570303 - RNA, 14 nt, Pseudomonas putida KT2440
cagcgcguccagca

SEQ ID NO: 1570304 - RNA, 14 nt, Pseudomonas putida KT2440
cagcgcuucgauca

SEQ ID NO: 1570305 - RNA, 14 nt, Pseudomonas putida KT2440
cagcgcuucgaucg

SEQ ID NO: 1570306 - RNA, 19 nt, Pseudomonas putida KT2440
cagcgcugggcgguaccca

SEQ ID NO: 1570307 - RNA, 16 nt, Pseudomonas putida KT2440
cagcgcugacucagcg

SEQ ID NO: 1570308 - RNA, 18 nt, Pseudomonas putida KT2440
cagcgcugacucagcggc

SEQ ID NO: 1570309 - RNA, 15 nt, Pseudomonas putida KT2440
cagcgcugcgaggcc

SEQ ID NO: 1570310 - RNA, 21 nt, Pseudomonas putida KT2440
cagcgcugaguggcaugacca

SEQ ID NO: 1570311 - RNA, 17 nt, Pseudomonas putida KT2440
cagcgcuuccaagugcu

SEQ ID NO: 1570312 - RNA, 16 nt, Pseudomonas putida KT2440
cagcggaccaggugca

SEQ ID NO: 1570313 - RNA, 13 nt, Pseudomonas putida KT2440
cagcggcaauucg

SEQ ID NO: 1570314 - RNA, 16 nt, Pseudomonas putida KT2440
cagcggcaauucggcc

SEQ ID NO: 1570315 - RNA, 19 nt, Pseudomonas putida KT2440
cagcggcaacaccagcagc

SEQ ID NO: 1570316 - RNA, 21 nt, Pseudomonas putida KT2440
cagcggcaaccugacccgcgc

SEQ ID NO: 1570317 - RNA, 20 nt, Pseudomonas putida KT2440
cagcggcagcaacacgacga

SEQ ID NO: 1570318 - RNA, 19 nt, Pseudomonas putida KT2440
cagcggcagacacaggcgc

SEQ ID NO: 1570319 - RNA, 17 nt, Pseudomonas putida KT2440
cagcggcacgucacugc

SEQ ID NO: 1570320 - RNA, 17 nt, Pseudomonas putida KT2440
cagcggcacggccacca

SEQ ID NO: 1570321 - RNA, 17 nt, Pseudomonas putida KT2440
cagcggcagcaucgacc

SEQ ID NO: 1570322 - RNA, 20 nt, Pseudomonas putida KT2440
cagcggcagcaucgaccugc

SEQ ID NO: 1570323 - RNA, 15 nt, Pseudomonas putida KT2440
cagcgggggcagugc

SEQ ID NO: 1570324 - RNA, 20 nt, Pseudomonas putida KT2440
cagcggggauucaacagcgc

SEQ ID NO: 1570325 - RNA, 21 nt, Pseudomonas putida KT2440
cagcggggauucaacagcgcg

SEQ ID NO: 1570326 - RNA, 17 nt, Pseudomonas putida KT2440
cagcggcuuggccgcga

SEQ ID NO: 1570327 - RNA, 20 nt, Pseudomonas putida KT2440
cagcggcuuggccgcgaagc

SEQ ID NO: 1570328 - RNA, 20 nt, Pseudomonas putida KT2440
cagcggcaguugcaggcgca

SEQ ID NO: 1570329 - RNA, 17 nt, Pseudomonas putida KT2440
cagcggccacagcgcca

SEQ ID NO: 1570330 - RNA, 15 nt, Pseudomonas putida KT2440
cagcggccagcucgg

SEQ ID NO: 1570331 - RNA, 23 nt, Pseudomonas putida KT2440
cagcggccagcucggccgaugcc

SEQ ID NO: 1570332 - RNA, 18 nt, Pseudomonas putida KT2440
cagcggccgcuugaucuu

SEQ ID NO: 1570333 - RNA, 18 nt, Pseudomonas putida KT2440
cagcggcgagucgaucgg

SEQ ID NO: 1570334 - RNA, 14 nt, Pseudomonas putida KT2440
cagcggcgcagcgc

SEQ ID NO: 1570335 - RNA, 22 nt, Pseudomonas putida KT2440
cagcucaugcgggucaagcugg

SEQ ID NO: 1570336 - RNA, 20 nt, Pseudomonas putida KT2440
cagcucaugggcuucgagca

SEQ ID NO: 1570337 - RNA, 20 nt, Pseudomonas putida KT2440
cagcucauccaucaccugcc

SEQ ID NO: 1570338 - RNA, 14 nt, Pseudomonas putida KT2440
cagcucaacccgcc

SEQ ID NO: 1570339 - RNA, 19 nt, Pseudomonas putida KT2440
cagcucacugaacgcaaua

SEQ ID NO: 1570340 - RNA, 15 nt, Pseudomonas putida KT2440
cagcucacuggcauc

SEQ ID NO: 1570341 - RNA, 17 nt, Pseudomonas putida KT2440
cagcucacuggcaucca

SEQ ID NO: 1570342 - RNA, 14 nt, Pseudomonas putida KT2440
cagcucacuggcca

SEQ ID NO: 1570343 - RNA, 15 nt, Pseudomonas putida KT2440
cagcucacuggccaa

SEQ ID NO: 1570344 - RNA, 15 nt, Pseudomonas putida KT2440
cagcguguuccauca

SEQ ID NO: 1570345 - RNA, 18 nt, Pseudomonas putida KT2440
cagcguguuccaucaccg

SEQ ID NO: 1570346 - RNA, 14 nt, Pseudomonas putida KT2440
cagcguggccugca

SEQ ID NO: 1570347 - RNA, 17 nt, Pseudomonas putida KT2440
cagcguggccgccaaca

SEQ ID NO: 1570348 - RNA, 21 nt, Pseudomonas putida KT2440
cagcguggccgccaacagcgc

SEQ ID NO: 1570349 - RNA, 17 nt, Pseudomonas putida KT2440
cagcgggucgaaggugu

SEQ ID NO: 1570350 - RNA, 17 nt, Pseudomonas putida KT2440
cagcggguuccccagca

SEQ ID NO: 1570351 - RNA, 20 nt, Pseudomonas putida KT2440
cagcgucaccccucggcuca

SEQ ID NO: 1570352 - RNA, 15 nt, Pseudomonas putida KT2440
cagcgucaagagcga

SEQ ID NO: 1570353 - RNA, 23 nt, Pseudomonas putida KT2440
cagcgucaagagcgacuggugug

SEQ ID NO: 1570354 - RNA, 22 nt, Pseudomonas putida KT2440
cagcguccacucaccggcaucg

SEQ ID NO: 1570355 - RNA, 14 nt, Pseudomonas putida KT2440
cagcgucagggucu

SEQ ID NO: 1570356 - RNA, 21 nt, Pseudomonas putida KT2440
cagcgucagggucucgcggcu

SEQ ID NO: 1570357 - RNA, 23 nt, Pseudomonas putida KT2440
cagcguccaguucaaugccagca

SEQ ID NO: 1570358 - RNA, 19 nt, Pseudomonas putida KT2440
ccaaccugccaugcagguc

SEQ ID NO: 1570359 - RNA, 22 nt, Pseudomonas putida KT2440
ccaaccugccaugcaggucgac

SEQ ID NO: 1570360 - RNA, 16 nt, Pseudomonas putida KT2440
ccaaccuccaggucau

SEQ ID NO: 1570361 - RNA, 17 nt, Pseudomonas putida KT2440
ccaaccguuccugcagg

SEQ ID NO: 1570362 - RNA, 18 nt, Pseudomonas putida KT2440
ccaaccgcuucaccgcgc

SEQ ID NO: 1570363 - RNA, 13 nt, Pseudomonas putida KT2440
ccaaccgcgugcu

SEQ ID NO: 1570364 - RNA, 21 nt, Pseudomonas putida KT2440
ccaacccggucccgcccucca

SEQ ID NO: 1570365 - RNA, 18 nt, Pseudomonas putida KT2440
ccaaaguccggcgaagca

SEQ ID NO: 1570366 - RNA, 16 nt, Pseudomonas putida KT2440
ccaaaguccugcaaag

SEQ ID NO: 1570367 - RNA, 19 nt, Pseudomonas putida KT2440
ccaaaguccugcaaaggcc

SEQ ID NO: 1570368 - RNA, 21 nt, Pseudomonas putida KT2440
ccaaaggcccgugguuggagc

SEQ ID NO: 1570369 - RNA, 21 nt, Pseudomonas putida KT2440
cauuuguggacgagguugcca

SEQ ID NO: 1570370 - RNA, 20 nt, Pseudomonas putida KT2440
cauuuguaggagcggguuua

SEQ ID NO: 1570371 - RNA, 16 nt, Pseudomonas putida KT2440
cauuugcuccagggca

SEQ ID NO: 1570372 - RNA, 21 nt, Pseudomonas putida KT2440
cauuugcucgacaaacccgug

SEQ ID NO: 1570373 - RNA, 19 nt, Pseudomonas putida KT2440
cauuguugcaacgcagcgc

SEQ ID NO: 1570374 - RNA, 21 nt, Pseudomonas putida KT2440
cauuguugcaacgcagcgcgu

SEQ ID NO: 1570375 - RNA, 23 nt, Pseudomonas putida KT2440
cauugugagucccuguaggcgca

SEQ ID NO: 1570376 - RNA, 18 nt, Pseudomonas putida KT2440
cauuggugccagcgccaa

SEQ ID NO: 1570377 - RNA, 23 nt, Pseudomonas putida KT2440
ccaaagaaggacucggcguagca

SEQ ID NO: 1570378 - RNA, 23 nt, Pseudomonas putida KT2440
ccaaacuugugugaacggcgccu

SEQ ID NO: 1570379 - RNA, 22 nt, Pseudomonas putida KT2440
ccaaaccaggccguugaucagc

SEQ ID NO: 1570380 - RNA, 17 nt, Pseudomonas putida KT2440
cauuggcggcaggcgca

SEQ ID NO: 1570381 - RNA, 18 nt, Pseudomonas putida KT2440
cauuggcgugcucgcgca

SEQ ID NO: 1570382 - RNA, 22 nt, Pseudomonas putida KT2440
cauugcgauguaucagcgccuc

SEQ ID NO: 1570383 - RNA, 21 nt, Pseudomonas putida KT2440
cauuggagcguugcaggcgcu

SEQ ID NO: 1570384 - RNA, 18 nt, Pseudomonas putida KT2440
cauuggaggugcgcggca

SEQ ID NO: 1570385 - RNA, 21 nt, Pseudomonas putida KT2440
cauugccgucaagcuggcgca

SEQ ID NO: 1570386 - RNA, 23 nt, Pseudomonas putida KT2440
cauugccaacagcaguugcugcu

SEQ ID NO: 1570387 - RNA, 16 nt, Pseudomonas putida KT2440
cauggugcagggcguu

SEQ ID NO: 1570388 - RNA, 20 nt, Pseudomonas putida KT2440
cauggugcagggcguugccg

SEQ ID NO: 1570389 - RNA, 24 nt, Pseudomonas putida KT2440
caugucccggguuucggugcgcug

SEQ ID NO: 1570390 - RNA, 15 nt, Pseudomonas putida KT2440
cauguccuugcugcg

SEQ ID NO: 1570391 - RNA, 16 nt, Pseudomonas putida KT2440
cauguccuugcugcgc

SEQ ID NO: 1570392 - RNA, 23 nt, Pseudomonas putida KT2440
cauguccuuggcccagccaucga

SEQ ID NO: 1570393 - RNA, 16 nt, Pseudomonas putida KT2440
caugucgaugcggugc

SEQ ID NO: 1570394 - RNA, 14 nt, Pseudomonas putida KT2440
caugucgaucagcg

SEQ ID NO: 1570395 - RNA, 15 nt, Pseudomonas putida KT2440
cauuccgggucgcca

SEQ ID NO: 1570396 - RNA, 19 nt, Pseudomonas putida KT2440
cauucucgccgccgcugac

SEQ ID NO: 1570397 - RNA, 13 nt, Pseudomonas putida KT2440
ccaccaggccgau

SEQ ID NO: 1570398 - RNA, 15 nt, Pseudomonas putida KT2440
ccaccaggcuggcca

SEQ ID NO: 1570399 - RNA, 23 nt, Pseudomonas putida KT2440
ccaccaggucgguagggaucacc

SEQ ID NO: 1570400 - RNA, 23 nt, Pseudomonas putida KT2440
ccaccaggguggcgauccacagc

SEQ ID NO: 1570401 - RNA, 19 nt, Pseudomonas putida KT2440
ccaccaggugcuugcggaa

SEQ ID NO: 1570402 - RNA, 15 nt, Pseudomonas putida KT2440
ccaccagucugcuca

SEQ ID NO: 1570403 - RNA, 16 nt, Pseudomonas putida KT2440
ccaccagucugcucag

SEQ ID NO: 1570404 - RNA, 13 nt, Pseudomonas putida KT2440
ccaccaguggguu

SEQ ID NO: 1570405 - RNA, 23 nt, Pseudomonas putida KT2440
ccaccacuugcucggugcugcug

SEQ ID NO: 1570406 - RNA, 18 nt, Pseudomonas putida KT2440
ccaccaauuugcggccau

SEQ ID NO: 1570407 - RNA, 21 nt, Pseudomonas putida KT2440
ccaccacaaaccacagcggcc

SEQ ID NO: 1570408 - RNA, 22 nt, Pseudomonas putida KT2440
ccaccacaaaccacagcggcca

SEQ ID NO: 1570409 - RNA, 13 nt, Pseudomonas putida KT2440
ccaccaagcccuu

SEQ ID NO: 1570410 - RNA, 22 nt, Pseudomonas putida KT2440
ccaccaaggcuucaaggucggu

SEQ ID NO: 1570411 - RNA, 16 nt, Pseudomonas putida KT2440
ccaccaaaggccuuga

SEQ ID NO: 1570412 - RNA, 13 nt, Pseudomonas putida KT2440
ccaccagcaggcu

SEQ ID NO: 1570413 - RNA, 15 nt, Pseudomonas putida KT2440
ccaccagcauggcgu

SEQ ID NO: 1570414 - RNA, 15 nt, Pseudomonas putida KT2440
ccaccagcccaccga

SEQ ID NO: 1570415 - RNA, 16 nt, Pseudomonas putida KT2440
ccaccagccccagcgc

SEQ ID NO: 1570416 - RNA, 17 nt, Pseudomonas putida KT2440
ccaccagccccagcgcc

SEQ ID NO: 1570417 - RNA, 21 nt, Pseudomonas putida KT2440
ccacaucaaaagggugaugcc

SEQ ID NO: 1570418 - RNA, 13 nt, Pseudomonas putida KT2440
ccacauccagcgc

SEQ ID NO: 1570419 - RNA, 15 nt, Pseudomonas putida KT2440
ccacauccagcgccu

SEQ ID NO: 1570420 - RNA, 17 nt, Pseudomonas putida KT2440
ccacaucggcgcgcccu

SEQ ID NO: 1570421 - RNA, 11 nt, Pseudomonas putida KT2440
ccacaccucga

SEQ ID NO: 1570422 - RNA, 15 nt, Pseudomonas putida KT2440
ccacaccucgacccg

SEQ ID NO: 1570423 - RNA, 17 nt, Pseudomonas putida KT2440
ccacacgcccgcgugag

SEQ ID NO: 1570424 - RNA, 15 nt, Pseudomonas putida KT2440
ccacacccugcgaag

SEQ ID NO: 1570425 - RNA, 14 nt, Pseudomonas putida KT2440
ccaauaaccggcac

SEQ ID NO: 1570426 - RNA, 15 nt, Pseudomonas putida KT2440
ccacacccgcgcguu

SEQ ID NO: 1570427 - RNA, 19 nt, Pseudomonas putida KT2440
ccaacgcgccgauugcugc

SEQ ID NO: 1570428 - RNA, 21 nt, Pseudomonas putida KT2440
ccaacgcugccuugcccagcu

SEQ ID NO: 1570429 - RNA, 12 nt, Pseudomonas putida KT2440
ccaacgcagcau

SEQ ID NO: 1570430 - RNA, 13 nt, Pseudomonas putida KT2440
ccaacgauuggca

SEQ ID NO: 1570431 - RNA, 21 nt, Pseudomonas putida KT2440
ccaacgcaaauccuccugcgc

SEQ ID NO: 1570432 - RNA, 16 nt, Pseudomonas putida KT2440
ccaacucgcgcaucca

SEQ ID NO: 1570433 - RNA, 20 nt, Pseudomonas putida KT2440
ccaacucgcgcauccagcca

SEQ ID NO: 1570434 - RNA, 20 nt, Pseudomonas putida KT2440
ccaagcggcacuaccaggcc

SEQ ID NO: 1570435 - RNA, 13 nt, Pseudomonas putida KT2440
ccaagcgucggcc

SEQ ID NO: 1570436 - RNA, 19 nt, Pseudomonas putida KT2440
ccaaguacaacugccaccc

SEQ ID NO: 1570437 - RNA, 21 nt, Pseudomonas putida KT2440
ccaagguggaaaucgccugcu

SEQ ID NO: 1570438 - RNA, 17 nt, Pseudomonas putida KT2440
ccaagcccacacaccgc

SEQ ID NO: 1570439 - RNA, 15 nt, Pseudomonas putida KT2440
ccaagcacgcacagu

SEQ ID NO: 1570440 - RNA, 20 nt, Pseudomonas putida KT2440
ccaacuggcgaauacgcuca

SEQ ID NO: 1570441 - RNA, 22 nt, Pseudomonas putida KT2440
ccaacuugcgcaguaacaggcg

SEQ ID NO: 1570442 - RNA, 22 nt, Pseudomonas putida KT2440
cauggucgcguuguucagcagc

SEQ ID NO: 1570443 - RNA, 17 nt, Pseudomonas putida KT2440
cauggucguguugagca

SEQ ID NO: 1570444 - RNA, 17 nt, Pseudomonas putida KT2440
cauguaggcgccgauca

SEQ ID NO: 1570445 - RNA, 22 nt, Pseudomonas putida KT2440
cauggucaacagcccggugaag

SEQ ID NO: 1570446 - RNA, 20 nt, Pseudomonas putida KT2440
cauggucagccggcagucac

SEQ ID NO: 1570447 - RNA, 17 nt, Pseudomonas putida KT2440
cauggcguuguccagca

SEQ ID NO: 1570448 - RNA, 15 nt, Pseudomonas putida KT2440
caugggucaacagga

SEQ ID NO: 1570449 - RNA, 21 nt, Pseudomonas putida KT2440
cauggccaggucggucagcac

SEQ ID NO: 1570450 - RNA, 13 nt, Pseudomonas putida KT2440
cauggcggcaccg

SEQ ID NO: 1570451 - RNA, 22 nt, Pseudomonas putida KT2440
cauggcagucguacgcgggcag

SEQ ID NO: 1570452 - RNA, 21 nt, Pseudomonas putida KT2440
cauggcgguauucacaccugc

SEQ ID NO: 1570453 - RNA, 16 nt, Pseudomonas putida KT2440
caugcgcgcagcgaac

SEQ ID NO: 1570454 - RNA, 20 nt, Pseudomonas putida KT2440
caugcgcgcagcgaacgccg

SEQ ID NO: 1570455 - RNA, 17 nt, Pseudomonas putida KT2440
caugcgcgacagcauca

SEQ ID NO: 1570456 - RNA, 12 nt, Pseudomonas putida KT2440
caugcgcaggca

SEQ ID NO: 1570457 - RNA, 17 nt, Pseudomonas putida KT2440
caugcgaugguacagcu

SEQ ID NO: 1570458 - RNA, 18 nt, Pseudomonas putida KT2440
caugcgaacgcaggcgcg

SEQ ID NO: 1570459 - RNA, 16 nt, Pseudomonas putida KT2440
caugcugucgaugucu

SEQ ID NO: 1570460 - RNA, 16 nt, Pseudomonas putida KT2440
cauggcaaacagcacc

SEQ ID NO: 1570461 - RNA, 21 nt, Pseudomonas putida KT2440
cauggcaaccaugucgaacca

SEQ ID NO: 1570462 - RNA, 16 nt, Pseudomonas putida KT2440
cauggcaaucagcgac

SEQ ID NO: 1570463 - RNA, 20 nt, Pseudomonas putida KT2440
caugccauccucggccaggc

SEQ ID NO: 1570464 - RNA, 13 nt, Pseudomonas putida KT2440
caugccagcagcu

SEQ ID NO: 1570465 - RNA, 14 nt, Pseudomonas putida KT2440
caugccacggccuu

SEQ ID NO: 1570466 - RNA, 21 nt, Pseudomonas putida KT2440
caugccacggccuucuucacg

SEQ ID NO: 1570467 - RNA, 12 nt, Pseudomonas putida KT2440
caugcaggucga

SEQ ID NO: 1570468 - RNA, 17 nt, Pseudomonas putida KT2440
caugcaggucgaccugc

SEQ ID NO: 1570469 - RNA, 22 nt, Pseudomonas putida KT2440
caugcaggucgacgaucgccgc

SEQ ID NO: 1570470 - RNA, 13 nt, Pseudomonas putida KT2440
caugcagcggcca

SEQ ID NO: 1570471 - RNA, 17 nt, Pseudomonas putida KT2440
caugcaugcguugcacg

SEQ ID NO: 1570472 - RNA, 18 nt, Pseudomonas putida KT2440
caugccacccccggccga

SEQ ID NO: 1570473 - RNA, 19 nt, Pseudomonas putida KT2440
caugccacccccggccgac

SEQ ID NO: 1570474 - RNA, 13 nt, Pseudomonas putida KT2440
caugccgauaugc

SEQ ID NO: 1570475 - RNA, 15 nt, Pseudomonas putida KT2440
caugccgauaugccg

SEQ ID NO: 1570476 - RNA, 22 nt, Pseudomonas putida KT2440
caugccgaugucggcgugcacc

SEQ ID NO: 1570477 - RNA, 23 nt, Pseudomonas putida KT2440
caugccuaucucuuccagcgucu

SEQ ID NO: 1570478 - RNA, 23 nt, Pseudomonas putida KT2440
caugacccuaugcgugaaacgca

SEQ ID NO: 1570479 - RNA, 19 nt, Pseudomonas putida KT2440
caugaucucgcccaugaug

SEQ ID NO: 1570480 - RNA, 15 nt, Pseudomonas putida KT2440
caugcacugccugca

SEQ ID NO: 1570481 - RNA, 19 nt, Pseudomonas putida KT2440
caugcacuuccaggaaggc

SEQ ID NO: 1570482 - RNA, 12 nt, Pseudomonas putida KT2440
caugcagcgcca

SEQ ID NO: 1570483 - RNA, 22 nt, Pseudomonas putida KT2440
caugaucugcaagcgcagcccc

SEQ ID NO: 1570484 - RNA, 18 nt, Pseudomonas putida KT2440
caugaaaccgcgugccga

SEQ ID NO: 1570485 - RNA, 14 nt, Pseudomonas putida KT2440
caugaacagcgccc

SEQ ID NO: 1570486 - RNA, 16 nt, Pseudomonas putida KT2440
caugacaaagcggauc

SEQ ID NO: 1570487 - RNA, 18 nt, Pseudomonas putida KT2440
caucuuccugccacucgu

SEQ ID NO: 1570488 - RNA, 20 nt, Pseudomonas putida KT2440
caucuugccauugucggcgc

SEQ ID NO: 1570489 - RNA, 18 nt, Pseudomonas putida KT2440
caucuuggugugggcgau

SEQ ID NO: 1570490 - RNA, 22 nt, Pseudomonas putida KT2440
caucuugguuggcggagccagc

SEQ ID NO: 1570491 - RNA, 23 nt, Pseudomonas putida KT2440
caucuuccagccugcagcacccu

SEQ ID NO: 1570492 - RNA, 15 nt, Pseudomonas putida KT2440
caucuuccggcaccc

SEQ ID NO: 1570493 - RNA, 14 nt, Pseudomonas putida KT2440
caucugcgacugca

SEQ ID NO: 1570494 - RNA, 19 nt, Pseudomonas putida KT2440
caucugcgcacggaaggca

SEQ ID NO: 1570495 - RNA, 18 nt, Pseudomonas putida KT2440
caucugcgccaguggguu

SEQ ID NO: 1570496 - RNA, 18 nt, Pseudomonas putida KT2440
caucugcgccccgcucgc

SEQ ID NO: 1570497 - RNA, 15 nt, Pseudomonas putida KT2440
caucugcucgccauc

SEQ ID NO: 1570498 - RNA, 18 nt, Pseudomonas putida KT2440
caucugcucggcguacuc

SEQ ID NO: 1570499 - RNA, 18 nt, Pseudomonas putida KT2440
caucuccauagguuaucc

SEQ ID NO: 1570500 - RNA, 15 nt, Pseudomonas putida KT2440
caucucgcgaugcuu

SEQ ID NO: 1570501 - RNA, 14 nt, Pseudomonas putida KT2440
caucgggaucagca

SEQ ID NO: 1570502 - RNA, 16 nt, Pseudomonas putida KT2440
caucgggaucagcacg

SEQ ID NO: 1570503 - RNA, 18 nt, Pseudomonas putida KT2440
caucggucaccggguaga

SEQ ID NO: 1570504 - RNA, 20 nt, Pseudomonas putida KT2440
cauccgccagguauucggca

SEQ ID NO: 1570505 - RNA, 17 nt, Pseudomonas putida KT2440
cauccgggccgucaccg

SEQ ID NO: 1570506 - RNA, 17 nt, Pseudomonas putida KT2440
caucguuauccagcacc

SEQ ID NO: 1570507 - RNA, 20 nt, Pseudomonas putida KT2440
caucguaauggccuacgcac

SEQ ID NO: 1570508 - RNA, 20 nt, Pseudomonas putida KT2440
caucguauuacccuucaucg

SEQ ID NO: 1570509 - RNA, 21 nt, Pseudomonas putida KT2440
caucguccuugcagggcacca

SEQ ID NO: 1570510 - RNA, 20 nt, Pseudomonas putida KT2440
ccagcgcaucggccacuucg

SEQ ID NO: 1570511 - RNA, 15 nt, Pseudomonas putida KT2440
ccagcgccgccaugc

SEQ ID NO: 1570512 - RNA, 14 nt, Pseudomonas putida KT2440
ccagcgaggguucc

SEQ ID NO: 1570513 - RNA, 15 nt, Pseudomonas putida KT2440
ccagccgccacgacc

SEQ ID NO: 1570514 - RNA, 23 nt, Pseudomonas putida KT2440
ccagccgcaaccgggucggcgcc

SEQ ID NO: 1570515 - RNA, 15 nt, Pseudomonas putida KT2440
ccagccgcgccaggu

SEQ ID NO: 1570516 - RNA, 15 nt, Pseudomonas putida KT2440
ccagcgggcccagca

SEQ ID NO: 1570517 - RNA, 18 nt, Pseudomonas putida KT2440
ccagcgucgucugcguga

SEQ ID NO: 1570518 - RNA, 16 nt, Pseudomonas putida KT2440
ccagcguauagccacc

SEQ ID NO: 1570519 - RNA, 12 nt, Pseudomonas putida KT2440
ccagcggcagca

SEQ ID NO: 1570520 - RNA, 19 nt, Pseudomonas putida KT2440
ccagcgccucaccgaccca

SEQ ID NO: 1570521 - RNA, 22 nt, Pseudomonas putida KT2440
ccagcgcgcgcagacgggcgac

SEQ ID NO: 1570522 - RNA, 21 nt, Pseudomonas putida KT2440
ccagcggcaguugcaggcgca

SEQ ID NO: 1570523 - RNA, 13 nt, Pseudomonas putida KT2440
ccagcggccagcg

SEQ ID NO: 1570524 - RNA, 14 nt, Pseudomonas putida KT2440
ccagcggccagcgc

SEQ ID NO: 1570525 - RNA, 16 nt, Pseudomonas putida KT2440
ccagcggccagcgccu

SEQ ID NO: 1570526 - RNA, 22 nt, Pseudomonas putida KT2440
ccagcggccagcgccuggcgca

SEQ ID NO: 1570527 - RNA, 16 nt, Pseudomonas putida KT2440
ccagcaccuggcggcc

SEQ ID NO: 1570528 - RNA, 16 nt, Pseudomonas putida KT2440
ccagcacgaacagcaa

SEQ ID NO: 1570529 - RNA, 16 nt, Pseudomonas putida KT2440
ccagcacgaaggccag

SEQ ID NO: 1570530 - RNA, 19 nt, Pseudomonas putida KT2440
ccagcacgaaggccagcaa

SEQ ID NO: 1570531 - RNA, 14 nt, Pseudomonas putida KT2440
ccagcacgcaggcc

SEQ ID NO: 1570532 - RNA, 15 nt, Pseudomonas putida KT2440
ccagcacgcaggcca

SEQ ID NO: 1570533 - RNA, 19 nt, Pseudomonas putida KT2440
ccagcacgcaggccagcgc

SEQ ID NO: 1570534 - RNA, 24 nt, Pseudomonas putida KT2440
ccagcacguucucgcucagcguac

SEQ ID NO: 1570535 - RNA, 20 nt, Pseudomonas putida KT2440
ccagcaccugacgcaagcgc

SEQ ID NO: 1570536 - RNA, 14 nt, Pseudomonas putida KT2440
ccagcaccugcagg

SEQ ID NO: 1570537 - RNA, 20 nt, Pseudomonas putida KT2440
ccagcaccugcagguacagc

SEQ ID NO: 1570538 - RNA, 14 nt, Pseudomonas putida KT2440
ccagcacugcugcg

SEQ ID NO: 1570539 - RNA, 22 nt, Pseudomonas putida KT2440
ccagcagauggcucaucgccgu

SEQ ID NO: 1570540 - RNA, 14 nt, Pseudomonas putida KT2440
ccagcagcacacgc

SEQ ID NO: 1570541 - RNA, 17 nt, Pseudomonas putida KT2440
ccagcagcaccugccgc

SEQ ID NO: 1570542 - RNA, 23 nt, Pseudomonas putida KT2440
ccagcaguucgucgagcaucugc

SEQ ID NO: 1570543 - RNA, 18 nt, Pseudomonas putida KT2440
ccagcaguuucagcggcc

SEQ ID NO: 1570544 - RNA, 13 nt, Pseudomonas putida KT2440
ccagcauggccga

SEQ ID NO: 1570545 - RNA, 17 nt, Pseudomonas putida KT2440
ccagcagugcggcaacc

SEQ ID NO: 1570546 - RNA, 15 nt, Pseudomonas putida KT2440
ccagcagugccgccu

SEQ ID NO: 1570547 - RNA, 17 nt, Pseudomonas putida KT2440
ccagcaggcuugccagc

SEQ ID NO: 1570548 - RNA, 23 nt, Pseudomonas putida KT2440
ccagcagugcaucgaagcaggcc

SEQ ID NO: 1570549 - RNA, 12 nt, Pseudomonas putida KT2440
ccagcaggcccg

SEQ ID NO: 1570550 - RNA, 19 nt, Pseudomonas putida KT2440
ccagcagcgccugcagcgc

SEQ ID NO: 1570551 - RNA, 22 nt, Pseudomonas putida KT2440
ccagccaccgacgaacagggcc

SEQ ID NO: 1570552 - RNA, 16 nt, Pseudomonas putida KT2440
ccagcauggcgucggc

SEQ ID NO: 1570553 - RNA, 21 nt, Pseudomonas putida KT2440
ccagcaucagcacacccagca

SEQ ID NO: 1570554 - RNA, 22 nt, Pseudomonas putida KT2440
ccagcaucagcacacccagcac

SEQ ID NO: 1570555 - RNA, 17 nt, Pseudomonas putida KT2440
ccagcauguucaccagg

SEQ ID NO: 1570556 - RNA, 19 nt, Pseudomonas putida KT2440
ccagcauguccugcugcag

SEQ ID NO: 1570557 - RNA, 21 nt, Pseudomonas putida KT2440
ccagccaacggucgaucagcu

SEQ ID NO: 1570558 - RNA, 21 nt, Pseudomonas putida KT2440
ccagccaacgccccacccgcu

SEQ ID NO: 1570559 - RNA, 13 nt, Pseudomonas putida KT2440
ccagccagcgaca

SEQ ID NO: 1570560 - RNA, 14 nt, Pseudomonas putida KT2440
ccagccagcgacag

SEQ ID NO: 1570561 - RNA, 19 nt, Pseudomonas putida KT2440
ccagccagguauggccaga

SEQ ID NO: 1570562 - RNA, 14 nt, Pseudomonas putida KT2440
ccagcccagcgcca

SEQ ID NO: 1570563 - RNA, 15 nt, Pseudomonas putida KT2440
ccagcccagcgccag

SEQ ID NO: 1570564 - RNA, 17 nt, Pseudomonas putida KT2440
ccagcccagcgccagua

SEQ ID NO: 1570565 - RNA, 18 nt, Pseudomonas putida KT2440
ccagcccaccacgaacgc

SEQ ID NO: 1570566 - RNA, 17 nt, Pseudomonas putida KT2440
ccagccauuccaggcua

SEQ ID NO: 1570567 - RNA, 20 nt, Pseudomonas putida KT2440
ccagcccggacugcaccagg

SEQ ID NO: 1570568 - RNA, 19 nt, Pseudomonas putida KT2440
ccagcccggcgccgagcca

SEQ ID NO: 1570569 - RNA, 16 nt, Pseudomonas putida KT2440
ccagcccggcggccag

SEQ ID NO: 1570570 - RNA, 21 nt, Pseudomonas putida KT2440
ccagcccuucggcaucggccu

SEQ ID NO: 1570571 - RNA, 22 nt, Pseudomonas putida KT2440
ccagcccugccgaggccaugug

SEQ ID NO: 1570572 - RNA, 13 nt, Pseudomonas putida KT2440
ccagcccucaagg

SEQ ID NO: 1570573 - RNA, 20 nt, Pseudomonas putida KT2440
ccagcccaguagaucgcgcc

SEQ ID NO: 1570574 - RNA, 20 nt, Pseudomonas putida KT2440
ccagccccaacccaccagca

SEQ ID NO: 1570575 - RNA, 18 nt, Pseudomonas putida KT2440
ccagccccagcggcagca

SEQ ID NO: 1570576 - RNA, 21 nt, Pseudomonas putida KT2440
ccagccccucauucaaagccu

SEQ ID NO: 1570577 - RNA, 14 nt, Pseudomonas putida KT2440
ccagcccgcccaca

SEQ ID NO: 1570578 - RNA, 19 nt, Pseudomonas putida KT2440
ccagcccgauuucgugcac

SEQ ID NO: 1570579 - RNA, 12 nt, Pseudomonas putida KT2440
ccagcccgaagc

SEQ ID NO: 1570580 - RNA, 17 nt, Pseudomonas putida KT2440
ccagcccgaagccggca

SEQ ID NO: 1570581 - RNA, 12 nt, Pseudomonas putida KT2440
ccagcccgaaac

SEQ ID NO: 1570582 - RNA, 21 nt, Pseudomonas putida KT2440
ccacgaagcgcggcaaggugg

SEQ ID NO: 1570583 - RNA, 12 nt, Pseudomonas putida KT2440
ccacgaaggccg

SEQ ID NO: 1570584 - RNA, 19 nt, Pseudomonas putida KT2440
ccaccuugccaucggccau

SEQ ID NO: 1570585 - RNA, 21 nt, Pseudomonas putida KT2440
ccaccuucaauagcggccaac

SEQ ID NO: 1570586 - RNA, 23 nt, Pseudomonas putida KT2440
ccaccuggucgaaugcgugcaac

SEQ ID NO: 1570587 - RNA, 15 nt, Pseudomonas putida KT2440
ccaccugugccggca

SEQ ID NO: 1570588 - RNA, 21 nt, Pseudomonas putida KT2440
ccaccuuccaggucgaucgca

SEQ ID NO: 1570589 - RNA, 15 nt, Pseudomonas putida KT2440
ccaccugcggcaggu

SEQ ID NO: 1570590 - RNA, 18 nt, Pseudomonas putida KT2440
ccaccugcagggucaggc

SEQ ID NO: 1570591 - RNA, 15 nt, Pseudomonas putida KT2440
ccaccaucgaccugg

SEQ ID NO: 1570592 - RNA, 17 nt, Pseudomonas putida KT2440
ccaccaucgccaggccu

SEQ ID NO: 1570593 - RNA, 15 nt, Pseudomonas putida KT2440
ccacccaaccgcgcc

SEQ ID NO: 1570594 - RNA, 21 nt, Pseudomonas putida KT2440
ccacgccagaaccugacaagc

SEQ ID NO: 1570595 - RNA, 15 nt, Pseudomonas putida KT2440
ccacgcaguuggcca

SEQ ID NO: 1570596 - RNA, 21 nt, Pseudomonas putida KT2440
ccacgcccaacccagccagcg

SEQ ID NO: 1570597 - RNA, 17 nt, Pseudomonas putida KT2440
ccacgcccgcugcaugc

SEQ ID NO: 1570598 - RNA, 17 nt, Pseudomonas putida KT2440
ccacgccgaagcgcgcc

SEQ ID NO: 1570599 - RNA, 19 nt, Pseudomonas putida KT2440
ccacgccgaccgcgcgcac

SEQ ID NO: 1570600 - RNA, 21 nt, Pseudomonas putida KT2440
ccacgccgcugccaaccggcu

SEQ ID NO: 1570601 - RNA, 15 nt, Pseudomonas putida KT2440
ccacgaucucacgcg

SEQ ID NO: 1570602 - RNA, 21 nt, Pseudomonas putida KT2440
ccacgaucuuggccagggccu

SEQ ID NO: 1570603 - RNA, 21 nt, Pseudomonas putida KT2440
ccacgaugcccauggcgcagc

SEQ ID NO: 1570604 - RNA, 13 nt, Pseudomonas putida KT2440
ccacgcaccaggg

SEQ ID NO: 1570605 - RNA, 15 nt, Pseudomonas putida KT2440
ccacgcacaucgucc

SEQ ID NO: 1570606 - RNA, 23 nt, Pseudomonas putida KT2440
ccacgauagcgucagcagggcca

SEQ ID NO: 1570607 - RNA, 24 nt, Pseudomonas putida KT2440
ccacgauagcgucagcagggccaa

SEQ ID NO: 1570608 - RNA, 16 nt, Pseudomonas putida KT2440
ccacgacgugucagug

SEQ ID NO: 1570609 - RNA, 12 nt, Pseudomonas putida KT2440
ccacggucggcc

SEQ ID NO: 1570610 - RNA, 24 nt, Pseudomonas putida KT2440
ccacggucggccugcgcuccagca

SEQ ID NO: 1570611 - RNA, 21 nt, Pseudomonas putida KT2440
ccacggucagcauccagccau

SEQ ID NO: 1570612 - RNA, 12 nt, Pseudomonas putida KT2440
ccacggcguugc

SEQ ID NO: 1570613 - RNA, 12 nt, Pseudomonas putida KT2440
ccacgccugcgc

SEQ ID NO: 1570614 - RNA, 14 nt, Pseudomonas putida KT2440
ccacgcgcaggcca

SEQ ID NO: 1570615 - RNA, 16 nt, Pseudomonas putida KT2440
ccacgcgcaggccacg

SEQ ID NO: 1570616 - RNA, 14 nt, Pseudomonas putida KT2440
ccacgucgccagcg

SEQ ID NO: 1570617 - RNA, 15 nt, Pseudomonas putida KT2440
ccacuccagggucug

SEQ ID NO: 1570618 - RNA, 17 nt, Pseudomonas putida KT2440
ccacuccagggucugcg

SEQ ID NO: 1570619 - RNA, 18 nt, Pseudomonas putida KT2440
ccacucauaaugaaaacc

SEQ ID NO: 1570620 - RNA, 18 nt, Pseudomonas putida KT2440
ccacucaauacucgcuga

SEQ ID NO: 1570621 - RNA, 18 nt, Pseudomonas putida KT2440
ccacguugaucgucggcc

SEQ ID NO: 1570622 - RNA, 14 nt, Pseudomonas putida KT2440
ccacguucugcagc

SEQ ID NO: 1570623 - RNA, 12 nt, Pseudomonas putida KT2440
ccagauccgcag

SEQ ID NO: 1570624 - RNA, 19 nt, Pseudomonas putida KT2440
ccagaucauuuucuacgau

SEQ ID NO: 1570625 - RNA, 15 nt, Pseudomonas putida KT2440
ccagaucagcagcac

SEQ ID NO: 1570626 - RNA, 16 nt, Pseudomonas putida KT2440
ccagaucagcagcacc

SEQ ID NO: 1570627 - RNA, 22 nt, Pseudomonas putida KT2440
ccagauagccauugcggcugaa

SEQ ID NO: 1570628 - RNA, 16 nt, Pseudomonas putida KT2440
ccagacccgcuucgcc

SEQ ID NO: 1570629 - RNA, 17 nt, Pseudomonas putida KT2440
ccagacccgcuucgccg

SEQ ID NO: 1570630 - RNA, 21 nt, Pseudomonas putida KT2440
ccacugucaaucuugcgcacg

SEQ ID NO: 1570631 - RNA, 22 nt, Pseudomonas putida KT2440
ccacugucggguuggucgccag

SEQ ID NO: 1570632 - RNA, 22 nt, Pseudomonas putida KT2440
ccacugcuucugagccagccgc

SEQ ID NO: 1570633 - RNA, 22 nt, Pseudomonas putida KT2440
ccacugcguucaucgaacugca

SEQ ID NO: 1570634 - RNA, 12 nt, Pseudomonas putida KT2440
ccacuggccagc

SEQ ID NO: 1570635 - RNA, 14 nt, Pseudomonas putida KT2440
ccagacgcaggcaa

SEQ ID NO: 1570636 - RNA, 16 nt, Pseudomonas putida KT2440
ccaggcaauugugccg

SEQ ID NO: 1570637 - RNA, 17 nt, Pseudomonas putida KT2440
ccaggcacaggcgcaca

SEQ ID NO: 1570638 - RNA, 18 nt, Pseudomonas putida KT2440
ccaggcauacagcuggcc

SEQ ID NO: 1570639 - RNA, 20 nt, Pseudomonas putida KT2440
ccaggaugccaaggaucagc

SEQ ID NO: 1570640 - RNA, 18 nt, Pseudomonas putida KT2440
ccagcguggccugcaagc

SEQ ID NO: 1570641 - RNA, 22 nt, Pseudomonas putida KT2440
ccagcguggccgccaacagcgc

SEQ ID NO: 1570642 - RNA, 14 nt, Pseudomonas putida KT2440
ccaggauggcauug

SEQ ID NO: 1570643 - RNA, 18 nt, Pseudomonas putida KT2440
ccaggauggcauuggcca

SEQ ID NO: 1570644 - RNA, 14 nt, Pseudomonas putida KT2440
ccaggauggcuuug

SEQ ID NO: 1570645 - RNA, 14 nt, Pseudomonas putida KT2440
ccaggauugccggg

SEQ ID NO: 1570646 - RNA, 15 nt, Pseudomonas putida KT2440
ccaggauuggccgca

SEQ ID NO: 1570647 - RNA, 23 nt, Pseudomonas putida KT2440
ccaggauuuucagcgcgaaaccc

SEQ ID NO: 1570648 - RNA, 21 nt, Pseudomonas putida KT2440
ccaggcccgcuauccucgauc

SEQ ID NO: 1570649 - RNA, 12 nt, Pseudomonas putida KT2440
ccaggcccagca

SEQ ID NO: 1570650 - RNA, 19 nt, Pseudomonas putida KT2440
ccaggcauuccccggucag

SEQ ID NO: 1570651 - RNA, 17 nt, Pseudomonas putida KT2440
ccaggccgauggcgaug

SEQ ID NO: 1570652 - RNA, 15 nt, Pseudomonas putida KT2440
ccaggccgcacgcgc

SEQ ID NO: 1570653 - RNA, 15 nt, Pseudomonas putida KT2440
ccaggcccugacgcc

SEQ ID NO: 1570654 - RNA, 20 nt, Pseudomonas putida KT2440
ccaggcccugacgccagcgc

SEQ ID NO: 1570655 - RNA, 14 nt, Pseudomonas putida KT2440
ccaggcccugcagc

SEQ ID NO: 1570656 - RNA, 16 nt, Pseudomonas putida KT2440
ccaggccgaaaccgcc

SEQ ID NO: 1570657 - RNA, 19 nt, Pseudomonas putida KT2440
ccaggccgaucaccagcac

SEQ ID NO: 1570658 - RNA, 20 nt, Pseudomonas putida KT2440
ccaggccgaucaccagcacc

SEQ ID NO: 1570659 - RNA, 16 nt, Pseudomonas putida KT2440
ccaggcgcgccugcac

SEQ ID NO: 1570660 - RNA, 14 nt, Pseudomonas putida KT2440
ccaggcggucggcc

SEQ ID NO: 1570661 - RNA, 16 nt, Pseudomonas putida KT2440
ccaggcguaaacccag

SEQ ID NO: 1570662 - RNA, 14 nt, Pseudomonas putida KT2440
ccaggcucaggccu

SEQ ID NO: 1570663 - RNA, 13 nt, Pseudomonas putida KT2440
ccaggcugcacug

SEQ ID NO: 1570664 - RNA, 21 nt, Pseudomonas putida KT2440
ccaggcgcaucacgaaauccu

SEQ ID NO: 1570665 - RNA, 21 nt, Pseudomonas putida KT2440
ccaggccuuucagcgcccaga

SEQ ID NO: 1570666 - RNA, 19 nt, Pseudomonas putida KT2440
ccaggccuuucugcucgaa

SEQ ID NO: 1570667 - RNA, 15 nt, Pseudomonas putida KT2440
ccaggcgaccaugcg

SEQ ID NO: 1570668 - RNA, 18 nt, Pseudomonas putida KT2440
ccaggcgcaaguagaacc

SEQ ID NO: 1570669 - RNA, 19 nt, Pseudomonas putida KT2440
ccaggccggcgcagauggu

SEQ ID NO: 1570670 - RNA, 23 nt, Pseudomonas putida KT2440
ccaggccucaagccucgcgcaac

SEQ ID NO: 1570671 - RNA, 20 nt, Pseudomonas putida KT2440
ccaggccuggaugcguugcu

SEQ ID NO: 1570672 - RNA, 20 nt, Pseudomonas putida KT2440
ccagugcggugaccgaggcg

SEQ ID NO: 1570673 - RNA, 24 nt, Pseudomonas putida KT2440
ccaguggcacccacagcgccugcu

SEQ ID NO: 1570674 - RNA, 14 nt, Pseudomonas putida KT2440
ccagugcuucacug

SEQ ID NO: 1570675 - RNA, 20 nt, Pseudomonas putida KT2440
ccagugcuucacugccggca

SEQ ID NO: 1570676 - RNA, 21 nt, Pseudomonas putida KT2440
ccagugcuucacugccggcaa

SEQ ID NO: 1570677 - RNA, 14 nt, Pseudomonas putida KT2440
ccaguucagcucgc

SEQ ID NO: 1570678 - RNA, 18 nt, Pseudomonas putida KT2440
ccaguucauucccggcca

SEQ ID NO: 1570679 - RNA, 15 nt, Pseudomonas putida KT2440
ccaguuccaccggca

SEQ ID NO: 1570680 - RNA, 14 nt, Pseudomonas putida KT2440
ccaguuccacgacc

SEQ ID NO: 1570681 - RNA, 16 nt, Pseudomonas putida KT2440
ccaguucacggaucgc

SEQ ID NO: 1570682 - RNA, 14 nt, Pseudomonas putida KT2440
ccaguucagcgccc

SEQ ID NO: 1570683 - RNA, 17 nt, Pseudomonas putida KT2440
ccaguucagcgcccgca

SEQ ID NO: 1570684 - RNA, 20 nt, Pseudomonas putida KT2440
ccaguuccggcaggucgaug

SEQ ID NO: 1570685 - RNA, 15 nt, Pseudomonas putida KT2440
ccaguacaugaucgg

SEQ ID NO: 1570686 - RNA, 16 nt, Pseudomonas putida KT2440
ccaguauugcgucagg

SEQ ID NO: 1570687 - RNA, 20 nt, Pseudomonas putida KT2440
ccagugccugaccggucagc

SEQ ID NO: 1570688 - RNA, 17 nt, Pseudomonas putida KT2440
ccagugccgcaagcagu

SEQ ID NO: 1570689 - RNA, 16 nt, Pseudomonas putida KT2440
ccauaggccgccugcc

SEQ ID NO: 1570690 - RNA, 18 nt, Pseudomonas putida KT2440
ccauagggccagcggcuu

SEQ ID NO: 1570691 - RNA, 18 nt, Pseudomonas putida KT2440
ccauaugaaaaggcccug

SEQ ID NO: 1570692 - RNA, 18 nt, Pseudomonas putida KT2440
ccauagcaccagcgggcc

SEQ ID NO: 1570693 - RNA, 13 nt, Pseudomonas putida KT2440
ccauagcgcugca

SEQ ID NO: 1570694 - RNA, 21 nt, Pseudomonas putida KT2440
ccauagcguugucgacugcac

SEQ ID NO: 1570695 - RNA, 15 nt, Pseudomonas putida KT2440
ccauagccugcugcu

SEQ ID NO: 1570696 - RNA, 17 nt, Pseudomonas putida KT2440
ccauaacuccagcgcca

SEQ ID NO: 1570697 - RNA, 18 nt, Pseudomonas putida KT2440
ccauaacuccagcgccag

SEQ ID NO: 1570698 - RNA, 21 nt, Pseudomonas putida KT2440
ccauaaaagccucagcgcccg

SEQ ID NO: 1570699 - RNA, 17 nt, Pseudomonas putida KT2440
ccaguucgcccuucagc

SEQ ID NO: 1570700 - RNA, 23 nt, Pseudomonas putida KT2440
ccauaaaaaaacccgcugaucgc

SEQ ID NO: 1570701 - RNA, 21 nt, Pseudomonas putida KT2440
ccaguaccaggucgccagcac

SEQ ID NO: 1570702 - RNA, 23 nt, Pseudomonas putida KT2440
ccaguacgaacuacgcgccagca

SEQ ID NO: 1570703 - RNA, 18 nt, Pseudomonas putida KT2440
ccaguaaugcagccggcc

SEQ ID NO: 1570704 - RNA, 19 nt, Pseudomonas putida KT2440
ccaguaggugugaucuucu

SEQ ID NO: 1570705 - RNA, 15 nt, Pseudomonas putida KT2440
ccaguaggcugcagc

SEQ ID NO: 1570706 - RNA, 16 nt, Pseudomonas putida KT2440
ccaguagcgccaccau

SEQ ID NO: 1570707 - RNA, 14 nt, Pseudomonas putida KT2440
ccaguagcaaucag

SEQ ID NO: 1570708 - RNA, 15 nt, Pseudomonas putida KT2440
ccaguagcacagugc

SEQ ID NO: 1570709 - RNA, 19 nt, Pseudomonas putida KT2440
ccaggugccaacggucaga

SEQ ID NO: 1570710 - RNA, 17 nt, Pseudomonas putida KT2440
ccaggugccaggcucag

SEQ ID NO: 1570711 - RNA, 19 nt, Pseudomonas putida KT2440
ccaggugguaacuggccag

SEQ ID NO: 1570712 - RNA, 14 nt, Pseudomonas putida KT2440
ccagguggccuucc

SEQ ID NO: 1570713 - RNA, 13 nt, Pseudomonas putida KT2440
ccaggugcucgau

SEQ ID NO: 1570714 - RNA, 16 nt, Pseudomonas putida KT2440
ccagguaaucaguucg

SEQ ID NO: 1570715 - RNA, 23 nt, Pseudomonas putida KT2440
ccagguaaucaguucgcagccca

SEQ ID NO: 1570716 - RNA, 16 nt, Pseudomonas putida KT2440
ccaggguuaccugcgc

SEQ ID NO: 1570717 - RNA, 18 nt, Pseudomonas putida KT2440
ccagguacgaagccaugu

SEQ ID NO: 1570718 - RNA, 16 nt, Pseudomonas putida KT2440
ccaggucgcggagcca

SEQ ID NO: 1570719 - RNA, 16 nt, Pseudomonas putida KT2440
ccaggucgccagcacc

SEQ ID NO: 1570720 - RNA, 22 nt, Pseudomonas putida KT2440
ccagguccuugcuguugcugca

SEQ ID NO: 1570721 - RNA, 12 nt, Pseudomonas putida KT2440
ccaggcuggcca

SEQ ID NO: 1570722 - RNA, 14 nt, Pseudomonas putida KT2440
ccaggcuggccagc

SEQ ID NO: 1570723 - RNA, 20 nt, Pseudomonas putida KT2440
ccaggcuggccagcaagugc

SEQ ID NO: 1570724 - RNA, 23 nt, Pseudomonas putida KT2440
ccagggacgaacccuugaccuug

SEQ ID NO: 1570725 - RNA, 16 nt, Pseudomonas putida KT2440
ccaugguaucgagcac

SEQ ID NO: 1570726 - RNA, 16 nt, Pseudomonas putida KT2440
ccauguacugcagaca

SEQ ID NO: 1570727 - RNA, 16 nt, Pseudomonas putida KT2440
ccaugucgugcugccg

SEQ ID NO: 1570728 - RNA, 21 nt, Pseudomonas putida KT2440
ccaugucgugcugccggucgg

SEQ ID NO: 1570729 - RNA, 14 nt, Pseudomonas putida KT2440
ccauguggcgcagc

SEQ ID NO: 1570730 - RNA, 18 nt, Pseudomonas putida KT2440
ccauuugcgcuggcugcc

SEQ ID NO: 1570731 - RNA, 23 nt, Pseudomonas putida KT2440
ccauuggcgucagcguugcuggc

SEQ ID NO: 1570732 - RNA, 16 nt, Pseudomonas putida KT2440
ccauguugucacccag

SEQ ID NO: 1570733 - RNA, 19 nt, Pseudomonas putida KT2440
ccauguugucgaagcgcac

SEQ ID NO: 1570734 - RNA, 16 nt, Pseudomonas putida KT2440
ccauguugugcuggcg

SEQ ID NO: 1570735 - RNA, 13 nt, Pseudomonas putida KT2440
cccaacuccagcg

SEQ ID NO: 1570736 - RNA, 23 nt, Pseudomonas putida KT2440
cccaauaaaaaaccggccaagcg

SEQ ID NO: 1570737 - RNA, 12 nt, Pseudomonas putida KT2440
cccaagcgggcc

SEQ ID NO: 1570738 - RNA, 14 nt, Pseudomonas putida KT2440
cccaaggcuggcca

SEQ ID NO: 1570739 - RNA, 20 nt, Pseudomonas putida KT2440
cccaaagcccgugccgcauc

SEQ ID NO: 1570740 - RNA, 22 nt, Pseudomonas putida KT2440
cccaaacucuugagcuggccgu

SEQ ID NO: 1570741 - RNA, 14 nt, Pseudomonas putida KT2440
cccacacaccgcaa

SEQ ID NO: 1570742 - RNA, 22 nt, Pseudomonas putida KT2440
cccaaugguuuaguccugcagc

SEQ ID NO: 1570743 - RNA, 15 nt, Pseudomonas putida KT2440
cccacacccgcgcgu

SEQ ID NO: 1570744 - RNA, 14 nt, Pseudomonas putida KT2440
cccacacggcaagc

SEQ ID NO: 1570745 - RNA, 19 nt, Pseudomonas putida KT2440
cccacacggcaagccacgc

SEQ ID NO: 1570746 - RNA, 18 nt, Pseudomonas putida KT2440
cccacagauauugcaccg

SEQ ID NO: 1570747 - RNA, 13 nt, Pseudomonas putida KT2440
cccacagcgccug

SEQ ID NO: 1570748 - RNA, 17 nt, Pseudomonas putida KT2440
cccacaggaauuacgca

SEQ ID NO: 1570749 - RNA, 14 nt, Pseudomonas putida KT2440
cccacaggcacagg

SEQ ID NO: 1570750 - RNA, 16 nt, Pseudomonas putida KT2440
cccacaggcacaggcc

SEQ ID NO: 1570751 - RNA, 22 nt, Pseudomonas putida KT2440
cccacaggcacaggcccagcaa

SEQ ID NO: 1570752 - RNA, 23 nt, Pseudomonas putida KT2440
cccacaggcacaggcccagcaac

SEQ ID NO: 1570753 - RNA, 21 nt, Pseudomonas putida KT2440
cccacaggcacgacugaacac

SEQ ID NO: 1570754 - RNA, 12 nt, Pseudomonas putida KT2440
ccaugcgaacug

SEQ ID NO: 1570755 - RNA, 20 nt, Pseudomonas putida KT2440
ccaucucgccaagcauucgc

SEQ ID NO: 1570756 - RNA, 17 nt, Pseudomonas putida KT2440
ccaugcgcgcagcgaac

SEQ ID NO: 1570757 - RNA, 15 nt, Pseudomonas putida KT2440
ccaugcgccgcugcu

SEQ ID NO: 1570758 - RNA, 23 nt, Pseudomonas putida KT2440
ccaugggcaaugcgagacgccac

SEQ ID NO: 1570759 - RNA, 17 nt, Pseudomonas putida KT2440
ccaugggcaggcccagg

SEQ ID NO: 1570760 - RNA, 21 nt, Pseudomonas putida KT2440
ccaugcggcucuguuucugcc

SEQ ID NO: 1570761 - RNA, 15 nt, Pseudomonas putida KT2440
ccaucagagcgccag

SEQ ID NO: 1570762 - RNA, 12 nt, Pseudomonas putida KT2440
ccaucagcgccg

SEQ ID NO: 1570763 - RNA, 16 nt, Pseudomonas putida KT2440
ccaucaccgccagguc

SEQ ID NO: 1570764 - RNA, 18 nt, Pseudomonas putida KT2440
ccaucaccgccagcaugg

SEQ ID NO: 1570765 - RNA, 16 nt, Pseudomonas putida KT2440
ccaucaccagcccgaa

SEQ ID NO: 1570766 - RNA, 22 nt, Pseudomonas putida KT2440
ccaucggcacccgcacaugccu

SEQ ID NO: 1570767 - RNA, 19 nt, Pseudomonas putida KT2440
ccaucaggaacagcucgau

SEQ ID NO: 1570768 - RNA, 18 nt, Pseudomonas putida KT2440
ccaucaggcacaggccag

SEQ ID NO: 1570769 - RNA, 12 nt, Pseudomonas putida KT2440
ccaucggcgucg

SEQ ID NO: 1570770 - RNA, 13 nt, Pseudomonas putida KT2440
cccaggagggcug

SEQ ID NO: 1570771 - RNA, 13 nt, Pseudomonas putida KT2440
cccaggaucacug

SEQ ID NO: 1570772 - RNA, 16 nt, Pseudomonas putida KT2440
cccagggcccucaacc

SEQ ID NO: 1570773 - RNA, 14 nt, Pseudomonas putida KT2440
cccagggcaguugc

SEQ ID NO: 1570774 - RNA, 20 nt, Pseudomonas putida KT2440
cccagggcaucgaucccugg

SEQ ID NO: 1570775 - RNA, 14 nt, Pseudomonas putida KT2440
cccagcgccaccgg

SEQ ID NO: 1570776 - RNA, 15 nt, Pseudomonas putida KT2440
cccagcgccaccggc

SEQ ID NO: 1570777 - RNA, 21 nt, Pseudomonas putida KT2440
cccagguguuguugcaaccag

SEQ ID NO: 1570778 - RNA, 18 nt, Pseudomonas putida KT2440
cccaggugcugaugccca

SEQ ID NO: 1570779 - RNA, 17 nt, Pseudomonas putida KT2440
cccauagggccagcggc

SEQ ID NO: 1570780 - RNA, 17 nt, Pseudomonas putida KT2440
cccauaccucuucacug

SEQ ID NO: 1570781 - RNA, 14 nt, Pseudomonas putida KT2440
cccauaaaagccuc

SEQ ID NO: 1570782 - RNA, 14 nt, Pseudomonas putida KT2440
cccaugaagcggcc

SEQ ID NO: 1570783 - RNA, 19 nt, Pseudomonas putida KT2440
cccaugacguucuucggca

SEQ ID NO: 1570784 - RNA, 22 nt, Pseudomonas putida KT2440
cccaugacguucuucggcaggu

SEQ ID NO: 1570785 - RNA, 17 nt, Pseudomonas putida KT2440
cccagcagguacaccgc

SEQ ID NO: 1570786 - RNA, 19 nt, Pseudomonas putida KT2440
cccagcagguagacgaugc

SEQ ID NO: 1570787 - RNA, 20 nt, Pseudomonas putida KT2440
cccagcaguucgcgcaccau

SEQ ID NO: 1570788 - RNA, 18 nt, Pseudomonas putida KT2440
cccagaacagccacagcu

SEQ ID NO: 1570789 - RNA, 17 nt, Pseudomonas putida KT2440
cccagcaugaacgcagc

SEQ ID NO: 1570790 - RNA, 16 nt, Pseudomonas putida KT2440
cccagcaucaacgcug

SEQ ID NO: 1570791 - RNA, 18 nt, Pseudomonas putida KT2440
cccagccaacccucgacc

SEQ ID NO: 1570792 - RNA, 12 nt, Pseudomonas putida KT2440
cccagccaucga

SEQ ID NO: 1570793 - RNA, 17 nt, Pseudomonas putida KT2440
cccagccaggcacuggc

SEQ ID NO: 1570794 - RNA, 22 nt, Pseudomonas putida KT2440
cccagccaccgacgaacagggc

SEQ ID NO: 1570795 - RNA, 17 nt, Pseudomonas putida KT2440
cccagccuucagcaggc

SEQ ID NO: 1570796 - RNA, 15 nt, Pseudomonas putida KT2440
cccagccggcguugc

SEQ ID NO: 1570797 - RNA, 22 nt, Pseudomonas putida KT2440
cccagccggucauccagcagcu

SEQ ID NO: 1570798 - RNA, 15 nt, Pseudomonas putida KT2440
cccagccccgagcaa

SEQ ID NO: 1570799 - RNA, 16 nt, Pseudomonas putida KT2440
cccacagguccagcgc

SEQ ID NO: 1570800 - RNA, 20 nt, Pseudomonas putida KT2440
cccacaggugcagcacaggu

SEQ ID NO: 1570801 - RNA, 18 nt, Pseudomonas putida KT2440
cccacagggaccucacag

SEQ ID NO: 1570802 - RNA, 21 nt, Pseudomonas putida KT2440
cccacagggaucgcgccagcu

SEQ ID NO: 1570803 - RNA, 21 nt, Pseudomonas putida KT2440
cccacauagcgcacuugcacu

SEQ ID NO: 1570804 - RNA, 18 nt, Pseudomonas putida KT2440
cccacagugucccggcca

SEQ ID NO: 1570805 - RNA, 13 nt, Pseudomonas putida KT2440
cccaccaccuucu

SEQ ID NO: 1570806 - RNA, 18 nt, Pseudomonas putida KT2440
cccaccacaaaccacagc

SEQ ID NO: 1570807 - RNA, 22 nt, Pseudomonas putida KT2440
cccaccagcacugccuugcccu

SEQ ID NO: 1570808 - RNA, 21 nt, Pseudomonas putida KT2440
cccaccagcacugcugcgcag

SEQ ID NO: 1570809 - RNA, 22 nt, Pseudomonas putida KT2440
cccaccagcacugcugcgcagu

SEQ ID NO: 1570810 - RNA, 20 nt, Pseudomonas putida KT2440
cccacugucaaucuugcgca

SEQ ID NO: 1570811 - RNA, 23 nt, Pseudomonas putida KT2440
cccacuccgggugaucauucagg

SEQ ID NO: 1570812 - RNA, 14 nt, Pseudomonas putida KT2440
cccgaggcaaucag

SEQ ID NO: 1570813 - RNA, 17 nt, Pseudomonas putida KT2440
cccgacaaagaagcgcc

SEQ ID NO: 1570814 - RNA, 16 nt, Pseudomonas putida KT2440
cccgacaacagcugca

SEQ ID NO: 1570815 - RNA, 22 nt, Pseudomonas putida KT2440
cccgaagcuaucgccagcaggc

SEQ ID NO: 1570816 - RNA, 23 nt, Pseudomonas putida KT2440
cccgaagcgcagguccaggcgca

SEQ ID NO: 1570817 - RNA, 17 nt, Pseudomonas putida KT2440
cccgaacgcgguaagca

SEQ ID NO: 1570818 - RNA, 21 nt, Pseudomonas putida KT2440
cccgaaacugcgcucaaccag

SEQ ID NO: 1570819 - RNA, 20 nt, Pseudomonas putida KT2440
cccgaaagggccgcaaagcg

SEQ ID NO: 1570820 - RNA, 19 nt, Pseudomonas putida KT2440
cccgaccaaggccaacugc

SEQ ID NO: 1570821 - RNA, 21 nt, Pseudomonas putida KT2440
cccgaccacccggugacggca

SEQ ID NO: 1570822 - RNA, 19 nt, Pseudomonas putida KT2440
cccgacaagccacgcaccu

SEQ ID NO: 1570823 - RNA, 17 nt, Pseudomonas putida KT2440
cccgacaccggccuugc

SEQ ID NO: 1570824 - RNA, 20 nt, Pseudomonas putida KT2440
cccgacaccggccuugcgca

SEQ ID NO: 1570825 - RNA, 16 nt, Pseudomonas putida KT2440
cccaugcucaccagcu

SEQ ID NO: 1570826 - RNA, 21 nt, Pseudomonas putida KT2440
cccaugcucugcgcaaaggcu

SEQ ID NO: 1570827 - RNA, 13 nt, Pseudomonas putida KT2440
cccaugccaagcc

SEQ ID NO: 1570828 - RNA, 16 nt, Pseudomonas putida KT2440
cccaugcccagcucgc

SEQ ID NO: 1570829 - RNA, 13 nt, Pseudomonas putida KT2440
cccaugcacagcg

SEQ ID NO: 1570830 - RNA, 18 nt, Pseudomonas putida KT2440
cccaugaucgcggcaaug

SEQ ID NO: 1570831 - RNA, 21 nt, Pseudomonas putida KT2440
cccaugcgaccaguaccgcgc

SEQ ID NO: 1570832 - RNA, 20 nt, Pseudomonas putida KT2440
cccauguugucacccagcac

SEQ ID NO: 1570833 - RNA, 15 nt, Pseudomonas putida KT2440
cccaugucgaucagc

SEQ ID NO: 1570834 - RNA, 22 nt, Pseudomonas putida KT2440
cccauggccaggcugucggcgu

SEQ ID NO: 1570835 - RNA, 14 nt, Pseudomonas putida KT2440
cccauggcgcagcu

SEQ ID NO: 1570836 - RNA, 18 nt, Pseudomonas putida KT2440
cccauguagaccaccagc

SEQ ID NO: 1570837 - RNA, 21 nt, Pseudomonas putida KT2440
cccauguagaccaccagcguu

SEQ ID NO: 1570838 - RNA, 21 nt, Pseudomonas putida KT2440
ccccgucgaucacaugcggca

SEQ ID NO: 1570839 - RNA, 20 nt, Pseudomonas putida KT2440
ccccguaggagcgggcuugc

SEQ ID NO: 1570840 - RNA, 17 nt, Pseudomonas putida KT2440
ccccgguucucgcgaac

SEQ ID NO: 1570841 - RNA, 11 nt, Pseudomonas putida KT2440
ccccggcuguc

SEQ ID NO: 1570842 - RNA, 14 nt, Pseudomonas putida KT2440
ccccgggcaggcca

SEQ ID NO: 1570843 - RNA, 15 nt, Pseudomonas putida KT2440
ccccgguaaugcugg

SEQ ID NO: 1570844 - RNA, 18 nt, Pseudomonas putida KT2440
ccccggggcgcuccagca

SEQ ID NO: 1570845 - RNA, 17 nt, Pseudomonas putida KT2440
ccccgguccagcacacu

SEQ ID NO: 1570846 - RNA, 12 nt, Pseudomonas putida KT2440
ccccucgacgcc

SEQ ID NO: 1570847 - RNA, 14 nt, Pseudomonas putida KT2440
ccccuccuccagca

SEQ ID NO: 1570848 - RNA, 21 nt, Pseudomonas putida KT2440
ccccugcaaggccagcggaau

SEQ ID NO: 1570849 - RNA, 15 nt, Pseudomonas putida KT2440
ccccugcacaucacg

SEQ ID NO: 1570850 - RNA, 15 nt, Pseudomonas putida KT2440
ccccuguaggagcgg

SEQ ID NO: 1570851 - RNA, 18 nt, Pseudomonas putida KT2440
ccccuguaggaucggguu

SEQ ID NO: 1570852 - RNA, 20 nt, Pseudomonas putida KT2440
ccccuguaggaucggguuua

SEQ ID NO: 1570853 - RNA, 17 nt, Pseudomonas putida KT2440
ccccugugggagcgggg

SEQ ID NO: 1570854 - RNA, 14 nt, Pseudomonas putida KT2440
ccccuucaaggggc

SEQ ID NO: 1570855 - RNA, 15 nt, Pseudomonas putida KT2440
ccccuucaaggggcc

SEQ ID NO: 1570856 - RNA, 23 nt, Pseudomonas putida KT2440
ccccuucacugaucgggauuaca

SEQ ID NO: 1570857 - RNA, 13 nt, Pseudomonas putida KT2440
ccccuuccaugcc

SEQ ID NO: 1570858 - RNA, 15 nt, Pseudomonas putida KT2440
ccccuucgauucagg

SEQ ID NO: 1570859 - RNA, 17 nt, Pseudomonas putida KT2440
ccccuuucuccagcaac

SEQ ID NO: 1570860 - RNA, 23 nt, Pseudomonas putida KT2440
cccgcgcauccuccgcccugccc

SEQ ID NO: 1570861 - RNA, 17 nt, Pseudomonas putida KT2440
cccgcgcaugaucagcu

SEQ ID NO: 1570862 - RNA, 18 nt, Pseudomonas putida KT2440
cccgcgcaugaucagcug

SEQ ID NO: 1570863 - RNA, 18 nt, Pseudomonas putida KT2440
cccgcgcggcgcaucgcg

SEQ ID NO: 1570864 - RNA, 12 nt, Pseudomonas putida KT2440
cccgcgaugccg

SEQ ID NO: 1570865 - RNA, 15 nt, Pseudomonas putida KT2440
cccgcgaggucaggu

SEQ ID NO: 1570866 - RNA, 19 nt, Pseudomonas putida KT2440
cccgcgaagcggccaaccg

SEQ ID NO: 1570867 - RNA, 21 nt, Pseudomonas putida KT2440
cccgcgaagggccgcaaagcg

SEQ ID NO: 1570868 - RNA, 20 nt, Pseudomonas putida KT2440
cccgcgaagggccgcaacgc

SEQ ID NO: 1570869 - RNA, 21 nt, Pseudomonas putida KT2440
cccgcgaagggccgccaagcg

SEQ ID NO: 1570870 - RNA, 21 nt, Pseudomonas putida KT2440
cccgcgaauagccgugaugcg

SEQ ID NO: 1570871 - RNA, 22 nt, Pseudomonas putida KT2440
cccgcgaaugcuccggcgacag

SEQ ID NO: 1570872 - RNA, 24 nt, Pseudomonas putida KT2440
cccgcgaaugcuccggcgacagcu

SEQ ID NO: 1570873 - RNA, 22 nt, Pseudomonas putida KT2440
cccgcgaaugggccgcaaagcg

SEQ ID NO: 1570874 - RNA, 22 nt, Pseudomonas putida KT2440
cccgcgaaugggccgccaagcg

SEQ ID NO: 1570875 - RNA, 20 nt, Pseudomonas putida KT2440
cccgcgaagaagccaccgcg

SEQ ID NO: 1570876 - RNA, 20 nt, Pseudomonas putida KT2440
cccgcgaagaauucaacgcg

SEQ ID NO: 1570877 - RNA, 14 nt, Pseudomonas putida KT2440
cccgcgaagaggcc

SEQ ID NO: 1570878 - RNA, 15 nt, Pseudomonas putida KT2440
cccgcgaagaggcca

SEQ ID NO: 1570879 - RNA, 20 nt, Pseudomonas putida KT2440
cccgcgaagaggccaguacc

SEQ ID NO: 1570880 - RNA, 22 nt, Pseudomonas putida KT2440
cccgcgaagaggccggcaaagc

SEQ ID NO: 1570881 - RNA, 17 nt, Pseudomonas putida KT2440
cccgcgaagaggccggu

SEQ ID NO: 1570882 - RNA, 20 nt, Pseudomonas putida KT2440
cccgcgaagagggcgacacc

SEQ ID NO: 1570883 - RNA, 17 nt, Pseudomonas putida KT2440
cccgcgaagcagccacc

SEQ ID NO: 1570884 - RNA, 22 nt, Pseudomonas putida KT2440
cccgcgaagcaggcgacgcagu

SEQ ID NO: 1570885 - RNA, 14 nt, Pseudomonas putida KT2440
cccgccccaauggc

SEQ ID NO: 1570886 - RNA, 13 nt, Pseudomonas putida KT2440
cccgcccgccugc

SEQ ID NO: 1570887 - RNA, 20 nt, Pseudomonas putida KT2440
cccgccccucgucacugacc

SEQ ID NO: 1570888 - RNA, 15 nt, Pseudomonas putida KT2440
cccgcccgaagggca

SEQ ID NO: 1570889 - RNA, 16 nt, Pseudomonas putida KT2440
cccgcuucgccagcgc

SEQ ID NO: 1570890 - RNA, 14 nt, Pseudomonas putida KT2440
cccgcuggcgaccg

SEQ ID NO: 1570891 - RNA, 19 nt, Pseudomonas putida KT2440
cccgcuguugagcagcagc

SEQ ID NO: 1570892 - RNA, 18 nt, Pseudomonas putida KT2440
cccgcuccugcaggguuc

SEQ ID NO: 1570893 - RNA, 20 nt, Pseudomonas putida KT2440
cccgcuccugcaggguucgc

SEQ ID NO: 1570894 - RNA, 20 nt, Pseudomonas putida KT2440
cccgcguccagggcagguca

SEQ ID NO: 1570895 - RNA, 20 nt, Pseudomonas putida KT2440
cccgcuccuacaaagcggcg

SEQ ID NO: 1570896 - RNA, 20 nt, Pseudomonas putida KT2440
cccgcuccuacaacgaucug

SEQ ID NO: 1570897 - RNA, 19 nt, Pseudomonas putida KT2440
cccgcuccuacacagguca

SEQ ID NO: 1570898 - RNA, 19 nt, Pseudomonas putida KT2440
cccgcuccuacaggauggc

SEQ ID NO: 1570899 - RNA, 19 nt, Pseudomonas putida KT2440
cccgcuccuacaggcgacc

SEQ ID NO: 1570900 - RNA, 20 nt, Pseudomonas putida KT2440
cccgcuccuacagguucugc

SEQ ID NO: 1570901 - RNA, 20 nt, Pseudomonas putida KT2440
cccgcuccuacgacggccug

SEQ ID NO: 1570902 - RNA, 20 nt, Pseudomonas putida KT2440
cccgcuccuacgacggucug

SEQ ID NO: 1570903 - RNA, 21 nt, Pseudomonas putida KT2440
cccgcuccuacgacggucugc

SEQ ID NO: 1570904 - RNA, 22 nt, Pseudomonas putida KT2440
cccgcuccuacgcaccgaucug

SEQ ID NO: 1570905 - RNA, 16 nt, Pseudomonas putida KT2440
cccgcuccuacgggca

SEQ ID NO: 1570906 - RNA, 17 nt, Pseudomonas putida KT2440
cccgcuccuacgggcaa

SEQ ID NO: 1570907 - RNA, 18 nt, Pseudomonas putida KT2440
cccgcuccuacgggcaac

SEQ ID NO: 1570908 - RNA, 19 nt, Pseudomonas putida KT2440
cccgcuccuacgggcaacc

SEQ ID NO: 1570909 - RNA, 20 nt, Pseudomonas putida KT2440
cccgcuccuacuacggccug

SEQ ID NO: 1570910 - RNA, 22 nt, Pseudomonas putida KT2440
cccgcgcguccauggcgccgau

SEQ ID NO: 1570911 - RNA, 18 nt, Pseudomonas putida KT2440
cccgcaaucgucgaccac

SEQ ID NO: 1570912 - RNA, 23 nt, Pseudomonas putida KT2440
cccgccacaggugacaagcugcg

SEQ ID NO: 1570913 - RNA, 22 nt, Pseudomonas putida KT2440
cccgccauugcaccacgccaua

SEQ ID NO: 1570914 - RNA, 24 nt, Pseudomonas putida KT2440
cccgccauugcaccacgccauagc

SEQ ID NO: 1570915 - RNA, 16 nt, Pseudomonas putida KT2440
cccgccagugaccgcu

SEQ ID NO: 1570916 - RNA, 21 nt, Pseudomonas putida KT2440
cccgccauaucaggauugccg

SEQ ID NO: 1570917 - RNA, 14 nt, Pseudomonas putida KT2440
cccgccaggcgcaa

SEQ ID NO: 1570918 - RNA, 15 nt, Pseudomonas putida KT2440
cccgcaacaaccugg

SEQ ID NO: 1570919 - RNA, 19 nt, Pseudomonas putida KT2440
cccgcaacaaccuggccgg

SEQ ID NO: 1570920 - RNA, 23 nt, Pseudomonas putida KT2440
cccgcaacauaaggugcaaagcg

SEQ ID NO: 1570921 - RNA, 17 nt, Pseudomonas putida KT2440
cccgcaagccagccucc

SEQ ID NO: 1570922 - RNA, 15 nt, Pseudomonas putida KT2440
cccgcaagcgccgau

SEQ ID NO: 1570923 - RNA, 20 nt, Pseudomonas putida KT2440
cccgauuacaagggccugug

SEQ ID NO: 1570924 - RNA, 22 nt, Pseudomonas putida KT2440
cccgaugcgcugaucgugcacc

SEQ ID NO: 1570925 - RNA, 15 nt, Pseudomonas putida KT2440
ccgaauccagguuga

SEQ ID NO: 1570926 - RNA, 13 nt, Pseudomonas putida KT2440
ccgaacgacacgg

SEQ ID NO: 1570927 - RNA, 15 nt, Pseudomonas putida KT2440
ccgaagcaccacugg

SEQ ID NO: 1570928 - RNA, 13 nt, Pseudomonas putida KT2440
ccgaaccauucaa

SEQ ID NO: 1570929 - RNA, 18 nt, Pseudomonas putida KT2440
ccgaaccaccgaugccug

SEQ ID NO: 1570930 - RNA, 17 nt, Pseudomonas putida KT2440
cccuggccuggccaagc

SEQ ID NO: 1570931 - RNA, 20 nt, Pseudomonas putida KT2440
cccuggcgguugaccagggc

SEQ ID NO: 1570932 - RNA, 23 nt, Pseudomonas putida KT2440
cccugggauuucggcggcgaugc

SEQ ID NO: 1570933 - RNA, 20 nt, Pseudomonas putida KT2440
cccugguuuuccaccggcac

SEQ ID NO: 1570934 - RNA, 18 nt, Pseudomonas putida KT2440
cccuggucauccaguggc

SEQ ID NO: 1570935 - RNA, 19 nt, Pseudomonas putida KT2440
cccugucgaucacgggcaa

SEQ ID NO: 1570936 - RNA, 22 nt, Pseudomonas putida KT2440
cccuguagauaggcuguuggcg

SEQ ID NO: 1570937 - RNA, 17 nt, Pseudomonas putida KT2440
cccuguaggagcgggcu

SEQ ID NO: 1570938 - RNA, 19 nt, Pseudomonas putida KT2440
cccuguaggagcggguuua

SEQ ID NO: 1570939 - RNA, 19 nt, Pseudomonas putida KT2440
cccuguaggugcggcuuua

SEQ ID NO: 1570940 - RNA, 19 nt, Pseudomonas putida KT2440
cccugugggagcggccuug

SEQ ID NO: 1570941 - RNA, 17 nt, Pseudomonas putida KT2440
cccugugggagcgggcu

SEQ ID NO: 1570942 - RNA, 18 nt, Pseudomonas putida KT2440
ccgaaaccaugcaggucg

SEQ ID NO: 1570943 - RNA, 20 nt, Pseudomonas putida KT2440
cccuuuuuuugugccggacu

SEQ ID NO: 1570944 - RNA, 21 nt, Pseudomonas putida KT2440
ccgaaaaaaucaugcgcuggc

SEQ ID NO: 1570945 - RNA, 22 nt, Pseudomonas putida KT2440
cccucgacgacacggcugccga

SEQ ID NO: 1570946 - RNA, 19 nt, Pseudomonas putida KT2440
cccucguaacgagccuugg

SEQ ID NO: 1570947 - RNA, 24 nt, Pseudomonas putida KT2440
cccucuuccgcacgggucaccuca

SEQ ID NO: 1570948 - RNA, 13 nt, Pseudomonas putida KT2440
cccugcccucgac

SEQ ID NO: 1570949 - RNA, 22 nt, Pseudomonas putida KT2440
cccugcgaagucagguaggugc

SEQ ID NO: 1570950 - RNA, 12 nt, Pseudomonas putida KT2440
cccgugguacac

SEQ ID NO: 1570951 - RNA, 12 nt, Pseudomonas putida KT2440
cccgugcugcuc

SEQ ID NO: 1570952 - RNA, 17 nt, Pseudomonas putida KT2440
cccgugccgcaucagcc

SEQ ID NO: 1570953 - RNA, 18 nt, Pseudomonas putida KT2440
cccgugcccgaucaccgc

SEQ ID NO: 1570954 - RNA, 14 nt, Pseudomonas putida KT2440
cccgugcccggcau

SEQ ID NO: 1570955 - RNA, 12 nt, Pseudomonas putida KT2440
cccucaggcaca

SEQ ID NO: 1570956 - RNA, 16 nt, Pseudomonas putida KT2440
cccucauucgcccgca

SEQ ID NO: 1570957 - RNA, 23 nt, Pseudomonas putida KT2440
cccguucaggucauugucaucca

SEQ ID NO: 1570958 - RNA, 22 nt, Pseudomonas putida KT2440
cccuccuaucgcgacacaaggc

SEQ ID NO: 1570959 - RNA, 15 nt, Pseudomonas putida KT2440
cccuccucaccgcag

SEQ ID NO: 1570960 - RNA, 21 nt, Pseudomonas putida KT2440
cccggggaucuugcuggccgg

SEQ ID NO: 1570961 - RNA, 16 nt, Pseudomonas putida KT2440
cccgggaaaagccugc

SEQ ID NO: 1570962 - RNA, 13 nt, Pseudomonas putida KT2440
cccgggcagguuc

SEQ ID NO: 1570963 - RNA, 13 nt, Pseudomonas putida KT2440
cccgggcaaagca

SEQ ID NO: 1570964 - RNA, 13 nt, Pseudomonas putida KT2440
cccggcgccaugc

SEQ ID NO: 1570965 - RNA, 19 nt, Pseudomonas putida KT2440
cccggcgccgccaggcagc

SEQ ID NO: 1570966 - RNA, 17 nt, Pseudomonas putida KT2440
cccggcgccgagccaua

SEQ ID NO: 1570967 - RNA, 21 nt, Pseudomonas putida KT2440
cccggcgccaaacgccagggc

SEQ ID NO: 1570968 - RNA, 21 nt, Pseudomonas putida KT2440
cccgcuuguagcucagguaga

SEQ ID NO: 1570969 - RNA, 14 nt, Pseudomonas putida KT2440
cccguaacggucac

SEQ ID NO: 1570970 - RNA, 15 nt, Pseudomonas putida KT2440
cccguaggagcgggu

SEQ ID NO: 1570971 - RNA, 17 nt, Pseudomonas putida KT2440
cccguaggagcggguuu

SEQ ID NO: 1570972 - RNA, 18 nt, Pseudomonas putida KT2440
cccguaggagcggguuua

SEQ ID NO: 1570973 - RNA, 21 nt, Pseudomonas putida KT2440
cccgguugccauaucggcuug

SEQ ID NO: 1570974 - RNA, 13 nt, Pseudomonas putida KT2440
cccggugaaguca

SEQ ID NO: 1570975 - RNA, 17 nt, Pseudomonas putida KT2440
cccggugaagucaccga

SEQ ID NO: 1570976 - RNA, 17 nt, Pseudomonas putida KT2440
cccgucgagccgggucc

SEQ ID NO: 1570977 - RNA, 20 nt, Pseudomonas putida KT2440
cccguauugguagccacgug

SEQ ID NO: 1570978 - RNA, 19 nt, Pseudomonas putida KT2440
cccgucagugcucggcaac

SEQ ID NO: 1570979 - RNA, 21 nt, Pseudomonas putida KT2440
cccgucagugcucggcaacgg

SEQ ID NO: 1570980 - RNA, 22 nt, Pseudomonas putida KT2440
cccgucagccgaaacgauacuc

SEQ ID NO: 1570981 - RNA, 15 nt, Pseudomonas putida KT2440
cccgucagcggcaac

SEQ ID NO: 1570982 - RNA, 15 nt, Pseudomonas putida KT2440
augccggucagcagc

SEQ ID NO: 1570983 - RNA, 16 nt, Pseudomonas putida KT2440
augccggucagcagca

SEQ ID NO: 1570984 - RNA, 16 nt, Pseudomonas putida KT2440
augccgguguccuggc

SEQ ID NO: 1570985 - RNA, 16 nt, Pseudomonas putida KT2440
augccgccauccucgg

SEQ ID NO: 1570986 - RNA, 17 nt, Pseudomonas putida KT2440
augccgcgcgcccgcug

SEQ ID NO: 1570987 - RNA, 15 nt, Pseudomonas putida KT2440
augccgccuugcaga

SEQ ID NO: 1570988 - RNA, 19 nt, Pseudomonas putida KT2440
augccgacagccaccgcga

SEQ ID NO: 1570989 - RNA, 12 nt, Pseudomonas putida KT2440
augccgaaggcc

SEQ ID NO: 1570990 - RNA, 13 nt, Pseudomonas putida KT2440
augcgaacugcag

SEQ ID NO: 1570991 - RNA, 16 nt, Pseudomonas putida KT2440
augcgccuggcccgca

SEQ ID NO: 1570992 - RNA, 17 nt, Pseudomonas putida KT2440
augcgcgaggucugcgc

SEQ ID NO: 1570993 - RNA, 17 nt, Pseudomonas putida KT2440
augcgaagcaagcgcau

SEQ ID NO: 1570994 - RNA, 13 nt, Pseudomonas putida KT2440
augcgacugagca

SEQ ID NO: 1570995 - RNA, 16 nt, Pseudomonas putida KT2440
augcgacugagcaacg

SEQ ID NO: 1570996 - RNA, 14 nt, Pseudomonas putida KT2440
augcgacugaggca

SEQ ID NO: 1570997 - RNA, 14 nt, Pseudomonas putida KT2440
augccucaucaggc

SEQ ID NO: 1570998 - RNA, 15 nt, Pseudomonas putida KT2440
augccuacugcuggc

SEQ ID NO: 1570999 - RNA, 19 nt, Pseudomonas putida KT2440
augccuaucucuuccagcg

SEQ ID NO: 1571000 - RNA, 22 nt, Pseudomonas putida KT2440
augccugcacugggcgaaggug

SEQ ID NO: 1571001 - RNA, 17 nt, Pseudomonas putida KT2440
augccuucuucgaugua

SEQ ID NO: 1571002 - RNA, 19 nt, Pseudomonas putida KT2440
augcgcucguagagcuugg

SEQ ID NO: 1571003 - RNA, 17 nt, Pseudomonas putida KT2440
augcgcuugccagcgug

SEQ ID NO: 1571004 - RNA, 16 nt, Pseudomonas putida KT2440
augcgcuucauccagc

SEQ ID NO: 1571005 - RNA, 17 nt, Pseudomonas putida KT2440
augcgcuucauccagcg

SEQ ID NO: 1571006 - RNA, 12 nt, Pseudomonas putida KT2440
augcguucggca

SEQ ID NO: 1571007 - RNA, 13 nt, Pseudomonas putida KT2440
augcguucggcau

SEQ ID NO: 1571008 - RNA, 15 nt, Pseudomonas putida KT2440
augcguucggcaucu

SEQ ID NO: 1571009 - RNA, 15 nt, Pseudomonas putida KT2440
augagccgcccaggu

SEQ ID NO: 1571010 - RNA, 19 nt, Pseudomonas putida KT2440
augaugauaccgaacagca

SEQ ID NO: 1571011 - RNA, 16 nt, Pseudomonas putida KT2440
aucugcacacugcgcu

SEQ ID NO: 1571012 - RNA, 13 nt, Pseudomonas putida KT2440
aucugcagcagca

SEQ ID NO: 1571013 - RNA, 19 nt, Pseudomonas putida KT2440
aucugccaggcaccacaag

SEQ ID NO: 1571014 - RNA, 20 nt, Pseudomonas putida KT2440
aucugccgggucggccugcu

SEQ ID NO: 1571015 - RNA, 23 nt, Pseudomonas putida KT2440
aucugccguuguucggcaaaggc

SEQ ID NO: 1571016 - RNA, 16 nt, Pseudomonas putida KT2440
aucugccccucgauca

SEQ ID NO: 1571017 - RNA, 22 nt, Pseudomonas putida KT2440
aucugcgcacggaaggcaucga

SEQ ID NO: 1571018 - RNA, 20 nt, Pseudomonas putida KT2440
augcccggcucaccgcagcc

SEQ ID NO: 1571019 - RNA, 17 nt, Pseudomonas putida KT2440
augcccgcaggugcggc

SEQ ID NO: 1571020 - RNA, 13 nt, Pseudomonas putida KT2440
augcccgcuccca

SEQ ID NO: 1571021 - RNA, 17 nt, Pseudomonas putida KT2440
augcccgcucccacagg

SEQ ID NO: 1571022 - RNA, 17 nt, Pseudomonas putida KT2440
augcccauggccaggcu

SEQ ID NO: 1571023 - RNA, 20 nt, Pseudomonas putida KT2440
augccccucgaacagcgccg

SEQ ID NO: 1571024 - RNA, 18 nt, Pseudomonas putida KT2440
augcccaaagcccgugcc

SEQ ID NO: 1571025 - RNA, 19 nt, Pseudomonas putida KT2440
augccauccucggccaggc

SEQ ID NO: 1571026 - RNA, 22 nt, Pseudomonas putida KT2440
augccauccucggccaggccca

SEQ ID NO: 1571027 - RNA, 20 nt, Pseudomonas putida KT2440
augccaucgaguaucgccuc

SEQ ID NO: 1571028 - RNA, 13 nt, Pseudomonas putida KT2440
augcacaggccgu

SEQ ID NO: 1571029 - RNA, 21 nt, Pseudomonas putida KT2440
augcacagcgagcagccuggc

SEQ ID NO: 1571030 - RNA, 18 nt, Pseudomonas putida KT2440
augcacagcucgcgcugc

SEQ ID NO: 1571031 - RNA, 23 nt, Pseudomonas putida KT2440
augcacagcucgcgcugccaggc

SEQ ID NO: 1571032 - RNA, 13 nt, Pseudomonas putida KT2440
augcaacggcaca

SEQ ID NO: 1571033 - RNA, 16 nt, Pseudomonas putida KT2440
augccaacuuccaucg

SEQ ID NO: 1571034 - RNA, 15 nt, Pseudomonas putida KT2440
augcaccacgcgcaa

SEQ ID NO: 1571035 - RNA, 18 nt, Pseudomonas putida KT2440
augcaccacgcgcaaaug

SEQ ID NO: 1571036 - RNA, 18 nt, Pseudomonas putida KT2440
auuacccuucaucgccgg

SEQ ID NO: 1571037 - RNA, 13 nt, Pseudomonas putida KT2440
auuacaagggccu

SEQ ID NO: 1571038 - RNA, 17 nt, Pseudomonas putida KT2440
auguuuggguugacggu

SEQ ID NO: 1571039 - RNA, 19 nt, Pseudomonas putida KT2440
auuacuccgauuguggccg

SEQ ID NO: 1571040 - RNA, 13 nt, Pseudomonas putida KT2440
auuccaagugccu

SEQ ID NO: 1571041 - RNA, 20 nt, Pseudomonas putida KT2440
auuaucugugggagcggccu

SEQ ID NO: 1571042 - RNA, 13 nt, Pseudomonas putida KT2440
auggcggcaccga

SEQ ID NO: 1571043 - RNA, 14 nt, Pseudomonas putida KT2440
auggcggcccagcc

SEQ ID NO: 1571044 - RNA, 18 nt, Pseudomonas putida KT2440
auggcgcgaacagggccu

SEQ ID NO: 1571045 - RNA, 21 nt, Pseudomonas putida KT2440
auggcguauccacauacugcu

SEQ ID NO: 1571046 - RNA, 23 nt, Pseudomonas putida KT2440
auggcuagggucguccuggguaa

SEQ ID NO: 1571047 - RNA, 21 nt, Pseudomonas putida KT2440
auggcuaagccaagccggcuu

SEQ ID NO: 1571048 - RNA, 17 nt, Pseudomonas putida KT2440
auggccggcugugcaga

SEQ ID NO: 1571049 - RNA, 17 nt, Pseudomonas putida KT2440
auggcgcagcuccacug

SEQ ID NO: 1571050 - RNA, 15 nt, Pseudomonas putida KT2440
auggccgcaggccca

SEQ ID NO: 1571051 - RNA, 15 nt, Pseudomonas putida KT2440
augcuccugcgccac

SEQ ID NO: 1571052 - RNA, 21 nt, Pseudomonas putida KT2440
augucgagcaugaucaccgcc

SEQ ID NO: 1571053 - RNA, 20 nt, Pseudomonas putida KT2440
augucgaaccacaucggcgc

SEQ ID NO: 1571054 - RNA, 21 nt, Pseudomonas putida KT2440
augucgaaccacaucggcgcg

SEQ ID NO: 1571055 - RNA, 16 nt, Pseudomonas putida KT2440
auguccuugcuggcca

SEQ ID NO: 1571056 - RNA, 15 nt, Pseudomonas putida KT2440
auguacucaggggca

SEQ ID NO: 1571057 - RNA, 13 nt, Pseudomonas putida KT2440
auguacuucggau

SEQ ID NO: 1571058 - RNA, 13 nt, Pseudomonas putida KT2440
auguacaccccga

SEQ ID NO: 1571059 - RNA, 22 nt, Pseudomonas putida KT2440
auggucgcguuguucagcagcg

SEQ ID NO: 1571060 - RNA, 19 nt, Pseudomonas putida KT2440
auggugaaggccaggaaca

SEQ ID NO: 1571061 - RNA, 19 nt, Pseudomonas putida KT2440
auggugaugccccugcgcc

SEQ ID NO: 1571062 - RNA, 14 nt, Pseudomonas putida KT2440
augguccggcauca

SEQ ID NO: 1571063 - RNA, 19 nt, Pseudomonas putida KT2440
augguccugguaacccggu

SEQ ID NO: 1571064 - RNA, 18 nt, Pseudomonas putida KT2440
auggucacguagaacagg

SEQ ID NO: 1571065 - RNA, 15 nt, Pseudomonas putida KT2440
auggcugcggcaggu

SEQ ID NO: 1571066 - RNA, 22 nt, Pseudomonas putida KT2440
auggcuggcagcacgaucagcg

SEQ ID NO: 1571067 - RNA, 19 nt, Pseudomonas putida KT2440
auggcuggugaagcccuuc

SEQ ID NO: 1571068 - RNA, 14 nt, Pseudomonas putida KT2440
auggcucgcagcca

SEQ ID NO: 1571069 - RNA, 18 nt, Pseudomonas putida KT2440
auggcucagugucagcgg

SEQ ID NO: 1571070 - RNA, 18 nt, Pseudomonas putida KT2440
auggcucacacccaggcu

SEQ ID NO: 1571071 - RNA, 20 nt, Pseudomonas putida KT2440
aucgcuuuugaagucgagcg

SEQ ID NO: 1571072 - RNA, 22 nt, Pseudomonas putida KT2440
aucgcggucuuguaucccaggc

SEQ ID NO: 1571073 - RNA, 22 nt, Pseudomonas putida KT2440
aucgcgacggucauaccucgac

SEQ ID NO: 1571074 - RNA, 20 nt, Pseudomonas putida KT2440
aucgccugcuuggccgacug

SEQ ID NO: 1571075 - RNA, 18 nt, Pseudomonas putida KT2440
aucgccucgugcagcugc

SEQ ID NO: 1571076 - RNA, 17 nt, Pseudomonas putida KT2440
aucgccucggcacugca

SEQ ID NO: 1571077 - RNA, 16 nt, Pseudomonas putida KT2440
aucgccuccagcgcau

SEQ ID NO: 1571078 - RNA, 15 nt, Pseudomonas putida KT2440
aucgccucgcuggcg

SEQ ID NO: 1571079 - RNA, 20 nt, Pseudomonas putida KT2440
aucgccaaccccaacccggu

SEQ ID NO: 1571080 - RNA, 21 nt, Pseudomonas putida KT2440
aucgccaaccccaacccgguc

SEQ ID NO: 1571081 - RNA, 15 nt, Pseudomonas putida KT2440
aucgcagggucgcgc

SEQ ID NO: 1571082 - RNA, 18 nt, Pseudomonas putida KT2440
aucgcagaaggccccguc

SEQ ID NO: 1571083 - RNA, 13 nt, Pseudomonas putida KT2440
aucgccaggcgca

SEQ ID NO: 1571084 - RNA, 22 nt, Pseudomonas putida KT2440
aucgccagguggaagcgcgcau

SEQ ID NO: 1571085 - RNA, 14 nt, Pseudomonas putida KT2440
aucgccaggacggu

SEQ ID NO: 1571086 - RNA, 21 nt, Pseudomonas putida KT2440
aucgccaggcccagccccgca

SEQ ID NO: 1571087 - RNA, 20 nt, Pseudomonas putida KT2440
aucgccagccccagcccggu

SEQ ID NO: 1571088 - RNA, 19 nt, Pseudomonas putida KT2440
aucgccaccggcauucccg

SEQ ID NO: 1571089 - RNA, 15 nt, Pseudomonas putida KT2440
aucgaguaucgccuc

SEQ ID NO: 1571090 - RNA, 18 nt, Pseudomonas putida KT2440
aucgauguacucgaacag

SEQ ID NO: 1571091 - RNA, 20 nt, Pseudomonas putida KT2440
aucgauguagauacgcucgu

SEQ ID NO: 1571092 - RNA, 22 nt, Pseudomonas putida KT2440
aucgcaagcuggcgcaagccgu

SEQ ID NO: 1571093 - RNA, 22 nt, Pseudomonas putida KT2440
aucgcaccacguccggccagca

SEQ ID NO: 1571094 - RNA, 16 nt, Pseudomonas putida KT2440
aucggguuuacccgcg

SEQ ID NO: 1571095 - RNA, 19 nt, Pseudomonas putida KT2440
aucggguccacccacccuc

SEQ ID NO: 1571096 - RNA, 18 nt, Pseudomonas putida KT2440
aucgguuuuuccaugcgc

SEQ ID NO: 1571097 - RNA, 20 nt, Pseudomonas putida KT2440
aucggugcguaggagcgggu

SEQ ID NO: 1571098 - RNA, 19 nt, Pseudomonas putida KT2440
aucggccacuucgcggaag

SEQ ID NO: 1571099 - RNA, 19 nt, Pseudomonas putida KT2440
aucgggcagacgacccgga

SEQ ID NO: 1571100 - RNA, 21 nt, Pseudomonas putida KT2440
aucgggcagacgacccggaua

SEQ ID NO: 1571101 - RNA, 14 nt, Pseudomonas putida KT2440
aucggcaugcagcg

SEQ ID NO: 1571102 - RNA, 13 nt, Pseudomonas putida KT2440
aucggcaggcugg

SEQ ID NO: 1571103 - RNA, 17 nt, Pseudomonas putida KT2440
aucggcaggccggccac

SEQ ID NO: 1571104 - RNA, 18 nt, Pseudomonas putida KT2440
aucucacuuucugcgcug

SEQ ID NO: 1571105 - RNA, 13 nt, Pseudomonas putida KT2440
aucucacggccau

SEQ ID NO: 1571106 - RNA, 18 nt, Pseudomonas putida KT2440
aucgucggugaugaucag

SEQ ID NO: 1571107 - RNA, 16 nt, Pseudomonas putida KT2440
aucgucgacaacgcac

SEQ ID NO: 1571108 - RNA, 21 nt, Pseudomonas putida KT2440
aucguccuggaaaagcaaggc

SEQ ID NO: 1571109 - RNA, 23 nt, Pseudomonas putida KT2440
aucgucccggcgucccggccagc

SEQ ID NO: 1571110 - RNA, 22 nt, Pseudomonas putida KT2440
aucaucagcgccgguagcggcu

SEQ ID NO: 1571111 - RNA, 17 nt, Pseudomonas putida KT2440
aucaucaucggcaugca

SEQ ID NO: 1571112 - RNA, 20 nt, Pseudomonas putida KT2440
aucauccugcuggcccgcga

SEQ ID NO: 1571113 - RNA, 14 nt, Pseudomonas putida KT2440
aucaucucgcgaug

SEQ ID NO: 1571114 - RNA, 21 nt, Pseudomonas putida KT2440
aucaucggcaugcagcggcca

SEQ ID NO: 1571115 - RNA, 18 nt, Pseudomonas putida KT2440
aucaugcccauggccagc

SEQ ID NO: 1571116 - RNA, 14 nt, Pseudomonas putida KT2440
aucaugcgacaggc

SEQ ID NO: 1571117 - RNA, 18 nt, Pseudomonas putida KT2440
auccacauacugcuucug

SEQ ID NO: 1571118 - RNA, 19 nt, Pseudomonas putida KT2440
auccaccaggcuggccacc

SEQ ID NO: 1571119 - RNA, 21 nt, Pseudomonas putida KT2440
auccaccucgucaugcagcgc

SEQ ID NO: 1571120 - RNA, 13 nt, Pseudomonas putida KT2440
aucaucacgcgca

SEQ ID NO: 1571121 - RNA, 14 nt, Pseudomonas putida KT2440
aucaucaacgccgc

SEQ ID NO: 1571122 - RNA, 15 nt, Pseudomonas putida KT2440
aucaggugcaggagc

SEQ ID NO: 1571123 - RNA, 24 nt, Pseudomonas putida KT2440
aucaggucggcggccucgguccac

SEQ ID NO: 1571124 - RNA, 13 nt, Pseudomonas putida KT2440
aucagguucaccg

SEQ ID NO: 1571125 - RNA, 17 nt, Pseudomonas putida KT2440
aucagguucagcaggau

SEQ ID NO: 1571126 - RNA, 17 nt, Pseudomonas putida KT2440
aucagguucagggcaau

SEQ ID NO: 1571127 - RNA, 20 nt, Pseudomonas putida KT2440
aucagguugcccagcaugcg

SEQ ID NO: 1571128 - RNA, 18 nt, Pseudomonas putida KT2440
aucagguugcccgcaugc

SEQ ID NO: 1571129 - RNA, 15 nt, Pseudomonas putida KT2440
aucaggcaggccagc

SEQ ID NO: 1571130 - RNA, 19 nt, Pseudomonas putida KT2440
aucaggcaugccagcagcu

SEQ ID NO: 1571131 - RNA, 23 nt, Pseudomonas putida KT2440
aucaggccgaugccaagcaccga

SEQ ID NO: 1571132 - RNA, 23 nt, Pseudomonas putida KT2440
aucaggaacagcucgauggccag

SEQ ID NO: 1571133 - RNA, 21 nt, Pseudomonas putida KT2440
aucagcucacaggcucagucg

SEQ ID NO: 1571134 - RNA, 15 nt, Pseudomonas putida KT2440
aucagcuuaacgcuu

SEQ ID NO: 1571135 - RNA, 21 nt, Pseudomonas putida KT2440
aucagcucauagaaauggcuu

SEQ ID NO: 1571136 - RNA, 22 nt, Pseudomonas putida KT2440
auccccggccuccucgcgggca

SEQ ID NO: 1571137 - RNA, 16 nt, Pseudomonas putida KT2440
aucccggacagcagca

SEQ ID NO: 1571138 - RNA, 19 nt, Pseudomonas putida KT2440
auccgcgcuacggcgucga

SEQ ID NO: 1571139 - RNA, 16 nt, Pseudomonas putida KT2440
auccggcacuccagcg

SEQ ID NO: 1571140 - RNA, 22 nt, Pseudomonas putida KT2440
auccggccguguucaggcacga

SEQ ID NO: 1571141 - RNA, 22 nt, Pseudomonas putida KT2440
auccggcgauacuuggccauca

SEQ ID NO: 1571142 - RNA, 16 nt, Pseudomonas putida KT2440
auccggcgcaucgacg

SEQ ID NO: 1571143 - RNA, 20 nt, Pseudomonas putida KT2440
auccggcgcaucgacgggca

SEQ ID NO: 1571144 - RNA, 21 nt, Pseudomonas putida KT2440
auccggccuuuucauccggcg

SEQ ID NO: 1571145 - RNA, 12 nt, Pseudomonas putida KT2440
auccagcuucuu

SEQ ID NO: 1571146 - RNA, 18 nt, Pseudomonas putida KT2440
auccagcuugccaccauc

SEQ ID NO: 1571147 - RNA, 17 nt, Pseudomonas putida KT2440
auccaggacaaaccagc

SEQ ID NO: 1571148 - RNA, 17 nt, Pseudomonas putida KT2440
auccaggcgggcgaaga

SEQ ID NO: 1571149 - RNA, 12 nt, Pseudomonas putida KT2440
auccaggcugca

SEQ ID NO: 1571150 - RNA, 14 nt, Pseudomonas putida KT2440
auccaggcugcacu

SEQ ID NO: 1571151 - RNA, 16 nt, Pseudomonas putida KT2440
auccaggcuggccagc

SEQ ID NO: 1571152 - RNA, 17 nt, Pseudomonas putida KT2440
auccaggcuggccagca

SEQ ID NO: 1571153 - RNA, 15 nt, Pseudomonas putida KT2440
auccaggcuggcgcu

SEQ ID NO: 1571154 - RNA, 15 nt, Pseudomonas putida KT2440
auccagaaagcgauu

SEQ ID NO: 1571155 - RNA, 15 nt, Pseudomonas putida KT2440
auccacguccugguc

SEQ ID NO: 1571156 - RNA, 13 nt, Pseudomonas putida KT2440
aucccaggcgcuu

SEQ ID NO: 1571157 - RNA, 13 nt, Pseudomonas putida KT2440
auuuccgggcaau

SEQ ID NO: 1571158 - RNA, 22 nt, Pseudomonas putida KT2440
auuuccauacgugcaccggccu

SEQ ID NO: 1571159 - RNA, 17 nt, Pseudomonas putida KT2440
auuucacgcacggccuu

SEQ ID NO: 1571160 - RNA, 18 nt, Pseudomonas putida KT2440
auuugccacucaggcgca

SEQ ID NO: 1571161 - RNA, 21 nt, Pseudomonas putida KT2440
auuugccagcgugaaccggcu

SEQ ID NO: 1571162 - RNA, 19 nt, Pseudomonas putida KT2440
caaaaacgaauaucgccga

SEQ ID NO: 1571163 - RNA, 18 nt, Pseudomonas putida KT2440
auuuuuuaacaaggcacg

SEQ ID NO: 1571164 - RNA, 16 nt, Pseudomonas putida KT2440
caaacgcccgcgcagc

SEQ ID NO: 1571165 - RNA, 20 nt, Pseudomonas putida KT2440
caaacacuucaucucgcuca

SEQ ID NO: 1571166 - RNA, 15 nt, Pseudomonas putida KT2440
caaacagcaccagcc

SEQ ID NO: 1571167 - RNA, 23 nt, Pseudomonas putida KT2440
caaacaggaucuccucggccagc

SEQ ID NO: 1571168 - RNA, 16 nt, Pseudomonas putida KT2440
caaacgaaaucugccu

SEQ ID NO: 1571169 - RNA, 19 nt, Pseudomonas putida KT2440
caaacgaaaucugccugcu

SEQ ID NO: 1571170 - RNA, 21 nt, Pseudomonas putida KT2440
caaacgaaaucugccugcugc

SEQ ID NO: 1571171 - RNA, 14 nt, Pseudomonas putida KT2440
caaaccacagcggc

SEQ ID NO: 1571172 - RNA, 15 nt, Pseudomonas putida KT2440
caaaccacagcggcc

SEQ ID NO: 1571173 - RNA, 17 nt, Pseudomonas putida KT2440
caaagcagacagcugug

SEQ ID NO: 1571174 - RNA, 22 nt, Pseudomonas putida KT2440
caaaacaaaaagcgcagcgcag

SEQ ID NO: 1571175 - RNA, 19 nt, Pseudomonas putida KT2440
caaaagaaaaagggcaucu

SEQ ID NO: 1571176 - RNA, 22 nt, Pseudomonas putida KT2440
caaacaccuugccccgcaggcc

SEQ ID NO: 1571177 - RNA, 17 nt, Pseudomonas putida KT2440
caaacagcucacuggca

SEQ ID NO: 1571178 - RNA, 20 nt, Pseudomonas putida KT2440
caaacagcaucaaugcagga

SEQ ID NO: 1571179 - RNA, 17 nt, Pseudomonas putida KT2440
caagcauagccaaacuu

SEQ ID NO: 1571180 - RNA, 16 nt, Pseudomonas putida KT2440
caagcagucccagcac

SEQ ID NO: 1571181 - RNA, 17 nt, Pseudomonas putida KT2440
caagcagucccagcacc

SEQ ID NO: 1571182 - RNA, 18 nt, Pseudomonas putida KT2440
caagcagucccagcaccg

SEQ ID NO: 1571183 - RNA, 19 nt, Pseudomonas putida KT2440
caagcagccacccuccgca

SEQ ID NO: 1571184 - RNA, 21 nt, Pseudomonas putida KT2440
caagccaaugguauugcccga

SEQ ID NO: 1571185 - RNA, 14 nt, Pseudomonas putida KT2440
caagccacgccaga

SEQ ID NO: 1571186 - RNA, 17 nt, Pseudomonas putida KT2440
caagcccauggcuggca

SEQ ID NO: 1571187 - RNA, 23 nt, Pseudomonas putida KT2440
caagcccauggcuggcagcacga

SEQ ID NO: 1571188 - RNA, 15 nt, Pseudomonas putida KT2440
caagaguuguuguuc

SEQ ID NO: 1571189 - RNA, 22 nt, Pseudomonas putida KT2440
caaggcccaguucggacaggcg

SEQ ID NO: 1571190 - RNA, 13 nt, Pseudomonas putida KT2440
caaggccaacugc

SEQ ID NO: 1571191 - RNA, 19 nt, Pseudomonas putida KT2440
caaggcauccaccugcagg

SEQ ID NO: 1571192 - RNA, 20 nt, Pseudomonas putida KT2440
caagcucagguuacgcacca

SEQ ID NO: 1571193 - RNA, 16 nt, Pseudomonas putida KT2440
caagcucaucaccagg

SEQ ID NO: 1571194 - RNA, 15 nt, Pseudomonas putida KT2440
caagcgggccaaggu

SEQ ID NO: 1571195 - RNA, 22 nt, Pseudomonas putida KT2440
caagcgggccaaggucaucggg

SEQ ID NO: 1571196 - RNA, 20 nt, Pseudomonas putida KT2440
caagcggguaaugucccgca

SEQ ID NO: 1571197 - RNA, 17 nt, Pseudomonas putida KT2440
caagcccgcucccacag

SEQ ID NO: 1571198 - RNA, 17 nt, Pseudomonas putida KT2440
caagcccgcucgccaca

SEQ ID NO: 1571199 - RNA, 13 nt, Pseudomonas putida KT2440
caagccagccucc

SEQ ID NO: 1571200 - RNA, 20 nt, Pseudomonas putida KT2440
caagccggcgcucagcgggc

SEQ ID NO: 1571201 - RNA, 18 nt, Pseudomonas putida KT2440
caagccgccgaccaggug

SEQ ID NO: 1571202 - RNA, 22 nt, Pseudomonas putida KT2440
caacggguucagguacagcagc

SEQ ID NO: 1571203 - RNA, 23 nt, Pseudomonas putida KT2440
caacggguucagguacagcagcu

SEQ ID NO: 1571204 - RNA, 22 nt, Pseudomonas putida KT2440
caacgguaacguggacagcagc

SEQ ID NO: 1571205 - RNA, 14 nt, Pseudomonas putida KT2440
caacggucgaucag

SEQ ID NO: 1571206 - RNA, 17 nt, Pseudomonas putida KT2440
caacgggcggaacuggc

SEQ ID NO: 1571207 - RNA, 13 nt, Pseudomonas putida KT2440
caacggcagcgac

SEQ ID NO: 1571208 - RNA, 16 nt, Pseudomonas putida KT2440
caacugcgccguggcc

SEQ ID NO: 1571209 - RNA, 17 nt, Pseudomonas putida KT2440
caacugcucuaccaacu

SEQ ID NO: 1571210 - RNA, 11 nt, Pseudomonas putida KT2440
caacugcagca

SEQ ID NO: 1571211 - RNA, 20 nt, Pseudomonas putida KT2440
caacuggugaaucagcccca

SEQ ID NO: 1571212 - RNA, 18 nt, Pseudomonas putida KT2440
caacuggcucaugcgcca

SEQ ID NO: 1571213 - RNA, 16 nt, Pseudomonas putida KT2440
caacugggcaauguaa

SEQ ID NO: 1571214 - RNA, 23 nt, Pseudomonas putida KT2440
caacugggcaauguaaugcgccg

SEQ ID NO: 1571215 - RNA, 15 nt, Pseudomonas putida KT2440
caacuguucaggccu

SEQ ID NO: 1571216 - RNA, 15 nt, Pseudomonas putida KT2440
caacuucgccgaggc

SEQ ID NO: 1571217 - RNA, 19 nt, Pseudomonas putida KT2440
caagaaacguaacgauugc

SEQ ID NO: 1571218 - RNA, 19 nt, Pseudomonas putida KT2440
caagaacaacacggcagag

SEQ ID NO: 1571219 - RNA, 12 nt, Pseudomonas putida KT2440
caaccacugcaa

SEQ ID NO: 1571220 - RNA, 16 nt, Pseudomonas putida KT2440
caaccacgccugcgcc

SEQ ID NO: 1571221 - RNA, 13 nt, Pseudomonas putida KT2440
caaccagccagcc

SEQ ID NO: 1571222 - RNA, 17 nt, Pseudomonas putida KT2440
caaccaguucagcgccc

SEQ ID NO: 1571223 - RNA, 23 nt, Pseudomonas putida KT2440
caacagcuggcuggugacaacgc

SEQ ID NO: 1571224 - RNA, 20 nt, Pseudomonas putida KT2440
caaagugauaacgcgccgcu

SEQ ID NO: 1571225 - RNA, 23 nt, Pseudomonas putida KT2440
caacagcgcgacgcagcagcgcg

SEQ ID NO: 1571226 - RNA, 22 nt, Pseudomonas putida KT2440
caacagcccggugaagucaccg

SEQ ID NO: 1571227 - RNA, 17 nt, Pseudomonas putida KT2440
caacagccgcggcaccc

SEQ ID NO: 1571228 - RNA, 17 nt, Pseudomonas putida KT2440
caacagcuccagcagug

SEQ ID NO: 1571229 - RNA, 23 nt, Pseudomonas putida KT2440
caacagccccaucaccagcccga

SEQ ID NO: 1571230 - RNA, 14 nt, Pseudomonas putida KT2440
caacagaccaccug

SEQ ID NO: 1571231 - RNA, 19 nt, Pseudomonas putida KT2440
caacacugucccgaucagg

SEQ ID NO: 1571232 - RNA, 15 nt, Pseudomonas putida KT2440
caacgcagccggcac

SEQ ID NO: 1571233 - RNA, 16 nt, Pseudomonas putida KT2440
caacgcaacaaccccg

SEQ ID NO: 1571234 - RNA, 16 nt, Pseudomonas putida KT2440
caaccuuugcggcaca

SEQ ID NO: 1571235 - RNA, 16 nt, Pseudomonas putida KT2440
caaccgagaucucggu

SEQ ID NO: 1571236 - RNA, 14 nt, Pseudomonas putida KT2440
caaccgaacccgcu

SEQ ID NO: 1571237 - RNA, 15 nt, Pseudomonas putida KT2440
caaccgaacccgcug

SEQ ID NO: 1571238 - RNA, 19 nt, Pseudomonas putida KT2440
caaccgaacccgcuggcga

SEQ ID NO: 1571239 - RNA, 21 nt, Pseudomonas putida KT2440
caaccgaacccgcuggcgauc

SEQ ID NO: 1571240 - RNA, 18 nt, Pseudomonas putida KT2440
caacccuugcagcgccug

SEQ ID NO: 1571241 - RNA, 21 nt, Pseudomonas putida KT2440
caacccucgaccucgaucucg

SEQ ID NO: 1571242 - RNA, 14 nt, Pseudomonas putida KT2440
caacccguggucug

SEQ ID NO: 1571243 - RNA, 17 nt, Pseudomonas putida KT2440
caacccgucagugcucg

SEQ ID NO: 1571244 - RNA, 17 nt, Pseudomonas putida KT2440
caacgccuuggccuggc

SEQ ID NO: 1571245 - RNA, 22 nt, Pseudomonas putida KT2440
caacgccucgggcgcucgcggu

SEQ ID NO: 1571246 - RNA, 16 nt, Pseudomonas putida KT2440
caacgccgccagcggc

SEQ ID NO: 1571247 - RNA, 18 nt, Pseudomonas putida KT2440
caacgccgccagcggcuc

SEQ ID NO: 1571248 - RNA, 21 nt, Pseudomonas putida KT2440
caacgcccgcaacaaccuggc

SEQ ID NO: 1571249 - RNA, 17 nt, Pseudomonas putida KT2440
caacggcaacgccagca

SEQ ID NO: 1571250 - RNA, 14 nt, Pseudomonas putida KT2440
caacgcggcccugg

SEQ ID NO: 1571251 - RNA, 15 nt, Pseudomonas putida KT2440
caacgcgcgggcaau

SEQ ID NO: 1571252 - RNA, 12 nt, Pseudomonas putida KT2440
caacgcgccgau

SEQ ID NO: 1571253 - RNA, 21 nt, Pseudomonas putida KT2440
caacgcgccgauugcugccga

SEQ ID NO: 1571254 - RNA, 21 nt, Pseudomonas putida KT2440
caccgccgcauuagcagguaa

SEQ ID NO: 1571255 - RNA, 18 nt, Pseudomonas putida KT2440
caccgccgcauucgcggg

SEQ ID NO: 1571256 - RNA, 14 nt, Pseudomonas putida KT2440
caccgccagcucca

SEQ ID NO: 1571257 - RNA, 13 nt, Pseudomonas putida KT2440
caccgccagcggc

SEQ ID NO: 1571258 - RNA, 15 nt, Pseudomonas putida KT2440
caccgccccggccag

SEQ ID NO: 1571259 - RNA, 18 nt, Pseudomonas putida KT2440
caccgccccaagcgccug

SEQ ID NO: 1571260 - RNA, 16 nt, Pseudomonas putida KT2440
caccgcgacgaccgca

SEQ ID NO: 1571261 - RNA, 23 nt, Pseudomonas putida KT2440
caccgcgaaacacagcaggccaa

SEQ ID NO: 1571262 - RNA, 19 nt, Pseudomonas putida KT2440
caccgcgaaugaacggguu

SEQ ID NO: 1571263 - RNA, 23 nt, Pseudomonas putida KT2440
caccgcgcgguuaagcgccacca

SEQ ID NO: 1571264 - RNA, 14 nt, Pseudomonas putida KT2440
caccgcgcaacgcg

SEQ ID NO: 1571265 - RNA, 15 nt, Pseudomonas putida KT2440
caccgcaaaucacug

SEQ ID NO: 1571266 - RNA, 18 nt, Pseudomonas putida KT2440
caccgcacucugcugcuc

SEQ ID NO: 1571267 - RNA, 20 nt, Pseudomonas putida KT2440
caccgcacucugcugcucug

SEQ ID NO: 1571268 - RNA, 13 nt, Pseudomonas putida KT2440
caccgcaggugca

SEQ ID NO: 1571269 - RNA, 16 nt, Pseudomonas putida KT2440
caccgcaggugcaggc

SEQ ID NO: 1571270 - RNA, 13 nt, Pseudomonas putida KT2440
caccgcauccgca

SEQ ID NO: 1571271 - RNA, 14 nt, Pseudomonas putida KT2440
caccgcauccgcac

SEQ ID NO: 1571272 - RNA, 15 nt, Pseudomonas putida KT2440
caccgcauccgcacc

SEQ ID NO: 1571273 - RNA, 21 nt, Pseudomonas putida KT2440
caccgcauugcaggccagcgu

SEQ ID NO: 1571274 - RNA, 14 nt, Pseudomonas putida KT2440
caccgccagcagcu

SEQ ID NO: 1571275 - RNA, 22 nt, Pseudomonas putida KT2440
caccgaggcgugaucacccggg

SEQ ID NO: 1571276 - RNA, 18 nt, Pseudomonas putida KT2440
caccgagccuuccgggca

SEQ ID NO: 1571277 - RNA, 18 nt, Pseudomonas putida KT2440
cacccuuggucaggauca

SEQ ID NO: 1571278 - RNA, 17 nt, Pseudomonas putida KT2440
cacccuggucacgcagu

SEQ ID NO: 1571279 - RNA, 15 nt, Pseudomonas putida KT2440
cacccuggcaugccc

SEQ ID NO: 1571280 - RNA, 19 nt, Pseudomonas putida KT2440
cacccuggcgguugaccag

SEQ ID NO: 1571281 - RNA, 21 nt, Pseudomonas putida KT2440
cacccucguaacgagccuugg

SEQ ID NO: 1571282 - RNA, 13 nt, Pseudomonas putida KT2440
cacccucacccac

SEQ ID NO: 1571283 - RNA, 14 nt, Pseudomonas putida KT2440
cacccucgacguug

SEQ ID NO: 1571284 - RNA, 15 nt, Pseudomonas putida KT2440
cacccucgcgcagca

SEQ ID NO: 1571285 - RNA, 21 nt, Pseudomonas putida KT2440
cacccucgcgcagcaucugca

SEQ ID NO: 1571286 - RNA, 14 nt, Pseudomonas putida KT2440
cacccggggcagca

SEQ ID NO: 1571287 - RNA, 20 nt, Pseudomonas putida KT2440
cacccggggcagcaucacca

SEQ ID NO: 1571288 - RNA, 16 nt, Pseudomonas putida KT2440
cacccgggcagcgggc

SEQ ID NO: 1571289 - RNA, 21 nt, Pseudomonas putida KT2440
caccccggugcagguuggagc

SEQ ID NO: 1571290 - RNA, 21 nt, Pseudomonas putida KT2440
caccccauagggccagcggcu

SEQ ID NO: 1571291 - RNA, 22 nt, Pseudomonas putida KT2440
caccccauagggccagcggcuu

SEQ ID NO: 1571292 - RNA, 17 nt, Pseudomonas putida KT2440
caccccggcagugccug

SEQ ID NO: 1571293 - RNA, 20 nt, Pseudomonas putida KT2440
caccccggcguucagccgau

SEQ ID NO: 1571294 - RNA, 15 nt, Pseudomonas putida KT2440
cacccaaccugccga

SEQ ID NO: 1571295 - RNA, 17 nt, Pseudomonas putida KT2440
cacccaaggcauccagc

SEQ ID NO: 1571296 - RNA, 15 nt, Pseudomonas putida KT2440
cacccaauagcccac

SEQ ID NO: 1571297 - RNA, 14 nt, Pseudomonas putida KT2440
caccccagccgcuc

SEQ ID NO: 1571298 - RNA, 17 nt, Pseudomonas putida KT2440
caccccaggccacuggu

SEQ ID NO: 1571299 - RNA, 12 nt, Pseudomonas putida KT2440
cacccggcugca

SEQ ID NO: 1571300 - RNA, 15 nt, Pseudomonas putida KT2440
cacccggcuggucga

SEQ ID NO: 1571301 - RNA, 14 nt, Pseudomonas putida KT2440
cacccggacccugg

SEQ ID NO: 1571302 - RNA, 18 nt, Pseudomonas putida KT2440
cacccgaguaaucgauga

SEQ ID NO: 1571303 - RNA, 12 nt, Pseudomonas putida KT2440
cacccgcagcaa

SEQ ID NO: 1571304 - RNA, 13 nt, Pseudomonas putida KT2440
caccaugcccaca

SEQ ID NO: 1571305 - RNA, 13 nt, Pseudomonas putida KT2440
caccaugaacagc

SEQ ID NO: 1571306 - RNA, 17 nt, Pseudomonas putida KT2440
caccaugaacagcacgc

SEQ ID NO: 1571307 - RNA, 13 nt, Pseudomonas putida KT2440
caccaucuugccc

SEQ ID NO: 1571308 - RNA, 19 nt, Pseudomonas putida KT2440
caccaugcucggccagcuc

SEQ ID NO: 1571309 - RNA, 19 nt, Pseudomonas putida KT2440
caccaucgaccuggcccga

SEQ ID NO: 1571310 - RNA, 15 nt, Pseudomonas putida KT2440
caccaucuccagcuc

SEQ ID NO: 1571311 - RNA, 22 nt, Pseudomonas putida KT2440
caccaucagagcgccagcaagc

SEQ ID NO: 1571312 - RNA, 15 nt, Pseudomonas putida KT2440
caccaguuccuggcg

SEQ ID NO: 1571313 - RNA, 15 nt, Pseudomonas putida KT2440
caccagggacgaacc

SEQ ID NO: 1571314 - RNA, 11 nt, Pseudomonas putida KT2440
caccagggcau

SEQ ID NO: 1571315 - RNA, 17 nt, Pseudomonas putida KT2440
caccagguuugcugccu

SEQ ID NO: 1571316 - RNA, 21 nt, Pseudomonas putida KT2440
caccaggccuucugcgcgagu

SEQ ID NO: 1571317 - RNA, 15 nt, Pseudomonas putida KT2440
caccaggcggucggc

SEQ ID NO: 1571318 - RNA, 15 nt, Pseudomonas putida KT2440
caccacguucgggca

SEQ ID NO: 1571319 - RNA, 16 nt, Pseudomonas putida KT2440
caccacguucgggcau

SEQ ID NO: 1571320 - RNA, 13 nt, Pseudomonas putida KT2440
caccacguccggc

SEQ ID NO: 1571321 - RNA, 21 nt, Pseudomonas putida KT2440
caauggccacacgcugcugcu

SEQ ID NO: 1571322 - RNA, 18 nt, Pseudomonas putida KT2440
caauggcaaucgccuggc

SEQ ID NO: 1571323 - RNA, 15 nt, Pseudomonas putida KT2440
caaugcgugggucgu

SEQ ID NO: 1571324 - RNA, 15 nt, Pseudomonas putida KT2440
caaugcucgccugcu

SEQ ID NO: 1571325 - RNA, 13 nt, Pseudomonas putida KT2440
caauuacuuggcc

SEQ ID NO: 1571326 - RNA, 16 nt, Pseudomonas putida KT2440
caauucgccggcagca

SEQ ID NO: 1571327 - RNA, 15 nt, Pseudomonas putida KT2440
caauucggccggcca

SEQ ID NO: 1571328 - RNA, 14 nt, Pseudomonas putida KT2440
caaugcacagcgcu

SEQ ID NO: 1571329 - RNA, 17 nt, Pseudomonas putida KT2440
caaugaugauguugccg

SEQ ID NO: 1571330 - RNA, 19 nt, Pseudomonas putida KT2440
caaugcgccggucgcguuc

SEQ ID NO: 1571331 - RNA, 15 nt, Pseudomonas putida KT2440
caaggucgccaggcg

SEQ ID NO: 1571332 - RNA, 16 nt, Pseudomonas putida KT2440
caaggccagugccgca

SEQ ID NO: 1571333 - RNA, 17 nt, Pseudomonas putida KT2440
caaggccgccaccucgc

SEQ ID NO: 1571334 - RNA, 17 nt, Pseudomonas putida KT2440
caagggcgcugaucaag

SEQ ID NO: 1571335 - RNA, 18 nt, Pseudomonas putida KT2440
caaggucaucgcugcggu

SEQ ID NO: 1571336 - RNA, 17 nt, Pseudomonas putida KT2440
caaggucuccagcaccg

SEQ ID NO: 1571337 - RNA, 19 nt, Pseudomonas putida KT2440
caaggugcuaccggcgcca

SEQ ID NO: 1571338 - RNA, 17 nt, Pseudomonas putida KT2440
caaggugggguugacca

SEQ ID NO: 1571339 - RNA, 12 nt, Pseudomonas putida KT2440
cacagaugccgc

SEQ ID NO: 1571340 - RNA, 23 nt, Pseudomonas putida KT2440
cacagaugccgccgcugccagca

SEQ ID NO: 1571341 - RNA, 16 nt, Pseudomonas putida KT2440
cacagauacuggcgcu

SEQ ID NO: 1571342 - RNA, 23 nt, Pseudomonas putida KT2440
cacagcacucguugaagcgguug

SEQ ID NO: 1571343 - RNA, 16 nt, Pseudomonas putida KT2440
cacagcaggccaagga

SEQ ID NO: 1571344 - RNA, 16 nt, Pseudomonas putida KT2440
cacagaaggcugcgua

SEQ ID NO: 1571345 - RNA, 21 nt, Pseudomonas putida KT2440
cacagcccaaggcuggccaga

SEQ ID NO: 1571346 - RNA, 20 nt, Pseudomonas putida KT2440
cacagccuccaguugcucca

SEQ ID NO: 1571347 - RNA, 14 nt, Pseudomonas putida KT2440
cacagcgagcagcc

SEQ ID NO: 1571348 - RNA, 22 nt, Pseudomonas putida KT2440
cacagcggccuugaccacuucg

SEQ ID NO: 1571349 - RNA, 15 nt, Pseudomonas putida KT2440
cacagcgcggaacac

SEQ ID NO: 1571350 - RNA, 16 nt, Pseudomonas putida KT2440
cacaccugccaggcca

SEQ ID NO: 1571351 - RNA, 19 nt, Pseudomonas putida KT2440
cacaccugccaggccaaac

SEQ ID NO: 1571352 - RNA, 13 nt, Pseudomonas putida KT2440
cacaccuugggcc

SEQ ID NO: 1571353 - RNA, 18 nt, Pseudomonas putida KT2440
cacaccguacugcuucau

SEQ ID NO: 1571354 - RNA, 21 nt, Pseudomonas putida KT2440
cacacauucccuguaggagcg

SEQ ID NO: 1571355 - RNA, 18 nt, Pseudomonas putida KT2440
caauuuucgaccaaggcu

SEQ ID NO: 1571356 - RNA, 16 nt, Pseudomonas putida KT2440
cacaaaccacagcggc

SEQ ID NO: 1571357 - RNA, 19 nt, Pseudomonas putida KT2440
cacaaacaccggcccccca

SEQ ID NO: 1571358 - RNA, 18 nt, Pseudomonas putida KT2440
cacaaccccugcaaggcc

SEQ ID NO: 1571359 - RNA, 20 nt, Pseudomonas putida KT2440
cacacacucuuccugccgca

SEQ ID NO: 1571360 - RNA, 13 nt, Pseudomonas putida KT2440
cacaugcugcgcc

SEQ ID NO: 1571361 - RNA, 19 nt, Pseudomonas putida KT2440
cacaugcgagccgcugcca

SEQ ID NO: 1571362 - RNA, 13 nt, Pseudomonas putida KT2440
caccaaacacgcc

SEQ ID NO: 1571363 - RNA, 15 nt, Pseudomonas putida KT2440
caccaauuugcggcc

SEQ ID NO: 1571364 - RNA, 17 nt, Pseudomonas putida KT2440
caccacaaaaccucagu

SEQ ID NO: 1571365 - RNA, 21 nt, Pseudomonas putida KT2440
caccaaugaaagugucggccg

SEQ ID NO: 1571366 - RNA, 13 nt, Pseudomonas putida KT2440
caccaauggccau

SEQ ID NO: 1571367 - RNA, 20 nt, Pseudomonas putida KT2440
caccacaaaccacagcggcc

SEQ ID NO: 1571368 - RNA, 21 nt, Pseudomonas putida KT2440
caccaccgcgaaacacagcag

SEQ ID NO: 1571369 - RNA, 15 nt, Pseudomonas putida KT2440
caccacgaagcgcgg

SEQ ID NO: 1571370 - RNA, 21 nt, Pseudomonas putida KT2440
caccacgaagcgcggcaaggu

SEQ ID NO: 1571371 - RNA, 19 nt, Pseudomonas putida KT2440
cacaucgaucaggucgaca

SEQ ID NO: 1571372 - RNA, 21 nt, Pseudomonas putida KT2440
cacaugaaggccguaggccag

SEQ ID NO: 1571373 - RNA, 16 nt, Pseudomonas putida KT2440
cacauccucugcccgc

SEQ ID NO: 1571374 - RNA, 15 nt, Pseudomonas putida KT2440
cacauccgaccccag

SEQ ID NO: 1571375 - RNA, 22 nt, Pseudomonas putida KT2440
cacaucacguuuggcagugcca

SEQ ID NO: 1571376 - RNA, 14 nt, Pseudomonas putida KT2440
cacaucaucgcccu

SEQ ID NO: 1571377 - RNA, 14 nt, Pseudomonas putida KT2440
cacauccaccgcuc

SEQ ID NO: 1571378 - RNA, 18 nt, Pseudomonas putida KT2440
cacaggaaucaccagacc

SEQ ID NO: 1571379 - RNA, 16 nt, Pseudomonas putida KT2440
cacaggcgcacacgcu

SEQ ID NO: 1571380 - RNA, 19 nt, Pseudomonas putida KT2440
cacagcucgcgcugccagg

SEQ ID NO: 1571381 - RNA, 13 nt, Pseudomonas putida KT2440
cacagcggccaca

SEQ ID NO: 1571382 - RNA, 17 nt, Pseudomonas putida KT2440
cacagcguccaguucaa

SEQ ID NO: 1571383 - RNA, 18 nt, Pseudomonas putida KT2440
cacagcugcacaucucca

SEQ ID NO: 1571384 - RNA, 22 nt, Pseudomonas putida KT2440
cacagguagguuuucggcugga

SEQ ID NO: 1571385 - RNA, 16 nt, Pseudomonas putida KT2440
cacaggcuacgcagca

SEQ ID NO: 1571386 - RNA, 11 nt, Pseudomonas putida KT2440
cacaggcgcuc

SEQ ID NO: 1571387 - RNA, 22 nt, Pseudomonas putida KT2440
cacaggcggauguucuugaccu

SEQ ID NO: 1571388 - RNA, 22 nt, Pseudomonas putida KT2440
cacaguucgaaaaccugcugac

SEQ ID NO: 1571389 - RNA, 17 nt, Pseudomonas putida KT2440
aggccuggaugcguugc

SEQ ID NO: 1571390 - RNA, 14 nt, Pseudomonas putida KT2440
aggccuggcccagu

SEQ ID NO: 1571391 - RNA, 20 nt, Pseudomonas putida KT2440
aggccucuucaggcaauggc

SEQ ID NO: 1571392 - RNA, 23 nt, Pseudomonas putida KT2440
aggccuugcucgaaugccgcugc

SEQ ID NO: 1571393 - RNA, 13 nt, Pseudomonas putida KT2440
aggccuuggccac

SEQ ID NO: 1571394 - RNA, 17 nt, Pseudomonas putida KT2440
aggccuucagcgcggca

SEQ ID NO: 1571395 - RNA, 22 nt, Pseudomonas putida KT2440
aggccuucaugguguccggcau

SEQ ID NO: 1571396 - RNA, 19 nt, Pseudomonas putida KT2440
aggccuucgccacugccac

SEQ ID NO: 1571397 - RNA, 20 nt, Pseudomonas putida KT2440
aggccuucgccacugccacu

SEQ ID NO: 1571398 - RNA, 14 nt, Pseudomonas putida KT2440
aggccuugaucgcu

SEQ ID NO: 1571399 - RNA, 16 nt, Pseudomonas putida KT2440
aggccuuucagcgccc

SEQ ID NO: 1571400 - RNA, 22 nt, Pseudomonas putida KT2440
aggccgaucaccagcaccccga

SEQ ID NO: 1571401 - RNA, 22 nt, Pseudomonas putida KT2440
aggcccuccccguuuggcagcu

SEQ ID NO: 1571402 - RNA, 16 nt, Pseudomonas putida KT2440
aggccgauggcgaugg

SEQ ID NO: 1571403 - RNA, 22 nt, Pseudomonas putida KT2440
aggcgcaucacgaaauccuggu

SEQ ID NO: 1571404 - RNA, 17 nt, Pseudomonas putida KT2440
aggcgcagggugugcug

SEQ ID NO: 1571405 - RNA, 14 nt, Pseudomonas putida KT2440
aggcgcaacucgcg

SEQ ID NO: 1571406 - RNA, 16 nt, Pseudomonas putida KT2440
aggcgcacauccacau

SEQ ID NO: 1571407 - RNA, 21 nt, Pseudomonas putida KT2440
aggcgaccuggaucgcgccuu

SEQ ID NO: 1571408 - RNA, 16 nt, Pseudomonas putida KT2440
aggcgaccgguggcgc

SEQ ID NO: 1571409 - RNA, 18 nt, Pseudomonas putida KT2440
aggcgaccgguggcgccu

SEQ ID NO: 1571410 - RNA, 19 nt, Pseudomonas putida KT2440
aggcgaccgguggcgccuu

SEQ ID NO: 1571411 - RNA, 13 nt, Pseudomonas putida KT2440
aggcgucacccgc

SEQ ID NO: 1571412 - RNA, 15 nt, Pseudomonas putida KT2440
aggcgucacccgcgc

SEQ ID NO: 1571413 - RNA, 13 nt, Pseudomonas putida KT2440
aggcguaccggca

SEQ ID NO: 1571414 - RNA, 22 nt, Pseudomonas putida KT2440
aggcucagggcagcaacgccga

SEQ ID NO: 1571415 - RNA, 18 nt, Pseudomonas putida KT2440
aggcuccaucuccagcuc

SEQ ID NO: 1571416 - RNA, 21 nt, Pseudomonas putida KT2440
aggcucgcccucgcggcggcu

SEQ ID NO: 1571417 - RNA, 21 nt, Pseudomonas putida KT2440
aggcuggccucacaucgcgca

SEQ ID NO: 1571418 - RNA, 12 nt, Pseudomonas putida KT2440
aggcuggcgcuu

SEQ ID NO: 1571419 - RNA, 22 nt, Pseudomonas putida KT2440
aggcucuugaacugggcaucca

SEQ ID NO: 1571420 - RNA, 23 nt, Pseudomonas putida KT2440
aggcucguugaugaugcgcaccg

SEQ ID NO: 1571421 - RNA, 19 nt, Pseudomonas putida KT2440
aggcucugaaugucagcgc

SEQ ID NO: 1571422 - RNA, 14 nt, Pseudomonas putida KT2440
aggcugucgaucag

SEQ ID NO: 1571423 - RNA, 22 nt, Pseudomonas putida KT2440
aggcuggcguggugcgauucgc

SEQ ID NO: 1571424 - RNA, 13 nt, Pseudomonas putida KT2440
aggcuggcggggu

SEQ ID NO: 1571425 - RNA, 17 nt, Pseudomonas putida KT2440
aggcggcucuugcagcg

SEQ ID NO: 1571426 - RNA, 23 nt, Pseudomonas putida KT2440
aggcggcugaccuguucgcgcaa

SEQ ID NO: 1571427 - RNA, 19 nt, Pseudomonas putida KT2440
aggcggccagccaacggca

SEQ ID NO: 1571428 - RNA, 14 nt, Pseudomonas putida KT2440
aggggccgcaaagc

SEQ ID NO: 1571429 - RNA, 19 nt, Pseudomonas putida KT2440
aggggcacggguacccgcg

SEQ ID NO: 1571430 - RNA, 16 nt, Pseudomonas putida KT2440
aggggaugcgcgagag

SEQ ID NO: 1571431 - RNA, 19 nt, Pseudomonas putida KT2440
aggggcggauuugcccgcu

SEQ ID NO: 1571432 - RNA, 19 nt, Pseudomonas putida KT2440
agggcugguggcggcauac

SEQ ID NO: 1571433 - RNA, 20 nt, Pseudomonas putida KT2440
agggcugguggcggcauaca

SEQ ID NO: 1571434 - RNA, 17 nt, Pseudomonas putida KT2440
agggcuuuuuccagcgc

SEQ ID NO: 1571435 - RNA, 20 nt, Pseudomonas putida KT2440
aggggacagccacaugccag

SEQ ID NO: 1571436 - RNA, 14 nt, Pseudomonas putida KT2440
agggugaggugcug

SEQ ID NO: 1571437 - RNA, 15 nt, Pseudomonas putida KT2440
agggugaugcccgca

SEQ ID NO: 1571438 - RNA, 22 nt, Pseudomonas putida KT2440
agggucuucucaggcaccagcg

SEQ ID NO: 1571439 - RNA, 21 nt, Pseudomonas putida KT2440
aggggcggguggaggugcagg

SEQ ID NO: 1571440 - RNA, 17 nt, Pseudomonas putida KT2440
agggucgggcacaggcc

SEQ ID NO: 1571441 - RNA, 19 nt, Pseudomonas putida KT2440
agggucgggcacaggccca

SEQ ID NO: 1571442 - RNA, 18 nt, Pseudomonas putida KT2440
agguauuggucaccggga

SEQ ID NO: 1571443 - RNA, 12 nt, Pseudomonas putida KT2440
agguaucgccgc

SEQ ID NO: 1571444 - RNA, 12 nt, Pseudomonas putida KT2440
agguauggccag

SEQ ID NO: 1571445 - RNA, 14 nt, Pseudomonas putida KT2440
agguccgccaaggu

SEQ ID NO: 1571446 - RNA, 17 nt, Pseudomonas putida KT2440
agguccauguugugcug

SEQ ID NO: 1571447 - RNA, 18 nt, Pseudomonas putida KT2440
agguagugaauguugacg

SEQ ID NO: 1571448 - RNA, 24 nt, Pseudomonas putida KT2440
aggguugcaucgcgcacuugccag

SEQ ID NO: 1571449 - RNA, 14 nt, Pseudomonas putida KT2440
agguaaacccgcgc

SEQ ID NO: 1571450 - RNA, 21 nt, Pseudomonas putida KT2440
agguaaagccaccggacagaa

SEQ ID NO: 1571451 - RNA, 13 nt, Pseudomonas putida KT2440
agggcugccgcgc

SEQ ID NO: 1571452 - RNA, 18 nt, Pseudomonas putida KT2440
agggcuacgaaaccguca

SEQ ID NO: 1571453 - RNA, 19 nt, Pseudomonas putida KT2440
agggcucaacgccagggca

SEQ ID NO: 1571454 - RNA, 14 nt, Pseudomonas putida KT2440
agggcgucgaacac

SEQ ID NO: 1571455 - RNA, 19 nt, Pseudomonas putida KT2440
agggcgucugcuccgcgau

SEQ ID NO: 1571456 - RNA, 21 nt, Pseudomonas putida KT2440
agggcgaugcgcacaccgcug

SEQ ID NO: 1571457 - RNA, 22 nt, Pseudomonas putida KT2440
agggcgcguguagcccgcugaa

SEQ ID NO: 1571458 - RNA, 15 nt, Pseudomonas putida KT2440
agggcgcgcuggcgc

SEQ ID NO: 1571459 - RNA, 14 nt, Pseudomonas putida KT2440
agggcggccaaggc

SEQ ID NO: 1571460 - RNA, 16 nt, Pseudomonas putida KT2440
agggcggccaaggcgu

SEQ ID NO: 1571461 - RNA, 16 nt, Pseudomonas putida KT2440
agggccuuggccuggg

SEQ ID NO: 1571462 - RNA, 14 nt, Pseudomonas putida KT2440
agggccuggcgcga

SEQ ID NO: 1571463 - RNA, 22 nt, Pseudomonas putida KT2440
agggccuccauacgcuggugca

SEQ ID NO: 1571464 - RNA, 13 nt, Pseudomonas putida KT2440
agggccgcaaagc

SEQ ID NO: 1571465 - RNA, 18 nt, Pseudomonas putida KT2440
agggccgcaaagcggccc

SEQ ID NO: 1571466 - RNA, 17 nt, Pseudomonas putida KT2440
agggcccucaacccucg

SEQ ID NO: 1571467 - RNA, 16 nt, Pseudomonas putida KT2440
agggccauggcgcgga

SEQ ID NO: 1571468 - RNA, 21 nt, Pseudomonas putida KT2440
agggccaucaucugcugaucu

SEQ ID NO: 1571469 - RNA, 19 nt, Pseudomonas putida KT2440
aggcuugcucaaggugucg

SEQ ID NO: 1571470 - RNA, 14 nt, Pseudomonas putida KT2440
aggagugucagcgu

SEQ ID NO: 1571471 - RNA, 19 nt, Pseudomonas putida KT2440
aggagcggguucacccgcg

SEQ ID NO: 1571472 - RNA, 21 nt, Pseudomonas putida KT2440
aggagcggguucacccgcgaa

SEQ ID NO: 1571473 - RNA, 19 nt, Pseudomonas putida KT2440
aggagcggguuuacccgcg

SEQ ID NO: 1571474 - RNA, 21 nt, Pseudomonas putida KT2440
aggagcggguuuacccgcgaa

SEQ ID NO: 1571475 - RNA, 23 nt, Pseudomonas putida KT2440
aggagcugauucagcacaccgcu

SEQ ID NO: 1571476 - RNA, 19 nt, Pseudomonas putida KT2440
aggagcgggcuuacccgcg

SEQ ID NO: 1571477 - RNA, 20 nt, Pseudomonas putida KT2440
aggagcgggcuuacccgcga

SEQ ID NO: 1571478 - RNA, 21 nt, Pseudomonas putida KT2440
aggagcgggcuuacccgcgaa

SEQ ID NO: 1571479 - RNA, 19 nt, Pseudomonas putida KT2440
aggagcgggucuacccgcg

SEQ ID NO: 1571480 - RNA, 21 nt, Pseudomonas putida KT2440
aggagcgggucuacccgcgaa

SEQ ID NO: 1571481 - RNA, 14 nt, Pseudomonas putida KT2440
aggaucagcggcuu

SEQ ID NO: 1571482 - RNA, 18 nt, Pseudomonas putida KT2440
aggaucgcgcagcagcuc

SEQ ID NO: 1571483 - RNA, 17 nt, Pseudomonas putida KT2440
aggaucaugugcgccac

SEQ ID NO: 1571484 - RNA, 19 nt, Pseudomonas putida KT2440
aggaucggguuuacccgcg

SEQ ID NO: 1571485 - RNA, 15 nt, Pseudomonas putida KT2440
aggaucuccucggcc

SEQ ID NO: 1571486 - RNA, 17 nt, Pseudomonas putida KT2440
aggaucuccucggccag

SEQ ID NO: 1571487 - RNA, 18 nt, Pseudomonas putida KT2440
aggcagcucaaagagcaa

SEQ ID NO: 1571488 - RNA, 15 nt, Pseudomonas putida KT2440
aggcaggccagcacg

SEQ ID NO: 1571489 - RNA, 12 nt, Pseudomonas putida KT2440
aggcagcagcuc

SEQ ID NO: 1571490 - RNA, 23 nt, Pseudomonas putida KT2440
aggcacgugauaccugggcugga

SEQ ID NO: 1571491 - RNA, 14 nt, Pseudomonas putida KT2440
aggcacgaugaccg

SEQ ID NO: 1571492 - RNA, 13 nt, Pseudomonas putida KT2440
aggcacacccgga

SEQ ID NO: 1571493 - RNA, 18 nt, Pseudomonas putida KT2440
aggcaaucagggcauccg

SEQ ID NO: 1571494 - RNA, 21 nt, Pseudomonas putida KT2440
aggcaccaacugcacccgcca

SEQ ID NO: 1571495 - RNA, 13 nt, Pseudomonas putida KT2440
aggcacaggccag

SEQ ID NO: 1571496 - RNA, 13 nt, Pseudomonas putida KT2440
aggcacaggccca

SEQ ID NO: 1571497 - RNA, 13 nt, Pseudomonas putida KT2440
aggaugccaagga

SEQ ID NO: 1571498 - RNA, 19 nt, Pseudomonas putida KT2440
aggauuuucagcgcgaaac

SEQ ID NO: 1571499 - RNA, 23 nt, Pseudomonas putida KT2440
aggcaaaacaaaaagcgcagcgc

SEQ ID NO: 1571500 - RNA, 16 nt, Pseudomonas putida KT2440
aggcaaagaagucgcc

SEQ ID NO: 1571501 - RNA, 20 nt, Pseudomonas putida KT2440
aggcaauaaaaaaccggcgc

SEQ ID NO: 1571502 - RNA, 17 nt, Pseudomonas putida KT2440
aggcccgccagagcaug

SEQ ID NO: 1571503 - RNA, 17 nt, Pseudomonas putida KT2440
aggccagcccauggcgc

SEQ ID NO: 1571504 - RNA, 18 nt, Pseudomonas putida KT2440
aggccccugcaacagggc

SEQ ID NO: 1571505 - RNA, 15 nt, Pseudomonas putida KT2440
aggccaccguugcgc

SEQ ID NO: 1571506 - RNA, 14 nt, Pseudomonas putida KT2440
aggccacgcgguac

SEQ ID NO: 1571507 - RNA, 14 nt, Pseudomonas putida KT2440
aggcaggucagcga

SEQ ID NO: 1571508 - RNA, 12 nt, Pseudomonas putida KT2440
aggcauccagcu

SEQ ID NO: 1571509 - RNA, 13 nt, Pseudomonas putida KT2440
aggcauccagcuc

SEQ ID NO: 1571510 - RNA, 12 nt, Pseudomonas putida KT2440
aggcauccacac

SEQ ID NO: 1571511 - RNA, 15 nt, Pseudomonas putida KT2440
aggcauaccgcaaca

SEQ ID NO: 1571512 - RNA, 21 nt, Pseudomonas putida KT2440
aggcauaccgcaacaccugcc

SEQ ID NO: 1571513 - RNA, 19 nt, Pseudomonas putida KT2440
agcuucagcgaccgacacg

SEQ ID NO: 1571514 - RNA, 13 nt, Pseudomonas putida KT2440
agcuucaacgcga

SEQ ID NO: 1571515 - RNA, 18 nt, Pseudomonas putida KT2440
agcuuaacgcuuggccag

SEQ ID NO: 1571516 - RNA, 19 nt, Pseudomonas putida KT2440
agcugucgcuacgcgccau

SEQ ID NO: 1571517 - RNA, 14 nt, Pseudomonas putida KT2440
agcugucggucagc

SEQ ID NO: 1571518 - RNA, 16 nt, Pseudomonas putida KT2440
agcuggugggcgauga

SEQ ID NO: 1571519 - RNA, 24 nt, Pseudomonas putida KT2440
agcuggucguugguguagucgguc

SEQ ID NO: 1571520 - RNA, 13 nt, Pseudomonas putida KT2440
agcuggcucaucu

SEQ ID NO: 1571521 - RNA, 19 nt, Pseudomonas putida KT2440
agcuggcucaucugccggc

SEQ ID NO: 1571522 - RNA, 19 nt, Pseudomonas putida KT2440
agcuggcuggugacaacgc

SEQ ID NO: 1571523 - RNA, 22 nt, Pseudomonas putida KT2440
agcuggcuacccgcucggccuu

SEQ ID NO: 1571524 - RNA, 21 nt, Pseudomonas putida KT2440
agcugggcccgcccagcuggc

SEQ ID NO: 1571525 - RNA, 15 nt, Pseudomonas putida KT2440
agcuggcaccggcgc

SEQ ID NO: 1571526 - RNA, 18 nt, Pseudomonas putida KT2440
agcuggccaucgacccgc

SEQ ID NO: 1571527 - RNA, 21 nt, Pseudomonas putida KT2440
agcuggagucguugcgcuggu

SEQ ID NO: 1571528 - RNA, 19 nt, Pseudomonas putida KT2440
agcuggaacgcuuggccag

SEQ ID NO: 1571529 - RNA, 20 nt, Pseudomonas putida KT2440
agcuggaacgcuuggccaga

SEQ ID NO: 1571530 - RNA, 19 nt, Pseudomonas putida KT2440
agcugcuuaccagcuuggc

SEQ ID NO: 1571531 - RNA, 22 nt, Pseudomonas putida KT2440
agcugcuuaccagcuuggcgcc

SEQ ID NO: 1571532 - RNA, 18 nt, Pseudomonas putida KT2440
agcugcugaccucgaccc

SEQ ID NO: 1571533 - RNA, 22 nt, Pseudomonas putida KT2440
agcgucguguucgccuguccgg

SEQ ID NO: 1571534 - RNA, 19 nt, Pseudomonas putida KT2440
aggaacgcugccuccacac

SEQ ID NO: 1571535 - RNA, 23 nt, Pseudomonas putida KT2440
aggaacaucgccgucaucaccac

SEQ ID NO: 1571536 - RNA, 14 nt, Pseudomonas putida KT2440
aggaauagccggug

SEQ ID NO: 1571537 - RNA, 14 nt, Pseudomonas putida KT2440
aggaaguacgccgg

SEQ ID NO: 1571538 - RNA, 20 nt, Pseudomonas putida KT2440
aggaagcuggccagccgcug

SEQ ID NO: 1571539 - RNA, 19 nt, Pseudomonas putida KT2440
aggaauuacgcaggcucca

SEQ ID NO: 1571540 - RNA, 19 nt, Pseudomonas putida KT2440
aggaauuucggcguugacc

SEQ ID NO: 1571541 - RNA, 23 nt, Pseudomonas putida KT2440
agcuugugcagcgacggcgaagu

SEQ ID NO: 1571542 - RNA, 14 nt, Pseudomonas putida KT2440
agcuuucaggcgca

SEQ ID NO: 1571543 - RNA, 19 nt, Pseudomonas putida KT2440
agcuugaacaacggcgcug

SEQ ID NO: 1571544 - RNA, 21 nt, Pseudomonas putida KT2440
agcuugaacaacggcgcuguc

SEQ ID NO: 1571545 - RNA, 19 nt, Pseudomonas putida KT2440
agcuugccuuccgggaaga

SEQ ID NO: 1571546 - RNA, 13 nt, Pseudomonas putida KT2440
agcuugccgauca

SEQ ID NO: 1571547 - RNA, 16 nt, Pseudomonas putida KT2440
agcuugcccagcaggu

SEQ ID NO: 1571548 - RNA, 19 nt, Pseudomonas putida KT2440
agcuucuagcaaugccagc

SEQ ID NO: 1571549 - RNA, 20 nt, Pseudomonas putida KT2440
agcuucucgcgcuuggccag

SEQ ID NO: 1571550 - RNA, 17 nt, Pseudomonas putida KT2440
agcuucccggccuggcg

SEQ ID NO: 1571551 - RNA, 20 nt, Pseudomonas putida KT2440
agcuucccggccuggcgcag

SEQ ID NO: 1571552 - RNA, 23 nt, Pseudomonas putida KT2440
auaucgcgaaacgcggcaaccug

SEQ ID NO: 1571553 - RNA, 14 nt, Pseudomonas putida KT2440
auaucucgggcuuc

SEQ ID NO: 1571554 - RNA, 22 nt, Pseudomonas putida KT2440
auagguccagcucuggucaccu

SEQ ID NO: 1571555 - RNA, 13 nt, Pseudomonas putida KT2440
auaguaaggcugg

SEQ ID NO: 1571556 - RNA, 17 nt, Pseudomonas putida KT2440
auaggcugucacgauga

SEQ ID NO: 1571557 - RNA, 23 nt, Pseudomonas putida KT2440
auaggccuuggcuucacuguuca

SEQ ID NO: 1571558 - RNA, 23 nt, Pseudomonas putida KT2440
auaggccaagguugccaccagca

SEQ ID NO: 1571559 - RNA, 14 nt, Pseudomonas putida KT2440
auagucgaaggcuu

SEQ ID NO: 1571560 - RNA, 17 nt, Pseudomonas putida KT2440
auagucgauacccaggc

SEQ ID NO: 1571561 - RNA, 16 nt, Pseudomonas putida KT2440
auagcgugcuuccacc

SEQ ID NO: 1571562 - RNA, 21 nt, Pseudomonas putida KT2440
auagacaaaaaaaucggccgc

SEQ ID NO: 1571563 - RNA, 22 nt, Pseudomonas putida KT2440
auacuuggccgacauggcgcuu

SEQ ID NO: 1571564 - RNA, 19 nt, Pseudomonas putida KT2440
auaacgccguuucagccac

SEQ ID NO: 1571565 - RNA, 22 nt, Pseudomonas putida KT2440
aguuucuugccuuccaccggga

SEQ ID NO: 1571566 - RNA, 19 nt, Pseudomonas putida KT2440
auaacguccagagggccug

SEQ ID NO: 1571567 - RNA, 22 nt, Pseudomonas putida KT2440
auaccaggcccgcuauccucga

SEQ ID NO: 1571568 - RNA, 23 nt, Pseudomonas putida KT2440
auaccguagcggucaugcagcgu

SEQ ID NO: 1571569 - RNA, 16 nt, Pseudomonas putida KT2440
auaccggugccccggu

SEQ ID NO: 1571570 - RNA, 20 nt, Pseudomonas putida KT2440
auaccguuucgaucgaggcg

SEQ ID NO: 1571571 - RNA, 18 nt, Pseudomonas putida KT2440
auacgcacacgaccuugg

SEQ ID NO: 1571572 - RNA, 21 nt, Pseudomonas putida KT2440
auacgcaccaacuggucggcc

SEQ ID NO: 1571573 - RNA, 21 nt, Pseudomonas putida KT2440
auacgcuucgaacacccgcuu

SEQ ID NO: 1571574 - RNA, 21 nt, Pseudomonas putida KT2440
aggucgcuaucggcaggcugg

SEQ ID NO: 1571575 - RNA, 14 nt, Pseudomonas putida KT2440
aggucggcaaccau

SEQ ID NO: 1571576 - RNA, 19 nt, Pseudomonas putida KT2440
aguaccuguggcagcggcu

SEQ ID NO: 1571577 - RNA, 20 nt, Pseudomonas putida KT2440
aguaccugugggagcgggcu

SEQ ID NO: 1571578 - RNA, 21 nt, Pseudomonas putida KT2440
aguacuuggcgccgcccugga

SEQ ID NO: 1571579 - RNA, 13 nt, Pseudomonas putida KT2440
aguagcuccagcc

SEQ ID NO: 1571580 - RNA, 19 nt, Pseudomonas putida KT2440
aguagaucaucagcgccag

SEQ ID NO: 1571581 - RNA, 14 nt, Pseudomonas putida KT2440
aguauuaauuugaa

SEQ ID NO: 1571582 - RNA, 20 nt, Pseudomonas putida KT2440
aguaguccccaucacgcagc

SEQ ID NO: 1571583 - RNA, 13 nt, Pseudomonas putida KT2440
agucaacacggcu

SEQ ID NO: 1571584 - RNA, 14 nt, Pseudomonas putida KT2440
agucaacacggcug

SEQ ID NO: 1571585 - RNA, 23 nt, Pseudomonas putida KT2440
agucaaccaacuccuucucgccc

SEQ ID NO: 1571586 - RNA, 13 nt, Pseudomonas putida KT2440
agucccaguugug

SEQ ID NO: 1571587 - RNA, 14 nt, Pseudomonas putida KT2440
aguccccaccggca

SEQ ID NO: 1571588 - RNA, 15 nt, Pseudomonas putida KT2440
aguccccaccggcac

SEQ ID NO: 1571589 - RNA, 15 nt, Pseudomonas putida KT2440
agucagccagccggc

SEQ ID NO: 1571590 - RNA, 16 nt, Pseudomonas putida KT2440
aguccaucugcuucug

SEQ ID NO: 1571591 - RNA, 17 nt, Pseudomonas putida KT2440
agucgccgauacccgca

SEQ ID NO: 1571592 - RNA, 15 nt, Pseudomonas putida KT2440
aguccugcagcggca

SEQ ID NO: 1571593 - RNA, 19 nt, Pseudomonas putida KT2440
aguccuccaacucgcgcau

SEQ ID NO: 1571594 - RNA, 21 nt, Pseudomonas putida KT2440
agucgcucaggcggcgcaggu

SEQ ID NO: 1571595 - RNA, 14 nt, Pseudomonas putida KT2440
agugaacaggcgua

SEQ ID NO: 1571596 - RNA, 14 nt, Pseudomonas putida KT2440
agugccgccugguu

SEQ ID NO: 1571597 - RNA, 18 nt, Pseudomonas putida KT2440
agugcaucgaagcaggcc

SEQ ID NO: 1571598 - RNA, 15 nt, Pseudomonas putida KT2440
agugauaaugggcaa

SEQ ID NO: 1571599 - RNA, 17 nt, Pseudomonas putida KT2440
agugaccgcuggcgccu

SEQ ID NO: 1571600 - RNA, 15 nt, Pseudomonas putida KT2440
agugcuucacugccg

SEQ ID NO: 1571601 - RNA, 17 nt, Pseudomonas putida KT2440
agugcuucacugccggc

SEQ ID NO: 1571602 - RNA, 18 nt, Pseudomonas putida KT2440
agugcuucacugccggca

SEQ ID NO: 1571603 - RNA, 21 nt, Pseudomonas putida KT2440
agugcugggcaugagccuggc

SEQ ID NO: 1571604 - RNA, 13 nt, Pseudomonas putida KT2440
agugcuuguggcc

SEQ ID NO: 1571605 - RNA, 18 nt, Pseudomonas putida KT2440
aguggccucgaacauggc

SEQ ID NO: 1571606 - RNA, 22 nt, Pseudomonas putida KT2440
aguggccuuguugccacccaga

SEQ ID NO: 1571607 - RNA, 18 nt, Pseudomonas putida KT2440
aguggcacuggcgcgaug

SEQ ID NO: 1571608 - RNA, 18 nt, Pseudomonas putida KT2440
aguggauauccagcgagg

SEQ ID NO: 1571609 - RNA, 19 nt, Pseudomonas putida KT2440
agugcgcaugcccgcgcaa

SEQ ID NO: 1571610 - RNA, 13 nt, Pseudomonas putida KT2440
agugccucgacca

SEQ ID NO: 1571611 - RNA, 15 nt, Pseudomonas putida KT2440
agugccucgaccacc

SEQ ID NO: 1571612 - RNA, 22 nt, Pseudomonas putida KT2440
agugccgugcauaagcgacacc

SEQ ID NO: 1571613 - RNA, 19 nt, Pseudomonas putida KT2440
aguucacccacacccgcgc

SEQ ID NO: 1571614 - RNA, 16 nt, Pseudomonas putida KT2440
aguucacgcaggucgg

SEQ ID NO: 1571615 - RNA, 20 nt, Pseudomonas putida KT2440
aguucgcgcaccaucggcuc

SEQ ID NO: 1571616 - RNA, 19 nt, Pseudomonas putida KT2440
aguggcccgaugaucaggc

SEQ ID NO: 1571617 - RNA, 16 nt, Pseudomonas putida KT2440
aguggcuagccucauc

SEQ ID NO: 1571618 - RNA, 17 nt, Pseudomonas putida KT2440
acugcugaugcgggacc

SEQ ID NO: 1571619 - RNA, 12 nt, Pseudomonas putida KT2440
acugcuggcgcg

SEQ ID NO: 1571620 - RNA, 20 nt, Pseudomonas putida KT2440
acugcuguaaucggcgcuga

SEQ ID NO: 1571621 - RNA, 15 nt, Pseudomonas putida KT2440
acugcuguggaacag

SEQ ID NO: 1571622 - RNA, 20 nt, Pseudomonas putida KT2440
acugcucgucaaaccggcac

SEQ ID NO: 1571623 - RNA, 13 nt, Pseudomonas putida KT2440
acugcucgcuggc

SEQ ID NO: 1571624 - RNA, 21 nt, Pseudomonas putida KT2440
acugcuucaucugcgccugug

SEQ ID NO: 1571625 - RNA, 23 nt, Pseudomonas putida KT2440
acugcuuuaucuccaagccgcuu

SEQ ID NO: 1571626 - RNA, 13 nt, Pseudomonas putida KT2440
agaacacuggcag

SEQ ID NO: 1571627 - RNA, 20 nt, Pseudomonas putida KT2440
agaacagcgaagccagcacg

SEQ ID NO: 1571628 - RNA, 22 nt, Pseudomonas putida KT2440
agaacagcgucaugcgguacag

SEQ ID NO: 1571629 - RNA, 16 nt, Pseudomonas putida KT2440
agaacaccugcagcgc

SEQ ID NO: 1571630 - RNA, 12 nt, Pseudomonas putida KT2440
agaacaugccac

SEQ ID NO: 1571631 - RNA, 23 nt, Pseudomonas putida KT2440
agaaauggcuuccggcgcuggua

SEQ ID NO: 1571632 - RNA, 23 nt, Pseudomonas putida KT2440
agaaccguuucaguacagccguu

SEQ ID NO: 1571633 - RNA, 14 nt, Pseudomonas putida KT2440
agaagccaccgcga

SEQ ID NO: 1571634 - RNA, 12 nt, Pseudomonas putida KT2440
agaacuggcgca

SEQ ID NO: 1571635 - RNA, 14 nt, Pseudomonas putida KT2440
agaaggacucggcg

SEQ ID NO: 1571636 - RNA, 13 nt, Pseudomonas putida KT2440
agaaggcauccag

SEQ ID NO: 1571637 - RNA, 15 nt, Pseudomonas putida KT2440
agacaacuggccagg

SEQ ID NO: 1571638 - RNA, 14 nt, Pseudomonas putida KT2440
agagaagcugcagc

SEQ ID NO: 1571639 - RNA, 23 nt, Pseudomonas putida KT2440
agacuuucccacauguaaugaaa

SEQ ID NO: 1571640 - RNA, 19 nt, Pseudomonas putida KT2440
agagcccggcgcagccguu

SEQ ID NO: 1571641 - RNA, 20 nt, Pseudomonas putida KT2440
agagccggugccauccaccg

SEQ ID NO: 1571642 - RNA, 22 nt, Pseudomonas putida KT2440
agacuucauaggcuggcgucuc

SEQ ID NO: 1571643 - RNA, 15 nt, Pseudomonas putida KT2440
agagcggcuucuacc

SEQ ID NO: 1571644 - RNA, 12 nt, Pseudomonas putida KT2440
agagcgccagca

SEQ ID NO: 1571645 - RNA, 13 nt, Pseudomonas putida KT2440
agaccugcguugc

SEQ ID NO: 1571646 - RNA, 18 nt, Pseudomonas putida KT2440
agaccgccgcccagguca

SEQ ID NO: 1571647 - RNA, 15 nt, Pseudomonas putida KT2440
agacccgcuucgccg

SEQ ID NO: 1571648 - RNA, 20 nt, Pseudomonas putida KT2440
agaccuucuggcagccgccc

SEQ ID NO: 1571649 - RNA, 19 nt, Pseudomonas putida KT2440
agaccuugcgcacggccuc

SEQ ID NO: 1571650 - RNA, 17 nt, Pseudomonas putida KT2440
agaccuugccagcgcug

SEQ ID NO: 1571651 - RNA, 13 nt, Pseudomonas putida KT2440
agcagcugccgga

SEQ ID NO: 1571652 - RNA, 16 nt, Pseudomonas putida KT2440
agcagcuucagccagg

SEQ ID NO: 1571653 - RNA, 21 nt, Pseudomonas putida KT2440
agcagcuugcgcgccuugcgc

SEQ ID NO: 1571654 - RNA, 13 nt, Pseudomonas putida KT2440
agcaggagcugaa

SEQ ID NO: 1571655 - RNA, 22 nt, Pseudomonas putida KT2440
agcaggauggugacugccagca

SEQ ID NO: 1571656 - RNA, 23 nt, Pseudomonas putida KT2440
agcaggaucugcugcagcauggc

SEQ ID NO: 1571657 - RNA, 13 nt, Pseudomonas putida KT2440
agcaggccaaugc

SEQ ID NO: 1571658 - RNA, 22 nt, Pseudomonas putida KT2440
agcaggccauauugcugagcca

SEQ ID NO: 1571659 - RNA, 19 nt, Pseudomonas putida KT2440
agcagcucccgagccagga

SEQ ID NO: 1571660 - RNA, 11 nt, Pseudomonas putida KT2440
agcagcgggca

SEQ ID NO: 1571661 - RNA, 22 nt, Pseudomonas putida KT2440
agcagcacaucccgucagccga

SEQ ID NO: 1571662 - RNA, 14 nt, Pseudomonas putida KT2440
agcagacaacgcgg

SEQ ID NO: 1571663 - RNA, 16 nt, Pseudomonas putida KT2440
agcagcgccugcagcg

SEQ ID NO: 1571664 - RNA, 23 nt, Pseudomonas putida KT2440
agcagcgaagggcucaacgccag

SEQ ID NO: 1571665 - RNA, 20 nt, Pseudomonas putida KT2440
agcagcgacacugacaacac

SEQ ID NO: 1571666 - RNA, 15 nt, Pseudomonas putida KT2440
agcagccucggccuc

SEQ ID NO: 1571667 - RNA, 21 nt, Pseudomonas putida KT2440
agcaucgaccugccacugcgc

SEQ ID NO: 1571668 - RNA, 21 nt, Pseudomonas putida KT2440
agcauguaagcuucagcgacc

SEQ ID NO: 1571669 - RNA, 22 nt, Pseudomonas putida KT2440
agccacauugauaguagccgcc

SEQ ID NO: 1571670 - RNA, 22 nt, Pseudomonas putida KT2440
agcaggucaugcaggucaucga

SEQ ID NO: 1571671 - RNA, 17 nt, Pseudomonas putida KT2440
agcagguaaacccgcgc

SEQ ID NO: 1571672 - RNA, 24 nt, Pseudomonas putida KT2440
agcagguaaccgcugccauagcgc

SEQ ID NO: 1571673 - RNA, 15 nt, Pseudomonas putida KT2440
agcaggggcuggacu

SEQ ID NO: 1571674 - RNA, 19 nt, Pseudomonas putida KT2440
agcaggucggcgucagcgu

SEQ ID NO: 1571675 - RNA, 15 nt, Pseudomonas putida KT2440
agcagugccagcaac

SEQ ID NO: 1571676 - RNA, 16 nt, Pseudomonas putida KT2440
agcaguucgucgagca

SEQ ID NO: 1571677 - RNA, 20 nt, Pseudomonas putida KT2440
agcaguggcaagccgagcau

SEQ ID NO: 1571678 - RNA, 23 nt, Pseudomonas putida KT2440
agcaguggugcucagcggcaccu

SEQ ID NO: 1571679 - RNA, 14 nt, Pseudomonas putida KT2440
agcaccggcagguu

SEQ ID NO: 1571680 - RNA, 15 nt, Pseudomonas putida KT2440
agcaccggcaguaca

SEQ ID NO: 1571681 - RNA, 13 nt, Pseudomonas putida KT2440
agcaccggccagg

SEQ ID NO: 1571682 - RNA, 14 nt, Pseudomonas putida KT2440
agcaccggccaggc

SEQ ID NO: 1571683 - RNA, 20 nt, Pseudomonas putida KT2440
agcaccgcuucacccucgcg

SEQ ID NO: 1571684 - RNA, 17 nt, Pseudomonas putida KT2440
agcaccgcgacgaccgc

SEQ ID NO: 1571685 - RNA, 22 nt, Pseudomonas putida KT2440
agcaccacggcggcgaucagcg

SEQ ID NO: 1571686 - RNA, 21 nt, Pseudomonas putida KT2440
agcaccugcagguacagcagc

SEQ ID NO: 1571687 - RNA, 16 nt, Pseudomonas putida KT2440
agcaccugacgcaagc

SEQ ID NO: 1571688 - RNA, 14 nt, Pseudomonas putida KT2440
agcaccgggcgggu

SEQ ID NO: 1571689 - RNA, 21 nt, Pseudomonas putida KT2440
agcaccgguaccgcucugcgc

SEQ ID NO: 1571690 - RNA, 17 nt, Pseudomonas putida KT2440
agcacgauggcggucga

SEQ ID NO: 1571691 - RNA, 19 nt, Pseudomonas putida KT2440
agcacgauggcggucgaac

SEQ ID NO: 1571692 - RNA, 15 nt, Pseudomonas putida KT2440
agcacgaugacgaac

SEQ ID NO: 1571693 - RNA, 14 nt, Pseudomonas putida KT2440
agcacgcaggccag

SEQ ID NO: 1571694 - RNA, 14 nt, Pseudomonas putida KT2440
agcaccuggcggcc

SEQ ID NO: 1571695 - RNA, 22 nt, Pseudomonas putida KT2440
agcacgaaacugcgcugguaca

SEQ ID NO: 1571696 - RNA, 12 nt, Pseudomonas putida KT2440
agcacgaacagc

SEQ ID NO: 1571697 - RNA, 14 nt, Pseudomonas putida KT2440
agcacgaucagcgc

SEQ ID NO: 1571698 - RNA, 17 nt, Pseudomonas putida KT2440
agcacgaucagcgcggc

SEQ ID NO: 1571699 - RNA, 13 nt, Pseudomonas putida KT2440
agcacggaaucac

SEQ ID NO: 1571700 - RNA, 15 nt, Pseudomonas putida KT2440
agaucaucagcgcca

SEQ ID NO: 1571701 - RNA, 19 nt, Pseudomonas putida KT2440
agaucaucaucggcaugca

SEQ ID NO: 1571702 - RNA, 19 nt, Pseudomonas putida KT2440
agaucauuaccugcaggcg

SEQ ID NO: 1571703 - RNA, 13 nt, Pseudomonas putida KT2440
agaucauggcggu

SEQ ID NO: 1571704 - RNA, 23 nt, Pseudomonas putida KT2440
agcaaaaguuggcugaccggcac

SEQ ID NO: 1571705 - RNA, 12 nt, Pseudomonas putida KT2440
agauuggccagc

SEQ ID NO: 1571706 - RNA, 14 nt, Pseudomonas putida KT2440
agauuggccagcag

SEQ ID NO: 1571707 - RNA, 13 nt, Pseudomonas putida KT2440
agcacaaggcugu

SEQ ID NO: 1571708 - RNA, 21 nt, Pseudomonas putida KT2440
agcacaaggcuguuccacagc

SEQ ID NO: 1571709 - RNA, 15 nt, Pseudomonas putida KT2440
agcacaagggccagg

SEQ ID NO: 1571710 - RNA, 17 nt, Pseudomonas putida KT2440
agcacaagggccagguc

SEQ ID NO: 1571711 - RNA, 15 nt, Pseudomonas putida KT2440
agcacauucagcagc

SEQ ID NO: 1571712 - RNA, 17 nt, Pseudomonas putida KT2440
agcacauucagcagcgc

SEQ ID NO: 1571713 - RNA, 20 nt, Pseudomonas putida KT2440
agcaaagguuugucgcccgc

SEQ ID NO: 1571714 - RNA, 17 nt, Pseudomonas putida KT2440
agcaaagucuucagcca
